United States Patent 9,220,755 (MODIFIED POLYNUCLEOTIDES FOR THE PRODUCTION OF PROTEINS ASSOCIATED WITH BLOOD AND LYMPHATIC DISORDERS) - sequence listing, part 89

SEQ ID NO: 174163 - DNA, 7098 bp, Artificial Sequence
  Description of Artificial Sequence: Synthetic coding sequence
atggaggaggtgcctggagatgccctgtgtgagcactttgaggccaacatcctgacccagaaccgctgccagaactgcttccaccctgaggaggcccatggagcccgctaccaggagctgcggagccccagcggggctgaggtgccctactgtgacctgccccgctgccccccagcccctgaggaccccctgagcgccagcaccagcggctgccagagcgtggtggaccccggcctgcggcccggccccaagaggggccccagccccagcgctggcctgcctgaggagggccccacagctgcccccaggagccgcagccgggagctggaggccgtgccctacctggagggcctgaccaccagcctgtgtggcagctgcaatgaagaccccggcagtgaccccaccagcagcccagacagcgccaccccagatgacaccagcaacagcagctctgtggactgggacacagtggagcggcaggaggaggaggcccccagctgggatgagctggccgtgatgatcccccggcggccccgggagggccccagggctgacagcagccagagggcccccagcctgctgaccaggagccctgtgggcggagatgctgctggccagaagaaggaggacacaggaggcggcggccgctctgctggccagcactgggcccggctgcggggggagagcggcctgagcctggagcggcacaggagcaccctgacccaggccagctccatgaccccccacagcggccccaggagcaccaccagccaggccagccctgcccagagggacacagcccaggccgccagcacccgggagatcccccgggccagcagcccccaccgcatcacccagagggacaccagccgggccagcagcacccagcaggagatcagccgggccagcagcacccagcaggagaccagccgggccagcagcacccaggaggacaccccccgggccagcagcacccaggaggacaccccccgggccagcagcacccagtggaacaccccccgggccagcagccccagccgcagcacccagctggacaaccccaggaccagcagcacccagcaggacaacccccagaccagcttccccacctgcaccccccagcgggagaaccccaggaccccctgtgtgcagcaggatgacccccgggccagcagccccaacagaaccacccagcgggagaacagcaggaccagctgtgcccagagggacaaccccaaggccagcaggaccagcagccccaacagagccacccgggacaaccccaggaccagctgtgcccagagggacaacccccgggccagcagccccagccgggccacccgggacaaccccaccaccagctgtgcccagagggacaacccccgggccagcaggaccagcagccccaacagagccacccgggacaaccccaggaccagctgtgcccagagggacaacccccgggccagcagccccagccgggccacccgggacaaccccaccaccagctgtgcccagagggacaacccccgggccagcaggaccagcagccccaacagagccacccgggacaaccccaggaccagctgtgcccagagggacaacccccgggccagcagccccaacagagctgcccgggacaaccccaccaccagctgtgcccagagggacaacccccgggccagcaggaccagcagccccaacagagccacccgggacaaccccaggaccagctgtgcccagagggacaacccccgggccagcagccccaacagagccacccgggacaaccccaccaccagctgtgcccagagggacaacccccgggccagcaggaccagcagccccaacagagccacccgggacaaccccaggaccagctgtgcccagagggacaacccccgggccagcagccccaacagaaccacccagcaggacagccccaggaccagctgtgccaggagagatgacccccgggccagcagccccaacagaaccatccagcaggagaaccccaggaccagctgtgccctgcgggacaacccccgggccagcagccccagcaggaccatccagcaggagaaccccaggaccagctgtgcccagagagatgacccccgggccagcagccccaacagaaccacccagcaggagaaccccaggaccagctgtgcccggcgggacaacccccgggccagcagcaggaacagaaccatccagagggacaaccccaggaccagctgtgcccagagggacaacccccgggccagcagccccaacagaaccatccagcaggagaacctgcggaccagctgcacccggcaggacaaccccaggaccagcagccccaacagagccacccgggacaaccccaggaccagctgtgcccagagggacaacctgcgggccagcagccccatccgggccacccagcaggacaaccccaggacctgcatccagcagaacatccccaggagcagcagcacccagcaggacaaccccaagaccagctgcaccaagagggacaacctgcggcccacctgcacccagagggacaggacccagagcttctccttccagagggacaaccctggcaccagcagcagccagtgctgcacccagaaggagaacctgcggcccagcagcccccacaggagcacccagtggaacaaccccaggaacagcagcccccacaggaccaacaaggacatcccctgggccagcttccccctgcggcccacccagagtgatggccccaggaccagcagccccagccgcagcaagcagagcgaggtgccctgggccagcatcgccctgcggcccacccagggcgaccggccccagaccagcagccccagcaggcctgcccagcacgaccccccccagagcagctttggccccacccagtacaacctgcccagccgggccaccagcagcagccacaaccctggccaccagagcaccagcaggaccagcagccctgtgtacccagctgcctacggggcccccctgaccagccctgagcccagccagcccccctgtgctgtgtgcatcggccacagagatgccccccgggccagcagccccccacgctacctgcagcacgaccccttccccttcttccctgagccccgggcccctgagagcgagcccccccaccacgagcccccctacatccccccagctgtgtgcatcggccacagagatgccccccgggccagcagcccccccaggcacacccagtttgaccccttccccttcctgcctgacaccagtgatgctgagcaccagtgccagagcccccagcacgagcccctgcagctgcctgcccctgtgtgcatcggctacagagatgccccccgggccagcagccccccccggcaggcccctgagcccagcctgctcttccaggacctgccccgggccagcacagagagcctggtgcccagcatggacagcctgcacgagtgcccccacatccccacccctgtgtgcatcggccacagagatgcccccagcttcagcagccccccccggcaggcccctgagcccagcctcttcttccaggaccccccaggcacctccatggagagcctggcccccagcacagacagcctgcacggcagccctgtgctgatcccccaggtgtgcatcggccacagagatgccccccgggccagcagccccccaagacaccccccaagtgacctggccttcctggcccccagccccagccctggcagcagcggcggcagccggggcagcgcccctcctggagagaccaggcacaacctggagcgggaggagtacacagtgctggccgacctgcccccaccccggcggctggcccagaggcagcccggcccccaggcccagtgcagcagcggcggccgcacccacagccctggccgggcagaggtggagcggctgtttggccaggagaggaggaagtctgaggccgccggggccttccaggcccaggatgagggccgcagccagcagcccagccagggccagagccagctgctgcggcggcagagcagccctgcccccagccggcaggtgaccatgctgcctgccaagcaggccgagctgaccaggaggagccaggccgagcccccccacccctggagccctgagaagaggcctgagggggaccggcagctgcagggcagccccctgccccccaggaccagcgcccggaccccagagcgggagctgcggacccagaggcccctggagagcggccaggccggcccccggcagcccctgggcgtgtggcagagccaggaggagcccccaggcagccagggcccccaccgccacctggagaggtcctggagcagccaggagggcggcctgggccctgggggctggtggggctgtggggagcccagcctgggcgccgccaaggcccctgagggcgcctggggcggcaccagccgggagtacaaggagagctggggccagcctgaggcctgggaggagaagcccacccatgagctgccccgggagctgggcaagaggagccccctgaccagccccccagagaactggggcggccctgctgagagcagccagagctggcacagcggcacccccacagctgtgggctggggcgctgagggcgcctgcccctacccccggggcagcgagaggaggcctgagctggactggagggacctgctgggcctgctgcgggcccctggagagggcgtgtgggcccgggtgcccagcctggactgggagggcctgctggagctgctgcaggcccggctgcccaggaaggaccctgctggccacagagatgacctggcccgggccctgggccctgagctgggccccccaggcaccaatgatgtgcctgagcaggagagccacagccagcctgagggctgggccgaggccacccctgtgaatggccacagccctgccctgcagagccagagccctgtgcagctgcccagccctgcctgcaccagcacccagtggcccaagatcaaggtgacccggggccctgccacagccaccctggccggcctggagcagacaggccccctgggcagccgcagcacagccaagggccccagcctgcctgagctgcagttccagcctgaggagcctgaggagagcgagcccagccggggccaggaccccctgacagaccagaagcaggccgacagcgctgacaagaggcctgctgagggcaaggccggcagccccctgaagggccgcctggtgacctcctggaggatgcctggggaccggcccaccctcttcaaccccttcctgctgagcctgggcgtgctgcgctggaggaggccagacctgctgaacttcaagaagggctggatgagcatcctggatgagcctggagagccccccagccccagcctgaccaccaccagcaccagccagtggaagaagcactggtttgtgctgacagacagcagcctgaagtactacagagacagcacagctgaggaggctgatgagctggatggagaaattgacctgcggagctgcacagatgtgacagaatatgctgtgcagaggaactacggcttccagatccacaccaaggatgctgtgtacaccctgagcgccatgaccagcggcatcagaagaaactggattgaggccctgaggaagacagtgcggcccaccagcgccccagatgtgaccaagctgagtgacagcaacaaggaaaatgccctgcacagctacagcacccagaagggccccctgaaggccggggagcagagagctggcagcgaggtgatcagcagaggaggccccaggaaggcagatggccagaggcaggccctggactatgtggagctgagccccctgacccaggccagcccccagagggcccggaccccagcccggaccccagaccggctggccaagcaggaggagctggagcgggacctggcccagaggtctgaggagaggaggaagtggtttgaggccacagacagcaggaccccagaggtgcctgctggggagggcccccggcggggcctgggcgcccccctgacagaggaccagcagaaccggctgtctgaggagattgagaagaagtggcaggagctggagaagctgcccctgcgggagaacaagagggtgcccctgacagccctgctgaaccagagcagaggagagcggcggggccccccatctgatggccacgaggccctggagaaggaggtgcaggccctgcgggcccagctggaggcctggaggctgcagggcgaggccccccagagcgccctgcggagccaggaggatggccacatccccccaggctacatcagccaggaggcctgtgagaggagcctggccgagatggagagcagccaccagcaggtgatggaggagctgcagaggcaccacgagcgggagctgcagaggctgcagcaggagaaggagtggctgctggccgaggagacagctgccacagccagcgccatcgaggccatgaagaaggcctaccaggaggagctgagccgggagctgagcaagaccaggagcctgcagcagggcccagatggcctgaggaagcagcaccagagtgatgtggaggccctgaagcgggagctgcaggtgctgtctgagcagtacagccagaagtgcctggagatcggggccctgatgaggcaggccgaggagcgggagcacaccctgcggcgctgccagcaggagggccaggagctgctgcggcacaaccaggagctgcacggccgcctgtctgaggagattgaccagctgcggggcttcatcgccagccagggcatgggaaatggctgcggccgcagcaatgaaagaagcagctgtgagctggaggtgctgctgcgggtgaaggaaaatgagctgcagtacctgaagaaggaggtgcagtgcctgagagatgagctgcagatgatgcagaaggacaagcgcttcaccagcggcaagtaccaggatgtgtatgtggagctgagccacatcaagaccaggtctgagcgggagattgagcagctgaaggagcacctgcggctggccatggccgccctgcaggagaaggagagcatgaggaacagcctggccgagtag

SEQ ID NO: 174164 - DNA, 1296 bp, Artificial Sequence
  Description of Artificial Sequence: Synthetic coding sequence
atgggcggctggaagggccctggccagaggcggggcaaggagggccctgaggcccggcggcgggctgctgagcggggcggcggcggcggcggcggcggcgtgcctgcccccaggagccctgcccgggagccccggcccaggagctgcctgctgctgcccccaccctggggcgccgccatgaccccagacctgctgaacttcaagaagggctggatgagcatcctggatgagcccggggagccccccagccccagcctgaccaccaccagcaccagccagtggaagaagcactggtttgtgctgacagacagcagcctgaagtactacagagacagcacagctgaggaggctgatgagctggatggagaaattgacctgcggagctgcacagatgtgacagaatatgctgtgcagagaaattatggcttccagatccacaccaaggatgctgtgtacaccctgagcgccatgaccagcggcatcagaagaaactggattgaggccctgaggaagacagtgcggcccaccagcgccccagatgtgaccaagctgagtgacagcaacaaggaaaatgccctgcacagctacagcacccagaagggccccctgaaggccggggagcagagagctggcagcgaggtgatcagccggggcggccccaggaaggcagatggccagaggcaggccctggactatgtggagctgagccccctgacccaggccagcccccagagggcccggaccccagcccggaccccagaccggctggccaagcaggaggagctggagcgggacctggcccagaggtctgaggagaggaggaagtggtttgaggccacagacagcaggaccccagaggtgcctgctggggagggcccccggcggggcctgggcgcccccctgacagaggaccagcagaaccggctgtctgaggagattgagaagaagtggcaggagctggagaagctgcccctgcgggagaacaagagggtgcccctgacagccctgctgaaccagagcagaggagagcggcggggccccccatctgatggccacgaggccctggagaaggaggtgcaggccctgcgggcccagctggaggcctggaggctgcagggcgaggccccccagagcgccctgcggagccaggaggatggccacatccccccaggctacatcagccagctggtgggcgtcatcaccgtgcctgtgctgcagacccggcccctgagcagcgagcggctgtgtgacctgcccaaggtgaccccacctgctggcctgaagggcggcatctag

SEQ ID NO: 174165 - DNA, 5070 bp, Artificial Sequence
  Description of Artificial Sequence: Synthetic coding sequence
atggaggaggtgcctggagatgccctgtgtgagcactttgaggccaacatcctgacccagaaccgctgccagaactgcttccaccctgaggaggcccatggagcccgctaccaggagctgcggagccccagcggggctgaggtgccctactgtgacctgccccgctgccccccagcccctgaggaccccctgagcgccagcaccagcggctgccagagcgtggtggaccccggcctgcggcccggccccaagaggggccccagccccagcgctggcctgcctgaggagggccccacagctgcccccaggagccgcagccgggagctggaggccgtgccctacctggagggcctgaccaccagcctgtgtggcagctgcaatgaagaccccggcagtgaccccaccagcagcccagacagcgccaccccagatgacaccagcaacagcagctctgtggactgggacacagtggagcggcaggaggaggaggcccccagctgggatgagctggccgtgatgatcccccggcggccccgggagggccccagggctgacagcagccagagggcccccagcctgctgaccaggagccctgtgggcggagatgctgctggccagaagaaggaggacacaggaggcggcggccgctctgctggccagcactgggcccggctgcggggggagagcggcctgagcctggagcggcacaggagcaccctgacccaggccagctccatgaccccccacagcggccccaggagcaccaccagccaggccagccctgcccagagggacacagcccaggccgccagcacccgggagatcccccgggccagcagcccccaccgcatcacccagagggacaccagccgggccagcagcacccagcaggagatcagccgggccagcagcacccagcaggagaccagccgggccagcagcacccaggaggacaccccccgggccagcagcacccaggaggacaccccccgggccagcagcacccagtggaacaccccccgggccagcagccccagccgcagcacccagctggacaaccccaggaccagcagcacccagcaggacaacccccagaccagcttccccacctgcaccccccagcgggagaaccccaggaccccctgtgtgcagcaggatgacccccgggccagcagccccaacagaaccacccagcgggagaacagcaggaccagctgtgcccagagggacaaccccaaggccagcaggaccagcagccccaacagagccacccgggacaaccccaggaccagctgtgcccagagggacaacccccgggccagcagccccagccgggccacccgggacaaccccaccaccagctgtgcccagagggacaacccccgggccagcaggaccagcagccccaacagagccacccgggacaaccccaggaccagctgtgcccagagggacaacccccgggccagcagccccagccgggccacccgggacaaccccaccaccagctgtgcccagagggacaacccccgggccagcaggaccagcagccccaacagagccacccgggacaaccccaggaccagctgtgcccagagggacaacccccgggccagcagccccaacagagctgcccgggacaaccccaccaccagctgtgcccagagggacaacccccgggccagcaggaccagcagccccaacagagccacccgggacaaccccaggaccagctgtgcccagagggacaacccccgggccagcagccccaacagagccacccgggacaaccccaccaccagctgtgcccagagggacaacccccgggccagcaggaccagcagccccaacagagccacccgggacaaccccaggaccagctgtgcccagagggacaacccccgggccagcagccccaacagaaccacccagcaggacagccccaggaccagctgtgccaggagagatgacccccgggccagcagccccaacagaaccatccagcaggagaaccccaggaccagctgtgccctgcgggacaacccccgggccagcagccccagcaggaccatccagcaggagaaccccaggaccagctgtgcccagagagatgacccccgggccagcagccccaacagaaccacccagcaggagaaccccaggaccagctgtgcccggcgggacaacccccgggccagcagcaggaacagaaccatccagagggacaaccccaggaccagctgtgcccagagggacaacccccgggccagcagccccaacagaaccatccagcaggagaacctgcggaccagctgcacccggcaggacaaccccaggaccagcagccccaacagagccacccgggacaaccccaggaccagctgtgcccagagggacaacctgcgggccagcagccccatccgggccacccagcaggacaaccccaggacctgcatccagcagaacatccccaggagcagcagcacccagcaggacaaccccaagaccagctgcaccaagagggacaacctgcggcccacctgcacccagagggacaggacccagagcttctccttccagagggacaaccctggcaccagcagcagccagtgctgcacccagaaggagaacctgcggcccagcagcccccacaggagcacccagtggaacaaccccaggaacagcagcccccacaggaccaacaaggacatcccctgggccagcttccccctgcggcccacccagagtgatggccccaggaccagcagccccagccgcagcaagcagagcgaggtgccctgggccagcatcgccctgcggcccacccagggcgaccggccccagaccagcagccccagcaggcctgcccagcacgaccccccccagagcagctttggccccacccagtacaacctgcccagccgggccaccagcagcagccacaaccctggccaccagagcaccagcaggaccagcagccctgtgtacccagctgcctacggggcccccctgaccagccctgagcccagccagcccccctgtgctgtgtgcatcggccacagagatgccccccgggccagcagccccccacgctacctgcagcacgaccccttccccttcttccctgagccccgggcccctgagagcgagcccccccaccacgagcccccctacatccccccagctgtgtgcatcggccacagagatgccccccgggccagcagcccccccaggcacacccagtttgaccccttccccttcctgcctgacaccagtgatgctgagcaccagtgccagagcccccagcacgagcccctgcagctgcctgcccctgtgtgcatcggctacagagatgccccccgggccagcagccccccccggcaggcccctgagcccagcctgctcttccaggacctgccccgggccagcacagagagcctggtgcccagcatggacagcctgcacgagtgcccccacatccccacccctgtgtgcatcggccacagagatgcccccagcttcagcagccccccccggcaggcccctgagcccagcctcttcttccaggaccccccaggcacctccatggagagcctggcccccagcacagacagcctgcacggcagccctgtgctgatcccccaggtgtgcatcggccacagagatgccccccgggccagcagccccccaagacaccccccaagtgacctggccttcctggcccccagccccagccctggcagcagcggcggcagccggggcagcgcccctcctggagagaccaggcacaacctggagcgggaggagtacacagtgctggccgacctgcccccaccccggcggctggcccagaggcagcccggcccccaggcccagtgcagcagcggcggccgcacccacagccctggccgggcagaggtggagcggctgtttggccaggagaggaggaccatgctgcctgccaagcaggccgagctgacccggcgcagccaggccgagcccccccacccctggagccctgagaagaggcctgagggggaccggcagctgcagggcagccccctgccccccaggaccagcgcccggaccccagagcgggagctgcggacccagaggcccctggagagcggccaggccggcccccggcagcccctgggcgtgtggcagagccaggaggagcccccaggcagccagggcccccaccgccacctggagaggtcctggagcagccaggagggcggcctgggccctgggggctggtggggctgtggggagcccagcctgggcgccgccaaggcccctgagggcgcctggggcggcaccagccgggagtacaaggagagctggggccagcctgaggcctgggaggagaagcccacccatgagctgccccgggagctgggcaagaggagccccctgaccagccccccagagaactggggcggccctgctgagagcagccagagctggcacagcggcacccccacagctgtgggctggggcgctgagggcgcctgcccctacccccggggcagcgagcggcggcctgagctggactggagggacctgctgggcctgctgcgggcccctggagaaggagtgtgggcccgggtgcccagcctggactgggagggcctgctggagctgctgcaggcccggctgcccaggaaggaccctgctggccacagagatgacctggcccgggccctgggccctgagctgggccccccaggcaccaatgatgtgcctgagcaggagagccacagccagcctgagggctgggccgaggccacccctgtgaatggccacagccctgccctgcagagccagagccctgtgcagctgcccagccctgcctgcaccagcacccagtggcccaagatcaaggtgacccggggccctgccacagccaccctggccggcctggagcagacaggccccctgggcagccgcagcacagccaagggccccagcctgcctgagctgcagttccagcctgaggagcctgaggagagcgagcccagccggggccaggaccccctgacagaccagaagcaggccgacagctag

SEQ ID NO: 174166 - DNA, 771 bp, Artificial Sequence
  Description of Artificial Sequence: Synthetic coding sequence
atgagcatcctggatgagcctggagagccccccagccccagcctgaccaccaccagcaccagccagtggaagaagcactggtttgtgctgacagacagcagcctgaagtactacagagacagcacagctgaggaggctgatgagctggatggagaaattgacctgcggagctgcacagatgtgacagaatatgctgtgcagaggaactacggcttccagatccacaccaaggatgctgtgtacaccctgagcgccatgaccagcggcatcagaagaaactggattgaggccctgaggaagacagtgcggcccaccagcgccccagatgtgaccaagctgagtgacagcaacaaggaaaatgccctgcacagctacagcacccagaagggccccctgaaggccggggagcagagagctggcagcgaggtgatcagcagaggaggccccaggaaggcagatggccagaggcaggccctggactatgtggagctgagccccctgacccaggccagcccccagagggcccggaccccagcccggaccccagaccggctggccaagcaggaggagctggagcgggacctggcccagaggtctgaggagaggaggaagtggtttgaggccacagacagcaggaccccagaggtgcctgctggggagggcccccggcggggcctgggcgcccccctgacagaggaccagcagaaccggctgtctgaggagattgagaagaagtggcaggagctggagaagctgcccctgcgggagtag

SEQ ID NO: 174167 - DNA, 252 bp, Artificial Sequence
  Description of Artificial Sequence: Synthetic coding sequence
atgagcatcctggatgagcctggagagccccccagccccagcctgaccaccaccagcaccagccagtggaagaagcactggtttgtgctgacagacagcagcctgaagtactacagagacagcacagctgaggaggctgatgagctggatggagaaattgacctgcggagctgcacagatgtgacagaatatgctgtgcagaggaactacggcttccagatccacaccaaggatgctgtgtacaccctgtag

SEQ ID NO: 174168 - DNA, 2577 bp, Artificial Sequence
  Description of Artificial Sequence: Synthetic coding sequence
atggccgagctgtctgaggaggccctgctgtctgtgctgcccaccatccgggtgcccaaggccggggacagagtgcacaaggatgaatgtgccttctcctttgacaccccagagagcgagggcggcctgtacatctgcatgaacaccttcctgggctttgggaagcagtatgtggagcggcacttcaacaagacaggccagagggtgtacctgcacctgcggaggacccggcggcccaaggaggaggaccctgccaccggcaccggggacccccccaggaagaagcccacccggctggccatcggcgtggagggcggctttgacctgtctgaggagaagtttgagctggatgaagatgtgaagatcgtcatcctgcctgactacctggagatcgccagagatggcctgggcggcctgcctgacatcgtgcgggacagagtgaccagcgctgtggaggccctgctgtctgctgacagcgccagcaggaagcaggaggtgcaggcctgggatggagaggtgcggcaggtgtccaagcacgccttcagcctgaagcagctggacaacccagcccgcatccccccctgtggctggaagtgcagcaaatgtgacatgagggagaacctgtggctgaacctgacagatggcagcatcctgtgtggccgccgctactttgatggcagcggcggcaacaaccacgctgtggagcactaccgggagaccggctaccccctggccgtgaagctgggcaccatcaccccagatggagcagatgtgtacagctatgatgaagatgacatggtgctggaccccagcctggccgagcacctgagccactttggaattgacatgctgaagatgcagaagacagacaagaccatgacagagctggagattgacatgaaccagagaattggagagtgggagctgatccaggagagcggcgtgcccctgaagcccctgtttggacctggctacacaggcatccggaacctgggcaacagctgctacctgaacagcgtggtgcaggtgctcttcagcatcccagacttccagaggaaatatgtggacaagctggagaagatcttccagaatgcccccacagaccccacccaggacttcagcacccaggtggccaagctgggccacggcctgctgagcggggagtacagcaagcctgtgcctgagagcggagatggagagcgggtgcctgagcagaaggaggtgcaggacggcatcgcccccaggatgttcaaggccctgattggcaagggccaccctgagttcagcaccaaccggcagcaggatgcccaggagttcttcctgcacctgatcaacatggtggagaggaactgccgcagcagcgagaaccccaatgaggtgttccgcttcctggtggaggagaagatcaagtgcctggccacagagaaggtgaagtacacccagagggtggactacatcatgcagctgcctgtgcccatggatgctgccctgaacaaggaggagctgctggagtatgaggagaagaagaggcaggccgaggaggagaagatggccctgcctgagctggtgcgggcccaggtgcccttcagcagctgcctggaggcctacggggcccctgagcaggtggatgacttctggagcacagccctgcaggccaagtctgtggccgtgaagaccaccaggtttgccagcttcccagactacctggtgatccagatcaagaagttcaccttcggcctggactgggtgcccaagaagctggatgtgtccattgagatgcctgaggagctggacatcagccagctgcggggcaccggcctgcagcctggagaggaggagctgcctgacatcgccccacccctggtgaccccagatgagcccaagggcagcctgggcttctatggaaatgaagatgaagattccttctgcagcccccacttcagcagccccaccagccccatgctggatgagagcgtcatcatccagctggtggagatgggcttccccatggatgcctgcaggaaggctgtgtactacacaggcaacagcggggctgaggccgccatgaactgggtgatgagccacatggatgatcctgactttgccaaccccctcatcctgcccggcagcagcggccctggcagcaccagcgctgctgctgaccccccacctgaggactgtgtgaccaccatcgtgtccatgggcttcagccgggaccaggccctgaaggccctgcgggccaccaacaacagcctggagagagctgtggactggatcttcagccacattgatgacctggatgctgaggccgccatggacatcagcgagggccgctctgctgctgacagcatcagcgagagcgtgcctgtgggccccaaggtgagagatggccctgggaagtaccagctgtttgccttcatcagccacatgggcaccagcaccatgtgtggccactacgtgtgccacatcaagaaggagggccgctgggtgatctacaatgaccagaaggtgtgtgccagcgagaagccacccaaggacctgggctacatctacttctaccagagggtggccagctag

SEQ ID NO: 174169 - DNA, 750 bp, Artificial Sequence
  Description of Artificial Sequence: Synthetic coding sequence
atggcccccagcaggaagttctttgtgggcggcaactggaagatgaatggaaggaagcagagcctgggggagctgattggcaccctgaatgctgccaaggtgcctgctgacacagaggtggtgtgtgccccacccacagcctacatcgactttgcccggcagaagctggaccccaagattgctgtggccgcccagaactgctacaaggtgaccaacggggccttcaccggggagatcagccctggcatgatcaaggactgtggggccacctgggtggtgctgggccacagcgagaggagacatgtgtttggagagagtgatgagctgattggccagaaggtggcccacgccctggccgagggcctgggcgtgattgcctgcatcggggagaagctggatgagcgggaggccggcatcacagagaaggtggtgtttgagcagaccaaggtgattgctgacaacgtgaaggactggagcaaggtggtgctggcctatgagcctgtgtgggccatcggcaccgggaagacagccaccccccagcaggcccaggaggtgcatgagaagctgcggggctggctgaagagcaatgtgtctgatgctgtggcccagagcacccgcatcatctatggaggctctgtgactggagccacctgcaaggagctggccagccagccagatgtggatggcttcctggtgggcggggccagcctgaagccagagtttgtggacatcatcaatgccaagcagtag

SEQ ID NO: 174170 - DNA, 504 bp, Artificial Sequence
  Description of Artificial Sequence: Synthetic coding sequence
atgatcaaggactgtggggccacctgggtggtgctgggccacagcgagaggagacatgtgtttggagagagtgatgagctgattggccagaaggtggcccacgccctggccgagggcctgggcgtgattgcctgcatcggggagaagctggatgagcgggaggccggcatcacagagaaggtggtgtttgagcagaccaaggtgattgctgacaacgtgaaggactggagcaaggtggtgctggcctatgagcctgtgtgggccatcggcaccgggaagacagccaccccccagcaggcccaggaggtgcatgagaagctgcggggctggctgaagagcaatgtgtctgatgctgtggcccagagcacccgcatcatctatggaggctctgtgactggagccacctgcaaggagctggccagccagccagatgtggatggcttcctggtgggcggggccagcctgaagccagagtttgtggacatcatcaatgccaagcagtag

SEQ ID NO: 174171 - DNA, 1233 bp, Artificial Sequence
  Description of Artificial Sequence: Synthetic coding sequence
atggatgtgatggagctgctggaggaggacctgacctgccccatctgctgcagcctgtttgatgacccccgggtgctgccctgcagccacaacttctgcaagaagtgcctggagggcatcctggagggctctgtgaggaacagcctgtggaggcctgcccccttcaagtgccccacctgcaggaaggagaccagcgccaccggcatcaacagcctgcaggtgaactacagcctgaagggcatcgtggagaagtacaacaagatcaagatcagccccaagatgcctgtgtgcaagggccacctgggccagcccctgaacatcttctgcctgacagacatgcagctgatctgtggcatctgtgccaccagaggagagcacaccaagcacgtgttctgcagcattgaagatgcctatgcccaggagagagatgcctttgagagcctcttccagagctttgagacctggaggagaggagatgccctgagccggctggacaccctggagaccagcaagaggaagagcctgcagctgctgaccaaggacagcgacaaggtgaaggagttctttgagaagctgcagcacaccctggaccagaagaagaatgagatcctgagtgactttgagaccatgaagctggccgtgatgcaggcctatgaccctgagatcaacaagctgaacaccatcctgcaggagcagaggatggccttcaacattgctgaggccttcaaggatgtgtctgagcccatcgtgttcctgcagcagatgcaggagttccgggagaagatcaaggtgatcaaggagacccccctgccccccagcaacctgcctgccagccccctgatgaagaactttgacaccagccagtgggaggacatcaagctggtggatgtggacaagctgagcctgccccaggacaccggcaccttcatcagcaagatcccctggagcttctacaagctgttcctgctgatcctgctgctgggcctggtgattgtgtttggccccaccatgttcctggagtggagcctgtttgatgacctggccacctggaagggctgcctgagcaacttcagcagctacctgaccaagacagctgacttcatcgagcagagcgtcttctactgggagcaggtgacagatggcttcttcatcttcaatgaacgcttcaagaacttcaccctggtggtgctgaacaacgtggccgagtttgtgtgcaagtacaagctgctgtag

SEQ ID NO: 174172 - DNA, 1233 bp, Artificial Sequence; identical to SEQ ID NO: 174171
  Description of Artificial Sequence: Synthetic coding sequence

SEQ ID NO: 174173 - DNA, 1224 bp, Artificial Sequence
  Description of Artificial Sequence: Synthetic coding sequence
atggagctgctggaggaggacctgacctgccccatctgctgcagcctgtttgatgacccccgggtgctgccctgcagccacaacttctgcaagaagtgcctggagggcatcctggagggctctgtgaggaacagcctgtggaggcctgcccccttcaagtgccccacctgcaggaaggagaccagcgccaccggcatcaacagcctgcaggtgaactacagcctgaagggcatcgtggagaagtacaacaagatcaagatcagccccaagatgcctgtgtgcaagggccacctgggccagcccctgaacatcttctgcctgacagacatgcagctgatctgtggcatctgtgccaccagaggagagcacaccaagcacgtgttctgcagcattgaagatgcctatgcccaggagagagatgcctttgagagcctcttccagagctttgagacctggaggagaggagatgccctgagccggctggacaccctggagaccagcaagaggaagagcctgcagctgctgaccaaggacagcgacaaggtgaaggagttctttgagaagctgcagcacaccctggaccagaagaagaatgagatcctgagtgactttgagaccatgaagctggccgtgatgcaggcctatgaccctgagatcaacaagctgaacaccatcctgcaggagcagaggatggccttcaacattgctgaggccttcaaggatgtgtctgagcccatcgtgttcctgcagcagatgcaggagttccgggagaagatcaaggtgatcaaggagacccccctgccccccagcaacctgcctgccagccccctgatgaagaactttgacaccagccagtgggaggacatcaagctggtggatgtggacaagctgagcctgccccaggacaccggcaccttcatcagcaagatcccctggagcttctacaagctgttcctgctgatcctgctgctgggcctggtgattgtgtttggccccaccatgttcctggagtggagcctgtttgatgacctggccacctggaagggctgcctgagcaacttcagcagctacctgaccaagacagctgacttcatcgagcagagcgtcttctactgggagcaggtgacagatggcttcttcatcttcaatgaacgcttcaagaacttcaccctggtggtgctgaacaacgtggccgagtttgtgtgcaagtacaagctgctgtag

SEQ ID NO: 174174 - DNA, 801 bp, Artificial Sequence
  Description of Artificial Sequence: Synthetic coding sequence
atggagctgctggaggaggacctgacctgccccatctgctgcagcctgtttgatgacccccgggtgctgccctgcagccacaacttctgcaagaagtgcctggagggcatcctggagggctctgtgaggaacagcctgtggaggcctgcccccttcaagtgccccacctgcaggaaggagaccagcgccaccggcatcaacagcctgcaggtgaactacagcctgaagggcatcgtggagaagtacaacaagatcaagatcagccccaagatgcctgtgtgcaagggccacctgggccagcccctgaacatcttctgcctgacagacatgcagctgatctgtggcatctgtgccaccagaggagagcacaccaagcacgtgttctgcagcattgaagatgcctatgcccaggagagagatgcctttgagagcctcttccagagctttgagacctggaggagaggagatgccctgagccggctggacaccctggagaccagcaagaggaagagcctgcagctgctgaccaaggacagcgacaaggtgaaggagttctttgagaagctgcagcacaccctggaccagaagaagaatgagatcctgagtgactttgagaccatgaagctggccgtgatgcaggcctatgaccctgagatcaacaagctgaacaccatcctgcaggagcagaggatggccttcaacattgctgaggccttcaaggatgtgtctgagcccatcgtgttcctgcagcagatgcaggagttccgggagaagatcaaggtgatcaaggagaccccctag

SEQ ID NO: 174175 - DNA, 1224 bp, Artificial Sequence; identical to SEQ ID NO: 174173
  Description of Artificial Sequence: Synthetic coding sequence

SEQ ID NO: 174176 - DNA, 390 bp, Artificial Sequence
  Description of Artificial Sequence: Synthetic coding sequence
atggagctgctggaggaggacctgacctgccccatctgctgcagcctgtttgatgacccccgggtgctgccctgcagccacaacttctgcaagaagtgcctggagggcatcctggagggctctgtgaggaacagcctgtggaggcctgcccccttcaagtgccccacctgcaggaaggagaccagcgccaccggcatcaacagcctgcaggtgaactacagcctgaagggcatcgtggagaagtacaacaagatcaagatcagccccaagatgcctgtgtgcaagggccacctgggccagcccctgaacatcttctgcctgacagacatgcagctgatctgtggcatctgtgccaccagaggagagcacaccaagcacgtgttctgctag

SEQ ID NO: 174177 - DNA, 1224 bp, Artificial Sequence; identical to SEQ ID NO: 174173
  Description of Artificial Sequence: Synthetic coding sequence

SEQ ID NO: 174178 - DNA, 669 bp, Artificial Sequence
  Description of Artificial Sequence: Synthetic coding sequence
atgaatgacctgagcaacagagtgtggagcatcagccaggagccagaccctgtgcagaggctgcaggcctacacagccacagagcaggagatgcagcagcagatgagcctgggggagctgtgccaccctgtgcccctgagctttgagcctgtgaagagcttcttcaagggcctggtggaggccgtggagagcaccctgcagacccccctggacatccggctgaaggagagcatcaactgccagctgagtgaccccagcagcaccaagccaggcaccctgctgaagaccagccccagccctgagaggagcctgctgctgaagagctgctgggccgcctggggcccctgcccctgctgcggcagcaccaggtctgggaagtgctggctggtgacagccagccccccagctgccaccaccggccgcctgacctgcagaagaagagccccagctgggggctgggcccggcccaccccaccatttggagctgctggccccaggcctcctccagcctgggccgccacagccagccctggggccagcagcgccaccaccctgagcacaggccccagcaccacagccagcgctgctgcctgtggccctgccaccaccagcactggaagtgccagctcctggaccaccaggcctgccagcagccccagcaccacctag

SEQ ID NO: 174179 - DNA, 1329 bp, Artificial Sequence
  Description of Artificial Sequence: Synthetic coding sequence
atggccggggccgccaccggcagcaggaccccaggccgctctgagctggtggagggctgcggctggcgctgcccagagcacggggacagagtggccgagctgttctgccgccgctgccgccgctgtgtgtgtgccctgtgccctgtgctgggcgcccaccggggccaccctgtgggcctggccctggaggccgctgtgcacgtgcagaagctgagccaggagtgcctgaagcagctggccatcaagaagcagcagcacatcgacaacatcacccagattgaagatgccacagagaagctgaaggccaatgctgagagcagcaagacctggctgaagggcaagttcacagagctgcggctgctgctggatgaggaggaggccctggccaagaagttcatcgacaagaacacccagctgaccctgcaggtgtaccgggagcaggccgacagctgccgggagcagctggacatcatgaatgacctgagcaacagagtgtggagcatcagccaggagccagaccctgtgcagaggctgcaggcctacacagccacagagcaggagatgcagcagcagatgagcctgggggagctgtgccaccctgtgcccctgagctttgagcctgtgaagagcttcttcaagggcctggtggaggccgtggagagcaccctgcagacccccctggacatccggctgaaggagagcatcaactgccagctgagtgaccccagcagcaccaagccaggcaccctgctgaagaccagccccagccctgagaggagcctgctgctgaagtatgcccggacccccaccctggaccctgacaccatgcacgcccggctgcggctgtctgctgaccggctgactgtgcgctgtggcctgctgggcagcctgggccctgtgcctgtgctgcgctttgatgccctgtggcaggtgctggcccgggactgctttgccaccggccgccactactgggaggtggatgtgcaggaggccggggccggctggtgggtgggcgccgcctatgccagcctgcggcggcggggggccagcgctgctgcccggctgggctgcaaccggcagagctggtgcctgaagagatatgacctggagtactgggccttccatgatggccagaggagccggctgcggcccagagatgacctggaccggctgggcgtcttcctggactatgaagctggggtgctggccttctatgatgtgactggaggcatgagccacctgcacaccttccgggccaccttccaggagcccctgtacccagccctgcggctgtgggagggcgccatcagcatcccccggctgccctag

SEQ ID NO: 174180 - DNA, 1329 bp, Artificial Sequence; identical to SEQ ID NO: 174179
  Description of Artificial Sequence: Synthetic coding sequence

SEQ ID NO: 174181 - DNA, 1221 bp, Artificial Sequence
  Description of Artificial Sequence: Synthetic coding sequence
atggccggggccgccaccggcagcaggaccccaggccgctctgagctggtggagggctgcggctggcgctgcccagagcacggggacagagtggccgagctgttctgccgccgctgccgccgctgtgtgtgtgccctgtgccctgtgctgggcgcccaccggggccaccctgtgggcctggccctggaggccgctgtgcacgtgcagaagctgagccaggagtgcctgaagcagctggccatcaagaagcagcagcacatcgacaacatcacccagattgaagatgccacagagaagctgaaggccaatgctgagagcagcaagacctggctgaagggcaagttcacagagctgcggctgctgctggatgaggaggaggccctggccaagaagttcatcgacaagaacacccagctgaccctgcaggtgtaccgggagcaggccgacagctgccgggagcagctggacatcatgaatgacctgagcaacagagtgtggagcatcagccaggagccagaccctgtgcagaggctgcaggcctacacagccacagagcaggagatgcagcagcagatgagcctgggggagctgtgccaccctgtgcccctgagctttgagcctgtgaagagcttcttcaagggcctggtggaggccgtggagagcaccctgcagacccccctggacatccggctgaaggagagcatcaactgccagctgagtgaccccagcagcaccaagccaggcaccctgctgaagaccagccccagccctgagaggagcctgctgctgaagtatgcccggacccccaccctggaccctgacaccatgcacgcccggctgcggctgtctgctgaccggctgactgtgcgctgtggcctgctgggcagcctgggccctgtgcctgtgctgcgctttgatgccctgtggcaggtgctggcccgggactgctttgccaccggccgccactactgggaggtggatgtgcaggaggccggggccggctggtgggtgggcgccgcctatgccagcctgcggcggcggggggccagcgctgctgcccggctgggctgcaaccggcagagctggtgcctgaagagatatgacctggagtactgggccttccatgatggccagaggtctgcctgtggccctgccaccaccagcactggaagtgccagctcctggaccaccaggcctgccagcagccccagcaccacctag

SEQ ID NO: 174182 - DNA, 762 bp, Artificial Sequence
  Description of Artificial Sequence: Synthetic coding sequence
atggccggggccgccaccggcagcaggaccccaggccgctctgagctggtggagggctgcggctggcgctgcccagagcacggggacagagtggccgagctgttctgccgccgctgccgccgctgtgtgtgtgccctgtgccctgtgctgggcgcccaccggggccaccctgtgggcctggccctggaggccgctgtgcacgtgcagaagctgagccaggagtgcctgaagcagctggccatcaagaagcagcagcacatcgacaacatcacccagattgaagatgccacagagaagctgaaggccaatgctgagagcagcaagacctggctgaagggcaagttcacagagctgcggctgctgctggatgaggaggaggccctggccaagaagttcatcgacaagaacacccagctgaccctgcaggtgtaccgggagcaggccgacagctgccgggagcagctggacatcatgaatgacctgagcaacagagtgtggagcatcagccaggagccagaccctgtgcagaggctgcaggcctacacagccacagagcaggagatgcagcagcagatgagcctgggggagctgtgccaccctgtgcccctgagctttgagcctgtgaagagcttcttcaagggcctggtggaggccgtggagagcaccctgcagacccccctggacatccggctgagccccaccaaccacgcctacagcgccctgaaggtgagcagcccccggctggtgagcaaccggccctag

SEQ ID NO: 174183 - DNA, 1329 bp, Artificial Sequence; identical to SEQ ID NO: 174179
  Description of Artificial Sequence: Synthetic coding sequence

SEQ ID NO: 174184 - DNA, 672 bp, Artificial Sequence
  Description of Artificial Sequence: Synthetic coding sequence
atgtctgctggcagtgatggcggcggccgccacttctgtggcggcatcaactgccagctgagtgaccccagcagcaccaagccaggcaccctgctgaagaccagccccagccctgagaggagcctgctgctgaagtatgcccggacccccaccctggaccctgacaccatgcacgcccggctgcggctgtctgctgaccggctgactgtgcgctgtggcctgctgggcagcctgggccctgtgcctgtgctgcgctttgatgccctgtggcaggtgctggcccgggactgctttgccaccggccgccactactgggaggtggatgtgcaggaggccggggccggctggtgggtgggcgccgcctatgccagcctgcggaggagaggagccagcgctgctgcccggctgggctgcaaccggcagagctggtgcctgaagagatatgacctggagtactgggccttccatgatggccagaggagccggctgcggcccagagatgacctggaccggctgggcgtcttcctggactatgaggccggcgtgctggccttctatgatgtgactggaggcatgagccacctgcacaccttccgggccaccttccaggagcccctgtacccagccctgcggctgtgggagggcgccatcagcatcccccggctgccctag

SEQ ID NO: 174185 - DNA, 2316 bp, Artificial Sequence
  Description of Artificial Sequence: Synthetic coding sequence
atgcacaggagcggccgctatggcacccagcagcagagagctggcagcaagacagctggccccccctgccagtggagcaggatggccagcgagggcaccaacatccccagccctgtggtgcggcagattgacaagcagttcctgatctgcagcatctgcctggagcgctacaagaaccccaaggtgctgccctgcctgcacaccttctgtgagcgctgcctgcagaactacatcccagcccacagcctgaccctgagctgccctgtgtgccggcagaccagcatcctgcctgagaagggcgtggccgccctgcagaacaacttcttcatcaccaacctgatggatgtgctgcagaggaccccaggcagcaatgctgaggagagcagcatcctggagaccgtgacagctgtggccgccggcaagcccctgagctgccccaaccatgatggaaatgtgatggagttctactgccagagctgtgaaacagccatgtgcagagaatgtacagaaggagaacatgctgagcaccccaccgtgcccctgaaggatgtggtggagcagcacaaggccagcctgcaggtgcagctggatgctgtgaacaagaggctgcctgagattgacagcgccctgcagttcatcagcgagatcatccaccagctgaccaaccagaaggccagcatcgtggatgacatccacagcacctttgatgagctgcagaagaccctgaatgtgaggaagtctgtgctgctgatggagctggaggtgaactacggcctgaagcacaaggtgctgcagagccagctggacaccctgctgcagggccaggagagcatcaagagctgcagcaacttcaccgcccaggccctgaaccacggcacagaaacagaggtgctgctggtgaagaagcagatgtctgagaagctgaatgagctggccgaccaggacttccccctgcacccccgggagaatgaccagctggacttcatcgtggagacagagggcctgaagaagagcatccacaacctgggcaccatcctgaccaccaatgctgtggccagcgagaccgtggccaccggggagggcctgcggcagaccatcatcggccagcccatgtctgtgaccatcaccaccaaggacaaggatggagagctgtgcaagacaggaaatgcctacctgacagctgagctgagcaccccagatggctctgtggctgatggagagatcctggacaacaagaatggcacctatgagttcctgtacacagtgcagaaggagggggacttcaccctgagcctgcggctgtatgaccagcacatccggggcagccccttcaagctgaaggtgatccgctctgcagatgtgagccccaccacagagggcgtgaagagaagagtgaagagccctggcagcggccacgtgaagcagaaggctgtgaagaggcctgcctccatgtacagcacaggcaagaggaaggagaaccccattgaagatgacctgatcttccgggtgggcaccaagggcaggaacaagggggagttcaccaacctgcagggcgtggccgccagcaccaacgggaagatcctgattgctgacagcaacaaccagtgtgtgcagatcttcagcaatgatggccagttcaagagccgcttcggcatccggggccgcagccctggccagctgcagaggcccaccggggtggccgtgcaccccagcggggacatcatcatcgctgactatgacaacaagtgggtgtccatcttcagcagtgatggcaagttcaagaccaagattggcagcggcaagctgatgggccccaagggcgtgtctgtggacagaaatggccacatcatcgtggtggacaacaaggcctgctgcgtgttcatcttccagcccaacgggaagatcgtgaccaggtttggcagcagaggaaatggagaccggcagtttgctggcccccactttgctgctgtgaacagcaacaatgagatcatcatcacagacttccacaaccacagcgtgaaggtgttcaaccaggagggggagttcatgctgaagtttggcagcaatggagagggcaatggccagttcaatgcccccaccggggtggccgtggacagcaatggaaacatcatcgtggccgactggggcaacagccgcatccaggtgtttgatggcagcggcagcttcctgagctacatcaacaccagcgctgaccccctgtatggcccccagggcctggccctgaccagtgatggccacgtggtggtggccgacagcggcaaccactgcttcaaggtgtaccgctacctgcagtag

SEQ ID NO: 174186 - DNA, 2235 bp, Artificial Sequence
  Description of Artificial Sequence: Synthetic coding sequence
atggccagcgagggcaccaacatccccagccctgtggtgcggcagattgacaagcagttcctgatctgcagcatctgcctggagcgctacaagaaccccaaggtgctgccctgcctgcacaccttctgtgagcgctgcctgcagaactacatcccagcccacagcctgaccctgagctgccctgtgtgccggcagaccagcatcctgcctgagaagggcgtggccgccctgcagaacaacttcttcatcaccaacctgatggatgtgctgcagaggaccccaggcagcaatgctgaggagagcagcatcctggagaccgtgacagctgtggccgccggcaagcccctgagctgccccaaccatgatggaaatgtgatggagttctactgccagagctgtgaaacagccatgtgccgggagtgcacagaaggagagcacgccgagcaccccaccgtgcccctgaaggatgtggtggagcagcacaaggccagcctgcaggtgcagctggatgctgtgaacaagaggctgcctgagattgattctgccctgcagttcatcagcgagatcatccaccagctgaccaaccagaaggccagcatcgtggatgacatccacagcacctttgatgagctgcagaagaccctgaatgtgaggaagtctgtgctgctgatggagctggaggtgaactacggcctgaagcacaaggtgctgcagagccagctggacaccctgctgcagggccaggagagcatcaagagctgcagcaacttcaccgcccaggccctgaaccacggcacagaaacagaggtgctgctggtgaagaagcagatgtctgagaagctgaatgagctggccgaccaggacttccccctgcaccccagagaaaatgaccagctggacttcatcgtggagacagagggcctgaagaagagcatccacaacctgggcaccatcctgaccaccaatgctgtggccagcgagaccgtggccactggagagggcctgcggcagaccatcatcggccagcccatgtctgtgaccatcaccaccaaggacaaggatggagagctgtgcaagacaggaaatgcctacctgacagctgagctgagcaccccagatggctctgtggctgatggagagatcctggacaacaagaatggcacctatgagttcctgtacacagtgcagaaggagggggacttcaccctgagcctgcggctgtatgaccagcacatccggggcagccccttcaagctgaaggtgatccgctctgcagatgtgagccccaccacagaaggagtgaagagaagagtgaagagccctggcagcggccacgtgaagcagaaggctgtgaagaggcctgcctccatgtacagcacaggcaagaggaaagaaaaccccattgaagatgacctgatcttccgggtgggcaccaagggcagaaataaaggagagttcaccaacctgcagggcgtggccgccagcaccaacgggaagatcctgattgctgacagcaacaaccagtgtgtgcagatcttcagcaatgatggccagttcaagagcagatttggcatccggggccgcagccctggccagctgcagaggcccactggagtggccgtgcaccccagcggggacatcatcatcgctgactatgacaacaagtgggtgtccatcttcagcagtgatggcaagttcaagaccaagattggcagcggcaagctgatgggccccaagggcgtgtctgtggacagaaatggccacatcatcgtggtggacaacaaggcctgctgcgtgttcatcttccagcccaacgggaagatcgtgacccgcttcggcagcagaggaaatggagaccggcagtttgctggcccccactttgctgctgtgaacagcaacaatgagatcatcatcacagacttccacaaccacagcgtgaaggtgttcaaccaggagggggagttcatgctgaagtttggcagcaatggagagggcaatggccagttcaatgcccccactggagtggccgtggacagcaatggaaacatcatcgtggccgactggggcaacagccgcatccaggtgtttgatggcagcggcagcttcctgagctacatcaacaccagcgctgaccccctgtatggcccccagggcctggccctgaccagtgatggccacgtggtggtggccgacagcggcaaccactgcttcaaggtgtaccgctacctgcagtag

SEQ ID NO: 174187 - DNA, 1428 bp, Artificial Sequence
  Description of Artificial Sequence: Synthetic coding sequence
atggccagcgctgcccggctgaccatgatgtgggaggaggtgacctgccccatctgcctggacccctttgtggagcctgtgtccattgaatgtggccacagcttctgccaggagtgcatcagccaggtgggcaaaggaggcggctctgtgtgccctgtgtgccggcagcgcttcctgctgaagaacctgcggcccaaccggcagctggccaacatggtgaacaacctgaaggagatcagccaggaggcccgggagggcacccagggcgagcgctgtgctgtgcatggagagcggctgcacctgttctgtgagaaggatggcaaggccctgtgctgggtgtgtgcccagagcaggaagcaccgggaccacgccatggtgcccctggaggaggccgcccaggagtaccaggagaagctgcaggtggccctgggggagctgcggaggaagcaggagctggccgagaagctggaggtggagatcgccatcaagagagctgactggaagaagacagtggagacccagaagagccgcatccacgccgagtttgtgcagcagaagaacttcctggtggaggaggagcagaggcagctgcaggagctggagaaggatgagcgggagcagctgcgcatcctgggggagaaggaggccaagctggcccagcagagccaggccctgcaggagctgatcagcgagctggaccggcgctgccacagcagcgccctggagctgctgcaggaggtgatcatcgtgctggagaggtctgagagctggaacctgaaggacctggacatcaccagccctgagctgcggtctgtgtgccacgtgcccggcctgaagaagatgctgcggacctgtgctgtgcacatcaccctggaccctgacacagccaacccctggctgatcctgtctgaggaccggcggcaggtgcggctgggggacacccagcagagcatccctggaaatgaggagagatttgacagctaccccatggtgctgggcgcccagcacttccacagcggcaagcactactgggaggtggatgtgacaggcaaggaggcctgggacctgggcgtgtgccgggacagcgtgcggaggaagggccacttcctgctgagcagcaagagcggcttctggaccatctggctgtggaacaagcagaagtatgaggccggcacctacccccagacccccctgcacctgcaggtgcccccctgccaggtgggcatcttcctggactatgaagctggcatggtgtccttctacaacatcacagaccacggcagcctcatctacagcttctctgaatgtgccttcaccggccccctgcggcccttcttcagccctggcttcaatgatggcggcaagaacacagcccccctgaccctgtgccccctgaacatcggcagccagggcagcacagactactag

SEQ ID NO: 174188 - DNA, 1428 bp, Artificial Sequence
  Description of Artificial Sequence: Synthetic coding sequence
atggccagcgctgcccggctgaccatgatgtgggaggaggtgacctgccccatctgcctggacccctttgtggagcctgtgtccattgaatgtggccacagcttctgccaggagtgcatcagccaggtgggcaaaggaggcggctctgtgtgccctgtgtgccggcagcgcttcctgctgaagaacctgcggcccaaccggcagctggccaacatggtgaacaacctgaaggagatcagccaggaggcccgggagggcacccagggcgagcgctgtgctgtgcatggagagcggctgcacctgttctgtgagaaggatggcaaggccctgtgctgggtgtgtgcccagagcaggaagcaccgggaccacgccatggtgcccctggaggaggccgcccaggagtaccaggagaagctgcaggtggccctgggggagctgcggaggaagcaggagctggccgagaagctggaggtggagatcgccatcaagagagctgactggaagaagacagtggagacccagaagagccgcatccacgccgagtttgtgcagcagaagaacttcctggtggaggaggagcagaggcagctgcaggagctggagaaggatgagcgggagcagctgcgcatcctgggggagaaggaggccaagctggcccagcagagccaggccctgcaggagctgatcagcgagctggaccggcgctgccacagcagcgccctggagctgctgcaggaggtgattgtgctgggccccaggtctgagagctggaacctgaaggacctggacatcaccagccctgagctgcggtctgtgtgccacgtgcccggcctgaagaagatgctgcggacctgtgctgtgcacatcaccctggaccctgacacagccaacccctggctgatcctgtctgaggaccggcggcaggtgcggctgggggacacccagcagagcatccctggaaatgaggagagatttgacagctaccccatggtgctgggcgcccagcacttccacagcggcaagcactactgggaggtggatgtgacaggcaaggaggcctgggacctgggcgtgtgccgggacagcgtgcggaggaagggccacttcctgctgagcagcaagagcggcttctggaccatctggctgtggaacaagcagaagtatgaggccggcacctacccccagacccccctgcacctgcaggtgcccccctgccaggtgggcatcttcctggactatgaagctggcatggtgtccttctacaacatcacagaccacggcagcctcatctacagcttctctgaatgtgccttcaccggccccctgcggcccttcttcagccctggcttcaatgatggcggcaagaacacagcccccctgaccctgtgccccctgaacatcggcagccagggcagcacagactactag

SEQ ID NO: 174189 - DNA, 1497 bp, Artificial Sequence
  Description of Artificial Sequence: Synthetic coding sequence
atggacttctctgtgaaggtggacatcgagaaggaggtgacctgccccatctgcctggagctgctgacagagcccctgagcctggactgtggccacagcttctgccaggcctgcatcacagccaagatcaaggagagcgtcatcatcagcagaggagagagcagctgccctgtgtgccagacccgcttccagcccggcaacctgcggcccaacagacacctggccaacatcgtggagcgggtgaaggaggtgaagatgagcccccaggagggccagaagagagatgtgtgtgagcaccacggcaagaagctgcagatcttctgcaaggaggatggcaaggtgatctgctgggtgtgtgagctgagccaggagcaccagggccaccagaccttccgcatcaatgaggtggtgaaggagtgccaggagaagctgcaggtggccctgcagaggctcatcaaggaggaccaggaggccgagaagctggaggatgacatccggcaggagaggacagcctggaagaactacatccagatcgagcggcagaagatcctgaagggcttcaatgagatgagggtcatcctggacaatgaggagcagcgggagctgcagaagctggaggagggggaggtgaatgtgctggacaacctggccgccgccacagaccagctggtgcagcagaggcaggatgccagcaccctcatcagtgacctgcagaggcggctgcggggcagctctgtggagatgctgcaggatgtgattgatgtgatgaagaggtctgagagctggaccctgaagaagcccaagtctgtgtccaagaagctgaagagcgtcttccgggtgcctgacctgagcggcatgctgcaggtgctgaaggagctgacagatgtgcagtactactgggtggatgtgatgctgaaccctggcagcgccaccagcaatgtggccatctctgtggaccagaggcaggtgaagacagtgaggacctgcaccttcaagaacagcaacccctgtgacttcagcgccttcggcgtgtttggctgccagtacttcagcagcggcaagtactactgggaggtggatgtgtctgggaagatcgcctggatcctgggcgtgcacagcaagatcagcagcctgaacaagaggaagagcagcggctttgcctttgaccccagcgtgaactacagcaaggtgtacagccgctaccggccccagtatggctactgggtgattggcctgcagaacacctgtgagtacaatgcctttgaggacagcagcagcagtgaccccaaggtgctgaccctcttcatggctgtgcccccctgcagaattggagtcttcctggactatgaagctggcatcgtgtccttcttcaacgtgaccaaccacggggccctgatctacaagttcagcggctgccgcttcagcaggcctgcctacccctacttcaacccctggaactgcctggtgcccatgacagtgtgcccccccagcagctag

SEQ ID NO: 174190 - DNA, 684 bp, Artificial Sequence
  Description of Artificial Sequence: Synthetic coding sequence
atggacttctctgtgaaggtggacatcgagaaggaggtgacctgccccatctgcctggagctgctgacagagcccctgagcctggactgtggccacagcttctgccaggcctgcatcacagccaagatcaaggagagcgtcatcatcagcagaggagagagcagctgccctgtgtgccagacccgcttccagcccggcaacctgcggcccaacagacacctggccaacatcgtggagcgggtgaaggaggtgaagatgagcccccaggagggccagaagagagatgtgtgtgagcaccacggcaagaagctgcagatcttctgcaaggaggatggcaaggtgatctgctgggtgtgtgagctgagccaggagcaccagggccaccagaccttccgcatcaatgaggtggtgaaggagtgccaggagaagctgcaggtggccctgcagaggctcatcaaggaggaccaggaggccgagaagctggaggatgacatccggcaggagaggacagcctggaagaactacatccagatcgagcggcagaagatcctgaagggcttcaatgagatgagggtcatcctggacaatgaggagcagcgggagctgcagaagctggaggagggggaggtgaatgtgctggacaacctggccgccgccacagaccagctggtgcagcagaggtag

SEQ ID NO: 174191 - DNA, 612 bp, Artificial Sequence
  Description of Artificial Sequence: Synthetic coding sequence
atggacttctctgtgaaggtggacatcgagaaggaggtgacctgccccatctgcctggagctgctgacagagcccctgagcctggactgtggccacagcttctgccaggcctgcatcacagccaagatcaaggagagcgtcatcatcagcagaggagagagcagctgccctgtgtgccagacccgcttccagcccggcaacctgcggcccaacagacacctggccaacatcgtggagcgggtgaaggaggtgaagatgagcccccaggagggccagaagagagatgtgtgtgagcaccacggcaagaagctgcagatcttctgcaaggaggatggcaaggtgatctgctgggtgtgtgagctgagccaggagcaccagggccaccagaccttccgcatcaatgaggtggtgaaggagtgccaggagaagctgcaggtggccctgcagaggctcatcaaggaggaccaggaggccgagaagctggaggatgacatccggcaggagaggacagcctggaagaactacatccagatcgagcggcagaagatcctgaagggcttcaatgagatgagggtcatcctggacaatgaggagcagcgggagctgcagtag

SEQ ID NO: 174192 - DNA, 1263 bp, Artificial Sequence
  Description of Artificial Sequence: Synthetic coding sequence
atggacttctctgtgaaggtggacatcgagaaggaggtgacctgccccatctgcctggagctgctgacagagcccctgagcctggactgtggccacagcttctgccaggcctgcatcacagccaagatcaaggagagcgtcatcatcagcagaggagagagcagctgccctgtgtgccagacccgcttccagcccggcaacctgcggcccaacagacacctggccaacatcgtggagcgggtgaaggaggtgaagatgagcccccaggagggccagaagagagatgtgtgtgagcaccacggcaagaagctgcagatcttctgcaaggaggatggcaaggtgatcctggacaatgaggagcagcgggagctgcagaagctggaggagggggaggtgaatgtgctggacaacctggccgccgccacagaccagctggtgcagcagaggcaggatgccagcaccctcatcagtgacctgcagaggcggctgcggggcagctctgtggagatgctgcaggatgtgattgatgtgatgaagaggtctgagagctggaccctgaagaagcccaagtctgtgtccaagaagctgaagagcgtcttccgggtgcctgacctgagcggcatgctgcaggtgctgaaggagctgacagatgtgcagtactactgggtggatgtgatgctgaaccctggcagcgccaccagcaatgtggccatctctgtggaccagaggcaggtgaagacagtgaggacctgcaccttcaagaacagcaacccctgtgacttcagcgccttcggcgtgtttggctgccagtacttcagcagcggcaagtactactgggaggtggatgtgtctgggaagatcgcctggatcctgggcgtgcacagcaagatcagcagcctgaacaagaggaagagcagcggctttgcctttgaccccagcgtgaactacagcaaggtgtacagccgctaccggccccagtatggctactgggtgattggcctgcagaacacctgtgagtacaatgcctttgaggacagcagcagcagtgaccccaaggtgctgaccctcttcatggctgtgcccccctgcagaattggagtcttcctggactatgaagctggcatcgtgtccttcttcaacgtgaccaaccacggggccctgatctacaagttcagcggctgccgcttcagcaggcctgcctacccctacttcaacccctggaactgcctggtgcccatgacagtgtgcccccccagcagctag

SEQ ID NO: 174193 - DNA, 930 bp, Artificial Sequence
  Description of Artificial Sequence: Synthetic coding sequence
atgagggtcatcctggacaatgaggagcagcgggagctgcagaagctggaggagggggaggtgaatgtgctggacaacctggccgccgccacagaccagctggtgcagcagaggcaggatgccagcaccctcatcagtgacctgcagaggcggctgcggggcagctctgtggagatgctgcaggatgtgattgatgtgatgaagaggtctgagagctggaccctgaagaagcccaagtctgtgtccaagaagctgaagtctgtgttccgggtgcctgacctgagcggcatgctgcaggtgctgaaggagctgacagatgtgcagtactactgggtggatgtgatgctgaaccctggcagcgccaccagcaatgtggccatctctgtggaccagaggcaggtgaagacagtgaggacctgcaccttcaagaacagcaacccctgtgacttcagcgcctttggagtgtttggctgccagtacttcagcagcggcaagtactactgggaggtggatgtgtctgggaagatcgcctggatcctgggcgtgcacagcaagatcagcagcctgaacaagaggaagagcagcggctttgcctttgaccccagcgtgaactacagcaaggtgtacagccgctaccggccccagtatggctactgggtgattggcctgcagaacacctgtgagtacaatgcctttgaggacagcagcagcagtgaccccaaggtgctgaccctcttcatggctgtgcccccctgccgcatcggggtcttcctggactatgaggccggcatcgtgtccttcttcaacgtgaccaaccacggggccctgatctacaagttcagcggctgccgcttcagcaggcctgcctacccctacttcaacccctggaactgcctggtgcccatgacagtgtgcccccccagcagctag

SEQ ID NO: 174194 - DNA, 1893 bp, Artificial Sequence
  Description of Artificial Sequence: Synthetic coding sequence
atggccgagctgtgccccctggccgaggagctgagctgcagcatctgcctggagcccttcaaggagcctgtgaccaccccctgtggccacaacttctgtggcagctgcctgaatgagacctgggccgtgcagggcagcccctacctgtgcccccagtgcagagctgtgtaccaggcccggccccagctgcacaagaacacagtgctgtgcaatgtggtggagcagttcctgcaggccgacctggcccgggagcccccagcagatgtgtggaccccaccagcccgggccagcgcccccagccccaatgcccaggtggcctgtgaccactgcctgaaggaggccgctgtgaagacctgcctggtgtgcatggccagcttctgccaggagcacctgcagccccactttgacagccctgccttccaggaccaccccctgcagccccctgtgcgggacctgctgcggaggaagtgcagccagcacaaccggctgcgggagttcttctgcccagagcacagcgagtgcatctgccacatctgcctggtggagcacaagacctgcagccctgccagcctgagccaggccagcgctgacctggaggccaccctgcggcacaagctgactgtgatgtacagccagatcaacggggccagccgggccctggatgatgtgaggaaccggcagcaggatgtgaggatgacagccaacaggaaggtggagcagctgcagcaggagtacacagagatgaaggccctgctggatgccagcgagaccaccagcaccaggaagatcaaggaggaggagaagagggtgaacagcaagtttgacaccatctaccagatcctgctgaagaagaagtctgagatccagaccctgaaggaggagattgagcagagcctgaccaagagagatgaatttgagttcctggagaaggccagcaagctgcggggcatcagcaccaagcctgtgtacatccctgaggtggagctgaaccacaagctgatcaagggcatccaccagagcaccatcgacctgaagaatgagctgaagcagtgcatcggccgcctgcaggagcccacccccagcagcggggaccctggagaacatgaccctgccagcacccacaagagcaccaggcctgtgaagaaggtgtccaaggaggagaagaagagcaagaagcccccacctgtgcctgccctgcccagcaagctgcccaccttcggggcccctgagcagctggtggacctgaagcaggccggcctggaggccgccgccaaggccaccagcagccaccccaacagcaccagcctgaaggccaaggtgctggagaccttcctggccaagagcaggcctgagctgctggagtactacatcaaggtgatcctggactacaacacagcccacaacaaggtggccctgtctgagtgctacacagtggcctctgtggccgagatgccccagaactaccggccccacccccagcgcttcacctactgcagccaggtgctgggcctgcactgctacaagaagggcatccactactgggaggtggagctgcagaagaacaacttctgtggggtgggcatctgctacggctccatgaaccggcagggccctgagagccggctgggcaggaacagcgcctcctggtgtgtggagtggttcaacaccaagatcagcgcctggcacaacaacgtggagaagaccctgcccagcaccaaggccaccagggtgggcgtgctgctgaactgtgaccacggctttgtgatcttctttgctgtggccgacaaggtgcacctgatgtacaagttccgggtggacttcacagaggccctgtacccagccttctgggtgttttctgctggggccaccctgagcatctgcagccccaagtag

SEQ ID NO: 174195 - DNA, 1893 bp, Artificial Sequence; identical to SEQ ID NO: 174194
  Description of Artificial Sequence: Synthetic coding sequence

SEQ ID NO: 174196 - DNA, 1077 bp, Artificial Sequence
  Description of Artificial Sequence: Synthetic coding sequence
atggccagcggctctgtggccgagtgcctgcagcaggagaccacctgccctgtgtgcctgcagtactttgctgagcccatgatgctggactgtggccacaacatctgctgtgcctgcctggcccgctgctggggcacagctgagaccaacgtgtcctgcccccagtgccgggagaccttcccccagaggcacatgaggcccaacagacacctggccaacgtgacccagctggtgaagcagctgaggacagagcggcccagcggccctggaggagagatgggcgtgtgtgagaagcaccgggagcccctgaagctgtactgtgaggaggaccagatgcccatctgtgtggtgtgtgacaggagccgggagcaccggggccacagcgtgctgcccctggaggaggccgtggagggcttcaaggagcagatccagaaccagctggaccacctgaagagggtgaaggacctgaagaagagaagaagagcccagggcgagcaggcccgggcagagctgctgagcctgacccagatggagcgggagaagatcgtgtgggagtttgagcagctgtaccacagcctgaaggagcacgagtaccgcctgctggcccggctggaggagctggacctggccatctacaacagcatcaacggggccatcacccagttcagctgcaacatcagccacctgagcagcctgattgcccagctggaggagaagcagcagcagcccacccgggagctgctgcaggacattggagacaccctgagcagagctgagcgcatccgcatccctgagccctggatcaccccaccagacctgcaggagaagatccacatctttgcccagaagtgcctcttcctgacagagagcctgaagcagttcacagagaagatgcagagcgacatggagaagatccaggagctgcgggaggcccagctgtacagcgtggatgtgaccctggaccctgacacagcctaccccagcctcatcctgagtgacaacctgcggcaggtgcgctacagctacctgcagcaggacctgcctgacaaccctgagaggagccccagcaccacctag

SEQ ID NO: 174197 - DNA, 1542 bp, Artificial Sequence
  Description of Artificial Sequence: Synthetic coding sequence
atggccagcggctctgtggccgagtgcctgcagcaggagaccacctgccctgtgtgcctgcagtactttgctgagcccatgatgctggactgtggccacaacatctgctgtgcctgcctggcccgctgctggggcacagctgagaccaacgtgtcctgcccccagtgccgggagaccttcccccagaggcacatgaggcccaacagacacctggccaacgtgacccagctggtgaagcagctgaggacagagcggcccagcggccctggaggagagatgggcgtgtgtgagaagcaccgggagcccctgaagctgtactgtgaggaggaccagatgcccatctgtgtggtgtgtgacaggagccgggagcaccggggccacagcgtgctgcccctggaggaggccgtggagggcttcaaggagcagatccagaaccagctggaccacctgaagagggtgaaggacctgaagaagagaagaagagcccagggcgagcaggcccgggcagagctgctgagcctgacccagatggagcgggagaagatcgtgtgggagtttgagcagctgtaccacagcctgaaggagcacgagtaccgcctgctggcccggctggaggagctggacctggccatctacaacagcatcaacggggccatcacccagttcagctgcaacatcagccacctgagcagcctgattgcccagctggaggagaagcagcagcagcccacccgggagctgctgcaggacattggagacaccctgagcagagctgagcgcatccgcatccctgagccctggatcaccccaccagacctgcaggagaagatccacatctttgcccagaagtgcctcttcctgacagagagcctgaagcagttcacagagaagatgcagagcgacatggagaagatccaggagctgcgggaggcccagctgtacagcgtggatgtgaccctggaccctgacacagcctaccccagcctcatcctgagtgacaacctgcggcaggtgcgctacagctacctgcagcaggacctgcctgacaaccctgagcgcttcaacctcttcccctgtgtgctgggcagcccctgcttcatcgccggccgccactactgggaggtggaggtgggggacaaggccaagtggaccatcggcgtgtgtgaagattctgtgtgcaggaaaggaggagtgaccagcgccccccagaatggcttctgggccgtgtccctgtggtacggcaaggagtactgggccctgaccagccccatgacagccctgcccctgcggacccccctgcagagggtgggcatcttcctggactatgatgctggggaggtgtccttctacaacgtgacagagcgctgccacaccttcaccttcagccacgccaccttctgtggccctgtgcggccctacttcagcctgagctacagcggcggcaagtctgctgcccccctcatcatctgccccatgtctggaattgatggcttcagcggccacgtgggcaaccacggccacagcatggagaccagcccctag

SEQ ID NO: 174198 - DNA, 1542 bp, Artificial Sequence; identical to SEQ ID NO: 174197
  Description of Artificial Sequence: Synthetic coding sequence

SEQ ID NO: 174199 - DNA, 1077 bp, Artificial Sequence; identical to SEQ ID NO: 174196
  Description of Artificial Sequence: Synthetic coding sequence

SEQ ID NO: 174200 - DNA, 747 bp, Artificial Sequence
  Description of Artificial Sequence: Synthetic coding sequence
tgactgaagcagttcacagagaagatgcagagcgacatggagaagatccaggagagcgctgacagcctggagggcggcatcctggacctgggctctgtgctgagccacatcctgcctgtgtctgagctgcgggaggcccagctgtacagcgtggatgtgaccctggaccctgacacagcctaccccagcctcatcctgagtgacaacctgcggcaggtgcgctacagctacctgcagcaggacctgcctgacaaccctgagcgcttcaacctcttcccctgtgtgctgggcagcccctgcttcatcgccggccgccactactgggaggtggaggtgggggacaaggccaagtggaccatcggcgtgtgtgaggacagcgtgtgcaggaagggcggcgtgaccagcgccccccagaatggcttctgggccgtgtccctgtggtacggcaaggagtactgggccctgaccagccccatgacagccctgcccctgcggacccccctgcagagggtgggcatcttcctggactatgatgctggggaggtgtccttctacaacgtgacagagcgctgccacaccttcaccttcagccacgccaccttctgtggccctgtgcggccctacttcagcctgagctacagcggcggcaagtctgctgcccccctcatcatctgccccatgagcggcattgatggcttcagcggccacgtgggcaaccacggccacagcatggagaccagcccctag

SEQ ID NO: 174201 - DNA, 1077 bp, Artificial Sequence; identical to SEQ ID NO: 174196
  Description of Artificial Sequence: Synthetic coding sequence

SEQ ID NO: 174202 - DNA, 747 bp, Artificial Sequence; identical to SEQ ID NO: 174200
  Description of Artificial Sequence: Synthetic coding sequence

SEQ ID NO: 174203 - DNA, 1077 bp, Artificial Sequence; identical to SEQ ID NO: 174196
  Description of Artificial Sequence: Synthetic coding sequence

SEQ ID NO: 174204 - DNA, 747 bp, Artificial Sequence; identical to SEQ ID NO: 174200
  Description of Artificial Sequence: Synthetic coding sequence

SEQ ID NO: 174205 - DNA, 750 bp, Artificial Sequence
  Description of Artificial Sequence: Synthetic coding sequence
atggccagcggctctgtggccgagtgcctgcagcaggagaccacctgccctgtgtgcctgcagtactttgctgagcccatgatgctggactgtggccacaacatctgctgtgcctgcctggcccgctgctggggcacagctgagaccaacgtgtcctgcccccagtgccgggagaccttcccccagaggcacatgaggcccaacagacacctggccaacgtgacccagctggtgaagcagctgaggacagagcggcccagcggccctggaggagagatgggcgtgtgtgagaagcaccgggagcccctgaagctgtactgtgaggaggaccagatgcccatctgtgtggtgtgtgacaggagccgggagcaccggggccacagcgtgctgcccctggaggaggccgtggagggcttcaaggagcagatccagaaccagctggaccacctgaagagggtgaaggacctgaagaagagaagaagagcccagggcgagcaggcccgggcagagctgctgagcctgacccagatggagcgggagaagatcgtgtgggagtttgagcagctgtaccacagcctgaaggagcacgagtaccgcctgctggcccggctggaggagctggacctggccatctacaacagcatcaacggggccatcacccagttcagctgcaacatcagccacctgagcagcctgattgcccagctggaggagaagcagcagcagcccacccgggagctgctgcagtag

SEQ ID NO: 174206 - DNA, 1542 bp, Artificial Sequence; identical to SEQ ID NO: 174197
  Description of Artificial Sequence: Synthetic coding sequence

SEQ ID NO: 174207 - DNA, 1542 bp, Artificial Sequence; identical to SEQ ID NO: 174197
  Description of Artificial Sequence: Synthetic coding sequence

SEQ ID NO: 174208 - DNA, 750 bp, Artificial Sequence; identical to SEQ ID NO: 174205
  Description of Artificial Sequence: Synthetic coding sequence

SEQ ID NO: 174209 - DNA, 1542 bp, Artificial Sequence; identical to SEQ ID NO: 174197
  Description of Artificial Sequence: Synthetic coding sequence

SEQ ID NO: 174210 - DNA, 744 bp, Artificial Sequence
  Description of Artificial Sequence: Synthetic coding sequence
ctgaagcagttcacagagaagatgcagagcgacatggagaagatccaggagagcgctgacagcctggagggcggcatcctggacctgggctctgtgctgagccacatcctgcctgtgtctgagctgcgggaggcccagctgtacagcgtggatgtgaccctggaccctgacacagcctaccccagcctcatcctgagtgacaacctgcggcaggtgcgctacagctacctgcagcaggacctgcctgacaaccctgagcgcttcaacctcttcccctgtgtgctgggcagcccctgcttcatcgccggccgccactactgggaggtggaggtgggggacaaggccaagtggaccatcggcgtgtgtgaagattctgtgtgcaggaaaggaggagtgaccagcgccccccagaatggcttctgggccgtgtccctgtggtacggcaaggagtactgggccctgaccagccccatgacagccctgcccctgcggacccccctgcagagggtgggcatcttcctggactatgatgctggggaggtgtccttctacaacgtgacagagcgctgccacaccttcaccttcagccacgccaccttctgtggccctgtgcggccctacttcagcctgagctacagcggcggcaagtctgctgcccccctcatcatctgccccatgtctggaattgatggcttcagcggccacgtgggcaaccacggccacagcatggagaccagcccctag

SEQ ID NO: 174211 - DNA, 750 bp, Artificial Sequence; identical to SEQ ID NO: 174205
  Description of Artificial Sequence: Synthetic coding sequence

SEQ ID NO: 174212 - DNA, 159 bp, Artificial Sequence
  Description of Artificial Sequence: Synthetic coding sequence
tgactgcgggaggcccagctgtacagcgtggatgtgaccctggaccctgacacagcctaccccagcctcatcctgagtgacaacctgcggcaggtgcgctacagctacctgcagcaggacctgcctgacaaccctgagaggagccccagcaccacctag

SEQ ID NO: 174213 - DNA, 696 bp, Artificial Sequence
  Description of Artificial Sequence: Synthetic coding sequence
tgaagtgctgacagcctggagggcggcatcctggacctgggctctgtgctgagccacatcctgcctgtgtctgagctgcgggaggcccagctgtacagcgtggatgtgaccctggaccctgacacagcctaccccagcctcatcctgagtgacaacctgcggcaggtgcgctacagctacctgcagcaggacctgcctgacaaccctgagcgcttcaacctcttcccctgtgtgctgggcagcccctgcttcatcgccggccgccactactgggaggtggaggtgggggacaaggccaagtggaccatcggcgtgtgtgaagattctgtgtgcaggaaaggaggagtgaccagcgccccccagaatggcttctgggccgtgtccctgtggtacggcaaggagtactgggccctgaccagccccatgacagccctgcccctgcggacccccctgcagagggtgggcatcttcctggactatgatgctggggaggtgtccttctacaacgtgacagagcgctgccacaccttcaccttcagccacgccaccttctgtggccctgtgcggccctacttcagcctgagctacagcggcggcaagtctgctgcccccctcatcatctgccccatgtctggaattgatggcttcagcggccacgtgggcaaccacggccacagcatggagaccagcccctag

SEQ ID NO: 174214 - DNA, 624 bp, Artificial Sequence
  Description of Artificial Sequence: Synthetic coding sequence
tgactgcgggaggcccagctgtacagcgtggatgtgaccctggaccctgacacagcctaccccagcctcatcctgagtgacaacctgcggcaggtgcgctacagctacctgcagcaggacctgcctgacaaccctgagcgcttcaacctcttcccctgtgtgctgggcagcccctgcttcatcgccggccgccactactgggaggtggaggtgggggacaaggccaagtggaccatcggcgtgtgtgaagattctgtgtgcaggaaaggaggagtgaccagcgccccccagaatggcttctgggccgtgtccctgtggtacggcaaggagtactgggccctgaccagccccatgacagccctgcccctgcggacccccctgcagagggtgggcatcttcctggactatgatgctggggaggtgtccttctacaacgtgacagagcgctgccacaccttcaccttcagccacgccaccttctgtggccctgtgcggccctacttcagcctgagctacagcggcggcaagtctgctgcccccctcatcatctgccccatgtctggaattgatggcttcagcggccacgtgggcaaccacggccacagcatggagaccagcccctag

SEQ ID NO: 174215 - DNA, 1077 bp, Artificial Sequence; identical to SEQ ID NO: 174196
  Description of Artificial Sequence: Synthetic coding sequence

SEQ ID NO: 174216 - DNA, 747 bp, Artificial Sequence; identical to SEQ ID NO: 174200
  Description of Artificial Sequence: Synthetic coding sequence

SEQ ID NO: 174217 - DNA, 750 bp, Artificial Sequence; identical to SEQ ID NO: 174205
  Description of Artificial Sequence: Synthetic coding sequence

SEQ ID NO: 174218 - DNA, 2202 bp, Artificial Sequence
  Description of Artificial Sequence: Synthetic coding sequence
atggccaagcgggaggacagccctggccctgaggtgcagcccatggacaagcagttcctggtgtgcagcatctgcctggaccgctaccagtgccccaaggtgctgccctgcctgcacaccttctgtgagcgctgcctgcagaactacatcccagcccagagcctgaccctgagctgccctgtgtgccggcagaccagcatcctgcctgagcagggcgtgtctgccctgcagaacaacttcttcatcagcagcctgatggaggccatgcagcaggccccagatggagcccatgaccctgaggacccccaccccctgtctgtggtggccggccggcccctgagctgccccaaccacgagggcaagaccatggagttctactgtgaggcctgtgaaacagccatgtgtggagaatgtcgggccggggagcaccgggagcagcacaaggccgccctgcagaggcagctggaggccgtgcggggccgcctgccccagctgtctgctgccatcgccctggtgggcggcatcagccagcagctgcaggagaggaaggccgaggccctggcccagatctctgctgcctttgaggacctggagcaggccctgcagcagaggaagcaggccctggtgtctgacctggagaccatctgtggggccaagcagaaggtgctgcagagccagctggacaccctgcggcagggccaggagcacatcggcagcagctgcagctttgctgagcaggccctgcggctgggcagcgcccctgaggtgctgctggtgaggaagcacatgagggagcggctggccgccctggccgcccaggccttccctgagcggccccatgaaaatgcccagctggagctggtgctggaggtggatggcctgcggcgctctgtgctgaacctgggcgccctgctgaccaccagcgccacagcccacgagaccgtggccactggagagggcctgcggcaggccctggtgggccagcctgccagcctgactgtgaccaccaaggacaaggatggccgcctggtgaggacaggcagcgctgagctgcgggcagagatcaccggcccagatggcacccggctgcctgtgcctgtggtggaccacaagaatggcacctatgagctggtgtacacagccaggacagaaggagagctgctgctgtctgtgctgctgtatggccagcctgtgcggggcagccccttccgggtgcgggccctgcggcctggggacctgccccccagcccagatgatgtgaagagaagagtgaagagccctgggggccctggcagccacgtgcggcagaaggctgtgcggcggcccagctccatgtacagcactggaggcaagaggaaggacaaccccattgaagatgagctggtgttccgggtgggcagccggggccgggagaagggggagttcaccaacctgcagggcgtgtctgctgccagcagcggcagaattgtggtggccgacagcaacaaccagtgcatccaggtgttcagcaatgaaggccagttcaagttccgcttcggcgtgcggggccgcagccctggccagctgcagaggcccaccggggtggccgtggacaccaatggagacatcatcgtggccgactatgacaaccgctgggtgtccatcttcagccctgagggcaagttcaagaccaagattggagctggccgcctgatgggccccaagggcgtggccgtggacagaaatggccacatcatcgtggtggacaacaagagctgctgcgtgttcaccttccagcccaacgggaagctggtgggccgctttggaggccgcggggccacagacagacactttgctggcccccactttgtggccgtgaacaacaagaatgaaattgtggtgacagacttccacaaccacagcgtgaaggtgtacagcgcagatggagagttcctgttcaagtttggcagccatggagagggcaatggccagttcaatgcccccaccggggtggccgtggacagcaatggaaacatcatcgtggccgactggggcaacagccgcatccaggtgtttgacagcagcggcagcttcctgagctacatcaacaccagcgctgagcccctgtatggcccccagggcctggccctgaccagtgatggccacgtggtggtggctgatgctggcaaccactgcttcaaggcctaccgctacctgcagtag

SEQ ID NO: 174219 - DNA, 2235 bp, Artificial Sequence
  Description of Artificial Sequence: Synthetic coding sequence
atggccaagcgggaggacagccctggccctgaggtgcagcccatggacaagcagttcctggtgtgcagcatctgcctggaccgctaccagtgccccaaggtgctgccctgcctgcacaccttctgtgagcgctgcctgcagaactacatcccagcccagagcctgaccctgagctgccctgtgtgccggcagaccagcatcctgcctgagcagggcgtgtctgccctgcagaacaacttcttcatcagcagcctgatggaggccatgcagcaggccccagatggagcccatgaccctgaggacccccaccccctgtctgtggtggccggccggcccctgagctgccccaaccacgagggcaagaccatggagttctactgtgaggcctgtgaaacagccatgtgtggagaatgtcgggccggggagcaccgggagcacggcaccgtgctgctgagagatgtggtggagcagcacaaggccgccctgcagaggcagctggaggccgtgcggggccgcctgccccagctgtctgctgccatcgccctggtgggcggcatcagccagcagctgcaggagaggaaggccgaggccctggcccagatctctgctgcctttgaggacctggagcaggccctgcagcagaggaagcaggccctggtgtctgacctggagaccatctgtggggccaagcagaaggtgctgcagagccagctggacaccctgcggcagggccaggagcacatcggcagcagctgcagctttgctgagcaggccctgcggctgggcagcgcccctgaggtgctgctggtgaggaagcacatgagggagcggctggccgccctggccgcccaggccttccctgagcggccccatgaaaatgcccagctggagctggtgctggaggtggatggcctgcggcgctctgtgctgaacctgggcgccctgctgaccaccagcgccacagcccatgaaacagtggccaccggggagggcctgcggcaggccctggtgggccagcctgccagcctgactgtgaccaccaaggacaaggatggccgcctggtgaggactggatctgctgagctgcgggcagagatcactggaccagatggcacccggctgcctgtgcctgtggtggaccacaagaatggcacctatgagctggtgtacacagccaggacagaaggagagctgctgctgtctgtgctgctgtatggccagcctgtgcggggcagccccttccgggtgcgggccctgcggcctggggacctgccccccagcccagatgatgtgaagagaagagtgaagagccctgggggccctggcagccacgtgcggcagaaggctgtgagaagacccagctccatgtacagcactggaggcaagaggaaggacaaccccattgaagatgagctggtgttccgggtgggcagccggggccgggagaagggggagttcaccaacctgcagggcgtgtctgctgccagcagcggccgcatcgtggtggccgacagcaacaaccagtgcatccaggtgttcagcaatgaaggccagttcaagttccgctttggagtgcggggccgcagccctggccagctgcagaggcccactggagtggccgtggacaccaacggggacatcatcgtggccgactatgacaaccgctgggtgtccatcttcagccctgagggcaagttcaagaccaagatcggggccggccgcctgatgggccccaagggcgtggccgtggacagaaatggccacatcatcgtggtggacaacaagagctgctgcgtgttcaccttccagcccaacgggaagctggtgggccgctttggaggccgcggggccacagacagacactttgctggcccccactttgtggccgtgaacaacaagaatgagatcgtggtgacagacttccacaaccacagcgtgaaggtgtacagcgcagatggagagttcctgttcaagtttggcagccacggggagggcaatggccagttcaatgcccccactggagtggccgtggacagcaatggaaacatcatcgtggccgactggggcaacagccgcatccaggtgtttgacagcagcggcagcttcctgagctacatcaacaccagcgctgagcccctgtatggcccccagggcctggccctgaccagtgatggccacgtggtggtggctgatgctggcaaccactgcttcaaggcctaccgctacctgcagtag

SEQ ID NO: 174220 - DNA, 2235 bp, Artificial Sequence; identical to SEQ ID NO: 174219
  Description of Artificial Sequence: Synthetic coding sequence

SEQ ID NO: 174221 - DNA, 2235 bp, Artificial Sequence; identical to SEQ ID NO: 174219
  Description of Artificial Sequence: Synthetic coding sequence

SEQ ID NO: 174222 - DNA, 2229 bp, Artificial Sequence
  Description of Artificial Sequence: Synthetic coding sequence
atggccaagcgggaggacagccctggccctgaggtgcagcccatggacaagcagttcctggtgtgcagcatctgcctggaccgctaccagtgccccaaggtgctgccctgcctgcacaccttctgtgagcgctgcctgcagaactacatcccagcccagagcctgaccctgagctgccctgtgtgccggcagaccagcatcctgcctgagcagggcgtgtctgccctgcagaacaacttcttcatcagcagcctgatggaggccatgcagcaggccccagatggagcccatgaccctgaggacccccaccccctgtctgtggtggccggccggcccctgagctgccccaaccacgagggcaagaccatggagttctactgtgaggcctgtgaaacagccatgtgtggagaatgtcgggccggggagcaccgggagcacggcaccgtgctgctgagagatgtggtggagcagcacaaggccgccctgcagaggcagctggaggccgtgcggggccgcctgccccagctgtctgctgccatcgccctggtgggcggcatcagccagcagctgcaggagaggaaggccgaggccctggcccagatctctgctgcctttgaggacctggagcaggccctgcagcagaggaagcaggccctggtgtctgacctggagaccatctgtggggccaagcagaaggtgctgcagagccagctggacaccctgcggcagggccaggagcacatcggcagcagctgcagctttgctgagcaggccctgcggctgggcagcgcccctgaggtgctgctggtgaggaagcacatgagggagcggctggccgccctggccgcccaggccttccctgagcggccccatgaaaatgcccagctggagctggtgctggaggtggatggcctgcggcgctctgtgctgaacctgggcgccctgctgaccaccagcgccacagcccatgaaacagtggccaccggggagggcctgcggcaggccctggtgggccagcctgccagcctgactgtgaccaccaaggacaaggatggccgcctggtgaggactggatctgctgagctgcgggcagagatcactggaccagatggcacccggctgcctgtgcctgtggtggaccacaagaatggcacctatgagctggtgtacacagccaggacagaaggagagctgctgctgtctgtgctgctgtatggccagcctgtgcggggcagccccttccgggtgcgggccctgcggcctggggacctgccccccagcccagatgatgtgaagagaagagtgaagagccctgggggccctggcagccacgtgcggcagaaggctgtgagaagacccagctccatgtacagcactggaggcaagaggaaggacaaccccattgaagatgagctggtgttccgggtgggcagccggggccgggagaagggggagttcaccaacctgcagggcgtgtctgctgccagcagcggccgcatcgtggtggccgacagcaacaaccagtgcatccaggtgttcagcaatgaaggccagttcaagttccgctttggagtgcggggccgcagccctggccagctgcagaggcccactggagtggccgtggacaccaacggggacatcatcgtggccgactatgacaaccgctgggtgtccatcttcagccctgagggcaagttcaagaccaagatcggggccggccgcctgatgggccccaagggcgtggccgtggacagaaatggccacatcatcgtggtggacaacaagagctgctgcgtgttcaccttccagcccaacgggaagctggtgggccgctttggaggccgcggggccacagacagacactttgctggcccccactttgtggccgtgaacaacaagaatgagatcgtggtgacagacttccacaaccacagcgtgaaggtgtacagcgcagatggagagttcctgttcaagtttggcagccacggggagggcaatggccagttcaatgcccccactggagtggccgtggacagcaatggaaacatcattgatgtgtgccgggccagcccctaccccagctacaccccaccccacccctgccagagcgccccccaccccccagcctggggccagaacagcctgccccaggacaggagccccagcagctgcctgcccaccaccctgtacaccctgacagaaacagccatcccccaccccccctactag

SEQ ID NO: 174223 - DNA, 1878 bp, Artificial Sequence
  Description of Artificial Sequence: Synthetic coding sequence
atgaagaccatggagttctactgtgaggcctgtgaaacagccatgtgtggggagtgcagagctggggagcaccgggagcacggcaccgtgctgctgagagatgtggtggagcagcacaaggccgccctgcagaggcagctggaggccgtgcggggccgcctgccccagctgtctgctgccatcgccctggtgggcggcatcagccagcagctgcaggagaggaaggccgaggccctggcccagatctctgctgcctttgaggacctggagcaggccctgcagcagaggaagcaggccctggtgtctgacctggagaccatctgtggggccaagcagaaggtgctgcagagccagctggacaccctgcggcagggccaggagcacatcggcagcagctgcagctttgctgagcaggccctgcggctgggcagcgcccctgaggtgctgctggtgaggaagcacatgagggagcggctggccgccctggccgcccaggccttccctgagcggccccatgaaaatgcccagctggagctggtgctggaggtggatggcctgcggcgctctgtgctgaacctgggcgccctgctgaccaccagcgccacagcccacgagaccgtggccactggagagggcctgcggcaggccctggtgggccagcctgccagcctgactgtgaccaccaaggacaaggatggccgcctggtgaggacaggcagcgctgagctgcgggcagagatcaccggcccagatggcacccggctgcctgtgcctgtggtggaccacaagaatggcacctatgagctggtgtacacagccaggacagaaggagagctgctgctgtctgtgctgctgtatggccagcctgtgcggggcagccccttccgggtgcgggccctgcggcctggggacctgccccccagcccagatgatgtgaagagaagagtgaagagccctgggggccctggcagccacgtgcggcagaaggctgtgcggcggcccagctccatgtacagcactggaggcaagaggaaggacaaccccattgaagatgagctggtgttccgggtgggcagccggggccgggagaagggggagttcaccaacctgcagggcgtgtctgctgccagcagcggcagaattgtggtggccgacagcaacaaccagtgcatccaggtgttcagcaatgaaggccagttcaagttccgcttcggcgtgcggggccgcagccctggccagctgcagaggcccaccggggtggccgtggacaccaatggagacatcatcgtggccgactatgacaaccgctgggtgtccatcttcagccctgagggcaagttcaagaccaagattggagctggccgcctgatgggccccaagggcgtggccgtggacagaaatggccacatcatcgtggtggacaacaagagctgctgcgtgttcaccttccagcccaacgggaagctggtgggccgctttggaggccgcggggccacagacagacactttgctggcccccactttgtggccgtgaacaacaagaatgaaattgtggtgacagacttccacaaccacagcgtgaaggtgtacagcgcagatggagagttcctgttcaagtttggcagccatggagagggcaatggccagttcaatgcccccaccggggtggccgtggacagcaatggaaacatcatcgtggccgactggggcaacagccgcatccaggtgtttgacagcagcggcagcttcctgagctacatcaacaccagcgctgagcccctgtatggcccccagggcctggccctgaccagtgatggccacgtggtggtggctgatgctggcaaccactgcttcaaggcctaccgctacctgcagtag

SEQ ID NO: 174224 - DNA, 2001 bp, Artificial Sequence
  Description of Artificial Sequence: Synthetic coding sequence
atggccaagcgggaggacagccctggccctgaggtgcagcccatggacaagcagttcctggtgtgcagcatctgcctggaccgctaccagtgccccaaggtgctgccctgcctgcacaccttctgtgagcgctgcctgcagaactacatcccagcccagagcctgaccctgagctgccctgtgtgccggcagaccagcatcctgcctgagcagggcgtgtctgccctgcagaacaacttcttcatcagcagcctgatggaggccatgcagcaggccccagatggagcccatgaccctgaggacccccaccccctgtctgtggtggccggccggcccctgagctgccccaaccacgagggcaagaccatggagttctactgtgaggcctgtgaaacagccatgtgtggagaatgtcgggccggggagcaccgggagcacggcaccgtgctgctgagagatgtggtggagcagcacaaggccgccctgcagaggcagctggaggccgtgcggggccgcctgccccagctgtctgctgccatcgccctggtgggcggcatcagccagcagctgcaggagaggaaggccgaggccctggcccagatctctgctgcctttgaggacctggagcaggccctgcagcagaggaagcaggccctggtgtctgacctggtggatggcctgcggcgctctgtgctgaacctgggcgccctgctgaccaccagcgccacagcccatgaaacagtggccaccggggagggcctgcggcaggccctggtgggccagcctgccagcctgactgtgaccaccaaggacaaggatggccgcctggtgaggactggatctgctgagctgcgggcagagatcactggaccagatggcacccggctgcctgtgcctgtggtggaccacaagaatggcacctatgagctggtgtacacagccaggacagaaggagagctgctgctgtctgtgctgctgtatggccagcctgtgcggggcagccccttccgggtgcgggccctgcggcctggggacctgccccccagcccagatgatgtgaagagaagagtgaagagccctgggggccctggcagccacgtgcggcagaaggctgtgagaagacccagctccatgtacagcactggaggcaagaggaaggacaaccccattgaagatgagctggtgttccgggtgggcagccggggccgggagaagggggagttcaccaacctgcagggcgtgtctgctgccagcagcggccgcatcgtggtggccgacagcaacaaccagtgcatccaggtgttcagcaatgaaggccagttcaagttccgctttggagtgcggggccgcagccctggccagctgcagaggcccactggagtggccgtggacaccaacggggacatcatcgtggccgactatgacaaccgctgggtgtccatcttcagccctgagggcaagttcaagaccaagatcggggccggccgcctgatgggccccaagggcgtggccgtggacagaaatggccacatcatcgtggtggacaacaagagctgctgcgtgttcaccttccagcccaacgggaagctggtgggccgctttggaggccgcggggccacagacagacactttgctggcccccactttgtggccgtgaacaacaagaatgagatcgtggtgacagacttccacaaccacagcgtgaaggtgtacagcgcagatggagagttcctgttcaagtttggcagccacggggagggcaatggccagttcaatgcccccactggagtggccgtggacagcaatggaaacatcatcgtggccgactggggcaacagccgcatccaggtgtttgacagcagcggcagcttcctgagctacatcaacaccagcgctgagcccctgtatggcccccagggcctggccctgaccagtgatggccacgtggtggtggctgatgctggcaaccactgcttcaaggcctaccgctacctgcagtag

SEQ ID NO: 174225 - DNA, 2226 bp, Artificial Sequence
  Description of Artificial Sequence: Synthetic coding sequence
atggccaagcgggaggacagccctggccctgaggtgcagcccatggacaagcagttcctggtgtgcagcatctgcctggaccgctaccagtgccccaaggtgctgccctgcctgcacaccttctgtgagcgctgcctgcagaactacatcccagcccagagcctgaccctgagctgccctgtgtgccggcagaccagcatcctgcctgagcagggcgtgtctgccctgcagaacaacttcttcatcagcagcctgatggaggccatgcagcaggccccagatggagcccatgaccctgaggacccccaccccctgtctgtggtggccggccggcccctgagctgccccaaccacgagggcaagaccatggagttctactgtgaggcctgtgaaacagccatgtgtggagaatgtcgggccggggagcaccgggagcacggcaccgtgctgctgagagatgtggtggagcagcacaaggccgccctgcagaggcagctggaggccgtgcggggccgcctgccccagctgtctgctgccatcgccctggtgggcggcatcagccagcagctgcaggagaggaaggccgaggccctggcccagatctctgctgcctttgaggacctggagcaggccctgcagcagaggaagcaggccctggtgtctgacctggagaccatctgtggggccaagcagaaggtgctgcagagccagctggacaccctgcggcagggccaggagcacatcggcagcagctgcagctttgctgagcaggccctgcggctgggcagcgcccctgaggtgctgctggtgaggaagcacatgagggagcggctggccgccctggccgcccaggccttccctgagcggccccatgaaaatgcccagctggagctggtgctggaggtggatggcctgcggcgctctgtgctgaacctgggcgccctgctgaccaccagcgccacagcccatgaaacagtggccaccggggagggcctgcggcaggccctggtgggccagcctgccagcctgactgtgaccaccaaggacaaggatggccgcctggtgaggactggatctgctgagctgcgggcagagatcactggaccagatggcacccggctgcctgtgcctgtggtggaccacaagaatggcacctatgagctggtgtacacagccaggacagaaggagagctgctgctgtctgtgctgctgtatggccagcctgtgcggggcagccccttccgggtgcgggccctgcggcctggggacctgccccccagcccagatgatgtgaagagaagagtgaagagccctgggggccctggcagccacgtgcggcagaaggctgtgagaagacccagctccatgtacagcactggaggcaagaggaaggacaaccccattgaagatgagctggtgttccgggtgggcagccggggccgggagaagggggagttcaccaacctgcagggcgtgtctgctgccagcagcggccgcatcgtggtggccgacagcaacaaccagtgcatccaggtgttcagcaatgaaggccagttcaagttccgctttggagtgcggggccgcagccctggccagctgcagaggcccactggagtggccgtggacaccaacggggacatcatcgtggccgactatgacaaccgctgggtgtccatcttcagccctgagggcaagttcaagaccaagatcggggccggccgcctgatgggccccaagggcgtggccgtggacagaaatggccacatcatcgtggtggacaacaagagctgctgcgtgttcaccttccagcccaacgggaagctggtgggccgctttggaggccgcggggccacagacagacactttgctggcccccactttgtggccgtgaacaacaagaatgagatcgtggtgacagacttccacaaccacagcgtgaaggtgtacagcgcagatggagagttcctgttcaagtttggcagccacggggagggcaatggccagttcaatgcccccactggagtggccgtggacagcaatggaaacatcatcgtgtgccgggccagcccctaccccagctacaccccaccccacccctgccagagcgccccccaccccccagcctggggccagaacagcctgccccaggacaggagccccagcagctgcctgcccaccaccctgtacaccctgacagaaacagccatcccccaccccccctactag

SEQ ID NO: 174226 - DNA, 1278 bp, Artificial Sequence
  Description of Artificial Sequence: Synthetic coding sequence
atggccagcggccagtttgtgaacaagctgcaggaggaggtgatctgccccatctgcctggacatcctgcagaagcctgtgaccatcgactgtggccacaacttctgcctgaagtgcatcacccagattggagagaccagctgtggcttcttcaagtgccccctgtgcaagacctctgtgaggaagaatgccatccgcttcaacagcctgctgaggaacctggtggagaagatccaggccctgcaggccagcgaggtgcagagcaagaggaaggaggccacctgccccaggcaccaggagatgttccactacttctgtgaagatgatggcaagttcctgtgctttgtgtgctgtgagagcaaggaccacaagagccacaacgtgtccctgattgaggaggccgcccagaactaccagggccagatccaggagcagatccaggtgctgcagcagaaggagaaggagaccgtgcaggtgaaggcccagggcgtgcaccgggtggatgtgttcacagaccaggtggagcacgagaagcagaggatcctgacagaatttgagctgctgcaccaggtgctggaggaggagaagaacttcctgctgagccgcatctactggctgggccacgagggcacagaagctgggaagcactacgtggccagcacagagccccagctgaatgacctgaagaagctggtggacagcctgaagaccaagcagaacatgccaccccggcagctgctggaggacatcaaggtggtgctgtgccgctctgaggagttccagttcctgaaccccacccctgtgcccctggagctggagaagaagctgtctgaggccaagagcagacatgacagcatcaccggcagcctgaagaagttcaaggaccagctgcaggccgacaggaagaaggatgaaaatcgcttcttcaagtccatgaacaagaatgacatgaagtcctggggcctgctgcagaagaacaaccacaagatgaacaagaccagcgagcccggcagcagcagcgctgggggccgcaccaccagcggcccccccaaccaccacagcagcgcccccagccacagcctcttccgggccagcagcgctgggaaggtgaccttccctgtgtgcctgctggccagctatgatgagatcagcggccagggcgccagcagccaggacaccaagacctttgatgtggccctgtctgaggagctgcacgccgccctgtctgagtggctgacagccatccgggcctggttctgtgaggtgcccagcagctag

SEQ ID NO: 174227 - DNA, 1278 bp, Artificial Sequence
  Description of Artificial Sequence: Synthetic coding sequence
atggccagcggccagtttgtgaacaagctgcaggaggaggtgatctgccccatctgcctggacatcctgcagaagcctgtgaccatcgactgtggccacaacttctgcctgaagtgcatcacccagattggagagaccagctgtggcttcttcaagtgccccctgtgcaagacctctgtgaggaagaatgccatccgcttcaacagcctgctgaggaacctggtggagaagatccaggccctgcaggccagcgaggtgcagagcaagaggaaggaggccacctgccccaggcaccaggagatgttccactacttctgtgaagatgatggcaagttcctgtgctttgtgtgccgggagagcaaggaccacaagagccacaacgtgtccctgattgaggaggccgcccagaactaccagggccagatccaggagcagatccaggtgctgcagcagaaggagaaggagaccgtgcaggtgaaggcccagggcgtgcaccgggtggatgtgttcacagaccaggtggagcacgagaagcagaggatcctgacagaatttgagctgctgcaccaggtgctggaggaggagaagaacttcctgctgagccgcatctactggctgggccacgagggcacagaagctgggaagcactacgtggccagcacagagccccagctgaatgacctgaagaagctggtggacagcctgaagaccaagcagaacatgccaccccggcagctgctggagcccgcccagccccacctgcccaggtctgaggagttccagttcctgaaccccacccctgtgcccctggagctggagaagaagctgtctgaggccaagagcagacatgacagcatcaccggcagcctgaagaagttcaaggaccagctgcaggccgacaggaagaaggatgaaaatcgcttcttcaagtccatgaacaagaatgacatgaagtcctggggcctgctgcagaagaacaaccacaagatgaacaagaccagcgagcccggcagcagcagcgctgggggccgcaccaccagcggcccccccaaccaccacagcagcgcccccagccacagcctcttccgggccagcagcgctgggaaggtgaccttccctgtgtgcctgctggccagctatgatgagatcagcggccagggcgccagcagccaggacaccaagacctttgatgtggccctgtctgaggagctgcacgccgccctgtctgagtggctgacagccatccgggcctggttctgtgaggtgcccagcagctag

SEQ ID NO: 174228 - DNA, 1278 bp, Artificial Sequence
  Description of Artificial Sequence: Synthetic coding sequence
atggccagcggccagtttgtgaacaagctgcaggaggaggtgatctgccccatctgcctggacatcctgcagaagcctgtgaccatcgactgtggccacaacttctgcctgaagtgcatcacccagattggagagaccagctgtggcttcttcaagtgccccctgtgcaagacctctgtgaggaagaatgccatccgcttcaacagcctgctgaggaacctggtggagaagatccaggccctgcaggccagcgaggtgcagagcaagaggaaggaggccacctgccccaggcaccaggagatgttccactacttctgtgaagatgatggcaagttcctgtgctttgtgtgccgggagagcaaggaccacaagagccacaacgtgtccctgattgaggaggccgcccagaactaccagggccagatccaggagcagatccaggtgctgcagcagaaggagaaggagaccgtgcaggtgaaggcccagggcgtgcaccgggtggatgtgttcacagaccaggtggagcacgagaagcagaggatcctgacagaatttgagctgctgcaccaggtgctggaggaggagaagaacttcctgctgagccgcatctactggctgggccacgagggcacagaagctgggaagcactacgtggccagcacagagccccagctgaatgacctgaagaagctggtggacagcctgaagaccaagcagaacatgccaccccggcagctgctggaggacatcaaggtggtgctgtgccgctctgaggagttccagttcctgaaccccacccctgtgcccctggagctggagaagaagctgtctgaggccaagagcagacatgacagcatcaccggcagcctgaagaagttcaaggaccagctgcaggccgacaggaagaaggatgaaaatcgcttcttcaagtccatgaacaagaatgacatgaagtcctggggcctgctgcagaagaacaaccacaagatgaacaagaccagcgagcccggcagcagcagcgctgggggccgcaccaccagcggcccccccaaccaccacagcagcgcccccagccacagcctcttccgggccagcagcgctgggaaggtgaccttccctgtgtgcctgctggccagctatgatgagatcagcggccagggcgccagcagccaggacaccaagacctttgatgtggccctgtctgaggagctgcacgccgccctgtctgagtggctgacagccatccgggcctggttctgtgaggtgcccagcagctag

SEQ ID NO: 174229 - DNA, 747 bp, Artificial Sequence
  Description of Artificial Sequence: Synthetic coding sequence
atggccagcggccagtttgtgaacaagctgcaggaggaggtgatctgccccatctgcctggacatcctgcagaagcctgtgaccatcgactgtggccacaacttctgcctgaagtgcatcacccagattggagagaccagctgtggcttcttcaagtgccccctgtgcaagacctctgtgaggaagaatgccatccgcttcaacagcctgctgaggaacctggtggagaagatccaggccctgcaggccagcgaggtgcagagcaagaggaaggaggccacctgccccaggcaccaggagatgttccactacttctgtgaagatgatggcaagttcctgtgctttgtgtgccgggagagcaaggaccacaagagccacaacgtgtccctgattgaggaggccgcccagaactaccagggccagatccaggagcagatccaggtgctgcagcagaaggagaaggagaccgtgcaggtgaaggcccagggcgtgcaccgggtggatgtgttcacagaccaggtggagcacgagaagcagaggatcctgacagaatttgagctgctgcaccaggtgctggaggaggagaagaacttcctgctgagccgcatctactggctgggccacgagggcacagaagctgggaagcactacgtggccagcacagagccccagctgaatgacctgaagaagctggtggacagcctgaagaccaagcagaacatgccaccccggcagctgctggagtag

SEQ ID NO: 174230 - DNA, 1278 bp, Artificial Sequence
  Description of Artificial Sequence: Synthetic coding sequence
atggccagcggccagtttgtgaacaagctgcaggaggaggtgatctgccccatctgcctggacatcctgcagaagcctgtgaccatcgactgtggccacaacttctgcctgaagtgcatcacccagattggagagaccagctgtggcttcttcaagtgccccctgtgcaagacctctgtgaggaagaatgccatccgcttcaacagcctgctgaggaacctggtggagaagatccaggccctgcaggccagcgaggtgcagagcaagaggaaggaggccacctgccccaggcaccaggagatgttccactacttctgtgaagatgatggcaagttcctgtgctttgtgtgccgggagagcaaggaccacaagagccacaacgtgtccctgattgaggaggccgcccagaactaccagggccagatccaggagcagatccaggtgctgcagcagaaggagaaggagaccgtgcaggtgaaggcccagggcgtgcaccgggtggatgtgttcacagaccaggtggagcacgagaagcagaggatcctgacagaatttgagctgctgcaccaggtgctggaggaggagaagaacttcctgctgagccgcatctactggctgggccacgagggcacagaagctgggaagcactacgtggccagcacagagccccagctgaatgacctgaagaagctggtggacagcctgaagaccaagcagaacatgccaccccggcagctgctggaggacatcaaggtggtgctgtgccgctctgaggagttccagttcctgaaccccacccctgtgcccctggagctggagaagaagctgtctgaggccaagagcagacatgacagcatcaccggcagcctgaagaagttcaaggaccagctgcaggccgacaggaagaaggatgaaaatcgcttcttcaagtccatgaacaagaatgacatgaagtcctggggcctgctgcagaagaacaaccacaagatgaacaagaccagcgagcccggcagcagcagcgctgggggccgcaccaccagcggcccccccaaccaccacagcagcgcccccagccacagcctcttccgggccagcagcgctgggaaggtgaccttccctgtgtgcctgctggccagctatgatgagatcagcggccagggcgccagcagccaggacaccaagacctttgatgtggccctgtctgaggagctgcacgccgccctgtctgagtggctgacagccatccgggcctggttctgcaaggtgcccagcagctag

SEQ ID NO: 174231 - DNA, 1278 bp, Artificial Sequence; identical to SEQ ID NO: 174228
  Description of Artificial Sequence: Synthetic coding sequence

SEQ ID NO: 174232 - DNA, 1278 bp, Artificial Sequence; identical to SEQ ID NO: 174228
  Description of Artificial Sequence: Synthetic coding sequence

SEQ ID NO: 174233 - DNA, 1278 bp, Artificial Sequence; identical to SEQ ID NO: 174228
  Description of Artificial Sequence: Synthetic coding sequence

SEQ ID NO: 174234 - DNA, 1278 bp, Artificial Sequence
  Description of Artificial Sequence: Synthetic coding sequence
atggccagcggccagtttgtgaacaagctgcaggaggaggtgatctgccccatctgcctggacatcctgcagaagcctgtgaccatcgactgtggccacaacttctgcctgaagtgcatcacccagattggagagaccagctgtggcttcttcaagtgccccctgtgcaagacctctgtgaggaagaatgccatccgcttcaacagcctgctgaggaacctggtggagaagatccaggccctgcaggccagcgaggtgcagagcaagaggaaggaggccacctgccccaggcaccaggagatgttccactacttctgtgaagatgatggcaagttcctgtgctttgtgtgccgggagagcaaggaccacaagagccacaacgtgtccctgattgaggaggccgcccagaactaccagggccagatccaggagcagatccaggtgctgcagcagaaggagaaggagaccgtgcaggtgaaggcccagggcgtgcaccgggtggatgtgttcacagaccaggtggagcacgagaagcagaggatcctgacagaatttgagctgctgcaccaggtgctggaggaggagaagaacttcctgctgagccgcatctactggctgggccacgagggcacagaagctgggaagcactacgtggccagcacagagccccagctgaatgacctgaagaagctgattgacagcctgaagaccaagcagaacatgccaccccggcagctgctggaggacatcaaggtggtgctgtgccgctctgaggagttccagttcctgaaccccacccctgtgcccctggagctggagaagaagctgtctgaggccaagagcagacatgacagcatcaccggcagcctgaagaagttcaaggaccagctgcaggccgacaggaagaaggatgaaaatcgcttcttcaagtccatgaacaagaatgacatgaagtcctggggcctgctgcagaagaacaaccacaagatgaacaagaccagcgagcccggcagcagcagcgctgggggccgcaccaccagcggcccccccaaccaccacagcagcgcccccagccacagcctcttccgggccagcagcgctgggaaggtgaccttccctgtgtgcctgctggccagctatgatgagatcagcggccagggcgccagcagccaggacaccaagacctttgatgtggccctgtctgaggagctgcacgccgccctgtctgagtggctgacagccatccgggcctggttctgcaaggtgcccagcagctag

SEQ ID NO: 174235 - DNA, 1278 bp, Artificial Sequence; identical to SEQ ID NO: 174228
  Description of Artificial Sequence: Synthetic coding sequence

SEQ ID NO: 174236 - DNA, 1278 bp, Artificial Sequence; identical to SEQ ID NO: 174227
  Description of Artificial Sequence: Synthetic coding sequence

SEQ ID NO: 174237 - DNA, 1278 bp, Artificial Sequence; identical to SEQ ID NO: 174230
  Description of Artificial Sequence: Synthetic coding sequence

SEQ ID NO: 174238 - DNA, 1278 bp, Artificial Sequence; identical to SEQ ID NO: 174227
  Description of Artificial Sequence: Synthetic coding sequence

SEQ ID NO: 174239 - DNA, 1278 bp, Artificial Sequence
  Description of Artificial Sequence: Synthetic coding sequence
atggccagcggccagtttgtgaacaagctgcaggaggaggtgatctgccccatctgcctggacatcctgcagaagcctgtgaccatcgactgtggccacaacttctgcctgaagtgcatcacccagattggagagaccagctgtggcttcttcaagtgccccctgtgcaagacctctgtgaggaagaatgccatccgcttcaacagcctgctgaggaacctggtggagaagatccaggccctgcaggccagcgaggtgcagagcaagaggaaggaggccacctgccccaggcaccaggagatgttccactacttctgtgaagatgatggcaagttcctgtgctttgtgtgccgggagagcaaggaccacaagagccacaacgtgtccctgattgaggaggccgcccagaactaccagggccagatccaggagcagatccaggtgctgcagcagaaggagaaggagaccgtgcaggtgaaggcccagggcgtgcaccgggtggatgtgttcacagaccaggtggagcacgagaagcagaggatcctgacagaatttgagctgctgcaccaggtgctggaggaggagaagaacttcctgctgagccgcatctactggctgggccacgagggcacagaagctgggaagcactacgtggccagcacagagccccagctgaatgacctgaagaagctgattgacagcctgaagaccaagcagaacatgccaccccggcagctgctggagcccgcccagccccacctgcccaggtctgaggagttccagttcctgaaccccacccctgtgcccctggagctggagaagaagctgtctgaggccaagagcagacatgacagcatcaccggcagcctgaagaagttcaaggaccagctgcaggccgacaggaagaaggatgaaaatcgcttcttcaagtccatgaacaagaatgacatgaagtcctggggcctgctgcagaagaacaaccacaagatgaacaagaccagcgagcccggcagcagcagcgctgggggccgcaccaccagcggcccccccaaccaccacagcagcgcccccagccacagcctcttccgggccagcagcgctgggaaggtgaccttccctgtgtgcctgctggccagctatgatgagatcagcggccagggcgccagcagccaggacaccaagacctttgatgtggccctgtctgaggagctgcacgccgccctgtctgagtggctgacagccatccgggcctggttctgcaaggtgcccagcagctag

SEQ ID NO: 174240 - DNA, 1278 bp, Artificial Sequence
  Description of Artificial Sequence: Synthetic coding sequence
atggccagcggccagtttgtgaacaagctgcaggaggaggtgatctgccccatctgcctggacatcctgcagaagcctgtgaccatcgactgtggccacaacttctgcctgaagtgcatcacccagattggagagaccagctgtggcttcttcaagtgccccctgtgcaagacctctgtgaggaagaatgccatccgcttcaacagcctgctgaggaacctggtggagaagatccaggccctgcaggccagcgaggtgcagagcaagaggaaggaggccacctgccccaggcaccaggagatgttccactacttctgtgaagatgatggcaagttcctgtgctttgtgtgctgtgagagcaaggaccacaagagccacaacgtgtccctgattgaggaggccgcccagaactaccagggccagatccaggagcagatccaggtgctgcagcagaaggagaaggagaccgtgcaggtgaaggcccagggcgtgcaccgggtggatgtgttcacagaccaggtggagcacgagaagcagaggatcctgacagaatttgagctgctgcaccaggtgctggaggaggagaagaacttcctgctgagccgcatctactggctgggccacgagggcacagaagctgggaagcactacgtggccagcacagagccccagctgaatgacctgaagaagctggtggacagcctgaagaccaagcagaacatgccaccccggcagctgctggagcccgcccagccccacctgcccaggtctgaggagttccagttcctgaaccccacccctgtgcccctggagctggagaagaagctgtctgaggccaagagcagacatgacagcatcaccggcagcctgaagaagttcaaggaccagctgcaggccgacaggaagaaggatgaaaatcgcttcttcaagtccatgaacaagaatgacatgaagtcctggggcctgctgcagaagaacaaccacaagatgaacaagaccagcgagcccggcagcagcagcgctgggggccgcaccaccagcggcccccccaaccaccacagcagcgcccccagccacagcctcttccgggccagcagcgctgggaaggtgaccttccctgtgtgcctgctggccagctatgatgagatcagcggccagggcgccagcagccaggacaccaagacctttgatgtggccctgtctgaggagctgcacgccgccctgtctgagtggctgacagccatccgggcctggttctgtgaggtgcccagcagctag

SEQ ID NO: 174241 - DNA, 1278 bp, Artificial Sequence; identical to SEQ ID NO: 174228
  Description of Artificial Sequence: Synthetic coding sequence

SEQ ID NO: 174242 - DNA, 1278 bp, Artificial Sequence; identical to SEQ ID NO: 174227
  Description of Artificial Sequence: Synthetic coding sequence

SEQ ID NO: 174243 - DNA, 1278 bp, Artificial Sequence; identical to SEQ ID NO: 174226
  Description of Artificial Sequence: Synthetic coding sequence

SEQ ID NO: 174244 - DNA, 1278 bp, Artificial Sequence; identical to SEQ ID NO: 174234
  Description of Artificial Sequence: Synthetic coding sequence

SEQ ID NO: 174245 - DNA, 1278 bp, Artificial Sequence
  Description of Artificial Sequence: Synthetic coding sequence
atggccagcggccagtttgtgaacaagctgcaggaggaggtgatctgccccatctgcctggacatcctgcagaagcctgtgaccatcgactgtggccacaacttctgcctgaagtgcatcacccagattggagagaccagctgtggcttcttcaagtgccccctgtgcaagacctctgtgaggaagaatgccatccgcttcaacagcctgctgaggaacctggtggagaagatccaggccctgcaggccagcgaggtgcagagcaagaggaaggaggccacctgccccaggcaccaggagatgttccactacttctgtgaagatgatggcaagttcctgtgctttgtgtgccgggagagcaaggaccacaagagccacaacgtgtccctgattgaggaggccgcccagaactaccagggccagatccaggagcagatccaggtgctgcagcagaaggagaaggagaccgtgcaggtgaaggcccagggcgtgcaccgggtggatgtgttcacagaccaggtggagcacgagaagcagaggatcctgacagaatttgagctgctgcaccaggtgctggaggaggagaagaacttcctgctgagccgcatctactggctgggccacgagggcacagaagctgggaagcactacgtggccagcacagagccccagctgaatgacctgaagaagctggtggacagcctgaagaccaagcagaacatgccaccccggcagctgctggagcccgcccagccccacctgcccaggtctgaggagttccagttcctgaaccccacccctgtgcccctggagctggagaagaagctgtctgaggccaagagcagacatgacagcatcaccggcagcctgaagaagttcaaggaccagctgcaggccgacaggaagaaggatgaaaatcgcttcttcaagtccatgaacaagaatgacatgaagtcctggggcctgctgcagaagaacaaccacaagatgaacaagaccagcgagcccggcagcagcagcgctgggggccgcaccaccagcggcccccccaaccaccacagcagcgcccccagccacagcctcttccgggccagcagcgctgggaaggtgaccttccctgtgtgcctgctggccagctatgatgagatcagcggccagggcgccagcagccaggacaccaagacctttgatgtggccctgtctgaggagctgcacgccgccctgtctgagtggctgacagccatccgggcctggttctgcaaggtgcccagcagctag

SEQ ID NO: 174246 - DNA, 1278 bp, Artificial Sequence; identical to SEQ ID NO: 174228
  Description of Artificial Sequence: Synthetic coding sequence

SEQ ID NO: 174247 - DNA, 1278 bp, Artificial Sequence; identical to SEQ ID NO: 174228
  Description of Artificial Sequence: Synthetic coding sequence

SEQ ID NO: 174248 - DNA, 1962 bp, Artificial Sequence
  Description of Artificial Sequence: Synthetic coding sequence
atggctgctgctgctgccagccacctgaacctggatgccctgcgggaggtgctggagtgccccatctgcatggagagcttcacagaggagcagctgcggcccaagctgctgcactgcggccacaccatctgccggcagtgcctggagaagctgctggccagcagcatcaatggagtgcgctgccccttctgcagcaagatcacccgcatcaccagcctgacccagctgacagacaacctgactgtgctgaagatcatcgacacagctggcctgtctgaggccgtgggcctgctgatgtgccgcagctgtggccgccgcctgccccggcagttctgccgcagctgtggcctggtgctgtgtgagccctgccgggaggccgaccaccagcccccaggccactgcaccctgcctgtgaaggaggccgctgaggagcggcggcgggactttggagagaagctgacccggctgcgggagctgatgggagagctgcagaggaggaaggccgccctggagggcgtgtccaaggacctgcaggcccgctacaaggctgtgctgcaggagtatggccacgaggagaggagagtgcaggatgagctggcccggagcaggaagttcttcaccggcagcctggccgaggtggagaagagcaacagccaggtggtggaggagcagagctacctgctgaacattgctgaggtgcaggccgtgagccgctgtgactacttcctggccaagatcaagcaggctgatgtggccctgctggaggagacagcagatgaggaggagcctgagctgacagccagcctgccccgggagctgaccctgcaggatgtggagctgctgaaggtgggccacgtgggccccctgcagatcggccaggccgtgaagaagcccaggacagtgaatgtggaggacagctgggccatggaggccacagccagcgctgccagcacctctgtgaccttccgggagatggacatgagccctgaggaggtggtggccagcccccgggccagccctgccaagcagaggggccctgaggccgccagcaacatccagcagtgcctcttcctgaagaagatgggcgccaagggcagcaccccaggcatgttcaacctgcctgtgtccctgtatgtgaccagccagggcgaggtgctggtggccgaccggggcaactaccgcatccaggtgttcaccaggaagggcttcctgaaggagatccgccgcagccccagcggcatcgacagctttgtgctgtccttcctgggcgctgacctgcccaacctgacccccctgtctgtggccatgaactgccagggcctcatcggcgtgacagacagctatgacaacagcctgaaggtgtacaccctggatggccactgtgtggcctgccacaggagccagctgagcaagccctggggcatcacagccctgcccagcggccagtttgtggtgacagatgtggagggcggcaagctgtggtgcttcaccgtggaccggggcagcggcgtggtgaagtacagctgcctgtgcagcgctgtgcggcccaagtttgtgacctgtgatgctgagggcaccgtgtacttcacccagggcctgggcctgaacctggagaaccggcagaatgagcaccacctggagggcggcttcagcatcggctctgtgggcccagatggccagctgggccggcagatcagccacttcttctctgaaaatgaagacttccgctgcatcgccggcatgtgtgtggatgcccggggggacctgattgtggccgacagcagcaggaaggagatcctgcacttccccaagggcggcggctacagcgtgctgatccgggagggcctgacctgccctgtgggcatcgccctgacccccaagggccagctgctggtgctggactgctgggaccactgcatcaagatctacagctaccacctgcggcgctacagcaccccctag

SEQ ID NO: 174249 - DNA, 522 bp, Artificial Sequence
  Description of Artificial Sequence: Synthetic coding sequence
atggctgctgctgctgccagccacctgaacctggatgccctgcgggaggtgctggagtgccccatctgcatggagagcttcacagaggagcagctgcggcccaagctgctgcactgcggccacaccatctgccggcagtgcctggagaagctgctggccagcagcatcaatggagtgcgctgccccttctgcagcaagatcacccgcatcaccagcctgacccagctgacagacaacctgactgtgctgaagatcatcgacacagctggcctgtctgaggccgtgggcctgctgatgtgccgcagctgtggccgccgcctgccccggcagttctgccgcagctgtggcctggtgctgtgtgagccctgccgggaggccgaccaccagcccccaggccactgcaccctgcctgtgaaggaggccgctgaggagcggcggcgggactttggagagaagctgacccggctgcgggagctgatgggagagctgcagaggaggaaggccgccctggagggcgtgtag

SEQ ID NO: 174250 - DNA, 1962 bp, Artificial Sequence; identical to SEQ ID NO: 174248
  Description of Artificial Sequence: Synthetic coding sequence

SEQ ID NO: 174251 - DNA, 3384 bp, Artificial Sequence
  Description of Artificial Sequence: Synthetic coding sequence
atggctgaaaataaaggaggaggagaggccgagagcggcggcggcggcagcggcagcgcccctgtgacagctggagctgctggccctgctgcccaggaggccgagccccccctgacagctgtgctggtggaggaggaggaggaggagggcggccgggccggggctgagggcggggccgccggcccagatgatggcggcgtggccgccgccagcagcggcagcgcccaggccgccagcagccctgctgcctctgtgggcactggagtggccggcggcgctgtgtccaccccagccccagccccagccagcgccccagcccctggccccagcgctggccccccacctggccccccagccagcctgctggacacctgtgctgtgtgccagcagagcctgcagagcagaagagaggccgagcccaagctgctgccctgcctgcacagcttctgcctgcgctgcctgcctgagcctgagcggcagctgtctgtgcccatccctgggggcagcaatggagacatccagcaggtgggcgtcatccgctgccctgtgtgccggcaggagtgccggcagattgacctggtggacaactactttgtgaaggacaccagcgaggcccccagcagcagtgatgagaagtctgagcaggtgtgcaccagctgtgaagataatgccagcgctgtgggcttctgtgtggagtgtggggagtggctgtgcaagacctgcatcgaggcccaccagagggtgaagttcaccaaggaccacctgatcaggaagaaggaggatgtgtctgagagcgtgggcgccagcggccagaggcctgtgttctgccctgtgcacaagcaggagcagctgaagctgttctgtgagacctgtgaccggctgacctgccgggactgccagctgctggagcacaaggagcaccgctaccagttcctggaggaggccttccagaaccagaagggggccatcgagaacctgctggccaagctgctggagaagaagaactacgtgcactttgctgccacccaggtgcagaaccgcatcaaggaggtgaatgagaccaacaagagggtggagcaggagatcaaggtggccatcttcaccctcatcaatgagatcaacaagaagggcaagagcctgctgcagcagctggagaatgtgaccaaggagcggcagatgaagctgctgcagcagcagaatgacatcaccggcctgagccggcaggtgaagcacgtgatgaacttcaccaactgggccatcgccagcggcagcagcacagccctgctgtacagcaagaggctcatcaccttccagctgcggcacatcctgaaggcccgctgtgaccctgtgcctgctgccaacggggccatccgcttccactgtgaccccaccttctgggccaagaatgtggtgaacctgggcaacctggtgattgagagcaagccagcccctggctacaccccaaatgtggtggtgggccaggtgcccccaggcaccaaccacatcagcaagaccccaggccagatcaacctggcccagctgcggctgcagcacatgcagcagcaggtgtatgcccagaagcaccagcagctgcagcagatgaggatgcagcagcccccagcccctgtgcccaccaccaccaccaccacccagcagcacccccggcaggccgccccccagatgctgcagcagcagccccccaggctcatctctgtgcagaccatgcagaggggcaacatgaactgtggggccttccaggcccaccagatgaggctggcccagaatgctgcccgcatccctggcatccccaggcacagcggcccccagtacagcatgatgcagccccacctgcagaggcagcacagcaaccctggccatgctggccccttccctgtggtgtctgtgcacaacaccaccatcaaccccaccagccccaccacagccaccatggccaatgccaacagaggccccaccagccccagcgtgacagccatcgagctgatccccagcgtgaccaaccctgagaacctgcccagcctgcctgacatcccccccatccagctggaggatgctggcagcagcagcctggacaacctgctgagccgctacatcagcggcagccacctgcccccccagcccaccagcaccatgaaccccagccctggccccagcgccctgagccctggcagcagcggcctgagcaacagccacacccctgtgcggccccccagcaccagcagcacaggcagccggggcagctgtggcagcagcggccgcacagctgagaagaccagcctgtccttcaagagtgaccaggtgaaggtgaagcaggagcctggaacagaagatgagatctgcagcttctctggaggagtgaagcaggagaagacagaagatggaagaagaagtgcctgcatgctgagcagccctgagagcagcctgaccccacccctgagcaccaacctgcacctggagagcgagctggatgccctggccagcctggagaaccacgtgaagattgagcctgctgacatgaatgaaagctgcaagcagagcggcctgagcagcctggtgaatggcaagagccccatccgcagcctgatgcacaggtctgccagaattggaggagatggcaacaacaaggatgatgaccccaatgaagactggtgtgctgtgtgccagaatggaggagacctgctgtgctgtgagaagtgccccaaggtgttccacctgacctgccacgtgcccaccctgctgtccttccccagcggggactggatctgcaccttctgccgggacatcggcaagccagaggtggagtatgactgtgacaacctgcagcacagcaagaagggcaagacagcccagggcctgagccctgtggaccagaggaaatgtgagcggctgctgctgtacctgtactgccacgagctgagcattgagttccaggagcctgtgcctgccagcatccccaactactacaagatcatcaagaagcccatggacctgagcacagtgaagaagaagctgcagaagaagcacagccagcactaccagatcccagatgactttgtggctgatgtgcggctcatcttcaagaactgtgagcgcttcaatgagatgatgaaggtggtgcaggtgtatgctgacacccaggagatcaacctgaaggctgacagcgaggtggcccaggccggcaaggctgtggccctgtactttgaggacaagctgacagagatctacagcgacaggacctttgcccccctgcctgagtttgagcaggaggaggatgatggagaggtgacagaagattctgatgaggacttcatccagcccaggaggaagaggctgaagagtgatgagaggcctgtgcacatcaagtag

SEQ ID NO: 174252 - DNA, 3333 bp, Artificial Sequence
  Description of Artificial Sequence: Synthetic coding sequence
atggctgaaaataaaggaggaggagaggccgagagcggcggcggcggcagcggcagcgcccctgtgacagctggagctgctggccctgctgcccaggaggccgagccccccctgacagctgtgctggtggaggaggaggaggaggagggcggccgggccggggctgagggcggggccgccggcccagatgatggcggcgtggccgccgccagcagcggcagcgcccaggccgccagcagccctgctgcctctgtgggcactggagtggccggcggcgctgtgtccaccccagccccagccccagccagcgccccagcccctggccccagcgctggccccccacctggccccccagccagcctgctggacacctgtgctgtgtgccagcagagcctgcagagcagaagagaggccgagcccaagctgctgccctgcctgcacagcttctgcctgcgctgcctgcctgagcctgagcggcagctgtctgtgcccatccctgggggcagcaatggagacatccagcaggtgggcgtcatccgctgccctgtgtgccggcaggagtgccggcagattgacctggtggacaactactttgtgaaggacaccagcgaggcccccagcagcagtgatgagaagtctgagcaggtgtgcaccagctgtgaagataatgccagcgctgtgggcttctgtgtggagtgtggggagtggctgtgcaagacctgcatcgaggcccaccagagggtgaagttcaccaaggaccacctgatcaggaagaaggaggatgtgtctgagagcgtgggcgccagcggccagaggcctgtgttctgccctgtgcacaagcaggagcagctgaagctgttctgtgagacctgtgaccggctgacctgccgggactgccagctgctggagcacaaggagcaccgctaccagttcctggaggaggccttccagaaccagaagggggccatcgagaacctgctggccaagctgctggagaagaagaactacgtgcactttgctgccacccaggtgcagaaccgcatcaaggaggtgaatgagaccaacaagagggtggagcaggagatcaaggtggccatcttcaccctcatcaatgagatcaacaagaagggcaagagcctgctgcagcagctggagaatgtgaccaaggagcggcagatgaagctgctgcagcagcagaatgacatcaccggcctgagccggcaggtgaagcacgtgatgaacttcaccaactgggccatcgccagcggcagcagcacagccctgctgtacagcaagaggctcatcaccttccagctgcggcacatcctgaaggcccgctgtgaccctgtgcctgctgccaacggggccatccgcttccactgtgaccccaccttctgggccaagaatgtggtgaacctgggcaacctggtgattgagagcaagccagcccctggctacaccccaaatgtggtggtgggccaggtgcccccaggcaccaaccacatcagcaagaccccaggccagatcaacctggcccagctgcggctgcagcacatgcagcagcaggtgtatgcccagaagcaccagcagctgcagcagatgaggatgcagcagcccccagcccctgtgcccaccaccaccaccaccacccagcagcacccccggcaggccgccccccagatgctgcagcagcagccccccaggctcatctctgtgcagaccatgcagaggggcaacatgaactgtggggccttccaggcccaccagatgaggctggcccagaatgctgcccgcatccctggcatccccaggcacagcggcccccagtacagcatgatgcagccccacctgcagaggcagcacagcaaccctggccatgctggccccttccctgtggtgtctgtgcacaacaccaccatcaaccccaccagccccaccacagccaccatggccaatgccaacagaggccccaccagccccagcgtgacagccatcgagctgatccccagcgtgaccaaccctgagaacctgcccagcctgcctgacatcccccccatccagctggaggatgctggcagcagcagcctggacaacctgctgagccgctacatcagcggcagccacctgcccccccagcccaccagcaccatgaaccccagccctggccccagcgccctgagccctggcagcagcggcctgagcaacagccacacccctgtgcggccccccagcaccagcagcacaggcagccggggcagctgtggcagcagcggccgcacagctgagaagaccagcctgtccttcaagagtgaccaggtgaaggtgaagcaggagcctggaacagaagatgagatctgcagcttctctggaggagtgaagcaggagaagacagaagatggaagaagaagtgcctgcatgctgagcagccctgagagcagcctgaccccacccctgagcaccaacctgcacctggagagcgagctggatgccctggccagcctggagaaccacgtgaagattgagcctgctgacatgaatgaaagctgcaagcagagcggcctgagcagcctggtgaatggcaagagccccatccgcagcctgatgcacaggtctgccagaattggaggagatggcaacaacaaggatgatgaccccaatgaagactggtgtgctgtgtgccagaatggaggagacctgctgtgctgtgagaagtgccccaaggtgttccacctgacctgccacgtgcccaccctgctgtccttccccagcggggactggatctgcaccttctgccgggacatcggcaagccagaggtggagtatgactgtgacaacctgcagcacagcaagaagggcaagacagcccagggcctgagccctgtggaccagaggaaatgtgagcggctgctgctgtacctgtactgccacgagctgagcattgagttccaggagcctgtgcctgccagcatccccaactactacaagatcatcaagaagcccatggacctgagcacagtgaagaagaagctgcagaagaagcacagccagcactaccagatcccagatgactttgtggctgatgtgcggctcatcttcaagaactgtgagcgcttcaatgaagctgacagcgaggtggcccaggccggcaaggctgtggccctgtactttgaggacaagctgacagagatctacagcgacaggacctttgcccccctgcctgagtttgagcaggaggaggatgatggagaggtgacagaggacagtgatgaggacttcatccagcccaggaggaagaggctgaagagtgatgagaggcctgtgcacatcaagtag

SEQ ID NO: 174253 - DNA, 2667 bp, Artificial Sequence
  Description of Artificial Sequence: Synthetic coding sequence
tgaagcgtgggcgccagcggccagaggcctgtgttctgccctgtgcacaagcaggagcagctgaagctgttctgtgagacctgtgaccggctgacctgccgggactgccagctgctggagcacaaggagcaccgctaccagttcctggaggaggccttccagaaccagaagggggccatcgagaacctgctggccaagctgctggagaagaagaactacgtgcactttgctgccacccaggtgcagaaccgcatcaaggaggtgaatgagaccaacaagagggtggagcaggagatcaaggtggccatcttcaccctcatcaatgagatcaacaagaagggcaagagcctgctgcagcagctggagaatgtgaccaaggagcggcagatgaagctgctgcagcagcagaatgacatcaccggcctgagccggcaggtgaagcacgtgatgaacttcaccaactgggccatcgccagcggcagcagcacagccctgctgtacagcaagaggctcatcaccttccagctgcggcacatcctgaaggcccgctgtgaccctgtgcctgctgccaatggagccatccgcttccactgtgaccccaccttctgggccaagaatgtggtgaacctgggcaacctggtgattgagagcaagccagcccctggctacacccccaacgtggtggtgggccaggtgcccccaggcaccaaccacatcagcaagaccccaggccagatcaacctggcccagctgcggctgcagcacatgcagcagcaggtgtatgcccagaagcaccagcagctgcagcagatgaggatgcagcagcccccagcccctgtgcccaccaccaccaccaccacccagcagcacccccggcaggccgccccccagatgctgcagcagcagccccccaggctcatctctgtgcagaccatgcagaggggcaacatgaactgtggggccttccaggcccaccagatgaggctggcccagaatgctgcccgcatccctggcatccccaggcacagcggcccccagtacagcatgatgcagccccacctgcagaggcagcacagcaaccctggccacgccggccccttccctgtggtgtctgtgcacaacaccaccatcaaccccaccagccccaccacagccaccatggccaatgccaacagaggccccaccagccccagcgtgacagccatcgagctgatccccagcgtgaccaaccctgagaacctgcccagcctgcctgacatcccccccatccaggccaacgtggtgcccatgatgcacagctggtatgaatttggagcccgggagaagacccaggaccagaatgtgctggaggatgctggcagcagcagcctggacaacctgctgagccgctacatcagcggcagccacctgcccccccagcccaccagcaccatgaaccccagccctggccccagcgccctgagccctggcagcagcggcctgagcaacagccacacccctgtgcggccccccagcaccagcagcacaggcagccggggcagctgtggcagcagcggccgcacagctgagaagaccagcctgtccttcaagagtgaccaggtgaaggtgaagcaggagcccggcacagaagatgagatctgcagcttcagcggcggcgtgaagcaggagaagacagaagatggccgccgcagcgcctgcatgctgagcagccctgagagcagcctgaccccacccctgagcaccaacctgcacctggagagcgagctggatgccctggccagcctggagaaccacgtgaagattgagcctgctgacatgaatgaaagctgcaagcagagcggcctgagcagcctggtgaatggcaagagccccatccgcagcctgatgcacaggtctgccagaattggaggagatggcaacaacaaggatgatgaccccaatgaagactggtgtgctgtgtgccagaatggaggagacctgctgtgctgtgagaagtgccccaaggtgttccacctgacctgccacgtgcccaccctgctgtccttccccagcggggactggatctgcaccttctgccgggacatcggcaagccagaggtggagtatgactgtgacaacctgcagcacagcaagaagggcaagacagcccagggcctgagccctgtggaccagaggaaatgtgagcggctgctgctgtacctgtactgccacgagctgagcattgagttccaggagcctgtgcctgccagcatccccaactactacaagatcatcaagaagcccatggacctgagcacagtgaagaagaagctgcagaagaagcacagccagcactaccagatcccagatgactttgtggctgatgtgcggctcatcttcaagaactgtgagcgcttcaatgagatgatgaaggtggtgcaggtgtatgctgacacccaggagatcaacctgaaggctgacagcgaggtggcccaggccggcaaggctgtggccctgtactttgaggacaagctgacagagatctacagcgacaggacctttgcccccctgcctgagtttgagcaggaggaggatgatggagaggtgacagaggacagtgatgaggacttcatccagcccaggaggaagaggctgaagagtgatgagaggcctgtgcacatcaagtag

SEQ ID NO: 174254 - DNA, 2280 bp, Artificial Sequence
  Description of Artificial Sequence: Synthetic coding sequence
atgaagctgctgcagcagcagaatgacatcaccggcctgagccggcaggtgaagcacgtgatgaacttcaccaactgggccatcgccagcggcagcagcacagccctgctgtacagcaagaggctcatcaccttccagctgcggcacatcctgaaggcccgctgtgaccctgtgcctgctgccaacggggccatccgcttccactgtgaccccaccttctgggccaagaatgtggtgaacctgggcaacctggtgattgagagcaagccagcccctggctacaccccaaatgtggtggtgggccaggtgcccccaggcaccaaccacatcagcaagaccccaggccagatcaacctggcccagctgcggctgcagcacatgcagcagcaggtgtatgcccagaagcaccagcagctgcagcagatgaggatgcagcagcccccagcccctgtgcccaccaccaccaccaccacccagcagcacccccggcaggccgccccccagatgctgcagcagcagccccccaggctcatctctgtgcagaccatgcagaggggcaacatgaactgtggggccttccaggcccaccagatgaggctggcccagaatgctgcccgcatccctggcatccccaggcacagcggcccccagtacagcatgatgcagccccacctgcagaggcagcacagcaaccctggccatgctggccccttccctgtggtgtctgtgcacaacaccaccatcaaccccaccagccccaccacagccaccatggccaatgccaacagaggccccaccagccccagcgtgacagccatcgagctgatccccagcgtgaccaaccctgagaacctgcccagcctgcctgacatcccccccatccaggccaacgtggtgcccatgatgcacagctggtatgaatttggagcccgggagaagacccaggaccagaatgtgctggaggatgctggcagcagcagcctggacaacctgctgagccgctacatcagcggcagccacctgcccccccagcccaccagcaccatgaaccccagccctggccccagcgccctgagccctggcagcagcggcctgagcaacagccacacccctgtgcggccccccagcaccagcagcacaggcagccggggcagctgtggcagcagcggccgcacagctgagaagaccagcctgtccttcaagagtgaccaggtgaaggtgaagcaggagcctggaacagaagatgagatctgcagcttctctggaggagtgaagcaggagaagacagaagatggaagaagaagtgcctgcatgctgagcagccctgagagcagcctgaccccacccctgagcaccaacctgcacctggagagcgagctggatgccctggccagcctggagaaccacgtgaagattgagcctgctgacatgaatgaaagctgcaagcagagcggcctgagcagcctggtgaatggcaagagccccatccgcagcctgatgcacaggtctgccagaattggaggagatggcaacaacaaggatgatgaccccaatgaagactggtgtgctgtgtgccagaatggaggagacctgctgtgctgtgagaagtgccccaaggtgttccacctgacctgccacgtgcccaccctgctgtccttccccagcggggactggatctgcaccttctgccgggacatcggcaagccagaggtggagtatgactgtgacaacctgcagcacagcaagaagggcaagacagcccagggcctgagccctgtggaccagaggaaatgtgagcggctgctgctgtacctgtactgccacgagctgagcattgagttccaggagcctgtgcctgccagcatccccaactactacaagatcatcaagaagcccatggacctgagcacagtgaagaagaagctgcagaagaagcacagccagcactaccagatcccagatgactttgtggctgatgtgcggctcatcttcaagaactgtgagcgcttcaatgagatgatgaaggtggtgcaggtgtatgctgacacccaggagatcaacctgaaggctgacagcgaggtggcccaggccggcaaggctgtggccctgtactttgaggacaagctgacagagatctacagcgacaggacctttgcccccctgcctgagtttgagcaggaggaggatgatggagaggtgacagaagattctgatgaggacttcatccagcccaggaggaagaggctgaagagtgatgagaggcctgtgcacatcaagtag

SEQ ID NO: 174255 - DNA, 2529 bp, Artificial Sequence
  Description of Artificial Sequence: Synthetic coding sequence
atgtgtggcagcgagcgcatcctgcaggccggcaacatcctggagatccgggtgggccaggccggggcccggcgggtggccaccatgaccagccctgtgctggtggacatccgggaggaggtgacctgccccatctgcctggagctgctgacagagcccctgagcattgactgtggccacagcttctgccaggcctgcatcacccccaacggccgggagagcgtcatcggccaggagggggagaggagctgccctgtgtgccagaccagctaccagcccggcaacctgcggcccaacagacacctggccaacatcgtgcggcggctgcgggaggtggtgctgggccctgggaagcagctgaaggctgtgctgtgtgccgaccacggggagaagctgcagctgttctgccaggaggatggcaaggtgatctgctggctgtgtgagaggagccaggagcaccggggccaccacaccttcctggtggaggaggtggcccaggagtaccaggagaagttccaggagagcctgaagaagctgaagaatgaggagcaggaggccgagaagctgacagccttcatccgggagaagaagacctcctggaagaaccagatggagcctgagcgctgccgcatccagacagagttcaaccagctgaggaacatcctggacagagtggagcagcgggagctgaagaagctggagcaggaggagaagaagggcctgcgcatcatcgaggaggccgagaatgacctggtgcaccagacccagagcctgcgggagctgatcagtgacctggagcggcgctgccagggcagcaccatggagctgctgcaggatgtgtctgatgtgacagagaggtctgagttctggaccctgaggaagccagaggccctgcccaccaagctgcgctccatgttccgggccccagacctgaagaggatgctgcgggtgtgccgggagctgacagatgtgcagagctactgggccatccagggcagcctgacccggcgggagcggcgggccagcggcgtgaggaccaggaggagccagggcagcagcgccatggccagcaagatcctgctgaatgtgcaggaggaggtgacctgccccatctgcctggagctgctgacagagcccctgagcctggactgtggccacagcctgtgccgggcctgcatcaccgtgagcaacaaggaggccgtgacctccatgggcggcaagagcagctgccctgtgtgtggcatctcctacagctttgagcacctgcaggccaaccagcacctggccaacatcgtggagcggctgaaggaggtgaagctgagcccagacaacgggaagaagagggacctgtgtgaccaccacggggagaagctgctgctcttctgcaaggaggacaggaaggtgatctgctggctgtgtgagaggagccaggagcaccggggccaccacacagtgctgacagaggaggtgttcaaggagtgccaggagaagctgcaggccgtgctgaagaggctgaagaaggaggaggaggaggccgagaagctggaggccgacatccgggaggagaagacctcctggaagtaccaggtgcagacagagcggcagaggatccagacagaatttgaccagctgcggagcatcctgaacaatgaggagcagcgggagctgcagaggctggaggaggaggagaagaagaccctggacaagtttgctgaggccgaggatgagctggtgcagcagaagcagctggtgcgggagctgatcagtgatgtggagtgccgcagccagtggagcaccatggagctgctgcaggacatgagcggcatcatgaagtggagcgagatctggaggctgaagaagcccaagatggtgtccaagaagctgaagacagtgttccacgccccagacctgagcaggatgctgcagatgttccgggagctgacagctgtgcgctgctactgggtggatgtgaccctgaacagcgtgaacctgaacctgaacctggtgctgtctgaggaccagaggcaggtgatctctgtgcccatctggcccttccagtgctacaactacggcgtgctgggcagccagtacttcagcagcggcaagcactactgggaggtggatgtgtccaagaagacagcctggatcctgggcgtgtactgcaggacctacagccgccacatgaagtatgtggtgagaagatgtgccaaccggcagaacctgtacaccaagtaccggcccctgtttggctactgggtgattggcctgcagaacaagtgcaagtatggagtgtttgaggagagcctgagcagtgaccctgaggtgctgaccctgtccatggctgtgcccccctgccgggtgggcgtcttcctggactatgaagctggcatcgtgtccttcttcaacgtgaccagccacggcagcctcatctacaagttcagcaagtgctgcttcagccagcctgtgtacccctacttcaacccctggaactgcccagcccccatgaccctgtgcccccccagcagctag

SEQ ID NO: 174256 - DNA, 1467 bp, Artificial Sequence
  Description of Artificial Sequence: Synthetic coding sequence
atggccagcaagatcctgctgaatgtgcaggaggaggtgacctgccccatctgcctggagctgctgacagagcccctgagcctggactgtggccacagcctgtgccgggcctgcatcaccgtgagcaacaaggaggccgtgacctccatgggcggcaagagcagctgccctgtgtgtggcatctcctacagctttgagcacctgcaggccaaccagcacctggccaacatcgtggagcggctgaaggaggtgaagctgagcccagacaacgggaagaagagggacctgtgtgaccaccacggggagaagctgctgctcttctgcaaggaggacaggaaggtgatctgctggctgtgtgagaggagccaggagcaccggggccaccacacagtgctgacagaggaggtgttcaaggagtgccaggagaagctgcaggccgtgctgaagaggctgaagaaggaggaggaggaggccgagaagctggaggccgacatccgggaggagaagacctcctggaagtaccaggtgcagacagagcggcagaggatccagacagaatttgaccagctgcggagcatcctgaacaatgaggagcagcgggagctgcagaggctggaggaggaggagaagaagaccctggacaagtttgctgaggccgaggatgagctggtgcagcagaagcagctggtgcgggagctgatcagtgatgtggagtgccgcagccagtggagcaccatggagctgctgcaggacatgagcggcatcatgaagtggagcgagatctggaggctgaagaagcccaagatggtgtccaagaagctgaagacagtgttccacgccccagacctgagcaggatgctgcagatgttccgggagctgacagctgtgcgctgctactgggtggatgtgaccctgaacagcgtgaacctgaacctgaacctggtgctgtctgaggaccagaggcaggtgatctctgtgcccatctggcccttccagtgctacaactacggcgtgctgggcagccagtacttcagcagcggcaagcactactgggaggtggatgtgtccaagaagacagcctggatcctgggcgtgtactgcaggacctacagccgccacatgaagtatgtggtgagaagatgtgccaaccggcagaacctgtacaccaagtaccggcccctgtttggctactgggtgattggcctgcagaacaagtgcaagtatggagtgtttgaggagagcctgagcagtgaccctgaggtgctgaccctgtccatggctgtgcccccctgccgggtgggcgtcttcctggactatgaagctggcatcgtgtccttcttcaacgtgaccagccacggcagcctcatctacaagttcagcaagtgctgcttcagccagcctgtgtacccctacttcaacccctggaactgcccagcccccatgaccctgtgcccccccagcagctag

SEQ ID NO: 174257 - DNA, 1467 bp, Artificial Sequence; identical to SEQ ID NO: 174256
  Description of Artificial Sequence: Synthetic coding sequence

SEQ ID NO: 174258 - DNA, 1467 bp, Artificial Sequence; identical to SEQ ID NO: 174256
  Description of Artificial Sequence: Synthetic coding sequence

SEQ ID NO: 174259 - DNA, 2187 bp, Artificial Sequence
  Description of Artificial Sequence: Synthetic coding sequence
atgtctgagagcggggagatgtctgaatttggctacatcatggagctgattgccaagggcaaggtgaccatcaagaacatcgagcgggagctgatctgcccagcctgcaaggagctgttcacccaccccctcatcctgccctgccagcacagcatctgccacaagtgtgtgaaggagctgctgctgaccctggatgacagcttcaatgatgtgggcagtgacaacagcaaccagagcagcccccggctgcggctgcccagccccagcatggacaagattgaccgcatcaacagacctggctggaagaggaacagcctgacccccaggaccaccgtcttcccctgccccggctgtgaacatgatgtggacctgggggagcggggcatcaatggcctcttcaggaacttcaccctggagaccatcgtggagcgctaccggcaggccgcccgggccgccacagccatcatgtgtgacctgtgcaagcccccaccccaggagagcaccaagagctgcatggactgcagcgccagctactgcaatgaatgcttcaagatccaccacccctggggcaccatcaaggcccagcacgagtatgtgggccccaccaccaacttccggcccaagatcctgatgtgcccagagcatgaaacagagcgcatcaacatgtactgtgagctgtgccggcggcctgtgtgccacctgtgcaagctgggcggcaaccacgccaaccaccgggtgaccaccatgagcagcgcctacaagaccctgaaggagaagctgagcaaggacatcgactacctgattggcaaggagagccaggtgaagagccagatcagcgagctgaacctgctgatgaaggagacagaatgtaatggagagcgggccaaggaggaggccatcacccactttgagaagctgtttgaggtgctggaggagaggaagagctctgtgctgaaggccatcgacagcagcaagaagctgcggctggacaagttccagacccagatggaggagtaccagggcctgctggagaacaacggcctggtgggctacgcccaggaggtgctgaaggagacagaccagagctgctttgtgcagacagccaagcagctgcacctgcgcatccagaaggccacagagagcctgaagagcttccggcctgctgcccagaccagctttgaggactatgtggtgaacaccagcaagcagacagagctgctgggggagctgtccttcttcagcagcggcattgatgtgcctgagatcaatgaggagcagagcaaggtgtacaacaatgccctgatcaactggcaccaccctgagaaggacaaggctgacagctatgtgctggagtacaggaagatcaacagagatgatgagatgtcctggaatgaaattgaggtgtgtggcaccagcaagatcatccaggacctggagaacagcagcacctacgccttccgggtgcgggcctacaagggcagcatctgcagcccctgcagccgggagctgatcctgcacaccccaccagcccctgtgttctccttcctgtttgatgagaagtgtggctacaacaatgagcacctgctgctgaacctgaagagggacagagtggagagcagagctggcttcaacctgctgctggccgctgagcgcatccaggtgggctactacaccagcctggactacatcatcggggacaccggcatcaccaagggcaagcacttctgggccttccgggtggagccctacagctacctggtgaaggtgggcgtggccagcagtgacaagctgcaggagtggctgcggagccccagagatgctgtgagccccaggtatgagcaggacagcggccatgacagcggctctgaagatgcctgctttgacagcagccagcccttcaccctggtgaccatcggcatgcagaagttcttcatccccaagagccccaccagcagcaatgaacctgagaacagagtgctgcccatgcccaccagcatcggcatcttcctggactgtgacaagggcaaggtggacttctatgacatggaccagatgaagtgcctgtatgagcggcaggtggactgcagccacaccctgtacccagcctttgccctgatgggcagcggcggcatccagctggaggagcccatcacagccaagtacctggagtaccaggaggacatgtag

SEQ ID NO: 174260 - DNA, 186 bp, Artificial Sequence
  Description of Artificial Sequence: Synthetic coding sequence
atgtctgagagcggggagatgtctgaatttggctacatcatggagctgattgccaagggcaaggccagcgccatgggcctgcagcagacccatgagcacagccggctgaccagcaaaggaggagaggcccgctgcccctttgagatcagcgaggtgggcaagcagagcctgcccaggagaacatag

SEQ ID NO: 174261 - DNA, 183 bp, Artificial Sequence
  Description of Artificial Sequence: Synthetic coding sequence
atgtctgagagcggggagatgtctgaatttggctacatcatggagctgattgccaagggcaagatgccagactggaggcggggctaccgctgccggcagggctgcggcaagaccacagagctggccacagccacagacttcagccagacaggcaacaagagcggcaagcacttcaagacctag

SEQ ID NO: 174262 - DNA, 2895 bp, Artificial Sequence
  Description of Artificial Sequence: Synthetic coding sequence
atggatgagcagagcgtggagagcattgctgaggtgttccgctgcttcatctgcatggagaagctgagagatgcccggctgtgcccccactgcagcaagctgtgctgcttcagctgcatccgccgctggctgacagagcagagggcccagtgcccccactgccgggcccccctgcagctgcgggagctggtgaactgccgctgggccgaggaggtgacccagcagctggacaccctgcagctgtgcagcctgaccaagcatgaagaaaatgagaaggacaagtgtgagaaccaccacgagaagctgtctgtgttctgctggacctgcaagaagtgcatctgccaccagtgtgccctgtggggcggcatgcacggcggccacaccttcaagcccctggccgagatctatgagcagcacgtgaccaaggtgaatgaggaggtggccaagctgcggcggcggctgatggagctgatcagcctggtgcaggaggtggagagaaatgtggaggccgtgagaaatgccaaggatgagcgggtgcgggagatcagaaatgctgtggagatgatgattgcccggctggacacccagctgaagaacaagctgatcaccctgatgggccagaagaccagcctgacccaggagacagagctgctggagagcctgctgcaggaggtggagcaccagctgcggagctgcagcaagtctgagctgatcagcaagagcagcgagatcctgatgatgttccagcaggtgcacaggaagcccatggccagctttgtgaccacccctgtgcccccagacttcaccagcgagctggtgcccagctatgacagcgccacctttgtgctggagaacttcagcaccctgcggcagagagctgaccctgtgtacagcccccccctgcaggtgtctggcctgtgctggaggctgaaggtgtacccagatggaaatggagtggtgcggggctactacctgagcgtcttcctggagctgtctgctggcctgcctgagaccagcaaatatgagtacagagtggagatggtgcaccagagctgcaatgaccccaccaagaacatcatccgggagtttgccagtgactttgaggtgggggagtgctggggctacaaccgcttcttccggctggacctgctggccaatgaaggctacctgaacccccagaatgacaccgtcatcctgcgcttccaggtgcgcagccccaccttcttccagaagagccgggaccagcactggtacatcacccagctggaggccgcccagaccagctacatccagcagatcaacaacctgaaggagcggctgaccatcgagctgagcaggacccagaagagccgggacctgagccccccagacaaccacctgagcccccagaatgatgatgccctggagacccgggccaagaagagcgcctgcagcgacatgctgctggagggcggccccaccacagcctctgtgcgggaggccaaggaggatgaagaagatgaggagaagatccagaatgaagactaccaccacgagctgagtgatggagacctggacctggacctggtgtatgaagatgaggtgaaccagctggatggcagcagcagcagcgccagcagcacagccaccagcaacacagaggagaatgacattgatgaggagaccatgtctggagaaaatgatgtggagtacaacaacatggagctggaggagggggagctgatggaggatgctgctgctgctggccctgctggcagcagccacggctacgtgggcagcagcagccgcatcagcaggaggacccacctgtgcagcgctgccaccagcagcctgctggacatcgaccccctcatcctgatccacctgctggacctgaaggacaggagcagcattgagaacctgtggggcctgcagccccggcccccagccagcctgctgcagcccacagccagctacagcaggaaggacaaggaccagaggaagcagcaggccatgtggagggtgcccagcgacctgaagatgctgaagaggctgaagacccagatggccgaggtgcgctgcatgaagacagatgtgaagaacaccctgtctgagatcaagagcagcagcgctgccagcggggacatgcagaccagcctcttctctgctgaccaggccgccctggccgcctgtggcacagaaaattctggccgcctgcaggacctgggcatggagctgctggccaagagctctgtggccaactgctacatccggaacagcaccaacaagaagagcaacagccccaagccagcccggagctctgtggccggcagcctgagcctgcggcgggctgtggaccccggggagaacagccgcagcaaaggagactgccagaccctgtctgagggcagccctggcagcagccagagcggcagccgccacagcagcccccgggccctgattcatggcagcatcggggacatcctgcccaagacagaggaccggcagtgcaaggccctggacagtgatgctgtggtggtggccgtgttcagcggcctgcctgctgtggagaagaggaggaagatggtgaccctgggcgccaatgccaagggcggccacctggagggcctgcagatgacagacctggagaacaacagcgagactggagagctgcagcctgtgctgcctgagggcgccagcgctgcccctgaggagggcatgagcagtgacagcgacattgaatgtgacacagaaaatgaggagcaggaggagcacacctctgtgggcggcttccatgacagcttcatggtgatgacccagcccccagatgaggacacccacagcagcttcccagatggagagcagatcggccctgaggacctgtccttcaacacagatgagaacagcggccgctag

SEQ ID NO: 174263 - DNA, 2412 bp, Artificial Sequence
  Description of Artificial Sequence: Synthetic coding sequence
atgcacggcggccacaccttcaagcccctggccgagatctatgagcagcacgtgaccaaggtgaatgaggaggtggccaagctgcggcggcggctgatggagctgatcagcctggtgcaggaggtggagagaaatgtggaggccgtgagaaatgccaaggatgagcgggtgcgggagatcagaaatgctgtggagatgatgattgcccggctggacacccagctgaagaacaagctgatcaccctgatgggccagaagaccagcctgacccaggagacagagctgctggagagcctgctgcaggaggtggagcaccagctgcggagctgcagcaagtctgagctgatcagcaagagcagcgagatcctgatgatgttccagcaggtgcacaggaagcccatggccagctttgtgaccacccctgtgcccccagacttcaccagcgagctggtgcccagctatgacagcgccacctttgtgctggagaacttcagcaccctgcggcagagagctgaccctgtgtacagcccccccctgcaggtgtctggcctgtgctggaggctgaaggtgtacccagatggaaatggagtggtgcggggctactacctgagcgtcttcctggagctgtctgctggcctgcctgagaccagcaaatatgagtacagagtggagatggtgcaccagagctgcaatgaccccaccaagaacatcatccgggagtttgccagtgactttgaggtgggggagtgctggggctacaaccgcttcttccggctggacctgctggccaatgaaggctacctgaacccccagaatgacaccgtcatcctgcgcttccaggtgcgcagccccaccttcttccagaagagccgggaccagcactggtacatcacccagctggaggccgcccagaccagctacatccagcagatcaacaacctgaaggagcggctgaccatcgagctgagcaggacccagaagagccgggacctgagccccccagacaaccacctgagcccccagaatgatgatgccctggagacccgggccaagaagagcgcctgcagcgacatgctgctggagggcggccccaccacagcctctgtgcgggaggccaaggaggatgaagaagatgaggagaagatccagaatgaagactaccaccacgagctgagtgatggagacctggacctggacctggtgtatgaagatgaggtgaaccagctggatggcagcagcagcagcgccagcagcacagccaccagcaacacagaggagaatgacattgatgaggagaccatgtctggagaaaatgatgtggagtacaacaacatggagctggaggagggggagctgatggaggatgctgctgctgctggccctgctggcagcagccacggctacgtgggcagcagcagccgcatcagcaggaggacccacctgtgcagcgctgccaccagcagcctgctggacatcgaccccctcatcctgatccacctgctggacctgaaggacaggagcagcattgagaacctgtggggcctgcagccccggcccccagccagcctgctgcagcccacagccagctacagcaggaaggacaaggaccagaggaagcagcaggccatgtggagggtgcccagcgacctgaagatgctgaagaggctgaagacccagatggccgaggtgcgctgcatgaagacagatgtgaagaacaccctgtctgagatcaagagcagcagcgctgccagcggggacatgcagaccagcctcttctctgctgaccaggccgccctggccgcctgtggcacagaaaattctggccgcctgcaggacctgggcatggagctgctggccaagagctctgtggccaactgctacatccggaacagcaccaacaagaagagcaacagccccaagccagcccggagctctgtggccggcagcctgagcctgcggcgggctgtggaccccggggagaacagccgcagcaaaggagactgccagaccctgtctgagggcagccctggcagcagccagagcggcagccgccacagcagcccccgggccctgattcatggcagcatcggggacatcctgcccaagacagaggaccggcagtgcaaggccctggacagtgatgctgtggtggtggccgtgttcagcggcctgcctgctgtggagaagaggaggaagatggtgaccctgggcgccaatgccaagggcggccacctggagggcctgcagatgacagacctggagaacaacagcgagactggagagctgcagcctgtgctgcctgagggcgccagcgctgcccctgaggaggacacccacagcagcttcccagatggagagcagatcggccctgaggacctgtccttcaacacagatgaaaattctggaagatag

SEQ ID NO: 174264 - DNA, 2793 bp, Artificial Sequence
  Description of Artificial Sequence: Synthetic coding sequence
atggatgagcagagcgtggagcgctggctgacagagcagagggcccagtgcccccactgccgggcccccctgcagctgcgggagctggtgaactgccgctgggccgaggaggtgacccagcagctggacaccctgcagctgtgcagcctgaccaagcatgaagaaaatgagaaggacaagtgtgagaaccaccacgagaagctgtctgtgttctgctggacctgcaagaagtgcatctgccaccagtgtgccctgtggggcggcatgcacggcggccacaccttcaagcccctggccgagatctatgagcagcacgtgaccaaggtgaatgaggaggtggccaagctgcggcggcggctgatggagctgatcagcctggtgcaggaggtggagagaaatgtggaggccgtgagaaatgccaaggatgagcgggtgcgggagatcagaaatgctgtggagatgatgattgcccggctggacacccagctgaagaacaagctgatcaccctgatgggccagaagaccagcctgacccaggagacagagctgctggagagcctgctgcaggaggtggagcaccagctgcggagctgcagcaagtctgagctgatcagcaagagcagcgagatcctgatgatgttccagcaggtgcacaggaagcccatggccagctttgtgaccacccctgtgcccccagacttcaccagcgagctggtgcccagctatgacagcgccacctttgtgctggagaacttcagcaccctgcggcagagagctgaccctgtgtacagcccccccctgcaggtgtctggcctgtgctggaggctgaaggtgtacccagatggaaatggagtggtgcggggctactacctgagcgtcttcctggagctgtctgctggcctgcctgagaccagcaaatatgagtacagagtggagatggtgcaccagagctgcaatgaccccaccaagaacatcatccgggagtttgccagtgactttgaggtgggggagtgctggggctacaaccgcttcttccggctggacctgctggccaatgaaggctacctgaacccccagaatgacaccgtcatcctgcgcttccaggtgcgcagccccaccttcttccagaagagccgggaccagcactggtacatcacccagctggaggccgcccagaccagctacatccagcagatcaacaacctgaaggagcggctgaccatcgagctgagcaggacccagaagagccgggacctgagccccccagacaaccacctgagcccccagaatgatgatgccctggagacccgggccaagaagagcgcctgcagcgacatgctgctggagggcggccccaccacagcctctgtgcgggaggccaaggaggatgaagaagatgaggagaagatccagaatgaagactaccaccacgagctgagtgatggagacctggacctggacctggtgtatgaagatgaggtgaaccagctggatggcagcagcagcagcgccagcagcacagccaccagcaacacagaggagaatgacattgatgaggagaccatgtctggagaaaatgatgtggagtacaacaacatggagctggaggagggggagctgatggaggatgctgctgctgctggccctgctggcagcagccacggctacgtgggcagcagcagccgcatcagcaggaggacccacctgtgcagcgctgccaccagcagcctgctggacatcgaccccctcatcctgatccacctgctggacctgaaggacaggagcagcattgagaacctgtggggcctgcagccccggcccccagccagcctgctgcagcccacagccagctacagcaggaaggacaaggaccagaggaagcagcaggccatgtggagggtgcccagcgacctgaagatgctgaagaggctgaagacccagatggccgaggtgcgctgcatgaagacagatgtgaagaacaccctgtctgagatcaagagcagcagcgctgccagcggggacatgcagaccagcctcttctctgctgaccaggccgccctggccgcctgtggcacagaaaattctggccgcctgcaggacctgggcatggagctgctggccaagagctctgtggccaactgctacatccggaacagcaccaacaagaagagcaacagccccaagccagcccggagctctgtggccggcagcctgagcctgcggcgggctgtggaccccggggagaacagccgcagcaaaggagactgccagaccctgtctgagggcagccctggcagcagccagagcggcagccgccacagcagcccccgggccctgattcatggcagcatcggggacatcctgcccaagacagaggaccggcagtgcaaggccctggacagtgatgctgtggtggtggccgtgttcagcggcctgcctgctgtggagaagaggaggaagatggtgaccctgggcgccaatgccaagggcggccacctggagggcctgcagatgacagacctggagaacaacagcgagactggagagctgcagcctgtgctgcctgagggcgccagcgctgcccctgaggagggcatgagcagtgacagcgacattgaatgtgacacagaaaatgaggagcaggaggagcacacctctgtgggcggcttccatgacagcttcatggtgatgacccagcccccagatgaggacacccacagcagcttcccagatggagagcagatcggccctgaggacctgtccttcaacacagatgagaacagcggccgctag

SEQ ID NO: 174265 - DNA, 2895 bp, Artificial Sequence; identical to SEQ ID NO: 174262
  Description of Artificial Sequence: Synthetic coding sequence

SEQ ID NO: 174266 - DNA, 1557 bp, Artificial Sequence
  Description of Artificial Sequence: Synthetic coding sequence
atggccgagaccagcctgctggaggccggggccagcgctgccagcacagctgctgccctggagaacctgcaggtggaggccagctgcagcgtgtgcctggagtacctgaaggagcctgtgatcattgaatgtggccacaacttctgcaaggcctgcatcacccgctggtgggaggacctggagcgggacttcccctgccctgtgtgcaggaagaccagccgctaccgcagcctgcggcccaaccggcagctgggctccatggtggagatcgccaagcagctgcaggccgtgaagaggaagatcagagatgagagcctgtgcccccagcaccacgaggccctgagcctcttctgctatgaggaccaggaggccgtgtgcctgatctgtgccatcagccacacccaccgggcccacacagtggtgcccctggatgatgccacccaggagtacaaggagaagctgcagaagtgcctggagcccctggagcagaagctgcaggagatcacccgctgcaagagcagcgaggagaagaagccaggagagctgaagaggctggtggagagccggcggcagcagatcctgcgggagtttgaggagctgcaccggcggctggatgaggagcagcaggtgctgctgagccggctggaggaggaggagcaggacatcctgcagaggctgcgggagaatgctgcccacctgggggacaagagaagagacctggcccacctggccgctgaggtggagggcaagtgcctgcagagcggctttgagatgctgaaggatgtgaagagcaccctggagaagaacatccccaggaagtttggaggcagcctgagcaccatctgcccccgggaccacaaggccctgctgggcctggtgaaggagatcaacagatgtgagaaggtgaagaccatggaggtgacctctgtgtccattgagctggagaagaacttcagcaacttcccccggcagtactttgccctgaggaagatcctgaagcagctgattgctgatgtgaccctggaccctgagacagcccaccccaacctggtgctgtctgaggacaggaagtctgtgaagtttgtggagacccggctgcgggacctgcctgacaccccccggcgcttcaccttctacccctgtgtgctggccacagagggcttcaccagcggccgccactactgggaggtggaggtgggggacaagacccactgggccgtgggcgtgtgccgggacagcgtgtccaggaaaggagagctgacccccctgcctgagaccggctactggagggtgcggctgtggaatggagacaagtatgctgccaccaccacccccttcacccccctgcacatcaaggtgaagcccaagagggtgggcatcttcctggactatgaggccggcaccctgtccttctacaacgtgacagacaggagccacatctacaccttcacagacaccttcacagagaagctgtggcccctcttctacccaggcatccgggccggcaggaagaatgctgcccccctgaccatccggcccccaacagactgggagtag

SEQ ID NO: 174267 - DNA, 1467 bp, Artificial Sequence
  Description of Artificial Sequence: Synthetic coding sequence
atggccgagaccagcctgctggaggccggggccagcgctgccagcacagctgctgccctggagaacctgcaggtggaggccagctgcagcgtgtgcctggagtacctgaaggagcctgtgatcattgaatgtggccacaacttctgcaaggcctgcatcacccgctggtgggaggacctggagcgggacttcccctgccctgtgtgcaggaagaccagccgctaccgcagcctgcggcccaaccggcagctgggctccatggtggagatcgccaagcagctgcaggccgtgaagaggaagatcagagatgagagcctgtgcccccagcaccacgaggccctgagcctcttctgctatgaggaccaggaggccgtgtgcctgatctgtgccatcagccacacccaccgggcccacacagtggtgcccctggatgatgccacccaggagtacaaggagaagctgcagaagtgcctggagcccctggagcagaagctgcaggagatcacccgctgcaagagcagcgaggagaagaagccaggagagctgaagaggctggtggagagccggcggcagcagatcctgcgggagtttgaggagctgcaccggcggctggatgaggagcagcaggtgctgctgagccggctggaggaggaggagcaggacatcctgcagaggctgcgggagaatgctgcccacctgggggacaagagaagagacctggcccacctggccgctgaggtggagggcaagtgcctgcagagcggctttgagatgctgaaggatgtgaagagcaccctggagaagtgtgagaaggtgaagaccatggaggtgacctctgtgtccattgagctggagaagaacttcagcaacttcccccggcagtactttgccctgaggaagatcctgaagcagctgattgctgatgtgaccctggaccctgagacagcccaccccaacctggtgctgtctgaggacaggaagtctgtgaagtttgtggagacccggctgcgggacctgcctgacaccccccggcgcttcaccttctacccctgtgtgctggccacagagggcttcaccagcggccgccactactgggaggtggaggtgggggacaagacccactgggccgtgggcgtgtgccgggacagcgtgtccaggaaaggagagctgacccccctgcctgagaccggctactggagggtgcggctgtggaatggagacaagtatgctgccaccaccacccccttcacccccctgcacatcaaggtgaagcccaagagggtgggcatcttcctggactatgaggccggcaccctgtccttctacaacgtgacagacaggagccacatctacaccttcacagacaccttcacagagaagctgtggcccctcttctacccaggcatccgggccggcaggaagaatgctgcccccctgaccatccggcccccaacagactgggagtag

SEQ ID NO: 174268 - DNA, 1467 bp, Artificial Sequence; identical to SEQ ID NO: 174267
  Description of Artificial Sequence: Synthetic coding sequence

SEQ ID NO: 174269 - DNA, 1557 bp, Artificial Sequence; identical to SEQ ID NO: 174266
  Description of Artificial Sequence: Synthetic coding sequence

SEQ ID NO: 174270 - DNA, 1467 bp, Artificial Sequence; identical to SEQ ID NO: 174267
  Description of Artificial Sequence: Synthetic coding sequence

SEQ ID NO: 174271 - DNA, 1557 bp, Artificial Sequence; identical to SEQ ID NO: 174266
  Description of Artificial Sequence: Synthetic coding sequence

SEQ ID NO: 174272 - DNA, 1467 bp, Artificial Sequence; identical to SEQ ID NO: 174267
  Description of Artificial Sequence: Synthetic coding sequence

SEQ ID NO: 174273 - DNA, 1467 bp, Artificial Sequence; identical to SEQ ID NO: 174267
  Description of Artificial Sequence: Synthetic coding sequence

SEQ ID NO: 174274 - DNA, 1467 bp, Artificial Sequence; identical to SEQ ID NO: 174267
  Description of Artificial Sequence: Synthetic coding sequence

SEQ ID NO: 174275 - DNA, 435 bp, Artificial Sequence
  Description of Artificial Sequence: Synthetic coding sequence
atggccgagaccagcctgctggaggccggggccagcgctgccagcacagctgctgccctggagaacctgcaggtggaggccagctgcagcgtgtgcctggagtacctgaaggagcctgtgatcattgaatgtggccacaacttctgcaaggcctgcatcacccgctggtgggaggacctggagcgggacttcccctgccctgtgtgcaggaagaccagccgctaccgcagcctgcggcccaaccggcagctgggctccatggtggagatcgccaagcagctgcaggccgtgaagaggaagatcagagatgagagcctgtgcccccagcaccacgaggccctgagcctcttctgctatgaggaccaggaggccgtgtgcctgatctgtgccatcagccacacccaccgggcccacacagtggtgcccctggactag

SEQ ID NO: 174276 - DNA, 684 bp, Artificial Sequence
  Description of Artificial Sequence: Synthetic coding sequence
tgaaccagccgctaccgcagcctgcggcccaaccggcagctgggctccatggtggagatcgccaagcagctgcaggccgtgaagaggaagatcagagatgagagcctgtgcccccagcaccacgaggccctgagcctcttctgctatgaggaccaggaggccgtgtgcctgatctgtgccatcagccacacccaccgggcccacacagtggtgcccctggatgatgccacccaggagtacaaggagaagctgcagaagtgcctggagcccctggagcagaagctgcaggagatcacccgctgcaagagcagcgaggagaagaagccaggagagctgaagaggctggtggagagccggcggcagcagatcctgcgggagtttgaggagctgcaccggcggctggatgaggagcagcaggtgctgctgagccggctggaggaggaggagcaggacatcctgcagaggctgcgggagaatgctgcccacctgggggacaagagaagagacctggcccacctggccgctgaggtggagggcaagtgcctgcagagcggctttgagatgctgaaggatgtgaagagcaccctggagaagtgtgagaaggtgaagaccatggaggtgaccagcaccaccccctgcaccagcctgcacagcgagatcaatgacaacgtgcggggccgctag

SEQ ID NO: 174277 - DNA, 225 bp, Artificial Sequence
  Description of Artificial Sequence: Synthetic coding sequence
atggccgagaccagcctgctggaggccggggccagcgctgccagcacagctgctgccctggagaacctgcaggtggaggccagctgcagcgtgtgcctggagtacctgaaggagcctgtgatcattgaatgtggccacaacttctgcaaggcctgcatcacccgctggtgggaggacctggagcgggacttcccctgccctgtgtgcaggaagaccagcaggtag

SEQ ID NO: 174278 - DNA, 1254 bp, Artificial Sequence
  Description of Artificial Sequence: Synthetic coding sequence
atggtggagatcgccaagcagctgcaggccgtgaagaggaagatcagagatgagagcctgtgcccccagcaccacgaggccctgagcctcttctgctatgaggaccaggaggccgtgtgcctgatctgtgccatcagccacacccaccgggcccacacagtggtgcccctggatgatgccacccaggagtacaaggagaagctgcagaagtgcctggagcccctggagcagaagctgcaggagatcacccgctgcaagagcagcgaggagaagaagccaggagagctgaagaggctggtggagagccggcggcagcagatcctgcgggagtttgaggagctgcaccggcggctggatgaggagcagcaggtgctgctgagccggctggaggaggaggagcaggacatcctgcagaggctgcgggagaatgctgcccacctgggggacaagagaagagacctggcccacctggccgctgaggtggagggcaagtgcctgcagagcggctttgagatgctgaagcctgtgctgagcgcccgggaggagtgtgagaaggtgaagaccatggaggtgacctctgtgtccattgagctggagaagaacttcagcaacttcccccggcagtactttgccctgaggaagatcctgaagcagctgattgctgatgtgaccctggaccctgagacagcccaccccaacctggtgctgtctgaggacaggaagtctgtgaagtttgtggagacccggctgcgggacctgcctgacaccccccggcgcttcaccttctacccctgtgtgctggccacagagggcttcaccagcggccgccactactgggaggtggaggccgcccactgtgtgctggcccaggaccctgagaaccaggccctggcccgcttctactgctacacagagaggaccatcgccaagaggctggtgctgcggcgggaccccagcgtgaagaggaccctgtgccggggctgcagcagcctgctggtgcccggcctgacctgcacccagaggcagaggcgctgccggggccagcgctggacagtgcagacctgcctgacctgccagaggagccagcgcttcctgaatgaccccggccacctgctgtggggagacaggcctgaggcccagctgggcagccaggccgacagcaagcccctgcagcccctgcccaacacagcccacagcatcagtgaccggctgcctgaggagaagatgcagacccagggcagcagcaaccagtag

SEQ ID NO: 174279 - DNA, 1557 bp, Artificial Sequence; identical to SEQ ID NO: 174266
  Description of Artificial Sequence: Synthetic coding sequence

SEQ ID NO: 174280 - DNA, 1467 bp, Artificial Sequence; identical to SEQ ID NO: 174267
  Description of Artificial Sequence: Synthetic coding sequence

SEQ ID NO: 174281 - DNA, 435 bp, Artificial Sequence; identical to SEQ ID NO: 174275
  Description of Artificial Sequence: Synthetic coding sequence

SEQ ID NO: 174282 - DNA, 225 bp, Artificial Sequence; identical to SEQ ID NO: 174277
  Description of Artificial Sequence: Synthetic coding sequence

SEQ ID NO: 174283 - DNA, 147 bp, Artificial Sequence
  Description of Artificial Sequence: Synthetic coding sequence
atggccgagaccagcctgctggaggccggggccagcgctgccagcacagctgctgccctggagaacctgcaggtggaggccagctgcagcgtgtgcctggagtacctgaaggagcctgtgatcattgaatgtggccacaacttctag

SEQ ID NO: 174284 - DNA, 1467 bp, Artificial Sequence; identical to SEQ ID NO: 174267
  Description of Artificial Sequence: Synthetic coding sequence

SEQ ID NO: 174285 - DNA, 684 bp, Artificial Sequence; identical to SEQ ID NO: 174276
  Description of Artificial Sequence: Synthetic coding sequence

SEQ ID NO: 174286 - DNA, 147 bp, Artificial Sequence; identical to SEQ ID NO: 174283
  Description of Artificial Sequence: Synthetic coding sequence

SEQ ID NO: 174287 - DNA, 147 bp, Artificial Sequence; identical to SEQ ID NO: 174283
  Description of Artificial Sequence: Synthetic coding sequence

SEQ ID NO: 174288 - DNA, 180 bp, Artificial Sequence
  Description of Artificial Sequence: Synthetic coding sequence
atggccgagaccagcctgctggaggccggggccagcgctgccagcacagctgctgccctggagaacctgcaggtggaggccagctgcagcgtgtgcctggagtacctgaaggagcctgtgatcattgaatgtggccacaacttctgcaaggcctgcatcacccgctggtgggaggactag

SEQ ID NO: 174289 - DNA, 180 bp, Artificial Sequence; identical to SEQ ID NO: 174288
  Description of Artificial Sequence: Synthetic coding sequence

SEQ ID NO: 174290 - DNA, 435 bp, Artificial Sequence; identical to SEQ ID NO: 174275
  Description of Artificial Sequence: Synthetic coding sequence

SEQ ID NO: 174291 - DNA, 1557 bp, Artificial Sequence; identical to SEQ ID NO: 174266
  Description of Artificial Sequence: Synthetic coding sequence

SEQ ID NO: 174292 - DNA, 684 bp, Artificial Sequence; identical to SEQ ID NO: 174276
  Description of Artificial Sequence: Synthetic coding sequence

SEQ ID NO: 174293 - DNA, 684 bp, Artificial Sequence; identical to SEQ ID NO: 174276
  Description of Artificial Sequence: Synthetic coding sequence

SEQ ID NO: 174294 - DNA, 147 bp, Artificial Sequence; identical to SEQ ID NO: 174283
  Description of Artificial Sequence: Synthetic coding sequence

SEQ ID NO: 174295 - DNA, 1557 bp, Artificial Sequence; identical to SEQ ID NO: 174266
  Description of Artificial Sequence: Synthetic coding sequence

SEQ ID NO: 174296 - DNA, 225 bp, Artificial Sequence; identical to SEQ ID NO: 174277
  Description of Artificial Sequence: Synthetic coding sequence

SEQ ID NO: 174297 - DNA, 180 bp, Artificial Sequence; identical to SEQ ID NO: 174288
  Description of Artificial Sequence: Synthetic coding sequence

SEQ ID NO: 174298 - DNA, 147 bp, Artificial Sequence; identical to SEQ ID NO: 174283
  Description of Artificial Sequence: Synthetic coding sequence

SEQ ID NO: 174299 - DNA, 786 bp, Artificial Sequence
  Description of Artificial Sequence: Synthetic coding sequence
atggccgagaccagcctgctggaggccggggccagcgctgccagcacagctgctgccctggagaacctgcaggtggaggccagctgcagcgtgtgcctggagtacctgaaggagcctgtgatcattgaatgtggccacaacttctgcaaggcctgcatcacccgctggtgggaggacctggagcgggacttcccctgccctgtgtgcaggaagaccagccgctaccgcagcctgcggcccaaccggcagctgggctccatggtggagatcgccaagcagctgcaggccgtgaagaggaagatcagagatgagagcctgtgcccccagcaccacgaggccctgagcctcttctgctatgaggaccaggaggccgtgtgcctgatctgtgccatcagccacacccaccgggcccacacagtggtgcccctggatgatgccacccaggagtacaaggagaagctgcagaagtgcctggagcccctggagcagaagctgcaggagatcacccgctgcaagagcagcgaggagaagaagccaggagagctgaagaggctggtggagagccggcggcagcagatcctgcgggagtttgaggagctgcaccggcggctggatgaggagcagcaggtgctgctgagccggctggaggaggaggagcaggacatcctgcagaggctgcgggagaatgctgcccacctgggggacaagagaagagacctggcccacctggccgctgaggtggagggcaagtgcctgcagagcggctttgagatgctgaaggtgtag

SEQ ID NO: 174300 - DNA, 180 bp, Artificial Sequence; identical to SEQ ID NO: 174288
  Description of Artificial Sequence: Synthetic coding sequence

SEQ ID NO: 174301 - DNA, 435 bp, Artificial Sequence; identical to SEQ ID NO: 174275
  Description of Artificial Sequence: Synthetic coding sequence

SEQ ID NO: 174302 - DNA, 1467 bp, Artificial Sequence; identical to SEQ ID NO: 174267
  Description of Artificial Sequence: Synthetic coding sequence

SEQ ID NO: 174303 - DNA, 1467 bp, Artificial Sequence; identical to SEQ ID NO: 174267
  Description of Artificial Sequence: Synthetic coding sequence

SEQ ID NO: 174304 - DNA, 786 bp, Artificial Sequence; identical to SEQ ID NO: 174299
  Description of Artificial Sequence: Synthetic coding sequence

SEQ ID NO: 174305 - DNA, 1467 bp, Artificial Sequence; identical to SEQ ID NO: 174267
  Description of Artificial Sequence: Synthetic coding sequence

SEQ ID NO: 174306 - DNA, 180 bp, Artificial Sequence; identical to SEQ ID NO: 174288
  Description of Artificial Sequence: Synthetic coding sequence

SEQ ID NO: 174307 - DNA, 180 bp, Artificial Sequence; identical to SEQ ID NO: 174288
  Description of Artificial Sequence: Synthetic coding sequence

SEQ ID NO: 174308 - DNA, 684 bp, Artificial Sequence; identical to SEQ ID NO: 174276
  Description of Artificial Sequence: Synthetic coding sequence

SEQ ID NO: 174309 - DNA, 1467 bp, Artificial Sequence; identical to SEQ ID NO: 174267
  Description of Artificial Sequence: Synthetic coding sequence

SEQ ID NO: 174310 - DNA, 225 bp, Artificial Sequence; identical to SEQ ID NO: 174277
  Description of Artificial Sequence: Synthetic coding sequence

SEQ ID NO: 174311 - DNA, 684 bp, Artificial Sequence; identical to SEQ ID NO: 174276
  Description of Artificial Sequence: Synthetic coding sequence

SEQ ID NO: 174312 - DNA, 1467 bp, Artificial Sequence; identical to SEQ ID NO: 174267
  Description of Artificial Sequence: Synthetic coding sequence

SEQ ID NO: 174313 - DNA, 1467 bp, Artificial Sequence; identical to SEQ ID NO: 174267
  Description of Artificial Sequence: Synthetic coding sequence

SEQ ID NO: 174314 - DNA, 786 bp, Artificial Sequence; identical to SEQ ID NO: 174299
  Description of Artificial Sequence: Synthetic coding sequence

SEQ ID NO: 174315 - DNA, 225 bp, Artificial Sequence; identical to SEQ ID NO: 174277
  Description of Artificial Sequence: Synthetic coding sequence

SEQ ID NO: 174316 - DNA, 180 bp, Artificial Sequence; identical to SEQ ID NO: 174288
  Description of Artificial Sequence: Synthetic coding sequence

SEQ ID NO: 174317 - DNA, 786 bp, Artificial Sequence; identical to SEQ ID NO: 174299
  Description of Artificial Sequence: Synthetic coding sequence

SEQ ID NO: 174318 - DNA, 1467 bp, Artificial Sequence; identical to SEQ ID NO: 174267
  Description of Artificial Sequence: Synthetic coding sequence

SEQ ID NO: 174319 - DNA, 1557 bp, Artificial Sequence; identical to SEQ ID NO: 174266
  Description of Artificial Sequence: Synthetic coding sequence

SEQ ID NO: 174320 - DNA, 1467 bp, Artificial Sequence; identical to SEQ ID NO: 174267
  Description of Artificial Sequence: Synthetic coding sequence

SEQ ID NO: 174321 - DNA, 786 bp, Artificial Sequence; identical to SEQ ID NO: 174299
  Description of Artificial Sequence: Synthetic coding sequence

SEQ ID NO: 174322 - DNA, 225 bp, Artificial Sequence; identical to SEQ ID NO: 174277
  Description of Artificial Sequence: Synthetic coding sequence

SEQ ID NO: 174323 - DNA, 1236 bp, Artificial Sequence
  Description of Artificial Sequence: Synthetic coding sequence
atggccgagaccagcctgctggaggccggggccagcgctgccagcacagctgctgccctggagaacctgcaggtggaggccagctgcagcgtgtgcctggagtacctgaaggagcctgtgatcattgaatgtggccacaacttctgcaaggcctgcatcacccgctggtgggaggacctggagcgggacttcccctgccctgtgtgcaggaagaccagccgctaccgcagcctgcggcccaaccggcagctgggctccatggtggagatcgccaagcagctgcaggccgtgaagaggaagatcagagatgagagcctgtgcccccagcaccacgaggccctgagcctcttctgctatgaggaccaggaggccgtgtgcctgatctgtgccatcagccacacccaccgggcccacacagtggtgcccctggatgatgccacccaggagtacaaggagaagctgcagaagtgcctggagcccctggagcagaagctgcaggagatcacccgctgcaagagcagcgaggagaagaagccaggagagctgaagaggctggtggagagccggcggcagcagatcctgcgggagtttgaggagctgcaccggcggctggatgaggagcagcaggtgctgctgagccggctggaggaggaggagcaggacatcctgcagaggctgcgggagaatgctgcccacctgggggacaagagaagagacctggcccacctggccgctgaggtggagggcaagtgcctgcagagcggctttgagatgctgaagcctgtgctgagcgcccgggaggagtgtgagaaggtgaagaccatggaggtgacctctgtgtccattgagctggagaagaacttcagcaacttcccccggcagtactttgccctgaggaagatcctgaagcagctgattgctgatgtgaccctggaccctgagacagcccaccccaacctggtgctgtctgaggacaggaagtctgtgaagtttgtggagacccggctgcgggacctgcctgacaccccccggcgcttcaccttctacccctgtgtgctggccacagagggcttcaccagcggccgccactactgggaggtggaggtgggggacaagacccactgggccgtgggcgtgtgccgggacagcgtgtccaggaaaggaggctgcggctacggcatgggcaccaacatgcagcccccaccccacctgctgcccctgtgcaccagcaggtag

SEQ ID NO: 174324 - DNA, 1467 bp, Artificial Sequence; identical to SEQ ID NO: 174267
  Description of Artificial Sequence: Synthetic coding sequence

SEQ ID NO: 174325 - DNA, 786 bp, Artificial Sequence; identical to SEQ ID NO: 174299
  Description of Artificial Sequence: Synthetic coding sequence

SEQ ID NO: 174326 - DNA, 147 bp, Artificial Sequence; identical to SEQ ID NO: 174283
  Description of Artificial Sequence: Synthetic coding sequence

SEQ ID NO: 174327 - DNA, 786 bp, Artificial Sequence; identical to SEQ ID NO: 174299
  Description of Artificial Sequence: Synthetic coding sequence

SEQ ID NO: 174328 - DNA, 1467 bp, Artificial Sequence; identical to SEQ ID NO: 174267
  Description of Artificial Sequence: Synthetic coding sequence

SEQ ID NO: 174329 - DNA, 225 bp, Artificial Sequence; identical to SEQ ID NO: 174277
  Description of Artificial Sequence: Synthetic coding sequence

SEQ ID NO: 174330 - DNA, 1467 bp, Artificial Sequence; identical to SEQ ID NO: 174267
  Description of Artificial Sequence: Synthetic coding sequence

SEQ ID NO: 174331 - DNA, 1557 bp, Artificial Sequence; identical to SEQ ID NO: 174266
  Description of Artificial Sequence: Synthetic coding sequence

SEQ ID NO: 174332 - DNA, 1467 bp, Artificial Sequence; identical to SEQ ID NO: 174267
  Description of Artificial Sequence: Synthetic coding sequence

SEQ ID NO: 174333 - DNA, 435 bp, Artificial Sequence; identical to SEQ ID NO: 174275
  Description of Artificial Sequence: Synthetic coding sequence

SEQ ID NO: 174334 - DNA, 435 bp, Artificial Sequence; identical to SEQ ID NO: 174275
  Description of Artificial Sequence: Synthetic coding sequence

SEQ ID NO: 174335 - DNA, 684 bp, Artificial Sequence; identical to SEQ ID NO: 174276
  Description of Artificial Sequence: Synthetic coding sequence

SEQ ID NO: 174336 - DNA, 147 bp, Artificial Sequence; identical to SEQ ID NO: 174283
  Description of Artificial Sequence: Synthetic coding sequence

SEQ ID NO: 174337 - DNA, 435 bp, Artificial Sequence; identical to SEQ ID NO: 174275
  Description of Artificial Sequence: Synthetic coding sequence

SEQ ID NO: 174338 - DNA, 1467 bp, Artificial Sequence; identical to SEQ ID NO: 174267
  Description of Artificial Sequence: Synthetic coding sequence

SEQ ID NO: 174339 - DNA, 1467 bp, Artificial Sequence
  Description of Artificial Sequence: Synthetic coding sequence
atggccgagaccagcctgctggaggccggggccagcgctgccagcacagctgctgccctggagaacctgcaggtggaggccagctgcagcgtgtgcctggagtacctgaaggagcctgtgatcattgaatgtggccacaacttctgcaaggcctgcatcacccgctggtgggaggacctggagcgggacttcccctgccctgtgtgcaggaagaccagccgctaccgcagcctgcggcccaaccggcagctgggctccatggtggagatcgccaagcagctgcaggccgtgaagaggaagatcagagatgagagcctgtgcccccagcaccacgaggccctgagcctcttctgctatgaggaccaggaggccgtgtgcctgatctgtgccatcagccacacccaccgggcccacacagtggtgcccctggatgatgccacccaggagtacaaggagaagctgcagaagtgcctggagcccctggagcagaagctgcaggagatcacccgctgcaagagcagcgaggagaagaagccaggagagctgaagaggctggtggagagccggcggcagcagatcctgcgggagtttgaggagctgcaccggcggctggatgaggagcagcaggtgctgctgagccggctggaggaggaggagcaggacatcctgcagaggctgcgggagaatgctgcccacctgggggacaagagaagagacctggcccacctggccgctgaggtggagggcaagtgcctgcagagcggctttgagatgctgaagcctgtgctgagcgcccgggaggagtgtgagaaggtgaagaccatggaggtgacctctgtgtccattgagctggagaagaacttcagcaacttcccccggcagtactttgccctgaggaagatcctgaagcagctgattgctgatgtgaccctggaccctgagacagcccaccccaacctggtgctgtctgaggacaggaagtctgtgaagtttgtggagacccggctgcgggacctgcctgacaccccccggcgcttcaccttctacccctgtgtgctggccacagagggcttcaccagcggccgccactactgggaggtggaggtgggggacaagacccactgggccgtgggcgtgtgccgggacagcgtgtccaggaaaggagagctgacccccctgcctgagaccggctactggagggtgcggctgtggaatggagacaagtatgctgccaccaccacccccttcacccccctgcacatcaaggtgaagcccaagagggtgggcatcttcctggactatgaggccggcaccctgtccttctacaacgtgacagacaggagccacatctacaccttcacagacaccttcacagagaagctgtggcccctcttctacccaggcatccgggccggcaggaagaatgctgcccccctgaccatccggcccccaacagactgggagtag

SEQ ID NO: 174340 - DNA, 1557 bp, Artificial Sequence
  Description of Artificial Sequence: Synthetic coding sequence
atggccgagaccagcctgctggaggccggggccagcgctgccagcacagctgctgccctggagaacctgcaggtggaggccagctgcagcgtgtgcctggagtacctgaaggagcctgtgatcattgaatgtggccacaacttctgcaaggcctgcatcacccgctggtgggaggacctggagcgggacttcccctgccctgtgtgcaggaagaccagccgctaccgcagcctgcggcccaaccggcagctgggctccatggtggagatcgccaagcagctgcaggccgtgaagaggaagatcagagatgagagcctgtgcccccagcaccacgaggccctgagcctcttctgctatgaggaccaggaggccgtgtgcctgatctgtgccatcagccacacccaccgggcccacacagtggtgcccctggatgatgccacccaggagtacaaggagaagctgcagaagtgcctggagcccctggagcagaagctgcaggagatcacccgctgcaagagcagcgaggagaagaagccaggagagctgaagaggctggtggagagccggcggcagcagatcctgcgggagtttgaggagctgcaccggcggctggatgaggagcagcaggtgctgctgagccggctggaggaggaggagcaggacatcctgcagaggctgcgggagaatgctgcccacctgggggacaagagaagagacctggcccacctggccgctgaggtggagggcaagtgcctgcagagcggctttgagatgctgaagcctgtgctgagcgcccgggagaagaacatccccaggaagtttggaggcagcctgagcaccatctgcccccgggaccacaaggccctgctgggcctggtgaaggagatcaacagatgtgagaaggtgaagaccatggaggtgacctctgtgtccattgagctggagaagaacttcagcaacttcccccggcagtactttgccctgaggaagatcctgaagcagctgattgctgatgtgaccctggaccctgagacagcccaccccaacctggtgctgtctgaggacaggaagtctgtgaagtttgtggagacccggctgcgggacctgcctgacaccccccggcgcttcaccttctacccctgtgtgctggccacagagggcttcaccagcggccgccactactgggaggtggaggtgggggacaagacccactgggccgtgggcgtgtgccgggacagcgtgtccaggaaaggagagctgacccccctgcctgagaccggctactggagggtgcggctgtggaatggagacaagtatgctgccaccaccacccccttcacccccctgcacatcaaggtgaagcccaagagggtgggcatcttcctggactatgaggccggcaccctgtccttctacaacgtgacagacaggagccacatctacaccttcacagacaccttcacagagaagctgtggcccctcttctacccaggcatccgggccggcaggaagaatgctgcccccctgaccatccggcccccaacagactgggagtag

SEQ ID NO: 174341 - DNA, 1236 bp, Artificial Sequence; identical to SEQ ID NO: 174323
  Description of Artificial Sequence: Synthetic coding sequence

SEQ ID NO: 174342 - DNA, 1557 bp, Artificial Sequence; identical to SEQ ID NO: 174340
  Description of Artificial Sequence: Synthetic coding sequence

SEQ ID NO: 174343 - DNA, 1467 bp, Artificial Sequence; identical to SEQ ID NO: 174339
  Description of Artificial Sequence: Synthetic coding sequence

SEQ ID NO: 174344 - DNA, 1557 bp, Artificial Sequence; identical to SEQ ID NO: 174266
  Description of Artificial Sequence: Synthetic coding sequence

SEQ ID NO: 174345 - DNA, 1467 bp, Artificial Sequence; identical to SEQ ID NO: 174339
  Description of Artificial Sequence: Synthetic coding sequence

SEQ ID NO: 174346 - DNA, 1467 bp, Artificial Sequence; identical to SEQ ID NO: 174339
  Description of Artificial Sequence: Synthetic coding sequence

SEQ ID NO: 174347 - DNA, 1467 bp, Artificial Sequence; identical to SEQ ID NO: 174339
  Description of Artificial Sequence: Synthetic coding sequence

SEQ ID NO: 174348 - DNA, 1557 bp, Artificial Sequence; identical to SEQ ID NO: 174266
  Description of Artificial Sequence: Synthetic coding sequence

SEQ ID NO: 174349 - DNA, 1236 bp, Artificial Sequence; identical to SEQ ID NO: 174323
  Description of Artificial Sequence: Synthetic coding sequence

SEQ ID NO: 174350 - DNA, 1557 bp, Artificial Sequence; identical to SEQ ID NO: 174340
  Description of Artificial Sequence: Synthetic coding sequence

SEQ ID NO: 174351 - DNA, 1236 bp, Artificial Sequence; identical to SEQ ID NO: 174323
  Description of Artificial Sequence: Synthetic coding sequence

SEQ ID NO: 174352 - DNA, 1236 bp, Artificial Sequence; identical to SEQ ID NO: 174323
  Description of Artificial Sequence: Synthetic coding sequence

SEQ ID NO: 174353 - DNA, 1557 bp, Artificial Sequence; identical to SEQ ID NO: 174266
  Description of Artificial Sequence: Synthetic coding sequence

SEQ ID NO: 174354 - DNA, 1557 bp, Artificial Sequence; identical to SEQ ID NO: 174340
  Description of Artificial Sequence: Synthetic coding sequence

SEQ ID NO: 174355 - DNA, 1557 bp, Artificial Sequence; identical to SEQ ID NO: 174340
  Description of Artificial Sequence: Synthetic coding sequence

SEQ ID NO: 174356 - DNA, 1557 bp, Artificial Sequence; identical to SEQ ID NO: 174266
  Description of Artificial Sequence: Synthetic coding sequence

SEQ ID NO: 174357 - DNA, 1557 bp, Artificial Sequence; identical to SEQ ID NO: 174340
  Description of Artificial Sequence: Synthetic coding sequence

SEQ ID NO: 174358 - DNA, 1254 bp, Artificial Sequence
  Description of Artificial Sequence: Synthetic coding sequence
atggtggagatcgccaagcagctgcaggccgtgaagaggaagatcagagatgagagcctgtgcccccagcaccacgaggccctgagcctcttctgctatgaggaccaggaggccgtgtgcctgatctgtgccatcagccacacccaccgggcccacacagtggtgcccctggatgatgccacccaggagtacaaggagaagctgcagaagtgcctggagcccctggagcagaagctgcaggagatcacccgctgcaagagcagcgaggagaagaagccaggagagctgaagaggctggtggagagccggcggcagcagatcctgcgggagtttgaggagctgcaccggcggctggatgaggagcagcaggtgctgctgagccggctggaggaggaggagcaggacatcctgcagaggctgcgggagaatgctgcccacctgggggacaagagaagagacctggcccacctggccgctgaggtggagggcaagtgcctgcagagcggctttgagatgctgaagcctgtgctgagcgcccgggaggagtgtgagaaggtgaagaccatggaggtgacctctgtgtccattgagctggagaagaacttcagcaacttcccccggcagtactttgccctgaggaagatcctgaagcagctgattgctgatgtgaccctggaccctgagacagcccaccccaacctggtgctgtctgaggacaggaagtctgtgaagtttgtggagacccggctgcgggacctgcctgacaccccccggcgcttcaccttctacccctgtgtgctggccacagagggcttcaccagcggccgccactactgggaggtggaggccgcccactgtgtgctggcccaggaccctgagaaccaggccctggcccgcttctactgctacacagagaggaccatcgccaagaggctggtgctgcggcgggaccccagcgtgaagaggaccctgtgccggggctgcagcagcctgctggtgcccggcctgacctgcacccaccggcagaggcgctgccggggccagcgctggacagtgcagacctgcctgacctgccagaggagccagcgcttcctgaatgaccccggccacctgctgtggggagacaggcctgaggcccagctgggcagccaggccgacagcaagcccctgcagcccctgcccaacacagcccacagcatcagtgaccggctgcctgaggagaagatgcagacccagggcagcagcaaccagtag

SEQ ID NO: 174359 - DNA, 1254 bp, Artificial Sequence; identical to SEQ ID NO: 174358
  Description of Artificial Sequence: Synthetic coding sequence

SEQ ID NO: 174360 - DNA, 1236 bp, Artificial Sequence; identical to SEQ ID NO: 174323
  Description of Artificial Sequence: Synthetic coding sequence

SEQ ID NO: 174361 - DNA, 1254 bp, Artificial Sequence; identical to SEQ ID NO: 174358
  Description of Artificial Sequence: Synthetic coding sequence

SEQ ID NO: 174362 - DNA, 1557 bp, Artificial Sequence; identical to SEQ ID NO: 174340
  Description of Artificial Sequence: Synthetic coding sequence

SEQ ID NO: 174363 - DNA, 1254 bp, Artificial Sequence
  Description of Artificial Sequence: Synthetic coding sequence
atggtggagatcgccaagcagctgcaggccgtgaagaggaagatcagagatgagagcctgtgcccccagcaccacgaggccctgagcctcttctgctatgaggaccaggaggccgtgtgcctgatctgtgccatcagccacacccaccgggcccacacagtggtgcccctggatgatgccacccaggagtacaaggagaagctgcagaagtgcctggagcccctggagcagaagctgcaggagatcacccgctgcaagagcagcgaggagaagaagccaggagagctgaagaggctggtggagagccggcggcagcagatcctgcgggagtttgaggagctgcaccggcggctggatgaggagcagcaggtgctgctgagccggctggaggaggaggagcaggacatcctgcagaggctgcgggagaatgctgcccacctgggggacaagagaagagacctggcccacctggccgctgaggtggagggcaagtgcctgcagagcggctttgagatgctgaagcctgtgctgagcgcccgggaggagtgtgagaaggtgaagaccatggaggtgacctctgtgtccattgagctggagaagaacttcagcaacttcccccggcagtactttgccctgaggaagatcctgaagcagctgattgctgatgtgaccctggaccctgagacagcccaccccaacctggtgctgtctgaggacaggaagtctgtgaagtttgtggagacccggctgcgggacctgcctgacaccccccggcgcttcaccttctacccctgtgtgctggccacagagggcttcaccagcggccgccactactgggaggtggaggccgcccactgtgtgctggcccaggaccctgagaaccaggccctggcccgcttctactgctacacagagaggaccatcgccaagaggctggtgctgcggcgggaccccagcgtgaagaggaccctgtgccggggctgcagcagcctgctggtgcccggcctgacctgcacccagaggcagaggcgctgccggggccagcgctggacagtgcagacctgcctgacctgccagaggagccagcgcttcctgaatgaccccggccacctgctgtggggagacaggcctgaggcccagctgggcagccaggccgacagcaagcccctgcagcccctgcccaacacagcccacagcatcagtgaccggctgcctgaggagaagatgcagaccaagggcagcagcaaccagtag

SEQ ID NO: 174364 - DNA, 1236 bp, Artificial Sequence; identical to SEQ ID NO: 174323
  Description of Artificial Sequence: Synthetic coding sequence

SEQ ID NO: 174365 - DNA, 1254 bp, Artificial Sequence; identical to SEQ ID NO: 174278
  Description of Artificial Sequence: Synthetic coding sequence

SEQ ID NO: 174366 - DNA, 1557 bp, Artificial Sequence; identical to SEQ ID NO: 174266
  Description of Artificial Sequence: Synthetic coding sequence

SEQ ID NO: 174367 - DNA, 1557 bp, Artificial Sequence; identical to SEQ ID NO: 174266
  Description of Artificial Sequence: Synthetic coding sequence

SEQ ID NO: 174368 - DNA, 1467 bp, Artificial Sequence; identical to SEQ ID NO: 174339
  Description of Artificial Sequence: Synthetic coding sequence

SEQ ID NO: 174369 - DNA, 1467 bp, Artificial Sequence; identical to SEQ ID NO: 174339
  Description of Artificial Sequence: Synthetic coding sequence

SEQ ID NO: 174370 - DNA, 1254 bp, Artificial Sequence; identical to SEQ ID NO: 174278
  Description of Artificial Sequence: Synthetic coding sequence

SEQ ID NO: 174371 - DNA, 1893 bp, Artificial Sequence
  Description of Artificial Sequence: Synthetic coding sequence
atggctgctgtggccatgacccccaaccctgtgcagaccctgcaggaggaggccgtgtgtgccatctgcctggactacttcacagatcctgtgtccatcggctgcggccacaacttctgccgggtgtgtgtgacccagctgtggggcggagaagatgaggaggacagagatgagctggaccgggaggaggaggaggaggatggagaggaggaggaggtggaggccgtgggcgctggggccggctgggacacccccatgagagatgaagattatgaaggagacatggaggaggaggtggaggaggaggaggagggcgtcttctggaccagcggcatgagccgcagctcctgggacaacatggactatgtgtgggaggaggaggatgaggaggaggacctggactactacctgggggacatggaggaggaggacctgcggggggaggatgaagaagatgaggaggaggtgctggaggaggtggaggaggaggacctggaccctgtgacccccctgcccccacctccagccccccggcgctgcttcacctgcccccagtgcaggaagagcttcccccggcgctccttccggcccaacctgcagctggccaacatggtgcaggtgatccggcagatgcaccccaccccaggccggggcagccgggtgacagaccagggcatctgccccaagcaccaggaggccctgaagctgttctgtgaggtggatgaggaggccatctgtgtggtgtgccgggagagccgcagccacaagcagcacagcgtggtgcccctggaggaggtggtgcaggagtacaaggccaagctgcagggccacgtggagcccctgaggaagcacctggaggccgtgcagaagatgaaggccaaggaggagaggagagtgacagagctgaagagccagatgaagtctgagctggccgctgtggccagcgagtttggccgcctgacccgcttcctggccgaggagcaggccggcctggagcggcggctgcgggagatgcatgaggcccagctgggccgggccggggctgctgccagccggctggccgagcaggccgcccagctgagccggctgctggccgaggcccaggagaggagccagcagggcggcctgcggctgctgcaggacatcaaggagaccttcaacagatgtgaggaggtgcagctgcagcccccagaggtgtggagcccagacccctgccagccccacagccatgacttcctgacagatgccatcgtgaggaagatgagcaggatgttctgccaggccgcccgggtggacctgaccctggaccctgacacagcccacccagccctgatgctgagcccagaccggcggggcgtgcggctggccgagcggcggcaggaggtggccgaccaccccaagcgcttctctgctgactgctgcgtgctgggcgcccagggcttccgcagcggccgccactactgggaggtggaggtgggcggcagaagaggctgggccgtgggcgccgcccgggagagcacccaccacaaggagaaggtgggccctgggggcagctctgtgggcagcggagatgccagcagcagccgccaccaccacagaagaagaaggctgcacctgccccagcagcccctgctgcagcgggaggtgtggtgtgtgggcaccaacgggaagcgctaccaggcccagagcagcacagagcagaccctgctgagccccagcgagaagcccaggagatttggagtgtacctggactatgaagctggccgcctgggcttctacaatgctgagaccctggcccacgtgcacaccttctctgctgccttcctgggggagagggtcttccccttcttccgggtgctgagcaagggcacccgcatcaagctgtgcccctag

SEQ ID NO: 174372 - DNA, 1557 bp, Artificial Sequence
  Description of Artificial Sequence: Synthetic coding sequence
atggctgctgtggccatgacccccaaccctgtgcagaccctgcaggaggaggccgtgtgtgccatctgcctggactacttcacagatcctgtgtccatcggctgcggccacaacttctgccgggtgtgtgtgacccagctgtggggcggagaagatgaggaggacagagatgagctggaccgggaggaggaggaggaggatggagaggaggaggaggtggaggccgtgggcgctggggccggctgggacacccccatgagagatgaagattatgaaggagacatggaggaggaggtggaggaggaggaggagggcgtcttctggaccagcggcatgagccgcagctcctgggacaacatggactatgtgtgggaggaggaggatgaggaggaggacctggactactacctgggggacatggaggaggaggacctgcggggggaggatgaagaagatgaggaggaggtgctggaggaggtggaggaggaggacctggaccctgtgacccccctgcccccacctccagccccccggcgctgcttcacctgcccccagtgcaggaagagcttcccccggcgctccttccggcccaacctgcagctggccaacatggtgcaggtgatccggcagatgcaccccaccccaggccggggcagccgggtgacagaccagggcatctgccccaagcaccaggaggccctgaagctgttctgtgaggtggatgaggaggccatctgtgtggtgtgccgggagagccgcagccacaagcagcacagcgtggtgcccctggaggaggtggtgcaggagtacaaggccaagctgcagggccacgtggagcccctgaggaagcacctggaggccgtgcagaagatgaaggccaaggaggagaggagagtgacagagctgaagagccagatgaagtctgagctggccgctgtggccagcgagtttggccgcctgacccgcttcctggccgaggagcaggccggcctggagcggcggctgcgggagatgcatgaggcccagctgggccgggccggggctgctgccagccggctggccgagcaggccgcccagctgagccggctgctggccgaggcccaggagaggagccagcagggcggcctgcggctgctgcaggacatcaaggagaccttcaacagatgtgaggaggtgcagctgcagcccccagaggtgtggagcccagacccctgccagccccacagccatgacttcctgacagatgccatcgtgaggaagatgagcaggatgttctgccaggccgcccgggtggacctgaccctggaccctgacacagcccacccagccctgatgctgagcccagaccggcggggcgtgcggctggccgagcggcggcaggaggtggccgaccaccccaagcgcttctctgctgactgctgcgtgctgggcgcccagggcttccgcagcggccgccactactgggaggagcccaaggagcccagctggcccccagcccagcccagcctgacctactacgtgtgccccacagacaggcctgagttctccttcacctag

SEQ ID NO: 174373 - DNA, 453 bp, Artificial Sequence
  Description of Artificial Sequence: Synthetic coding sequence
ctgcaggaggaggccgtgtgtgccatctgcctggactacttcacagatcctgtgtccatcggctgcggccacaacttctgccgggtgtgtgtgacccagctgtggggcagaagaggaggcggcagcggcggctaccctgtgacccccctgcccccacctccagccccccggcgctgcttcacctgcccccagtgcaggaagagcttccccaggaggagcttccggcccaacctgcagctggccaacatggtgcaggtgatccggcagatgcaccccaccccaggccggggcagccgggtgacagaccagggcatctgccccaagcaccaggaggccctgaagctgttctgtgaggtggatgaggaggccatctgtgtggtgtgccgggagagccgcagccacaagcagcacagcgtggtgcccctggaggaggtggtgcaggagtacaagtag

SEQ ID NO: 174374 - DNA, 948 bp, Artificial Sequence
  Description of Artificial Sequence: Synthetic coding sequence
atgaaggccaaggaggagaggagagtgacagagctgaagagccagatgaagtctgagctggccgctgtggccagcgagtttggccgcctgacccgcttcctggccgaggagcaggccggcctggagcggcggctgcgggagatgcatgaggcccagctgggccgggccggggctgctgccagccggctggccgagcaggccgcccagctgagccggctgctggccgaggcccaggagaggagccagcagggcggcctgcggctgctgcagcaggacatcaaggagaccttcaacagatatgccatcgtgaggaagatgagcaggatgttctgccaggccgcccgggtggacctgaccctggaccctgacacagcccacccagccctgatgctgagcccagacagaagaggagtgcggctggccgagcggcggcaggaggtggccgaccaccccaagcgcttctctgctgactgctgcgtgctgggcgcccagggcttccgcagcggccgccactactgggaggtggaggtgggcggccggcggggctgggccgtgggcgccgcccgggagagcacccaccacaaggagaaggtgggccctgggggcagctctgtgggcagcggagatgccagcagcagccgccaccaccacagaagaagaaggctgcacctgccccagcagcccctgctgcagcgggaggtgtggtgtgtgggcaccaacgggaagcgctaccaggcccagagcagcacagagcagaccctgctgagccccagcgagaagccccggcgcttcggcgtgtacctggactatgaggccggccgcctgggcttctacaatgctgagaccctggcccacgtgcacaccttctctgctgccttcctgggggagagggtcttccccttcttccgggtgctgagcaagggcacccgcatcaagctgtgcccctag

SEQ ID NO: 174375 - DNA, 1035 bp, Artificial Sequence
  Description of Artificial Sequence: Synthetic coding sequence
atggccagcggcgtgggcgccgcctttgaggagctgccccatgatggcacctgtgatgaatgtgagccagatgaggcccctggagctgaggaggtgtgcagagaatgtggcttctgctactgcagaagacatgctgaggcccaccggcagaagttcctgagccaccacctggccgagtatgtgcacggcagccaggcctggaccccaccagcagatggagagggcgctgggaaggaggaggccgaggtgaaggtggagcaggagcgggagattgaaagtgaagctggggaggagagcgagagcgaggaggagagcgagagcgaggaggagagcgagacagaggaggagagtgaagatgaaagtgatgaggagagtgaagaagattctgaggaggagatggaggatgagcaggagagcgaggccgaggaggacaaccaggaggagggggagagcgaggccgagggggagacagaagctgagagcgagtttgatcctgagattgagatggaggccgagcgggtggccaagaggaagtgcccagaccacggcctggacctgagcacctactgccaggaggaccggcagctgatctgtgtgctgtgccctgtgattggagcccaccagggccaccagctgagcaccctggatgaggcctttgaggagctgcggagcaaggacagcggcggcctgaaggccgccatgattgagctggtggagcggctgaagttcaagagcagtgaccccaaggtgacccgggaccagatgaagatgttcatccagcaggagttcaagaaggtgcagaaggtgattgctgatgaggagcagaaggccctgcacctggtggacatccaggaggccatggccacagcccacgtgacagagatcctggccgacatccagagccacatggaccggctgatgacccagatggcccaggccaaggagcagctggacaccagcaatgaatctgctgagcccaaggccgagggagatgaggagggccccagcggggccagcgaggaggaggacacctag

SEQ ID NO: 174376 - DNA, 1743 bp, Artificial Sequence
  Description of Artificial Sequence: Synthetic coding sequence
atgtctgaaaataggaagcccctgctgggctttgtgtccaagctgaccagcggcacagccctgggcaacagcggcaagacccactgccccctgtgcctgggcctcttcaaggccccccggctgctgccctgcctgcacacagtgtgcaccacctgcctggagcagctggagcccttctctgtggtggacatccggggcggggacagcgacaccagcagcgagggcagcatcttccaggagctgaagcccaggagcctgcagagccagatcggcatcctgtgccctgtgtgtgatgcccaggtggacctgcccatgggcggcgtgaaggccctgaccatcgaccacctggccgtgaatgatgtgatgctggagagcctgcggggggagggccagggcctggtgtgtgacctgtgcaatgaccgggaggtggagaagcgctgccagacctgcaaggccaacctgtgccacttctgctgccaggcccaccggcggcagaagaagaccacctaccacaccatggtggacctgaaggacctgaagggctacagcagaattggcaagcccatcctgtgccctgtgcaccctgctgaggagctgcggctcttctgtgagttctgtgacaggcctgtgtgccaggactgtgtggtgggggagcaccgggagcacccctgtgacttcaccagcaatgtcatccacaagcacggggacagcgtgtgggagctgctgaagggcacccagccccacgtggaggccctggaggaggccctggcccagatccacatcatcaacagcgccctgcagaagagggtggaggccgtggccgcagatgtgaggaccttcagcgagggctacatcaaggccatcgaggagcaccgggacaagctgctgaagcagctggaggacatccgggcccagaaggagaacagcctgcagctgcagaaggcccagctggagcagctgctggccgacatgaggactggagtggagttcacagagcacctgctgaccagcggcagtgacctggagatcctgatcaccaagagggtggtggtggagcggctgaggaagctgaacaaggtgcagtacagcaccaggcctggggtgaatgacaagatccgcttctgcccccaggagaaggccggccagtgccggggctatgagatctacggcaccatcaacaccaaggaggtggaccctgccaagtgtgtgctgcagggcgaggacctgcaccgggcccgggagaagcagacagccagcttcaccctgctgtgcaaggatgctgctggggagatcatgggccggggcggggacaacgtgcaggtggccgtggtgcccaaggacaagaaggacagccctgtgaggaccatggtgcaggacaacaaggatggcacctactacatctcctacacccccaaggagcccggggtgtacacagtgtgggtgtgcatcaaggagcagcacgtgcagggcagccccttcaccgtgatggtgcggaggaagcaccggccccacagcggggtcttccactgctgcaccttctgcagcagcggcggccagaagacagcccgctgtgcctgtggcggcaccatgcctgggggctacctgggctgcggccacggccacaagggccaccctggccacccccactggagctgctgcggcaagttcaatgagaagtcagaatgtacctggacaggaggccagagcgcccccaggagcctgctgaggacagtggccctgtag

SEQ ID NO: 174377 - DNA, 1572 bp, Artificial Sequence
  Description of Artificial Sequence: Synthetic coding sequence
atgctgtctggagtgaccctggagggcggcggggcccggagcggggagggccgccgcagcaggacagagctgaagcccaggagcctgcagagccagatcggcatcctgtgccctgtgtgtgatgcccaggtggacctgcccatgggcggcgtgaaggccctgaccatcgaccacctggccgtgaatgatgtgatgctggagagcctgcggggggagggccagggcctggtgtgtgacctgtgcaatgaccgggaggtggagaagcgctgccagacctgcaaggccaacctgtgccacttctgctgccaggcccaccggcggcagaagaagaccacctaccacaccatggtggacctgaaggacctgaagggctacagccgcatcggcaagcccatcctgtgccctgtgcaccctgctgaggagctgcggctcttctgtgagttctgtgacaggcctgtgtgccaggactgtgtggtgggggagcaccgggagcacccctgtgacttcaccagcaatgtcatccacaagcatggagacagcgtgtgggagctgctgaagggcacccagccccacgtggaggccctggaggaggccctggcccagatccacatcatcaacagcgccctgcagaagagggtggaggccgtggccgcagatgtgaggaccttcagcgagggctacatcaaggccatcgaggagcaccgggacaagctgctgaagcagctggaggacatccgggcccagaaggagaacagcctgcagctgcagaaggcccagctggagcagctgctggccgacatgaggactggagtggagttcacagagcacctgctgaccagcggcagtgacctggagatcctgatcaccaagagggtggtggtggagcggctgaggaagctgaacaaggtgcagtacagcaccaggcctggggtgaatgacaagatccgcttctgcccccaggagaaggccggccagtgccggggctatgagatctacggcaccatcaacaccaaggaggtggaccctgccaagtgtgtgctgcagggcgaggacctgcaccgggcccgggagaagcagacagccagcttcaccctgctgtgcaaggatgctgctggggagatcatgggccggggcggggacaacgtgcaggtggccgtggtgcccaaggacaagaaggacagccctgtgaggaccatggtgcaggacaacaaggatggcacctactacatctcctacacccccaaggagcccggggtgtacacagtgtgggtgtgcatcaaggagcagcacgtgcagggcagccccttcaccgtgatggtgcggaggaagcaccggccccacagcggggtcttccactgctgcaccttctgcagcagcggcggccagaagacagcccgctgtgcctgtggcggcaccatgcctgggggctacctgggctgcggccacggccacaagggccaccctggccacccccactggagctgctgcggcaagttcaatgagaagtctgagtgcacctggacaggaggccagagcgcccccaggagcctgctgaggacagtggccctgtag

SEQ ID NO: 174378 - DNA, 1689 bp, Artificial Sequence
  Description of Artificial Sequence: Synthetic coding sequence
atgtctgaaaataggaagcccctgctgggctttgtgtccaagctgaccagcggcacagccctgggcaacagcggcaagacccactgccccctgtgcctgggcctcttcaaggccccccggctgctgccctgcctgcacacagtgtgcaccacctgcctggagcagctggagcccttctctgtggtggacatccggggcggggacagcgacaccagcagcgagggcagcatcttccaggagctgaagcccaggagcctgcagagccagatcggcatcctgtgccctgtgtgtgatgcccaggtggacctgcccatgggcggcgtgaaggccctgaccatcgaccacctggccgtgaatgatgtgatgctggagagcctgcggggggagggccagggcctggtgtgtgacctgtgcaatgaccgggaggtggagaagcgctgccagacctgcaaggccaacctgtgccacttctgctgccaggcccaccggcggcagaagaagaccacctaccacaccatggtggacctgaaggacctgaagggctacagcagaattggcaagcccatcctgtgccctgtgcaccctgctgaggagctgcggctcttctgtgagttctgtgacaggcctgtgtgccaggactgtgtggtgggggagcaccgggagcacccctgtgacttcaccagcaatgtcatccacaagcacggggacagcgtgtgggagctgctgaagggcacccagccccacgtggaggccctggaggaggccctggcccagatccacatcatcaacagcgccctgcagaagagggtggaggccgtggccgcagatgtgaggaccttcagcgagggctacatcaaggccatcgaggagcaccgggacaagctgctgaagcagctggaggacatccgggcccagaaggagaacagcctgcagctgcagaaggcccagctggagcagctgctggccgacatgaggactggagtggagttcacagagcacctgctgaccagcggcagtgacctggagatcctgatcaccaagagggtggtggtggagcggctgaggaagctgaacaaggtgcagtacagcaccaggcctggggtgaatgacaagatccgcttctgcccccaggagaaggccggccagtgccggggctatgagatctatgacctgcaccgggcccgggagaagcagacagccagcttcaccctgctgtgcaaggatgctgctggggagatcatgggccggggcggggacaacgtgcaggtggccgtggtgcccaaggacaagaaggacagccctgtgaggaccatggtgcaggacaacaaggatggcacctactacatctcctacacccccaaggagcccggggtgtacacagtgtgggtgtgcatcaaggagcagcacgtgcagggcagccccttcaccgtgatggtgcggaggaagcaccggccccacagcggggtcttccactgctgcaccttctgcagcagcggcggccagaagacagcccgctgtgcctgtggcggcaccatgcctgggggctacctgggctgcggccacggccacaagggccaccctggccacccccactggagctgctgcggcaagttcaatgagaagtcagaatgtacctggacaggaggccagagcgcccccaggagcctgctgaggacagtggccctgtag

SEQ ID NO: 174379 - DNA, 1917 bp, Artificial Sequence
  Description of Artificial Sequence: Synthetic coding sequence
atggatggcagcggccccttcagctgccccatctgcctggagcccctgcgggagcctgtgaccctgccctgtggccacaacttctgcctggcctgcctgggcgccctgtggccccacagaggagccagcggggccggcggccctgggggcgccgcccgctgccccctgtgccaggagcccttcccagatggcctgcagctgaggaagaaccacaccctgtctgagctgctgcagctgcggcagggcagcggccctggcagcggccctggccctgccccagccctggcccctgagcccagcgcccccagcgccctgcccagcgtgcctgagcccagcgccccctgtgcccctgagccctggccagctggggaggagcctgtgcgctgtgatgcctgcccagagggcgccgccctgcctgctgccctgagctgcctgagctgcctggccagcttctgcccagcccacctgggcccccatgagaggagccctgccctgcggggccaccggctggtgccccccctgcggcggctggaggagagcctgtgccccaggcacctgcggcccctggagcgctactgcagagctgagcgggtgtgcctgtgtgaggcctgtgccgcccaggagcaccggggccacgagctggtgcccctggagcaggagcgggccctgcaggaggccgagcagagcaaggtgctgtctgctgtggaggacaggatggatgagctgggcgccggcatcgcccagagcagaagaacagtggccctgatcaagtctgctgctgtggccgagcgggagcgggtgtcccggctgtttgctgatgctgctgctgccctgcagggcttccagacccaggtgctgggcttcatcgaggagggggaggccgccatgctgggccgcagccagggcgacctgcggcggcaggaggagcagaggagccggctgagccgggcccggcagaacctgagccaggtgcctgaggccgacagcgtgtccttcctgcaggagctgctggccctgcggctggccctggaggatggctgcggccctggccctggccccccccgggagctgtccttcaccaagagcagccaggccgtgcgggctgtgcgggacatgctggccgtggcctgtgtgaaccagtgggagcagctgcggggccctggaggaaatgaagatggcccccagaagctggacagcgaggctgatgctgagccccaggacctggagagcaccaacctgctggagagcgaggccccccgggactacttcctgaagtttgcctacatcgtggacctggacagcgacacagctgacaagttcctgcagctgtttggcaccaagggcgtgaagagggtgctgtgccccatcaactaccccctgagccccacccgcttcacccactgtgagcaggtgctgggggagggcgccctggaccggggcacctactactgggaggtggagatcatcgagggctgggtgtccatgggcgtgatggccgaggacttcagcccccaggagccctatgaccggggccgcctgggcagaaatgcccacagctgctgcctgcagtggaatggccgctccttctctgtgtggttccacggcctggaggcccccctgccccaccccttcagccccaccgtgggcgtgtgcctggagtatgctgaccgggccctggccttctatgctgtgagagatggcaagatgagcctgctgcggcggctgaaggccagccggcccaggagaggaggcatcccagccagccccatcgaccccttccagagccggctggacagccactttgctggcctcttcacccaccggctgaagccagccttcttcctggagagcgtggatgcccacctgcagatcggccccctgaagaagagctgcatctctgtgctgaagagaagatag

SEQ ID NO: 174380 - DNA, 1482 bp, Artificial Sequence
  Description of Artificial Sequence: Synthetic coding sequence
atggccagcggcatcctggtgaatgtgaaggaggaggtgacctgccccatctgcctggagctgctgacccagcccctgagcctggactgtggccacagcttctgccaggcctgcctgacagccaaccacaagaagtccatgctggacaagggggagagcagctgccctgtgtgccgcatctcctaccagcctgagaacatccggcccaacagacatgtggccaacatcgtggagaagctgcgggaggtgaagctgagccctgagggccagaaggtggaccactgtgcccggcacggggagaagctgctgctcttctgccaggaggatggcaaggtgatctgctggctgtgtgagaggagccaggagcaccggggccaccacaccttcctgacagaggaggtggcccgggagtaccaggtgaagctgcaggccgccctggagatgctgcggcagaagcagcaggaggccgaggagctggaggccgacatccgggaggagaaggcctcctggaagacccagatccagtatgacaagaccaacgtgctggccgactttgagcagctgcgggacatcctggactgggaggagagcaatgagctgcagaacctggagaaggaggaggaggacatcctgaagagcctgaccaacagcgagacagagatggtgcagcagacccagagcctgcgggagctgatcagtgacctggagcaccggctgcagggctctgtgatggagctgctgcagaaggtgtctgggaagatcctgaggacagaaaatgtgaccctgaagaagccagagaccttccccaagaaccagaggagggtcttccgggccccagacctgaagggcatgctggaggtgttccgggagctgacagatgtgcggcgctactgggtggatgtgacagtggcccccaacaacatcagctgtgctgtgatcagcgaggacaagaggcaggtgagcagccccaagccccagatcatctatggagcccggggcacccgctaccagacctttgtgaacttcaactactgcaccggcatcctgggcagccagagcatcaccagcggcaagcactactgggaggtggatgtgtccaagaagacagcctggatcctgggcgtgtgtgccggcttccagccagatgccatgtgcaacatcgagaagaatgaaaactaccagcccaagtatggctactgggtgattggcctggaggagggcgtgaagtgcagcgccttccaggacagcagcttccacacccccagcgtgcccttcatcgtgcccctgagcgtcatcatctgcccagacagagtgggcgtcttcctggactatgaggcctgcaccgtgtccttcttcaacatcaccaaccacggcttcctgatctacaagttcagccactgcagcttcagccagcccgtcttcccctacctgaaccccaggaaatgtggggtgcccatgaccctgtgcagccccagcagctag

SEQ ID NO: 174381 - DNA, 981 bp, Artificial Sequence
  Description of Artificial Sequence: Synthetic coding sequence
atggccagcggcatcctggtgaatgtgaaggaggaggtgacctgccccatctgcctggagctgctgacccagcccctgagcctggactgtggccacagcttctgccaggcctgcctgacagccaaccacaagaagtccatgctggacaagggggagagcagctgccctgtgtgccgcatctcctaccagcctgagaacatccggcccaacagacatgtggccaacatcgtggagaagctgcgggaggtgaagctgagccctgagggccagaaggtggaccactgtgcccggcacggggagaagctgctgctcttctgccaggaggatggcaaggtgatctgctggctgtgtgagaggagccaggagcaccggggccaccacaccttcctgacagaggaggtggcccgggagtaccaggtgaagctgcaggccgccctggagatgctgcggcagaagcagcaggaggccgaggagctggaggccgacatccgggaggagaaggcctcctggaagacccagatccagtatgacaagaccaacgtgctggccgactttgagcagctgcgggacatcctggactgggaggagagcaatgagctgcagaacctggagaaggaggaggaggacatcctgaagagcctgaccaacagcgagacagagatggtgcagcagacccagagcctgcgggagctgatcagtgacctggagcaccggctgcagggctctgtgatggagctgctgcagggcgtggatggagtcatcaagaggacagaaaatgtgaccctgaagaagccagagaccttccccaagaaccagaggagggtcttccgggccccagacctgaagggcatgctggaggtgttccgggagctgacagatgtgcggcgctactggggctggagcgccatggcccggagccgcttcaccgccaccagcaccagccagatccaggccatcctgctgccccagccccccaagtag

SEQ ID NO: 174382 - DNA, 1482 bp, Artificial Sequence
  Description of Artificial Sequence: Synthetic coding sequence
atggccagcggcatcctggtgaatgtgaaggaggaggtgacctgccccatctgcctggagctgctgacccagcccctgagcctggactgtggccacagcttctgccaggcctgcctgacagccaaccacaagaagtccatgctggacaagggggagagcagctgccctgtgtgccgcatctcctaccagcctgagaacatccggcccaacagacatgtggccaacatcgtggagaagctgcgggaggtgaagctgagccctgagggccagaaggtggaccactgtgcccggcacggggagaagctgctgctcttctgccaggaggatggcaaggtgatctgctggctgtgtgagaggagccaggagcaccggggccaccacaccttcctgacagaggaggtggcccgggagtaccaggtgaagctgcaggccgccctggagatgctgcggcagaagcagcaggaggccgaggagctggaggccgacatccgggaggagaaggcctcctggaagacccagatccagtatgacaagaccaacgtgctggccgactttgagcagctgcgggacatcctggactgggaggagagcaatgagctgcagaacctggagaaggaggaggaggacatcctgaagagcctgaccaacagcgagacagagatggtgcagcagacccagagcctgcgggagctgatcagtgacctggagcaccggctgcagggctctgtgatggagctgctgcagggcgtggatggagtcatcaagaggacagaaaatgtgaccctgaagaagccagagaccttccccaagaaccagaggagggtcttccgggccccagacctgaagggcatgctggaggtgttccgggagctgacagatgtgcggcgctactgggtggatgtgacagtggcccccaacaacatcagctgtgctgtgatcagcgaggacaagaggcaggtgagcagccccaagccccagatcatctatggagcccggggcacccgctaccagacctttgtgaacttcaactactgcaccggcatcctgggcagccagagcatcaccagcggcaagcactactgggaggtggatgtgtccaagaagacagcctggatcctgggcgtgtgtgccggcttccagccagatgccatgtgcaacatcgagaagaatgaaaactaccagcccaagtatggctactgggtgattggcctggaggagggcgtgaagtgcagcgccttccaggacagcagcttccacacccccagcgtgcccttcatcgtgcccctgagcgtcatcatctgcccagacagagtgggcgtcttcctggactatgaggcctgcaccgtgtccttcttcaacatcaccaaccacggcttcctgatctacaagttcagccactgcagcttcagccagcccgtcttcccctacctgaaccccaggaaatgtggggtgcccatgaccctgtgcagccccagcagctag

SEQ ID NO: 174383 - DNA, 1044 bp, Artificial Sequence
  Description of Artificial Sequence: Synthetic coding sequence
atggccagcggcatcctggtgaatgtgaaggaggaggtgacctgccccatctgcctggagctgctgacccagcccctgagcctggactgtggccacagcttctgccaggcctgcctgacagccaaccacaagaagtccatgctggacaagggggagagcagctgccctgtgtgccgcatctcctaccagcctgagaacatccggcccaacagacatgtggccaacatcgtggagaagctgcgggaggtgaagctgagccctgagggccagaaggtggaccactgtgcccggcacggggagaagctgctgctcttctgccaggaggatggcaaggtgatctgctggctgtgtgagaggagccaggagcaccggggccaccacaccttcctgacagaggaggtggcccgggagtaccaggtgaagctgcaggccgccctggagatgctgcggcagaagcagcaggaggccgaggagctggaggccgacatccgggaggagaaggcctcctggaagacccagatccagtatgacaagaccaacgtgctggccgactttgagcagctgcgggacatcctggactgggaggagagcaatgagctgcagaacctggagaaggaggaggaggacatcctgaagagcctgaccaacagcgagacagagatggtgcagcagacccagagcctgcgggagctgatcagtgacctggagcaccggctgcagggctctgtgatggagctgctgcagggcgtggatggagtcatcaagaggacagaaaatgtgaccctgaagaagccagagaccttccccaagaaccagaggagggtcttccgggccccagacctgaagggcatgctggaggtgttccgggagctgacagatgtgcggcgctactggggcaaggagaagagccactaccacaagccaccctgtggcctgagcctgctgctgagcctgtccttccgcatcctgtgcagcctgctgggcagctgcttcaagatctatgacagccccagcaagacccacatcacctaccccagcctgtag

SEQ ID NO: 174384 - DNA, 984 bp, Artificial Sequence
  Description of Artificial Sequence: Synthetic coding sequence
atggccagcggcatcctggtgaatgtgaaggaggaggtgacctgccccatctgcctggagctgctgacccagcccctgagcctggactgtggccacagcttctgccaggcctgcctgacagccaaccacaagaagtccatgctggacaagggggagagcagctgccctgtgtgccgcatctcctaccagcctgagaacatccggcccaacagacatgtggccaacatcgtggagaagctgcgggaggtgaagctgagccctgagggccagaaggtggaccactgtgcccggcacggggagaagctgctgctcttctgccaggaggatggcaaggtgatctgctggctgtgtgagaggagccaggagcaccggggccaccacaccttcctgacagaggaggtggcccgggagtaccaggtgaagctgcaggccgccctggagatgctgcggcagaagcagcaggaggccgaggagctggaggccgacatccgggaggagaaggcctcctggaagacccagatccagtatgacaagaccaacgtgctggccgactttgagcagctgcgggacatcctggactgggaggagagcaatgagctgcagaacctggagaaggaggaggaggacatcctgaagagcctgaccaacagcgagacagagatggtgcagcagacccagagcctgcgggagctgatcagtgacctggagcaccggctgcagggctctgtgatggagctgctgcaggccggcgtgcagtgcctgatcctgaggacagaaaatgtgaccctgaagaagccagagaccttccccaagaaccagaggagggtcttccgggccccagacctgaagggcatgctggaggtgttccgggagctgacagatgtgcggcgctactggggctggagcgccatggcccggagccgcttcaccgccaccagcaccagccagatccaggccatcctgctgccccagccccccaagtag

SEQ ID NO: 174385 - DNA, 981 bp, Artificial Sequence; identical to SEQ ID NO: 174381
  Description of Artificial Sequence: Synthetic coding sequence

SEQ ID NO: 174386 - DNA, 630 bp, Artificial Sequence
  Description of Artificial Sequence: Synthetic coding sequence
atggccagcggcatcctggtgaatgtgaaggaggaggtgacctgccccatctgcctggagctgctgacccagcccctgagcctggactgtggccacagcttctgccaggcctgcctgacagccaaccacaagaagtccatgctggacaagggggagagcagctgccctgtgtgccgcatctcctaccagcctgagaacatccggcccaacagacatgtggccaacatcgtggagaagctgcgggaggtgaagctgagccctgagggccagaaggtggaccactgtgcccggcacggggagaagctgctgctcttctgccaggaggatggcaaggtgatctgctggctgtgtgagaggagccaggagcaccggggccaccacaccttcctgacagaggaggtggcccgggagtaccaggtgaagctgcaggccgccctggagatgctgcggcagaagcagcaggaggccgaggagctggaggccgacatccgggaggagaaggcctcctggaagacccagatccagtatgacaagaccaacgtgctggccgactttgagcagctgcgggacatcctggactgggaggagagcaatgagctgcagaacctggagaaggaggaggaggactag

SEQ ID NO: 174387 - DNA, 219 bp, Artificial Sequence
  Description of Artificial Sequence: Synthetic coding sequence
atggccagcggcatcctggtgaatgtgaaggaggaggtgacctgccccatctgcctggagctgctgacccagcccctgagcctggactgtggccacagcttctgccaggcctgcctgacagccaaccacaagaagtccatgctggacaagggggagagcagctgccctgtgtgccgcatctcctaccagcctgagaacatccggcccaacagacactag

SEQ ID NO: 174388 - DNA, 816 bp, Artificial Sequence
  Description of Artificial Sequence: Synthetic coding sequence
atggccagcggcatcctggtgaatgtgaaggaggaggtgacctgccccatctgcctggagctgctgacccagcccctgagcctggactgtggccacagcttctgccaggcctgcctgacagccaaccacaagaagtccatgctggacaagggggagagcagctgccctgtgtgccgcatctcctaccagcctgagaacatccggcccaacagacatgtggccaacatcgtggagaagctgcgggaggtgaagctgagccctgagggccagaaggtggaccactgtgcccggcacggggagaagctgctgctcttctgccaggaggatggcaaggtgatctgctggctgtgtgagaggagccaggagcaccggggccaccacaccttcctgacagaggaggtggcccgggagtaccaggtgaagctgcaggccgccctggagatgctgcggcagaagcagcaggaggccgaggagctggaggccgacatccgggaggagaaggcctcctggaagacccagatccagtatgacaagaccaacgtgctggccgactttgagcagctgcgggacatcctggactgggaggagagcaatgagctgcagaacctggagaaggaggaggaggacatcctgaagagcctgaccaacagcgagacagagatggtgcagcagacccagagcctgcgggagctgatcagtgacctggagcaccggctgcagggctctgtgatggagctgctgcaggatggagagcgggacctggaggaggccaggaacttcagcaagaagagcaaggagagcgtgagcagcagctag

SEQ ID NO: 174389 - DNA, 1464 bp, Artificial Sequence
  Description of Artificial Sequence: Synthetic coding sequence
atggcctggcaggtgtccctgctggagctggaggactggctgcagtgccccatctgcctggaggtgttcaaggagcccctgatgctgcagtgtggccacagctactgcaagggctgcctggtgtccctgagctgccacctggatgctgagctgcgctgccctgtgtgccggcaggccgtggatggcagcagcagcctgcccaacgtgtccctggcccgggtgattgaggccctgcggctgcccggggaccctgagcccaaggtgtgtgtgcaccacaggaaccccctgagcctcttctgtgagaaggaccaggagctgatctgtggcctgtgtggcctgctgggcagccaccagcaccaccctgtgacccctgtgtccacagtgtacagcaggatgaaggaggagctggccgccctgatcagcgagctgaagcaggagcagaagaaggtggatgagctgattgccaagctggtgaacaacagaacccgcatcgtgaatgaaagtgatgtgttctcctgggtgatccggcgggagttccaggagctgcaccacctggtggatgaggagaaggcccgctgcctggagggcattggaggccacacccggggcctggtggccagcctggacatgcagctggagcaggcccagggcacccgggagcggctggcccaggccgagtgtgtgctggagcagtttggaaatgaagaccaccacaagttcatcaggaagttccacagcatggccagcagagctgagatgccccaggcccggcccctggagggcgccttcagccccatctccttcaagccaggcctgcaccaggccgacatcaagctgactgtgtggaagaggctcttcaggaaggtgctgcctgcccctgagcccctgaagctggaccctgccacagcccaccccctgctggagctgagcaaaggaaacacagtggtgcagtgtggcctgctggcccagaggcgggccagccagcctgagagatttgactacagcacctgtgtgctggccagccggggcttcagctgtggccgccactactgggaggtggtggtgggcagcaagagtgactggaggctgggcgtcatcaagggcacagccagcaggaagggcaagctgaacagaagccctgagcacggcgtgtggctgattggcctgaaggagggccgggtgtatgaggcctttgcctgcccccgggtgcccctgcctgtggccggccacccccaccgcatcggcctgtacctgcactatgagcagggcgagctgaccttctttgatgctgacagaccagatgacctgcggcccctgtacaccttccaggccgacttccagggcaagctgtaccccatcctggacacctgctggcatgagcggggcagcaacagcctgcccatggtgctgcccccacccagcggccctggccccctgagccctgagcagcccaccaagctgtag

SEQ ID NO: 174390 - DNA, 1464 bp, Artificial Sequence; identical to SEQ ID NO: 174389
  Description of Artificial Sequence: Synthetic coding sequence

SEQ ID NO: 174391 - DNA, 1467 bp, Artificial Sequence
  Description of Artificial Sequence: Synthetic coding sequence
atgaccagccctgtgctggtggacatccgggaggaggtgacctgccccatctgcctggagctgctgacagagcccctgagcattgactgtggccacagcttctgccaggcctgcatcacccccaacggccgggagagcgtcatcggccaggagggggagaggagctgccctgtgtgccagaccagctaccagcccggcaacctgcggcccaacagacacctggccaacatcgtgcggcggctgcgggaggtggtgctgggccctgggaagcagctgaaggctgtgctgtgtgccgaccacggggagaagctgcagctgttctgccaggaggatggcaaggtgatctgctggctgtgtgagaggagccaggagcaccggggccaccacaccttcctggtggaggaggtggcccaggagtaccaggagaagttccaggagagcctgaagaagctgaagaatgaggagcaggaggccgagaagctgacagccttcatccgggagaagaagacctcctggaagaaccagatggagcctgagcgctgccgcatccagacagagttcaaccagctgaggaacatcctggacagagtggagcagcgggagctgaagaagctggagcaggaggagaagaagggcctgcgcatcatcgaggaggccgagaatgacctggtgcaccagacccagagcctgcgggagctgatcagtgacctggagcggcgctgccagggcagcaccatggagctgctgcaggatgtgtctgatgtgacagagaggtctgagttctggaccctgaggaagccagaggccctgcccaccaagctgcgctccatgttccgggccccagacctgaagaggatgctgcgggtgtgccgggagctgacagatgtgcagagctactgggtggatgtgaccctgaacccccacacagccaacctgaacctggtgctggccaagaacagacggcaggtgcgctttgtgggcgccaaggtgtctggccccagctgcctggagaagcactatgactgcagcgtgctgggcagccagcacttcagcagcggcaagcactactgggaggtggatgtggccaagaagacagcctggatcctgggcgtgtgcagcaacagcctgggccccaccttctccttcaaccactttgcccagaaccacagcgcctacagccgctaccagccccagagcggctactgggtgattggcctgcagcacaaccacgagtaccgggcctatgaggacagcagccccagcctgctgctgtccatgacagtgcccccaagaagagtgggcgtcttcctggactatgaagctggcaccgtgtccttctacaacgtgaccaaccacggcttccccatctacaccttcagcaagtactacttccccaccaccctgtgcccctacttcaacccctgcaactgtgtgatccccatgaccctgcggcggcccagcagctag

SEQ ID NO: 174392 - DNA, 1551 bp, Artificial Sequence
  Description of Artificial Sequence: Synthetic coding sequence
atgtgtggcagcgagcgcatcctgcaggccggcaacatcctggagatccgggtgggccaggccggggcccggcgggtggccaccatgaccagccctgtgctggtggacatccgggaggaggtgacctgccccatctgcctggagctgctgacagagcccctgagcattgactgtggccacagcttctgccaggcctgcatcacccccaacggccgggagagcgtcatcggccaggagggggagaggagctgccctgtgtgccagaccagctaccagcccggcaacctgcggcccaacagacacctggccaacatcgtgcggcggctgcgggaggtggtgctgggccctgggaagcagctgaaggctgtgctgtgtgccgaccacggggagaagctgcagctgttctgccaggaggatggcaaggtgatctgctggctgtgtgagaggagccaggagcaccggggccaccacaccttcctggtggaggaggtggcccaggagtaccaggagaagttccaggagagcctgaagaagctgaagaatgaggagcaggaggccgagaagctgacagccttcatccgggagaagaagacctcctggaagaaccagatggagcctgagcgctgccgcatccagacagagttcaaccagctgaggaacatcctggacagagtggagcagcgggagctgaagaagctggagcaggaggagaagaagggcctgcgcatcatcgaggaggccgagaatgacctggtgcaccagacccagagcctgcgggagctgatcagtgacctggagcggcgctgccagggcagcaccatggagctgctgcaggatgtgtctgatgtgacagagaggtctgagttctggaccctgaggaagccagaggccctgcccaccaagctgcgctccatgttccgggccccagacctgaagaggatgctgcgggtgtgccgggagctgacagatgtgcagagctactgggtggatgtgaccctgaacccccacacagccaacctgaacctggtgctggccaagaacagacggcaggtgcgctttgtgggcgccaaggtgtctggccccagctgcctggagaagcactatgactgcagcgtgctgggcagccagcacttcagcagcggcaagcactactgggaggtggatgtggccaagaagacagcctggatcctgggcgtgtgcagcaacagcctgggccccaccttctccttcaaccactttgcccagaaccacagcgcctacagccgctaccagccccagagcggctactgggtgattggcctgcagcacaaccacgagtaccgggcctatgaggacagcagccccagcctgctgctgtccatgacagtgcccccaagaagagtgggcgtcttcctggactatgaagctggcaccgtgtccttctacaacgtgaccaaccacggcttccccatctacaccttcagcaagtactacttccccaccaccctgtgcccctacttcaacccctgcaactgtgtgatccccatgaccctgcggcggcccagcagctag

SEQ ID NO: 174393 - DNA, 1389 bp, Artificial Sequence
  Description of Artificial Sequence: Synthetic coding sequence
atgaccagccctgtgctggtggacatccgggaggaggtgacctgccccatctgcctggagctgctgacagagcccctgagcattgactgtggccacagcttctgccaggcctgcatcacccccaacggccgggagagcgtcatcggccaggagggggagaggagctgccctgtgtgccagaccagctaccagcccggcaacctgcggcccaacagacacctggccaacatcgtgcggcggctgcgggaggaggatggcaaggtgatctgctggctgtgtgagaggagccaggagcaccggggccaccacaccttcctggtggaggaggtggcccaggagtaccaggagaagttccaggagagcctgaagaagctgaagaatgaggagcaggaggccgagaagctgacagccttcatccgggagaagaagacctcctggaagaaccagatggagcctgagcgctgccgcatccagacagagttcaaccagctgaggaacatcctggacagagtggagcagcgggagctgaagaagctggagcaggaggagaagaagggcctgcgcatcatcgaggaggccgagaatgacctggtgcaccagacccagagcctgcgggagctgatcagtgacctggagcggcgctgccagggcagcaccatggagctgctgcaggatgtgtctgatgtgacagagaggtctgagttctggaccctgaggaagccagaggccctgcccaccaagctgcgctccatgttccgggccccagacctgaagaggatgctgcgggtgtgccgggagctgacagatgtgcagagctactgggtggatgtgaccctgaacccccacacagccaacctgaacctggtgctggccaagaacagacggcaggtgcgctttgtgggcgccaaggtgtctggccccagctgcctggagaagcactatgactgcagcgtgctgggcagccagcacttcagcagcggcaagcactactgggaggtggatgtggccaagaagacagcctggatcctgggcgtgtgcagcaacagcctgggccccaccttctccttcaaccactttgcccagaaccacagcgcctacagccgctaccagccccagagcggctactgggtgattggcctgcagcacaaccacgagtaccgggcctatgaggacagcagccccagcctgctgctgtccatgacagtgcccccaagaagagtgggcgtcttcctggactatgaagctggcaccgtgtccttctacaacgtgaccaaccacggcttccccatctacaccttcagcaagtactacttccccaccaccctgtgcccctacttcaacccctgcaactgtgtgatccccatgaccctgcggcggcccagcagctag

SEQ ID NO: 174394 - DNA, 1188 bp, Artificial Sequence
  Description of Artificial Sequence: Synthetic coding sequence
atgtgtggcagcgagcggccctggaggaagacagctgccctgctgagcggcggctgggagggccacctgctggcctgtgagaggagccaggagcaccggggccaccacaccttcctggtggaggaggtggcccaggagtaccaggagaagttccaggagagcctgaagaagctgaagaatgaggagcaggaggccgagaagctgacagccttcatccgggagaagaagacctcctggaagaaccagatggagcctgagcgctgccgcatccagacagagttcaaccagctgaggaacatcctggacagagtggagcagcgggagctgaagaagctggagcaggaggagaagaagggcctgcgcatcatcgaggaggctgaaaatgacctggtgcaccagacccagagcctgcgggagctgatcagtgacctggagcggcgctgccagggcagcaccatggagctgctgcaggatgtgtctgatgtgacagagaggtctgagttctggaccctgaggaagccagaggccctgcccaccaagctgcgctccatgttccgggccccagacctgaagaggatgctgcgggtgtgccgggagctgacagatgtgcagagctactgggtggatgtgaccctgaacccccacacagccaacctgaacctggtgctggccaagaacagacggcaggtgcgctttgtgggcgccaaggtgtctggccccagctgcctggagaagcactatgactgcagcgtgctgggcagccagcacttcagcagcggcaagcactactgggaggtggatgtggccaagaagacagcctggatcctgggcgtgtgcagcaacagcctgggccccaccttctccttcaaccactttgcccagaaccacagcgcctacagccgctaccagccccagagcggctactgggtgattggcctgcagcacaaccacgagtaccgggcctatgaggacagcagccccagcctgctgctgtccatgacagtgcccccccggcgggtgggcgtcttcctggactatgaggccggcaccgtgtccttctacaacgtgaccaaccacggcttccccatctacaccttcagcaagtactacttccccaccaccctgtgcccctacttcaacccctgcaactgtgtgatccccatgaccctgcggcggcccagcagctag

SEQ ID NO: 174395 - DNA, 942 bp, Artificial Sequence
  Description of Artificial Sequence: Synthetic coding sequence
atggagcctgagcgctgccgcatccagacagagttcaaccagctgaggaacatcctggacagagtggagcagcgggagctgaagaagctggagcaggaggagaagaagggcctgcgcatcatcgaggaggctgaaaatgacctggtgcaccagacccagagcctgcgggagctgatcagtgacctggagcggcgctgccagggcagcaccatggagctgctgcaggatgtgtctgatgtgacagagaggtctgagttctggaccctgaggaagccagaggccctgcccaccaagctgcgctccatgttccgggccccagacctgaagaggatgctgcgggtgtgccgggagctgacagatgtgcagagctactgggtggatgtgaccctgaacccccacacagccaacctgaacctggtgctggccaagaacagacggcaggtgcgctttgtgggcgccaaggtgtctggccccagctgcctggagaagcactatgactgcagcgtgctgggcagccagcacttcagcagcggcaagcactactgggaggtggatgtggccaagaagacagcctggatcctgggcgtgtgcagcaacagcctgggccccaccttctccttcaaccactttgcccagaaccacagcgcctacagccgctaccagccccagagcggctactgggtgattggcctgcagcacaaccacgagtaccgggcctatgaggacagcagccccagcctgctgctgtccatgacagtgcccccccggcgggtgggcgtcttcctggactatgaggccggcaccgtgtccttctacaacgtgaccaaccacggcttccccatctacaccttcagcaagtactacttccccaccaccctgtgcccctacttcaacccctgcaactgtgtgatccccatgaccctgcggcggcccagcagctag

SEQ ID NO: 174396 - DNA, 942 bp, Artificial Sequence; identical to SEQ ID NO: 174395
  Description of Artificial Sequence: Synthetic coding sequence

SEQ ID NO: 174397 - DNA, 942 bp, Artificial Sequence; identical to SEQ ID NO: 174395
  Description of Artificial Sequence: Synthetic coding sequence

SEQ ID NO: 174398 - DNA, 942 bp, Artificial Sequence; identical to SEQ ID NO: 174395
  Description of Artificial Sequence: Synthetic coding sequence

SEQ ID NO: 174399 - DNA, 3651 bp, Artificial Sequence
  Description of Artificial Sequence: Synthetic coding sequence
atggccaggaactgcagcgagtgcaaggagaagagagctgcccacatcctgtgcacctactgcaaccgctggctgtgcagcagctgcacagaggagcaccgccacagccctgtgcctgggggccccttcttcccccgggcccagaagggcagccctggggtgaatggaggccctggggacttcaccctgtactgccccctgcacacccaggaggtgctgaagctgttctgtgagacctgtgacatgctgacctgccacagctgcctggtggtggagcacaaggagcaccgctgccgccacgtggaggaggtgctgcagaaccagaggatgctgctggagggcgtgaccacccaggtggcccacaagaagagcagcctgcagaccagcgccaagcagatcgaggaccgcatctttgaggtgaagcaccagcacaggaaggtggagaaccagatcaagatggccaagatggtgctgatgaatgagctgaacaagcaggccaacggcctcatcgaggagctggagggcatcaccaatgaaaggaagaggaagctggagcagcagctgcagagcatcatggtgctgaaccggcagtttgagcacgtgcagaacttcatcaactgggccgtgtgcagcaagacctctgtgcccttcctgttcagcaaggagctgattgtgttccagatgcagaggctgctggagaccagctgcaacacagaccccggcagcccctggagcatccgcttcacctgggagcccaacttctggaccaagcagctggccagcctgggctgcatcaccacagaaggaggccagatgagcagagcagatgccccagcctacggcggcctgcagggcagcagccccttctaccagagccaccagagccctgtggcccagcaggaggccctgagccaccccagccacaagttccagagccctgctgtgtgcagcagctctgtgtgctgcagccactgcagccctgtgagccccagcctgaagggccaggtgcccccacccagcatccacccagcccacagcttccggcagcccccagagatggtgccccagcagctgggcagcctgcagtgcagcgccctgctgccccgggagaaggagctggcctgcagcccccacccccccaagctgctgcagccctggctggagacccagccccctgtggagcaggagagcaccagccagaggctgggccagcagctgaccagccagcctgtgtgcatcgtgcccccccaggatgtgcagcagggcgcccacgcccagcccaccctgcagacccccagcatccaggtgcagtttggccaccaccagaagctgaagctgagccacttccagcagcagccccagcagcagctgcccccacctcctccacccctgccccaccccccaccacccctgcccccaccaccccagcagccccacccccccctgccccccagccagcacctggccagcagccagcacgagagccccccaggccctgcctgcagccagaacatggacatcatgcaccacaagtttgagctggaggagatgcagaaggacctggagctgctgctgcaggcccagcagcccagcctgcagctgagccagaccaagagcccccagcacctgcagcagaccatcgtgggccagatcaactacatcgtgcggcagcctgcccctgtgcagagccagagccaggaggagaccctgcaggccacagatgagcccccagccagccagggcagcaagccagccctgcccctggacaagaacacagctgctgccctgccccaggccagcggggaggagacccccctgtctgtgccccctgtggacagcaccatccagcacagcagccccaacgtggtgaggaagcacagcaccagcctgagcatcatgggcttcagcaacaccctggagatggagctgagcagcacccggctggagcggcccctggagccccagatccagagcgtgagcaacctgacagctggggccccccaggccgtgcccagcctgctgagcgccccacccaagatggtgagcagcctgacctctgtgcagaaccaggccatgcccagcctgaccaccagccacctgcagacagtgcccagcctggtgcacagcaccttccagagcatgcccaacctgatcagtgacagcccccaggccatggccagcctggccagtgaccacccccaggccggccccagcctgatgagcggccacacccaggccgtgcccagcctggccacctgccccctgcagagcatcccccctgtgtctgacatgcagcctgagaccggcagcagcagcagcagcggccgcaccagcggcagcctgtgccccagagatggagctgaccccagcctggagaatgccctgtgcaaggtgaagctggaggagcccatcaacctgtctgtgaagaagccacccctggcccctgtggtgtccaccagcacagccctgcagcagtaccagaaccccaaggaatgtgaaaattttgagcagggcgccctggagctggatgccaaggagaaccagagcatccgggccttcaacagcgagcacaagatcccctacgtgcggctggagcggctgaagatctgtgccgccagcagcggggagatgcctgtgttcaagctgaagccccagaagaatgaccaggacggcagcttcctgctgatcattgaatgtggcacagagagcagctccatgagcatcaaggtgtcccaggaccggctgtctgaggccacccaggcccctggcctggagggcaggaaggtgacagtgaccagcctggccggccagaggcctcctgaggtggagggcaccagccctgaggagcacaggctcatccccaggacccctggggccaagaagggccccccagcccccattgaaaatgaagacttctgtgctgtgtgcctgaatggaggagagctgctgtgctgtgaccgctgccccaaggtgttccacctgagctgccacgtgcctgccctgctgtccttccctggaggagagtgggtgtgcaccctgtgccgcagcctgacccagcctgagatggagtatgactgtgaaaatgcctgctacaaccagcccggcatgagggccagccctggcctgtccatgtatgaccagaagaagtgtgagaagctggtgctgagcctgtgctgcaacaacctgagcctgcccttccacgagcctgtgagccccctggcccggcactactaccagatcatcaagaggcccatggacctgagcatcatccggaggaagctgcagaagaaggaccctgcccactacaccaccccagaggaggtggtgtctgatgtgcggctgatgttctggaactgtgccaagttcaactacccagattctgaggtggccgaggccggccgctgcctggaggtgttctttgagggctggctgaaggagatctacccagagaagagatttgcccagccccggcaggaggacagcgacagcgaggaggtgagcagcgagagcggctgcagcaccccccagggcttcccctggccaccctacatgcaggagggcatccagcccaagagaagaagaagacacatggagaatgaaagagccaagaggatgtccttccggctggccaacagcatcagccaggtgtag

SEQ ID NO: 174400 - DNA, 1458 bp, Artificial Sequence
  Description of Artificial Sequence: Synthetic coding sequence
atggaccccacagccctggtggaggccatcgtggaggaggtggcctgccccatctgcatgaccttcctgcgggagcccatgagcattgactgtggccacagcttctgccacagctgcctgagcggcctgtgggagatccctggagagagccagaactggggctacacctgccccctgtgccgggcccctgtgcagcccaggaacctgcggcccaactggcagctggccaacgtggtggagaaggtgcggctgctgcggctgcaccctggcatgggcctgaagggggacctgtgtgaaagacatggagagaagctgaagatgttctgcaaggaggatgtgctgatcatgtgtgaggcctgcagccagagccctgagcacgaggcccacagcgtggtgcccatggaggatgtggcctgggagtacaagtgggagctgcacgaggccctggagcacctgaagaaggagcaggaggaggcctggaagctggaggtgggggagaggaagaggacagccacctggaagatccaggtggagaccaggaagcagagcatcgtgtgggagtttgagaagtaccagaggctgctggagaagaagcagcccccccaccggcagctgggcgctgaggtggccgccgccctggccagcctgcagcgggaggccgctgagaccatgcagaagctggagctgaaccacagcgagctgatccagcagagccaggtgctgtggaggatgattgctgagctgaaggagaggagccagaggcctgtgcgctggatgctgcaggacatccaggaggtgctgaacagaagcaagtcctggagcctgcagcagcctgagcccatcagcctggagctgaagacagactgccgggtgctgggcctgcgggagatcctgaagacctacgccgcagatgtgcggctggaccctgacacagcctacagccggctgattgtgtctgaggacaggaagagggtgcactatggagacaccaaccagaagctgcctgacaaccctgagcgcttctaccgctacaacatcgtgctgggcagccagtgcatcagcagcggccgccactactgggaggtggaggtgggggacagaagtgagtggggcctgggcgtgtgcaagcagaatgtggacaggaaggaggtggtgtacctgagcccccactacggcttctgggtgatccggctgaggaaaggaaatgagtaccgggccggcacagatgagtaccccatcctgagcctgcctgtgcccccaagaagagtgggcatctttgtggactatgaggcccatgacatctccttctacaacgtgacagactgtggcagccacatcttcaccttcccccgctaccccttccctggccgcctgctgccctacttcagcccctgctacagcatcggcaccaacaacacagcccccctggccatctgcagcctggatggagaggactag

SEQ ID NO: 174401 - DNA, 621 bp, Artificial Sequence
  Description of Artificial Sequence: Synthetic coding sequence
atgcagaagctggagctgaagacagactgccgggtgctgggcctgcgggagatcctgaagacctatgctgctgatgtgcggctggaccctgacacagcctacagccgcctcatcgtgtctgaggacaggaagagggtgcactacggggacaccaaccagaagctgcctgacaaccctgagcgcttctaccgctacaacatcgtgctgggcagccagtgcatcagcagcggccgccactactgggaggtggaggtgggggacagaagtgagtggggcctgggcgtgtgcaagcagaatgtggacaggaaggaggtggtgtacctgagcccccactacggcttctgggtgatccggctgaggaaaggaaatgagtacagagctggaacagatgagtaccccatcctgagcctgcctgtgcccccccggcgggtgggcatctttgtggactatgaggcccatgacatctccttctacaacgtgacagactgtggcagccacatcttcaccttcccccgctaccccttccctggccgcctgctgccctacttcagcccctgctacagcatcggcaccaacaacacagcccccctggccatctgcagcctggatggagaagattag

SEQ ID NO: 174402 - DNA, 1536 bp, Artificial Sequence
  Description of Artificial Sequence: Synthetic coding sequence
atggctgctgtgggccccaggacaggccctggcaccggggctgaggccctggccctggccgctgagctgcagggcgaggccacctgcagcatctgcctggagctgttccgggagcctgtgtctgtggagtgtggccacagcttctgccgggcctgcatcggccgctgctgggagaggcctggggccggctctgtgggcgccgccacccgggccccacccttccccctgccctgcccccagtgccgggagcccgcccggcccagccagctgcggcccaaccggcagctggccgctgtggccaccctgctgcggcgcttcagcctgcctgctgctgcccctggagagcacggcagccaggccgccgccgcccgggctgctgctgcccgctgtggccagcacggggagcccttcaagctgtactgccaggatgatggccgggccatctgtgtggtgtgtgaccgggcccgggagcaccgggagcacgctgtgctgcccctggatgaagctgtgcaggaggccaaggagctgctggagagccggctgcgggtgctgaagaaggagctggaggactgtgaggtgttccgcagcacagagaagaaggagagcaaggagctgctgaagcagatggctgctgagcaggagaaggtgggcgctgagttccaggccctgcgggccttcctggtggagcaggagggccgcctgctgggccgcctggaggagctgagccgggaggtggcccagaagcagaatgaaaacctggcccagctgggcgtggagatcacccagctgagcaagctgagcagccagatccaggagacagcccagaagccagacctggacttcctgcaggagttcaagagcaccctgagccgctgcagcaatgtgcccggccccaagcccaccaccgtgtcctctgagatgaagaacaaggtgtggaatgtgtccctgaagacctttgtgctgaagggcatgctgaagaagttcaaggaggacctgcggggggagctggagaaggaggagaaggtggagctgaccctggaccctgacacagccaaccccaggctcatcctgagcctggacctgaagggcgtgcggctgggggagcgggcccaggacctgcccaaccacccctgccgctttgacaccaacaccagggtgctggccagctgtggcttcagcagcggccgccaccactgggaggtggaggtgggcagcaaggatggctgggcctttggagtggcccgggagagcgtgcggaggaagggcctgacccccttcaccccagaggagggcgtgtgggccctgcagctgaatggaggccagtactgggccgtgaccagccctgagaggagccccctgagctgtggccacctgagccgggtgcgggtggccctggacctggaggtgggcgctgtgtccttctatgctgtggaggacatgaggcacctgtacaccttccgggtgaacttccaggagagggtcttccccctcttctctgtgtgcagcacaggcacctacctgcgcatctggccctag

SEQ ID NO: 174403 - DNA, 666 bp, Artificial Sequence
  Description of Artificial Sequence: Synthetic coding sequence
atggctgctgtgggccccaggacaggccctggcaccggggctgaggccctggccctggccgctgagctgcagggcgaggccacctgcagcatctgcctggagctgttccgggagcctgtgtctgtggagtgtggccacagcttctgccgggcctgcatcggccgctgctgggagaggcctggggccggctctgtgggcgccgccacccgggccccacccttccccctgccctgcccccagtgccgggagcccgcccggcccagccagctgcggcccaaccggcagctggccgctgtggccaccctgctgcggcgcttcagcctgcctgctgctgcccctggagagcacggcagccaggccgccgccgcccgggctgctgctgcccgctgtggccagcacggggagcccttcaagctgtactgccaggatgatggccgggccatctgtgtggtgtgtgaccgggcccgggagcaccgggagcacgctgtgctgcccctggatgaagctgtgcaggaggccaaggagctgctggagagccggctgcgggtgctgaagaaggagctggaggactgtgaggtgttccgcagcacagagaagaaggagagcaaggagctgctggtgtcccaggccccagctggccccccctgggacatcacagaggcctag

SEQ ID NO: 174404 - DNA, 912 bp, Artificial Sequence
  Description of Artificial Sequence: Synthetic coding sequence
atggctgctgagcaggagaaggtgggcgctgagttccaggccctgcgggccttcctggtggagcaggagggccgcctgctgggccgcctggaggagctgagccgggaggtggcccagaagcagaatgaaaacctggcccagctgggcgtggagatcacccagctgagcaagctgagcagccagatccaggagacagcccagaagccagacctggacttcctgcaggagttcaagagcaccctgagccgctgcagcaatgtgcccggccccaagcccaccaccgtgtcctctgagatgaagaacaaggtgtggaatgtgtccctgaagacctttgtgctgaagggcatgctgaagaagttcaaggaggacctgcggggggagctggagaaggaggagaaggtggagctgaccctggaccctgacacagccaaccccaggctcatcctgagcctggacctgaagggcgtgcggctgggggagcgggcccaggacctgcccaaccacccctgccgctttgacaccaacaccagggtgctggccagctgtggcttcagcagcggccgccaccactgggaggtggaggtgggcagcaaggatggctgggcctttggagtggcccgggagagcgtgcggaggaagggcctgacccccttcaccccagaggagggcgtgtgggccctgcagctgaatggaggccagtactgggccgtgaccagccctgagaggagccccctgagctgtggccacctgagccgggtgcgggtggccctggacctggaggtgggcgctgtgtccttctatgctgtggaggacatgaggcacctgtacaccttccgggtgaacttccaggagagggtcttccccctcttctctgtgtgcagcacaggcacctacctgcgcatctggccctag

SEQ ID NO: 174405 - DNA, 912 bp, Artificial Sequence; identical to SEQ ID NO: 174404
  Description of Artificial Sequence: Synthetic coding sequence

SEQ ID NO: 174406 - DNA, 990 bp, Artificial Sequence
  Description of Artificial Sequence: Synthetic coding sequence
atgacccaggccaccggccagatgctgtgcctgcacgtgcaggtgcccctgcagctgctgctgctgggccagaagcagatggctgctgagcaggagaaggtgggcgctgagttccaggccctgcgggccttcctggtggagcaggagggccgcctgctgggccgcctggaggagctgagccgggaggtggcccagaagcagaatgaaaacctggcccagctgggcgtggagatcacccagctgagcaagctgagcagccagatccaggagacagcccagaagccagacctggacttcctgcaggagttcaagagcaccctgagccgctgcagcaatgtgcccggccccaagcccaccaccgtgtcctctgagatgaagaacaaggtgtggaatgtgtccctgaagacctttgtgctgaagggcatgctgaagaagttcaaggaggacctgcggggggagctggagaaggaggagaaggtggagctgaccctggaccctgacacagccaaccccaggctcatcctgagcctggacctgaagggcgtgcggctgggggagcgggcccaggacctgcccaaccacccctgccgctttgacaccaacaccagggtgctggccagctgtggcttcagcagcggccgccaccactgggaggtggaggtgggcagcaaggatggctgggcctttggagtggcccgggagagcgtgcggaggaagggcctgacccccttcaccccagaggagggcgtgtgggccctgcagctgaatggaggccagtactgggccgtgaccagccctgagaggagccccctgagctgtggccacctgagccgggtgcgggtggccctggacctggaggtgggcgctgtgtccttctatgctgtggaggacatgaggcacctgtacaccttccgggtgaacttccaggagagggtcttccccctcttctctgtgtgcagcacaggcacctacctgcgcatctggccctag

SEQ ID NO: 174407 - DNA, 912 bp, Artificial Sequence; identical to SEQ ID NO: 174404
  Description of Artificial Sequence: Synthetic coding sequence

SEQ ID NO: 174408 - DNA, 1434 bp, Artificial Sequence
  Description of Artificial Sequence: Synthetic coding sequence
atgtctgctgcccctggcctgctgcaccaggagctgagctgccccctgtgcctgcagctgtttgatgcccctgtgacagcagaatgtggccacagcttctgccgggcctgcctgggccgggtggccggggagcctgctgctgatggcaccgtgctgtgcccctgctgccaggcccccacccggccccaggccctgagcaccaacctgcagctggcccggctggtggagggcctggcccaggtgccccagggccactgtgaggagcacctggaccccctgagcatctactgtgagcaggaccgggccctggtgtgtggggtgtgtgccagcctgggcagccaccggggccaccggctgctgcctgctgctgaggcccacgcccggctgaagacccagctgccccagcagaagctgcagctgcaggaggcctgcatgaggaaggagaagtctgtggccgtgctggagcaccagctggtggaggtggaggagaccgtgcggcagttcagaggagctgtgggggagcagctgggcaagatgagggtcttcctggccgccctggagggcagcctggaccgggaggccgagcgggtgcggggggaggccggcgtggccctgcggcgggagctgggcagcctgaacagctacctggagcagctgcggcagatggagaaggtgctggaggaggtggccgacaagccccagacagagttcctgatgaagtactgcctggtgaccagccggctgcagaagatcctggccgagagccccccaccagcccggctggacatccagctgcccatcatcagtgatgacttcaagttccaggtgtggaggaagatgttccgggccctgatgcctgccctggaggagctgacctttgaccccagcagcgcccaccccagcctggtggtgagcagcagtggaagaagagtggagtgcagcgagcagaaggcccctcctgctggggaggacccccggcagtttgacaaggctgtggccgtggtggcccaccagcagctgtctgagggggagcactactgggaggtggatgtgggggacaagccccgctgggccctgggcgtgattgctgctgaggccccccggcggggccgcctgcatgctgtgcccagccagggcctgtggctgctgggcctgcgggagggcaagatcctggaggcccacgtggaggccaaggagccccgggccctgcggagccctgagcggcggcccaccagaattggcctgtacctgagctttggagatggagtgctgtccttctatgatgccagtgatgctgatgccctggtgcccctgtttgccttccacgagcggctgcccaggcctgtgtaccccttctttgatgtgtgctggcatgacaagggcaagaatgcccagcccctgctgctggtgggccctgagggcgctgaggcctag

SEQ ID NO: 174409 - DNA, 753 bp, Artificial Sequence
  Description of Artificial Sequence: Synthetic coding sequence
atggcctggcaggtgtccctgctggagctggaggaccggctgcagtgccccatctgcctggaggtgttcaaggagagcctgatgctgcagtgtggccacagctactgcaagggctgcctggtgtccctgagctaccacctggacaccaaggtgcgctgccccatgtgctggcaggtggtggatggcagcagcagcctgcccaacgtgtccctggcctgggtgattgaggccctgcggctgcccggggaccctgagcccaaggtgtgtgtgcaccacaggaaccccctgagcctcttctgtgagaaggaccaggagctgatctgtggcctgtgtggcctgctgggcagccaccagcaccaccctgtgacccctgtgtccacagtgtgcagcaggatgaaggaggagctggccgccctcttcagcgagctgaagcaggagcagaagaaggtggatgagctgattgccaagctggtgaagaacagaacccgcatcgtgaatgaaagtgatgtgttctcctgggtgatccggcgggagttccaggagctgcggcaccctgtggatgaggagaaggcccgctgcctggagggcattggaggccacacccggggcctggtggccagcctggacatgcagctggagcaggcccagggcacccgggagcggctggcccaggccgagtgtgtgctggagcagtttggaaatgaagaccaccacgagttcatctggaagttccacagcatggccagcaggtag

SEQ ID NO: 174410 - DNA, 849 bp, Artificial Sequence
  Description of Artificial Sequence: Synthetic coding sequence
atggcctggcaggtgtccctgctggagctggaggaccggctgcagtgccccatctgcctggaggtgttcaaggagagcctgatgctgcagtgtggccacagctactgcaagggctgcctggtgtccctgagctaccacctggacaccaaggtgcgctgccccatgtgctggcaggtggtggatggcagcagcagcctgcccaacgtgtccctggcctgggtgattgaggccctgcggctgcccggggaccctgagcccaaggtgtgtgtgcaccacaggaaccccctgagcctcttctgtgagaaggaccaggagctgatctgtggcctgtgtggcctgctgggcagccaccagcaccaccctgtgacccctgtgtccacagtgtgcagcaggatgaaggaggagctggccgccctcttcagcgagctgaagcaggagcagaagaaggtggatgagctgattgccaagctggtgaagaacagaacccgcatcgtgaatgaaagtgatgtgttctcctgggtgatccggcgggagttccaggagctgcggcaccctgtggatgaggagaaggcccgctgcctggagggcattggaggccacacccggggcctggtggccagcctggacatgcagctggagcaggcccagggcacccgggagcggctggcccaggccgagtgtgtgctggagcagtttggaaatgaagaccaccacgagttcatctggaagttccacagcatggccagccggctgaccaagacagaggagctggagaagaagtggagaaatggcctggccgccagccacagcctgccccagcaggtgcggccccagaggaggaccccctag

SEQ ID NO: 174411 - DNA, 753 bp, Artificial Sequence; identical to SEQ ID NO: 174409
  Description of Artificial Sequence: Synthetic coding sequence

SEQ ID NO: 174412 - DNA, 750 bp, Artificial Sequence
  Description of Artificial Sequence: Synthetic coding sequence
atggcctggcaggtgtccctgctggagctggaggaccggctgcagtgccccatctgcctggaggtgttcaaggagagcctgatgctgcagtgtggccacagctactgcaagggctgcctggtgtccctgagctaccacctggacaccaaggtgcgctgccccatgtgctggcaggtggtggatggcagcagcagcctgcccaacgtgtccctggcctgggtgattgaggccctgcggctgcccggggaccctgagcccaaggtgtgtgtgcaccacaggaaccccctgagcctcttctgtgagaaggaccaggagctgatctgtggcctgtgtggcctgctgggcagccaccagcaccaccctgtgacccctgtgtccacagtgtgcagcaggatgaaggaggagctggccgccctcttcagcgagctgaagcaggagcagaagaaggtggatgagctgattgccaagctggtgaagaacagaacccgcatcgtgaatgaaagtgatgtgttctcctgggtgatccggcgggagttccaggagctgcggcaccctgtggatgaggagaaggcccgctgcctggagggcattggaggccacacccggggcctggtggccagcctggacatgcagctggagcaggcccagggcacccgggagcggctggcccaggccgagtgtgtgctggagcagtttggaaatgaagaccaccacgagttcatctggttccacagcatggccagcaggtag

SEQ ID NO: 174413 - DNA, 753 bp, Artificial Sequence
  Description of Artificial Sequence: Synthetic coding sequence
atggcctggcaggtgtccctgctggagctggaggactggctgcagtgccccatctgcctggaggtgttcaaggagagcctgatgctgcagtgtggccacagctactgcaagggctgcctggtgtccctgagctaccacctggacaccaaggtgcgctgccccatgtgctggcaggtggtggatggcagcagcagcctgcccaacgtgtccctggcctgggtgattgaggccctgcggctgcccggggaccctgagcccaaggtgtgtgtgcaccacaggaaccccctgagcctcttctgtgagaaggaccaggagctgatctgtggcctgtgtggcctgctgggcagccaccagcaccaccctgtgacccctgtgtccacagtgtgcagcaggatgaaggaggagctggccgccctcttcagcgagctgaagcaggagcagaagaaggtggatgagctgattgccaagctggtgaagaacagaacccgcatcgtgaatgaaagtgatgtgttctcctgggtgatccggcgggagttccaggagctgcggcaccctgtggatgaggagaaggcccgctgcctggagggcattggaggccacacccggggcctggtggccagcctggacatgcagctggagcaggcccagggcacccgggagcggctggcccaggccgagtgtgtgctggagcagtttggaaatgaagaccaccacgagttcatctggaagttccacagcatggccagcaggtag

SEQ ID NO: 174414 - DNA, 750 bp, Artificial Sequence
  Description of Artificial Sequence: Synthetic coding sequence
atggcctggcaggtgtccctgctggagctggaggactggctgcagtgccccatctgcctggaggtgttcaaggagagcctgatgctgcagtgtggccacagctactgcaagggctgcctggtgtccctgagctaccacctggacaccaaggtgcgctgccccatgtgctggcaggtggtggatggcagcagcagcctgcccaacgtgtccctggcctgggtgattgaggccctgcggctgcccggggaccctgagcccaaggtgtgtgtgcaccacaggaaccccctgagcctcttctgtgagaaggaccaggagctgatctgtggcctgtgtggcctgctgggcagccaccagcaccaccctgtgacccctgtgtccacagtgtgcagcaggatgaaggaggagctggccgccctcttcagcgagctgaagcaggagcagaagaaggtggatgagctgattgccaagctggtgaagaacagaacccgcatcgtgaatgaaagtgatgtgttctcctgggtgatccggcgggagttccaggagctgcggcaccctgtggatgaggagaaggcccgctgcctggagggcattggaggccacacccggggcctggtggccagcctggacatgcagctggagcaggcccagggcacccgggagcggctggcccaggccgagtgtgtgctggagcagtttggaaatgaagaccaccacgagttcatctggttccacagcatggccagcaggtag

SEQ ID NO: 174415 - DNA, 1656 bp, Artificial Sequence
  Description of Artificial Sequence: Synthetic coding sequence
atggccgagaactggaagaactgctttgaggaggagctgatctgccccatctgcctgcacgtgtttgtggagcctgtgcagctgccctgcaagcacaacttctgccggggctgcattggagaggcctgggccaaggacagcggcctggtgcgctgcccagagtgcaaccaggcctacaaccagaagccaggcctggagaagaacctgaagctgaccaacatcgtggagaagttcaatgccctgcacgtggagaagcccccagctgccctgcactgtgtgttctgccggcggggcccccccctgcctgcccagaaggtgtgcctgcgctgtgaggccccctgctgccagagccacgtgcagacccacctgcagcagcccagcacagcccggggccacctgctggtggaggctgatgatgtgcgggcctggagctgcccccagcacaatgcctaccgcctgtaccactgtgaggccgagcaggtggccgtgtgccagtactgctgctactacagcggggcccaccagggccacagcgtgtgtgatgtggagatcagaagaaatgagatcaggaagatgctgatgaagcagcaggaccggctggaggagcgggagcaggacatcgaggaccagctgtacaagctggagagtgacaagaggctggtggaggagaaggtgaaccagctgaaggaggaggtgcggctgcagtatgagaagctgcaccagctgctggatgaggacctgcggcagacagtggaggtgctggacaaggcccaggccaagttctgcagtgaaaatgctgcccaggccctgcacctgggggagaggatgcaggaggccaagaagctgctgggcagcctgcagctgctgtttgacaagacagaagatgtgtccttcatgaagaacaccaagtctgtgaagatcctgatggacaggacccagacctgcaccagcagcagcctgagccccaccaagattggccacctgaacagcaagctgttcctgaatgaggtggccaagaaggagaagcagctgaggaagatgctggagggccccttcagcacccctgtgcccttcctgcagagcgtgcccctgtacccctgtggggtgagcagcagcggggctgagaagaggaagcacagcacagccttccctgaggccagcttcctggagaccagcagcggccctgtgggcggccagtacggggctgctggaacagccagcggggagggccagagcggccagcccctgggcccctgcagcagcacccagcacctggtggccctgcctggaggagcccagcctgtgcacagcagccctgtgttcccccccagccagtaccccaacggcagcgctgcccagcagcccatgctgccccagtatggaggcaggaagatcctggtgtgcagcgtggacaactgctactgcagctctgtggccaaccacggcggccaccagccctaccccaggagcggccacttcccctggacagtgcccagccaggagtacagccaccccctgccccccaccccatctgtgccccagagcctgcccagcctggccgtgcgggactggctggatgccagccagcagcccggccaccaggacttctacagagtgtatggccagcccagcaccaagcactacgtgaccagctag

SEQ ID NO: 174416 - DNA, 1653 bp, Artificial Sequence
  Description of Artificial Sequence: Synthetic coding sequence
atggccgagaactggaagaactgctttgaggaggagctgatctgccccatctgcctgcacgtgtttgtggagcctgtgcagctgccctgcaagcacaacttctgccggggctgcattggagaggcctgggccaaggacagcggcctggtgcgctgcccagagtgcaaccaggcctacaaccagaagccaggcctggagaagaacctgaagctgaccaacatcgtggagaagttcaatgccctgcacgtggagaagcccccagctgccctgcactgtgtgttctgccggcggggcccccccctgcctgcccagaaggtgtgcctgcgctgtgaggccccctgctgccagagccacgtgcagacccacctgcagcagcccagcacagcccggggccacctgctggtggaggctgatgatgtgcgggcctggagctgcccccagcacaatgcctaccgcctgtaccactgtgaggccgagcaggtggccgtgtgccagtactgctgctactacagcggggcccaccagggccacagcgtgtgtgatgtggagatcagaagaaatgagatccgcatgctgatgaagcagcaggaccggctggaggagcgggagcaggacatcgaggaccagctgtacaagctggagagtgacaagaggctggtggaggagaaggtgaaccagctgaaggaggaggtgcggctgcagtatgagaagctgcaccagctgctggatgaggacctgcggcagacagtggaggtgctggacaaggcccaggccaagttctgcagtgaaaatgctgcccaggccctgcacctgggggagaggatgcaggaggccaagaagctgctgggcagcctgcagctgctgtttgacaagacagaagatgtgtccttcatgaagaacaccaagtctgtgaagatcctgatggacaggacccagacctgcaccagcagcagcctgagccccaccaagattggccacctgaacagcaagctgttcctgaatgaggtggccaagaaggagaagcagctgaggaagatgctggagggccccttcagcacccctgtgcccttcctgcagagcgtgcccctgtacccctgtggggtgagcagcagtggagctgagaagaggaagcacagcacagccttccctgaggccagcttcctggagaccagcagcggccctgtgggcggccagtatggagctgctggaacagccagcggggagggccagagcggccagcccctgggcccctgcagcagcacccagcacctggtggccctgcccggcggggcccagcctgtgcacagcagccctgtgtttcctcccagccagtacccaaatggatctgctgcccagcagcccatgctgccccagtatggaggcaggaagatcctggtgtgcagcgtggacaactgctactgcagctctgtggccaaccacggcggccaccagccctaccccaggagcggccacttcccctggacagtgcccagccaggagtacagccaccccctgccccccacccccagcgtgccccagagcctgcccagcctggccgtgcgggactggctggatgccagccagcagcccggccaccaggacttctacagagtgtatggccagcccagcaccaagcactacgtgaccagctag

SEQ ID NO: 174417 - DNA, 2133 bp, Artificial Sequence
  Description of Artificial Sequence: Synthetic coding sequence
atggaggagatggaggaggagctgaagtgccctgtgtgtggcagcttctaccgggagcccatcatcctgccctgcagccacaacctgtgccaggcctgtgccaggaacatcctggtgcagaccccagagagcgagagcccccagagccacagagctgctggcagcggcgtgtctgactatgactacctggacctggacaagatgagcctgtacagcgaggccgacagcggctacggcagctatggaggctttgccagcgcccccaccaccccctgccagaagagccccaatggagtgcgggtcttccccccagccatgcctcctccagccacccacctgagccctgccctggcccctgtgcccaggaacagctgcatcacctgcccccagtgccacaggagcctcatcctggatgaccggggcctgcggggcttccccaagaacagagtgctggagggcgtgattgaccgctaccagcagagcaaggccgccgccctgaagtgccagctgtgtgagaaggcccccaaggaggccaccgtgatgtgtgagcagtgtgatgtgttctactgtgacccctgccgcctgcgctgccaccccccccggggccccctggccaagcaccggctggtgcccccagcccagggccgggtgtcccggcggctgagccccaggaaggtgtccacctgcacagaccacgagctggagaaccacagcatgtactgtgtgcagtgcaagatgcctgtgtgctaccagtgcctggaggagggcaagcacagcagccatgaggtgaaggccctgggcgccatgtggaagctgcacaagagccagctgagccaggccctgaatggcctgagtgaccgggccaaggaggccaaggagttcctggtgcagctgaggaacatggtgcagcagatccaggagaacagcgtggagtttgaggcctgcctggtggcccagtgtgatgccctgattgatgccctgaacagaaggaaggcccagctgctggcccgggtgaacaaggagcacgagcacaagctgaaggtggtgcgggaccagatcagccactgcaccgtgaagctgcggcagaccaccggcctgatggagtactgcctggaggtgatcaaggaaaatgaccccagcggcttcctgcagatcagtgatgccctgatcagaagagtgcacctgacagaggaccagtggggcaagggcaccctgacccccaggatgaccacagactttgacctgagcctggacaacagccccctgctgcagagcatccaccagctggactttgtgcaggtgaaggccagcagccctgtgcctgccacccccatcctgcagctggaggagtgctgcacccacaacaacagcgccaccctgtcctggaagcagccccccctgagcacagtgcctgcagatggctacatcctggagctggatgatggaaatggaggccagttccgggaggtgtatgtgggcaaggagaccatgtgcaccgtggatggcctgcacttcaacagcacctacaatgcccgggtgaaggccttcaacaagacaggagtgagcccctacagcaagaccctggtgctgcagaccagcgaggtggcctggtttgcctttgaccccggcagcgcccacagcgacatcatcctgagcaatgacaacctgactgtgacctgcagcagctatgatgacagagtggtgctgggcaagacaggcttcagcaagggcatccactactgggagctgactgtggacagatatgacaaccacccagaccctgccttcggcgtggccaggatggatgtgatgaaggatgtgatgctgggcaaggatgacaaggcctgggccatgtatgtggacaacaacagatcctggttcatgcacaacaacagccacaccaacagaacagaaggaggcatcaccaagggggccaccatcggcgtgctgctggacctgaacaggaagaacctgaccttcttcatcaatgatgagcagcagggccccatcgcctttgacaacgtggagggcctcttcttccctgctgtgtccctgaacagaaatgtgcaggtgaccctgcacacaggcctgcctgtgcctgacttctacagcagccgggccagcatcgcctag

SEQ ID NO: 174418 - DNA, 2409 bp, Artificial Sequence
  Description of Artificial Sequence: Synthetic coding sequence
atggaggagatggaggaggagctgaagtgccctgtgtgtggcagcttctaccgggagcccatcatcctgccctgcagccacaacctgtgccaggcctgtgccaggaacatcctggtgcagaccccagagagcgagagcccccagagccacagagctgctggcagcggcgtgtctgactatgactacctggacctggacaagatgagcctgtacagcgaggccgacagcggctacggcagctatggaggctttgccagcgcccccaccaccccctgccagaagagccccaatggagtgcgggtcttccccccagccatgcctcctccagccacccacctgagccctgccctggcccctgtgcccaggaacagctgcatcacctgcccccagtgccacaggagcctcatcctggatgaccggggcctgcggggcttccccaagaacagagtgctggagggcgtgattgaccgctaccagcagagcaaggccgccgccctgaagtgccagctgtgtgagaaggcccccaaggaggccaccgtgatgtgtgagcagtgtgatgtgttctactgtgacccctgccgcctgcgctgccaccccccccggggccccctggccaagcaccggctggtgcccccagcccagggccgggtgtcccggcggctgagccccaggaaggtgtccacctgcacagaccacgagctggagaaccacagcatgtactgtgtgcagtgcaagatgcctgtgtgctaccagtgcctggaggagggcaagcacagcagccatgaggtgaaggccctgggcgccatgtggaagctgcacaagagccagctgagccaggccctgaatggcctgagtgaccgggccaaggaggccaaggagttcctggtgcagctgaggaacatggtgcagcagatccaggagaacagcgtggagtttgaggcctgcctggtggcccagtgtgatgccctgattgatgccctgaacagaaggaaggcccagctgctggcccgggtgaacaaggagcacgagcacaagctgaaggtggtgcgggaccagatcagccactgcaccgtgaagctgcggcagaccaccggcctgatggagtactgcctggaggtgatcaaggaaaatgaccccagcggcttcctgcagatcagtgatgccctgatcagaagagtgcacctgacagaggaccagtggggcaagggcaccctgacccccaggatgaccacagactttgacctgagcctggacaacagccccctgctgcagagcatccaccagctggactttgtgcaggtgaaggtgcctgccacccccatcctgcagctggaggagtgctgcacccacaacaacagcgccaccctgtcctggaagcagccccccctgagcacagtgcctgcagatggctacatcctggagctggatgatggaaatggaggccagttccgggaggtgtatgtgggcaaggagaccatgtgcaccgtggatggcctgcacttcaacagcacctacaatgcccgggtgaaggccttcaacaagacaggagtgagcccctacagcaagaccctggtgctgcagaccagcgaggacacagacagcgaggagcagaccctgcccttccctgtgcccagcgagcggctgcccctgcggaggatgagccccttcagcagcaccctgaacctgcagcccagcttccctggccgcagctactttgacttccgcagcagcccccaccagctgagcctgcacagcagcctgcagagcctgaatgcccctggctgcaactttgagacccagagcgccccctacagccagctggtggacatcaagaagctgctggccgtggcctggtttgcctttgatcctggcagcgcccacagcgacatcatcctgagcaatgacaacctgactgtgacctgcagcagctatgatgacagagtggtgctgggcaagacaggcttcagcaagggcatccactactgggagctgactgtggacagatatgacaaccacccagaccctgcctttggagtggccaggatggatgtgatgaaggatgtgatgctgggcaaggatgacaaggcctgggccatgtatgtggacaacaacagatcctggttcatgcacaacaacagccacaccaacagaacagagggcggcatcaccaagggggccaccatcggcgtgctgctggacctgaacaggaagaacctgaccttcttcatcaatgatgagcagcagggccccatcgcctttgacaacgtggagggcctcttcttccctgctgtgtccctgaacagaaatgtgcaggtgtccaccctgcccctgcggctgaacagctgctgctggctgcctgtgcagaggctgcccagggctgtgcagagcaacagaagagagggcagctag

SEQ ID NO: 174419 - DNA, 1653 bp, Artificial Sequence
  Description of Artificial Sequence: Synthetic coding sequence
atggaggagatggaggaggagctgaagtgccctgtgtgtggcagcttctaccgggagcccatcatcctgccctgcagccacaacctgtgccaggcctgtgccaggaacatcctggtgcagaccccagagagcgagagcccccagagccacagagctgctggcagcggcgtgtctgactatgactacctggacctggacaagatgagcctgtacagcgaggccgacagcggctacggcagctatggaggctttgccagcgcccccaccaccccctgccagaagagccccaatggagtgcgggtcttccccccagccatgcctcctccagccacccacctgagccctgccctggcccctgtgcccaggaacagctgcatcacctgcccccagtgccacaggagcctcatcctggatgaccggggcctgcggggcttccccaagaacagagtgctggagggcgtgattgaccgctaccagcagagcaaggccgccgccctgaagtgccagctgtgtgagaaggcccccaaggaggccaccgtgatgtgtgagcagtgtgatgtgttctactgtgacccctgccgcctgcgctgccaccccccccggggccccctggccaagcaccggctggtgcccccagcccagggccgggtgtcccggcggctgagccccaggaaggtgtccacctgcacagaccacgagctggagaaccacagcatgtactgtgtgcagtgcaagatgcctgtgtgctaccagtgcctggaggagggcaagcacagcagccatgaggtgaaggccctgggcgccatgtggaagctgcacaagagccagctgagccaggccctgaatggcctgagtgaccgggccaaggaggccaaggagttcctggtgcagctgaggaacatggtgcagcagatccaggagaacagcgtggagtttgaggcctgcctggtggcccagtgtgatgccctgattgatgccctgaacagaaggaaggcccagctgctggcccgggtgaacaaggagcacgagcacaagctgaaggtggtgcgggaccagatcagccactgcaccgtgaagctgcggcagaccaccggcctgatggagtactgcctggaggtgatcaaggaaaatgaccccagcggcttcctgcagatcagtgatgccctgatcagaagagtgcacctgacagaggaccagtggggcaagggcaccctgacccccaggatgaccacagactttgacctgagcctggacaacagccccctgctgcagagcatccaccagctggactttgtgcaggtgaaggccagcagccctgtgcctgccacccccatcctgcagctggaggagtgctgcacccacaacaacagcgccaccctgtcctggaagcagccccccctgagcacagtgcctgcagatggctacatcctggagctggatgatggaaatggaggccagttccgggaggtgtatgtgggcaaggagaccatgtgcaccgtggatggcctgcacttcaacagcacctacaatgcccgggtgaaggccttcaacaagacaggagtgagcccctacagcaagaccctggtgctgcagaccagcgagggcaaggccctgcagcagtaccccagcgagcgggagctgcggggcatctag

SEQ ID NO: 174420 - DNA, 3750 bp, Artificial Sequence
  Description of Artificial Sequence: Synthetic coding sequence
atggccacagctgccacagaggagcccttccccttccacggcctgctgcccaagaaggagactggagctgccagcttcctgtgccgctacccagaatatgatggccggggcgtgctgattgctgtgctggacacaggagtggaccccggggcccctggcatgcaggtgaccacagatggcaagcccaagatcgtggacatcatcgacaccactggaagtggagatgtgaacacagccacagaggtggagcccaaggatggagaaattgtgggcctgagcggccgggtgctgaagatcccagcctcctggaccaaccccagcggcaagtaccacatcggcatcaagaatggctatgacttctaccccaaggccctgaaggagcgcatccagaaggagaggaaggagaagatctgggaccctgtgcaccgggtggccctggccgaggcctgcaggaagcaggaggagtttgatgtggccaacaacggcagcagccaggccaacaagctgatcaaggaggagctgcagagccaggtggagctgctgaacagctttgagaagaagtacagcgaccccggccctgtgtatgactgcctggtgtggcatgatggagaggtgtggagggcctgcatcgacagcaatgaagatggagacctgagcaagagcacagtgctgaggaactacaaggaggcccaggagtatggcagctttggaacagctgagatgctgaactacagcgtgaacatctatgatgatggcaacctgctgagcatcgtgaccagcggcggggcccacggcacccacgtggccagcattgctgctggccacttccctgaggagcctgagagaaatggagtggcccctggggcccagatcctgagcatcaagatcggggacacccggctgagcaccatggagaccggcaccggcctcatccgggccatgattgaagtcatcaaccacaagtgtgacctggtgaactacagctatggagaggccacccactggcccaacagcggccgcatctgtgaggtgatcaatgaggccgtgtggaagcacaacatcatctacgtgtcctctgctggcaacaacggcccctgcctgagcacagtgggctgccctgggggcaccaccagctctgtgattggagtgggcgcctacgtgtccccagacatgatggtggccgagtacagcctgcgggagaagctgcctgccaaccagtacacctggagcagccggggccccagcgcagatggagccctgggcgtgtccatcagcgcccctggaggagccatcgcctctgtgcccaactggaccctgcggggcacccagctgatgaatggcacctccatgagcagccccaatgcctgtggcggcatcgccctgatcctgagcggcctgaaggccaacaacatcgactacacagtgcacagcgtgagaagagccctggagaacacagctgtgaaggctgacaacatcgaggtgtttgcccagggccacggcatcatccaggtggacaaggcctatgactacctggtgcagaacaccagctttgccaacaagctgggcttcaccgtgacagtgggcaacaacagaggcatctacctgcgggaccctgtgcaggtggccgcccccagcgaccatggagtgggcatcgagcctgtgtttcctgaaaatacagagaacagcgagaagatcagcctgcagctgcacctggccctgaccagcaacagctcctgggtgcagtgccccagccacctggagctgatgaaccagtgccgccacatcaacatccgggtggacccccggggcctgcgggagggcctgcactacacagaggtgtgtggctatgacatcgccagccccaatgccggccccctcttccgggtgcccatcacagctgtgattgctgccaaggtgaatgaaagcagccactatgacctggccttcacagatgtgcacttcaagccaggccagatccgccgccacttcatcgaggtgcctgagggcgccacctgggccgaggtgacagtgtgcagctgcagcagcgaggtgtctgccaagtttgtgctgcatgctgtgcagctggtgaagcagagggcctaccgcagccatgagttctacaagttctgcagcctgcctgagaagggcaccctgacagaggccttccctgtgctgggcggcaaggccatcgagttctgcatcgcccgctggtgggccagcctgagtgatgtgaacatcgactacaccatctccttccatggaattgtgtgcacagccccccagctgaacatccacgccagcgagggcatcaacagatttgatgtgcagagcagcctgaagtatgaggacctggccccctgcatcaccctgaagaactgggtgcagaccctgcggcctgtgtctgccaagaccaagcccctgggcagcagagatgtgctgcccaacaaccggcagctgtatgagatggtgctgacctacaacttccaccagcccaagtctggagaggtgacccccagctgccccctgctgtgtgagctgctgtatgagagcgagtttgacagccagctgtggatcatctttgaccagaacaagaggcagatgggcagcggagatgcctacccccaccagtacagcctgaagctggagaagggggactacaccatccggctgcagatcagacatgagcagatcagtgacctggagcggctgaaggacctgcccttcatcgtgagccaccggctgagcaacaccctgagcctggacatccacgagaaccacagctttgccctgctgggcaagaagaagagcagcaacctgaccctgccccccaagtacaaccagcccttctttgtgaccagcctgcctgatgacaagatccccaagggagctggccctggctgctacctggccggcagcctgaccctgagcaagacagagctgggcaagaaggcagatgtgattcctgtgcactactacctgatccccccacccaccaagaccaagaatggcagcaaggacaaggagaaggacagcgagaaggagaaggacctgaaggaggagttcacagaggccctgcgggacctgaagatccagtggatgaccaagctggacagcagtgacatctacaatgagctgaaggagacctaccccaactacctgcccctgtatgtggcccggctgcaccagctggatgctgagaaggagaggatgaagaggctgaatgagatcgtggatgctgccaatgctgtgatcagccacatcgaccagacagccctggccgtgtacatcgccatgaagacagaccccaggccagatgctgccaccatcaagaatgacatggacaagcagaagagcaccctggtggatgccctgtgcaggaagggctgtgccctggccgaccacctgctgcacacccaggcccaggatggagccatcagcacagatgctgagggcaaggaggaggagggggagagccccctggacagcctggccgagaccttctgggagaccaccaagtggacagacctgtttgacaacaaggtgctgacctttgcctacaagcacgccctggtgaacaagatgtatggccggggcctgaagtttgccaccaagctggtggaggagaagcccaccaaggagaactggaagaactgcatccagctgatgaagctgctgggctggacccactgtgccagcttcacagagaactggctgcccatcatgtaccccccagactactgtgtgttctag

SEQ ID NO: 174421 - DNA, 1791 bp, Artificial Sequence
  Description of Artificial Sequence: Synthetic coding sequence
atgctgcccagccaggcccagggcctgctgtggtgggtgttccccctcttccctgccagcagcctgagctacccacctgtgtcctacagagcagatggcctggccaggaacaccttcctgaaggcctgcagcgagagcagcagcagcagcaacatcagcaccatgctggtgacccatgactacacagctgtgaaggaggatgagatcaacgtgtaccagggcgaggtggtgcagatcctggccagcaaccagcagaacatgttcctggtgttccgggccgccacagaccagtgcccagctgctgagggctggatccctggctttgtgctgggccacaccagcgctgtgattgtggagaacccagatggcaccctgaagaagagcacctcctggcacacagccctgcggctgaggaagaagtctgagaagaaggacaaggatggcaagcgggagggcaagctggagaatggctacaggaagagccgggagggcctgagcaacaaggtgtctgtgaagctgctgaaccccaactacatctatgatgtgcccccagagtttgtgatccccctgtctgaggtgacctgtgaaacaggagagaccgtggtgctgcgctgccgggtgtgtggccggcccaaggccagcatcacctggaagggccctgagcacaacaccctgaacaatgatggccactacagcatctcctacagcgacctgggggaggccaccctgaagatcgtgggcgtgaccacagaagatgatggcatctacacctgcatcgctgtgaatgacatgggcagcgccagcagcagcgccagcctgcgggtgctgggccctggcatggatggcatcatggtgacctggaaggacaactttgacagcttctacagcgaggtggccgagctgggccggggccgcttctctgtggtgaagaagtgtgaccagaagggcaccaagagagctgtggccaccaagtttgtgaacaagaagctgatgaagagggaccaggtgacccatgagctgggcatcctgcagagcctgcagcaccccctgctggtgggcctgctggacacctttgagacccccaccagctacatcctggtgctggagatggctgaccagggccgcctgctggactgtgtggtgcgctggggcagcctgacagagggcaagatccgggcccacctgggggaggtgctggaggccgtgcgctacctgcacaactgccgcatcgcccacctggacctgaagccagagaacatcctggtggatgagagcctggccaagcccaccatcaagctggccgactttggagatgctgtgcagctgaacaccacctactacatccaccagctgctgggcaaccctgagtttgctgcccctgagatcatcctgggcaaccctgtgtccctgaccagtgacacctggagcgtgggcgtgctgacctacgtgctgctgagcggcgtgagccccttcctggatgattctgtggaggagacctgcctgaacatctgccgcctggacttctccttcccagatgactacttcaagggcgtgtcccagaaggccaaggagtttgtgtgcttcctgctgcaggaggaccctgccaagaggccttctgctgccctggccctgcaggagcagtggctgcaggccggaaatggccgcagcactggagtgctggacaccagccggctgaccagcttcattgaaagaaggaagcaccagaatgatgtgcggcccatccgcagcatcaagaacttcctgcagagccggctgctgccccgggtgtag

SEQ ID NO: 174422 - DNA, 9294 bp, Artificial Sequence
  Description of Artificial Sequence: Synthetic coding sequence
atgagcggcagcagtggaggagctgctgccccagctgccagcagcggccctgctgctgctgccagcgctgctggcagcggctgcggcggcggggccggggagggcgctgaggaggccgccaaggacctggccgacattgctgccttcttccgcagcggcttcaggaagaatgatgagatgaaggccatggatgtgctgcccatcctgaaggagaaggtggcctacctgagcggcggccgggacaagaggggcggccccatcctgaccttccctgcccggagcaaccacgaccgcatccggcaggaggacctgcggcggctcatctcctacctggcctgcatccccagcgaggaggtgtgcaagaggggcttcaccgtgattgtggacatgaggggcagcaagtgggacagcatcaagcccctgctgaagatcctgcaggagagcttcccctgctgcatccacgtggccctgatcatcaagccagacaacttctggcagaagcagaggaccaactttggcagcagcaagtttgaatttgagaccaacatggtgtccctggagggcctgaccaaggtggtggaccccagccagctgaccccagagtttgatggctgcctggagtacaaccacgaggagtggattgagatccgggtggcctttgaggactacatcagcaatgccacccacatgctgagccggctggaggagctgcaggacatcctggccaagaaggagctgccccaggacctggagggcgccaggaacatgattgaggagcacagccagctgaagaagaaggtgatcaaggcccccatcgaggacctggacctggagggccagaagctgctgcagaggatccagagcagcgagagcttccccaagaagaacagcggcagcggaaatgctgacctgcagaacctgctgcccaaggtgtccaccatgctggaccggctgcacagcacccggcagcacctgcaccagatgtggcacgtgaggaagctgaagctggaccagtgcttccagctgcggctgtttgagcaggatgctgagaagatgtttgactggatcacccacaacaagggcctcttcctgaacagctacacagagatcggcaccagccacccccacgccatggagctgcagacccagcacaaccactttgccatgaactgcatgaatgtgtatgtgaacatcaaccgcatcatgtctgtggccaaccggctggtggagagcggccactacgccagccagcagatccggcagatcgccagccagctggagcaggagtggaaggcctttgctgctgccctggatgagaggagcaccctgctggacatgagcagcatcttccaccagaaggccgagaagtacatgagcaatgtggacagctggtgcaaggcctgtggggaggtggacctgcccagcgagctgcaggacctggaggatgccatccaccaccaccagggcatctatgagcacatcaccctggcctacagcgaggtgtcccaggacggcaagagcctgctggacaagctgcagaggcccctgaccccaggcagcagtgacagcctgacagccagcgccaactacagcaaggctgtgcaccacgtgctggatgtgatccacgaggtgctgcaccaccagaggcagctggagaacatctggcagcacaggaaggtgcggctgcaccagaggctgcagctgtgtgtgttccagcaggatgtgcagcaggtgctggactggattgaaaatcatggagaggccttcctgagcaagcacactggagtgggcaagagcctgcaccgggcccgggccctgcagaagagacatgaagattttgaggaggtggcccagaacacctacaccaatgctgacaagctgctggaggccgctgagcagctggcccagacaggagaatgtgaccctgaggagatctaccaggccgcccaccagctggaggaccgcatccaggactttgtgagaagagtggagcagaggaagatcctgctggacatgtctgtgtccttccacacccacgtgaaggagctgtggacctggctggaggagctgcagaaggagctgctggatgatgtgtatgcagagagcgtggaggccgtgcaggacctgatcaagagatttggccagcagcagcagaccaccctgcaggtgacagtgaatgtcatcaaggagggggaggacctgatccagcagctgcgggacagcgccatcagcagcaacaagaccccccacaacagcagcatcaaccacattgaaacagtgctgcagcagctggatgaggcccagagccagatggaggagctgttccaggagaggaagatcaagctggagctgttcctgcagctgcgcatctttgaaagagatgccatcgacatcatcagtgacctggagagctggaatgatgagctgagccagcagatgaatgactttgacacagaggacctgaccatcgccgagcagaggctgcagcaccacgccgacaaggccctgaccatgaacaacctgacctttgatgtgatccaccagggccaggacctgctgcagtatgtgaatgaggtgcaggccagcggcgtggagctgctgtgtgacagagatgtggacatggccaccagggtgcaggacctgctggagttcctgcacgagaagcagcaggagctggacctggccgctgagcagcacaggaagcacctggagcagtgtgtgcagctgcggcacctgcaggccgaggtgaagcaggtgctgggctggatcagaaatggagagagcatgctgaatgccggcctcatcacagccagcagcctgcaggaggccgagcagctgcagcgggagcacgagcagttccagcacgccatcgagaagacccaccagagcgccctgcaggtgcagcagaaggccgaggccatgctgcaggccaaccactatgacatggacatgatccgggactgtgccgagaaggtggccagccactggcagcagctgatgctgaagatggaggaccggctgaagctggtgaatgcctctgtggccttctacaagaccagcgagcaggtgtgcagcgtgctggagagcctggagcaggagtacaagcgggaggaggactggtgtggcggcgctgacaagctgggccccaacagcgagacagaccacgtgacccccatgatcagcaagcacctggagcagaaggaggccttcctgaaggcctgcaccctggccaggagaaatgctgatgtgttcctgaagtacctgcacaggaacagcgtgaacatgcctggcatggtgacccacatcaaggcccctgagcagcaggtgaagaacatcctgaatgagctgttccagcgggagaacagagtgctgcactactggaccatgaggaagaggcggctggaccagtgccagcagtatgtggtgtttgagaggtctgccaagcaggccctggagtggattcatgacaatggagagttctacctgagcacccacaccagcacaggcagcagcatccagcacacccaggagctgctgaaggagcacgaggagttccagatcacagccaagcagaccaaggagcgggtgaagctgctgatccagctggctgatggcttctgtgagaagggccacgcccacgccgctgagatcaagaagtgtgtgacagctgtggacaagcgctacagagacttcagcctgaggatggagaagtaccgcaccagcctggagaaggccctgggcatcagcagtgacagcaacaagagcagcaagagcctgcagctggacatcatcccagccagcatccctggcagcgaggtgaagctgagagatgctgcccacgagctgaatgaggagaagaggaagagcgcccggaggaaggagttcatcatggccgagctgatccagacagagaaggcctacgtgcgggacctgcgggagtgcatggacacctacctgtgggagatgaccagcggcgtggaggagatccccccaggcatcgtgaacaaggagctgatcatctttggaaacatgcaggagatctatgagttccacaacaacatcttcctgaaggagctggagaagtatgagcagctgcctgaagatgtgggccactgctttgtgacctgggccgacaagttccagatgtatgtgacctactgcaagaacaagccagacagcacccagctgatcctggagcacgccggcagctactttgatgagatccagcagagacatggcctggccaacagcatcagcagctacctgatcaagcctgtgcagaggatcaccaagtaccagctgctgctgaaggagctgctgacctgctgtgaggagggcaaaggagagatcaaggatggcctggaggtgatgctgtctgtgcccaagagggccaatgatgccatgcacctgtccatgctggagggctttgatgagaacatcgagagccagggcgagctgatcctgcaggagagcttccaggtgtgggaccccaagaccctcatcaggaagggccgggagcggcacctgttcctgtttgagatgagcctggtgttcagcaaggaggtgaaggacagcagcggccgcagcaagtacctgtacaagagcaagctgttcaccagcgagctgggcgtgacagaacatgtggagggggacccctgcaagtttgccctgtgggtgggccgcacccccaccagtgacaacaagatcgtgctgaaggccagcagcattgagaacaagcaggactggatcaagcacatccgggaggtgatccaggagaggaccatccacctgaagggggccctgaaggagcccatccacatccccaagacagccccagccacccggcagaagggcagaagagatggagaggacctggacagccagggagatggcagcagccagcctgacaccatcagcatcgccagcaggaccagccagaacaccctggacagcgacaagctgagcggcggctgtgagctgactgtggtgattcatgacttcaccgcctgcaacagcaatgagctgaccatccggcggggccagacagtggaggtgctggagcggccccatgacaagccagactggtgcctggtgaggaccacagacaggagccctgctgctgagggcctggtgccctgtggcagcctgtgcatcgcccacagccgcagctccatggagatggagggcatcttcaaccacaaggacagcctgtctgtgagcagcaatgatgccagccccccagcctctgtggccagcctgcagccccacatgattggagcccagagcagccctggccccaagaggcctggcaacaccctgaggaagtggctgaccagccctgtgcggcggctgagcagcggcaaggcagatggccacgtgaagaagctggcccacaagcacaagaagagccgggaggtgaggaagtctgcagatgctggcagccagaaggacagtgatgattctgctgccaccccccaggatgaaacagtggaggagcggggcagaaatgaaggcctgagcagcggcaccctgagcaagagcagcagcagcggcatgcagagctgtggggaggaggagggggaggagggcgcagatgctgtgcccctgcccccacccatggccatccagcagcacagcctgctgcagcctgacagccaggatgacaaggccagcagccggctgctggtgcggcccaccagcagcgagaccccatctgctgctgagctggtgtctgccatcgaggagctggtgaagagcaagatggccctggaggaccggcccagcagcctgctggtggaccagggcgacagcagcagccccagcttcaaccccagcgacaacagcctgctgagcagcagcagccccattgatgagatggaggagaggaagagcagcagcctgaagagaagacactacgtgctgcaggagctggtggagacagagcgggactatgtgcgggacctgggctacgtggtggagggctacatggccctgatgaaggaggatggagtgcctgatgacatgaagggcaaggacaagatcgtgtttggaaacatccaccagatctatgactggcaccgggacttcttcctgggggagctggagaagtgcctggaggaccctgagaagctgggcagcctgtttgtgaagcatgaaagaaggctgcacatgtacatcgcctactgccagaacaagcccaagtctgagcacatcgtgtctgagtacatcgacaccttctttgaggacctgaagcagaggctgggccaccggctgcagctgacagacctgctgatcaagcctgtgcagaggatcatgaagtaccagctgctgctgaaggacttcctgaagtacagcaagaaggccagcctggacaccagcgagctggagagagctgtggaggtgatgtgcatcgtgccccggcgctgcaatgacatgatgaatgtgggccgcctgcagggctttgatggcaagatcgtggcccagggcaagctgctgctgcaggacaccttcctggtgacagaccaggatgctggcctgctgccccgctgccgggagcggcgcatcttcctgtttgagcagatcgtcatcttcagcgagcccctggacaagaagaagggcttctccatgcctggcttcctgttcaagaacagcatcaaggtgtcctgcctgtgcctggaggagaatgtggagaatgacccctgcaagtttgccctgaccagcaggactggagatgtggtggagaccttcatcctgcacagcagcagccccagcgtgcggcagacctggatccacgagatcaaccagatcctggagaaccagaggaacttcctgaatgccctgaccagccccatcgagtaccagaggaaccacagcggcggcggcggcggcggcggcagcggcggcagcggcggcggcggcggcagcggcggcggcggggcccccagcggcggcagcggccacagcggcggccccagcagctgtggcggggcccccagcaccagccgcagccggcccagccgcatcccccagcctgtgcgccaccacccccctgtgctggtgtcctctgctgccagcagccaggccgaggccgacaagatgagcggcaccagcaccccaggccccagcctgcccccacctggagctgcccctgaggccggccccagcgcccccagccggcggcccccaggagcagatgctgagggcagcgagcgggaggccgagcccatccccaagatgaaggtgctggagagccccaggaagggggccgccaatgccagcggcagcagcccagatgccccagccaaggatgcccgggccagcctgggcaccctgcccctgggcaagcccagggctggagctgccagccccctgaacagccccctgagcagcgctgtgcccagcctgggcaaggagcccttcccccccagcagccccctgcagaagggcggcagcttctggagcagcatcccagccagccctgccagcaggcctggcagcttcaccttccctggggacagcgacagcctgcagaggcagacccccaggcatgctgcccctgggaaggacacagacaggatgagcacctgcagcagcgccagcgagcagagcgtgcagagcacccagagcaatggaagtgagagcagcagcagcagcaacatcagcaccatgctggtgacccatgactacacagctgtgaaggaggatgagatcaacgtgtaccagggcgaggtggtgcagatcctggccagcaaccagcagaacatgttcctggtgttccgggccgccacagaccagtgcccagctgctgagggctggatccctggctttgtgctgggccacaccagcgctgtgattgtggagaacccagatggcaccctgaagaagagcacctcctggcacacagccctgcggctgaggaagaagtctgagaagaaggacaaggatggcaagcgggagggcaagctggagaatggctacaggaagagccgggagggcctgagcaacaaggtgtctgtgaagctgctgaaccccaactacatctatgatgtgcccccagagtttgtgatccccctgtctgaggtgacctgtgagaccggggagaccgtggtgctgcgctgccgggtgtgtggccggcccaaggccagcatcacctggaagggccctgagcacaacaccctgaacaatgatggccactacagcatctcctacagcgacctgggggaggccaccctgaagatcgtgggcgtgaccacagaagatgatggcatctacacctgcatcgctgtgaatgacatgggcagcgccagcagcagcgccagcctgcgggtgctgggccctggcatggatggcatcatggtgacctggaaggacaactttgacagcttctacagcgaggtggccgagctgggccggggccgcttctctgtggtgaagaagtgtgaccagaagggcaccaagagagctgtggccaccaagtttgtgaacaagaagctgatgaagagggaccaggtgacccatgagctgggcatcctgcagagcctgcagcaccccctgctggtgggcctgctggacacctttgagacccccaccagctacatcctggtgctggagatggctgaccagggccgcctgctggactgtgtggtgcgctggggcagcctgacagagggcaagatccgggcccacctgggggaggtgctggaggccgtgcgctacctgcacaactgcagaattgcccacctggacctgaagccagagaacatcctggtggatgagagcctggccaagcccaccatcaagctggccgactttggagatgctgtgcagctgaacaccacctactacatccaccagctgctgggcaaccctgagtttgctgcccctgagatcatcctgggcaaccctgtgtccctgaccagtgacacctggagcgtgggcgtgctgacctacgtgctgctgtctggagtgagccccttcctggatgacagcgtggaggagacctgcctgaacatctgccgcctggacttctccttcccagatgactacttcaagggcgtgtcccagaaggccaaggagtttgtgtgcttcctgctgcaggaggaccctgccaagaggcccagcgctgccctggccctgcaggagcagtggctgcaggccggaaatggccgcagcactggagtgctggacaccagccggctgaccagcttcatcgagaggaggaagcaccagaatgatgtgcggcccatccgcagcatcaagaacttcctgcagagccggctgctgccccgggtgtag

SEQ ID NO: 174423 - DNA, 7503 bp, Artificial Sequence
  Description of Artificial Sequence: Synthetic coding sequence
atgctggaccggctgcacagcacccggcagcacctgcaccagatgtggcacgtgaggaagctgaagctggaccagtgcttccagctgcggctgtttgagcaggatgctgagaagatgtttgactggatcacccacaacaagggcctcttcctgaacagctacacagaaattggcaccagccacccccacgccatggagctgcagacccagcacaaccactttgccatgaactgcatgaatgtgtatgtgaacatcaaccgcatcatgtctgtggccaaccggctggtggagagcggccactacgccagccagcagatccggcagatcgccagccagctggagcaggagtggaaggcctttgctgctgccctggatgagaggagcaccctgctggacatgagcagcatcttccaccagaaggccgagaagtacatgagcaatgtggacagctggtgcaaggcctgtggggaggtggacctgcccagcgagctgcaggacctggaggatgccatccaccaccaccagggcatctatgagcacatcaccctggcctacagcgaggtgtcccaggacggcaagagcctgctggacaagctgcagaggcccctgaccccaggcagcagtgacagcctgacagccagcgccaactacagcaaggctgtgcaccacgtgctggatgtgattcatgaggtgctgcaccaccagaggcagctggagaacatctggcagcacaggaaggtgcggctgcaccagaggctgcagctgtgtgtgttccagcaggatgtgcagcaggtgctggactggattgagaaccacggggaggccttcctgagcaagcacactggagtgggcaagagcctgcaccgggcccgggccctgcagaagagacatgaggactttgaggaggtggcccagaacacctacaccaatgctgacaagctgctggaggccgctgagcagctggcccagacaggagaatgtgaccctgaggagatctaccaggccgcccaccagctggaggaccgcatccaggactttgtgcggcgggtggagcagaggaagatcctgctggacatgtctgtgtccttccacacccacgtgaaggagctgtggacctggctggaggagctgcagaaggagctgctggatgatgtgtatgcagagagcgtggaggccgtgcaggacctgatcaagcgcttcggccagcagcagcagaccaccctgcaggtgacagtgaatgtcatcaaggagggagaagatctcatccagcagctgcgggacagcgccatcagcagcaacaagaccccccacaacagcagcatcaaccacatcgagaccgtgctgcagcagctggatgaggcccagagccagatggaggagctgttccaggagaggaagatcaagctggagctgttcctgcagctgcgcatctttgaaagagatgccatcgacatcatcagtgacctggagagctggaatgatgagctgagccagcagatgaatgactttgacacagaggacctgaccatcgccgagcagaggctgcagcaccacgccgacaaggccctgaccatgaacaacctgacctttgatgtgatccaccagggccaggacctgctgcagtatgtgaatgaggtgcaggccagcggcgtggagctgctgtgtgacagagatgtggacatggccaccagggtgcaggacctgctggagttcctgcacgagaagcagcaggagctggacctggccgctgagcagcacaggaagcacctggagcagtgtgtgcagctgcggcacctgcaggccgaggtgaagcaggtgctgggctggatcagaaatggagagagcatgctgaatgccggcctcatcacagccagcagcctgcaggaggccgagcagctgcagcgggagcacgagcagttccagcacgccatcgagaagacccaccagagcgccctgcaggtgcagcagaaggccgaggccatgctgcaggccaaccactatgacatggacatgatccgggactgtgccgagaaggtggccagccactggcagcagctgatgctgaagatggaggaccggctgaagctggtgaatgcctctgtggccttctacaagaccagcgagcaggtgtgcagcgtgctggagagcctggagcaggagtacaagcgggaggaggactggtgtggcggcgctgacaagctgggccccaacagcgagacagaccacgtgacccccatgatcagcaagcacctggagcagaaggaggccttcctgaaggcctgcaccctggccaggagaaatgctgatgtgttcctgaagtacctgcacagaaattctgtgaacatgcctggcatggtgacccacatcaaggcccctgagcagcaggtgaagaacatcctgaatgaactcttccagagagaaaatagagtgctgcactactggaccatgaggaagaggcggctggaccagtgccagcagtatgtggtgtttgagaggtctgccaagcaggccctggagtggattcatgacaacggggagttctacctgagcacccacaccagcacaggcagcagcatccagcacacccaggagctgctgaaggagcacgaggagttccagatcacagccaagcagaccaaggagcgggtgaagctgctgatccagctggctgatggcttctgtgagaagggccacgcccatgctgctgagatcaagaagtgtgtgacagctgtggacaagcgctacagagacttcagcctgaggatggagaagtaccgcaccagcctggagaaggccctgggcatcagcagtgacagcaacaagagcagcaagagcctgcagctggacatcatcccagccagcatccctggcagcgaggtgaagctgagagatgctgcccacgagctgaatgaggagaagaggaagagcgcccggaggaaggagttcatcatggccgagctgatccagacagagaaggcctacgtgcgggacctgcgggagtgcatggacacctacctgtgggagatgaccagcggcgtggaggagatccccccaggcatcgtgaacaaggagctgatcatcttcggcaacatgcaggagatctatgagttccacaacaacatcttcctgaaggagctggagaagtatgagcagctgcctgaagatgtgggccactgctttgtgacctgggccgacaagttccagatgtatgtgacctactgcaagaacaagccagacagcacccagctgatcctggagcacgccggcagctactttgatgagatccagcagagacatggcctggccaacagcatcagcagctacctgatcaagcctgtgcagaggatcaccaagtaccagctgctgctgaaggagctgctgacctgctgtgaggagggcaagggggagatcaaggatggcctggaggtgatgctgtctgtgcccaagagggccaatgatgccatgcacctgtccatgctggagggctttgatgaaaatattgagagccagggcgagctgatcctgcaggagagcttccaggtgtgggaccccaagaccctcatcaggaagggccgggagcggcacctgttcctgtttgagatgagcctggtgttcagcaaggaggtgaaggacagcagcggccgcagcaagtacctgtacaagagcaagctgttcaccagcgagctgggcgtgacagagcacgtggagggggacccctgcaagtttgccctgtgggtgggccgcacccccaccagtgacaacaagatcgtgctgaaggccagcagcattgagaacaagcaggactggatcaagcacatccgggaggtgatccaggagaggaccatccacctgaagggggccctgaaggagcccatccacatccccaagacagccccagccacccggcagaagggcagaagagatggagaggacctggacagccagggagatggcagcagccagcctgacaccatcagcatcgccagcaggaccagccagaacaccctggacagcgacaagctgagcggcggctgtgagctgactgtggtgattcatgacttcaccgcctgcaacagcaatgagctgaccatcagaagaggccagacagtggaggtgctggagcggccccatgacaagccagactggtgcctggtgaggaccacagacaggagccctgctgctgagggcctggtgccctgtggcagcctgtgcatcgcccacagccgcagctccatggagatggagggcatcttcaaccacaaggacagcctgtctgtgagcagcaatgatgccagccccccagcctctgtggccagcctgcagccccacatgattggagcccagagcagccctggccccaagaggcctggcaacaccctgaggaagtggctgaccagccctgtgcggcggctgagcagcggcaaggcagatggccacgtgaagaagctggcccacaagcacaagaagagccgggaggtgaggaagtctgcagatgctggcagccagaaggacagtgatgacagcgctgccaccccccaggatgagaccgtggaggagcggggcagaaatgaaggcctgagcagcggcaccctgagcaagagcagcagcagcggcatgcagagctgtggggaggaggagggggaggagggcgcagatgctgtgcccctgcccccacccatggccatccagcagcacagcctgctgcagcctgacagccaggatgacaaggccagcagccggctgctggtgcggcccaccagcagcgagacccccagcgctgctgagctggtgtctgccatcgaggagctggtgaagagcaagatggccctggaggaccggcccagcagcctgctggtggaccagggcgacagcagcagccccagcttcaaccccagcgacaacagcctgctgagcagcagcagccccattgatgagatggaggagaggaagagcagcagcctgaagaggaggcactacgtgctgcaggagctggtggagacagagcgggactatgtgcgggacctgggctacgtggtggagggctacatggccctgatgaaggaggatggagtgcctgatgacatgaagggcaaggacaagatcgtgtttggaaacatccaccagatctatgactggcaccgggacttcttcctgggggagctggagaagtgcctggaggaccctgagaagctgggcagcctgtttgtgaagcatgagcggcggctgcacatgtacatcgcctactgccagaacaagcccaagtctgagcacatcgtgtctgagtacatcgacaccttctttgaggacctgaagcagaggctgggccaccggctgcagctgacagacctgctgatcaagcctgtgcagaggatcatgaagtaccagctgctgctgaaggacttcctgaagtacagcaagaaggccagcctggacaccagcgagctggagagagctgtggaggtgatgtgcatcgtgccccggcgctgcaatgacatgatgaatgtgggccgcctgcagggctttgatggcaagatcgtggcccagggcaagctgctgctgcaggacaccttcctggtgacagaccaggatgctggcctgctgccccgctgccgggagcggcgcatcttcctgtttgagcagatcgtcatcttcagcgagcccctggacaagaagaagggcttctccatgcctggcttcctgttcaagaacagcatcaaggtgtcctgcctgtgcctggaggagaatgtggagaatgacccctgcaagtttgccctgaccagcaggactggagatgtggtggagaccttcatcctgcacagcagcagccccagcgtgcggcagacctggattcatgagatcaaccagatcctggagaaccagaggaacttcctgaatgccctgaccagccccatcgagtaccagaggaaccacagcggcggcggcggcggcggcggcagcggcggcagcggcggcggcggcggcagcggcggcggcggggcccccagcggcggcagcggccacagcggcggccccagcagctgtggcggggcccccagcaccagccgcagccggcccagccgcatcccccagcctgtgcgccaccacccccctgtgctggtgagcagcgctgccagcagccaggccgaggccgacaagatgagcggcaccagcaccccaggccccagcctgcccccacctggggccgcccctgaggccggccccagcgcccccagcagaagacctcctggagcagatgctgagggcagcgagcgggaggccgagcccatccccaagatgaaggtgctggagagccccaggaaaggagctgccaatgccagcggcagcagcccagatgccccagccaaggatgcccgggccagcctgggcaccctgcccctgggcaagccccgggccggggccgccagccccctgaacagccccctgagcagcgctgtgcccagcctgggcaaggagcccttcccccccagcagccccctgcagaagggcggcagcttctggagcagcatcccagccagccctgccagccggcccggcagcttcaccttccctggggacagcgacagcctgcagaggcagacccccaggcatgctgcccctgggaaggacacagacaggatgagcacctgcagcagcgccagcgagcagagcgtgcagagcacccagagcaatggcagcgagagcagcagcagcagcaacatcagcaccatgctggtgacccatgactacacagctgtgaaggaggatgagatcaacgtgtaccagggcgaggtggtgcagatcctggccagcaaccagcagaacatgttcctggtgttccgggccgccacagaccagtgcccagctgctgagggctggatccctggctttgtgctgggccacaccagcgctgtgattgtggagaacccagatggcaccctgaagaagagcacctcctggcacacagccctgcggctgaggaagaagtctgagaagaaggacaaggatggcaagcgggagggcaagctggagaatggctacaggaagagccgggagggcctgagcaacaaggtgtctgtgaagctgctgaaccccaactacatctatgatgtgcccccagagtttgtgatccccctgtctgaggtgacctgtgaaacaggagagaccgtggtgctgcgctgccgggtgtgtggccggcccaaggccagcatcacctggaagggccctgagcacaacaccctgaacaatgatggccactacagcatctcctacagcgacctgggggaggccaccctgaagatcgtgggcgtgaccacagaagatgatggcatctacacctgcatcgctgtgaatgacatgggcagcgccagcagcagcgccagcctgcgggtgctgggccctggcatggatggcatcatggtgacctggaaggacaactttgacagcttctacagcgaggtggccgagctgggccgggccaactggaacaactggagcccctactag

SEQ ID NO: 174424 - DNA, 8766 bp, Artificial Sequence
  Description of Artificial Sequence: Synthetic coding sequence
atgagcggcagcagtggaggagctgctgccccagctgccagcagcggccctgctgctgctgccagcgctgctggcagcggctgcggcggcggggccggggagggcgctgaggaggccgccaaggacctggccgacattgctgccttcttccgcagcggcttcaggaagaatgatgagatgaaggccatggatgtgctgcccatcctgaaggagaaggtggcctacctgagcggcggccgggacaagaggggcggccccatcctgaccttccctgcccggagcaaccacgaccgcatccggcaggaggacctgcggcggctcatctcctacctggcctgcatccccagcgaggaggtgtgcaagaggggcttcaccgtgattgtggacatgaggggcagcaagtgggacagcatcaagcccctgctgaagatcctgcaggagagcttcccctgctgcatccacgtggccctgatcatcaagccagacaacttctggcagaagcagaggaccaactttggcagcagcaagtttgaatttgagaccaacatggtgtccctggagggcctgaccaaggtggtggaccccagccagctgaccccagagtttgatggctgcctggagtacaaccacgaggagtggattgagatccgggtggcctttgaggactacatcagcaatgccacccacatgctgagccggctggaggagctgcaggacatcctggccaagaaggagctgccccaggacctggagggcgccaggaacatgattgaggagcacagccagctgaagaagaaggtgatcaaggcccccatcgaggacctggacctggagggccagaagctgctgcagaggatccagagcagcgagagcttccccaagaagaacagcggcagcggaaatgctgacctgcagaacctgctgcccaaggtgtccaccatgctggaccggctgcacagcacccggcagcacctgcaccagatgtggcacgtgaggaagctgaagctggaccagtgcttccagctgcggctgtttgagcaggatgctgagaagatgtttgactggatcacccacaacaagggcctcttcctgaacagctacacagagatcggcaccagccacccccacgccatggagctgcagacccagcacaaccactttgccatgaactgcatgaatgtgtatgtgaacatcaaccgcatcatgtctgtggccaaccggctggtggagagcggccactacgccagccagcagatccggcagatcgccagccagctggagcaggagtggaaggcctttgctgctgccctggatgagaggagcaccctgctggacatgagcagcatcttccaccagaaggccgagaagtacatgagcaatgtggacagctggtgcaaggcctgtggggaggtggacctgcccagcgagctgcaggacctggaggatgccatccaccaccaccagggcatctatgagcacatcaccctggcctacagcgaggtgtcccaggacggcaagagcctgctggacaagctgcagaggcccctgaccccaggcagcagtgacagcctgacagccagcgccaactacagcaaggctgtgcaccacgtgctggatgtgatccacgaggtgctgcaccaccagaggcagctggagaacatctggcagcacaggaaggtgcggctgcaccagaggctgcagctgtgtgtgttccagcaggatgtgcagcaggtgctggactggattgaaaatcatggagaggccttcctgagcaagcacactggagtgggcaagagcctgcaccgggcccgggccctgcagaagagacatgaagattttgaggaggtggcccagaacacctacaccaatgctgacaagctgctggaggccgctgagcagctggcccagacaggagaatgtgaccctgaggagatctaccaggccgcccaccagctggaggaccgcatccaggactttgtgagaagagtggagcagaggaagatcctgctggacatgtctgtgtccttccacacccacgtgaaggagctgtggacctggctggaggagctgcagaaggagctgctggatgatgtgtatgcagagagcgtggaggccgtgcaggacctgatcaagagatttggccagcagcagcagaccaccctgcaggtgacagtgaatgtcatcaaggagggggaggacctgatccagcagctgcgggacagcgccatcagcagcaacaagaccccccacaacagcagcatcaaccacattgaaacagtgctgcagcagctggatgaggcccagagccagatggaggagctgttccaggagaggaagatcaagctggagctgttcctgcagctgcgcatctttgaaagagatgccatcgacatcatcagtgacctggagagctggaatgatgagctgagccagcagatgaatgactttgacacagaggacctgaccatcgccgagcagaggctgcagcaccacgccgacaaggccctgaccatgaacaacctgacctttgatgtgatccaccagggccaggacctgctgcagtatgtgaatgaggtgcaggccagcggcgtggagctgctgtgtgacagagatgtggacatggccaccagggtgcaggacctgctggagttcctgcacgagaagcagcaggagctggacctggccgctgagcagcacaggaagcacctggagcagtgtgtgcagctgcggcacctgcaggccgaggtgaagcaggtgctgggctggatcagaaatggagagagcatgctgaatgccggcctcatcacagccagcagcctgcaggaggccgagcagctgcagcgggagcacgagcagttccagcacgccatcgagaagacccaccagagcgccctgcaggtgcagcagaaggccgaggccatgctgcaggccaaccactatgacatggacatgatccgggactgtgccgagaaggtggccagccactggcagcagctgatgctgaagatggaggaccggctgaagctggtgaatgcctctgtggccttctacaagaccagcgagcaggtgtgcagcgtgctggagagcctggagcaggagtacaagcgggaggaggactggtgtggcggcgctgacaagctgggccccaacagcgagacagaccacgtgacccccatgatcagcaagcacctggagcagaaggaggccttcctgaaggcctgcaccctggccaggagaaatgctgatgtgttcctgaagtacctgcacaggaacagcgtgaacatgcctggcatggtgacccacatcaaggcccctgagcagcaggtgaagaacatcctgaatgagctgttccagcgggagaacagagtgctgcactactggaccatgaggaagaggcggctggaccagtgccagcagtatgtggtgtttgagaggtctgccaagcaggccctggagtggattcatgacaatggagagttctacctgagcacccacaccagcacaggcagcagcatccagcacacccaggagctgctgaaggagcacgaggagttccagatcacagccaagcagaccaaggagcgggtgaagctgctgatccagctggctgatggcttctgtgagaagggccacgcccacgccgctgagatcaagaagtgtgtgacagctgtggacaagcgctacagagacttcagcctgaggatggagaagtaccgcaccagcctggagaaggccctgggcatcagcagtgacagcaacaagagcagcaagagcctgcagctggacatcatcccagccagcatccctggcagcgaggtgaagctgagagatgctgcccacgagctgaatgaggagaagaggaagagcgcccggaggaaggagttcatcatggccgagctgatccagacagagaaggcctacgtgcgggacctgcgggagtgcatggacacctacctgtgggagatgaccagcggcgtggaggagatccccccaggcatcgtgaacaaggagctgatcatctttggaaacatgcaggagatctatgagttccacaacaacatcttcctgaaggagctggagaagtatgagcagctgcctgaagatgtgggccactgctttgtgacctgggccgacaagttccagatgtatgtgacctactgcaagaacaagccagacagcacccagctgatcctggagcacgccggcagctactttgatgagatccagcagagacatggcctggccaacagcatcagcagctacctgatcaagcctgtgcagaggatcaccaagtaccagctgctgctgaaggagctgctgacctgctgtgaggagggcaaaggagagatcaaggatggcctggaggtgatgctgtctgtgcccaagagggccaatgatgccatgcacctgtccatgctggagggctttgatgagaacatcgagagccagggcgagctgatcctgcaggagagcttccaggtgtgggaccccaagaccctcatcaggaagggccgggagcggcacctgttcctgtttgagatgagcctggtgttcagcaaggaggtgaaggacagcagcggccgcagcaagtacctgtacaagagcaagctgttcaccagcgagctgggcgtgacagaacatgtggagggggacccctgcaagtttgccctgtgggtgggccgcacccccaccagtgacaacaagatcgtgctgaaggccagcagcattgagaacaagcaggactggatcaagcacatccgggaggtgatccaggagaggaccatccacctgaagggggccctgaaggagcccatccacatccccaagacagccccagccacccggcagaagggcagaagagatggagaggacctggacagccagggagatggcagcagccagcctgacaccatcagcatcgccagcaggaccagccagaacaccctggacagcgacaagctgagcggcggctgtgagctgactgtggtgattcatgacttcaccgcctgcaacagcaatgagctgaccatccggcggggccagacagtggaggtgctggagcggccccatgacaagccagactggtgcctggtgaggaccacagacaggagccctgctgctgagggcctggtgccctgtggcagcctgtgcatcgcccacagccgcagctccatggagatggagggcatcttcaaccacaaggacagcctgtctgtgagcagcaatgatgccagccccccagcctctgtggccagcctgcagccccacatgattggagcccagagcagccctggccccaagaggcctggcaacaccctgaggaagtggctgaccagccctgtgcggcggctgagcagcggcaaggcagatggccacgtgaagaagctggcccacaagcacaagaagagccgggaggtgaggaagtctgcagatgctggcagccagaaggacagtgatgattctgctgccaccccccaggatgaaacagtggaggagcggggcagaaatgaaggcctgagcagcggcaccctgagcaagagcagcagcagcggcatgcagagctgtggggaggaggagggggaggagggcgcagatgctgtgcccctgcccccacccatggccatccagcagcacagcctgctgcagcctgacagccaggatgacaaggccagcagccggctgctggtgcggcccaccagcagcgagaccccatctgctgctgagctggtgtctgccatcgaggagctggtgaagagcaagatggccctggaggaccggcccagcagcctgctggtggaccagggcgacagcagcagccccagcttcaaccccagcgacaacagcctgctgagcagcagcagccccattgatgagatggaggagaggaagagcagcagcctgaagagaagacactacgtgctgcaggagctggtggagacagagcgggactatgtgcgggacctgggctacgtggtggagggctacatggccctgatgaaggaggatggagtgcctgatgacatgaagggcaaggacaagatcgtgtttggaaacatccaccagatctatgactggcaccgggacttcttcctgggggagctggagaagtgcctggaggaccctgagaagctgggcagcctgtttgtgaagcatgaaagaaggctgcacatgtacatcgcctactgccagaacaagcccaagtctgagcacatcgtgtctgagtacatcgacaccttctttgaggacctgaagcagaggctgggccaccggctgcagctgacagacctgctgatcaagcctgtgcagaggatcatgaagtaccagctgctgctgaaggacttcctgaagtacagcaagaaggccagcctggacaccagcgagctggagagagctgtggaggtgatgtgcatcgtgccccggcgctgcaatgacatgatgaatgtgggccgcctgcagggctttgatggcaagatcgtggcccagggcaagctgctgctgcaggacaccttcctggtgacagaccaggatgctggcctgctgccccgctgccgggagcggcgcatcttcctgtttgagcagatcgtcatcttcagcgagcccctggacaagaagaagggcttctccatgcctggcttcctgttcaagaacagcatcaaggtgtcctgcctgtgcctggaggagaatgtggagaatgacccctgcaagtttgccctgaccagcaggactggagatgtggtggagaccttcatcctgcacagcagcagccccagcgtgcggcagacctggatccacgagatcaaccagatcctggagaaccagaggaacttcctgaatgccctgaccagccccatcgagtaccagaggaaccacagcggcggcggcggcggcggcggcagcggcggcagcggcggcggcggcggcagcggcggcggcggggcccccagcggcggcagcggccacagcggcggccccagcagctgtggcggggcccccagcaccagccgcagccggcccagccgcatcccccagcctgtgcgccaccacccccctgtgctggtgtcctctgctgccagcagccaggccgaggccgacaagatgtctgagagcgagagcagcagcagcagcaacatcagcaccatgctggtgacccatgactacacagctgtgaaggaggatgagatcaacgtgtaccagggcgaggtggtgcagatcctggccagcaaccagcagaacatgttcctggtgttccgggccgccacagaccagtgcccagctgctgagggctggatccctggctttgtgctgggccacaccagcgctgtgattgtggagaacccagatggcaccctgaagaagagcacctcctggcacacagccctgcggctgaggaagaagtctgagaagaaggacaaggatggcaagcgggagggcaagctggagaatggctacaggaagagccgggagggcctgagcaacaaggtgtctgtgaagctgctgaaccccaactacatctatgatgtgcccccagagtttgtgatccccctgtctgaggtgacctgtgagaccggggagaccgtggtgctgcgctgccgggtgtgtggccggcccaaggccagcatcacctggaagggccctgagcacaacaccctgaacaatgatggccactacagcatctcctacagcgacctgggggaggccaccctgaagatcgtgggcgtgaccacagaagatgatggcatctacacctgcatcgctgtgaatgacatgggcagcgccagcagcagcgccagcctgcgggtgctgggccctggcatggatggcatcatggtgacctggaaggacaactttgacagcttctacagcgaggtggccgagctgggccggggccgcttctctgtggtgaagaagtgtgaccagaagggcaccaagagagctgtggccaccaagtttgtgaacaagaagctgatgaagagggaccaggtgacccatgagctgggcatcctgcagagcctgcagcaccccctgctggtgggcctgctggacacctttgagacccccaccagctacatcctggtgctggagatggctgaccagggccgcctgctggactgtgtggtgcgctggggcagcctgacagagggcaagatccgggcccacctgggggaggtgctggaggccgtgcgctacctgcacaactgcagaattgcccacctggacctgaagccagagaacatcctggtggatgagagcctggccaagcccaccatcaagctggccgactttggagatgctgtgcagctgaacaccacctactacatccaccagctgctgggcaaccctgagtttgctgcccctgagatcatcctgggcaaccctgtgtccctgaccagtgacacctggagcgtgggcgtgctgacctacgtgctgctgtctggagtgagccccttcctggatgacagcgtggaggagacctgcctgaacatctgccgcctggacttctccttcccagatgactacttcaagggcgtgtcccagaaggccaaggagtttgtgtgcttcctgctgcaggaggaccctgccaagaggcccagcgctgccctggccctgcaggagcagtggctgcaggccggaaatggccgcagcactggagtgctggacaccagccggctgaccagcttcatcgagaggaggaagcaccagaatgatgtgcggcccatccgcagcatcaagaacttcctgcagagccggctgctgccccgggtgtag

SEQ ID NO: 174425 - DNA, 768 bp, Artificial Sequence
  Description of Artificial Sequence: Synthetic coding sequence
atggccctggaggaccggcccagcagcctgctggtggaccagggcgacagcagcagccccagcttcaaccccagcgacaacagcctgctgagcagcagcagccccattgatgagatggaggagaggaagagcagcagcctgaagagaagacactacgtgctgcaggagctggtggagacagagcgggactatgtgcgggacctgggctacgtggtggagggctacatggccctgatgaaggaggatggagtgcctgatgacatgaagggcaaggacaagatcgtgtttggaaacatccaccagatctatgactggcaccgggacttcttcctgggggagctggagaagtgcctggaggaccctgagaagctgggcagcctgtttgtgaagcatgaaagaaggctgcacatgtacatcgcctactgccagaacaagcccaagtctgagcacatcgtgtctgagtacatcgacaccttctttgaggacctgaagcagaggctgggccaccggctgcagctgacagacctgctgatcaagcctgtgcagaggatcatgaagtaccagctgctgctgaaggacttcctgaagtacagcaagaaggccagcctggacaccagcgagctggagagagctgtggaggtgatgtgcatcgtgccccggcgctgcaatgacatgatgaatgtgggccgcctgcagggctttgatggccgggtggtggccctgtgccaccgcttcaaggagaccttccgggagatctgctggttctag

SEQ ID NO: 174426 - DNA, 1203 bp, Artificial Sequence
  Description of Artificial Sequence: Synthetic coding sequence
atgaatggccagctggacctgagcggcaagctgatcatcaaggcccagctgggggaggacatccgccgcatccccatccacaatgaagacatcacctatgatgagctggtgctgatgatgcagagggtcttccggggcaagctgctgagcaatgatgaggtgaccatcaagtacaaggatgaagatggagacctgatcaccatctttgacagcagtgacctgagctttgccatccagtgcagccgcatcctgaagctgaccctgtttgtgaatggccagccccggcccctggagagcagccaggtgaagtacctgcggcgggagctgattgagctgaggaacaaggtgaaccggctgctggacagcctggagcccccaggagagcccggccccagcaccaacatcccagaaaatgacacagtggatggccgggaggagaagagcgccagtgacagcagcggcaagcagagcacccaggtgatggccgcctccatgtctgcctttgaccccctgaagaaccaggatgagatcaacaagaatgtgatgtctgccttcggcctgacagatgaccaggtgtctggccccccatctgccccagcagaagatagaagtggcaccccagacagcatcgccagcagcagcagcgctgcccaccccccaggagtgcagccccagcagcccccctacaccggggcccagacccaggccggccagatcgagggccagatgtaccagcagtaccagcagcaggccggctatggagcccagcagccccaggccccaccccagcagccccagcagtatggcatccagtacagcgccagctacagccagcagacaggcccccagcagccccagcagttccagggctacggccagcagcccaccagccaggccccagccccagccttcagcggccagccccagcagctgcctgcccagcccccccagcagtaccaggccagcaactacccagcccagacctacacagcccagaccagccagcccaccaactacacagtggccccagccagccagcccggcatggcccccagccagcccggggcctaccagcccaggcctggcttcaccagcctgcccggcagcaccatgaccccaccacccagcggccccaacccctatgccaggaaccggccccccttcggccagggctacacccagcccggccctggctacagatag

SEQ ID NO: 174427 - DNA, 1101 bp, Artificial Sequence
  Description of Artificial Sequence: Synthetic coding sequence
atgaatggccagctggacctgagcggcaagctgatcatcaaggcccagctgggggaggacatccgccgcatccccatccacaatgaagacatcacctatgatgagctggtgctgatgatgcagagggtcttccggggcaagctgctgagcaatgatgaggtgaccatcaagtacaaggatgaagatggagacctgatcaccatctttgacagcagtgacctgagctttgccatccagtgcagccgcatcctgaagctgaccctgtttgtgaatggccagccccggcccctggagagcagccaggtgaagtacctgcggcgggagctgattgagctgaggaacaaggtgaaccggctgctggacagcctggagcccccaggagagcccggccccagcaccaacatcccagaaaatgacacagtggatggccgggaggagaagagcgccagtgacagcagcggcaagcagagcacccaggtgatggccgcctccatgtctgcctttgaccccctgaagaaccaggatgagatcaacaagaatgtgatgtctgccttcggcctgacagatgaccaggtgtctggccccccatctgccccagcagaagatagaagtggcaccccagacagcatcgccagcagcagcagcgctgcccaccccccaggagtgcagccccagcagcccccctacaccggggcccagacccaggccggccagatgtaccagcagtacagcaacagacctgccatggtgcacagcagccggcggctgcacctgagcagcctgaacagcatggtgttcagcatccagcaggccatcgtgtcccggctggacctgaacaacctgagcagcagccgggacatggccagcaaccagctgcccaggcaccagctgctgcccttcctggtgtccctgaacaactgcctgctgagccgccacagcagcacccggcgggccatcatcctgcacaagctgaccctgcccaagctgctgagcctgctgatcatcctgtggctgctgcccctgaacctggagtggctgcaggccaacctgggccccatcaaccaggaccaggtgctgctgcacttcctggaggtgccctag

SEQ ID NO: 174428 - DNA, 474 bp, Artificial Sequence
  Description of Artificial Sequence: Synthetic coding sequence
atgaatggccagctggacctgagcggcaagctgatcatcaaggcccagctgggggaggacatccgccgcatccccatccacaatgaagacatcacctatgatgagctggtgctgatgatgcagagggtcttccggggcaagctgctgagcaatgatgaggtgaccatcaagtacaaggatgaagatggagacctgatcaccatctttgacagcagtgacctgagctttgccatccagtgcagccgcatcctgaagctgaccctgtttgtgaatggccagccccggcccctggagagcagccaggtgaagtacctgcggcgggagctgattgagctgaggaacaaggtgaaccggctgctggacagcctggagcccccaggagagcccggccccagcaccaacatcccagaaaatgacacagtggatggccgggaggagaagagcgccagtgacagcagcggcaagcagagctag

SEQ ID NO: 174429 - DNA, 387 bp, Artificial Sequence
  Description of Artificial Sequence: Synthetic coding sequence
atgaatggccagctggacctgagcggcaagctgatcatcaaggcccagctgggggaggacatccgccgcatccccatccacaatgaagacatcacctatgatgagctggtgctgatgatgcagagggtcttccggggcaagctgctgagcaatgatgaggtgaccatcaagtacaaggatgaagatggagacctgatcaccatctttgacagcagtgacctgagctttgccatccagtgcagccgcatcctgaagctgaccctgtttgtgaatggccagccccggcccctggagagcagccaggtgaagtacctgcggcgggagctgattgagctgaggaacaaggtgaaccggctgctggacagcctggagcccccaggagagtag

SEQ ID NO: 174430 - DNA, 546 bp, Artificial Sequence
  Description of Artificial Sequence: Synthetic coding sequence
atgaatggccagctggacctgagcggcaagctgatcatcaaggcccagctgggggaggacatccgccgcatccccatccacaatgaagacatcacctatgatgagctggtgctgatgatgcagagggtcttccggggcaagctgctgagcaatgatgaggtgaccatcaagtacaaggatgaagatggagacctgatcaccatctttgacagcagtgacctgagctttgccatccagtgcagccgcatcctgaagctgaccctgtttgtgaatggccagccccggcccctggagagcagccaggtgaagtacctgcggcgggagctgattgagctgaggaacaaggtgaaccggctgctggacagcctggagcccccaggagagcccggccccagcaccaacatcccagaaaatgacacagtggatggccgggaggagaagagcgccagtgacagcagcggcaagcagagcacccaggtgatggccgcctccatgtctgcctttgaccccctgaagaaccaggatgagatcaacaagaatgtgtag

SEQ ID NO: 174431 - DNA, 1203 bp, Artificial Sequence; identical to SEQ ID NO: 174426
  Description of Artificial Sequence: Synthetic coding sequence

SEQ ID NO: 174432 - DNA, 1191 bp, Artificial Sequence
  Description of Artificial Sequence: Synthetic coding sequence
atgaatggccagctggacctgagcggcaagctgatcatcaaggcccagctgggggaggacatccgccgcatccccatccacaatgaagacatcacctatgatgagctggtgctgatgatgcagagggtcttccggggcaagctgctgagcaatgatgaggtgaccatcaagtacaaggatgaagatggagacctgatcaccatctttgacagcagtgacctgagctttgccatccagtgcagccgcatcctgaagctgaccctgtttgtgaatggccagccccggcccctggagagcagccaggtgaagtacctgcggcgggagctgattgagctgaggaacaaggtgaaccggctgctggacagcctggagcccccaggagagcccggccccagcaccaacatcccagaaaatgacacagtggatggccgggaggagaagagcgccagtgacagcagcggcaagcagagcacccaggtgatggccgcctccatgtctgcctttgaccccctgaagaaccaggatgagatcaacaagaatgtgatgtctgccttcggcctgacagatgaccaggtgtctggccccccatctgccccagcagaagatagaagtggcaccccagacagcatcgccagcagcagcagcgctgcccaccccccaggagtgcagccccagcagcccccctacaccggggcccagacccaggccggccagatgtaccagcagtaccagcagcaggccggctatggagcccagcagccccaggccccaccccagcagccccagcagtatggcatccagtacagcgccagctacagccagcagacaggcccccagcagccccagcagttccagggctacggccagcagcccaccagccaggccccagccccagccttcagcggccagccccagcagctgcctgcccagcccccccagcagtaccaggccagcaactacccagcccagacctacacagcccagaccagccagcccaccaactacacagtggccccagccagccagcccggcatggcccccagccagcccggggcctaccagcccaggcctggcttcaccagcctgcccggcagcaccatgaccccaccacccagcggccccaacccctatgccaggaaccggccccccttcggccagggctacacccagcccggccctggctacagatag

SEQ ID NO: 174433 - DNA, 729 bp, Artificial Sequence
  Description of Artificial Sequence: Synthetic coding sequence
atgggagaggccagccccccagccccagcccggcggcacctgctggtgctgctgctgctgctgagcaccctggtgatccccagcgctgctgcccccatccatgatgctgatgcccaggagagcagcctgggcctgaccggcctgcagagcctgctgcagggcttcagccgcctcttcctgaagggcaacctgctgcggggcatcgacagcctcttcagcgcccccatggacttccggggcctgcccggcaactaccacaaggaggagaaccaggagcaccagctgggcaacaacaccctgagcagccacctgcagattgacaagatgacagacaacaagacaggagaggtgctgatcagtgaaaatgtggtggccagcatccagcctgctgagggcagctttgaaggagacctgaaggtgcccaggatggaggagaaggaggccctggtgcccatccagaaggccacagacagcttccacacagagctgcacccccgggtggccttctggatcatcaagctgcccaggagaagaagccaccaggatgccctggagggcggccactggctgtctgagaagaggcaccggctgcaggccatcagagatggcctgaggaagggcacccacaaggatgtgctggaggagggcacagagagcagcagccacagccggctgagccccaggaagacccacctgctgtacatcctgcggcccagccggcagctgtag

SEQ ID NO: 174434 - DNA, 1980 bp, Artificial Sequence
  Description of Artificial Sequence: Synthetic coding sequence
atgcagggcagcagcctgtggctgagcctgaccttccgcagcgcccgggtgctgagccgggcccgcttctttgagtggcagagccctggcctgcccaacacagctgccatggagaatggaacaggcccctacggggaggagcggccccgggaggtgcaggagaccaccgtgacagagggcgccgccaagatcgccttccccagcgccaatgaggtgttctacaaccctgtgcaggagttcaacagagacctgacctgtgctgtgatcacagaatttgcccgcatccagctgggcgccaagggcatccagatcaaggtgcctggagagaaggacacccagaaggtggtggtggacctgtctgagcaggaggaggagaaggtggagctgaaggagagcgagaacctggccagcggggaccagcccaggacagctgctgtgggggagatctgtgaggagggcctgcacgtgctggagggcctggccgccagcggcctgcggagcatccgctttgccctggaggtgcccggcctgcggtctgtggtggccaatgatgccagcaccagggctgtggacctgatcagaagaaatgtgcagctgaatgatgtggcccacctggtgcagcccagccaggctgatgccaggatgctgatgtaccagcaccagagggtgtctgaaagatttgatgtgattgacctggacccctacggcagccctgccaccttcctggatgctgctgtgcaggccgtgtctgagggcggcctgctgtgtgtgacctgcacagacatggctgtgctggccggcaacagcggggagacctgctacagcaaatatggagccatggccctgaagagccgggcctgccacgagatggccctgcgcatcgtgctgcacagcctggacctgcgggccaactgctaccagagatttgtggtgcccctgctgagcatctctgctgacttctacgtgcgggtgtttgtgcgggtcttcaccggccaggccaaggtgaaggccagcgccagcaagcaggccctggtgttccagtgtgtgggctgtggggccttccacctgcagaggctgggcaaggccagcggcgtgcccagcggccgggccaagttctctgctgcctgtggcccccctgtgaccccagaatgtgagcactgcggccagaggcaccagctgggcggccccatgtgggccgagcccatccatgacctggactttgtgggccgggtgctggaggccgtgtctgccaaccctggccgcttccacaccagcgagcgcatccggggcgtgctgagcgtcatcacagaggagctgcctgatgtgcccctgtactacaccctggaccagctgagcagcaccatccactgcaacacccccagcctgctgcagctgcggagcgccctgctgcacgccgacttccgggtgtccctgagccacgcctgcaagaatgctgtgaagacagatgccccagccagcgccctgtgggacatcatgcgctgctgggagaaggaatgtcctgtgaagcgggagcggctgtctgagaccagccctgccttccgcatcctgtctgtggagccccggctgcaggccaacttcaccatcagagaagatgccaaccccagcagccggcagaggggcctgaagcgcttccaggccaaccctgaggccaactggggcccccggccccgggcccggcctgggggcaaggccgcagatgaggccatggaggagcggcggcggctgctgcagaacaagaggaaggagcccccagaagatgtggcccagagagctgcccggctgaagaccttcccctgcaagcgcttcaaggagggcacctgccagagaggagaccagtgctgctacagccacagcccccccaccccccgggtgtctgcagatgctgccccagactgcccagagaccagcaaccagaccccacctggccctggagctgctgctggccctggcatcgactag

SEQ ID NO: 174435 - DNA, 1980 bp, Artificial Sequence; identical to SEQ ID NO: 174434
  Description of Artificial Sequence: Synthetic coding sequence

SEQ ID NO: 174436 - DNA, 1878 bp, Artificial Sequence
  Description of Artificial Sequence: Synthetic coding sequence
atgtctgagaacctggacaatgaaggccccaagcccatggagagctgtggccaggagagcagcagcgccctgagctgccccaccgtgtctgtgcccccagctgccccagctgccctggaggaggtggagaaggagggcgctggggccgccactggacctggcccccagcccggcctgtacagctacatcagagatgacctcttcaccagcgagatcttcaagctggagctgcagaatgtgcccaggcatgccagcttcagtgatgtgcggcgcttcctgggccgcttcggcctgcagccccacaagaccaagctgtttggccagcccccctgtgcctttgtgaccttccgctctgctgctgagcgggacaaggccctgcgggtgctgcacggggccctgtggaagggccggcccctgtctgtgcggctggcccggcccaaggctgaccccatggccaggagaagacggcaggagggggagagcgagccccctgtgaccagggtggctgatgtggtgacccccctgtggacagtgccctatgcagagcagctggagaggaagcagctggagtgtgagcaggtgctgcagaagctggccaaggagatcggcagcaccaacagagccctgctgccctggctgctggagcagaggcacaagcacaacaaggcctgctgccccctggagggcgtgcggcccagcccccagcagacagagtacagaaacaagtgtgagttcctggtgggcgtgggcgtggatggagaggacaacacagtgggctgccgcctgggcaagtacaagggcggcacctgtgctgtggccgccccctttgacacagtgcacatccctgaggccaccaagcaggtggtgaaggccttccaggagttcatccgcagcaccccctacagcgcctatgaccctgagacctacacaggccactggaagcagctgactgtgaggaccagccgccgccaccaggccatggccatcgcctacttccacccccagaagctgagccctgaggagctggccgagctgaagaccagcctggcccagcacttcaccgctggccctggccgggccagcggcgtgacctgcctgtactttgtggaggagggccagaggaagacccccagccaggagggcctgcccctggagcacgtggccggggaccgctgcatccacgaggacctgctgggcctgaccttccgcatcagcccccacgccttcttccaggtgaacaccccagctgctgaggtgctgtacaccgtcatccaggactgggcccagctggatgctggctccatggtgctggatgtgtgctgcggcaccggcaccatcggcctggccctggccaggaaggtgaagagggtcatcggcgtggagctgtgcccagaggccgtggaggatgcccgggtgaatgcccaggacaatgagctgagcaatgtggagttccactgcggccgggcagaggacctggtgcccaccctggtgtcccggctggccagccagcacctggtggccatcctggaccccccccgggccggcctgcacagcaaggtgatcctggccatcagaagagccaagaacctgcggcggctgctgtatgtgtcctgcaacccccgggccgccatgggcaactttgtggacctgtgccgggcccccagcaacagagtgaagggcatccccttccggcctgtgaaggctgtggccgtggacctcttcccccagaccccccactgtgagatgctgatcctgtttgagcgggtggagcaccccaatggaactggagtgctgggcccccacagccccccagcccagcccaccccaggccccccagacaacaccctgcaggagaccggcaccttccccagcagctag

SEQ ID NO: 174437 - DNA, 1878 bp, Artificial Sequence; identical to SEQ ID NO: 174436
  Description of Artificial Sequence: Synthetic coding sequence

SEQ ID NO: 174438 - DNA, 1689 bp, Artificial Sequence
  Description of Artificial Sequence: Synthetic coding sequence
atgtctgagaacctggacaatgaaggccccaagcccatggagagctgtggccaggagagcagcagcgccctgagctgccccaccgtgtctgtgcccccagctgccccagctgccctggaggaggtggagaaggagggcgctggggccgccactggacctggcccccagcccggcctgtacagctacatcagagatgacctcttcaccagcgagatcttcaagctggagctgcagaatgtgcccaggcatgccagcttcagtgatgtgcggcgcttcctgggccgcttcggcctgcagccccacaagaccaagctgtttggccagcccccctgtgcctttgtgaccttccgctctgctgctgagcgggacaaggccctgcgggtgctgcacggggccctgtggaagggccggcccctgtctgtgcggctggcccggcccaaggctgaccccatggccaggagaagacggcaggagggggagagcgagccccctgtgaccagggtggctgatgtggtgacccccctgtggacagtgccctatgcagagcagctggagaggaagcagctggagtgtgagcaggtgctgcagaagctggccaaggagatcggcagcaccaacagagccctgctgccctggctgctggagcagaggcacaagcacaacaaggcctgctgccccctggagggcgtgcggcccagcccccagcagacagagtacagaaacaagtgtgagttcctggtgggcgtgggcgtggatggagaggacaacacagtgggctgccgcctgggcaagtacaagggcggcacctgtgctgtggccgccccctttgacacagtgcacatccctgaggccaccaagcaggtggtgaaggccttccaggagttcatccgcagcaccccctacagcgcctatgaccctgagacctacacaggccactggaagcagctgactgtgaggaccagccgccgccaccaggccatggccatcgcctacttccacccccagaagctgagccctgaggagctggccgagctgaagaccagcctggcccagcacttcaccgctggccctggccgggccagcggcgtgacctgcctgtactttgtggaggagggccagaggaagacccccagccaggagggcctgcccctggagcacgtggccggggaccgctgcatccacgaggacctgctgggcctgaccttccgcatcagcccccacgccttcttccaggtgaacaccccagctgctgaggtgctgtacaccgtcatccaggactgggcccagctggatgctggctccatggtgctggatgtgtgctgcggcaccggcaccatcggcctggccctggccaggaaggtgaagagggtcatcggcgtggagctgtgcccagaggccgtggaggatgcccgggtgaatgcccaggacaatgagctgagcaatgtggagttccactgcggccgggcagaggacctggtgcccaccctggtgtcccggctggccagccagcacctggtggccatcctggaccccccccgggccggcctgcacagcaaggtgatcctggccatcagaagagccaagaacctgcggcggctgctgtatgtgtcctgcaacccccgggccgccatgggcaactttgtggatgcccccctcttccccccccagcccctgcagagccccatctag

SEQ ID NO: 174439 - DNA, 1530 bp, Artificial Sequence
  Description of Artificial Sequence: Synthetic coding sequence
atggtgctgtggatcctgtggaggcccttcggcttcagcggccgcttcctgaagctggagagccacagcatcacagagagcaagagcctcatccctgtggcctggaccagcctgacccagatgctgctggaggcccctggcatcttcctgctgggccagaggaagcgcttcagcaccatgcctgagacagagacccatgagcgggagacagagctgttcagccccccatctgatgtgcggggcatgaccaagctggacagaacagccttcaagaagacagtgaacatccctgtgctgaaggtgaggaaggagatcgtgtccaagctgatgaggagcctgaagagagctgccctgcagaggcctggcatccggcgggtgattgaggaccctgaggacaaggagagccgcctcatcatgctggacccctacaagatcttcacccatgacagctttgagaaggccgagctgtctgtgctggagcagctgaatgtgagcccccagatcagcaagtacaacctggagctgacctatgagcacttcaagtctgaggagatcctgcgggctgtgctgcctgagggccaggatgtgaccagcggcttcagcagaattggccacatcgcccacctgaacctgcgggaccaccagctgtccttcaagcacctgattggccaggtgatgattgacaagaaccctggcatcaccagcgctgtgaacaagatcaacaacatcgacaacatgtacagaaacttccagatggaggtgctgagcggggagcagaacatgatgaccaaggtgcgggagaacaactacacctatgaatttgacttcagcaaggtgtactggaacccccggctgagcacagagcacagccgcatcacagagctgctgaagccaggagatgtgctgtttgatgtgtttgctggggtgggcccctttgccatccctgtggccaagaagaactgcaccgtgtttgccaatgacctgaaccctgagagccacaagtggctgctgtacaactgcaagctgaacaaggtggaccagaaggtgaaggtgttcaacctggatggcaaggacttcctgcagggccctgtgaaggaggagctgatgcagctgctgggcctgagcaaggagaggaagcccagcgtgcacgtggtgatgaacctgcctgccaaggccatcgagttcctgagcgccttcaagtggctgctggatggccagccctgcagcagcgagttcctgcccatcgtgcactgctacagcttcagcaaggatgccaacccagcagaagatgtgcggcagagagctggagctgtgctgggcatcagcctggaggcctgcagctctgtgcacctggtgagaaatgtggcccccaacaaggagatgctgtgcatcaccttccagatcccagcctctgtgctgtacaagaaccagaccagaaatcctgagaaccatgaagatcctcccctgaagaggcagaggacagctgaggccttcagtgatgagaagacccagatcgtgagcaacacctag

SEQ ID NO: 174440 - DNA, 1266 bp, Artificial Sequence
  Description of Artificial Sequence: Synthetic coding sequence
atgcaggccctgcggcacgtggtgtgtgccctgagcggcggcgtggacagcgctgtggccgccctgctgctgcggcggcggggctaccaggtgactggagtcttcatgaagaactgggacagcctggatgaacatggagtgtgcacagctgacaaggactgtgaagatgcctacagagtgtgccagatcctggacatccccttccaccaggtgtcctatgtgaaggagtactggaatgatgtgttcagtgacttcctgaatgaatatgaaaaaggaagaacacccaacccagacatcgtgtgcaacaagcacatcaagttcagctgcttcttccactatgctgtggacaacctgggcgcagatgccatcgccaccggccactacgcccggaccagcctggaggatgaggaggtgtttgagcagaagcacgtgaagaagccagagggcctcttcaggaacagatttgaggtgagaaatgctgtgaagctgctgcaggccgctgacagcttcaaggaccagaccttcttcctgagccaggtgtcccaggatgccctgcggaggaccatcttccccctgggcggcctgaccaaggagtttgtgaagaagattgctgctgagaaccggctgcaccacgtgctgcagaagaaggagagcatgggcatgtgcttcatcggcaagaggaactttgagcacttcctgctgcagtacctgcagcccaggcctggccacttcatcagcattgaggacaacaaggtgctgggcacccacaagggctggttcctgtacaccctgggccagagggccaacatcggcggcctgcgggagccctggtacgtggtggagaaggacagcgtgaagggagatgtgtttgtggcccccaggacagaccacccagccctgtacagagacctgctgcggaccagccgggtgcactggattgctgaggagcccccagctgccctggtgcgggacaagatgatggagtgccacttccgcttccgccaccagatggccctggtgccctgtgtgctgaccctgaaccaggacggcaccgtgtgggtgacagctgtgcaggccgtgcgggccctggccaccggccagtttgctgtgttctacaagggagatgagtgcctgggcagcggcaagatcctgcggctgggccccagcgcctacaccctgcagaagggccagaggcgggccggcatggccacagagagccccagcgacagcccagaagatggccctggcctgagccccctgctgtag

SEQ ID NO: 174441 - DNA, 300 bp, Artificial Sequence
  Description of Artificial Sequence: Synthetic coding sequence
atgcaggccctgcggcacgtggtgtgtgccctgagcggcggcgtggacagcgctgtggccgccctgctgctgcggcggcggggctaccaggtgactggagtcttcatgaagaactgggacagcctggatgaacatggagtgtgcacagctgacaaggactgtgaagatgcctacagagtgtgccagatcctggacatccccttccaccaggtgtcctatgtgaaggagtactggaatgatgtgttccggggccgctgccactgccacaggagcctgtgcaagaacttccctggaagatag

SEQ ID NO: 174442 - DNA, 396 bp, Artificial Sequence
  Description of Artificial Sequence: Synthetic coding sequence
atgaagaactgggacagcctggatgagcacggcgtgtgcacagctgacaaggactgtgaagatgcctacagagtgtgccagatcctggacatccccttccaccaggtgtcctatgtgaaggagtactggaatgatgtgttcagtgacttcctgaatgaatatgagaagggccgcacccccaacccagacatcgtgtgcaacaagcacatcaagttcagctgcttcttccactatgctgtggacaacctgggcgcagatgccatcgccaccggccactacgcccggaccagcctggaggatgaggaggtgtttgagcagaagcacgtgaagaagccagagggcctcttcaggaacagatttgaggtgagaaatgcccgcttccccaggatgccctag

SEQ ID NO: 174443 - DNA, 300 bp, Artificial Sequence; identical to SEQ ID NO: 174441
  Description of Artificial Sequence: Synthetic coding sequence

SEQ ID NO: 174444 - DNA, 300 bp, Artificial Sequence; identical to SEQ ID NO: 174441
  Description of Artificial Sequence: Synthetic coding sequence

SEQ ID NO: 174445 - DNA, 300 bp, Artificial Sequence; identical to SEQ ID NO: 174441
  Description of Artificial Sequence: Synthetic coding sequence

SEQ ID NO: 174446 - DNA, 501 bp, Artificial Sequence
  Description of Artificial Sequence: Synthetic coding sequence
atgcaggccctgcggcacgtggtgtgtgccctgagcggcggcgtggacagcgctgtggccgccctgctgctgcggcggcggggctaccaggtgactggagtcttcatgaagaactgggacagcctggatgaacatggagtgtgcacagctgacaaggactgtgaagatgcctacagagtgtgccagatcctggacatccccttccaccaggtgtcctatgtgaaggagtactggaatgatgtgttcagtgacttcctgaatgaatatgaaaaaggaagaacacccaacccagacatcgtgtgcaacaagcacatcaagttcagctgcttcttccactatgctgtggacaacctgggcgcagatgccatcgccaccggccactacgcccggaccagcctggaggatgaggaggtgtttgagcagaagcacgtgaagaagccagagggcctcttcaggaacagatttgaggtgagaaatgcccgcttccccaggatgccctag

SEQ ID NO: 174447 - DNA, 1038 bp, Artificial Sequence
  Description of Artificial Sequence: Synthetic coding sequence
atggagcccctgcgggtgctggagctgtacagcggcgtgggcggcatgcaccacgccctgcgggagagctgcatcccagcccaggtggtggccgccattgatgtgaacacagtggccaatgaggtgtacaagtacaacttcccccacacccagctgctggccaagaccatcgagggcatcaccctggaggagtttgaccggctgagctttgacatgatcctgatgagccccccctgccagcccttcacccgggacctgctgatccagaccatcgagaactgtggcttccagtaccaggagttcctgctgagccccaccagcctgggcatccccaacagccggctgcgctacttcctgattgccaagctgcagagcgagcccctgcccttccaggcccctggccaggtgctgatggagttccccaagattgaatctgtgcacccccagaagtatgccatggatgtggagaacaagatccaggagaagaatgtggagcccaacatcagctttgatggcagcatccagtgcagcggcaaggatgccatcctcttcaagctggagacagctgaggagatccacaggaagaaccagcaggacagcgacctgtctgtgaagatgctgaaggacttcctggaggatgacacagatgtgaaccagtacctgctgccccccaagagcctgctgcgctatgccctgctgctggacatcgtgcagcccacctgccgccgctctgtgtgcttcaccaagggctacggcagctacatcgagggcaccggctctgtgctgcagacagcagaagatgtgcaggtggagaacatctacaagagcctgaccaacctgagccaggaggagcagatcaccaagctgctgatcctgaagctgcgctacttcacccccaaggagatcgccaacctgctgggcttccccccagagtttggcttccctgagaagatcaccgtgaagcagcgctaccgcctgctgggcaacagcctgaatgtgcacgtggtggccaagctgatcaagatcctgtatgaatag

SEQ ID NO: 174448 - DNA, 216 bp, Artificial Sequence
  Description of Artificial Sequence: Synthetic coding sequence
atggagcccctgcgggtgctggagctgtacagcggcgtgggcggcatgcaccacgccctgcgggagagctgcatcccagcccaggtggtggccgccattgatgtgaacacagtggccaatgaggtgtacaagtacaacttcccccacacccagctgctggccaagaccatcgagatcaccaagatcaccaaggtgtacagctttgggaagtgctag

SEQ ID NO: 174449 - DNA, 354 bp, Artificial Sequence
  Description of Artificial Sequence: Synthetic coding sequence
atggagcccctgcgggtgctggagctgtacagcggcgtgggcggcatgcaccacgccctgcgggagagctgcatcccagcccaggtggtggccgccattgatgtgaacacagtggccaatgaggtgtacaagtacaacttcccccacacccagctgctggccaagaccatcgagcggcccctggacaccaacaacaggaagctgtggctgtctgtgccccgggtgtccatcatcagcaacctgtcctggcacagcaagttcaaggccaccatcttctcctactgcaaggcctctgtgcgggccatcaccctgagcagcccctggagcggcacagatggagtgccccagaactag

SEQ ID NO: 174450 - DNA, 1176 bp, Artificial Sequence
  Description of Artificial Sequence: Synthetic coding sequence
atggagcccctgcgggtgctggagctgtacagcggcgtgggcggcatgcaccacgccctgcgggagagctgcatcccagcccaggtggtggccgccattgatgtgaacacagtggccaatgaggtgtacaagtacaacttcccccacacccagctgctggccaagaccatcgagggcatcaccctggaggagtttgaccggctgagctttgacatgatcctgatgagccccccctgccagcccttcaccagaattggccggcagggcgacatgacagacagcaggaccaacagcttcctgcacatcctggacatcctgccccggctgcagaagctgcccaagtacatcctgctggagaatgtgaagggctttgaggtgagcagcacccgggacctgctgatccagaccatcgagaactgtggcttccagtaccaggagttcctgctgagccccaccagcctgggcatccccaacagccggctgcgctacttcctgattgccaagctgcagagcgagcccctgcccttccaggcccctggccaggtgctgatggagttccccaagattgaatctgtgcacccccagaagtatgccatggatgtggagaacaagatccaggagaagaatgtggagcccaacatcagctttgatggcagcatccagtgcagcggcaaggatgccatcctcttcaagctggagacagctgaggagatccacaggaagaaccagcaggacagcgacctgtctgtgaagatgctgaaggacttcctggaggatgacacagatgtgaaccagtacctgctgccccccaagagcctgctgcgctatgccctgctgctggacatcgtgcagcccacctgccgccgctctgtgtgcttcaccaagggctacggcagctacatcgagggcaccggctctgtgctgcagacagcagaagatgtgcaggtggagaacatctacaagagcctgaccaacctgagccaggaggagcagatcaccaagctgctgatcctgaagctgcgctacttcacccccaaggagatcgccaacctgctgggcttccccccagagtttggcttccctgagaagatcaccgtgaagcagcgctaccgcctgctgggcaacagcctgaatgtgcacgtggtggccaagctgatcaagatcctgtatgaatag

SEQ ID NO: 174451 - DNA, 1104 bp, Artificial Sequence
  Description of Artificial Sequence: Synthetic coding sequence
atggagcccctgcgggtgctggagctgtacagcggcgtgggcggcatgcaccacgccctgcgggagagctgcatcccagcccaggtggtggccgccattgatgtgaacacagtggccaatgaggtgtacaagtacaacttcccccacacccagctgctggccaagaccatcgagggcatcaccctggaggagtttgaccggctgagctttgacatgatcctgatgagccccccctgccagcccttcacccggctgcagaagctgcccaagtacatcctgctggagaatgtgaagggctttgaggtgagcagcacccgggacctgctgatccagaccatcgagaactgtggcttccagtaccaggagttcctgctgagccccaccagcctgggcatccccaacagccggctgcgctacttcctgattgccaagctgcagagcgagcccctgcccttccaggcccctggccaggtgctgatggagttccccaagattgaatctgtgcacccccagaagtatgccatggatgtggagaacaagatccaggagaagaatgtggagcccaacatcagctttgatggcagcatccagtgcagcggcaaggatgccatcctcttcaagctggagacagctgaggagatccacaggaagaaccagcaggacagcgacctgtctgtgaagatgctgaaggacttcctggaggatgacacagatgtgaaccagtacctgctgccccccaagagcctgctgcgctatgccctgctgctggacatcgtgcagcccacctgccgccgctctgtgtgcttcaccaagggctacggcagctacatcgagggcaccggctctgtgctgcagacagcagaagatgtgcaggtggagaacatctacaagagcctgaccaacctgagccaggaggagcagatcaccaagctgctgatcctgaagctgcgctacttcacccccaaggagatcgccaacctgctgggcttccccccagagtttggcttccctgagaagatcaccgtgaagcagcgctaccgcctgctgggcaacagcctgaatgtgcacgtggtggccaagctgatcaagatcctgtatgaatag

SEQ ID NO: 174452 - DNA, 933 bp, Artificial Sequence
  Description of Artificial Sequence: Synthetic coding sequence
atgagcaccctgagcctgatgaagtacaccagcatcatcttcctgacccacagctacctgccccggcggctgaagattggccggcagggcgacatgacagacagcaggaccaacagcttcctgcacatcctggacatcctgccccgggacctgctgatccagaccatcgagaactgtggcttccagtaccaggagttcctgctgagccccaccagcctgggcatccccaacagccggctgcgctacttcctgattgccaagctgcagagcgagcccctgcccttccaggcccctggccaggtgctgatggagttccccaagattgagagcgtgcacccccagaagtatgccatggatgtggagaacaagatccaggagaagaatgtggagcccaacatcagctttgatggcagcatccagtgcagcggcaaggatgccatcctcttcaagctggagacagctgaggagatccacaggaagaaccagcaggacagcgacctgtctgtgaagatgctgaaggacttcctggaggatgacacagatgtgaaccagtacctgctgccccccaagagcctgctgcgctatgccctgctgctggacatcgtgcagcccacctgcagaagatctgtgtgcttcaccaagggctacggcagctacatcgagggcactggatctgtgctgcagacagcagaagatgtgcaggtggagaacatctacaagagcctgaccaacctgagccaggaggagcagatcaccaagctgctgatcctgaagctgcgctacttcacccccaaggagatcgccaacctgctgggcttccccccagagtttggcttccctgagaagatcaccgtgaagcagcgctaccgcctgctgggcaacagcctgaatgtgcacgtggtggccaagctgatcaagatcctgtatgaatag

SEQ ID NO: 174453 - DNA, 1305 bp, Artificial Sequence
  Description of Artificial Sequence: Synthetic coding sequence
atgctgcgctgcctgtaccactggcacaggcctgtgctgaacagacgctggagccggctgtgcctgcccaagcagtacctgttcaccatgaagctgcagagccctgagttccagagcctcttcacagagggcctgaagagcctgacagagctgtttgtgaaggaaaatcatgagctgagaattgctgggggcgctgtgcgggacctgctgaatggagtgaagccccaggacatcgactttgccaccacagccacccccacccagatgaaggagatgttccagagcgctggcatccgcatgatcaacaacagaggagagaagcacggcaccatcacagcccggctgcacgaggagaactttgagatcaccaccctgagaattgatgtgaccacagatggaagacatgctgaggtggagttcaccacagactggcagaaggatgctgagcggcgggacctgaccatcaacagcatgttcctgggctttgatggcaccctgtttgactacttcaacggctatgaggacctgaagaacaagaaggtgcgctttgtgggccacgccaagcagaggatccaggaggactacctgcgcatcctgcgctacttccgcttctacggccgcatcgtggacaagccaggggaccatgaccctgagaccctggaggccatcgcagaaaatgccaagggcctggccggcatcagcggggagcgcatctgggtggagctgaagaagatcctggtgggcaaccacgtgaaccacctgatccacctgatctatgacctggatgtggccccctacatcggcctgcctgccaatgccagcctggaggagtttgacaaggtgtccaagaatgtggatggcttcagccccaagcctgtgaccctgctggccagcctcttcaaggtgcaggatgatgtgaccaagctggacctgcggctgaagatcgccaaggaggagaagaacctgggcctcttcatcgtgaagaacaggaaggacctgatcaaggccacagacagcagtgaccccctgaagccctaccaggacttcatcatcgacagccgggagccagatgccaccaccagggtgtgtgagctgctgaagtaccagggcgagcactgcctgctgaaggagatgcagcagtggagcatcccccccttccctgtgtctggccatgacatcaggaaggtgggcatcagcagcggcaaggagatcggggccctgctgcagcagctgcgggagcagtggaagaagagcggctaccagatggagaaggatgagctgctgagctacatcaagaagacctag

SEQ ID NO: 174454 - DNA, 1245 bp, Artificial Sequence
  Description of Artificial Sequence: Synthetic coding sequence
atgctgcgctgcctgtaccactggcacaggcctgtgctgaacagacgctggagccggctgtgcctgcccaagcagtacctgttcaccatgaagctgcagagccctgagttccagagcctcttcacagagggcctgaagagcctgacagagctgtttgtgaaggaaaatcatgagctgagaattgctgggggcgctgtgcgggacctgctgaatggagtgaagccccaggacatcgactttgccaccacagccacccccacccagatgaaggagatgttccagagcgctggcatccgcatgatcaacaacagaggagagaagcacggcaccatcacagcccggctgcacgaggagaactttgagatcaccaccctgagaattgatgtgaccacagatggaagacatgctgaggtggagttcaccacagactggcagaaggatgctgagcggcgggacctgaccatcaacagcatgttcctgggctttgatggcaccctgtttgactacttcaacggctatgaggacctgaagaacaagaaggtgcgctttgtgggccacgccaagcagaggatccaggaggactacctgcgcatcctgcgctacttccgcttctacggccgcatcgtggacaagccaggggaccatgaccctgagaccctggaggccatcgcagaaaatgccaagggcctggccggcatcagcggggagcgcatctgggtggagctgaagaagatcctggtgggcctgcctgccaatgccagcctggaggagtttgacaaggtgtccaagaatgtggatggcttcagccccaagcctgtgaccctgctggccagcctcttcaaggtgcaggatgatgtgaccaagctggacctgcggctgaagatcgccaaggaggagaagaacctgggcctcttcatcgtgaagaacaggaaggacctgatcaaggccacagacagcagtgaccccctgaagccctaccaggacttcatcatcgacagccgggagccagatgccaccaccagggtgtgtgagctgctgaagtaccagggcgagcactgcctgctgaaggagatgcagcagtggagcatcccccccttccctgtgtctggccatgacatcaggaaggtgggcatcagcagcggcaaggagatcggggccctgctgcagcagctgcgggagcagtggaagaagagcggctaccagatggagaaggatgagctgctgagctacatcaagaagacctag

SEQ ID NO: 174455 - DNA, 174 bp, Artificial Sequence
  Description of Artificial Sequence: Synthetic coding sequence
atgctgcgctgcctgtaccactggcacaggcctgtgctgaacagacgctggagccggctgtgcctgcccaagcagtacctgttcaccatgaagctgcagagccctgagttccagagcctcttcacagagggcctgaagagcctgaccggcatcaatgccttccacgagaactag

SEQ ID NO: 174456 - DNA, 174 bp, Artificial Sequence; identical to SEQ ID NO: 174455
  Description of Artificial Sequence: Synthetic coding sequence

SEQ ID NO: 174457 - DNA, 189 bp, Artificial Sequence
  Description of Artificial Sequence: Synthetic coding sequence
atgctgcgctgcctgtaccactggcacaggcctgtgctgaacagacgctggagccggctgtgcctgcccaagcagtacctgttcaccatgaagctgcagagccctgagttccagagcctcttcacagagggcctgaagagcctgacagagctgtttgtgaaggaaaatcatgagctgagaattgcctag

SEQ ID NO: 174458 - DNA, 174 bp, Artificial Sequence; identical to SEQ ID NO: 174455
  Description of Artificial Sequence: Synthetic coding sequence

SEQ ID NO: 174459 - DNA, 1305 bp, Artificial Sequence; identical to SEQ ID NO: 174453
  Description of Artificial Sequence: Synthetic coding sequence

SEQ ID NO: 174460 - DNA, 762 bp, Artificial Sequence
  Description of Artificial Sequence: Synthetic coding sequence
atgaacttcagcggcggcggccggcaggaggccgccggcagccggggcagaagagccccccggccccgggagcaggacagagatgtgcagctgagcaaggccctgtcctatgccctgcggcatggagccctgaagctgggcctgcccatgggcgcagatggctttgtgcccctgggcaccctgctgcagctgccccagttccggggcttcagcgcagaagatgtgcagagggtggtggacaccaacaggaagcagagatttgccctgcagctgggggaccccagcacaggcctgctgatccgggccaaccagggccacagcctgcaggtgcccaagctggagctgatgcccctggagaccccccaggccctgccccccatgctggtgcacggcaccttctggaagcactggcccagcatcctgctgaagggcctgagctgccagggccgcacccacatccacctggcccctggcctgcccggggaccccggcatcatcagcggcatgaggagccactgtgaaattgctgtgttcattgatggccccctggccctggctgatggcatccccttcttccgcagcgccaacggggtcatcctgaccccaggcaacacagatggcttcctgctgcccaagtacttcaaggaggccctgcagctgcggcccaccaggaagcccctgagcctggccggagatgaggagacagagtgccagagcagccccaagcacagcagccgggagcggcggcgcatccagcagtag

SEQ ID NO: 174461 - DNA, 768 bp, Artificial Sequence
  Description of Artificial Sequence: Synthetic coding sequence
atgaacttcagcggcggcggccggcaggaggccgccggcagccggggcagaagagccccccggccccgggagcaggacagagatgtgcagctgagcaaggccctgtcctatgccctgcggcatggagccctgaagctgggcctgcccatgggcgcagatggctttgtgcccctgggcaccctgctgcagctgccccagttccggggcttcagcgcagaagatgtgcagagggtggtggacaccaacaggaagcagagatttgccctgcagctgggggaccccagcacaggcctgctgatccgggccaaccagggccacagcctgcaggtgggcgtgcccaagctggagctgatgcccctggagaccccccaggccctgccccccatgctggtgcacggcaccttctggaagcactggcccagcatcctgctgaagggcctgagctgccagggccgcacccacatccacctggcccctggcctgcccggggaccccggcatcatcagcggcatgaggagccactgtgaaattgctgtgttcattgatggccccctggccctggctgatggcatccccttcttccgcagcgccaacggggtcatcctgaccccaggcaacacagatggcttcctgctgcccaagtacttcaaggaggccctgcagctgcggcccaccaggaagcccctgagcctggccggagatgaggagacagagtgccagagcagccccaagcacagcagccgggagcggcggcgcatccagcagtag

SEQ ID NO: 174462 - DNA, 615 bp, Artificial Sequence
  Description of Artificial Sequence: Synthetic coding sequence
atgggcgcagatggctttgtgcccctgggcaccctgctgcagctgccccagttccggggcttcagcgcagaagatgtgcagagggtggtggacaccaacaggaagcagagatttgccctgcagctgggggaccccagcacaggcctgctgatccgggccaaccagggccacagcctgcaggtgcccaagctggagctgatgcccctggagaccccccaggccctgccccccatgctggtgcacggcaccttctggaagcactggcccagcatcctgctgaagggcctgagctgccagggccgcacccacatccacctggcccctggcctgcccggggaccccggcatcatcagcggcatgaggagccactgtgaaattgctgtgttcattgatggccccctggccctggctgatggcatccccttcttccgcagcgccaatggagtcatcctgaccccaggcaacacagatggcttcctgctgcccaagtacttcaaggaggccctgcagctgcggcccaccaggaagcccctgagcctggccggagatgaggagacagagtgccagagcagccccaagcacagcagccgggagcggcggcgcatccagcagtag

SEQ ID NO: 174463 - DNA, 651 bp, Artificial Sequence
  Description of Artificial Sequence: Synthetic coding sequence
atgaacttcagcggcggcggccggcaggaggccgccggcagccggggcagaagagccccccggccccgggagcaggacagagatgtgcagctgagcaaggccctgtcctatgccctgcggcatggagccctgaagctgggcctgcccatgggcgcagatggctttgtgcccctgggcaccctgctgcagctgccccagttccggggcttcagcgcagaagatgtgcagagggtggtggacaccaacaggaagcagagatttgccctgcagctgggggaccccagcacaggcctgctgatccgggccaaccagggccacagcctgcaggtgcccaagctggagctgatgcccctggagaccccccaggccctgccccccatgctggtgcacggcaccttctggaagcactggcccagcatcctgctgaagggcctgagctgccagggccgcacccacatccacctggcccctggcctgcccggggaccccggcatcatcagcggcatgaggagccactgtgaaattgctgtgttcattgatggccccctggccctggccggcaagcccctgagcctggccggagatgaggagacagagtgccagagcagccccaagcacagcagccgggagcggcggcgcatccagcagtag

SEQ ID NO: 174464 - DNA, 504 bp, Artificial Sequence
  Description of Artificial Sequence: Synthetic coding sequence
atgggcgcagatggctttgtgcccctgggcaccctgctgcagctgccccagttccggggcttcagcgcagaagatgtgcagagggtggtggacaccaacaggaagcagagatttgccctgcagctgggggaccccagcacaggcctgctgatccgggccaaccagggccacagcctgcaggtgcccaagctggagctgatgcccctggagaccccccaggccctgccccccatgctggtgcacggcaccttctggaagcactggcccagcatcctgctgaagggcctgagctgccagggccgcacccacatccacctggcccctggcctgcccggggaccccggcatcatcagcggcatgaggagccactgtgaaattgctgtgttcattgatggccccctggccctggccggcaagcccctgagcctggccggagatgaggagacagagtgccagagcagccccaagcacagcagccgggagcggcggcgcatccagcagtag

SEQ ID NO: 174465 - DNA, 516 bp, Artificial Sequence
  Description of Artificial Sequence: Synthetic coding sequence
atggaggagcggggggacagcgagcccaccccaggctgcagcggcctgggccctgggggcgtgcggggctttggagatggcggcggggcccccagctgggccccagaagatgcctggatgggcacccaccccaagtacctggagatgatggagctggacattggagatgccacccaggtgtatgtggccttcctggtgtacctggacctgatggagagcaagtcctggcatgaggtgaactgtgtgggcctgcctgagctgcagctgatctgcctggtgggcacagaaattgaaggagagggcctgcagacagtggtgcccacccccatcacagccagcctgagccacaaccgcatccgggagatcctgaaggccagcaggaagctgcagggcgaccctgacctgcccatgtccttcaccctggccatcgtggagagtgacagcaccatcgtgtactacaagctgacagatggcttcatgctgcctgacccccagaacatcagcctgcggaggtag

SEQ ID NO: 174466 - DNA, 390 bp, Artificial Sequence
  Description of Artificial Sequence: Synthetic coding sequence
atggaggagcggggggacagcgagcccaccccaggctgcagcggcctgggccctgggggcgtgcggggctttggagatggcggcggggcccccagctgggccccagaagatgcctggatgggcacccaccccaagtacctggagatgatggagctggacattggagatgccacccaggtgtatgtggccttcctggtgtacctggacctgatggagagcaagtcctggcatgaggtgaactgtgtgggcctgcctgagctgcagctgatctgcctggtgggcacagaaattgaaggagagggcctgcagacagtggtgcccacccccatcacagccagcctgagccacaaccgcatcttcctgctggaggatgacatccacgtgtcctag

SEQ ID NO: 174467 - DNA, 1398 bp, Artificial Sequence
  Description of Artificial Sequence: Synthetic coding sequence
atggccgaggccgtgttccacgcccccaagaggaagagaagagtgtatgagacctatgagagccccctgcccatccccttcggccaggaccacggccccctgaaggagttcaagatcttccgggcagagatgatcaacaacaacgtcatcgtgagaaatgcagaagatattgagcagctgtatggcaagggctactttgggaagggcatcctgagccgcagccggcccagcttcaccatcagtgaccccaagctggtggccaagtggaaggacatgaagaccaacatgcccatcatcaccagcaagcgctaccagcacagcgtggagtgggccgctgagctgatgaggcggcagggccaggatgagagcacagtgcggcgcatcctgaaggactacaccaagcccctggagcacccccctgtgaagagaaatgaggaggcccaggtgcatgacaagctgaacagcggcatggtgagcaacatggagggcacagctggaggagagcggcccagcgtggtgaatggagacagcggcaagagcggcggcgtgggggacccccgggagcccctgggctgcctgcaggagggcagcggctgccaccccaccacagagagctttgagaagtctgtgcgggaggatgccagccccctgccccacgtgtgctgctgcaagcaggatgccctgatcctgcagaggggcctgcaccatgaagatggcagccagcacatcggcctgctgcaccctggggaccggggccctgaccatgaatatgtgctggtggaggaggccgagtgtgccatgtctgagcgggaggccgccccaaatgaggagctggtgcagaggaacagactcatctgcagaagaaacccctaccgcatctttgagtacctgcagctgagcctggaggaggccttcttcctggtgtatgccctgggctgcctgagcatctactatgagaaggagcccctgaccatcgtgaagctgtggaaggccttcaccgtggtgcagcccaccttccgcaccacctacatggcctaccactacttccgcagcaagggctgggtgcccaaggtgggcctgaagtatggaacagacctgctgctgtacagaaaaggaccacccttctaccacgccagctacagcgtcatcatcgagctggtggatgaccactttgagggcagcctgcggcggcccctgtcctggaagagcctggccgccctgagccgggtgtctgtgaatgtgtccaaggagctgatgctgtgctacctgatcaagcccagcaccatgacagacaaggagatggagagccctgagtgcatgaagaggatcaaggtgcaggaggtgatcctgagccgctgggtgagcagccgggagaggagtgaccaggatgacctgtag

SEQ ID NO: 174468 - DNA, 1320 bp, Artificial Sequence
  Description of Artificial Sequence: Synthetic coding sequence
atggccgaggccgtgttccacgcccccaagaggaagagaagagtgtatgagacctatgagagccccctgcccatccccttcggccaggaccacggccccctgaaggagttcaagatcttccgggcagagatgatcaacaacaacgtcatcgtgagaaatgcagaagatattgagcagctgtatggcaagggctactttgggaagggcatcctgagccgcagccggcccagcttcaccatcagtgaccccaagctggtggccaagtggaaggacatgaagaccaacatgcccatcatcaccagcaagcgctaccagcacagcgtggagtgggccgctgagctgatgaggcggcagggccaggatgagagcacagtgcggcgcatcctgaaggactacaccaagcccctggagcacccccctgtgaagagaaatgaggaggcccaggtgcatgacaagctgaacagcggcatggtgagcaacatggagggcacagctggaggagagcggcccagcgtggtgaatggagacagcggcaagagcggcggcgtgggggacccccgggagcccctgggctgcctgcaggagggcagcggctgccaccccaccacagagagctttgagaagtctgtgcgggaggatgccagccccctgccccacgtgtgctgctgcaagcaggatgccctgatcctgcagaggggcctgcaccatgaagatggcagccagcacatcggcctgctgcaccctggggaccggggccctgaccatgaatatgtgctggtggaggaggccgagtgtgccatgtctgagcgggaggccgccccaaatgaggaggccttcttcctggtgtatgccctgggctgcctgagcatctactatgagaaggagcccctgaccatcgtgaagctgtggaaggccttcaccgtggtgcagcccaccttccgcaccacctacatggcctaccactacttccgcagcaagggctgggtgcccaaggtgggcctgaagtatggaacagacctgctgctgtacagaaaaggaccacccttctaccacgccagctacagcgtcatcatcgagctggtggatgaccactttgagggcagcctgcggcggcccctgtcctggaagagcctggccgccctgagccgggtgtctgtgaatgtgtccaaggagctgatgctgtgctacctgatcaagcccagcaccatgacagacaaggagatggagagccctgagtgcatgaagaggatcaaggtgcaggaggtgatcctgagccgctgggtgagcagccgggagaggagtgaccaggatgacctgtag

SEQ ID NO: 174469 - DNA, 1347 bp, Artificial Sequence
  Description of Artificial Sequence: Synthetic coding sequence
atggccgaggccgtgttccacgcccccaagaggaagagaagagtgtatgagacctatgagagccccctgcccatccccttcggccaggaccacggccccctgaaggagttcaagatcttccgggcagagatgatcaacaacaacgtcatcgtgagaaatgcagaagatattgagcagctgtatggcaagggctactttgggaagggcatcctgagccgcagccggcccagcttcaccatcagtgaccccaagctggtggccaagtggaaggacatgaagaccaacatgcccatcatcaccagcaagcgctaccagcacagcgtggagtgggccgctgagctgatgaggcggcagggccaggatgagagcacagtgcggcgcatcctgaaggactacaccaagcccctggagcacccccctgtgaagagaaatgaggaggcccaggtgcatgacaagctgaacagcggcatggtgagcaacatggagggcacagctggaggagagcggcccagcgtggtgaatggagacagcggcaagagcggcggcgtgggggacccccgggagcccctgggctgcctgcaggagggcagcggctgccaccccaccacagagagctttgagaagtctgtgcgggaggatgccagccccctgccccacgtgtgctgctgcaagcaggatgccctgatcctgcagaggggcctgcaccatgaagatggcagccagcacatcggcctgctgcaccctggggaccggggccctgaccatgaatatgtgctggtggaggaggccgagtgtgccatgtctgagcgggaggccgccccaaatgaggagctggtgcagaggaacagactcatctgcagaagaaacccctaccgcatctttgagtacctgcagctgagcctggaggaggagcccctgaccatcgtgaagctgtggaaggccttcaccgtggtgcagcccaccttccgcaccacctacatggcctaccactacttccgcagcaagggctgggtgcccaaggtgggcctgaagtatggaacagacctgctgctgtacaggaagggcccccccttctaccacgccagctacagcgtcatcatcgagctggtggatgaccactttgagggcagcctgcggcggcccctgtcctggaagagcctggccgccctgagccgggtgtctgtgaatgtgtccaaggagctgatgctgtgctacctgatcaagcccagcaccatgacagacaaggagatggagagccctgagtgcatgaagaggatcaaggtgcaggaggtgatcctgagccgctgggtgagcagccgggagaggagtgaccaggatgacctgtag

SEQ ID NO: 174470 - DNA, 1398 bp, Artificial Sequence; identical to SEQ ID NO: 174467
  Description of Artificial Sequence: Synthetic coding sequence

SEQ ID NO: 174471 - DNA, 1320 bp, Artificial Sequence; identical to SEQ ID NO: 174468
  Description of Artificial Sequence: Synthetic coding sequence

SEQ ID NO: 174472 - DNA, 1209 bp, Artificial Sequence
  Description of Artificial Sequence: Synthetic coding sequence
atggccgaggccgtgttccacgcccccaagaggaagagaagagtgtatgagacctatgagagccccctgcccatccccttcggccaggaccacggccccctgaaggagttcaagatcttccgggcagagatgatcaacaacaacgtcatcgtgagaaatgcagaagatattgagcagctgtatggcaagggctactttgggaagggcatcctgagccgcagccggcccagcttcaccatcagtgaccccaagctggtggccaagtggaaggacatgaagaccaacatgcccatcatcaccagcaagcgctaccagcacagcgtggagtgggccgctgagctgatgaggcggcagggccaggatgagagcacagtgcggcgcatcctgaaggactacaccaagcccctggagcacccccctgtgaagagaaatgaggaggcccaggtgcatgacaagctgaacagcggcatggtgagcaacatggagggcacagctggaggagagcggcccagcgtggtgaatggagacagcggcaagagcggcggcgtgggggacccccgggagcccctgggctgcctgcaggagggcagcggctgccaccccaccacagagagctttgagaagtctgtgcgggaggatgccagccccctgccccacgtgtgctgctgcaagcaggatgccctgatcctgcagaggggcctgcaccatgaagatggcagccagcacatcggcctgctgcaccctggggaccggggccctgaccatgaatatgtgctggtggaggaggccgagtgtgccatgtctgagcgggaggccgccccaaatgaggaggccttcttcctggtgtatgccctgggctgcctgagcatctactatgagaaggagcccctgaccatcgtgaagctgtggaaggccttcaccgtggtgcagcccaccttccgcaccacctacatggcctaccactacttccgcagcaagggctgggtgcccaaggtgggcctgaagtatggaacagacctgctgctgtacagaaaaggaccacccttctaccacgccagctacagcgtcatcatcgagctggtggatgaccactttgagggcagcctgcggcggcccctgtcctggaagagcctggccgccctgagccgggtgtctgtgaatgtgtccaaggtgacccagcaccagctgtgccactggagcgtgacctag

SEQ ID NO: 174473 - DNA, 1137 bp, Artificial Sequence
  Description of Artificial Sequence: Synthetic coding sequence
atggccgaggccgtgttccacgcccccaagaggaagagaagagtgtatgagacctatgagagccccctgcccatccccttcggccaggaccacggccccctgaaggagttcaagatcttccgggcagagatgatcaacaacaacgtcatcgtgagaaatgcagaagatattgagcagctgtatggcaagggctactttgggaagggcatcctgagccgcagccggcccagcttcaccatcagtgaccccaagctggtggccaagtggaaggacatgaagaccaacatgcccatcatcaccagcaagcgctaccagcacagcgtggagtgggccgctgagctgatgaggcggcagggccaggatgagagcacagtgcggcgcatcctgaaggactacaccaagcccctggagcacccccctgtgaagagaaatgaggaggcccaggtgcatgacaagctgaacagcggcatggtgagcaacatggagggcacagctggaggagagcggcccagcgtggtgaatggagacagcggcaagagcggcggcgtgggggacccccgggagcccctgggctgcctgcaggagggcagcggctgccaccccaccacagagagctttgagaagtctgtgcgggaggatgccagccccctgccccacgtgtgctgctgcaagcaggatgccctgatcctgcagaggggcctgcaccatgaagatggcagccagcacatcggcctgctgcaccctggggaccggggccctgaccatgaatatgtgctggtggaggaggccgagtgtgccatgtctgagcgggaggccgccccaaatgaggagctggtgcagaggaacagactcatctgcagaagaaacccctaccgcatctttgagtacctgcagctgagcctggaggaggccttcttcctggtgtatgccctgggctgcctgagcatctactatgagaaggagcccctgaccatcgtgaagctgtggaaggccttcaccgtggtgcagcccaccttccgcaccacctacatggcctaccactacttccgcagcaagggctgggtgcccaaggtgggcctgaagtatggaacagacctgctgctgtacagaaaaggaccacccttctaccacgcctag

SEQ ID NO: 174474 - DNA, 1317 bp, Artificial Sequence
  Description of Artificial Sequence: Synthetic coding sequence
atggccgaggccgtgttccacgcccccaagaggaagagaagagtgtatgagacctatgagagccccctgcccatccccttcggccaggaccacggccccctgaaggagttcaagatcttccgggcagagatgatcaacaacaacgtcatcgtgagaaatgcagaagatattgagcagctgtatggcaaggacatgaagaccaacatgcccatcatcaccagcaagcgctaccagcacagcgtggagtgggccgctgagctgatgaggcggcagggccaggatgagagcacagtgcggcgcatcctgaaggactacaccaagcccctggagcacccccctgtgaagagaaatgaggaggcccaggtgcatgacaagctgaacagcggcatggtgagcaacatggagggcacagctggaggagagcggcccagcgtggtgaatggagacagcggcaagtctggaggagtgggggacccccgggagcccctgggctgcctgcaggagggcagcggctgccaccccaccacagagagctttgagaagtctgtgagagaagatgccagccccctgccccacgtgtgctgctgcaagcaggatgccctgatcctgcagaggggcctgcaccatgaagatggcagccagcacatcggcctgctgcaccctggggaccggggccctgaccacgagtatgtgctggtggaggaggctgaatgtgccatgtctgagcgggaggccgccccaaatgaggagctggtgcagaggaacagactcatctgcagaagaaacccctaccgcatctttgagtacctgcagctgagcctggaggaggccttcttcctggtgtatgccctgggctgcctgagcatctactatgagaaggagcccctgaccatcgtgaagctgtggaaggccttcaccgtggtgcagcccaccttccgcaccacctacatggcctaccactacttccgcagcaagggctgggtgcccaaggtgggcctgaagtatggaacagacctgctgctgtacaggaagggcccccccttctaccacgccagctacagcgtcatcatcgagctggtggatgaccactttgagggcagcctgcggcggcccctgtcctggaagagcctggccgccctgagccgggtgtctgtgaatgtgtccaaggagctgatgctgtgctacctgatcaagcccagcaccatgacagacaaggagatggagagccctgagtgcatgaagaggatcaaggtgcaggaggtgatcctgagccgctgggtgagcagccgggagaggagtgaccaggatgacctgtag

SEQ ID NO: 174475 - DNA, 1221 bp, Artificial Sequence
  Description of Artificial Sequence: Synthetic coding sequence
atggccgaggccgtgttccacgcccccaagaggaagagaagagtgtatgagacctatgagagccccctgcccatccccttcggccaggaccacggccccctgaaggagttcaagatcttccgggcagagatgatcaacaacaacgtcatcgtgagaaatgcagaagatattgagcagctgtatggcaagggctactttgggaagggcatcctgagccgcagccggcccagcttcaccatcagtgaccccaagctggtggccaagtggaaggacatgaagaccaacatgcccatcatcaccagcaagcgctaccagcacagcgtggagtgggccgctgagctgatgaggcggcagggccaggatgagagcacagtgcggcgcatcctgaaggactacaccaagcccctggagcacccccctgtgaagagaaatgaggaggcccaggtgcatgacaagctgaacagcggcatggtgagcaacatggagggcacagctggaggagagcggcccagcgtgcggggcctgcaccatgaagatggcagccagcacatcggcctgctgcaccctggggaccggggccctgaccacgagtatgtgctggtggaggaggctgaatgtgccatgtctgagcgggaggccgccccaaatgaggagctggtgcagaggaacagactcatctgcagaagaaacccctaccgcatctttgagtacctgcagctgagcctggaggaggccttcttcctggtgtatgccctgggctgcctgagcatctactatgagaaggagcccctgaccatcgtgaagctgtggaaggccttcaccgtggtgcagcccaccttccgcaccacctacatggcctaccactacttccgcagcaagggctgggtgcccaaggtgggcctgaagtatggaacagacctgctgctgtacaggaagggcccccccttctaccacgccagctacagcgtcatcatcgagctggtggatgaccactttgagggcagcctgcggcggcccctgtcctggaagagcctggccgccctgagccgggtgtctgtgaatgtgtccaaggagctgatgctgtgctacctgatcaagcccagcaccatgacagacaaggagatggagagccctgagtgcatgaagaggatcaaggtgcaggaggtgatcctgagccgctgggtgagcagccgggagaggagtgaccaggatgacctgtag

SEQ ID NO: 174476 - DNA, 933 bp, Artificial Sequence
  Description of Artificial Sequence: Synthetic coding sequence
atgctggtggtggaggtggccaacggccgcagcctggtgtggggcgctgaggccgtgcaggccctgcgggagcggctgggcgtgggcggccgcacagtgggcgccctgccccggggcccccggcagaacagccggctgggcctgcccctgctgctgatgcctgaggaggcccggctgctggccgagattggagctgtgaccctggtgtctgcccccaggccagacagccgccaccacagcctggccctgaccagcttcaagaggcagcaggaggagagcttccaggagcagagcgccctggccgctgaggcccgggagacccggcggcaggagctgctggagaagatcacagagggccaggccgccaagaagcagaagctggagcaggccagcggggccagcagcagccaggaggccggcagcagccaggccgccaaggaggatgagaccagtgatggccaggccagcggggagcaggaggaggccggccccagcagcagccaggccggccccagcaatggagtggcccccctgcccaggtctgccctgctggtgcagctggccacagcccggcccaggcctgtgaaggcccggcccctggactggagggtgcagagcaaggactggccccacgccggccgcccagcccacgagctgcgctacagcatctacagagacctgtgggagcggggcttcttcctgtctgctgctgggaagtttggaggagacttcctggtgtacccaggggaccccctgcgcttccacgcccactacatcgcccagtgctgggcccctgaggacaccatccccctgcaggacctggtggccgccggccgcctgggcacctctgtgaggaagaccctgctgctgtgcagcccccagccagatggcaaggtggtgtacaccagcctgcagtgggccagcctgcagtag

SEQ ID NO: 174477 - DNA, 933 bp, Artificial Sequence; identical to SEQ ID NO: 174476
  Description of Artificial Sequence: Synthetic coding sequence

SEQ ID NO: 174478 - DNA, 933 bp, Artificial Sequence; identical to SEQ ID NO: 174476
  Description of Artificial Sequence: Synthetic coding sequence

SEQ ID NO: 174479 - DNA, 939 bp, Artificial Sequence
  Description of Artificial Sequence: Synthetic coding sequence
atgctggtggtggaggtggccaacggccgcagcctggtgtggggcgctgaggccgtgcaggccctgcgggagcggctgggcgtgggcggccgcacagtgggcgccctgccccggggcccccggcagaacagccggctgggcctgcccctgctgctgatgcctgaggaggcccggctgctggccgagattggagctgtgaccctggtgtctgcccccaggccagacagccgccaccacagcctggccctgaccagcttcaagaggcagcaggaggagagcttccaggagcagagcgccctggccgctgaggcccgggagacccggcggcaggagctgctggagaagatcacagagggccaggccgccaagaagcagaagctggagcaggccagcggggccagcagcagccaggaggccggcagcagccaggccgccaaggaggatgagaccagtgatggccaggccagcggggagcaggaggaggccggccccagcagcagccaggccggccccagcaatggagtggcccccctgcccaggtctgccctgctggtgcagctggccacagcccggcccaggcctgtgaaggcccggcccctggactggagggtgcagagcaaggactggccccacgccggccgcccagcccacgagctgcgctacagcatctacagagacctgtgggagcggggcttcttcctgtctgctgctgggaagtttggaggagacttcctggtgtacccaggggaccccctgcgcttccacgcccactacatcgcccagtgctgggcccctgaggacaccatccccctgcaggacctggtggccgccggccgcctgggcacctctgtgaggaagaccctgctgctgtgcagcccccagccagatggcttcaagagccaggaggtgtccatcaacctggtgtacaagtgcagctag

SEQ ID NO: 174480 - DNA, 729 bp, Artificial Sequence
  Description of Artificial Sequence: Synthetic coding sequence
atgctggtggtggaggtggccaacggccgcagcctggtgtggggcgctgaggccgtgcaggccctgcgggagcggctgggcgtgggcggccgcacagtgggcgccctgccccggggcccccggcagaacagccggctgggcctgcccctgctgctgatgcctgaggaggcccggctgctggccgagattggagctgtgaccctggtgtctgcccccaggccagacagccgccaccacagcctggccctgaccagcttcaagaggcagcaggaggagagcttccaggagcagagcgccctggccgctgaggcccgggagacccggcggcaggagctgctggagaagatcacagagggccaggccgccaagaagcagaagctggagcaggccagcggggccagcagcagccaggaggccggcagcagccaggccgccaaggaggatgagaccagtgatggccaggccagcggggagcaggaggaggccggccccagcagcagccaggccggccccagcaatggagtggcccccctgcccaggtctgccctgctggtgcagctggccacagcccggcccaggcctgtgaaggcccggcccctggactggagggtgcagagcaaggactggccccacgccggccgcccagcccacgagctgcgctacagcatctacagagacctgtgggagcggggcttcttcctgtctgctgctgggaagtttggaggatag

SEQ ID NO: 174481 - DNA, 1581 bp, Artificial Sequence
  Description of Artificial Sequence: Synthetic coding sequence
atggagcctgagcctgagcctgctgctgtggaggtgcctgctggccgggtgctgagcgcccgggagctgtttgctgcccggagccgcagccagaagctgccccagaggagccacggccccaaggacttcctgcctgatggcagcgctgcccaggccgagcggctgcggcgctgccgggaggagctgtggcagctgctggccgagcagagggtggagcggctgggcagcctggtggccgctgagtggaggcctgaggagggctttgtggagctgaagagccctgctgggaagttctggcagaccatgggcttcagcgagcagggccggcagaggctgcaccctgaggaggccctgtacctgctggagtgtggcagcatccacctgttccaccaggacctgcccctgagcatccaggaggcctaccagctgctgctgacagaccacacagtgaccttcctgcagtaccaggtgttcagccacctgaagaggctgggctacgtggtgcggcgcttccagcccagctctgtgctgagcccctatgaaaggcagctgaacctggatgcctctgtgcagcacctggaggatggagatggcaagaggaagaggagcagcagcagccccaggagcatcaacaagaaggccaaggccctggacaacagcctgcagcccaagagcctggccgccagcagccccccaccctgcagccagcccagccagtgcccagaggagaagccccaggagagcagccccatgaagggccctgggggccccttccagctgctgggcagcctgggccccagccctggccctgcccgggagggcgtgggctgctcctgggagagcggccgggcagaaaatggagtgactggagctgggaagaggcgctggaactttgagcagatctccttccccaacatggccagtgacagccgccacaccctgctgcgggccccagcccctgagctgctgcctgccaacgtggccggccgggagacagatgctgagagctggtgccagaagctgaaccagaggaaggagaagctgagccggcgggagcgggagcaccacgccgaggccgcccagttccaggaggatgtgaatgctgaccctgaggtgcagcgctgcagctcctggagggagtacaaggagctgctgcagaggcggcaggtgcagaggagccagaggcgggccccccacctgtggggccagcctgtgacccccctgctgagccctggccaggccagcagccctgctgtggtgctgcagcacatctctgtgctgcagaccacccacctgcctgatggaggagcccggctgctggagaagagcggcggcctggagatcatctttgatgtgtaccaggctgatgctgtggccaccttcaggaagaacaaccctgggaagccctatgccaggatgtgcatcagcggctttgatgagcctgtgcctgacctgtgcagcctgaagaggctgagctaccagagcggagatgtgcccctcatctttgccctggtggaccatggagacatctccttctacagcttccgggacttcaccctgccccaggatgtgggccactag

SEQ ID NO: 174482 - DNA, 594 bp, Artificial Sequence
  Description of Artificial Sequence: Synthetic coding sequence
atgggcttcagcgagcagggccggcagaggctgcaccctgaggaggccctgtacctgctggagtgtggcagcatccacctgttccaccaggacctgcccctgagcatccaggaggcctaccagctgctgctgacagaccacacagtgaccttcctgcagtaccaggtgttcagccacctgaagaggctgggctacgtggtgcggcgcttccagcccagctctgtgctgagcccctatgagcggcagctgaacctggatgcctctgtgcagcacctggaggatggagatggcaagaggaagaggagcagcagcagccccaggagcatcaacaagaaggccaaggccctggacaacagcctgcagcccaagagcctggccgccagcagcccccccagcggcaccagccgctgccccaggatgtggggcacagacctgacagccctgcagaggatggagctggcccctggggaccgggactgcctcttcagcggcaccatctctgctgccagctgcacccagaccctgacctgcagcttccggggccagagcggcccctggccctgggtgtctgacacccaccgggtgaagctgtag

SEQ ID NO: 174483 - DNA, 534 bp, Artificial Sequence
  Description of Artificial Sequence: Synthetic coding sequence
atggagcctgagcctgagcctgctgctgtggaggtgcctgctggccgggtgctgagcgcccgggagctgtttgctgcccggagccgcagccagaagctgccccagaggagccacggccccaaggacttcctgcctgatggcagcgctgcccaggccgagcggctgcggcgctgccgggaggagctgtggcagctgctggccgagcagagggtggagcggctgggcagcctggtggccgctgagtggaggcctgaggagggctttgtggagctgaagagccctgctgggaagttctggcagaccatgggcttcagcgagcagggccggcagaggctgcaccctgaggaggccctgtacctgctggagtgtggcagcatccacctgttccaccaggacctgcccctgagcatccaggaggcctaccagctgctgctgacagaccacacagtgaccttcctgcagtaccagcccccagaggaggtgggcctgtgtggcagcaccatccccaccaagctgtgccctgtgcctgtgtag

SEQ ID NO: 174484 - DNA, 4296 bp, Artificial Sequence
  Description of Artificial Sequence: Synthetic coding sequence
atggacagaagaaatgactatggctacagagtgcccctcttccagggccccctgcccccacctggcagcctgggcctgcccttccccccagacatccagacagagaccacagaagaagattctgtgctgctgatgcacaccctgctggccgccaccaaggacagcctggccatggacccccctgtggtgaaccggcccaagaagagcaagaccaagaaggcccccatcaagaccatcaccaaggccgccccagctgcccctcctgtgcctgctgccaatgaaattgccaccaacaagcccaagatcacctggcaggccctgaacctgcccgtcatcacccagatcagccaggccctgcccaccacagaggtgaccaacacccaggccagctctgtgacagcccagcccaagaaggccaacaagatgaagagggtgacagccaaggccgcccagggcagccagagccccactggacatgaaggaggcaccatccagctgaagagccccctgcaggtgctgaagctgcccgtcatcagccagaacatccacgcccccatcgccaatgaaagtgccagcagccaggccctgatcaccagcatcaagcccaagaaggccagcaaggccaagaaggccgccaacaaggccatcgccagcgccacagaggtgtccctggccgccacagccacccacacagccaccacccagggccagatcaccaatgaaacagccagcatccacaccacagctgccagcatccgcaccaagaaggccagcaaggccaggaagaccatcgccaaggtgatcaacacagacacagagcacatcgaggccctgaatgtgacagatgctgccacccggcagatcgaggcctctgtggtggccatccggcccaagaagagcaagggcaagaaggccgccagccggggccccaacagcgtgtctgagatcagcgaggcccccctggccacccagatcgtgaccaaccaggccctggccgccaccctgcgggtgaagaggggcagccgggccaggaaggccgccaccaaggcccgggccacagagagccagaccccaaatgctgaccagggcgcccaggccaagatcgccagcgcccagaccaacgtgtctgccctggagacccaggtggccgctgctgtgcaggccctggctgatgactacctggcccagctgagcctggagcccaccaccaggacccggggcaagaggaacaggaagagcaagcacctgaatggagatgagaggagcggcagcaactaccgccgcatcccctggggcagaagacctgcccccccaagagatgtggccatcctgcaggagcgggccaacaagctggtgaagtacctgctggtgaaggaccagaccaagatccccatcaagagaagtgacatgctgagagatgtgatccaggagtatgatgagtacttccctgagatcatcgagcgggccagctacaccctggagaagatgttccgggtgaacctgaaggagattgacaagcagagcagcctgtacatcctgatcagcacccaggagagcagcgctggcatcctgggcaccaccaaggacacccccaagctgggcctgctgatggtgatcctgagcgtcatcttcatgaatggaaacaaggccagcgaggccgtcatctgggaggtgctgaggaagctgggcctgcggcctggggtgcgccacagcctgtttggagaggtgaggaagctgatcacagatgaatttgtgaagcagaagtacctggagtacaagagggtgcccaacagccggcccccagaatatgagttcttctggggcctgcggagctaccacgagaccagcaagatgaaggtgctgaagtttgcctgccgggtgcagaagaaggaccccaaggactgggccgtgcagtaccgggaggccgtggagatggaggtgcaggccgctgctgtggccgtggccgaggccgaggcccgggcagaggcccgggcccagatgggcattggagaggaggccgtggccggcccctggaactgggatgacatggacatcgactgcctgacccgggaggagctgggagatgatgcccaggcctggagccgcttctcctttgaaattgaggcccgggcccaggagaatgctgatgccagcaccaacgtgaacttcagcagaggagccagcaccagggctggcttcagtgatggagccagcatctccttcaacggggcccccagcagcagcggcggcttcagcggcggccctggcatcacctttggagtggcccccagcaccagcgccagcttcagcaacacagccagcatcagctttggaggcaccctgagcaccagcagcagcttcagcagcgctgccagcatcagctttggctgtgcccacagcaccagcaccagcttcagcagcgaggccagcatcagctttggaggcatgccctgcaccagcgccagcttcagcggcggcgtgagcagcagcttcagcggccccctgagcaccagcgccaccttcagcggcggggccagcagcggctttggaggcaccctgagcaccacagctggcttcagcggcgtgctgagcaccagcaccagctttggaagtgcccccaccaccagcacagtgttcagcagcgccctgagcaccagcactggatttggaggcatcctgagcacctctgtgtgctttggaggcagccccagcagcagcggcagctttggaggcaccctgagcaccagcatctgctttggaggcagcccctgcaccagcactggatttggaggcaccctgagcacctctgtgtcctttggaggcagcagcagcaccagcgccaactttggaggcaccctgagcaccagcatctgctttgatggcagccccagcactggagctggctttggaggagccctgaacaccagcgccagctttggatctgtgctgaacaccagcactggatttggaggagccatgagcaccagcgctgactttggaggcaccctgagcacctctgtgtgctttggaggcagccctggcacctctgtgtcctttggaagtgccctgaacaccaatgccggctatggaggagctgtgtccaccaacacagactttggaggcaccctgagcacctctgtgtgctttggaggcagccccagcaccagcgctggctttggaggagccctgaacaccaatgccagctttggctgtgctgtgtccaccagcgccagcttcagcggggctgtgtccaccagcgcctgcttcagcggggcccccatcaccaaccctggctttggaggagccttcagcaccagcgctggctttggaggagccctgagcacagctgctgactttggaggcacccccagcaacagcattggatttggagctgcccccagcacctctgtgtcctttggaggagcccacggcaccagcctgtgctttggaggagcccccagcaccagcctgtgctttggaagtgccagcaacaccaacctgtgctttggaggcccccccagcaccagcgcctgcttcagcggggccaccagccccagcttctgtgatggccccagcaccagcacaggcttctcctttggaaatggcctgagcaccaatgccggctttggaggcggcctgaacaccagcgctggctttggaggcggcctgggcaccagcgctggcttcagcggcggcctgagcaccagcagcggctttgatggcggcctgggcaccagcgctggctttggaggcggccctggcaccagcactggatttggaggcggcctgggcaccagcgctggcttcagcggcggcctgggcaccagcgctggctttggaggcggcctggtgaccagtgatggctttggaggcggcctgggcaccaatgccagctttggcagcaccctgggcaccagcgctggcttcagcggcggcctgagcaccagtgatggcttcggcagccggcccaatgccagctttgaccggggcctgagcaccatcattggatttggaagtggcagcaacaccagcacaggcttcaccggggagcccagcaccagcacaggcttcagcagcggccccagcagcatcgtgggcttcagcggcggccccagcactggagtgggcttctgcagcggccccagcaccagcggcttcagcggcggccccagcactggagctggctttggaggcggccccaacacaggagctggctttggaggcggccccagcaccagcgctggcttcggcagcggggccgccagcctgggcgcctgtggcttctcctatggatag

SEQ ID NO: 174485 - DNA, 2121 bp, Artificial Sequence
  Description of Artificial Sequence: Synthetic coding sequence
atggacagaagaaatgactatggctacagagtgcccctcttccagggccccctgcccccacctggcagcctgggcctgcccttccccccagacatccagacagagaccacagaagaagattctgtgctgctgatgcacaccctgctggccgccaccaaggacagcctggccatggacccccctgtggtgaaccggcccaagaagagcaagaccaagaaggcccccatcaagaccatcaccaaggccgccccagctgcccctcctgtgcctgctgccaatgaaattgccaccaacaagcccaagatcacctggcaggccctgaacctgcccgtcatcacccagatcagccaggccctgcccaccacagaggtgaccaacacccaggccagctctgtgacagcccagcccaagaaggccaacaagatgaagagggtgacagccaaggccgcccagggcagccagagccccactggacatgaaggaggcaccatccagctgaagagccccctgcaggtgctgaagctgcccgtcatcagccagaacatccacgcccccatcgccaatgaaagtgccagcagccaggccctgatcaccagcatcaagcccaagaaggccagcaaggccaagaaggccgccaacaaggccatcgccagcgccacagaggtgtccctggccgccacagccacccacacagccaccacccagggccagatcaccaatgaaacagccagcatccacaccacagctgccagcatccgcaccaagaaggccagcaaggccaggaagaccatcgccaaggtgatcaacacagacacagagcacatcgaggccctgaatgtgacagatgctgccacccggcagatcgaggcctctgtggtggccatccggcccaagaagagcaagggcaagaaggccgccagccggggccccaacagcgtgtctgagatcagcgaggcccccctggccacccagatcgtgaccaaccaggccctggccgccaccctgcgggtgaagaggggcagccgggccaggaaggccgccaccaaggcccgggccacagagagccagaccccaaatgctgaccagggcgcccaggccaagatcgccagcgcccagaccaacgtgtctgccctggagacccaggtggccgctgctgtgcaggccctggctgatgactacctggcccagctgagcctggagcccaccaccaggacccggggcaagaggaacaggaagagcaagcacctgaatggagatgagaggagcggcagcaactaccgccgcatcccctggggcagaagacctgcccccccaagagatgtggccatcctgcaggagcgggccaacaagctggtgaagtacctgctggtgaaggaccagaccaagatccccatcaagagaagtgacatgctgagagatgtgatccaggagtatgatgagtacttccctgagatcatcgagcgggccagctacaccctggagaagatgttccgggtgaacctgaaggagattgacaagcagagcagcctgtacatcctgatcagcacccaggagagcagcgctggcatcctgggcaccaccaaggacacccccaagctgggcctgctgatggtgatcctgagcgtcatcttcatgaatggaaacaaggccagcgaggccgtcatctgggaggtgctgaggaagctgggcctgcggcctggggtgcgccacagcctgtttggagaggtgaggaagctgatcacagatgaatttgtgaagcagaagtacctggagtacaagagggtgcccaacagccggcccccagaatatgagttcttctggggcctgcggagctaccacgagaccagcaagatgaaggtgctgaagtttgcctgccgggtgcagaagaaggaccccaaggactgggccgtgcagtaccgggaggccgtggagatggaggtgcaggccgctgctgtggccgtggccgaggccgaggcccgggcagagatctacagcccctgcctgcagatccccctcatcaactgcagcagccccagccacggggccaaggtgcacccctggaacctgtgcccccacagcagccagggcagctatggccagagcgctgagggcgtgatgtag

SEQ ID NO: 174486 - DNA, 1074 bp, Artificial Sequence
  Description of Artificial Sequence: Synthetic coding sequence
atggacagaagaaatgactatggctacagagtgcccctcttccagagcaagcacctgaatggagatgagaggagcggcagcaactaccgccgcatcccctggggccggcggcctgcccccccaagagatgtggccatcctgcaggagcgggccaacaagctggtgaagtacctgctggtgaaggaccagaccaagatccccatcaagagaagtgacatgctgagagatgtgatccaggagtatgatgagtacttccctgagatcatcgagcgggccagctacaccctggagaagatgttccgggtgaacctgaaggagattgacaagcagagcagcctgtacatcctgatcagcacccaggagagcagcgctggcatcctgggcaccaccaaggacacccccaagctgggcctgctgatggtgatcctgagcgtcatcttcatgaatggaaacaaggccagcgaggccgtcatctgggaggtgctgaggaagctgggcctgcggcctggggtgcgccacagcctgtttggagaggtgaggaagctgatcacagatgaatttgtgaagcagaagtacctggagtacaagagggtgcccaacagccggcccccagaatatgagttcttctggggcctgcggagctaccacgagaccagcaagatgaaggtgctgaagtttgcctgccgggtgcagaagaaggaccccaaggactgggccgtgcagtaccgggaggccgtggagatggaggtgcagctgcagctgtggctgtggctgcggctgaagccaggcctgagcggcagcaacaccagcacaggcttcaccggggagcccagcaccagcacaggcttcagcagcggccccagcagcatcgtgggcttcagcggcggccccagcactggagtgggcttctgcagcggccccagcaccagcggcttcagcggcggccccagcactggagctggctttggaggcggccccaacacaggagctggctttggaggcggccccagcaccagcgctggcttcggcagcggggccgccagcctgggcgcctgtggcttctcctatggatag

SEQ ID NO: 174487 - DNA, 2121 bp, Artificial Sequence; identical to SEQ ID NO: 174485
  Description of Artificial Sequence: Synthetic coding sequence

SEQ ID NO: 174488 - DNA, 3105 bp, Artificial Sequence
  Description of Artificial Sequence: Synthetic coding sequence
atggacagaagaaatgactatggctacagagtgcccctcttccagagcaagcacctgaatggagatgagaggagcggcagcaactaccgccgcatcccctggggccggcggcctgcccccccaagagatgtggccatcctgcaggagcgggccaacaagctggtgaagtacctgctggtgaaggaccagaccaagatccccatcaagagaagtgacatgctgagagatgtgatccaggagtatgatgagtacttccctgagatcatcgagcgggccagctacaccctggagaagatgttccgggtgaacctgaaggagattgacaagcagagcagcctgtacatcctgatcagcacccaggagagcagcgctggcatcctgggcaccaccaaggacacccccaagctgggcctgctgatggtgatcctgagcgtcatcttcatgaatggaaacaaggccagcgaggccgtcatctgggaggtgctgaggaagctgggcctgcggcctggggtgcgccacagcctgtttggagaggtgaggaagctgatcacagatgaatttgtgaagcagaagtacctggagtacaagagggtgcccaacagccggcccccagaatatgagttcttctggggcctgcggagctaccacgagaccagcaagatgaaggtgctgaagtttgcctgccgggtgcagaagaaggaccccaaggactgggccgtgcagtaccgggaggccgtggagatggaggtgcaggccgctgctgtggccgtggccgaggccgaggcccgggcagaggcccgggcccagatgggcatcggggaggaggccgtggccggcccctggaactgggatgacatggacatcgactgcctgacccgggaggagctgggagatgatgcccaggcctggagccgcttctcctttgaaattgaggcccgggcccaggagaatgctgatgccagcaccaacgtgaacttcagcagaggagccagcacccgggccggcttcagtgatggagccagcatctccttcaatggagcccccagcagcagcggcggcttcagcggcggccctggcatcaccttcggcgtggcccccagcaccagcgccagcttcagcaacacagccagcatcagctttggaggcaccctgagcaccagcagcagcttcagcagcgctgccagcatcagctttggctgtgcccacagcaccagcaccagcttcagcagcgaggccagcatcagctttggaggcatgccctgcaccagcgccagcttctctggaggagtgagcagcagcttcagcggccccctgagcaccagcgccaccttctctggaggagccagcagcggctttggaggcaccctgagcaccacagctggcttctctggagtgctgagcaccagcaccagctttggcagcgcccccaccaccagcaccgtcttcagcagcgccctgagcaccagcacaggctttggaggcatcctgagcacctctgtgtgcttcggcggcagccccagcagcagcggcagctttggaggcaccctgagcaccagcatctgcttcggcggcagcccctgcaccagcacaggctttggaggcaccctgagcacctctgtgtcctttggaggcagcagcagcaccagcgccaactttggaggcaccctgagcaccagcatctgctttgatggcagccccagcactggagctggctttggaggagccctgaacaccagcgccagctttggatctgtgctgaacaccagcacaggctttggaggagccatgagcaccagcgctgactttggaggcaccctgagcacctctgtgtgcttcggcggcagccctggcacctctgtgtcctttggcagcgccctgaacaccaatgccggctacggcggcgctgtgtccaccaacacagactttggaggcaccctgagcacctctgtgtgcttcggcggcagccccagcaccagcgctggctttggaggagccctgaacaccaatgccagctttggctgtgctgtgtccaccagcgccagcttctctggagctgtgtccaccagcgcctgcttcagcggggcccccatcaccaaccctggctttggaggagccttcagcaccagcgctggctttggaggagccctgagcacagctgctgactttggaggcacccccagcaacagcatcggctttggagctgcccccagcacctctgtgtcctttggaggagcccacggcaccagcctgtgcttcggcggggcccccagcaccagcctgtgcttcggcagcgccagcaacaccaacctgtgcttcggcggcccccccagcaccagcgcctgcttcagcggggccaccagccccagcttctgtgatggccccagcaccagcacaggcttctcctttggaaatggcctgagcaccaatgccggctttggaggcggcctgaacaccagcgctggctttggaggcggcctgggcaccagcgctggcttcagcggcggcctgagcaccagcagcggctttgatggcggcctgggcaccagcgctggctttggaggcggccctggcaccagcacaggctttggaggcggcctgggcaccagcgctggcttcagcggcggcctgggcaccagcgctggctttggaggcggcctggtgaccagtgatggctttggaggcggcctgggcaccaatgccagctttggcagcaccctgggcaccagcgctggcttcagcggcggcctgagcaccagtgatggcttcggcagccggcccaatgccagctttgaccggggcctgagcaccatcatcggcttcggcagcggcagcaacaccagcacaggcttcaccggggagcccagcaccagcacaggcttcagcagcggccccagcagcatcgtgggcttcagcggcggccccagcactggagtgggcttctgcagcggccccagcaccagcggcttcagcggcggccccagcactggagctggctttggaggcggccccaacacaggagctggctttggaggcggccccagcaccagcgctggctttggaagtggagctgccagcctgggcgcctgtggcttctcctatggatag

SEQ ID NO: 174489 - DNA, 693 bp, Artificial Sequence
  Description of Artificial Sequence: Synthetic coding sequence
atgcacaccctgctggccgccaccaaggacagcctggccatggacccccctgtggtgaaccggcccaagaagagcaagaccaagaaggcccccatcaagaccatcaccaaggccgccccagctgcccctcctgtgcctgctgccaatgaaattgccaccaacaagcccaagatcacctggcaggccctgaacctgcccgtcatcacccagatcagccaggccctgcccaccacagaggtgaccaacacccaggccagctctgtgacagcccagcccaagaaggccaacaagatgaagagggtgacagccaaggccgcccagggcagccagagccccactggacatgaaggaggcaccatccagctgaagagccccctgcaggtgctgaagctgcccgtcatcagccagaacatccacgcccccatcgccaatgaaagtgccagcagccaggccctgatcaccagcatcaagcccaagaaggccagcaaggccaagaaggccgccaacaaggccatcgccagcgccacagaggtgtccctggccgccacagccacccacacagccaccacccagggccagatcaccaatgaaacagccagcatccacaccacagctgccagcatccgcaccaagaaggccagcaaggccaggaagaccatcgccaaggtgatcaacacagacacagagcactag

SEQ ID NO: 174490 - DNA, 510 bp, Artificial Sequence
  Description of Artificial Sequence: Synthetic coding sequence
atggacagaagaaatgactatggctacagagtgcccctcttccagggccccctgcccccacctggcagcctgggcctgcccttccccccagacatccagacagagaccacagaagaagattctgtgctgctgatgcacaccctgctggccgccaccaaggacagcctggccatggacccccctgtggtgaaccggcccaagaagagcaagaccaagaaggcccccatcaagaccatcaccaaggccgccccagctgcccctcctgtgcctgctgccaatgaaattgccaccaacaagcccaagatcacctggcaggccctgaacctgcccgtcatcacccagatcagccaggccctgcccaccacagaggtgaccaacacccaggccagctctgtgacagcccagcccaagaaggccaacaagatgaagagggtgacagccaaggccgcccagggcagccagagccccactggacatgaaggaggcaccatccagctgaagagcccctag

SEQ ID NO: 174491 - DNA, 2889 bp, Artificial Sequence
  Description of Artificial Sequence: Synthetic coding sequence
atgctgagagatgtgatccaggagtatgatgagtacttccctgagatcatcgagcgggccagctacaccctggagaagatgttccgggtgaacctgaaggagattgacaagcagagcagcctgtacatcctgatcagcacccaggagagcagcgctggcatcctgggcaccaccaaggacacccccaagctgggcctgctgatggtgatcctgagcgtcatcttcatgaatggaaacaaggccagcgaggccgtcatctgggaggtgctgaggaagctgggcctgcggcctggggtgcgccacagcctgtttggagaggtgaggaagctgatcacagatgaatttgtgaagcagaagtacctggagtacaagagggtgcccaacagccggcccccagaatatgagttcttctggggcctgcggagctaccacgagaccagcaagatgaaggtgctgaagtttgcctgccgggtgcagaagaaggaccccaaggactgggccgtgcagtaccgggaggccgtggagatggaggtgcaggccgctgctgtggccgtggccgaggccgaggcccgggcagaggcccgggcccagatgggcatcggggaggaggccgtggccggcccctggaactgggatgacatggacatcgactgcctgacccgggaggagctgggagatgatgcccaggcctggagccgcttctcctttgaaattgaggcccgggcccaggagaatgctgatgccagcaccaacgtgaacttcagcagaggagccagcacccgggccggcttcagtgatggagccagcatctccttcaatggagcccccagcagcagcggcggcttcagcggcggccctggcatcaccttcggcgtggcccccagcaccagcgccagcttcagcaacacagccagcatcagctttggaggcaccctgagcaccagcagcagcttcagcagcgctgccagcatcagctttggctgtgcccacagcaccagcaccagcttcagcagcgaggccagcatcagctttggaggcatgccctgcaccagcgccagcttctctggaggagtgagcagcagcttcagcggccccctgagcaccagcgccaccttctctggaggagccagcagcggctttggaggcaccctgagcaccacagctggcttctctggagtgctgagcaccagcaccagctttggcagcgcccccaccaccagcaccgtcttcagcagcgccctgagcaccagcacaggctttggaggcatcctgagcacctctgtgtgcttcggcggcagccccagcagcagcggcagctttggaggcaccctgagcaccagcatctgcttcggcggcagcccctgcaccagcacaggctttggaggcaccctgagcacctctgtgtcctttggaggcagcagcagcaccagcgccaactttggaggcaccctgagcaccagcatctgctttgatggcagccccagcactggagctggctttggaggagccctgaacaccagcgccagctttggatctgtgctgaacaccagcacaggctttggaggagccatgagcaccagcgctgactttggaggcaccctgagcacctctgtgtgcttcggcggcagccctggcacctctgtgtcctttggcagcgccctgaacaccaatgccggctacggcggcgctgtgtccaccaacacagactttggaggcaccctgagcacctctgtgtgcttcggcggcagccccagcaccagcgctggctttggaggagccctgaacaccaatgccagctttggctgtgctgtgtccaccagcgccagcttctctggagctgtgtccaccagcgcctgcttcagcggggcccccatcaccaaccctggctttggaggagccttcagcaccagcgctggctttggaggagccctgagcacagctgctgactttggaggcacccccagcaacagcatcggctttggagctgcccccagcacctctgtgtcctttggaggagcccacggcaccagcctgtgcttcggcggggcccccagcaccagcctgtgcttcggcagcgccagcaacaccaacctgtgcttcggcggcccccccagcaccagcgcctgcttcagcggggccaccagccccagcttctgtgatggccccagcaccagcacaggcttctcctttggaaatggcctgagcaccaatgccggctttggaggcggcctgaacaccagcgctggctttggaggcggcctgggcaccagcgctggcttcagcggcggcctgagcaccagcagcggctttgatggcggcctgggcaccagcgctggctttggaggcggccctggcaccagcacaggctttggaggcggcctgggcaccagcgctggcttcagcggcggcctgggcaccagcgctggctttggaggcggcctggtgaccagtgatggctttggaggcggcctgggcaccaatgccagctttggcagcaccctgggcaccagcgctggcttcagcggcggcctgagcaccagtgatggcttcggcagccggcccaatgccagctttgaccggggcctgagcaccatcatcggcttcggcagcggcagcaacaccagcacaggcttcaccggggagcccagcaccagcacaggcttcagcagcggccccagcagcatcgtgggcttcagcggcggccccagcactggagtgggcttctgcagcggccccagcaccagcggcttcagcggcggccccagcactggagctggctttggaggcggccccaacacaggagctggctttggaggcggccccagcaccagcgctggctttggaagtggagctgccagcctgggcgcctgtggcttctcctatggatag

SEQ ID NO: 174492 - DNA, 366 bp, Artificial Sequence
  Description of Artificial Sequence: Synthetic coding sequence
atgcacaccctgctggccgccaccaaggacagcctggccatggacccccctgtggtgaaccggcccaagaagagcaagaccaagaaggcccccatcaagaccatcaccaaggccgccccagctgcccctcctgtgcctgctgccaatgaaattgccaccaacaagcccaagatcacctggcaggccctgaacctgcccgtcatcacccagatcagccaggccctgcccaccacagaggtgaccaacacccaggccagctctgtgacagcccagcccaagaaggccaacaagatgaagagggtgacagccaaggccgcccagggcagccagagccccactggacatgaaggaggcaccatccagtag

SEQ ID NO: 174493 - DNA, 579 bp, Artificial Sequence
  Description of Artificial Sequence: Synthetic coding sequence
atgcacaccctgctggccgccaccaaggacagcctggccatggacccccctgtggtgaaccggcccaagaagagcaagaccaagaaggcccccatcaagaccatcaccaaggccgccccagctgcccctcctgtgcctgctgccaatgaaattgccaccaacaagcccaagatcacctggcaggccctgaacctgcccgtcatcacccagatcagccaggccctgcccaccacagaggtgaccaacacccaggccagctctgtgacagcccagcccaagaaggccaacaagatgaagagggtgacagccaaggccgcccagggcagccagagccccactggacatgaaggaggcaccatccagctgaagagccccctgcaggtgctgaagctgcccgtcatcagccagaacatccacgcccccatcgccaatgaaagtgccagcagccaggccctgatcaccagcatcaagcccaagaaggccagcaaggccaagaaggccgccaacaaggccatcgccagcgccacagaggtgtccctggccgccacagccacccacacagccaccacccagggctag

SEQ ID NO: 174494 - DNA, 531 bp, Artificial Sequence
  Description of Artificial Sequence: Synthetic coding sequence
atggacagaagaaatgactatggctacagagtgcccctcttccagggccccctgcccccacctggcagcctgggcctgcccttccccccagacatccagacagagaccacagaagaagattctgtgctgctgatgcacaccctgctggccgccaccaaggacagcctggccatggacccccctgtggtgaaccggcccaagaagagcaagaccaagaaggcccccatcaagaccatcaccaaggccgccccagctgcccctcctgtgcctgctgccaatgaaattgccaccaacaagcccaagatcacctggcaggccctgaacctgcccgtcatcacccagatcagccaggccctgcccaccacagaggtgaccaacacccaggccagctctgtgacagcccagcccaagaaggccaacaagatgaagagggtgacagccaaggccgcccagggcagccagagccccactggacatgaaggaggcaccatccagctgaagagccccctgcaggtgctgaagctgccctag

SEQ ID NO: 174495 - DNA, 507 bp, Artificial Sequence
  Description of Artificial Sequence: Synthetic coding sequence
atggacagaagaaatgactatggctacagagtgcccctcttccagggccccctgcccccacctggcagcctgggcctgcccttccccccagacatccagacagagaccacagaagaagattctgtgctgctgatgcacaccctgctggccgccaccaaggacagcctggccatggacccccctgtggtgaaccggcccaagaagagcaagaccaagaaggcccccatcaagaccatcaccaaggccgccccagctgcccctcctgtgcctgctgccaatgaaattgccaccaacaagcccaagatcacctggcaggccctgaacctgcccgtcatcacccagatcagccaggccctgcccaccacagaggtgaccaacacccaggccagctctgtgacagcccagcccaagaaggccaacaagatgaagagggtgacagccaaggccgcccagggcagccagagccccactggacatgaaggaggcaccatccagctgaagagctag

SEQ ID NO: 174496 - DNA, 2046 bp, Artificial Sequence
  Description of Artificial Sequence: Synthetic coding sequence
atggacagaagaaatgactatggctacagagtgcccctcttccagggccccctgcccccacctggcagcctgggcctgcccttccccccagacatccagacagagaccacagaagaagattctgtgctgctgatgcacaccctgctggccgccaccaaggacagcctggccatggacccccctgtggtgaaccggcccaagaagagcaagaccaagaaggcccccatcaagaccatcaccaaggccgccccagctgcccctcctgtgcctgctgccaatgaaattgccaccaacaagcccaagatcacctggcaggccctgaacctgcccgtcatcacccagatcagccaggccctgcccaccacagaggtgaccaacacccaggccagctctgtgacagcccagcccaagaaggccaacaagatgaagagggtgacagccaaggccgcccagggcagccagagccccactggacatgaaggaggcaccatccagctgaagagccccctgcaggtgctgaagctgcccgtcatcagccagaacatccacgcccccatcgccaatgaaagtgccagcagccaggccctgatcaccagcatcaagcccaagaaggccagcaaggccaagaaggccgccaacaaggccatcgccagcgccacagaggtgtccctggccgccacagccacccacacagccaccacccagggccagatcaccaatgaaacagccagcatccacaccacagctgccagcatccgcaccaagaaggccagcaaggccaggaagaccatcgccaaggtgatcaacacagacacagagcacatcgaggccctgaatgtgacagatgctgccacccggcagatcgaggcctctgtggtggccatccggcccaagaagagcaagggcaagaaggccgccagccggggccccaacagcgtgtctgagatcagcgaggcccccctggccacccagatcgtgaccaaccaggccctggccgccaccctgcgggtgaagaggggcagccgggccaggaaggccgccaccaaggcccgggccacagagagccagaccccaaatgctgaccagggcgcccaggccaagatcgccagcgcccagaccaacgtgtctgccctggagacccaggtggccgctgctgtgcaggccctggctgatgactacctggcccagctgagcctggagcccaccaccaggacccggggcaagaggaacaggaagagcaagcacctgaatggagatgagaggagcggcagcaactaccgccgcatcccctggggcagaagacctgcccccccaagagatgtggccatcctgcaggagcgggccaacaagctggtgaagtacctgctggtgaaggaccagaccaagatccccatcaagagaagtgacatgctgagagatgtgatccaggagtatgatgagtacttccctgagatcatcgagcgggccagctacaccctggagaagatgttccgggtgaacctgaaggagattgacaagcagagcagcctgtacatcctgatcagcacccaggagagcagcgctggcatcctgggcaccaccaaggacacccccaagctgggcctgctgatggtgatcctgagcgtcatcttcatgaatggaaacaaggccagcgaggccgtcatctgggaggtgctgaggaagctgggcctgcggcctggggtgcgccacagcctgtttggagaggtgaggaagctgatcacagatgaatttgtgaagcagaagtacctggagtacaagagggtgcccaacagccggcccccagaatatgagttcttctggggcctgcggagctaccacgagaccagcaagatgaaggtgctgaagtttgcctgccgggtgcagaagaaggaccccaaggactgggccgtgcagtaccgggaggccgtggagatggaggtgcaggccgctgctgtggccgtggccgaggccgaggcccgggcagagtggttccagcaccagcactggctgtactggaggacccagcaccagcacggcctgcagtag

SEQ ID NO: 174497 - DNA, 372 bp, Artificial Sequence
  Description of Artificial Sequence: Synthetic coding sequence
atgcacaccctgctggccgccaccaaggacagcctggccatggacccccctgtggtgaaccggcccaagaagagcaagaccaagaaggcccccatcaagaccatcaccaaggccgccccagctgcccctcctgtgcctgctgccaatgaaattgccaccaacaagcccaagatcacctggcaggccctgaacctgcccgtcatcacccagatcagccaggccctgcccaccacagaggtgaccaacacccaggccagctctgtgacagcccagcccaagaaggccaacaagatgaagagggtgacagccaaggccgcccagggcagccagagccccactggacatgaaggaggcaccatccagctgaagtag

SEQ ID NO: 174498 - DNA, 216 bp, Artificial Sequence
  Description of Artificial Sequence: Synthetic coding sequence
atgcacaccctgctggccgccaccaaggacagcctggccatggacccccctgtggtgaaccggcccaagaagagcaagaccaagaaggcccccatcaagaccatcaccaaggccgccccagctgcccctcctgtgcctgctgccaatgaaattgccaccaacaagcccaagatcacctggcaggccctgaacctgcccgtcatcacccagatctag

SEQ ID NO: 174499 - DNA, 195 bp, Artificial Sequence
  Description of Artificial Sequence: Synthetic coding sequence
atgcacaccctgctggccgccaccaaggacagcctggccatggacccccctgtggtgaaccggcccaagaagagcaagaccaagaaggcccccatcaagaccatcaccaaggccgccccagctgcccctcctgtgcctgctgccaatgaaattgccaccaacaagcccaagatcacctggcaggccctgaactag

SEQ ID NO: 174500 - DNA, 930 bp, Artificial Sequence
  Description of Artificial Sequence: Synthetic coding sequence
atggacagaagaaatgactatggctacagagtgcccctcttccagagcaagcacctgaatggagatgagaggagcggcagcaactaccgccgcatcccctggggccggcggcctgcccccccaagagatgtggccatcctgcaggagcgggccaacaagctggtgaagtacctgctggtgaaggaccagaccaagatccccatcaagagaagtgacatgctgagagatgtgatccaggagtatgatgagtacttccctgagatcatcgagcgggccagctacaccctggagaagatgttccgggtgaacctgaaggagattgacaagcagagcagcctgtacatcctgatcagcacccaggagagcagcgctggcatcctgggcaccaccaaggacacccccaagctgggcctgctgatggtgatcctgagcgtcatcttcatgaatggaaacaaggccagcgaggccgtcatctgggaggtgctgaggaagctgggcctgcggcctggggtgcgccacagcctgtttggagaggtgaggaagctgatcacagatgaatttgtgaagcagaagtacctggagtacaagagggtgcccaacagccggcccccagaatatgagttcttctggggcctgcggagctaccacgagaccagcaagatgaaggtgctgaagtttgcctgccgggtgcagaagaaggaccccaaggactgggccgtgcagtaccgggaggccgtggagatggaggtgcaggccgctgctgtggccgtggccgaggccgaggcccgggcagagatctacagcccctgcctgcagatccccctcatcaactgcagcagccccagccatggagccaaggtgcacccctggaacctgtgcccccacagcagccagggcagctatggccagagcgctgagggcgtgatgtag

SEQ ID NO: 174501 - DNA, 1263 bp, Artificial Sequence
  Description of Artificial Sequence: Synthetic coding sequence
atgcctgggggctgcagccggggccctgctgctggagatggccgcctgcggctggcccggctggccctggtgctgctgggctgggtgagcagcagcagccccaccagcagcgccagcagcttcagcagcagcgcccccttcctggccagcgctgtgtctgcccagccccccctgcctgaccagtgcccagccctgtgtgaatgttctgaggccgccaggacagtgaagtgtgtgaacagaaacctgacagaggtgcccacagacctgcctgcctacgtgaggaacctcttcctgactggaaaccagctggccgtgctgcctgctggggcctttgcccggcggccccccctggccgagctggccgccctgaacctgagcggcagccggctggatgaggtgcgggccggggcctttgagcacctgcccagcctgcggcagctggacctgagccacaaccccctggccgacctgagcccctttgccttcagcggcagcaatgcctctgtgtctgcccccagccccctggtggagctgatcctgaaccacatcgtgcccccagaagatgagcggcagaacagaagctttgagggcatggtggtggccgccctgctggccggccgggccctgcagggcctgcggcggctggagctggccagcaaccacttcctgtacctgcccagagatgtgctggcccagctgcccagcctgcggcacctggacctgagcaacaacagcctggtgtccctgacctacgtgtccttcaggaacctgacccacctggagagcctgcacctggaggacaatgccctgaaggtgctgcacaacggcaccctggccgagctgcagggcctgccccacatccgggtcttcctggacaacaacccctgggtgtgtgactgccacatggctgacatggtgacctggctgaaggagacagaggtggtgcagggcaaggaccggctgacctgtgcctacccagagaagatgaggaacagagtgctgctggagctgaacagcgctgacctggactgtgaccccatcctgccccccagcctgcagaccagctatgtgttcctgggcatcgtgctggccctgattggagccatcttcctgctggtgctgtacctgaacaggaagggcatcaagaagtggatgcacaacatcagagatgcctgccgggaccacatggagggctaccactaccgctatgagatcaatgctgacccccggctgaccaacctgagcagcaacagtgatgtgtag

SEQ ID NO: 174502 - DNA, 1263 bp, Artificial Sequence; identical to SEQ ID NO: 174501
  Description of Artificial Sequence: Synthetic coding sequence

SEQ ID NO: 174503 - DNA, 1263 bp, Artificial Sequence; identical to SEQ ID NO: 174501
  Description of Artificial Sequence: Synthetic coding sequence

SEQ ID NO: 174504 - DNA, 1056 bp, Artificial Sequence
  Description of Artificial Sequence: Synthetic coding sequence
atggccctgcccttccagaaggagctggagaagtacaagaacattgatgaagatgagctgctgggcaagctgtctgaggaggagctgaagcagctggagaatgtgctggatgacctggaccctgagagcgccatgctgcctgctggcttccggcagaaggaccagacccagaaggccgccaccggcccctttgaccgggagcacctgctgatgtacctggagaaggaggccctggagcagaaggaccgggaggactttgtgcccttcaccggggagaagaagggccgggtcttcatccccaaggagaagcccatcgagaccaggaaggaggagaaggtgaccctggaccctgagctggaggaggccctggccagcgccagtgacacagagctgtatgacctggccgctgtgctgggcgtgcacaacctgctgaacaaccccaagtttgatgaggagacagccaacaacaagggcggcaagggccctgtgagaaatgtggtgaagggggagaaggtgaagcctgtgtttgaggagccccccaaccccaccaacgtggagatcagcctgcagcagatgaaggccaatgaccccagcctgcaggaggtgaacctgaacaacatcaagaacatccccatccccaccctgcgggagtttgccaaggccctggagaccaacacccacgtgaagaagttcagcctggccgccaccaggagcaatgaccctgtggccatcgcctttgctgacatgctgaaggtgaacaagaccctgaccagcctgaacatcgagagcaacttcatcactggaacaggcatcctggccctggtggaggccctgaaggaaaatgacaccctgacagagatcaagattgacaaccagaggcagcagctgggcacagctgtggagatggagatcgcccagatgctggaggagaacagccgcatcctgaagtttggctaccagttcaccaagcagggccccaggaccagggtggccgccgccatcaccaagaacaatgacctggtgaggaagaagagggtggaggccgacagaagatag

SEQ ID NO: 174505 - DNA, 948 bp, Artificial Sequence
  Description of Artificial Sequence: Synthetic coding sequence
atggccctgcccttccagaaggagctggagaagtacaagaacattgatgaagatgagctgctgggcaagctgtctgaggaggagctgaagcagctggagaatgtgctggatgacctggaccctgagagcgccatgctgcctgctggcttccggcagaaggaccagacccagaaggccgccaccggcccctttgaccgggagcacctgctgatgtacctggagaaggaggccctggagcagaaggaccgggaggactttgtgcccttcaccggggagaagaagggccgggtcttcatccccaaggagaagcccatcgagaccaggaaggaggagaaggtgaccctggaccctgagctggaggaggccctggccagcgccagtgacacagagctgtatgacctggccgctgtgctgggcgtgcacaacctgctgaacaaccccaagtttgatgaggagacagccaacaacaagggcggcaagggccctgtgagaaatgtggtgaagggggagaaggtgaagcctgtgtttgaggagccccccaaccccaccaacgtggagatcagcctgcagcagatgaaggccaatgaccccagcctgcaggaggtgaacctgaacaacatcaaggcctttgctgacatgctgaaggtgaacaagaccctgaccagcctgaacatcgagagcaacttcatcactggaacaggcatcctggccctggtggaggccctgaaggaaaatgacaccctgacagagatcaagattgacaaccagaggcagcagctgggcacagctgtggagatggagatcgcccagatgctggaggagaacagccgcatcctgaagtttggctaccagttcaccaagcagggccccaggaccagggtggccgccgccatcaccaagaacaatgacctggtgaggaagaagagggtggaggccgacagaagatag

SEQ ID NO: 174506 - DNA, 1059 bp, Artificial Sequence
  Description of Artificial Sequence: Synthetic coding sequence
atggccctgcccttcaggaaggacctggagaagtacaaggacctggatgaagatgagctgctgggcaacctgtctgaaacagagctgaagcagctggagaccgtgctggatgacctggaccctgaaaatgccctgctgcctgctggcttccggcagaagaaccagaccagcaagagcaccaccggcccctttgaccgggagcacctgctgagctacctggagaaggaggccctggagcacaaggaccgggaggactatgtgccctacaccggggagaagaagggcaagatcttcatccccaagcagaagcctgtgcagaccttcacagaggagaaggtgtccctggaccctgagctggaggaggccctgaccagcgccagtgacacagagctgtgtgacctggccgccatcctgggcatgcacaacctgatcaccaacaccaagttctgcaacatcatgggcagcagcaatggagtggaccaggagcacttcagcaatgtggtgaagggggagaagatcctgcctgtgtttgatgagccccccaaccccaccaacgtggaggagagcctgaagaggaccaaggaaaatgatgcccacctggtggaggtgaacctgaacaacatcaagaacatccccatccccaccctgaaggactttgccaaggccctggagaccaacacccacgtgaagtgcttcagcctggccgccaccaggagcaatgaccctgtggccacagcctttgctgagatgctgaaggtgaacaagaccctgaagagcctgaatgtggagagcaacttcatcaccggggtgggcatcctggccctgattgatgccctgcgggacaatgagaccctggccgagctgaagattgacaaccagaggcagcagctgggcacagctgtggagctggagatggccaagatgctggaggagaacaccaacatcctgaagtttggctaccagttcacccagcagggccccaggaccagggctgccaatgccatcaccaagaacaatgacctggtgaggaagagaagagtggagggggaccaccagtag

SEQ ID NO: 174507 - DNA, 1059 bp, Artificial Sequence; identical to SEQ ID NO: 174506
  Description of Artificial Sequence: Synthetic coding sequence

SEQ ID NO: 174508 - DNA, 102 bp, Artificial Sequence
  Description of Artificial Sequence: Synthetic coding sequence
atggccctgcccttcaggaaggacctggagaagtacaaggacctggatgaagatgagctgctgggcaacctgtctgaaacagagctgaagcagctggagtag

SEQ ID NO: 174509 - DNA, 1038 bp, Artificial Sequence
  Description of Artificial Sequence: Synthetic coding sequence
atgagcagctaccagaaggagctggagaagtacagagacattgatgaagatgagatcctgcggaccctgagccctgaggagctggagcagctggactgtgagctgcaggagatggaccctgagaacatgctgctgcctgctggcctgcggcagagggaccagaccaagaagagccccaccggccccctggaccgggaggccctgctgcagtacctggagcagcaggccctggaggtgaaggagagagatgacctggtgcccttcaccggggagaagaagggcaagccctacatccagcccaagcgggagatcccagctgaggagcagatcaccctggagcctgagctggaggaggccctggcccacgccacagatgctgagatgtgtgacattgctgccatcctggacatgtacaccctgatgagcaacaagcagtactatgatgccctgtgcagcggggagatctgcaacacagagggcatcagctctgtggtgcagcctgacaagtacaagcctgtgcctgatgagccccccaaccccaccaacatcgaggagatcctgaagagggtgcgcagcaatgacaaggagctggaggaggtgaacctgaacaacatccaggacatccccatccccatgctgtctgagctgtgtgaggccatgaaggccaacacctacgtgcgctccttcagcctggtggccaccaggtctggggaccccatcgccaatgctgtggccgacatgctgcgggagaacagaagcctgcagagcctgaacatcgagagcaacttcatcagcagcacaggcctgatggctgtgctgaaggctgtgcgggagaatgccaccctgacagagctgcgggtggacaaccagaggcagtggccaggagatgctgtggagatggagatggccaccgtgctggagcagtgccccagcatcgtgcgcttcggctaccacttcacccagcagggcccccgggcccgggccgcccaggccatgaccaggaacaatgagctgcggcggcagcagaagaagaggtag

SEQ ID NO: 174510 - DNA, 831 bp, Artificial Sequence
  Description of Artificial Sequence: Synthetic coding sequence
atgagcagctaccagaaggagctggagaagtacagagacattgatgaagatgagatcctgcggaccctgagccctgaggagctggagcagctggactgtgagctgcaggagatggaccctgagaacatgctgctgcctgctggcctgcggcagagggaccagaccaagaagagccccaccggccccctggaccgggaggccctgctgcagtacctggagcagcaggccctggaggtgaaggagagagatgacctggtgcccttcaccggggagaagaagggcgtggtgcagcctgacaagtacaagcctgtgcctgatgagccccccaaccccaccaacatcgaggagatcctgaagagggtgcgcagcaatgacaaggagctggaggaggtgaacctgaacaacatccaggacatccccatccccatgctgtctgagctgtgtgaggccatgaaggccaacacctacgtgcgctccttcagcctggtggccaccaggtctggggaccccatcgccaatgctgtggccgacatgctgagagaaaatagaagcctgcagagcctgaacatcgagagcaacttcatcagcagcacaggcctgatggctgtgctgaaggctgtgagagaaaatgccaccctgacagagctgcgggtggacaaccagaggcagtggccaggagatgctgtggagatggagatggccaccgtgctggagcagtgccccagcatcgtgcgcttcggctaccacttcacccagcagggcccccgggcccgggccgcccaggccatgaccagaaataatgagctgcggcggcagcagaagaagaggtag

SEQ ID NO: 174511 - DNA, 429 bp, Artificial Sequence
  Description of Artificial Sequence: Synthetic coding sequence
atgagcagctaccagaaggagctggagaagtacagagacattgatgaagatgagatcctgcggaccctgagccctgaggagctggagcagctggactgtgagctgcaggagatggaccctgagaacatgctgctgcctgctggcctgcggcagagggaccagaccaagaagagccccaccggccccctggaccgggaggccctgctgcagtacctggagcagcaggccctggaggtgaaggagagagatgacctggtgcccttcaccggggagaagaagggcaagccctacatccagcccaagcgggagatcccagctgaggagcagatcaccctggagcctgagctggaggaggccctggcccacgccacagatgctgagatgtgtgacattgctgccatcctggacatgtacaccctgatgtcctag

SEQ ID NO: 174512 - DNA, 855 bp, Artificial Sequence
  Description of Artificial Sequence: Synthetic coding sequence
atggatgccatcaagaagaagatgcagatgctgaagctggacaaggaaaatgccctggacagagctgagcaggccgaggccgacaagaaggccgcagaagatagaagcaagcagctggaggaggacattgctgccaaggagaagctgctgcgggtgtctgaagatgagcgggacagagtgctggaggagctgcacaaggccgaggacagcctgctggccgctgaggaggccgccgccaaggccgaggctgatgtggccagcctgaacagacgcatccagctggtggaggaggagctggaccgggcccaggagcggctggccacagccctgcagaagctggaggaggccgagaaggccgcagatgaaagtgagcggggcatgaaggtgattgagagccgggcccagaaggatgaggagaagatggagatccaggagatccagctgaaggaggccaagcacatcgccgaggatgctgacagaaaatatgaggaggtggccaggaagctggtgatcatcgagagtgacctggagagagctgaggagagagctgagctgtctgagggcaaatgtgccgagctggaggaggagctgaagacagtgaccaacaacctgaagagcctggaggcccaggccgagaagtacagccagaaggaggacagatatgaggaggagatcaaggtgctgagtgacaagctgaaggaggccgagaccagggctgagtttgctgagaggtctgtgaccaagctggagaagagcattgatgacctggaggagaaggtggcccacgccaaggaggagaacctgtccatgcaccagatgctggaccagaccctgctggagctgaacaacatgtag

SEQ ID NO: 174513 - DNA, 855 bp, Artificial Sequence
  Description of Artificial Sequence: Synthetic coding sequence
atggatgccatcaagaagaagatgcagatgctgaagctggacaaggaaaatgccctggacagagctgagcaggccgaggccgacaagaaggccgcagaagatagaagcaagcagctggaggatgagctggtgtccctgcagaagaagctgaagggcacagaagatgagctggacaagtacagcgaggccctgaaggatgcccaggagaagctggagctggccgagaagaaggccacagatgctgaggctgatgtggccagcctgaacagacgcatccagctggtggaggaggagctggaccgggcccaggagcggctggccacagccctgcagaagctggaggaggccgagaaggccgcagatgaaagtgagcggggcatgaaggtgattgagagccgggcccagaaggatgaggagaagatggagatccaggagatccagctgaaggaggccaagcacatcgccgaggatgctgacagaaaatatgaggaggtggccaggaagctggtgatcatcgagagtgacctggagagagctgaggagagagctgagctgtctgagggccaggtgcggcagctggaggagcagctgcgcatcatggaccagaccctgaaggccctgatggctgctgaggacaagtacagccagaaggaggacagatatgaggaggagatcaaggtgctgagtgacaagctgaaggaggccgagaccagggctgagtttgctgagaggtctgtgaccaagctggagaagagcattgatgacctggaggatgagctgtatgcccagaagctgaagtacaaggccatcagcgaggagctggaccacgccctgaatgacatgacctccatgtag

SEQ ID NO: 174514 - DNA, 738 bp, Artificial Sequence
  Description of Artificial Sequence: Synthetic coding sequence
atggccggcagcagcagcctggaggccgtgcggaggaagatccgcagcctgcaggagcaggctgatgctgctgaggagcgggccggcaccctgcagcgggagctggaccacgagaggaagctgcgggagacagctgaggctgatgtggccagcctgaacagacgcatccagctggtggaggaggagctggaccgggcccaggagcggctggccacagccctgcagaagctggaggaggccgagaaggccgcagatgaaagtgagcggggcatgaaggtgattgagagccgggcccagaaggatgaggagaagatggagatccaggagatccagctgaaggaggccaagcacatcgccgaggatgctgacagaaaatatgaggaggtggccaggaagctggtgatcatcgagagtgacctggagagagctgaggagagagctgagctgtctgagggcaaatgtgccgagctggaggaggagctgaagacagtgaccaacaacctgaagagcctggaggcccaggccgagaagtacagccagaaggaggacagatatgaggaggagatcaaggtgctgagtgacaagctgaaggaggccgagaccagggctgagtttgctgagaggtctgtgaccaagctggagaagagcattgatgacctggaggaccagctgtaccagcagctggagcagaacagaaggctgaccaatgagctgaagctggccctgaatgaagattag

SEQ ID NO: 174515 - DNA, 981 bp, Artificial Sequence
  Description of Artificial Sequence: Synthetic coding sequence
atggatgccatcaagaagaagatgcagatgctgaagctggacaaggaaaatgccctggacagagctgagcaggccgaggccgacaagaaggccgcagaagatagaagcaagcagctggaggaggacattgctgccaaggagaagctgctgcgggtgtctgaagatgagcgggacagagtgctggaggagctgcacaaggccgaggacagcctgctggccgctgaggaggccgccgccaagctggaggatgagctggtgtccctgcagaagaagctgaagggcacagaagatgagctggacaagtacagcgaggccctgaaggatgcccaggagaagctggagctggccgagaagaaggccacagatgctgaggctgatgtggccagcctgaacagacgcatccagctggtggaggaggagctggaccgggcccaggagcggctggccacagccctgcagaagctggaggaggccgagaaggccgcagatgaaagtgagcggggcatgaaggtgattgagagccgggcccagaaggatgaggagaagatggagatccaggagatccagctgaaggaggccaagcacatcgccgaggatgctgacagaaaatatgaggaggtggccaggaagctggtgatcatcgagagtgacctggagagagctgaggagagagctgagctgtctgagggcaaatgtgccgagctggaggaggagctgaagacagtgaccaacaacctgaagagcctggaggcccaggccgagaagtacagccagaaggaggacagatatgaggaggagatcaaggtgctgagtgacaagctgaaggaggccgagaccagggctgagtttgctgagaggtctgtgaccaagctggagaagagcattgatgacctggaggagaaggtggcccacgccaaggaggagaacctgtccatgcaccagatgctggaccagaccctgctggagctgaacaacatgtag

SEQ ID NO: 174516 - DNA, 855 bp, Artificial Sequence
  Description of Artificial Sequence: Synthetic coding sequence
atggatgccatcaagaagaagatgcagatgctgaagctggacaaggaaaatgccctggacagagctgagcaggccgaggccgacaagaaggccgcagaagatagaagcaagcagctggaggatgagctggtgtccctgcagaagaagctgaagggcacagaagatgagctggacaagtacagcgaggccctgaaggatgcccaggagaagctggagctggccgagaagaaggccacagatgctgaggctgatgtggccagcctgaacagacgcatccagctggtggaggaggagctggaccgggcccaggagcggctggccacagccctgcagaagctggaggaggccgagaaggccgcagatgaaagtgagcggggcatgaaggtgattgagagccgggcccagaaggatgaggagaagatggagatccaggagatccagctgaaggaggccaagcacatcgccgaggatgctgacagaaaatatgaggaggtggccaggaagctggtgatcatcgagagtgacctggagagagctgaggagagagctgagctgtctgagggccaggtgcggcagctggaggagcagctgcgcatcatggaccagaccctgaaggccctgatggctgctgaggacaagtacagccagaaggaggacagatatgaggaggagatcaaggtgctgagtgacaagctgaaggaggccgagaccagggctgagtttgctgagaggtctgtgaccaagctggagaagagcattgatgacctggaggagaaggtggcccacgccaaggaggagaacctgtccatgcaccagatgctggaccagaccctgctggagctgaacaacatgtag

SEQ ID NO: 174517 - DNA, 855 bp, Artificial Sequence
  Description of Artificial Sequence: Synthetic coding sequence
atggatgccatcaagaagaagatgcagatgctgaagctggacaaggaaaatgccctggacagagctgagcaggccgaggccgacaagaaggccgcagaagatagaagcaagcagctggaggatgagctggtgtccctgcagaagaagctgaagggcacagaagatgagctggacaagtacagcgaggccctgaaggatgcccaggagaagctggagctggccgagaagaaggccacagatgctgaggctgatgtggccagcctgaacagacgcatccagctggtggaggaggagctggaccgggcccaggagcggctggccacagccctgcagaagctggaggaggccgagaaggccgcagatgaaagtgagcggggcatgaaggtgattgagagccgggcccagaaggatgaggagaagatggagatccaggagatccagctgaaggaggccaagcacatcgccgaggatgctgacagaaaatatgaggaggtggccaggaagctggtgatcatcgagagtgacctggagagagctgaggagagagctgagctgtctgagggcaaatgtgccgagctggaggaggagctgaagacagtgaccaacaacctgaagagcctggaggcccaggccgagaagtacagccagaaggaggacagatatgaggaggagatcaaggtgctgagtgacaagctgaaggaggccgagaccagggctgagtttgctgagaggtctgtgaccaagctggagaagagcattgatgacctggaggatgagctgtatgcccagaagctgaagtacaaggccatcagcgaggagctggaccacgccctgaatgacatgaccagcatctag

SEQ ID NO: 174518 - DNA, 855 bp, Artificial Sequence
  Description of Artificial Sequence: Synthetic coding sequence
atggatgccatcaagaagaagatgcagatgctgaagctggacaaggaaaatgccctggacagagctgagcaggccgaggccgacaagaaggccgcagaagatagaagcaagcagctggaggaggacattgctgccaaggagaagctgctgcgggtgtctgaagatgagcgggacagagtgctggaggagctgcacaaggccgaggacagcctgctggccgctgaggaggccgccgccaaggccgaggctgatgtggccagcctgaacagacgcatccagctggtggaggaggagctggaccgggcccaggagcggctggccacagccctgcagaagctggaggaggccgagaaggccgcagatgaaagtgagcggggcatgaaggtgattgagagccgggcccagaaggatgaggagaagatggagatccaggagatccagctgaaggaggccaagcacatcgccgaggatgctgacagaaaatatgaggaggtggccaggaagctggtgatcatcgagagtgacctggagagagctgaggagagagctgagctgtctgagggccaggtgcggcagctggaggagcagctgcgcatcatggaccagaccctgaaggccctgatggctgctgaggacaagtacagccagaaggaggacagatatgaggaggagatcaaggtgctgagtgacaagctgaaggaggccgagaccagggctgagtttgctgagaggtctgtgaccaagctggagaagagcattgatgacctggaggagaaggtggcccacgccaaggaggagaacctgtccatgcaccagatgctggaccagaccctgctggagctgaacaacatgtag

SEQ ID NO: 174519 - DNA, 855 bp, Artificial Sequence
  Description of Artificial Sequence: Synthetic coding sequence
atggatgccatcaagaagaagatgcagatgctgaagctggacaaggaaaatgccctggacagagctgagcaggccgaggccgacaagaaggccgcagaagatagaagcaagcagctggaggatgagctggtgtccctgcagaagaagctgaagggcacagaagatgagctggacaagtacagcgaggccctgaaggatgcccaggagaagctggagctggccgagaagaaggccacagatgctgaggctgatgtggccagcctgaacagacgcatccagctggtggaggaggagctggaccgggcccaggagcggctggccacagccctgcagaagctggaggaggccgagaaggccgcagatgaaagtgagcggggcatgaaggtgattgagagccgggcccagaaggatgaggagaagatggagatccaggagatccagctgaaggaggccaagcacatcgccgaggatgctgacagaaaatatgaggaggtggccaggaagctggtgatcatcgagagtgacctggagagagctgaggagagagctgagctgtctgagggcaaatgtgccgagctggaggaggagctgaagacagtgaccaacaacctgaagagcctggaggcccaggccgagaagtacagccagaaggaggacagatatgaggaggagatcaaggtgctgagtgacaagctgaaggaggccgagaccagggctgagtttgctgagaggtctgtgaccaagctggagaagagcattgatgacctggaggagaaggtggcccacgccaaggaggagaacctgtccatgcaccagatgctggaccagaccctgctggagctgaacaacatgtag

SEQ ID NO: 174520 - DNA, 798 bp, Artificial Sequence
  Description of Artificial Sequence: Synthetic coding sequence
tgaagagctgagcaggccgaggccgacaagaaggctgctgaggacaggagcaagcagctggaggatgagctggtgtccctgcagaagaagctgaagggcacagaagatgagctggacaagtacagcgaggccctgaaggatgcccaggagaagctggagctggccgagaagaaggccacagatgctgaggctgatgtggccagcctgaacagacgcatccagctggtggaggaggagctggaccgggcccaggagcggctggccacagccctgcagaagctggaggaggccgagaaggctgctgatgagagcgagcggggcatgaaggtgattgagagccgggcccagaaggatgaggagaagatggagatccaggagatccagctgaaggaggccaagcacatcgcagaagatgctgacagaaaatatgaggaggtggccaggaagctggtgatcattgaaagtgacctggagcgggcagaggagcgggcagagctgtctgagggcaaatgtgccgagctggaggaggagctgaagacagtgaccaacaacctgaagagcctggaggcccaggccgagaagtacagccagaaggaggacagatatgaggaggagatcaaggtgctgagtgacaagctgaaggaggccgagaccagggctgagtttgctgagaggtctgtgaccaagctggagaagagcattgatgacctggaggatgagctgtatgcccagaagctgaagtacaaggccatcagcgaggagctggaccacgccctgaatgacatgacctccatgtag

SEQ ID NO: 174521 - DNA, 855 bp, Artificial Sequence
  Description of Artificial Sequence: Synthetic coding sequence
atggatgccatcaagaagaagatgcagatgctgaagctggacaaggaaaatgccatcgacagagctgagcaggccgaggccgacaagaagcaggctgaagatcgctgcaagcagctggaggaggagcagcaggccctgcagaagaagctgaagggcacagaagatgaggtggagaagtacagcgagagcgtgaaggaggcccaggagaagctggagcaggccgagaagaaggccacagatgctgaggctgatgtggccagcctgaacagacgcatccagctggtggaggaggagctggaccgggcccaggagcggctggccacagccctgcagaagctggaggaggccgagaaggccgcagatgaaagtgagcggggcatgaaggtgattgaaaatagagccatgaaggatgaggagaagatggagctgcaggagatgcagctgaaggaggccaagcacatcgccgaggacagcgacagaaaatatgaggaggtggccaggaagctggtgatcctggagggggagctggagaggtctgaggagagagctgaggtggccgagagcaaatgtggggacctggaggaggagctgaagatcgtgaccaacaacctgaagagcctggaggcccaggccgacaagtacagcaccaaggaggacaagtatgaggaggagatcaagctgctggaggagaagctgaaggaggccgagaccagggctgagtttgctgagaggtctgtggccaagctggagaagaccattgatgacctggaggagaccctggccagcgccaaggaggagaatgtggagatccaccagaccctggaccagaccctgctggagctgaacaacctgtag

SEQ ID NO: 174522 - DNA, 855 bp, Artificial Sequence
  Description of Artificial Sequence: Synthetic coding sequence
atggatgccatcaagaagaagatgcagatgctgaagctggacaaggaaaatgccatcgacagagctgagcaggccgaggccgacaagaagcaggctgaagatcgctgcaagcagctggaggaggagcagcaggccctgcagaagaagctgaagggcacagaagatgaggtggagaagtacagcgagagcgtgaaggaggcccaggagaagctggagcaggccgagaagaaggccacagatgctgaggctgatgtggccagcctgaacagacgcatccagctggtggaggaggagctggaccgggcccaggagcggctggccacagccctgcagaagctggaggaggccgagaaggccgcagatgaaagtgagcggggcatgaaggtgattgaaaatagagccatgaaggatgaggagaagatggagctgcaggagatgcagctgaaggaggccaagcacatcgccgaggacagcgacagaaaatatgaggaggtggccaggaagctggtgatcctggagggggagctggagaggtctgaggagagagctgaggtggccgagagcaaatgtggggacctggaggaggagctgaagatcgtgaccaacaacctgaagagcctggaggcccaggccgacaagtacagcaccaaggaggacaagtatgaggaggagatcaagctgctggaggagaagctgaaggaggccgagaccagggctgagtttgctgagaggtctgtggccaagctggagaagaccattgatgacctggaggatgaggtgtatgcccagaagatgaagtacaaggccatcagcgaggagctggacaatgccctgaatgacatcaccagcctgtag

SEQ ID NO: 174523 - DNA, 855 bp, Artificial Sequence
  Description of Artificial Sequence: Synthetic coding sequence
atggatgccatcaagaagaagatgcagatgctgaagctggacaaggaaaatgccatcgacagagctgagcaggccgaggccgacaagaagcaggctgaagatcgctgcaagcagctggaggaggagcagcaggccctgcagaagaagctgaagggcacagaagatgaggtggagaagtacagcgagagcgtgaaggaggcccaggagaagctggagcaggccgagaagaaggccacagatgctgaggctgatgtggccagcctgaacagacgcatccagctggtggaggaggagctggaccgggcccaggagcggctggccacagccctgcagaagctggaggaggccgagaaggccgcagatgaaagtgagcggggcatgaaggtgattgaaaatagagccatgaaggatgaggagaagatggagctgcaggagatgcagctgaaggaggccaagcacatcgccgaggacagcgacagaaaatatgaggaggtggccaggaagctggtgatcctggagggggagctggagaggtctgaggagagagctgaggtggccgagagccgggcccggcagctggaggaggagctgcggaccatggaccaggccctgaagagcctgatggccagcgaggaggagtacagcaccaaggaggacaagtatgaggaggagatcaagctgctggaggagaagctgaaggaggccgagaccagggctgagtttgctgagaggtctgtggccaagctggagaagaccattgatgacctggaggagaccctggccagcgccaaggaggagaatgtggagatccaccagaccctggaccagaccctgctggagctgaacaacctgtag

SEQ ID NO: 174524 - DNA, 969 bp, Artificial Sequence
  Description of Artificial Sequence: Synthetic coding sequence
atggatgccatcaagaagaagatgcagatgctgaagctggacaaggaaaatgccatcgacagagctgagcaggccgaggccgacaagaagcaggctgaagatcgctgcaagcagctggaggaggagcagcaggccctgcagaagaagctgaagggcacagaagatgaggtggagaagtacagcgagagcgtgaaggaggcccaggagaagctggagcaggccgagaagaaggccacagatgctgaggctgatgtggccagcctgaacagacgcatccagctggtggaggaggagctggaccgggcccaggagcggctggccacagccctgcagaagctggaggaggccgagaaggccgcagatgaaagtgagcggggcatgaaggtgattgaaaatagagccatgaaggatgaggagaagatggagctgcaggagatgcagctgaaggaggccaagcacatcgccgaggacagcgacagaaaatatgaggaggtggccaggaagctggtgatcctggagggggagctggagaggtctgaggagagagctgaggtggccgagagcaaatgtggggacctggaggaggagctgaagatcgtgaccaacaacctgaagagcctggaggcccaggccgacaagtacagcaccaaggaggacaagtatgaggaggagatcaagctgctggaggagaagctgaaggaggccgagaccagggctgagtttgctgagaggtctgtggccaagctggagaagaccattgatgacctggaggagagcaccagcatcgccaccacagagcactggttcaccccagacaccctggccctgacagacacccccagcccctgcacagagcccacccacaagaccccctggcccaccctgaagcccctgtgcaccggcaccccctggctgagcctgagtgacagccccctgcacgtgggcacctgtggccccatcaagccctag

SEQ ID NO: 174525 - DNA, 858 bp, Artificial Sequence
  Description of Artificial Sequence: Synthetic coding sequence
atgatggaggccatcaagaagaagatgcagatgctgaagctggacaaggaaaatgccctggacagagctgagcaggccgaggccgagcagaagcaggccgaggagaggagcaagcagctggaggatgagctggccgccatgcagaagaagctgaagggcacagaagatgagctggacaagtacagcgaggccctgaaggatgcccaggagaagctggagctggccgagaagaaggccgcagatgctgaggccgaggtggccagcctgaacagacgcatccagctggtggaggaggagctggaccgggcccaggagcggctggccacagccctgcagaagctggaggaggccgagaaggctgctgatgagagcgagcggggcatgaaggtgattgagaacagagccctgaaggatgaggagaagatggagctgcaggagatccagctgaaggaggccaagcacatcgccgaggaggccgacagaaaatatgaggaggtggccaggaagctggtgatcattgaaggagacctggagaggacagaggagcgggcagagctggccgagagccgctgccgggagatggatgagcagatccggctgatggaccagaacctgaagtgcctgtctgctgctgaggagaagtacagccagaaggaggacaagtatgaggaggagatcaagatcctgacagacaagctgaaggaggccgagaccagggctgagtttgctgagaggtctgtggccaagctggagaagaccattgatgacctggaggacaagctgaagtgcaccaaggaggagcacctgtgcacccagaggatgctggaccagaccctgctggacctgaatgagatgtag

SEQ ID NO: 174526 - DNA, 744 bp, Artificial Sequence
  Description of Artificial Sequence: Synthetic coding sequence
atggccggcatcaccaccattgaagctgtgaagaggaagatccaggtgctgcagcagcaggctgatgatgctgaggagcgggcagagcggctgcagcgggaggtggagggggagcggcgggcccgggagcaggccgaggccgaggtggccagcctgaacagacgcatccagctggtggaggaggagctggaccgggcccaggagcggctggccacagccctgcagaagctggaggaggccgagaaggccgcagatgaaagtgagcggggcatgaaggtgattgaaaatagagccctgaaggatgaggagaagatggagctgcaggagatccagctgaaggaggccaagcacatcgccgaggaggccgacagaaaatatgaggaggtggccaggaagctggtgatcatcgagggggacctggagaggacagaggagagagctgagctggccgagagcaaatgttctgagctggaggaggagctgaagaatgtgaccaacaacctgaagagcctggaggcccaggccgagaagtacagccagaaggaggacaagtatgaggaggagatcaagatcctgacagacaagctgaaggaggccgagaccagggctgagtttgctgagaggtctgtggccaagctggagaagaccattgatgacctggaggagcggctgtacagccagctggagaggaaccggctgctgagcaatgagctgaagctgaccctgcatgacctgtgtgactag

SEQ ID NO: 174527 - DNA, 747 bp, Artificial Sequence
  Description of Artificial Sequence: Synthetic coding sequence
atggccggcatcaccaccattgaagctgtgaagaggaagatccaggtgctgcagcagcaggctgatgatgctgaggagcgggcagagcggctgcagcgggaggtggagggggagcggcgggcccgggagcaggccgaggccgaggtggccagcctgaacagacgcatccagctggtggaggaggagctggaccgggcccaggagcggctggccacagccctgcagaagctggaggaggccgagaaggccgcagatgaaagtgagcggggcatgaaggtgattgaaaatagagccctgaaggatgaggagaagatggagctgcaggagatccagctgaaggaggccaagcacatcgccgaggaggccgacagaaaatatgaggaggtggccaggaagctggtgatcatcgagggggacctggagaggacagaggagagagctgagctggccgagagccgctgccgggagatggatgagcagatccggctgatggaccagaacctgaagtgcctgtctgctgctgaggagaagtacagccagaaggaggacaagtatgaggaggagatcaagatcctgacagacaagctgaaggaggccgagaccagggctgagtttgctgagaggtctgtggccaagctggagaagaccattgatgacctggaggatgagctgtatgcccagaagctgaagtacaaggccatcagcgaggagctggaccacgccctgaatgacatgaccagcatctag

SEQ ID NO: 174528 - DNA, 747 bp, Artificial Sequence
  Description of Artificial Sequence: Synthetic coding sequence
atggccggcatcaccaccattgaagctgtgaagaggaagatccaggtgctgcagcagcaggctgatgatgctgaggagcgggcagagcggctgcagcgggaggtggagggggagcggcgggcccgggagcaggccgaggccgaggtggccagcctgaacagacgcatccagctggtggaggaggagctggaccgggcccaggagcggctggccacagccctgcagaagctggaggaggccgagaaggccgcagatgaaagtgagcggggcatgaaggtgattgaaaatagagccctgaaggatgaggagaagatggagctgcaggagatccagctgaaggaggccaagcacatcgccgaggaggccgacagaaaatatgaggaggtggccaggaagctggtgatcatcgagggggacctggagaggacagaggagagagctgagctggccgagagcaaatgttctgagctggaggaggagctgaagaatgtgaccaacaacctgaagagcctggaggcccaggccgagaagtacagccagaaggaggacaagtatgaggaggagatcaagatcctgacagacaagctgaaggaggccgagaccagggctgagtttgctgagaggtctgtggccaagctggagaagaccattgatgacctggaggacaagctgaagtgcaccaaggaggagcacctgtgcacccagaggatgctggaccagaccctgctggacctgaatgagatgtag

SEQ ID NO: 174529 - DNA, 675 bp, Artificial Sequence
  Description of Artificial Sequence: Synthetic coding sequence
atggccggcatcaccaccattgaagctgtgaagaggaagatccaggtgctgcagcagcaggctgatgatgctgaggagcgggcagagcggctgcagcgggaggtggagggggagcggcgggcccgggagcagaggctggccacagccctgcagaagctggaggaggccgagaaggccgcagatgaaagtgagcggggcatgaaggtgattgaaaatagagccctgaaggatgaggagaagatggagctgcaggagatccagctgaaggaggccaagcacatcgccgaggaggccgacagaaaatatgaggaggtggccaggaagctggtgatcatcgagggggacctggagaggacagaggagagagctgagctggccgagagccgctgccgggagatggatgagcagatccggctgatggaccagaacctgaagtgcctgtctgctgctgaggagaagtacagccagaaggaggacaagtatgaggaggagatcaagatcctgacagacaagctgaaggaggccgagaccagggctgagtttgctgagaggtctgtggccaagctggagaagaccattgatgacctggaggacaagctgaagtgcaccaaggaggagcacctgtgcacccagaggatgctggaccagaccctgctggacctgaatgagatgtag

SEQ ID NO: 174530 - DNA, 858 bp, Artificial Sequence
  Description of Artificial Sequence: Synthetic coding sequence
atgatggaggccatcaagaagaagatgcagatgctgaagctggacaaggaaaatgccctggacagagctgagcaggccgaggccgagcagaagcaggccgaggagaggagcaagcagctggaggatgagctggccgccatgcagaagaagctgaagggcacagaagatgagctggacaagtacagcgaggccctgaaggatgcccaggagaagctggagctggccgagaagaaggccgcagatgctgaggccgaggtggccagcctgaacagacgcatccagctggtggaggaggagctggaccgggcccaggagcggctggccacagccctgcagaagctggaggaggccgagaaggctgctgatgagagcgagcggggcatgaaggtgattgagaacagagccctgaaggatgaggagaagatggagctgcaggagatccagctgaaggaggccaagcacatcgccgaggaggccgacagaaaatatgaggaggtggccaggaagctggtgatcattgaaggagacctggagaggacagaggagcgggcagagctggccgagagcaagtgcagcgagctggaggaggagctgaagaatgtgaccaacaacctgaagagcctggaggcccaggccgagaagtacagccagaaggaggacaagtatgaggaggagatcaagatcctgacagacaagctgaaggaggccgagaccagggctgagtttgctgagaggtctgtggccaagctggagaagaccattgatgacctggaggatgagctgtatgcccagaagctgaagtacaaggccatcagcgaggagctggaccacgccctgaatgacatgaccagcatctag

SEQ ID NO: 174531 - DNA, 744 bp, Artificial Sequence
  Description of Artificial Sequence: Synthetic coding sequence
atggccggcatcaccaccattgaagctgtgaagaggaagatccaggtgctgcagcagcaggctgatgatgctgaggagcgggcagagcggctgcagcgggaggtggagggggagcggcgggcccgggagcaggccgaggccgaggtggccagcctgaacagacgcatccagctggtggaggaggagctggaccgggcccaggagcggctggccacagccctgcagaagctggaggaggccgagaaggccgcagatgaaagtgagcggggcatgaaggtgattgaaaatagagccctgaaggatgaggagaagatggagctgcaggagatccagctgaaggaggccaagcacatcgccgaggaggccgacagaaaatatgaggaggtggccaggaagctggtgatcatcgagggggacctggagaggacagaggagagagctgagctggccgagagccgctgccgggagatggatgagcagatccggctgatggaccagaacctgaagtgcctgtctgctgctgaggagaagtacagccagaaggaggacaagtatgaggaggagatcaagatcctgacagacaagctgaaggaggccgagaccagggctgagtttgctgagaggtctgtggccaagctggagaagaccattgatgacctggaggagcggctgtacagccagctggagaggaaccggctgctgagcaatgagctgaagctgaccctgcatgacctgtgtgactag

SEQ ID NO: 174532 - DNA, 747 bp, Artificial Sequence
  Description of Artificial Sequence: Synthetic coding sequence
atggccggcatcaccaccattgaagctgtgaagaggaagatccaggtgctgcagcagcaggctgatgatgctgaggagcgggcagagcggctgcagcgggaggtggagggggagcggcgggcccgggagcaggccgaggccgaggtggccagcctgaacagacgcatccagctggtggaggaggagctggaccgggcccaggagcggctggccacagccctgcagaagctggaggaggccgagaaggccgcagatgaaagtgagcggggcatgaaggtgattgaaaatagagccctgaaggatgaggagaagatggagctgcaggagatccagctgaaggaggccaagcacatcgccgaggaggccgacagaaaatatgaggaggtggccaggaagctggtgatcatcgagggggacctggagaggacagaggagagagctgagctggccgagagccgctgccgggagatggatgagcagatccggctgatggaccagaacctgaagtgcctgtctgctgctgaggagaagtacagccagaaggaggacaagtatgaggaggagatcaagatcctgacagacaagctgaaggaggccgagaccagggctgagtttgctgagaggtctgtggccaagctggagaagaccattgatgacctggaggacaagctgaagtgcaccaaggaggagcacctgtgcacccagaggatgctggaccagaccctgctggacctgaatgagatgtag

SEQ ID NO: 174533 - DNA, 228 bp, Artificial Sequence
  Description of Artificial Sequence: Synthetic coding sequence
atgatggaggccatcaagaagaagatgcagatgctgaagctggacaaggaaaatgccctggacagagctgagcaggccgaggccgagcagaagcaggccgaggagaggagcaagcagctggaggatgagctggccgccatgcagaagaagctgaagggcacagaagatgagctggacaagtacagcgaggccctgaaggatgcccaggagaagctggagctggcctag

SEQ ID NO: 174534 - DNA, 747 bp, Artificial Sequence
  Description of Artificial Sequence: Synthetic coding sequence
atggccggcctgaacagcctggaggccgtgaagaggaagatccaggccctgcagcagcaggctgatgaagcagaagatcgggcccagggcctgcagcgggagctggatggagagcgggagcggcgggagaaggccgagggagatgtggccgccctgaacagacgcatccagctggtggaggaggagctggaccgggcccaggagcggctggccacagccctgcagaagctggaggaggccgagaaggccgcagatgaaagtgagcggggcatgaaggtgattgaaaatagagccatgaaggatgaggagaagatggagatccaggagatgcagctgaaggaggccaagcacatcgccgaggaggccgacagaaaatatgaggaggtggccaggaagctggtgatcctggagggggagctggagagagctgaggagagagctgaggtgtctgagctgaagtgtggggacctggaggaggagctgaagaatgtgaccaacaacctgaagagcctggaggccgccagcgagaagtacagcgagaaggaggacaagtatgaggaggagatcaagctgctgagtgacaagctgaaggaggccgagaccagggctgagtttgctgagaggacagtggccaagctggagaagaccattgatgacctggaggagaagctggcccaggccaaggaggagaatgtgggcctgcaccagaccctggaccagaccctgaatgagctgaactgcatctag

SEQ ID NO: 174535 - DNA, 855 bp, Artificial Sequence
  Description of Artificial Sequence: Synthetic coding sequence
atggaggccatcaagaagaagatgcagatgctgaagctggacaaggaaaatgccatcgacagagctgagcaggccgaggccgacaagaaggctgctgaggacaagtgcaagcaggtggaggaggagctgacccacctgcagaagaagctgaagggcacagaagatgagctggacaagtacagcgaggacctgaaggatgcccaggagaagctggagctgacagagaagaaggccagtgatgctgaaggagatgtggccgccctgaacagacgcatccagctggtggaggaggagctggaccgggcccaggagcggctggccacagccctgcagaagctggaggaggccgagaaggccgcagatgaaagtgagcggggcatgaaggtgattgaaaatagagccatgaaggatgaggagaagatggagatccaggagatgcagctgaaggaggccaagcacatcgccgaggaggccgacagaaaatatgaggaggtggccaggaagctggtgatcctggagggggagctggagagagctgaggagagagctgaggtgtctgagctgaagtgtggggacctggaggaggagctgaagaatgtgaccaacaacctgaagagcctggaggccgccagcgagaagtacagcgagaaggaggacaagtatgaggaggagatcaagctgctgagtgacaagctgaaggaggccgagaccagggctgagtttgctgagaggacagtggccaagctggagaagaccattgatgacctggaggagaagctggcccaggccaaggaggagaatgtgggcctgcaccagaccctggaccagaccctgaatgagctgaactgcatctag

SEQ ID NO: 174536 - DNA, 855 bp, Artificial Sequence; identical to SEQ ID NO: 174535
  Description of Artificial Sequence: Synthetic coding sequence

SEQ ID NO: 174537 - DNA, 2244 bp, Artificial Sequence
  Description of Artificial Sequence: Synthetic coding sequence
atgggccgcctgaatgagcagaggctcttccagcctgacctgtgtgatgtggacctggtgctggtgccccagaggagcgtcttccctgcccacaagggcgtgctggccgcctacagccagttcttccacagcctcttcacccagaacaagcagctgcagagggtggagctgagcctggaggccctggcccctgggggcctgcagcagatcctgaacttcatctacaccagcaagctgctggtgaatgctgccaacgtgcatgaggtgctgtctgctgccagcctgctgcagatggctgacattgctgccagctgccaggagctgctggatgcccggagcctgggccccccaggccctggcaccgtggccctggcccagcctgctgccagctgcaccccagctgccccaccctactactgtgacatcaagcaggaggccgacaccccaggcctgcccaagatctatgcccgggagggccctgacccctacagcgtgcgggtggaggatggagctggaacagctgggggcaccgtgcctgccaccatcggccctgcccagcccttcttcaaggaggagaaggagggcggcgtggaggaggccggcggccccccagccagcctgtgcaagctggagggcggggaggagctggaggaggagctgggcggcagcggcacctacagccggcgggagcagagccagatcatcgtggaggtgaacctgaacaaccagaccctgcacgtgtccactggacctgagggcaagccaggagctggccccagccctgccaccgtggtgctgggcagagaagatggcctgcagaggcacagtgatgaggaggaggaggatgatgaggaggaggaggaggaggaggaggaggaggagggcggcggcagcggccgggaggaggaggaggaggaggagggcggcagccagggcgaggaggaggaggaggaggaggatggccacagcgagcaggaggaggaggaggaggaggaggaggaggagggccccagcgagcaggaccaggagagcagcgaggaggaggagggggaggagggggaggccggcggcaagcagggcccccggggcagccgcagcagcagagctgaccccccaccccacagccacatggccaccaggagcagagaaaatgccaggagaagaggcaccccagagcctgaggaggccggccggcggggcggcaagaggcccaagcccccacctggggtggccagcgccagcgcccggggccccccagccacagatggcctgggcgccaaggtgaagctggaggagaagcagcaccacccctgccagaagtgccccagggtcttcaacaaccgctggtacctggagaagcacatgaatgtgacccacagcaggatgcagatctgtgaccagtgtgggaagcgcttcctgctggagagcgagctgctgctgcaccggcagacagactgtgagaggaacatccagtgtgtgacctgtgggaaggccttcaagaagctgtggagcctgcacgagcacaacaagatcgtgcacggctacgccgagaagaagttcagctgtgagatctgtgagaagaagttctacaccatggcccacgtgaggaagcacatggtggcccacaccaaggacatgcccttcacctgtgagacctgtgggaagagcttcaagaggtccatgagcctgaaggtgcacagcctgcagcacagcggggagaagcccttccgctgtgagaactgcaatgaacgcttccagtacaagtaccagctgcggagccacatgagcatccacatcggccacaagcagttcatgtgccagtggtgtgggaaggacttcaacatgaagcagtactttgatgagcacatgaagacccacactggagagaagccctacatctgtgagatctgtgggaagagcttcaccagccggcccaacatgaagaggcacaggaggacccacactggagagaagccctacccctgtgatgtgtgtggccagcgcttccgcttcagcaacatgctgaaggcccacaaggagaagtgcttccgggtgagccacaccctggccggagatggagtgcctgctgcccctggcctgccccccacccagccccaggcccacgccctgcccctgctgcccggcctgccccagaccctgcccccaccaccccacctgcccccacctccacccctcttccccaccacagccagccctgggggccgcatgaatgccaacaactag

SEQ ID NO: 174538 - DNA, 483 bp, Artificial Sequence
  Description of Artificial Sequence: Synthetic coding sequence
atgacagaccagcaggccgaggcccggagctacctgtctgaggagatgattgctgagttcaaggccgcctttgacatgtttgatgctgatggcggcggggacatctctgtgaaggagctgggcaccgtgatgaggatgctgggccagacccccaccaaggaggagctggatgccatcatcgaggaggtggatgaagatggcagcggcaccatcgactttgaggagttcctggtgatgatggtgcggcagatgaaggaggatgccaagggcaagtctgaggaggagctggccgagtgcttccgcatctttgacagaaatgctgatggctacattgatcctgaggagctggccgagatcttccgggccagcggggagcacgtgacagatgaggagattgagagcctgatgaaggatggagacaagaacaatgatggaagaattgactttgatgagttcctgaagatgatggagggcgtgcagtag

SEQ ID NO: 174539 - DNA, 438 bp, Artificial Sequence
  Description of Artificial Sequence: Synthetic coding sequence
atgattgctgagttcaaggccgcctttgacatgtttgatgctgatggcggcggggacatctctgtgaaggagctgggcaccgtgatgaggatgctgggccagacccccaccaaggaggagctggatgccatcatcgaggaggtggatgaagatggcagcggcaccatcgactttgaggagttcctggtgatgatggtgcggcagatgaaggaggatgccaagggcaagtctgaggaggagctggccgagtgcttccgcatctttgacagaaatgctgatggctacatcgaccctgaggagctggccgagatcttccgggccagcggggagcacgtgacagatgaggagattgagagcctgatgaaggatggagacaagaacaatgatggaagaattgactttgatgagttcctgaagatgatggagggcgtgcagtag

SEQ ID NO: 174540 - DNA, 564 bp, Artificial Sequence
  Description of Artificial Sequence: Synthetic coding sequence
atgcctgaggtggagaggaagcccaagatcacagccagcaggaagctgctgctgaagagcctgatgctggccaaggccaaggagtgctgggagcaggagcacgaggagcgggaggccgagaaggtgcgctacctggccgagcgcatccccaccctgcagacccggggcctgagcctgagcgccctgcaggacctgtgccgggagctgcacgccaaggtggaggtggtggatgaggagagatatgacatcgaggccaagtgcctgcacaacacccgggagatcaaggacctgaagctgaaggtgatggacctgcggggcaagttcaagaggcctcccctgcggcgggtgcgggtgtctgcagatgccatgctgcgggccctgctgggcagcaagcacaaggtgtccatggacctgcgggccaacctgaagtctgtgaagaaggaggacacagagaaggagaggcctgtggaggtgggggactggaggaagaatgtggaggccatgagcggcatggagggcaggaagaagatgtttgatgctgccaagagccccaccagccagtag

SEQ ID NO: 174541 - DNA, 564 bp, Artificial Sequence
  Description of Artificial Sequence: Synthetic coding sequence
atgcctgaggtgcagaggaagcccaagatcacagccagcaggaagctgctgctgaagagcctgatgctggccaaggccaaggagtgctgggagcaggagcacgaggagcgggaggccgagaaggtgcgctacctggccgagcgcatccccaccctgcagacccggggcctgagcctgagcgccctgcaggacctgtgccgggagctgcacgccaaggtggaggtggtggatgaggagagatatgacatcgaggccaagtgcctgcacaacacccgggagatcaaggacctgaagctgaaggtgatggacctgcggggcaagttcaagaggcctcccctgcggcgggtgcgggtgtctgcagatgccatgctgcgggccctgctgggcagcaagcacaaggtgtccatggacctgcgggccaacctgaagtctgtgaagaaggaggacacagagaaggagaggcctgtggaggtgggggactggaggaagaatgtggaggccatgagcggcatggagggcaggaagaagatgtttgatgctgccaagagccccaccagccagtag

SEQ ID NO: 174542 - DNA, 564 bp, Artificial Sequence; identical to SEQ ID NO: 174540
  Description of Artificial Sequence: Synthetic coding sequence

SEQ ID NO: 174543 - DNA, 564 bp, Artificial Sequence; identical to SEQ ID NO: 174540
  Description of Artificial Sequence: Synthetic coding sequence

SEQ ID NO: 174544 - DNA, 564 bp, Artificial Sequence; identical to SEQ ID NO: 174541
  Description of Artificial Sequence: Synthetic coding sequence

SEQ ID NO: 174545 - DNA, 414 bp, Artificial Sequence
  Description of Artificial Sequence: Synthetic coding sequence
atgcctgaggtggagaggaagcccaagatcacagccagcaggaagctgctgctgaagagcctgatgctggccaaggccaaggagtgctgggagcaggagcacgaggagcgggaggccgagaaggtgcgctacctggccgagcgcatccccaccctgcagacccggggcctgagcctgagcgccctgcaggacctgtgccgggagctgcacgccaaggtggaggtggtggatgaggagagatatgacatcgaggccaagtgcctgcacaacacccgggagatcaaggacctgaagctgaaggtgatggacctgcggggcaagttcaagaggcctcccctgcggcgggtgcgggtgtctgcagatgccatgctgcgggccctgctgggcagcaagcacaaggtgtccatggactag

SEQ ID NO: 174546 - DNA, 549 bp, Artificial Sequence
  Description of Artificial Sequence: Synthetic coding sequence
atgagccagtgcaagaagaggaacagagccatcacagcccggcggcagcacctgaagtctgtgatgctgcagattgctgccacagagctggagaaggaggagagccggcgggaggccgagaagcagaactacctggccgagcactgcccccccctgcacatccctggctccatgtctgaggtgcaggagctgtgcaagcagctgcacgccaagattgatgctgctgaggaggagaagtatgacatggaggtgcgggtgcagaagaccagcaaggagctggaggacatgaaccagaagctgtttgacctgcggggcaagttcaagaggcctcccctgcggcgggtgaggatgtctgcagatgccatgctgaaggccctgctgggcagcaagcacaaggtgtgcatggacctgcgggccaacctgaagcaggtgaagaaggaggacacagagaaggagcgggacctgagagatgtgggggactggaggaagaacatcgaggagaagagcggcatggagggcaggaagaagatgtttgagagcgagagctag

SEQ ID NO: 174547 - DNA, 549 bp, Artificial Sequence
  Description of Artificial Sequence: Synthetic coding sequence
atgggagatgaggagaagaggaacagagccatcacagcccggcggcagcacctgaagtctgtgatgctgcagattgctgccacagagctggagaaggaggagagccggcgggaggccgagaagcagaactacctggccgagcactgcccccccctgcacatccctggctccatgtctgaggtgcaggagctgtgcaagcagctgcacgccaagattgatgctgctgaggaggagaagtatgacatggaggtgcgggtgcagaagaccagcaaggagctggaggacatgaaccagaagctgtttgacctgcggggcaagttcaagaggcctcccctgcggcgggtgaggatgtctgcagatgccatgctgaaggccctgctgggcagcaagcacaaggtgtgcatggacctgcgggccaacctgaagcaggtgaagaaggaggacacagagaaggagcgggacctgagagatgtgggggactggaggaagaacatcgaggagaagagcggcatggagggcaggaagaagatgtttgagagcgagagctag

SEQ ID NO: 174548 - DNA, 549 bp, Artificial Sequence; identical to SEQ ID NO: 174547
  Description of Artificial Sequence: Synthetic coding sequence

SEQ ID NO: 174549 - DNA, 549 bp, Artificial Sequence; identical to SEQ ID NO: 174547
  Description of Artificial Sequence: Synthetic coding sequence

SEQ ID NO: 174550 - DNA, 633 bp, Artificial Sequence
  Description of Artificial Sequence: Synthetic coding sequence
atggctgatggcagcagtgatgctgcccgggagcccaggcctgccccagcccccatcagaagaagaagcagcaactaccgggcctatgccacagagccccacgccaagaagaagagcaagatcagcgccagcaggaagctgcagctgaagaccctgctgctgcagatcgccaagcaggagctggagcgggaggccgaggagcggcggggggagaagggccgggccctgagcacccgctgccagcccctggagctggccggcctgggctttgctgagctgcaggacctgtgccggcagctgcacgcccgggtggacaaggtggatgaggagagatatgacatcgaggccaaggtgaccaagaacatcacagaaattgctgacctgacccagaagatctttgacctgcggggcaagttcaagaggcccaccctgcggcgggtgcgcatctctgcagatgccatgatgcaggccctgctgggcgcccgggccaaggagagcctggacctgcgggcccacctgaagcaggtgaagaaggaggacacagagaaggagaaccgggaggtgggggactggaggaagaacattgatgccctgagcggcatggagggcaggaagaagaagtttgagagctag

SEQ ID NO: 174551 - DNA, 837 bp, Artificial Sequence
  Description of Artificial Sequence: Synthetic coding sequence
atgtctgacacagaggagcaggagtatgaggaggagcagcctgaggaggaggccgctgaggaggaggaggaggcccctgaggagcctgagcctgtggccgagcctgaggaggagcggcccaagcccagcaggcctgtggtgcccccactcatcccccccaagatccctgagggggagcgggtggactttgatgacatccacaggaagaggatggagaaggacctgctggagctgcagaccctgattgatgtgcactttgagcagaggaagaaggaggaggaggagctggtggccctgaaggagagaattgaaagaagaagaagtgaaagagctgagcagcagcgcttcagaacagagaaggagcgggagcggcaggccaagctggccgaggagaagatgaggaaggaggaggaggaggccaagaagagagcagaagatgatgccaagaagaagaaggtgctgagcaacatgggcgcccactttggaggctacctggtgaaggccgagcagaagaggggcaagaggcagacaggccgggagatgaaggtgcgcatcctgtctgagaggaagaagcccctggacatcgactacatgggagaggagcagctgcgggcccggagcgcctggctgccccccagccagcccagctgcccagcccgggagaaggcccaggagctgagtgactggatccaccagctggagagcgagaagtttgacctgatggccaagctgaagcagcagaagtatgagatcaacgtgctgtacaaccgcatcagccacgcccagaagttcaggaagggggccggcaagggccgggtgggcggccgctggaagtag

SEQ ID NO: 174552 - DNA, 837 bp, Artificial Sequence; identical to SEQ ID NO: 174551
  Description of Artificial Sequence: Synthetic coding sequence

SEQ ID NO: 174553 - DNA, 756 bp, Artificial Sequence
  Description of Artificial Sequence: Synthetic coding sequence
atgtctgacacagaggagcaggagtatgaggaggagcagcctgaggaggaggccgctgaggaggaggaggaggaggaggagcggcccaagcccagcaggcctgtggtgcccccactcatcccccccaagatccctgagggggagcgggtggactttgatgacatccacaggaagaggatggagaaggacctgctggagctgcagaccctgattgatgtgcactttgagcagaggaagaaggaggaggaggagctggtggccctgaaggagcgcatcgagaggagaagaagtgagcgggcagagcagcagcgcttcagaacagagaaggagcgggagcggcaggccaagctggccgaggagaagatgaggaaggaggaggaggaggccaagaagagagcagaagatgatgccaagaagaagaaggtgctgagcaacatgggcgcccactttggaggctacctggtgaaggccgagcagaagaggggcaagaggcagacaggccgggagatgaaggtgcgcatcctgtctgagaggaagaagcccctggacatcgactacatgggagaggagcagctgcgggagaaggcccaggagctgagtgactggatccaccagctggagagcgagaagtttgacctgatggccaagctgaagcagcagaagtatgagatcaacgtgctgtacaaccgcatcagccacgcccagaagttcagaaaaggagctgggaagggccgggtgggcggccgctggaagtag

SEQ ID NO: 174554 - DNA, 522 bp, Artificial Sequence
  Description of Artificial Sequence: Synthetic coding sequence
agcaaggcccagccccaggacagccagcacctgcggcacagcctgggccgcaccaggatgtctgacacagaggagcaggagtatgaggaggagcagcctgaggaggaggccgctgaggaggaggaggagggggaggtgcctgattctgctgaggaggagcggcccaagcccagcaggcctgtggtgcccccactcatcccccccaagatccctgagggggagcgggtggactttgatgacatccacaggaagaggatggagaaggacctgctggagctgcagaccctgattgatgtgcactttgagcagaggaagaaggaggaggaggagctggtggccctgaaggagcgcatcgagaggagaagaagtgagcgggcagagcagcagcgcttcagaacagagaaggagcgggagcggcaggccaagctggccgaggagaagatgaggaaggaggaggaggaggccaagaagagagcagaagatgatgccaagaagaagaagaagaagaagaagaagaagtag

SEQ ID NO: 174555 - DNA, 756 bp, Artificial Sequence
  Description of Artificial Sequence: Synthetic coding sequence
atgtctgacacagaggagcaggagtatgaggaggagcagcctgaggaggaggccgctgaggaggaggaggaggcccctgaggagcctgagcctgtgcggcctgtggtgcccccactcatcccccccaagatccctgagggggagcgggtggactttgatgacatccacaggaagaggatggagaaggacctgctggagctgcagaccctgattgatgtgcactttgagcagaggaagaaggaggaggaggagctggtggccctgaaggagcgcatcgagaggagaagaagtgagcgggcagagcagcagcgcttcagaacagagaaggagcgggagcggcaggccaagctggccgaggagaagatgaggaaggaggaggaggaggccaagaagagagcagaagatgatgccaagaagaagaaggtgctgagcaacatgggcgcccactttggaggctacctggtgaaggccgagcagaagaggggcaagaggcagacaggccgggagatgaaggtgcgcatcctgtctgagaggaagaagcccctggacatcgactacatgggagaggagcagctgcgggagaaggcccaggagctgagtgactggatccaccagctggagagcgagaagtttgacctgatggccaagctgaagcagcagaagtatgagatcaacgtgctgtacaaccgcatcagccacgcccagaagttcagaaaaggagctgggaagggccgggtgggcggccgctggaagtag

SEQ ID NO: 174556 - DNA, 579 bp, Artificial Sequence
  Description of Artificial Sequence: Synthetic coding sequence
atggagaaggacctgctggagctgcagaccctgattgatgtgcactttgagcagaggaagaaggaggaggaggagctggtggccctgaaggagagaattgaaagaagaagaagtgaaagagctgagcagcagcgcttcagaacagagaaggagcgggagcggcaggccaagctggccgaggagaagatgaggaaggaggaggaggaggccaagaagagagcagaagatgatgccaagaagaagaaggtgctgagcaacatgggcgcccactttggaggctacctggtgaaggccgagcagaagaggggcaagaggcagacaggccgggagatgaaggtgcgcatcctgtctgagaggaagaagcccctggacatcgactacatgggagaggagcagctgcgggagaaggcccaggagctgagtgactggatccaccagctggagagcgagaagtttgacctgatggccaagctgaagcagcagaagtatgagatcaacgtgctgtacaaccgcatcagccacgcccagaagttcaggaagggggccggcaagggccgggtgggcggccgctggaagtag

SEQ ID NO: 174557 - DNA, 882 bp, Artificial Sequence
  Description of Artificial Sequence: Synthetic coding sequence
atgtctgacatcgaggaggtggtggaggagtatgaggaggagcaccctgaggaggaggaggactggagagaagatgaagatgagcaggaggaggccgcagaagaagatgctgaggccgaggccgagacagaggagaccagggctgaggaggatgaggaggaggaggaggccaaggaggctgaagatggccccatggaggagagcaagcccaagcccaggagcttcatgcccaacctggtgccccccaagatcccagatggagagcgggtggactttgatgacatccacaggaagaggatggagaaggacctgaatgagctgcaggccctgattgaggcccactttgagaacaggaagaaggaggaggaggagctggtgtccctgaaggaccgcatcgagaggagaagagctgagcgggcagagcagcagaggatcagaaatgaaagagagaaggagcggcagaaccggctggccgaggagcgggcccggcgggaggaggaggagaacagaaggaaggccgaggatgaggccaggaagaagaaggccctgagcaacatgatgcactttggaggctacatccagaagcaggcccagacagagaggaagagcggcaagaggcagacagagcgggagaagaagaagaagatcctggccgagaggaggaaggtgctggccatcgaccacctgaatgaagaccagctgcgggagaaggccaaggagctgtggcagagcatctacaacctggaggccgagaagtttgacctgcaggagaagttcaagcagcagaagtatgagatcaacgtgctgaggaaccgcatcaatgacaaccagaaggtgtccaagacccggggcaaggccaaggtgacaggccgctggaagtag

SEQ ID NO: 174558 - DNA, 600 bp, Artificial Sequence
  Description of Artificial Sequence: Synthetic coding sequence
atgtctgacatcgaggaggtggtggaggagtatgaggaggagatggccgccccccagcaccaggaggaggccgcagaagaagatgctgaggccgaggccgagacagaggagaccagggcagaagatgaggaggaggaggaggccaaggaggccgaggatggccccatggaggagagcaagcccaagcccaggagcttcatgcccaacctggtgccccccaagatcccagatggagagcgggtggactttgatgacatccacaggaagaggatggagaaggacctgaatgagctgcaggccctgattgaggcccactttgaaaataggaagaaggaggaggaggagctggtgtccctgaaggacagaattgaaagaagaagagctgagagagctgagcagcagaggatcagaaatgaaagagagaaggagcggcagaaccggctggccgaggagcgggcccggcgggaggaggaggagaacagaaggaaggcagaagatgaggccaggaagaagaaggccctgagcaacatgatgcactttggaggctacatccagaagcaccccccagacagagctgagaagtgggaggaggccgactag

SEQ ID NO: 174559 - DNA, 852 bp, Artificial Sequence
  Description of Artificial Sequence: Synthetic coding sequence
atgtctgacatcgaggaggtggtggaggagtatgaggaggaggccaagctggagcaggaggaggccgcagaagaagatgctgaggccgaggccgagacagaggagaccagggctgaggaggatgaggaggaggaggaggccaaggaggctgaagatggccccatggaggagagcaagcccaagcccaggagcttcatgcccaacctggtgccccccaagatcccagatggagagcgggtggactttgatgacatccacaggaagaggatggagaaggacctgaatgagctgcaggccctgattgaggcccactttgagaacaggaagaaggaggaggaggagctggtgtccctgaaggaccgcatcgagaggagaagagctgagcgggcagagcagcagaggatcagaaatgaaagagagaaggagcggcagaaccggctggccgaggagcgggcccggcgggaggaggaggagaacagaaggaaggccgaggatgaggccaggaagaagaaggccctgagcaacatgatgcactttggaggctacatccagaagcaggcccagacagagaggaagagcggcaagaggcagacagagcgggagaagaagaagaagatcctggccgagaggaggaaggtgctggccatcgaccacctgaatgaagaccagctgcgggagaaggccaaggagctgtggcagagcatctacaacctggaggccgagaagtttgacctgcaggagaagttcaagcagcagaagtatgagatcaacgtgctgaggaaccgcatcaatgacaaccagaaggtgtccaagacccggggcaaggccaaggtgacaggccgctggaagtag

SEQ ID NO: 174560 - DNA, 858 bp, Artificial Sequence
  Description of Artificial Sequence: Synthetic coding sequence
atgtctgacatcgaggaggtggtggaggagtatgaggaggaggagcaggaggaggccgctgtggaggagcaggaggaggccgctgaggaggatgctgaggccgaggccgagacagaggagaccagggcagaagaagatgaggaggaggaggaggccaaggaggccgaggatggccccatggaggagagcaagcccaagcccaggagcttcatgcccaacctggtgccccccaagatcccagatggagagcgggtggactttgatgacatccacaggaagaggatggagaaggacctgaatgagctgcaggccctgattgaggcccactttgaaaataggaagaaggaggaggaggagctggtgtccctgaaggacagaattgaaagaagaagagctgagagagctgagcagcagaggatcagaaatgaaagagagaaggagcggcagaaccggctggccgaggagcgggcccggcgggaggaggaggagaacagaaggaaggcagaagatgaggccaggaagaagaaggccctgagcaacatgatgcactttggaggctacatccagaagacagagaggaagagcggcaagaggcagacagagcgggagaagaagaagaagatcctggccgagaggaggaaggtgctggccatcgaccacctgaatgaagaccagctgcgggagaaggccaaggagctgtggcagagcatctacaacctggaggccgagaagtttgacctgcaggagaagttcaagcagcagaagtatgagatcaacgtgctgaggaaccgcatcaatgacaaccagaaggtgtccaagacccggggcaaggccaaggtgacaggccgctggaagtag

SEQ ID NO: 174561 - DNA, 867 bp, Artificial Sequence
  Description of Artificial Sequence: Synthetic coding sequence
atgtctgacatcgaggaggtggtggaggagtatgaggaggaggagcaggaggaggccgctgtggaggagcaggaggaggccgctgaggaggatgctgaggccgaggccgagacagaggagaccagggcagaagaagatgaggaggaggaggaggccaaggaggccgaggatggccccatggaggagagcaagcccaagcccaggagcttcatgcccaacctggtgccccccaagatcccagatggagagcgggtggactttgatgacatccacaggaagaggatggagaaggacctgaatgagctgcaggccctgattgaggcccactttgaaaataggaagaaggaggaggaggagctggtgtccctgaaggacagaattgaaagaagaagagctgagagagctgagcagcagaggatcagaaatgaaagagagaaggagcggcagaaccggctggccgaggagcgggcccggcgggaggaggaggagaacagaaggaaggcagaagatgaggccaggaagaagaaggccctgagcaacatgatgcactttggaggctacatccagaagcaggcccagacagagaggaagagcggcaagaggcagacagagcgggagaagaagaagaagatcctggccgagaggaggaaggtgctggccatcgaccacctgaatgaagaccagctgcgggagaaggccaaggagctgtggcagagcatctacaacctggaggccgagaagtttgacctgcaggagaagttcaagcagcagaagtatgagatcaacgtgctgaggaaccgcatcaatgacaaccagaaggtgtccaagacccggggcaaggccaaggtgacaggccgctggaagtag

SEQ ID NO: 174562 - DNA, 867 bp, Artificial Sequence; identical to SEQ ID NO: 174561
  Description of Artificial Sequence: Synthetic coding sequence

SEQ ID NO: 174563 - DNA, 681 bp, Artificial Sequence
  Description of Artificial Sequence: Synthetic coding sequence
atggaggagagcaagcccaagcccaggagcttcatgcccaacctggtgccccccaagatcccagatggagagcgggtggactttgatgacatccacaggaagaggatggagaaggacctgaatgagctgcaggccctgattgaggcccactttgagaacaggaagaaggaggaggaggagctggtgtccctgaaggaccgcatcgagaggagaagagctgagcgggcagagcagcagaggatcagaaatgaaagagagaaggagcggcagaaccggctggccgaggagcgggcccggcgggaggaggaggagaacagaaggaaggccgaggatgaggccaggaagaagaaggccctgagcaacatgatgcactttggaggctacatccagaagacagagaggaagagcggcaagaggcagacagagcgggagaagaagaagaagatcctggccgagaggaggaaggtgctggccatcgaccacctgaatgaagaccagctgcgggagaaggccaaggagctgtggcagagcatctacaacctggaggccgagaagtttgacctgcaggagaagttcaagcagcagaagtatgagatcaacgtgctgaggaaccgcatcaatgacaaccagaaggtgtccaagacccggggcaaggccaaggtgacaggccgctggaagtag

SEQ ID NO: 174564 - DNA, 858 bp, Artificial Sequence; identical to SEQ ID NO: 174560
  Description of Artificial Sequence: Synthetic coding sequence

SEQ ID NO: 174565 - DNA, 876 bp, Artificial Sequence
  Description of Artificial Sequence: Synthetic coding sequence
atgtctgacatcgaggaggtggtggaggagtatgaggaggagtacctggagcacgccgaggccgctgtggaggagcaggaggaggccgctgaggaggatgctgaggccgaggccgagacagaggagaccagggcagaagaagatgaggaggaggaggaggccaaggaggccgaggatggccccatggaggagagcaagcccaagcccaggagcttcatgcccaacctggtgccccccaagatcccagatggagagcgggtggactttgatgacatccacaggaagaggatggagaaggacctgaatgagctgcaggccctgattgaggcccactttgaaaataggaagaaggaggaggaggagctggtgtccctgaaggacagaattgaaagaagaagagctgagagagctgagcagcagaggatcagaaatgaaagagagaaggagcggcagaaccggctggccgaggagcgggcccggcgggaggaggaggagaacagaaggaaggcagaagatgaggccaggaagaagaaggccctgagcaacatgatgcactttggaggctacatccagaagcacaccctgcagacagagaggaagagcggcaagaggcagacagagcgggagaagaagaagaagatcctggccgagaggaggaaggtgctggccatcgaccacctgaatgaagaccagctgcgggagaaggccaaggagctgtggcagagcatctacaacctggaggccgagaagtttgacctgcaggagaagttcaagcagcagaagtatgagatcaacgtgctgaggaaccgcatcaatgacaaccagaaggtgtccaagacccggggcaaggccaaggtgacaggccgctggaagtag

SEQ ID NO: 174566 - DNA, 894 bp, Artificial Sequence
  Description of Artificial Sequence: Synthetic coding sequence
atgtctgacatcgaggaggtggtggaggagtatgaggaggagtacctggagcacgccgaggccgctgtggaggaggaggaggactggagagaagatgaagatgagcaggaggaggccgctgaggaggatgctgaggccgaggccgagacagaggagaccagggcagaagaagatgaggaggaggaggaggccaaggaggccgaggatggccccatggaggagagcaagcccaagcccaggagcttcatgcccaacctggtgccccccaagatcccagatggagagcgggtggactttgatgacatccacaggaagaggatggagaaggacctgaatgagctgcaggccctgattgaggcccactttgaaaataggaagaaggaggaggaggagctggtgtccctgaaggacagaattgaaagaagaagagctgagagagctgagcagcagaggatcagaaatgaaagagagaaggagcggcagaaccggctggccgaggagcgggcccggcgggaggaggaggagaacagaaggaaggcagaagatgaggccaggaagaagaaggccctgagcaacatgatgcactttggaggctacatccagaagacagagaggaagagcggcaagaggcagacagagcgggagaagaagaagaagatcctggccgagaggaggaaggtgctggccatcgaccacctgaatgaagaccagctgcgggagaaggccaaggagctgtggcagagcatctacaacctggaggccgagaagtttgacctgcaggagaagttcaagcagcagaagtatgagatcaacgtgctgaggaaccgcatcaatgacaaccagaaggtgtccaagacccggggcaaggccaaggtgacaggccgctggaagtag

SEQ ID NO: 174567 - DNA, 867 bp, Artificial Sequence; identical to SEQ ID NO: 174561
  Description of Artificial Sequence: Synthetic coding sequence

SEQ ID NO: 174568 - DNA, 771 bp, Artificial Sequence
  Description of Artificial Sequence: Synthetic coding sequence
atgtctgatgaggaggtggagcaggtggaggagcagtatgaggaggaggaggaggcccaggaggaggccgctgaggtgcatgaggaggtgcatgagcctgaggagaagccccggcccaagctgacagcccccaagatccctgagggggagaaggtggactttgatgacatccagaagaagaggcagaacaaggacctgatggagctgcaggccctgattgacagccactttgaggccaggaagaaggaggaggaggagctggtggccctgaaggagcgcatcgagaagagaagagctgagcgggcagagcagcagaggatccgggcagagaaggagcgggagcggcagaaccggctggccgaggagaaggcccggcgggaggaggaggatgccaagagaagagcagaagatgacctgaagaagaagaaggccctgagctccatgggcgccaactacagcagctacctggccaaggctgaccagaagaggggcaagaagcagacagcccgggagatgaagaagaagatcctggccgagaggaggaagcccctgaacatcgaccacctgggggaggacaagctgcgggacaaggccaaggagctgtgggagaccctgcaccagctggagattgacaagtttgaatttggagagaagctgaagaggcagaagtatgacatcaccaccctgcggagcagaattgaccaggcccagaagcacagcaagaaggccggcaccccagccaagggcaaggtgggcggccgctggaagtag

SEQ ID NO: 174569 - DNA, 777 bp, Artificial Sequence
  Description of Artificial Sequence: Synthetic coding sequence
atgtctgatgaggaggtggagcaggtggaggagcagtatgaggaggaggaggaggcccaggaggaggaggaggtgcaggaggacacagctgaggaggatgctgaggaggagaagccccggcccaagctgacagcccccaagatccctgagggggagaaggtggactttgatgacatccagaagaagaggcagaacaaggacctgatggagctgcaggccctgattgacagccactttgaggccaggaagaaggaggaggaggagctggtggccctgaaggagcgcatcgagaagagaagagctgagcgggcagagcagcagaggatccgggcagagaaggagcgggagcggcagaaccggctggccgaggagaaggcccggcgggaggaggaggatgccaagagaagagcagaagatgacctgaagaagaagaaggccctgagctccatgggcgccaactacagcagctacctggccaaggctgaccagaagaggggcaagaagcagacagcccgggagatgaagaagaagatcctggccgagaggaggaagcccctgaacatcgaccacctgggggaggacaagctgcgggacaaggccaaggagctgtgggagaccctgcaccagctggagattgacaagtttgaatttggagagaagctgaagaggcagaagtatgacatcaccaccctgcggagcagaattgaccaggcccagaagcacagcaagaaggccggcaccccagccaagggcaaggtgggcggccgctggaagtag

SEQ ID NO: 174570 - DNA, 738 bp, Artificial Sequence
  Description of Artificial Sequence: Synthetic coding sequence
atgtctgatgaggaggtggagcaggtggaggagcagtatgaggaggaggaggaggcccaggaggaggaggagaagccccggcccaagctgacagcccccaagatccctgagggggagaaggtggactttgatgacatccagaagaagaggcagaacaaggacctgatggagctgcaggccctgattgacagccactttgaggccaggaagaaggaggaggaggagctggtggccctgaaggagagaattgagaagagaagagctgagagagctgagcagcagaggatccgggcagagaaggagcgggagcggcagaaccggctggccgaggagaaggcccggcgggaggaggaggatgccaagagaagagcagaagatgacctgaagaagaagaaggccctgagctccatgggcgccaactacagcagctacctggccaaggctgaccagaagaggggcaagaagcagacagcccgggagatgaagaagaagatcctggccgagaggaggaagcccctgaacatcgaccacctgggggaggacaagctgcgggacaaggccaaggagctgtgggagaccctgcaccagctggagattgacaagtttgaatttggagagaagctgaagaggcagaagtatgacatcaccaccctgcggagcagaattgaccaggcccagaagcacagcaagaaggccggcaccccagccaagggcaaggtgggcggccgctggaagtag

SEQ ID NO: 174571 - DNA, 759 bp, Artificial Sequence
  Description of Artificial Sequence: Synthetic coding sequence
atgtctgatgaggaggtggagcaggtggaggagcagtatgaggaggaggaggaggcccaggaggaggccgctgaggtgcatgaggaggaggagaagccccggcccaagctgacagcccccaagatccctgagggggagaaggtggactttgatgacatccagaagaagaggcagaacaaggacctgatggagctgcaggccctgattgacagccactttgaggccaggaagaaggaggaggaggagctggtggccctgaaggagcgcatcgagaagagaagagctgagcgggcagagcagcagaggatccgggcagagaaggagcgggagcggcagaaccggctggccgaggagaaggcccggcgggaggaggaggatgccaagagaagagcagaagatgacctgaagaagaagaaggccctgagctccatgggcgccaactacagcagctacctggccaaggctgaccagaagaggggcaagaagcagacagcccgggagatgaagaagaagatcctggccgagaggaggaagcccctgaacatcgaccacctgggggaggacaagctgcgggacaaggccaaggagctgtgggagaccctgcaccagctggagattgacaagtttgaatttggagagaagctgaagaggcagaagtatgacatcatgaatgtgcgggcccgggtgcagatgctggccaagttcagcaagaaggccggcaccccagccaagggcaaggtgggcggccgctggaagtag

SEQ ID NO: 174572 - DNA, 783 bp, Artificial Sequence
  Description of Artificial Sequence: Synthetic coding sequence
atgtctgatgaggaggtggagcaggtggaggagcagtatgaggaggaggaggaggcccaggaggaggccgctgaggtgcatgaggaggacacagctgaggaggatgctgaggaggagaagccccggcccaagctgacagcccccaagatccctgagggggagaaggtggactttgatgacatccagaagaagaggcagaacaaggacctgatggagctgcaggccctgattgacagccactttgaggccaggaagaaggaggaggaggagctggtggccctgaaggagcgcatcgagaagagaagagctgagcgggcagagcagcagaggatccgggcagagaaggagcgggagcggcagaaccggctggccgaggagaaggcccggcgggaggaggaggatgccaagagaagagcagaagatgacctgaagaagaagaaggccctgagctccatgggcgccaactacagcagctacctggccaaggctgaccagaagaggggcaagaagcagacagcccgggagatgaagaagaagatcctggccgagaggaggaagcccctgaacatcgaccacctgggggaggacaagctgcgggacaaggccaaggagctgtgggagaccctgcaccagctggagattgacaagtttgaatttggagagaagctgaagaggcagaagtatgacatcaccaccctgcggagcagaattgaccaggcccagaagcacagcaagaaggccggcaccccagccaagggcaaggtgggcggccgctggaagtag

SEQ ID NO: 174573 - DNA, 753 bp, Artificial Sequence
  Description of Artificial Sequence: Synthetic coding sequence
atgtctgatgaggaggtggagcaggtggaggagcagtatgaggaggaggaggaggcccaggaggaggaggaggtgcaggaggaggagaagccccggcccaagctgacagcccccaagatccctgagggggagaaggtggactttgatgacatccagaagaagaggcagaacaaggacctgatggagctgcaggccctgattgacagccactttgaggccaggaagaaggaggaggaggagctggtggccctgaaggagcgcatcgagaagagaagagctgagcgggcagagcagcagaggatccgggcagagaaggagcgggagcggcagaaccggctggccgaggagaaggcccggcgggaggaggaggatgccaagagaagagcagaagatgacctgaagaagaagaaggccctgagctccatgggcgccaactacagcagctacctggccaaggctgaccagaagaggggcaagaagcagacagcccgggagatgaagaagaagatcctggccgagaggaggaagcccctgaacatcgaccacctgggggaggacaagctgcgggacaaggccaaggagctgtgggagaccctgcaccagctggagattgacaagtttgaatttggagagaagctgaagaggcagaagtatgacatcaccaccctgcggagcagaattgaccaggcccagaagcacagcaagaaggccggcaccccagccaagggcaaggtgggcggccgctggaagtag

SEQ ID NO: 174574 - DNA, 786 bp, Artificial Sequence
  Description of Artificial Sequence: Synthetic coding sequence
atgtctgatgaggaggtggagcaggtggaggagcagtatgaggaggaggaggaggcccaggaggaggccgctgaggtgcatgaggagggcatgaggacccaggacttcttccacgaggagaagccccggcccaagctgacagcccccaagatccctgagggggagaaggtggactttgatgacatccagaagaagaggcagaacaaggacctgatggagctgcaggccctgattgacagccactttgaggccaggaagaaggaggaggaggagctggtggccctgaaggagagaattgagaagagaagagctgagagagctgagcagcagaggatccgggcagagaaggagcgggagcggcagaaccggctggccgaggagaaggcccggcgggaggaggaggatgccaagagaagagcagaagatgacctgaagaagaagaaggccctgagctccatgggcgccaactacagcagctacctggccaaggctgaccagaagaggggcaagaagcagacagcccgggagatgaagaagaagatcctggccgagaggaggaagcccctgaacatcgaccacctgggggaggacaagctgcgggacaaggccaaggagctgtgggagaccctgcaccagctggagattgacaagtttgaatttggagagaagctgaagaggcagaagtatgacatcaccaccctgcggagcagaattgaccaggcccagaagcacagcaagaaggccggcaccccagccaagggcaaggtgggcggccgctggaagtag

SEQ ID NO: 174575 - DNA, 786 bp, Artificial Sequence
  Description of Artificial Sequence: Synthetic coding sequence
atgtctgatgaggaggtggagcaggtggaggagcagtatgaggaggaggaggaggcccaggaggaggccgctgaggtgcatgaggaggtgcatgagcctgaggaggtgcaggaggaggagaagccccggcccaagctgacagcccccaagatccctgagggggagaaggtggactttgatgacatccagaagaagaggcagaacaaggacctgatggagctgcaggccctgattgacagccactttgaggccaggaagaaggaggaggaggagctggtggccctgaaggagagaattgagaagagaagagctgagagagctgagcagcagaggatccgggcagagaaggagcgggagcggcagaaccggctggccgaggagaaggcccggcgggaggaggaggatgccaagagaagagcagaagatgacctgaagaagaagaaggccctgagctccatgggcgccaactacagcagctacctggccaaggctgaccagaagaggggcaagaagcagacagcccgggagatgaagaagaagatcctggccgagaggaggaagcccctgaacatcgaccacctgggggaggacaagctgcgggacaaggccaaggagctgtgggagaccctgcaccagctggagattgacaagtttgaatttggagagaagctgaagaggcagaagtatgacatcaccaccctgcggagcagaattgaccaggcccagaagcacagcaagaaggccggcaccccagccaagggcaaggtgggcggccgctggaagtag

SEQ ID NO: 174576 - DNA, 753 bp, Artificial Sequence
  Description of Artificial Sequence: Synthetic coding sequence
atgtctgatgaggaggtggagcaggtggaggagcagtatgaggaggaggaggaggcccaggaggaggaggaggtgcaggaggaggagaagccccggcccaagctgacagcccccaagatccctgagggggagaaggtggactttgatgacatccagaagaagaggcagaacaaggacctgatggagctgcaggccctgattgacagccactttgaggccaggaagaaggaggaggaggagctggtggccctgaaggagcgcatcgagaagagaagagctgagcgggcagagcagcagaggatccgggcagagaaggagcgggagcggcagaaccggctggccgaggagaaggcccggcgggaggaggaggatgccaagagaagagcagaagatgacctgaagaagaagaaggccctgagctccatgggcgccaactacagcagctacctggccaaggctgaccagaagaggggcaagaagcagacagcccgggagatgaagaagaagatcctggccgagaggaggaagcccctgaacatcgaccacctgggggaggacaagctgcgggacaaggccaaggagctgtgggagaccctgcaccagctggagattgacaagtttgaatttggagagaagctgaagaggcagaagtatgacatcatgaatgtgcgggcccgggtgcagatgctggccaagttcagcaagaaggccggcaccccagccaagggcaaggtgggcggccgctggaagtag

SEQ ID NO: 174577 - DNA, 810 bp, Artificial Sequence
  Description of Artificial Sequence: Synthetic coding sequence
atgtctgatgaggaggtggagcaggtggaggagcagtatgaggaggaggaggaggcccaggaggaggccgctgaggtgcatgaggaggtgcatgagcctgaggaggtgcaggaggacacagcagaagaagatgctgaggaggagaagccccggcccaagctgacagcccccaagatccctgagggggagaaggtggactttgatgacatccagaagaagaggcagaacaaggacctgatggagctgcaggccctgattgacagccactttgaggccaggaagaaggaggaggaggagctggtggccctgaaggagagaattgagaagagaagagctgagagagctgagcagcagaggatccgggcagagaaggagcgggagcggcagaaccggctggccgaggagaaggcccggcgggaggaggaggatgccaagagaagagcagaagatgacctgaagaagaagaaggccctgagctccatgggcgccaactacagcagctacctggccaaggctgaccagaagaggggcaagaagcagacagcccgggagatgaagaagaagatcctggccgagaggaggaagcccctgaacatcgaccacctgggggaggacaagctgcgggacaaggccaaggagctgtgggagaccctgcaccagctggagattgacaagtttgaatttggagagaagctgaagaggcagaagtatgacatcaccaccctgcggagcagaattgaccaggcccagaagcacagcaagaaggccggcaccccagccaagggcaaggtgggcggccgctggaagtag

SEQ ID NO: 174578 - DNA, 813 bp, Artificial Sequence
  Description of Artificial Sequence: Synthetic coding sequence
atgtctgatgaggaggtggagcaggtggaggagcagtatgaggaggaggaggaggcccaggaggaggccgctgaggtgcatgaggaggcccaccctggagaggagagcgtgcgggaggacacagctgaggaggatgctgaggaggagaagccccggcccaagctgacagcccccaagatccctgagggggagaaggtggactttgatgacatccagaagaagaggcagaacaaggacctgatggagctgcaggccctgattgacagccactttgaggccaggaagaaggaggaggaggagctggtggccctgaaggagcgcatcgagaagagaagagctgagcgggcagagcagcagaggatccgggcagagaaggagcgggagcggcagaaccggctggccgaggagaaggcccggcgggaggaggaggatgccaagagaagagcagaagatgacctgaagaagaagaaggccctgagctccatgggcgccaactacagcagctacctggccaaggctgaccagaagaggggcaagaagcagacagcccgggagatgaagaagaagatcctggccgagaggaggaagcccctgaacatcgaccacctgggggaggacaagctgcgggacaaggccaaggagctgtgggagaccctgcaccagctggagattgacaagtttgaatttggagagaagctgaagaggcagaagtatgacatcaccaccctgcggagcagaattgaccaggcccagaagcacagcaagaaggccggcaccccagccaagggcaaggtgggcggccgctggaagtag

SEQ ID NO: 174579 - DNA, 435 bp, Artificial Sequence
  Description of Artificial Sequence: Synthetic coding sequence
atgtctgatgaggaggtggagcaggtggaggagcagtatgaggaggaggaggaggcccaggaggaggccgctgaggtgcatgaggaggagaggagagcagaagatgacctgaagaagaagaaggccctgagctccatgggcgccaactacagcagctacctggccaaggctgaccagaagaggggcaagaagcagacagcccgggagatgaagaagaagatcctggccgagaggaggaagcccctgaacatcgaccacctgggggaggacaagctgcgggacaaggccaaggagctgtgggagcccccccagagctgccagggcctgcctgacagccctgggggcggggaggccatccctggccggcccccccggctgtgcccctgctgcctgcaccccctgggccctgtgaacaaggctgctgagcccccatag

SEQ ID NO: 174580 - DNA, 1617 bp, Artificial Sequence
  Description of Artificial Sequence: Synthetic coding sequence
atggaggagagcgtgaaccagatgcagcccctgaatgagaagcagatcgccaacagccaggacggctacgtgtggcaggtgacagacatgaaccggctgcaccgcttcctgtgctttggaagtgaaggaggcacctactacatcaaggagcagaagctgggcctggagaatgctgaggccctgatccggctgattgaagatggccggggctgtgaggtgatccaggagatcaagagcttcagccaggagggccgcaccaccaagcaggagcccatgctgtttgccctggccatctgcagccagtgcagcgacatcagcaccaagcaggccgccttcaaggctgtgtctgaggtgtgccgcatccccacccacctgttcaccttcatccagttcaagaaggacctgaaggagagcatgaagtgtggcatgtggggccgggccctgaggaaggccatcgctgactggtacaatgaaaaaggaggcatggccctggccctggccgtgaccaagtacaagcagagaaatggctggagccacaaggacctgctgcggctgagccacctgaagcccagcagcgagggcctggccatcgtgaccaagtacatcaccaagggctggaaggaggtgcatgagctgtacaaggagaaggccctgtctgtggagacagagaagctgctgaagtacctggaggccgtggagaaggtgaagaggaccagagatgagctggaggtgatccacctgattgaggagcaccggctggtgcgggagcacctgctgaccaaccacctgaagagcaaggaggtgtggaaggccctgctgcaggagatgcccctgacagccctgctgaggaacctgggcaagatgacagccaacagcgtgctggagcccggcaacagcgaggtgtccctggtgtgtgagaagctgtgcaatgagaagctgctgaagaaggcccgcatccaccccttccacatcctgattgccctggagacctacaagacaggccacggcctgcggggcaagctgaagtggaggccagatgaggagatcctgaaggccctggatgctgccttctacaagaccttcaagacagtggagcccaccgggaagcgcttcctgctggccgtggatgtgtctgcctccatgaaccagagggtgctgggcagcatcctgaatgccagcacagtggccgccgccatgtgcatggtggtgaccaggacagagaaggacagctatgtggtggccttcagtgatgagatggtgccctgccctgtgaccacagacatgaccctgcagcaggtgctgatggccatgagccagatcccagctgggggcacagactgcagcctgcccatgatctgggcccagaagaccaacaccccagcagatgtgttcatcgtgttcacagacaatgagacctttgctgggggcgtgcacccagccatcgccctgcgggagtacaggaagaagatggacatcccagccaagctgattgtgtgtggcatgaccagcaatggcttcaccatcgctgaccctgatgaccggggcatgctggacatgtgtggctttgacaccggggccctggatgtgatccggaacttcaccctggacatgatctag

SEQ ID NO: 174581 - DNA, 1557 bp, Artificial Sequence
  Description of Artificial Sequence: Synthetic coding sequence
atggaggagagcgtgaaccagatgcagcccctgaatgagaagcagatcgccaacagccaggacggctacgtgtggcaggtgacagacatgaaccggctgcaccgcttcctgtgctttggaagtgaaggaggcacctactacatcaaggagcagaagctgggcctggagaatgctgaggccctgatccggctgattgaagatggccggggctgtgaggtgatccaggagatcaagagcttcagccaggagggccgcaccaccaagcaggagcccatgctgtttgccctggccatctgcagccagtgcagcgacatcagcaccaagcaggccgccttcaaggctgtgtctgaggtgtgccgcatccccacccacctgttcaccttcatccagttcaagaaggacctgaaggagagcatgaagtgtggcatgtggggccgggccctgaggaaggccatcgctgactggtacaatgaaaaaggaggcatggccctggccctggccgtgaccaagtacaagcagagaaatggctggagccacaaggacctgctgcggctgagccacctgaagcccagcagcgagggcctggccatcgtgaccaagtacatcaccaagggctggaaggaggtgcatgagctgtacaaggagaaggccctgtctgtggagacagagaagctgctgaagtacctggaggccgtggagaaggtgaagaggaccagagatgagctggaggtgatccacctgattgaggagcaccggctggtgcgggagcacctgctgaccaaccacctgaagagcaaggaggtgtggaaggccctgctgcaggagatgcccctgacagccctgctgaggaacctgggcaagatgacagccaacagcgtgctggagcccggcaacagcgaggtgtccctggtgtgtgagaagctgtgcaatgagaagctgctgaagaaggcccgcatccaccccttccacatcctgattgccctggagacctacaagacaggccacggcctgcggggcaagctgaagtggaggccagatgaggagatcctgaaggccctggatgctgccttctacaagaccttcaagacagtggagcccaccgggaagcgcttcctgctggccgtggatgtgtctgcctccatgaaccagagggtgctgggcagcatcctgaatgccagcacagtggccgccgccatgtgcatggtggtgaccaggacagagaaggacagctatgtggtggccttcagtgatgagatggtgccctgccctgtgaccacagacatgaccctgcagcaggtgctgatggccatgagccagatcccagctgggggcacagactgcagcctgcccatgatctgggcccagaagaccaacaccccagcagatgtgttcatcgtgttcacagacaatgagacctttgctgggggcgtgcacccagccatcgccctgcgggagtacaggaagaagatggacatcccagccaagctgattgtgtgtggcatgaccagcaatggcttcaccatcgctgaccctgatgaccgggacacagtgaagtag

SEQ ID NO: 174582 - DNA, 1578 bp, Artificial Sequence
  Description of Artificial Sequence: Synthetic coding sequence
atggaggagagcgtgaaccagatgcagcccctgaatgagaagcagatcgccaacagccaggacggctacgtgtggcaggtgacagacatgaaccggctgcaccgcttcctgtgctttggaagtgaaggaggcacctactacatcaaggagcagaagctgggcctggagaatgctgaggccctgatccggctgattgaagatggccggggctgtgaggtgatccaggagatcaagagcttcagccaggagggccgcaccaccaagcaggagcccatgctgtttgccctggccatctgcagccagtgcagcgacatcagcaccaagcaggccgccttcaaggctgtgtctgaggtgtgccgcatccccacccacctgttcaccttcatccagttcaagaaggacctgaaggagagcatgaagtgtggcatgtggggccgggccctgaggaaggccatcgctgactggtacaatgaaaaaggaggcatggccctggccctggccgtgaccaagtacaagcagagaaatggctggagccacaaggacctgctgcggctgagccacctgaagcccagcagcgagggcctggccatcgtgaccaagtacatcaccaagggctggaaggaggtgcatgagctgtacaaggagaaggccctgtctgtggagacagagaagctgctgaagtacctggaggccgtggagaaggtgaagaggaccagagatgagctggaggtgatccacctgattgaggagcaccggctggtgcgggagcacctgctgaccaaccacctgaagagcaaggaggtgtggaaggccctgctgcaggagatgcccctgacagccctgctgaggaacctgggcaagatgacagccaacagcgtgctggagcccggcaacagcgaggtgtccctggtgtgtgagaagctgtgcaatgagaagctgctgaagaaggcccgcatccaccccttccacatcctgattgccctggagacctacaagacaggccacggcctgcggggcaagctgaagtggaggccagatgaggagatcctgaaggccctggatgctgccttctacaagaccttcaagacagtggagcccaccgggaagcgcttcctgctggccgtggatgtgtctgcctccatgaaccagagggtgctgggcagcatcctgaatgccagcacagtggccgccgccatgtgcatggtggtgaccaggacagagaaggacagctatgtggtggccttcagtgatgagatggtgccctgccctgtgaccacagacatgaccctgcagcaggtgctgatggccatgagccagatcccagctgggggcacagactgcagcctgcccatgatctgggcccagaagaccaacaccccagcagatgtgttcatcgtgttcacagacaatgagacctttgctgggggcgtgcacccagccatcgccctgcgggagtacaggaagaagatggacatcccagccaagctgattgtgtgtggcatgaccagcaatggcttcaccatcgctgaccctgatgaccgggccctgcagaacaccctgctgaacaagagcttctag

SEQ ID NO: 174583 - DNA, 1605 bp, Artificial Sequence
  Description of Artificial Sequence: Synthetic coding sequence
atggaggagagcgtgaaccagatgcagcccctgaatgagaagcagatcgccaacagccaggacggctacgtgtggcaggtgacagacatgaaccggctgcaccgcttcctgtgctttggaagtgaaggaggcacctactacatcaaggagcagaagctgggcctggagaatgctgaggccctgatccggctgattgaagatggccggggctgtgaggtgatccaggagatcaagagcttcagccaggagggccgcaccaccaagcaggagcccatgctgtttgccctggccatctgcagccagtgcagcgacatcagcaccaagcaggccgccttcaaggctgtgtctgaggtgtgccgcatccccacccacctgttcaccttcatccagttcaagaaggacctgaaggagagcatgaagtgtggcatgtggggccgggccctgaggaaggccatcgctgactggtacaatgaaaaaggaggcatggccctggccctggccgtgaccaagtacaagcagagaaatggctggagccacaaggacctgctgcggctgagccacctgaagcccagcagcgagggcctggccatcgtgaccaagtacatcaccaagggctggaaggaggtgcatgagctgtacaaggagaaggccctgtctgtggagacagagaagctgctgaagtacctggaggccgtggagaaggtgaagaggaccagagatgagctggaggtgatccacctgattgaggagcaccggctggtgcgggagcacctgctgaccaaccacctgaagagcaaggaggtgtggaaggccctgctgcaggagatgcccctgacagccctgctgaggaacctgggcaagatgacagccaacagcgtgctggagcccggcaacagcgaggtgtccctggtgtgtgagaagctgtgcaatgagaagctgctgaagaaggcccgcatccaccccttccacatcctgattgccctggagacctacaagacaggccacggcctgcggggcaagctgaagtggaggccagatgaggagatcctgaaggccctggatgctgccttctacaagaccttcaagacagtggagcccaccgggaagcgcttcctgctggccgtggatgtgtctgcctccatgaaccagagggtgctgggcagcatcctgaatgccagcacagtggccgccgccatgtgcatggtggtgaccaggacagagaaggacagctatgtggtggccttcagtgatgagatggtgccctgccctgtgaccacagacatgaccctgcagcaggtgctgatggccatgagccagatcccagctgggggcacagactgcagcctgcccatgatctgggcccagaagaccaacaccccagcagatgtgttcatcgtgttcacagacaatgagacctttgctgggggcgtgcacccagccatcgccctgcgggagtacaggaagaagatggacatcccagccaagctgattgtgtgtggcatgaccagcaatggcttcaccatcgctgaccctgatgaccggggcatgctggacatgtgtggctttgacaccggggccctggacccctgcaagatcccctactag

SEQ ID NO: 174584 - DNA, 1617 bp, Artificial Sequence; identical to SEQ ID NO: 174580
  Description of Artificial Sequence: Synthetic coding sequence

SEQ ID NO: 174585 - DNA, 1617 bp, Artificial Sequence; identical to SEQ ID NO: 174580
  Description of Artificial Sequence: Synthetic coding sequence

SEQ ID NO: 174586 - DNA, 792 bp, Artificial Sequence
  Description of Artificial Sequence: Synthetic coding sequence
atgcccctgacagccctgctgaggaacctgggcaagatgacagccaacagcgtgctggagcccggcaacagcgaggtgtccctggtgtgtgagaagctgtgcaatgagaagctgctgaagaaggcccgcatccaccccttccacatcctgattgccctggagacctacaagacaggccacggcctgcggggcaagctgaagtggaggccagatgaggagatcctgaaggccctggatgctgccttctacaagaccttcaagacagtggagcccaccgggaagcgcttcctgctggccgtggatgtgtctgcctccatgaaccagagggtgctgggcagcatcctgaatgccagcacagtggccgccgccatgtgcatggtggtgaccaggacagagaaggacagctatgtggtggccttcagtgatgagatggtgccctgccctgtgaccacagacatgaccctgcagcaggtgctgatggccatgagccagatcccagctgggggcacagactgcagcctgcccatgatctgggcccagaagaccaacaccccagcagatgtgttcatcgtgttcacagacaatgagacctttgctggaggagtgcacccagccatcgccctgcgggagtacaggaagaagatggacatcccagccaagctgattgtgtgtggcatgaccagcaatggcttcaccatcgctgaccctgatgaccggggcatgctggacatgtgtggctttgacacaggagccctggatgtgatccggaacttcaccctggacatgatctag

SEQ ID NO: 174587 - DNA, 126 bp, Artificial Sequence
  Description of Artificial Sequence: Synthetic coding sequence
atggaggagagcgtgaaccagatgcagcccctgaatgagaagcagatcgccaacagccaggacggctacgtgtggcaggtgacagacatgaaccggctgcaccgcttcctgtgcttcggcagctag

SEQ ID NO: 174588 - DNA, 1050 bp, Artificial Sequence
  Description of Artificial Sequence: Synthetic coding sequence
atggccgccagcgaggccgctgtggtgagcagccccagcctgaagacagacaccagccctgtgctggagacagctggcaccgtggccgccatggccgccacccccagcgcccgggctgctgctgctgtggtggccgctgctgccaggacaggcagcgaggcccgggtgtccaaggccgccctggccaccaagctgctgagcctgtctggagtgtttgctgtgcacaagcccaagggccccaccagcgctgagctgctgaaccggctgaaggagaagctgctggccgaggccggcatgcccagccctgagtggaccaagaggaagaagcagaccctgaagattggccacggcggcaccctggacagcgctgcccggggcgtgctggtggtgggcatcggcagcggcaccaagatgctgacctccatgctgagcggcagcaagcgctacacagccatcggggagctgggcaaggccacagacaccctggacagcacaggccgggtgacagaggagaagccctatgacaagatcacccaggaggacatcgagggcatcctgcagaagttcaccggcaacatcatgcaggtgccccccctgtacagcgccctgaagaaggatggccagaggctgagcaccctgatgaagagaggagaggtggtggaggccaagccagcccggcctgtgacagtgtacagcatcagcctgcagaagttccagccccccttcttcaccctggatgtggagtgtggcggcggcttctacatccgcagcctggtgtctgacatcggcaaggagctgagcagctgtgccaacgtgctggagctgaccaggaccaagcagggccccttcaccctggaggagcacgccctgcctgaggacaagtggaccattgatgacatcgcccagagcctggagcactgcagcagcctcttccctgctgagctggccctgaagaagagcaagccagagagcaatgagcaggtgctgagctgtgagtacatcaccctgaatgagcccaagcgggaggatgatgtgatcaagacctgctag

SEQ ID NO: 174589 - DNA, 996 bp, Artificial Sequence
  Description of Artificial Sequence: Synthetic coding sequence
atgggcagcgctggcctgagccggctgcacggcctgtttgctgtgtacaagcccccaggcctgaagtggaagcacctgcgggacacagtggagctgcagctgctgaagggcctgaatgccaggaagcccccagcccccaagcagagggtgcgcttcctgctgggccccatggagggcagcgaggagaaggagctgaccctgacagccacctctgtgcccagcttcatcaaccaccccctggtgtgtggccctgcctttgcccacctgaaggtgggcgtgggccaccggctggatgcccaggccagcggcgtgctggtgctgggcgtgggccacggctgccgcctgctgacagacatgtacaatgcccacctgaccaaggactacacagtgcggggcctgctgggcaaggccacagatgacttcagagaagatggccgcctggtggagaagaccacctatgaccacgtgacccgggagaagctggaccgcatcctggccgtcatccagggcagccaccagaaggccctggtgatgtacagcaacctggacctgaagacccaggaggcctatgagatggctgtgcggggcctcatccggcccatgaacaagagccccatgctgatcaccggcatccgctgcctgtactttgcccctcctgagttcctgctggaggtgcagtgcatgcatgagacccagaaggagctgaggaagctggtgcatgagatcggcctggagctgaagaccacagctgtgtgcacccaggtgcggaggaccagagatggcttcttcaccctggacagcgccctgctgcggacccagtgggacctgaccaacatccaggatgccatccgggccgccaccccccaggtggccgctgagctggagaagagcctgagccctggcctggacaccaagcagctgcccagccctggctggagctgggacagccagggccccagcagcaccctgggcctggagagaggagctggccagtag

SEQ ID NO: 174590 - DNA, 828 bp, Artificial Sequence
  Description of Artificial Sequence: Synthetic coding sequence
atggagggcagcgaggagaaggagctgaccctgacagccacctctgtgcccagcttcatcaaccaccccctggtgtgtggccctgcctttgcccacctgaaggtgggcgtgggccaccggctggatgcccaggccagcggcgtgctggtgctgggcgtgggccacggctgccgcctgctgacagacatgtacaatgcccacctgaccaaggactacacagtgcggggcctgctgggcaaggccacagatgacttcagagaagatggccgcctggtggagaagaccacctatgaccacgtgacccgggagaagctggaccgcatcctggccgtcatccagggcagccaccagaaggccctggtgatgtacagcaacctggacctgaagacccaggaggcctatgagatggctgtgcggggcctcatccggcccatgaacaagagccccatgctgatcaccggcatccgctgcctgtactttgcccctcctgagttcctgctggaggtgcagtgcatgcatgagacccagaaggagctgaggaagctggtgcatgagatcggcctggagctgaagaccacagctgtgtgcacccaggtgcggaggaccagagatggcttcttcaccctggacagcgccctgctgcggacccagtgggacctgaccaacatccaggatgccatccgggccgccaccccccaggtggccgctgagctggagaagagcctgagccctggcctggacaccaagcagctgcccagccctggctggagctgggacagccagggccccagcagcaccctgggcctggagagaggagctggccagtag

SEQ ID NO: 174591 - DNA, 1701 bp, Artificial Sequence
  Description of Artificial Sequence: Synthetic coding sequence
atgaggcggcagtggggcagcgccatgagagctgctgagcaggccggctgcatggtgtctgccagccgggccggccagcctgaggccggcccctggagctgcagcggggtcatcctgagccgcagccctggcctggtgctgtgccacggcggcatctttgtgcccttcctgcgggccggcagcgaggtgctgacagctgctggagctgtgttcctgcccggggacagctgcagagatgacctgcggctgcacgtgcagtgggcccccacagctgctggccctgggggcggcgctgagcggggccggcccggcctgtgcaccccccagtgtgccagcctggagcccggccccccagcccccagccggggccggcccctgcagccccggctgcctgctgagctgctgctgctgctgagctgcccagccttctgggcccactttgcccggctgtttggagatgaagctgctgagcagtggaggttcagcagcgctgccagagatgatgaggtgtctgaagatgaggaggccgaccagctgcgggccctgggctggtttgccctgctgggcgtgcggctgggccaggaggaggtggaggaggagcggggccctgccatggctgtgagccccctgggcgctgtgcccaagggggcccccctgctggtgtgtggcagcccctttggagccttctgcccagacatcttcctgaacaccctgagctgtggggtgctgagcaatgtggccggccccctgctgctgacagatgcccgctgcctgcctggaacagaaggaggaggagtcttcaccgcccggcctgctggggccctggtggccctggtggtggcccccctgtgctggaaggccggggagtgggtgggcttcaccctgctgtgtgccgccgcccccctcttccgggccgccagagatgccctgcaccggctgccccacagcacagctgccctggccgccctgctgcccccagaggtgggcgtgccctggggcctgcccctgcgggacagcggccccctgtgggccgctgctgctgtgctggtggagtgtggcaccgtgtggggcagcggcgtggccgtggccccccggctggtggtgacctgccgccacgtgagcccccgggaggccgcccgggtgctggtgcgcagcaccacccccaagtctgtggccatctggggccgggtggtgtttgccacccaggagacctgcccctatgacattgctgtggtgtccctggaggaggacctggatgatgtgcccatccctgtgcctgctgagcacttccatgaaggagaggccgtgtctgtggtgggctttggagtgtttggccagagctgtggccccagcgtgaccagcggcatcctgtctgctgtggtgcaggtgaatggcacccctgtgatgctgcagaccacctgtgctgtgcacagcggcagcagcggcggccccctcttcagcaaccacagcggcaacctgctgggcatcatcaccagcaacacccgggacaacaacacaggagccacctacccccacctgaacttcagcatccccatcaccgtgctgcagcctgccctgcagcagtacagccagacccaggacctgggcggcctgcgggagctggacagagctgctgagcctgtgcgggtggtgtggaggctgcagaggcccctggccgaggcccccaggagcaagctgtag

SEQ ID NO: 174592 - DNA, 1197 bp, Artificial Sequence
  Description of Artificial Sequence: Synthetic coding sequence
atgaggcggcagtggggcagcgccatgagagctgctgagcaggccggctgcatggtgtctgccagccgggccggccagcctgaggccggcccctggagctgcagcggggtcatcctgagccgcagccctggcctggtgctgtgccacggcggcatctttgtgcccttcctgcgggccggcagcgaggtgctgacagctgctggagctgtgttcctgcccggggacagctgcagagatgacctgcggctgcacgtgcagtgggcccccacagctgctggccctgggggcggcgctgagcggggccggcccggcctgtgcaccccccagtgtgccagcctggagcccggccccccagcccccagccggggccggcccctgcagccccggctgcctgctgagctgctgctgctgctgagctgcccagccttctgggcccactttgcccggctgtttggagatgaagctgctgagcagtggaggttcagcagcgctgccagagatgatgaggtgtctgaagatgaggaggccgaccagctgcgggccctgggctggtttgccctgctgggcgtgcggctgggccaggaggaggtggaggaggagcggggccctgccatggctgtgagccccctgggcgctgtgcccaagggggcccccctgctggtgtgtggcagcccctttggagccttctgcccagacatcttcctgaacaccctgagctgtggggtgctgagcaatgtggccggccccctgctgctgacagatgcccgctgcctgcctggaacagaaggaggaggagtcttcaccgcccggcctgctggggccctggtggccctggtggtggcccccctgtgctggaaggccggggagtgggtgggcttcaccctgctgtgtgccgccgcccccctcttccgggccgccagagatgccctgcaccggctgccccacagcacagctgccctggccgccctgctgcccccagaggtgggcgtgccctggggcctgcccctgcgggacagcggccccctgtgggccgctgctgctgtgctggtggagtgtggcaccgtgtggggcagcggcgtggccgtggccccccggctggtggtgacctgccgccacgtgagcccccgggaggccgcccgggtgctggtgcgcagcaccacccccaagcacaaccaccagcagcaccctggccagtag

SEQ ID NO: 174593 - DNA, 828 bp, Artificial Sequence
  Description of Artificial Sequence: Synthetic coding sequence
atgctgaacctgctgctgctggccctgcctgtgctggccagccgggcctatgctgccccagcccctggccaggccctgcagagggtgggcatcgtgggcggccaggaggcccccaggagcaagtggccctggcaggtgtccctgcgggtgcacggcccctactggatgcacttctgtggcggcagcctcatccacccccagtgggtgctgacagctgcccactgtgtgggcccagatgtgaaggacctggccgccctgcgggtgcagctgcgggagcagcacctgtactaccaggaccagctgctgcctgtgagccgcatcatcgtgcacccccagttctacacagcccagatcggggctgacatcgccctgctggagctggaggagcctgtgaatgtgagcagccacgtgcacacagtgaccctgcccccagccagcgagaccttccccccaggcatgccctgctgggtgacaggctggggagatgtggacaatgatgagcggctgcccccacccttccccctgaagcaggtgaaggtgcccatcatggagaaccacatctgtgatgccaagtaccacctgggcgcctacacaggagatgatgtgcgcatcgtgagagatgacatgctgtgtgccggcaacacccggcgggacagctgccagggcgacagcggcggccccctggtgtgcaaggtgaatggcacctggctgcaggccggcgtggtgtcctggggcgagggctgtgcccagcccaaccggcccggcatctacaccagggtgacctactacctggactggatccaccactacgtgcccaagaagccctag

SEQ ID NO: 174594 - DNA, 849 bp, Artificial Sequence
  Description of Artificial Sequence: Synthetic coding sequence
atgctgctgctggccccccagatgctgaacctgctgctgctggccctgcctgtgctggccagccgggcctatgctgccccagcccctggccaggccctgcagagggtgggcatcgtgggcggccaggaggcccccaggagcaagtggccctggcaggtgtccctgcgggtgcacggcccctactggatgcacttctgtggcggcagcctcatccacccccagtgggtgctgacagctgcccactgtgtgggcccagatgtgaaggacctggccgccctgcgggtgcagctgcgggagcagcacctgtactaccaggaccagctgctgcctgtgagccgcatcatcgtgcacccccagttctacacagcccagattggagctgacatcgccctgctggagctggaggagcctgtgaatgtgagcagccacgtgcacacagtgaccctgcccccagccagcgagaccttccccccaggcatgccctgctgggtgacaggctggggagatgtggacaatgatgagcggctgcccccacccttccccctgaagcaggtgaaggtgcccatcatggagaaccacatctgtgatgccaagtaccacctgggcgcctacacaggagatgatgtgagaattgtgagagatgacatgctgtgtgccggcaacacccggcgggacagctgccagggcgacagcggcggccccctggtgtgcaaggtgaatggcacctggctgcaggccggcgtggtgtcctggggcgagggctgtgcccagcccaacagacctggcatctacaccagggtgacctactacctggactggatccaccactacgtgcccaagaagccctag

SEQ ID NO: 174595 - DNA, 2532 bp, Artificial Sequence
  Description of Artificial Sequence: Synthetic coding sequence
atgtggggccgcctgtggcccctgctgctgagcatcctgacagccacagctgtgcccggccccagcctgcggcggcccagccgggagctggatgccacccccaggatgaccatcccctatgaggagctgagcggcaccaggcacttcaagggccaggcccagaactacagcaccctgctgctggaggaggccagcgcccggctgctggtgggcgcccggggggccctcttcagcctgagcgccaatgacattggagatggagcccacaaggagatccactgggaggccagccctgagatgcagagcaagtgccaccagaagggcaagaacaaccagacagagtgcttcaaccacgtgcgcttcctgcagaggctgaacagcacccacctgtatgcctgtggcacccacgccttccagcccctgtgtgccgccattgatgctgaggccttcaccctgcccaccagctttgaggagggcaaggagaagtgcccctatgaccctgcccggggcttcaccggcctcatcattgatggcggcctgtacacagccaccaggtatgagttccgcagcatcccagacatcagaagaagccgccacccccacagcctgaggacagaggagacccccatgcactggctgaatgatgctgagtttgtgttttctgtgctggtgcgggagagcaaggccagcgctgtgggagatgatgacaaggtgtactacttcttcacagagcgggccacagaggagggcagcggcagcttcacccagagccgcagcagccaccgggtggcccgggtggcccgggtgtgcaagggggacctgggcggcaagaagatcctgcagaagaagtggaccagcttcctgaaggcccggctcatctgccacatccccctgtatgagaccctgcggggcgtgtgcagcctggatgctgagaccagcagcaggacccacttctacgccgccttcaccctgagcacccagtggaagaccctggaggccagcgccatctgccgctatgacctggccgagatccaggccgtgtttgctggcccctacatggagtaccaggacggcagccgccgctggggccgctatgaaggaggagtgcctgagccccggcccggcagctgcatcacagacagcctgcggagccagggctacaacagcagccaggacctgcccagcctggtgctggactttgtgaagctgcaccccctgatggcccggcctgtggtgcccacccggggccggcccctgctgctgaagaggaacatccgctacacccacctgaccggcacccctgtgaccaccccagctggccccacctatgacctgctcttcctgggcacagcagatggctggatccacaaggctgtggtgctgggcagcggcatgcacatcatcgaggagacccaggtgttccgggagagccagagcgtggagaacctggtgatcagcctgctgcagcacagcctgtatgtgggcgcccccagcggggtcatccagctgcccctgagcagctgcagccgctaccgcagctgctatgactgcatcctggcccgggacccctactgcggctgggaccccggcacccacgcctgtgccgccgccaccaccatcgccaacagaagccagggcagcaggacagccctgatccaggacatcgagcggggcaacagaggctgtgagagcagccgggacaccggccccccaccacccctgaagaccaggtctgtgctgcggggagatgatgtgctgctgccctgtgaccagcccagcaacctggcccgggccctgtggctgctgaatggctccatgggcctgagtgatggccagggcggctacagagtgggcgtggatggcctgctggtgacagatgcccagcctgagcacagcggcaactacggctgctacgcagaagaaaatggcctgcggaccctgctggccagctacagcctgactgtgcggcctgccaccccagccccagcccccaaggccccagccacccctggggcccagctggccccagatgtgcggctgctgtatgtgctggccatcgccgccctgggcggcctgtgcctgatcctggccagcagcctgctgtatgtggcctgcctgcgggagggccggcggggcagaagaaggaagtacagcctgggccgggccagcagagctgggggcagcgctgtgcagctgcagacagtgtctggccagtgccctggagaagaagatgaaggagatgatgagggcgccggcggcctggagggcagctgcctgcagatcatccctggagagggcgccccagcccctcctcctcctcctcctcctcctcctcctgctgagctgaccaacggcctggtggccctgcccagccggctgcggaggatgaatggaaacagctatgtgctgctgcggcagagcaacaatggagtgcctgctggcccctgcagctttgctgaggagctgagccgcatcctggagaagaggaagcacacccagctggtggagcagctggatgagagctctgtgtag

SEQ ID NO: 174596 - DNA, 708 bp, Artificial Sequence
  Description of Artificial Sequence: Synthetic coding sequence
atgctgagcctgctgctgctggccctgcctgtgctggccagccctgcctacgtggccccagcccctggccaggccctgcagcagacaggaattgtgggcggccaggaggcccccaggagcaagtggccctggcaggtgtccctgcgggtgcggggcccctactggatgcacttctgtggcggcagcctcatccacccccagtgggtgctgacagctgcccactgtgtggagccagacatcaaggacctggccgccctgcgggtgcagctgcgggagcagcacctgtactaccaggaccagctgctgcctgtgagccgcatcatcgtgcacccccagttctacatcatccagacaggagctgacatcgccctgctggagctggaggagcctgtgaacatcagcagccacatccacacagtgaccctgcccccagccagcgagaccttccccccaggcatgccctgctgggtgacaggctggggagatgtggacaacaacgtgcacctgcccccaccctaccccctgaaggaggtggaggtgcctgtggtggagaaccacctgtgcaatgctgagtaccacacaggcctgcacacaggccacagcttccagatcgtgagagatgacatgctgtgtgccggctctgaaaatcatgacagctgccagggcgacagcggcggccccctggtgtgcaaggtgaatggcacctag

SEQ ID NO: 174597 - DNA, 4281 bp, Artificial Sequence
  Description of Artificial Sequence: Synthetic coding sequence
atgcacagcagcaaccccaaggtgcgcagcagccccagcggcaacacccagagcagccccaagagcaagcaggaggtgatggtgcggccccccaccgtgatgagccccagcggcaacccccagctggacagcaagttcagcaaccagggcaagcagggcggcagcgccagccagagccagcccagcccctgtgacagcaagagcggcggccacacccccaaggccctgcccggccctgggggctccatgggcctgaagaatggagctggaaatggagccaagggcaagggcaagcgggagaggagcatctctgctgacagctttgaccagagggaccccggcaccccaaatgatgacagcgacatcaaggagtgcaacagcgctgaccacatcaagagccaggacagccagcacaccccccacagcatgacccccagcaatgccacagcccccaggagcagcacccccagccacggccagaccacagccacagagcccaccccagcccagaagaccccagccaaggtggtgtatgtgttcagcacagagatggccaacaaggctgctgaggccgtgctgaagggccaggtggagaccatcgtgtccttccacatccagaacatcagcaacaacaagacagagaggagcacagcccccctgaacacccagatcagcgccctgagaaatgaccccaagcccctgccccagcagcccccagccccagccaaccaggaccagaacagcagccagaacacccggctgcagcccaccccacccatcccagccccagcccccaagccagctgccccaccccggcccctggaccgggagagccctggggtggagaacaagctgatccccagcgtgggcagccctgccagcagcacccccctgcccccagatggcaccggccccaacagcacccccaacaacagagctgtgacccctgtgtcccagggcagcaacagcagcagcgctgaccccaaggcccctcctcctcctcctgtgagcagcggggagccccccaccctgggggagaacccagatggcctgagccaggagcagctggagcaccgggagaggagcctgcagaccctgcgggacatccagaggatgctgttcccagatgagaaggagttcaccggggcccagagcggcggcccccagcagaaccctggggtgctggatggcccccagaagaagccagagggccccatccaggccatgatggcccagagccagagcctgggcaagggccctggccccaggacagatgtgggcgcccccttcggcccccagggccacagagatgtgcccttctccccagatgagatggtgcccccatccatgaacagccagagcggcaccatcggccctgaccacctggaccacatgaccccagagcagatcgcctggctgaagctgcagcaggagttctatgaggagaagaggaggaagcaggagcaggtggtggtgcagcagtgcagcctgcaggacatgatggtgcaccagcacggcccccggggcgtggtgcggggccccccaccaccctaccagatgaccccatctgagggctgggcccctgggggcacagagcccttcagtgatggcatcaacatgccccacagcctgcccccccggggcatggccccccaccccaacatgcctggcagccagatgaggctgcccggctttgctggcatgatcaacagcgagatggagggccccaacgtgcccaacccagccagcaggcctggcctgagcggcgtgtcctggccagatgatgtgcccaagatcccagatggaagaaacttccccccaggccagggcatcttcagcggccctggccgcggggagcgcttccccaacccccagggcctgtctgaggagatgttccagcagcagctggccgagaagcagctgggcctgcccccaggcatggccatggagggcatccggcccagcatggagatgaacaggatgatccctggcagccagaggcacatggagcccggcaacaaccccatcttcccccgcatccctgtggagggccccctgagccccagcagaggagacttccccaagggcatccccccccagatgggccctggccgggagctggagtttggcatggtgcccagcggcatgaagggagatgtgaacctgaatgtgaacatgggcagcaacagccagatgatcccccagaagatgagggaggccggggccggccctgaggagatgctgaagctgcggcctgggggcagtgacatgctgcctgcccagcagaagatggtgcccctgccctttggagagcacccccagcaggagtatggcatgggcccccggcccttcctgcccatgagccagggccctggcagcaacagcggcctgaggaacctgcgggagcccatcggccctgaccagaggaccaacagccggctgagccacatgccacccctgcccctgaaccccagcagcaaccccaccagcctgaacacagcccctcctgtgcagaggggcctgggcaggaagcccctggacatctctgtggccggcagccaggtgcacagccctggcatcaaccccctgaagagccccaccatgcaccaggtgcagagccccatgctgggcagccccagcggcaacctgaagagcccccagacccccagccagctggccggcatgctggccggccctgctgctgctgccagcatcaagagcccccctgtgctgggcagcgctgctgccagccctgtgcacctgaagagccccagcctgcctgcccccagccctggctggaccagcagccccaagccacccctgcagagccctggcatcccccccaaccacaaggcccccctgaccatggccagccctgccatgctgggcaatgtggagagcggcggccccccaccacccacagccagccagcctgcctctgtgaacatccctggcagcctgcccagcagcaccccctacaccatgcctcctgagcccaccctgagccagaaccccctgagcatcatgatgagcaggatgagcaagtttgccatgcccagcagcacccccctgtaccatgatgccatcaagacagtggccagcagtgatgatgacagccccccagcccggagccccaacctgcccagcatgaacaacatgcctggcatgggcatcaacacccagaacccccgcatcagcggccccaaccctgtggtgcccatgcccaccctgagccccatgggcatgacccagcccctgagccacagcaaccagatgcccagccccaatgctgtgggccccaacatcccccctcatggagtgcccatgggccctggcctgatgagccacaaccccatcatgggccacggcagccaggagccccccatggtgccccagggccgcatgggcttcccccagggcttcccccctgtgcagagccccccccagcaggtgcccttcccccacaacggccccagcggcggccagggcagcttccctgggggcatgggcttccctggagagggccccctgggccggcccagcaacctgccccagagcagcgcagatgctgccctgtgcaagccaggcggccctgggggccctgacagcttcaccgtgctgggcaacagcatgcccagcgtcttcacagatcctgacctgcaggaggtgatccggcctggggccaccggcatccctgagtttgacctgagccgcatcatccccagcgagaagcccagccagaccctgcagtacttccccagaggagaggtgcccggcaggaagcagccccagggccctggccctggcttcagccacatgcagggcatgatgggagagcaggcccccaggatgggcctggccctgcccggcatgggcggccctggccctgtgggcaccccagacatccccctgggcacagcccccagcatgcctggccacaaccccatgaggcccccagccttcctgcagcagggcatgatgggcccccaccacaggatgatgagccctgcccagagcaccatgcctggccagcccaccctgatgagcaacccagctgctgctgtgggcatgatccctgggaaggaccggggccctgctggcctgtacacccaccctggccctgtgggcagccctggcatgatgatgtccatgcagggcatgatgggcccccagcagaacatcatgatccccccccagatgaggccccggggcatggctgctgatgtgggcatgggcggcttcagccagggccctggcaaccctggcaacatgatgttttag

SEQ ID NO: 174598 - DNA, 1221 bp, Artificial Sequence
  Description of Artificial Sequence: Synthetic coding sequence
atgagcggctgccccttcctgggcaacaactttggctacaccttcaagaagctgcctgtggagggcagcgaggaggacaagagccagacaggagtgaacagagccagcaaaggaggcctcatctacggcaactacctgcacctggagaaggtgctgaatgcccaggagctgcagagcgagaccaagggcaacaagatccatgatgagcacctgttcatcatcacccaccaggcctatgagctgtggttcaagcagatcctgtgggagctggacagcgtgcgggagatcttccagaatggacatgtgagagatgagaggaacatgctgaaggtggtgtccaggatgcaccgggtgtctgtcatcctgaagctgctggtgcagcagttcagcatcctggagaccatgacagccctggacttcaatgacttccgggagtacctgagccctgccagcggcttccagagcctgcagttccggctgctggagaacaagattggagtgctgcagaacatgagggtgccctacaacagaagacactacagagacaacttcaagggggaggagaatgagctgctgctgaagtctgagcaggagaagaccctgctggagctggtggaggcctggctggagaggaccccaggcctggagccccacggcttcaacttctggggcaagctggagaagaacatcacccggggcctggaggaggagttcatccgcatccaggccaaggaggagagcgaggagaaggaggagcaggtggccgagttccagaagcagaaggaggtgctgctgagcctgtttgatgagaagagacatgagcacctgctgagcaaaggagagcggcggctgagctaccgggccctgcagggcgccctgatgatctacttctaccgggaggagccccgcttccaggtgcccttccagctgctgaccagcctgatggacatcgacagcctgatgaccaagtggagatacaaccacgtgtgcatggtgcacaggatgctgggcagcaaggccggcaccggcggcagcagcggctaccactacctgcggagcacagtgtctgaccgctacaaggtgtttgtggacctcttcaacctgagcacctacctgatccccaggcactggatccccaagatgaaccccaccatccacaagttcctgtacacagctgagtactgtgacagcagctacttcagcagtgatgaaagtgactag

SEQ ID NO: 174599 - DNA, 1335 bp, Artificial Sequence
  Description of Artificial Sequence: Synthetic coding sequence
atgattgaggacaacaaggagaacaaggaccacagcctggagcggggccgggccagcctcatcttcagcctgaagaatgaggtgggcggcctcatcaaggccctgaagatcttccaggagaagcacgtgaacctgctgcacatcgagagcaggaagagcaagagaagaaacagcgagtttgagatctttgtggactgtgacatcaaccgggagcagctgaatgacatcttccacctgctgaagagccacaccaacgtgctgtctgtgaacctgcctgacaacttcaccctgaaggaggatggcatggagaccgtgccctggttccccaagaagatcagtgacctggaccactgtgccaacagagtgctgatgtatggcagcgagctggatgctgaccaccctggcttcaaggacaacgtgtacaggaagaggaggaagtactttgctgacctggccatgaactacaagcatggagaccccatccccaaggtggagttcacagaggaggagatcaagacctggggcaccgtcttccaggagctgaacaagctgtaccccacccacgcctgccgggagtacctgaagaacctgcccctgctgagcaagtactgcggctaccgggaggacaacatcccccagctggaggatgtgagcaacttcctgaaggagaggacaggcttcagcatccggcctgtggccggctacctgagcccccgggacttcctgagcggcctggccttccgggtcttccactgcacccagtatgtgcgccacagcagtgaccccttctacaccccagagccagacacctgccacgagctgctgggccacgtgcccctgctggccgagcccagctttgcccagttcagccaggagatcggcctggccagcctgggcgccagcgaggaggccgtgcagaagctggccacctgctacttcttcaccgtggagtttggcctgtgcaagcaggacggccagctgcgggtgtttggagctggcctgctgagcagcatcagcgagctgaagcacgccctgagcggccacgccaaggtgaagccctttgaccccaagatcacctgcaagcaggagtgcctgatcaccaccttccaggatgtgtactttgtgtctgagagctttgaagatgccaaggagaagatgagggagttcaccaagaccatcaagaggccctttggagtgaagtacaacccctacaccaggagcatccagatcctgaaggacaccaagagcatcaccagcgccatgaatgagctgcagcacgacctggatgtggtgtctgatgccctggccaaggtgtccaggaagcccagcatctag

SEQ ID NO: 174600 - DNA, 1401 bp, Artificial Sequence
  Description of Artificial Sequence: Synthetic coding sequence
atgattgaggacaacaaggagaacaaggaccacagcctggagcggggccgggccagcctcatcttcagcctgaagaatgaggtgggcggcctcatcaaggccctgaagatcttccaggagaagcacgtgaacctgctgcacatcgagagcaggaagagcaagagaagaaacagcgagtttgagatctttgtggactgtgacatcaaccgggagcagctgaatgacatcttccacctgctgaagagccacaccaacgtgctgtctgtgaacctgcctgacaacttcaccctgaaggaggatggcatggagaccgtgccctggttccccaagaagatcagtgacctggaccactgtgccaacagagtgctgatgtatggcagcgagctggatgctgaccaccctggcttcaaggacaacgtgtacaggaagaggaggaagtactttgctgacctggccatgaactacaagcatggagaccccatccccaaggtggagttcacagaggaggagatcaagacctggggcaccgtcttccaggagctgaacaagctgtaccccacccacgcctgccgggagtacctgaagaacctgcccctgctgagcaagtactgcggctaccgggaggacaacatcccccagctggaggatgtgagcaacttcctgaaggagaggacaggcttcagcatccggcctgtggccggctacctgagcccccgggacttcctgagcggcctggccttccgggtcttccactgcacccagtatgtgcgccacagcagtgaccccttctacaccccagagccagacacctgccacgagctgctgggccacgtgcccctgctggccgagcccagctttgcccagttcagccaggagatcggcctggccagcctgggcgccagcgaggaggccgtgcagaagctggccacctgctacttcttcaccgtggagtttggcctgtgcaagcaggacggccagctgcgggtgtttggagctggcctgctgagcagcatcagcgagctgaagcacgccctgagcggccacgccaaggtgaagccctttgaccccaagatcacctgcaagcaggagtgcctgatcaccaccttccaggatgtgtactttgtgtctgagagctttgaagatgccaaggagaagatgagggagttcaccaagaccatcaagaggccctttggagtgaagtacaacccctacaccaggagcatccagatcctgaaggacaccaagagcatcaccagcgccatgaatgagctgcagcacgacctggatgtggtgtctgatgccctggccaagagcctgaatgaagatgtgctgcaggtgtctgtgtttgccctgctgctcttcctgcccagcctgcatggagagtgccacccagacacctag

SEQ ID NO: 174601 - DNA, 753 bp, Artificial Sequence
  Description of Artificial Sequence: Synthetic coding sequence
atgcagcctgccatgatgatgttcagcagcaagtactgggcccggcggggcttcagcctggacagcgctgtgcctgaggagcaccagctgctgggcagcagcaccctgaacaagcccaacagcggcaagaatgatgacaagggcaacaagggcagcagcaagcgggaggccgccacagaaagtggcaagacagctgtggtgttcagcctgaagaatgaggtgggcggcctggtgaaggccctgcggctcttccaggagaagagggtgaacatggtgcacatcgagagcaggaagagcagaagaagaagcagcgaggtggagatctttgtggactgtgaatgtgggaagacagagttcaatgagctgatccagctgctgaagttccagaccaccatcgtgaccctgaaccccccagagaacatctggacagaggaggaggagctggaggatgtgccctggttccccaggaagatcagcgagctggacaagtgcagccaccgggtgctgatgtatggcagcgagctggatgctgaccaccctggcttcaaggacaacgtgtaccggcagaggaggaagtactttgtggatgtggccatgggctacaagtatggcccccggctgctggccgccatcggggactgggagttccagctgttctctgtgagcagcagcctgagcagcagcagcctgtgcatgctgtctgtgcacatcctgatggatgtgcgcagcatcgtggtggccgtggacatctag

SEQ ID NO: 174602 - DNA, 1473 bp, Artificial Sequence
  Description of Artificial Sequence: Synthetic coding sequence
atgcagcctgccatgatgatgttcagcagcaagtactgggcccggcggggcttcagcctggacagcgctgtgcctgaggagcaccagctgctgggcagcagcaccctgaacaagcccaacagcggcaagaatgatgacaagggcaacaagggcagcagcaagcgggaggccgccacagaaagtggcaagacagctgtggtgttcagcctgaagaatgaggtgggcggcctggtgaaggccctgcggctcttccaggagaagagggtgaacatggtgcacatcgagagcaggaagagcagaagaagaagcagcgaggtggagatctttgtggactgtgaatgtgggaagacagagttcaatgagctgatccagctgctgaagttccagaccaccatcgtgaccctgaaccccccagagaacatctggacagaggaggaggagctggaggatgtgccctggttccccaggaagatcagcgagctggacaagtgcagccaccgggtgctgatgtatggcagcgagctggatgctgaccaccctggcttcaaggacaacgtgtaccggcagaggaggaagtactttgtggatgtggccatgggctacaagtatggccagcccatcccccgggtggagtacacagaggaggagaccaagacctggggcgtggtgttccgggagctgagcaagctgtaccccacccacgcctgccgggagtacctgaagaacttccccctgctgaccaagtactgcggctaccgggaggacaacgtgccccagctggaggatgtgtccatgttcctgaaggagaggagcggcttcaccgtgcggcctgtggccggctacctgagcccccgggacttcctggccggcctggcctacagagtcttccactgcacccagtacatccgccacggcagtgaccccctgtacaccccagagccagacacctgccacgagctgctgggccacgtgcccctgctggccgaccccaagtttgcccagttcagccaggagatcggcctggccagcctgggcgccagtgatgaagatgtgcagaagctggccacctgctacttcttcaccatcgagtttggcctgtgcaagcaggagggccagctgcgggcctacggggccggcctgctgagcagcatcggggagctgaagcacgccctgagtgacaaggcctgtgtgaaggcctttgaccccaagaccacctgcctgcaggagtgcctgatcaccaccttccaggaggcctactttgtgtctgagagctttgaggaggccaaggagaagatgagggactttgccaagagcatcacccggcccttctctgtgtacttcaacccctacacccagagcattgagatcctgaaggacaccaggagcattgaaaatgtggtgcaggacctgcggagtgacctgaacacagtgtgtgatgccctgaacaagatgaaccagtacctgggcatctag

SEQ ID NO: 174603 - DNA, 525 bp, Artificial Sequence
  Description of Artificial Sequence: Synthetic coding sequence
atgagcagcgctgctgctgaccactgggcctggctgctggtgctgagctttgtgtttggctgcaatgtgctgcgcatcctgctgcccagcttcagcagcttcatgagccgggtgctgcagaaggatgctgagcaggagagccagatgagagctgagatccaggacatgaagcaggagctgagcacagtgaacatgatggatgaatttgcccgctatgcccggctggagaggaagatcaacaagatgacagacaagctgaagacccacgtgaaggccaggacagcccagctggccaagatcaagtgggtgatctctgtggccttctacgtgctgcaggccgccctgatgatcagcctcatctggaagtactacagcgtgcctgtggccgtggtgcccagcaagtggatcacccccctggaccggctggtggccttccccaccagggtggccggcggcgtgggcatcacctgctggatcctggtgtgcaacaaggtggtggccatcgtgctgcaccccttctcctag

SEQ ID NO: 174604 - DNA, 423 bp, Artificial Sequence
  Description of Artificial Sequence: Synthetic coding sequence
atgagccgggtgctgcagaaggatgctgagcaggagagccagatgagagctgagatccaggacatgaagcaggagctgagcacagtgaacatgatggatgaatttgcccgctatgcccggctggagaggaagatcaacaagatgacagacaagctgaagacccacgtgaaggccaggacagcccagctggccaagatcaagtgggtgatctctgtggccttctacgtgctgcaggccgccctgatgatcagcctcatctggaagtactacagcgtgcctgtggccgtggtgcccagcaagtggatcacccccctggaccggctggtggccttccccaccagggtggccggcggcgtgggcatcacctgctggatcctggtgtgcaacaaggtggtggccatcgtgctgcaccccttctcctag

SEQ ID NO: 174605 - DNA, 423 bp, Artificial Sequence; identical to SEQ ID NO: 174604
  Description of Artificial Sequence: Synthetic coding sequence

SEQ ID NO: 174606 - DNA, 519 bp, Artificial Sequence
  Description of Artificial Sequence: Synthetic coding sequence
atgagcagcgctgctgctgaccactgggcctggctgctggtgctgagctttgtgtttggctgcaatgtgctgcgcatcctgctgcccagcttcagcagcttcatgagccgggtgctgcagaaggatgctgagcaggagagccagatgagagctgagatccaggacatgaagcaggagctgagcacagtgaacatgatggatgaatttgcccgctatgcccggctggagaggaagatcaacaagatgacagacaagctgaagacccacgtgaaggccaggacagcccagctggccaagatcaagtgggtgatctctgtggccttctacgtgctgcaggccgccctgatgatcagcctcatctggaagtactacagcgtgcctgtggccgtggtgcccagcaagtggatcacccccctggaccggctggtggccttccccaccagggtggccgtgttcagcagcagcatctggaccagcaagtgcttcagcagcccagacaagagcatcctggagaagtag

SEQ ID NO: 174607 - DNA, 1083 bp, Artificial Sequence
  Description of Artificial Sequence: Synthetic coding sequence
atggccctgcacagcatgaggaaggcccgggagcgctggagcttcatccgggccctgcacaagggcagcgctgctgccccagccctgcagaaggacagcaagaagagggtcttcagcggcatccagcccaccggcatcctgcacctgggcaactacctgggcgccatcgagagctgggtgcggctgcaggatgaatatgacagcgtgctgtacagcatcgtggacctgcacagcatcaccgtgccccaggaccctgctgtgctgcggcagagcatcctggacatgacagctgtgctgctggcctgtggcatcaaccctgagaagagcatcctcttccagcagagccaggtgtctgagcacacccagctgtcctggatcctgagctgcatggtgcggctgccccggctgcagcacctgcaccagtggaaggccaagaccaccaagcagaagcatgatggcaccgtgggcctgctgacctaccctgtgctgcaggccgctgacatcctgctgtacaagagcacccacgtgcctgtgggggaggaccaggtgcagcacatggagctggtgcaggacctggcccagggcttcaacaagaagtacggggagttcttccctgtgcctgagagcatcctgacctccatgaagaaggtgaagagcctgcgggaccccagcgccaagatgagcaagagtgaccctgacaagctggccaccgtgcgcatcacagacagccctgaggagatcgtgcagaagttcaggaaggctgtgacagacttcaccagcgaggtgacctatgaccctgctggccgggccggcgtgagcaacatcgtggccgtgcacgccgctgtgacaggcctgtctgtggaggaggtggtgcggcgctctgctggcatgaacacagcccgctacaagctggccgtggctgatgctgtgattgagaagtttgcccccatcaagcgggagattgagaagctgaagctggacaaggaccacctggagaaggtgctgcagatcggcagcgccaaggccaaggagctggcctacacagtgtgccaggaggtgaagaagctggtgggcttcctgtag

SEQ ID NO: 174608 - DNA, 663 bp, Artificial Sequence
  Description of Artificial Sequence: Synthetic coding sequence
atggccctgcacagcatgaggaaggcccgggagcgctggagcttcatccgggccctgcacaagggcagcgctgctgccccagccctgcagaaggacagcaagaagagggtcttcagcggcatccagcccaccggcatcctgcacctgggcaactacctgggcgccatcgagagctgggtgcggctgcaggatgaatatgacagcgtgctgtacagcatcgtggacctgcacagcatcaccgtgccccaggaccctgctgtgctgcggcagagcatcctggacatgacagctgtgctgctggcctgtggcatcaaccctgagaagagcatcctcttccagcagagccaggtgtctgagcacacccagctgtcctggatcctgagctgcatggtgcggctgccccggctgcagcacctgcaccagtggaaggccaagaccaccaagcagaagcatgatggcaccgtgggcctgctgacctaccctgtgctgcaggccgctgacatcctgctgtacaagagcacccacgtgcctgtgggggaggaccaggtgcagcacatggagctggtgcaggacctggcccagggcttcaacaagaagtacggggagttcttccctgtgcctgagagcatcctgtccatgtgtgtgctggtgttcctgacctag

SEQ ID NO: 174609 - DNA, 801 bp, Artificial Sequence
  Description of Artificial Sequence: Synthetic coding sequence
atgacagctgtgctgctggcctgtggcatcaaccctgagaagagcatcctcttccagcagagccaggtgtctgagcacacccagctgtcctggatcctgagctgcatggtgcggctgccccggctgcagcacctgcaccagtggaaggccaagaccaccaagcagaagcatgatggcaccgtgggcctgctgacctaccctgtgctgcaggccgctgacatcctgctgtacaagagcacccacgtgcctgtgggggaggaccaggtgcagcacatggagctggtgcaggacctggcccagggcttcaacaagaagtacggggagttcttccctgtgcctgagagcatcctgacctccatgaagaaggtgaagagcctgcgggaccccagcgccaagatgagcaagagtgaccctgacaagctggccaccgtgcgcatcacagacagccctgaggagatcgtgcagaagttcaggaaggctgtgacagacttcaccagcgaggtgacctatgaccctgctggccgggccggcgtgagcaacatcgtggccgtgcacgccgctgtgacaggcctgtctgtggaggaggtggtgcggcgctctgctggcatgaacacagcccgctacaagctggccgtggctgatgctgtgattgagaagtttgcccccatcaagcgggagattgagaagctgaagctggacaaggaccacctggagaaggtgctgcagatcggcagcgccaaggccaaggagctggcctacacagtgtgccaggaggtgaagaagctggtgggcttcctgtag

SEQ ID NO: 174610 - DNA, 1293 bp, Artificial Sequence
  Description of Artificial Sequence: Synthetic coding sequence
atgctggtgtccctgaagatgagctacaaggctgctgctggggaggactacaaggctgactgccccccaggcaacccagcccccaccagcaaccacggcccagatgccacagaagcagaagaagattttgtggacccctggacagtgcagaccagcagcgccaagggcattgattatgacaagctgattgtgcgcttcggcagcagcaagattgacaaggagctgatcaacagaattgagcgggccaccggccagaggccccaccacttcctgcggcggggcatcttcttcagccaccgggacatgaaccaggtgctggatgcctatgagaacaagaagcccttctacctgtacacaggccggggccccagcagcgaggccatgcacgtgggccacctgatccccttcatcttcaccaagtggctgcaggatgtgttcaacgtgcccctggtgatccagatgacagatgatgagaagtacctgtggaaggacctgaccctggaccaggcctacagctatgctgtggagaatgccaaggacatcatcgcctgtggctttgacatcaacaagaccttcatcttcagtgacctggactacatgggcatgagcagcggcttctacaagaatgtggtgaagatccagaagcacgtgaccttcaaccaggtgaagggcatcttcggcttcacagacagcgactgcatcggcaagatctccttccctgccatccaggccgcccccagcttcagcaacagcttcccccagatcttccgggacagaacagacatccagtgcctgatcccctgtgccatcgaccaggacccctacttcaggatgaccagagatgtggccccccgcatcggctaccccaagccagccctgctgcacagcaccttcttccctgccctgcagggcgcccagaccaagatgtctgccagtgaccccaacagcagcatcttcctgacagacacagccaagcagatcaagaccaaggtgaacaagcacgccttcagcggcggccgggacaccatcgaggagcaccggcagtttggaggcaactgtgatgtggatgtgtccttcatgtacctgaccttcttcctggaggatgatgacaagctggagcagatcaggaaggactacaccagcggggccatgctgaccggggagctgaagaaggccctgattgaggtgctgcagcccctgattgctgagcaccaggcccggaggaaggaggtgacagatgaaattgtgaaggagttcatgacccccaggaagctgagctttgacttccagtag

SEQ ID NO: 174611 - DNA, 1416 bp, Artificial Sequence
  Description of Artificial Sequence: Synthetic coding sequence
atgcccaacagcgagcccgccagcctgctggagctgttcaacagcatcgccacccagggcgagctggtgcgcagcctgaaggctggaaatgccagcaaggatgaaattgacagcgctgtgaagatgctggtgtccctgaagatgagctacaaggctgctgctggggaggactacaaggctgactgccccccaggcaacccagcccccaccagcaaccacggcccagatgccacagaggccgaggaggactttgtggacccctggacagtgcagaccagcagcgccaagggcatcgactatgacaagctgattgtgcgcttcggcagcagcaagattgacaaggagctgatcaaccgcatcgagcgggccaccggccagaggccccaccacttcctgcggcggggcatcttcttcagccaccgggacatgaaccaggtgctggatgcctatgagaacaagaagcccttctacctgtacacaggccggggccccagcagcgaggccatgcacgtgggccacctgatccccttcatcttcaccaagtggctgcaggatgtgttcaacgtgcccctggtgatccagatgacagatgatgagaagtacctgtggaaggacctgaccctggaccaggcctacagctatgctgtggagaatgccaaggacatcatcgcctgtggctttgacatcaacaagaccttcatcttcagtgacctggactacatgggcatgagcagcggcttctacaagaatgtggtgaagatccagaagcacgtgaccttcaaccaggtgaagggcatcttcggcttcacagacagcgactgcatcggcaagatctccttccctgccatccaggccgcccccagcttcagcaacagcttcccccagatcttccgggacagaacagacatccagtgcctgatcccctgtgccatcgaccaggacccctacttcaggatgaccagagatgtggcccccagaattggctaccccaagccagccctgctgcacagcaccttcttccctgccctgcagggcgcccagaccaagatgtctgccagtgaccccaacagcagcatcttcctgacagacacagccaagcagatcaagaccaaggtgaacaagcacgccttcagcggcggccgggacaccatcgaggagcaccggcagtttggaggcaactgtgatgtggatgtgtccttcatgtacctgaccttcttcctggaggatgatgacaagctggagcagatcaggaaggactacaccagcggggccatgctgactggagagctgaagaaggccctgattgaggtgctgcagcccctgattgctgagcaccaggcccggaggaaggaggtgacagatgagatcgtgaaggagttcatgacccccaggaagctgagctttgacttccagtag

SEQ ID NO: 174612 - DNA, 1293 bp, Artificial Sequence; identical to SEQ ID NO: 174610
  Description of Artificial Sequence: Synthetic coding sequence

SEQ ID NO: 174613 - DNA, 1416 bp, Artificial Sequence; identical to SEQ ID NO: 174611
  Description of Artificial Sequence: Synthetic coding sequence

SEQ ID NO: 174614 - DNA, 684 bp, Artificial Sequence
  Description of Artificial Sequence: Synthetic coding sequence
atgctggtgtccctgaagatgagctacaaggctgctgctggggaggactacaaggctgactgccccccaggcaacccagcccccaccagcaaccacggcccagatgccacagaagcagaagaagattttgtggacccctggacagtgcagaccagcagcgccaagggcattgattatgacaagctgattgtgcgcttcggcagcagcaagattgacaaggagctgatcaacagaattgagcgggccaccggccagaggccccaccacttcctgcggcggggcatcttcttcagccaccgggacatgaaccaggtgctggatgcctatgagaacaagaagcccttctacctgtacacaggccggggccccagcagcgaggccatgcacgtgggccacctgatccccttcatcttcaccaagtggctgcaggatgtgttcaacgtgcccctggtgatccagatgacagatgatgagaagtacctgtggaaggacctgaccctggaccaggcctacagctatgctgtggagaatgccaaggacatcatcgcctgtggctttgacatcaacaagaccttcatcttcagtgacctggactacatgggcatgagcagcggcttctacaagaatgtggtgaagatccagaagcacgtgaccttcaaccaggtgaagggcatcttcggctag

SEQ ID NO: 174615 - DNA, 324 bp, Artificial Sequence
  Description of Artificial Sequence: Synthetic coding sequence
atgcccaacagcgagcccgccagcctgctggagctgttcaacagcatcgccacccagggcgagctggtgcgcagcctgaaggctggaaatgccagcaaggatgaaattgacagcgctgtgaagatgctggtgtccctgaagatgagctacaaggctgctgctggggaggactacaaggctgactgccccccaggcaacccagcccccaccagcaaccacggcccagatgccacagaggccgaggaggactttgtggacccctggacagtgcagaccagcagcgccaagggcatcgactatgacaagctgattgtgcgcttctag

SEQ ID NO: 174616 - DNA, 453 bp, Artificial Sequence
  Description of Artificial Sequence: Synthetic coding sequence
atgcccaacagcgagcccgccagcctgctggagctgttcaacagcatcgccacccagggcgagctggtgcgcagcctgaaggctggaaatgccagcaaggatgaaattgacagcgctgtgaagatgctggtgtccctgaagatgagctacaaggctgctgctggggaggactacaaggctgactgccccccaggcaacccagcccccaccagcaaccacggcccagatgccacagaggccgaggaggactttgtggacccctggacagtgcagaccagcagcgccaagggcatcgactatgacaagctgattgtgcgcttcggcagcagcaagattgacaaggagctgatcaaccgcatcgagcgggccaccggccagaggccccaccacttcctgcggcggggcatcttcttcagccaccgggacatgaaccaggtgctggatgcctactag

SEQ ID NO: 174617 - DNA, 294 bp, Artificial Sequence
  Description of Artificial Sequence: Synthetic coding sequence
atgcccaacagcgagcccgccagcctgctggagctgttcaacagcatcgccacccagggcgagctggtgcgcagcctgaaggctggaaatgccagcaaggatgaaattgacagcgctgtgaagatgctggtgtccctgaagatgagctacaaggctgctgctggggaggactacaaggctgactgccccccaggcaacccagcccccaccagcaaccacggcccagatgccacagaggccgaggaggactttgtggacccctggacagtgcagaccagcagcgccaagggctag

SEQ ID NO: 174618 - DNA, 81 bp, Artificial Sequence
  Description of Artificial Sequence: Synthetic coding sequence
atgcccaacagcgagcccgccagcctgctggagctgttcaacagcatcgccacccagggcgagctggtgcgcagcctgtag

SEQ ID NO: 174619 - DNA, 318 bp, Artificial Sequence
  Description of Artificial Sequence: Synthetic coding sequence
atgcccaacagcgagcccgccagcctgctggagctgttcaacagcatcgccacccagggcgagctggtgcgcagcctgaaggctggaaatgccagcaaggatgaaattgacagcgctgtgaagatgctggtgtccctgaagatgagctacaaggctgctgctggggaggactacaaggctgactgccccccaggcaacccagcccccaccagcaaccacggcccagatgccacagaggccgaggaggactttgtggacccctggacagtgcagaccagcagcgccaagggcatcgactatgacaagctgattgtgtag

SEQ ID NO: 174620 - DNA, 102 bp, Artificial Sequence
  Description of Artificial Sequence: Synthetic coding sequence
atgcccaacagcgagcccgccagcctgctggagctgttcaacagcatcgccacccagggcgagctggtgcgcagcctgaaggctggaaatgccagcaagtag

SEQ ID NO: 174621 - DNA, 207 bp, Artificial Sequence
  Description of Artificial Sequence: Synthetic coding sequence
atgcccaacagcgagcccgccagcctgctggagctgttcaacagcatcgccacccagggcgagctggtgcgcagcctgaaggctggaaatgccagcaaggatgaaattgacagcgctgtgaagatgctggtgtccctgaagatgagctacaaggctgctgctggggaggactacaaggctgactgccccccaggcaacccagcctag

SEQ ID NO: 174622 - DNA, 375 bp, Artificial Sequence
  Description of Artificial Sequence: Synthetic coding sequence
atgcccaacagcgagcccgccagcctgctggagctgttcaacagcatcgccacccagggcgagctggtgcgcagcctgaaggctggaaatgccagcaaggatgaaattgacagcgctgtgaagatgctggtgtccctgaagatgagctacaaggctgctgctggggaggactacaaggctgactgccccccaggcaacccagcccccaccagcaaccacggcccagatgccacagaggccgaggaggactttgtggacccctggacagtgcagaccagcagcgccaagggcatcgactatgacaagctgattgtgcgcttcggcagcagcaagattgacaaggagctgatcaaccgcatcgagcgggccacctag

SEQ ID NO: 174623 - DNA, 261 bp, Artificial Sequence
  Description of Artificial Sequence: Synthetic coding sequence
atgcccaacagcgagcccgccagcctgctggagctgttcaacagcatcgccacccagggcgagctggtgcgcagcctgaaggctggaaatgccagcaaggatgaaattgacagcgctgtgaagatgctggtgtccctgaagatgagctacaaggctgctgctggggaggactacaaggctgactgccccccaggcaacccagcccccaccagcaaccacggcccagatgccacagaggccgaggaggactttgtggactag

SEQ ID NO: 174624 - DNA, 168 bp, Artificial Sequence
  Description of Artificial Sequence: Synthetic coding sequence
atgcccaacagcgagcccgccagcctgctggagctgttcaacagcatcgccacccagggcgagctggtgcgcagcctgaaggctggaaatgccagcaaggatgaaattgacagcgctgtgaagatgctggtgtccctgaagatgagctacaaggctgctgctggatag

SEQ ID NO: 174625 - DNA, 192 bp, Artificial Sequence
  Description of Artificial Sequence: Synthetic coding sequence
atgcccaacagcgagcccgccagcctgctggagctgttcaacagcatcgccacccagggcgagctggtgcgcagcctgaaggctggaaatgccagcaaggatgaaattgacagcgctgtgaagatgctggtgtccctgaagatgagctacaaggctgctgctggggaggactacaaggctgactgcccctag

SEQ ID NO: 174626 - DNA, 213 bp, Artificial Sequence
  Description of Artificial Sequence: Synthetic coding sequence
atgcccaacagcgagcccgccagcctgctggagctgttcaacagcatcgccacccagggcgagctggtgcgcagcctgaaggctggaaatgccagcaaggatgaaattgacagcgctgtgaagatgctggtgtccctgaagatgagctacaaggctgctgctggggaggactacaaggctgactgccccccaggcaacccagcccccacctag

SEQ ID NO: 174627 - DNA, 177 bp, Artificial Sequence
  Description of Artificial Sequence: Synthetic coding sequence
atgcccaacagcgagcccgccagcctgctggagctgttcaacagcatcgccacccagggcgagctggtgcgcagcctgaaggctggaaatgccagcaaggatgaaattgacagcgctgtgaagatgctggtgtccctgaagatgagctacaaggctgctgctggggaggactactag

SEQ ID NO: 174628 - DNA, 423 bp, Artificial Sequence
  Description of Artificial Sequence: Synthetic coding sequence
atgctggtgtccctgaagatgagctacaaggctgctgctggggaggactacaaggctgactgccccccaggcaacccagcccccaccagcaaccacggcccagatgccacagaagcagaagaagattttgtggacccctggacagtgcagaccagcagcgccaagggcattgattatgacaagctgattgtgcgcttcggcagcagcaagattgacaaggagctgatcaacagaattgagcgggccaccggccagaggccccaccacttcctgcggcggggcatcttcttcagccaccgggacatgaaccaggtgctggatgcctatgagaacaagaagcccttctacctgtacacaggccggggccccagcagcgaggccatgcacgtgggccacctgatccccttcatcttcaccaagtag

SEQ ID NO: 174629 - DNA, 462 bp, Artificial Sequence
  Description of Artificial Sequence: Synthetic coding sequence
atgctggtgtccctgaagatgagctacaaggctgctgctggggaggactacaaggctgactgccccccaggcaacccagcccccaccagcaaccacggcccagatgccacagaagcagaagaagattttgtggacccctggacagtgcagaccagcagcgccaagggcattgattatgacaagctgattgtgcgcttcggcagcagcaagattgacaaggagctgatcaacagaattgagcgggccaccggccagaggccccaccacttcctgcggcggggcatcttcttcagccaccgggacatgaaccaggtgctggatgcctatgagaacaagaagcccttctacctgtacacaggccggggccccagcagcgaggccatgcacgtgggccacctgatccccttcatcttcaccaagtggctgcaggatgtgttcaacgtgcccctggtgatccagtag

SEQ ID NO: 174630 - DNA, 675 bp, Artificial Sequence
  Description of Artificial Sequence: Synthetic coding sequence
atgctggtgtccctgaagatgagctacaaggctgctgctggggaggactacaaggctgactgccccccaggcaacccagcccccaccagcaaccacggcccagatgccacagaagcagaagaagattttgtggacccctggacagtgcagaccagcagcgccaagggcattgattatgacaagctgattgtgcgcttcggcagcagcaagattgacaaggagctgatcaacagaattgagcgggccaccggccagaggccccaccacttcctgcggcggggcatcttcttcagccaccgggacatgaaccaggtgctggatgcctatgagaacaagaagcccttctacctgtacacaggccggggccccagcagcgaggccatgcacgtgggccacctgatccccttcatcttcaccaagtggctgcaggatgtgttcaacgtgcccctggtgatccagatgacagatgatgagaagtacctgtggaaggacctgaccctggaccaggcctacagctatgctgtggagaatgccaaggacatcatcgcctgtggctttgacatcaacaagaccttcatcttcagtgacctggactacatgggcatgagcagcggcttctacaagaatgtggtgaagatccagaagcacgtgaccttcaaccaggtgaagggctag

SEQ ID NO: 174631 - DNA, 1293 bp, Artificial Sequence; identical to SEQ ID NO: 174610
  Description of Artificial Sequence: Synthetic coding sequence

SEQ ID NO: 174632 - DNA, 345 bp, Artificial Sequence
  Description of Artificial Sequence: Synthetic coding sequence
atgcccaacagcgagcccgccagcctgctggagctgttcaacagcatcgccacccagggcgagctggtgcgcagcctgaaggctggaaatgccagcaaggatgaaattgacagcgctgtgaagatgctggtgtccctgaagatgagctacaaggctgctgctggggaggactacaaggctgactgccccccaggcaacccagcccccaccagcaaccacggcccagatgccacagaggccgaggaggactttgtggacccctggacagtgcagaccagcagcgccaagggcatcgactatgacaagctgattgtgcgcttcggcagcagcaagattgacaagtag

SEQ ID NO: 174633 - DNA, 177 bp, Artificial Sequence; identical to SEQ ID NO: 174627
  Description of Artificial Sequence: Synthetic coding sequence

SEQ ID NO: 174634 - DNA, 459 bp, Artificial Sequence
  Description of Artificial Sequence: Synthetic coding sequence
atgcccaacagcgagcccgccagcctgctggagctgttcaacagcatcgccacccagggcgagctggtgcgcagcctgaaggctggaaatgccagcaaggatgaaattgacagcgctgtgaagatgctggtgtccctgaagatgagctacaaggctgctgctggggaggactacaaggctgactgccccccaggcaacccagcccccaccagcaaccacggcccagatgccacagaggccgaggaggactttgtggacccctggacagtgcagaccagcagcgccaagggcatcgactatgacaagctgattgtgcgcttcggcagcagcaagattgacaaggagctgatcaaccgcatcgagcgggccaccggccagaggccccaccacttcctgcggcggggcatcttcttcagccaccgggacatgaaccaggtgctggatgcctatgaaaattag

SEQ ID NO: 174635 - DNA, 1416 bp, Artificial Sequence; identical to SEQ ID NO: 174611
  Description of Artificial Sequence: Synthetic coding sequence

SEQ ID NO: 174636 - DNA, 465 bp, Artificial Sequence
  Description of Artificial Sequence: Synthetic coding sequence
atgctggtgtccctgaagatgagctacaaggctgctgctggggaggactacaaggctgactgccccccaggcaacccagcccccaccagcaaccacggcccagatgccacagaagcagaagaagattttgtggacccctggacagtgcagaccagcagcgccaagggcattgattatgacaagctgattgtgcgcttcggcagcagcaagattgacaaggagctgatcaacagaattgagcgggccaccggccagaggccccaccacttcctgcggcggggcatcttcttcagccaccgggacatgaaccaggtgctggatgcctatgagaacaagaagcccttctacctgtacacaggccggggccccagcagcgaggccatgcacgtgggccacctgatccccttcatcttcaccaagtggctgcaggatgtgttcaacgtgcccctggtgatccagatgtag

SEQ ID NO: 174637 - DNA, 639 bp, Artificial Sequence
  Description of Artificial Sequence: Synthetic coding sequence
atgcccaacagcgagcccgccagcctgctggagctgttcaacagcatcgccacccagggcgagctggtgcgcagcctgaaggctggaaatgccagcaaggatgaaattgacagcgctgtgaagatgctggtgtccctgaagatgagctacaaggctgctgctggggaggactacaaggctgactgccccccaggcaacccagcccccaccagcaaccacggcccagatgccacagaggccgaggaggactttgtggacccctggacagtgcagaccagcagcgccaagggcatcgactatgacaagctgattgtgcgcttcggcagcagcaagattgacaaggagctgatcaaccgcatcgagcgggccaccggccagaggccccaccacttcctgcggcggggcatcttcttcagccaccgggacatgaaccaggtgctggatgcctatgagaacaagaagcccttctacctgtacacaggccggggccccagcagcgaggccatgcacgtgggccacctgatccccttcatcttcaccaagtggctgcaggatgtgttcaacgtgcccctggtgatccagatgacagatgatgagaagtacctgtggaaggacctgaccctggaccaggcctactag

SEQ ID NO: 174638 - DNA, 1041 bp, Artificial Sequence
  Description of Artificial Sequence: Synthetic coding sequence
atgagcctgctgcggagcctgcgggtcttcctggtggccaggacaggcagctacccagctggcagcctgctgcggcagagcccccagcccaggcacaccttctacgccggcccccggctgagcgccagcgccagcagcaaggagctgctgatgaagctgcggaggaagacaggctacagctttgtgaactgcaagaaggccctggagacctgtggcggggacctgaagcaggccgagatctggctgcacaaggaggcccagaaggagggctggagcaaggccgccaagctgcagggcaggaagaccaaggagggcctgattggcctgctgcaggagggcaacaccaccgtgctggtggaggtgaactgtgaaacagactttgtgtccaggaacctgaagttccagctgctggtgcagcaggtggccctgggcaccatgatgcactgccagaccctgaaggaccagcccagcgcctacagcaaggtgcagtggctgacccctgtgaacctggccctgtgggaggccgaggccggcggcagcctggagggcttcctgaacagcagcgagctgagcggcctgcctgctggccctgaccgggagggcagcctgaaggaccagctggccctggccatcggcaagctgggggagaacatgatcctgaagagagctgcctgggtgaaggtgcccagcggcttctacgtgggcagctatgtgcatggagccatgcagagccccagcctgcacaagctggtgctgggcaagtatggagccctggtgatctgtgagaccagcgagcagaagaccaacctggaggatgtgggccgccgcctgggccagcacgtggtgggcatggcccccctgtctgtgggcagcctggatgatgagcccggcggggaggccgagaccaagatgctgagccagccctacctgctggaccccagcatcaccctgggccagtatgtgcagccccagggcgtgtctgtggtggactttgtgcgctttgaatgtggggagggggaggaggccgctgagacagaatag

SEQ ID NO: 174639 - DNA, 858 bp, Artificial Sequence
  Description of Artificial Sequence: Synthetic coding sequence
atggtgtactgcaccaccacctgggccatctggaactgccagctgctgctgggctacaagcccctgcagaatgtgacaggcctgaacacagtgggcagctgcaacacagtggccgagatctggctgcacaaggaggcccagaaggagggctggagcaaggccgccaagctgcagggcaggaagaccaaggagggcctgattggcctgctgcaggagggcaacaccaccgtgctggtggaggtgaactgtgaaacagactttgtgtccaggaacctgaagttccagctgctggtgcagcaggtggccctgggcaccatgatgcactgccagaccctgaaggaccagcccagcgcctacagcaagggcttcctgaacagcagcgagctgagcggcctgcctgctggccctgaccgggagggcagcctgaaggaccagctggccctggccatcggcaagctgggggagaacatgatcctgaagagagctgcctgggtgaaggtgcccagcggcttctacgtgggcagctatgtgcacggggccatgcagagccccagcctgcacaagctggtgctgggcaagtacggggccctggtgatctgtgagaccagcgagcagaagaccaacctggaggatgtgggccggcggctgggccagcacgtggtgggcatggcccccctgtctgtgggcagcctggatgatgagcctggaggagaggccgagaccaagatgctgagccagccctacctgctggaccccagcatcaccctgggccagtatgtgcagccccagggcgtgtctgtggtggactttgtgcgctttgaatgtggggagggggaggaggccgctgagacagaatag

SEQ ID NO: 174640 - DNA, 978 bp, Artificial Sequence
  Description of Artificial Sequence: Synthetic coding sequence
atgagcctgctgcggagcctgcgggtcttcctggtggccaggacaggcagctacccagctggcagcctgctgcggcagagcccccagcccaggcacaccttctacgccggcccccggctgagcgccagcgccagcagcaaggagctgctgatgaagctgcggaggaagacaggctacagctttgtgaactgcaagaaggccctggagacctgtggcggggacctgaagcaggccgagatctggctgcacaaggaggcccagaaggagggctggagcaaggccgccaagctgcagggcaggaagaccaaggagggcctgattggcctgctgcaggagggcaacaccaccgtgctggtggaggtgaactgtgaaacagactttgtgtccaggaacctgaagttccagctgctggtgcagcaggtggccctgggcaccatgatgcactgccagaccctgaaggaccagcccagcgcctacagcaagggcttcctgaacagcagcgagctgagcggcctgcctgctggccctgaccgggagggcagcctgaaggaccagctggccctggccatcggcaagctgggggagaacatgatcctgaagagagctgcctgggtgaaggtgcccagcggcttctacgtgggcagctatgtgcacggggccatgcagagccccagcctgcacaagctggtgctgggcaagtacggggccctggtgatctgtgagaccagcgagcagaagaccaacctggaggatgtgggccggcggctgggccagcacgtggtgggcatggcccccctgtctgtgggcagcctggatgatgagcctggaggagaggccgagaccaagatgctgagccagccctacctgctggaccccagcatcaccctgggccagtatgtgcagccccagggcgtgtctgtggtggactttgtgcgctttgaatgtggggagggggaggaggccgctgagacagaatag

SEQ ID NO: 174641 - DNA, 504 bp, Artificial Sequence
  Description of Artificial Sequence: Synthetic coding sequence
atgagcctgctgcggagcctgcgggtcttcctggtggccaggacaggcagctacccagctggcagcctgctgcggcagagcccccagcccaggcacaccttctacgccggcccccggctgagcgccagcgccagcagcaaggagctgctgatgaagctgcggaggaagacaggctacagctttgtgaactgcaagaaggccctggagacctgtggcggggacctgaagcaggccgagatctggctgcacaaggaggcccagaaggagggctggagcaaggccgccaagctgcagggcaggaagaccaaggagggcctgattggcctgctgcaggagggcaacaccaccgtgctggtggaggtgaactgtgaaacagactttgtgtccaggaacctgaagttccagctgctggtgcagcaggtggccctgggcaccatgatgcactgccagaccctgaaggaccagcccagcgcctacagcaaggagaactgggagaagacctag

SEQ ID NO: 174642 - DNA, 648 bp, Artificial Sequence
  Description of Artificial Sequence: Synthetic coding sequence
atgagcctgctgcggagcctgcgggtcttcctggtggccaggacaggcagctacccagctggcagcctgctgcggcagagcccccagcccaggcacaccttctacgccggcccccggctgagcgccagcgccagcagcaaggagctgctgatgaagctgcggaggaagacaggctacagctttgtgaactgcaagaaggccctggagacctgtggcggggacctgaagcaggccgagatctggctgcacaaggaggcccagaaggagggctggagcaaggccgccaagctgcagggcaggaagaccaaggagggcctgattggcctgctgcaggagggcaacaccaccgtgctggtggaggtgaactgtgaaacagactttgtgtccaggaacctgaagttccagctgctggtgcagcaggtggccctgggcaccatgatgcactgccagaccctgaaggaccagcccagcgcctacagcaagggcttcctgaacagcagcgagctgagcggcctgcctgctggccctgaccgggagggcagcctgaaggaccagctggccctggccatcggcctgcccttccagatcggggctgtgtctgagctgcagctgcctgagagcaacttcctgcagaacaccagcagctag

SEQ ID NO: 174643 - DNA, 435 bp, Artificial Sequence
  Description of Artificial Sequence: Synthetic coding sequence
atgaagagccagtggtgcaggcctgtggccatggacctgggcgtgtaccagctgcggcacttcagcatctccttcctgagcagcctgctgggcacagaaaatgcctctgtgcggctggacaacagcagcagcggggcctctgtggtggccatcgacaacaagattgagcaggccatggacctggtgaagagccacctgatgtatgctgtgcgggaggaggtggaggtgctgaaggagcagatcaaggagctgattgagaagaacagccagctggagcaggagaacaacctgctgaagaccctggccagccctgagcagctggcccagttccaggcccagctgcagacaggcagccccccagccaccacccagccccagggcaccacccagcccccagcccagcctgccagccagggcagcggccccacagcctag

SEQ ID NO: 174644 - DNA, 3222 bp, Artificial Sequence
  Description of Artificial Sequence: Synthetic coding sequence
atgcaccagcccccagagagcacagctgctgctgctgctgctgctgacatcagcgccaggaagatggcccacccagccatgttcccccggcggggcagcggcagcggcagcgccagcgccctgaatgctgctggcaccggggtgggcagcaatgccaccagcagcgaggacttccccccacccagcctgctgcagcccccacctcctgctgccagcagcaccagcggcccccagcccccaccaccccagagcctgaacctgctgagccaggcccagctgcaggcccagcccctggcccctgggggcacccagatgaagaagaagagcggcttccagatcacctctgtgaccccagcccagatcagcgccagcatcagcagcaacaacagcattgctgaggacacagagagctatgatgacctggatgagagccacacagaggacctgagcagcagcgagatcctggatgtgtccctgagccgggccacagacctgggggagcctgagaggagcagcagcgaggagaccctgaacaacttccaggaggccgagaccccaggagctgtgagccccaaccagccccacctgccccagccccacctgccccacctgccccagcagaatgtggtgatcaatggaaatgcccacccccaccacctgcaccaccaccaccagatccaccacggccaccacctgcagcacggccaccaccaccccagccacgtggccgtggccagcgccagcatcaccggcggcccccccagcagccctgtgtccaggaagctgagcaccaccggcagcagtgacagcatcacccctgtggcccccaccagcgctgtgagcagcagcggcagccctgcctctgtgatgaccaacatgagggcccccagcaccactggaggcatcggcatcaacagcgtgacaggcaccagcacagtgaacaacgtgaacatcacagctgtgggcagcttcaaccccaacgtgaccagctccatgctgggcaatgtgaacatcagcaccagcaacatccccagcgctgctggggtgtctgtgggccctggggtgaccagcggcgtgaatgtgaacatcctgagcggcatgggaaatggcaccatcagcagcagcgctgctgtgtcctctgtgcccaatgctgctgctggcatgactggaggctctgtgagcagccagcagcagcagcccaccgtgaacaccagccgcttccgggtggtgaagctggacagcagcagcgagcccttcaagaagggccgctggacctgcacagagttctatgagaaggaaaatgctgtgcctgccacagaaggagtgctgatcaacaaggtggtggagaccgtgaagcagaaccccatcgaggtgaccagcgagcgggagagcaccagcggcagctctgtgagcagctctgtgtccaccctgagccactacacagaatctgtgggcagcggggagatgggcgcccccaccgtggtggtgcagcagcagcagcagcagcagcagcagcagcagcagcagcctgccctgcagggcgtgaccctgcagcagatggactttggcagcacaggcccccagagcatcccagctgtgtccatcccccagagcatcagccagagccagatcagccaggtgcagctgcagagccaggagctgagctaccagcagaagcagggcctgcagcctgtgcccctgcaggccaccatgtctgctgccaccggcatccagcccagccctgtgaatgtggtgggcgtgaccagcgccctgggccagcagcccagcatcagcagcctggcccagccccagctgccctacagccaggccgcccctcctgtgcagacccccctgcccggggcccccccaccccagcagctgcagtatggccagcagcagcccatggtgtccacccagatggcccctggccacgtgaagtctgtgacccagaacccagcctctgaatatgtgcagcagcagcccatcctgcagacagccatgagcagcggccagcccagcagcgctggggtgggcgccggcaccaccgtcatccctgtggcccagccccagggcatccagctgcctgtgcagcccacagctgtgcctgcccagcctgctggggcctctgtgcagcctgtgggccaggccccagctgctgtgtctgctgtgcccaccggcagccagatcgccaacatcggccagcaggccaacatccccacagctgtgcagcagcccagcacccaggtgccccccagcgtcatccagcagggcgccccacccagcagccaggtggtgcccccagcccagacaggcatcatccaccagggcgtgcagaccagcgcccccagcctgccccagcagctggtgattgccagccagagcagcctgctgactgtgcccccccagccccagggcgtggagcctgtggcccagggcatcgtgtcccagcagctgcctgctgtgagcagcctgcccagcgccagcagcatctctgtgaccagccaggtgagcagcacaggccccagcggcatgcccagcgcccccaccaacctggtgcccccccagaacatcgcccagaccccagccacccagaatggaaacctggtgcagagcgtgtcccagcccccactcatcgccaccaacaccaacctgcccctggcccagcagatccccctgagcagcacccagttcagcgcccagagcctggcccaggccatcggcagccagattgaagatgcccggcgggctgctgagcccagcctggtgggcctgccccagaccatcagcggggacagcggcggcatgtctgctgtgtctgatggcagcagcagcagcctggccgccagcgccagcctcttccccctgaaggtgctgcccctgaccacccccctggtggatggagaagatgagagcagcagcggggcctctgtggtggccatcgacaacaagattgagcaggccatggacctggtgaagagccacctgatgtatgctgtgcgggaggaggtggaggtgctgaaggagcagatcaaggagctgattgagaagaacagccagctggagcaggagaacaacctgctgaagaccctggccagccctgagcagctggcccagttccaggcccagctgcagacaggcagccccccagccaccacccagccccagggcaccacccagcccccagcccagcctgccagccagggcagcggccccacagcctag

SEQ ID NO: 174645 - DNA, 126 bp, Artificial Sequence
  Description of Artificial Sequence: Synthetic coding sequence
atgaagagccagtggtgcaggcctgtggccatggacctgggcgtgtaccagctgcggcacttcagcatctccttcctgagcagcctgctgggcacagaaaatgcctctgtgcggctggacaactag

SEQ ID NO: 174646 - DNA, 429 bp, Artificial Sequence
  Description of Artificial Sequence: Synthetic coding sequence
atgcaccagcccccagagagcacagctgctgctgctgctgctgctgacatcagcgccaggaagatggcccacccagccatgttcccccggcggggcagcggcagcggcagcgccagcgccctgaatgctgctggcaccggggtgggcagcaatgccaccagcagcgaggacttccccccacccagcctgctgcagcccccacctcctgctgccagcagcaccagcggcccccagcccccaccaccccagagcctgaacctgctgagccaggcccagctgcaggcccagcccctggcccctgggggcacccagatgaagaagaagagcggcttccagatcacctctgtgaccccagcccagatcagcgccagcatcagcagcaacaacagcattgctgaggacacagagagctatgatgacctggactag

SEQ ID NO: 174647 - DNA, 1713 bp, Artificial Sequence
  Description of Artificial Sequence: Synthetic coding sequence
atgcaccagcccccagagagcacagctgctgctgctgctgctgctgacatcagcgccaggaagatggcccacccagccatgttcccccggcggggcagcggcagcggcagcgccagcgccctgaatgctgctggcaccggggtgggcagcaatgccaccagcagcgaggacttccccccacccagcctgctgcagcccccacctcctgctgccagcagcaccagcggcccccagcccccaccaccccagagcctgaacctgctgagccaggcccagctgcaggcccagcccctggcccctgggggcacccagatgaagaagaagagcggcttccagatcacctctgtgaccccagcccagatcagcgccagcatcagcagcaacaacagcattgctgaggacacagagagctatgatgacctggatgagagccacacagaggacctgagcagcagcgagatcctggatgtgtccctgagccgggccacagacctgggggagcctgagaggagcagcagcgaggagaccctgaacaacttccaggaggccgagaccccaggagctgtgagccccaaccagccccacctgccccagccccacctgccccacctgccccagcagaatgtggtgatcaatggaaatgcccacccccaccacctgcaccaccaccaccagatccaccacggccaccacctgcagcacggccaccaccaccccagccacgtggccgtggccagcgccagcatcaccggcggcccccccagcagccctgtgtccaggaagctgagcaccaccggcagcagtgacagcatcacccctgtggcccccaccagcgctgtgagcagcagcggcagccctgcctctgtgatgaccaacatgagggcccccagcaccactggaggcatcggcatcaacagcgtgacaggcaccagcacagtgaacaacgtgaacatcacagctgtgggcagcttcaaccccaacgtgaccagctccatgctgggcaatgtgaacatcagcaccagcaacatccccagcgctgctggggtgtctgtgggccctggggtgaccagcggcgtgaatgtgaacatcctgagcggcatgggaaatggcaccatcagcagcagcgctgctgtgtcctctgtgcccaatgctgctgctggcatgactggaggctctgtgagcagccagcagcagcagcccaccgtgaacaccagccgcttccgggtggtgaagctggacagcagcagcgagcccttcaagaagggccgctggacctgcacagagttctatgagaaggaaaatgctgtgcctgccacagaaggagtgctgatcaacaaggtggtggagaccgtgaagcagaaccccatcgaggtgaccagcgagcgggagagcaccagcggcagctctgtgagcagctctgtgtccaccctgagccactacacagaatctgtgggcagcggggagatgggcgcccccaccgtggtggtgcagcagcagcagcagcagcagcagcagcagcagcagcagcctgccctgcagggcgtgaccctgcagcagatggactttggcagcacaggcccccagagcatcccagctgtgtccatcccccagagcatcagccagagccagatcagccaggtgcagctgcagagccaggagctgagctacctgaccatgaaggtggtgctgctgattgtgtacctgtgcatgtag

SEQ ID NO: 174648 - DNA, 603 bp, Artificial Sequence
  Description of Artificial Sequence: Synthetic coding sequence
atggcccagagcaagctggactgccgcagccctgtgggcctggactgctgcaactgctgcctggacctggcccacaggagcggcctgcagaggggcagcagcggggagaacaacaaccctggcagccccaccgtgagcaacttccggcagctgcaggagaagctggtgtttgagaacctgaacacagacaagctgaacagcatcatgaggcaggacagcctggagcctgtgctgcgggacccctgctacctgatcaatgaaggcatctgcaacagaaacatcgaccagaccatgctgagcatcctgctcttcttccacagcgccagcggggcctctgtggtggccatcgacaacaagattgagcaggccatggacctggtgaagaaccacctgatgtatgctgtgcgggaggaggtggagatcctgaaggagcagatccgggagctggtggagaagaacagccagctggagcgggagaacaccctgctgaagaccctggccagccctgagcagctggagaagttccagagctgcctgagccctgaggagcccgcccctgagagcccccaggtgcctgaggcccctgggggcagcgctgtgtag

SEQ ID NO: 174649 - DNA, 333 bp, Artificial Sequence
  Description of Artificial Sequence: Synthetic coding sequence
atggccttccagcccccctacagcagcagcctcttcaggaagagggacaatgccagcggggcctctgtggtggccatcgacaacaagattgagcaggccatggacctggtgaagaaccacctgatgtatgctgtgcgggaggaggtggagatcctgaaggagcagatccgggagctggtggagaagaacagccagctggagcgggagaacaccctgctgaagaccctggccagccctgagcagctggagaagttccagagctgcctgagccctgaggagcccgcccctgagagcccccaggtgcctgaggcccctgggggcagcgctgtgtag

SEQ ID NO: 174650 - DNA, 603 bp, Artificial Sequence; identical to SEQ ID NO: 174648
  Description of Artificial Sequence: Synthetic coding sequence

SEQ ID NO: 174651 - DNA, 603 bp, Artificial Sequence; identical to SEQ ID NO: 174648
  Description of Artificial Sequence: Synthetic coding sequence

SEQ ID NO: 174652 - DNA, 234 bp, Artificial Sequence
  Description of Artificial Sequence: Synthetic coding sequence
atggacctggtgaagaaccacctgatgtatgctgtgcgggaggaggtggagatcctgaaggagcagatccgggagctggtggagaagaacagccagctggagcgggagaacaccctgctgaagaccctggccagccctgagcagctggagaagttccagagctgcctgagccctgaggagcccgcccctgagagcccccaggtgcctgaggcccctgggggcagcgctgtgtag

SEQ ID NO: 174653 - DNA, 405 bp, Artificial Sequence
  Description of Artificial Sequence: Synthetic coding sequence
atgaacacagagatgtaccagacccccatggaggtggccgtgtaccagctgcacaacttcagcatctccttcttcagcagcctgctgggcggagatgtggtgtctgtgaagctggacaacagcgccagcggggcctctgtggtggccatcgacaacaagattgagcaggccatggacctggtgaagaaccacctgatgtatgctgtgcgggaggaggtggagatcctgaaggagcagatccgggagctggtggagaagaacagccagctggagcgggagaacaccctgctgaagaccctggccagccctgagcagctggagaagttccagagctgcctgagccctgaggagcccgcccctgagagcccccaggtgcctgaggcccctgggggcagcgctgtgtag

SEQ ID NO: 174654 - DNA, 540 bp, Artificial Sequence
  Description of Artificial Sequence: Synthetic coding sequence
atggcccagagcaagctggactgccgcagccctgtgggcctggactgctgcaactgctgcctggacctggcccacaggagcggcctgcagaggggcagcagcggggagaacaacaaccctggcagccccaccgtgagcaacttccggcaggacagcctggagcctgtgctgcgggacccctgctacctgatcaatgaaggcatctgcaacagaaatattgaccagaccatgctgagcatcctgctcttcttccacagcgccagcggggcctctgtggtggccatcgacaacaagattgagcaggccatggacctggtgaagaaccacctgatgtatgctgtgcgggaggaggtggagatcctgaaggagcagatccgggagctggtggagaagaacagccagctggagcgggagaacaccctgctgaagaccctggccagccctgagcagctggagaagttccagagctgcctgagccctgaggagcccgcccctgagagcccccaggtgcctgaggcccctgggggcagcgctgtgtag

SEQ ID NO: 174655 - DNA, 372 bp, Artificial Sequence
  Description of Artificial Sequence: Synthetic coding sequence
atggcccagagcaagctggactgccgcagccctgtgggcctggactgctgcaactgctgcctggacctggcccacaggagcggcctgcagaggggcagcagcggggagaacaacaaccctggcagccccaccgtgagcaacttccggcagctgcaggagaagctggtgtttgagaacctgaacacagacaagctgaacagcatcatgaggcaggacagcctggagcctgtgctgcgggacccctgctacctgatcaatgaaggcatctgcaacagaaacatcgaccagaccatgctgagcatcctgctcttcttccacagcgccagcggggcctctgtggtggccatcgacaacaagattgagcaggcctag

SEQ ID NO: 174656 - DNA, 78 bp, Artificial Sequence
  Description of Artificial Sequence: Synthetic coding sequence
atggacctggtgaagaaccacctgatgtatgctgtgcgggaggaggtggagatcctgaaggagcagatccgggagtag

SEQ ID NO: 174657 - DNA, 351 bp, Artificial Sequence
  Description of Artificial Sequence: Synthetic coding sequence
atggcccagagcaagctggactgccgcagccctgtgggcctggactgctgcaactgctgcctggacctggcccacaggagcggcctgcagaggggcagcagcggggagaacaacaaccctggcagccccaccgtgagcaacttccggcagctgcaggagaagctggtgtttgagaacctgaacacagacaagctgaacagcatcatgaggcaggacagcctggagcctgtgctgcgggacccctgctacctgatcaatgaaggcatctgcaacagaaacatcgaccagaccatgctgagcatcctgctcttcttccacagcgccagcggggcctctgtggtggccatctag

SEQ ID NO: 174658 - DNA, 177 bp, Artificial Sequence
  Description of Artificial Sequence: Synthetic coding sequence
atggcccagagcaagctggactgccgcagccctgtgggcctggactgctgcaactgctgcctggacctggcccacaggagcggcctgcagaggggcagcagcggggagaacaacaaccctggcagccccaccgtgagcaacttccggcagctgcaggagaagctggtgtttgaatag

SEQ ID NO: 174659 - DNA, 255 bp, Artificial Sequence
  Description of Artificial Sequence: Synthetic coding sequence
atggcccagagcaagctggactgccgcagccctgtgggcctggactgctgcaactgctgcctggacctggcccacaggagcggcctgcagaggggcagcagcggggagaacaacaaccctggcagccccaccgtgagcaacttccggcagctgcaggagaagctggtgtttgagaacctgaacacagacaagctgaacagcatcatgaggcaggacagcctggagcctgtgctgcgggacccctgctacctgtag

SEQ ID NO: 174660 - DNA, 603 bp, Artificial Sequence; identical to SEQ ID NO: 174648
  Description of Artificial Sequence: Synthetic coding sequence

SEQ ID NO: 174661 - DNA, 303 bp, Artificial Sequence
  Description of Artificial Sequence: Synthetic coding sequence
atggcccagagcaagctggactgccgcagccctgtgggcctggactgctgcaactgctgcctggacctggcccacaggagcggcctgcagaggggcagcagcggggagaacaacaaccctggcagccccaccgtgagcaacttccggcagctgcaggagaagctggtgtttgagaacctgaacacagacaagctgaacagcatcatgaggcaggacagcctggagcctgtgctgcgggacccctgctacctgatcaatgaaggcatctgcaacagaaacatcgaccagaccatgctgtcctag

SEQ ID NO: 174662 - DNA, 360 bp, Artificial Sequence
  Description of Artificial Sequence: Synthetic coding sequence
atggcccagagcaagctggactgccgcagccctgtgggcctggactgctgcaactgctgcctggacctggcccacaggagcggcctgcagaggggcagcagcggggagaacaacaaccctggcagccccaccgtgagcaacttccggcagctgcaggagaagctggtgtttgagaacctgaacacagacaagctgaacagcatcatgaggcaggacagcctggagcctgtgctgcgggacccctgctacctgatcaatgaaggcatctgcaacagaaacatcgaccagaccatgctgagcatcctgctcttcttccacagcgccagcggggcctctgtggtggccatcgacaacaagtag

SEQ ID NO: 174663 - DNA, 399 bp, Artificial Sequence
  Description of Artificial Sequence: Synthetic coding sequence
atgaggcaggacagcctggagcctgtgctgcgggacccctgctacctgatcaatgaaggcatctgcaacagaaacatcgaccagaccatgctgagcatcctgctcttcttccacagcgccagcggggcctctgtggtggccatcgacaacaagattgagcaggccatggacctggtgaagaaccacctgatgtatgctgtgcgggaggaggtggagatcctgaaggagcagatccgggagctggtggagaagaacagccagctggagcgggagaacaccctgctgaagaccctggccagccctgagcagctggagaagttccagagctgcctgagccctgaggagcccgcccctgagagcccccaggtgcctgaggcccctgggggcagcgctgtgtag

SEQ ID NO: 174664 - DNA, 375 bp, Artificial Sequence
  Description of Artificial Sequence: Synthetic coding sequence
atggcccagagcaagctggactgccgcagccctgtgggcctggactgctgcaactgctgcctggacctggcccacaggagcggcctgcagaggggcagcagcggggagaacaacaaccctggcagccccaccgtgagcaacttccggcagctgcaggagaagctggtgtttgagaacctgaacacagacaagctgaacagcatcatgaggcaggacagcctggagcctgtgctgcgggacccctgctacctgatcaatgaaggcatctgcaacagaaacatcgaccagaccatgctgagcatcctgctcttcttccacagcgccagcggggcctctgtggtggccatcgacaacaagattgagcaggccatgtag

SEQ ID NO: 174665 - DNA, 1188 bp, Artificial Sequence
  Description of Artificial Sequence: Synthetic coding sequence
atgtctgggggcaagaagaagagcagcttccagatcacctctgtgaccacagattatgagggccctggcagccctggggccagtgacccccccaccccccagcccccaactggacctccaccccggctgcccaatggagagcccagcccagaccccggcggcaagggcaccccaagaaatggcagccccccacctggggcccccagcagccgcttccgggtggtgaagctgccccacggcctgggggagccctaccgccggggccgctggacctgtgtggatgtgtatgaaagagacctggagccccacagctttggaggcctgctggagggcatccggggggccagcggcggggccggcggccgcagcctggacagccggctggagctggccagcctgggcctgggcgcccccaccccacccagcggcctgagccagggccccacctcctggctgcggcccccacccaccagccctggcccccaggcccgctccttcaccggcggcctgggccagctggtggtgcccagcaaggccaaggccgagaagccacccctgagcgccagcagcccccagcagaggcctcctgagcctgagaccggggagagcgctggcaccagcagagctgccacccccctgcccagcctgcgggtggaggccgaggccggcggcagcggggcccggaccccacccctgagcaggaggaaggctgtggacatgaggctgaggatggagctgggcgcccctgaggagatgggccaggtgccccccctggacagccggcccagcagccctgccctgtacttcacccatgatgccagcctggtgcacaagagcccagacccctttggagctgtggccgcccagaagttcagcctggcccacagcatgctggccatcagcggccacctggacagtgatgatgacagcggcagcggcagcctggtgggcatcgacaacaagattgagcaggccatggacctggtgaagagccacctgatgtttgctgtgcgggaggaggtggaggtgctgaaggagcagatccgggagctggccgagagaaatgctgccctggagcaggagaatggcctgctgcgggccctggccagccctgagcagctggcccagctgcccagcagcggcgtgccccggctgggccccccagccccaaatggccccagcgtgtag

SEQ ID NO: 174666 - DNA, 1314 bp, Artificial Sequence
  Description of Artificial Sequence: Synthetic coding sequence
atgagcggcctggatggagtgaagaggaccacccccctgcagacccacagcatcatcatcagtgaccaggtgcccagcgaccaggatgcccaccagtacctgcggctgcgggaccagagcgaggccacccaggtgatggccgagcctggagagggcggcagcgagaccgtggccctgcccccacctcctccttctgaggagggcggcgtgccccaggatgctgctggccggggcggcaccccccagatccgggtggtgggcggccggggccacgtggccatcaaggccggccaggaggagggccagcccccagctgagggcctggccgccgcctctgtggtgatggctgctgacaggagcctgaagaagggcgtgcagggcggggagaaggccctggagatctgtggggcccagaggtctgccagcgagctgacagctggagctgaggccgaggccgaggaggtgaagacaggaaaatgtgccaccgtgtctgctgctgtggccgagcgggagagcgctgaggtggtgaaggagggcctggccgagaaggaggtgatggaggagcagatggaggtggaggagcagcccccagagggggaggagattgaggtggccgaggaggaccggctggaggaggaggcccgggaggaggagggcccctggcccctgcacgaggccctgaggatggaccccctggaggccatccagctggagctggacacagtgaatgcccaggccgaccgggccttccagcagctggagcacaagtttggaaggatgagaagacactacctggagaggaggaactacatcatccagaacatccctggcttctggatgacagccttcaggaaccacccccagctgagcgccatgatccggggccaggatgctgagatgctgcgctacatcaccaacctggaggtgaaggagctgcggcaccccaggacaggctgcaagttcaagttcttcttcagaagaaacccctacttcaggaacaagctgattgtgaaggagtatgaggtgcgcagcagcggccgggtggtgtccctgagcacccccatcatctggaggcggggccacgagccccagagcttcatcagaagaaaccaggacctgatctgcagcttcttcacctggttcagtgaccacagcctgcctgagagtgacaagattgctgagatcatcaaggaggacctgtggcccaaccccctgcagtactacctgctgcgggagggcgtgagaagagccaggagaagacccctgcgggagcctgtggagatcccccggcccttcggcttccagagcggctag

SEQ ID NO: 174667 - DNA, 522 bp, Artificial Sequence
  Description of Artificial Sequence: Synthetic coding sequence
atgagcggcctggatggagtgaagaggaccacccccctgcagacccacagcatcatcatcagtgaccaggtgcccagcgaccaggatgcccaccagtacctgcggctgcgggaccagagcgaggccacccaggtgatggccgagcctggagagggcggcagcgagaccgtggccctgcccccacctcctccttctgaggagggcggcgtgccccaggatgctgctggccggggcggcaccccccagatccgggtggtgggcggccggggccacgtggccatcaaggccggccaggaggagggccagcccccagctgagggcctggccgccgcctctgtggtgatggctgctgacaggagcctgaagaagggcgtgcagggcggggagaaggccctggagatctgtggggcccagaggtctgccagcgagctgacagctggagctgaggccgaggccgaggaggtgaagacaggaaaatgtgccaccgtgtctgctgctgtggccaagatgcagcgctgctag

SEQ ID NO: 174668 - DNA, 2082 bp, Artificial Sequence
  Description of Artificial Sequence: Synthetic coding sequence
atggacagaccagatgagggccccccagccaagacccggcggctgagcagcagcgagagcccccagagggaccccccacctcctcctcctcctccacccctgctgcggctgcccctgcccccaccccagcagaggccccggctgcaggaggagacagaggccgcccaggtgctggccgacatgagaggagtgggcctgggccctgccctgcccccacctccaccctacgtgatcctggaggagggcggcatccgggcctacttcaccctgggcgcagaatgtcctggctgggacagcaccattgaaagtggctatggagaggcccccccacccacagagagcctggaggccctgcccaccccagaggccagcggcggcagcctggagattgacttccaggtggtgcagagcagcagctttggaggagagggcgccctggagacctgcagcgctgtgggctgggccccccagaggctggtggaccccaagagcaaggaggaggccatcatcatcgtggaggatgaagatgaagatgagcgggagagcatgaggagcagcagaagaagaagaagaagaagaagaaggaagcagaggaaggtgaagcgggagagccgggagagaaatgctgagaggatggagagcatcctgcaggccctggaggacatccagctggacctggaggccgtgaacatcaaggccggcaaggccttcctgcggctgaagaggaagttcatccagatgaggcggcccttcctggagcggcgggacctgatcatccagcacatccctggcttctgggtgaaggccttcctgaaccacccccgcatcagcatcctgatcaacagaagagatgaggacatcttccgctacctgaccaacctgcaggtgcaggacctgcggcacatctccatgggctacaagatgaagctgtacttccagaccaacccctacttcaccaacatggtgattgtgaaggagttccagaggaacagaagtggccgcctggtgagccacagcacccccatccgctggcaccggggccaggagccccaggccaggagacatggcaaccaggatgccagccacagcttcttctcctggttcagcaaccacagcctgcctgaggccgacagaattgctgagatcatcaagaatgacctgtgggtgaaccccctgcgctactacctgcgggagcggggcagccgcatcaagaggaagaagcaggagatgaagaagaggaagacccggggccgctgtgaggtggtgatcatggaggatgccccagactactatgctgtggaggacatcttcagcgagatcagtgacattgatgagaccatccatgacatcaagatcagtgacttcatggagaccacagactactttgagaccacagacaatgagatcacagacatcaatgaaaacatctgtgacagcgagaacccagaccacaatgaggtgcccaacaatgagaccacagacaacaatgaatctgcagatgaccacgagaccacagacaacaatgaatctgcagatgacaacaatgaaaatcctgaggacaacaacaagaacacagatgacaatgaggagaaccccaacaacaatgaaaacacctacggcaacaacttcttcaagggcggcttctggggcagccacggcaacaaccaggacagcagtgacagcgacaatgaagcagatgaggccagtgatgatgaggacaatgatggaaatgaaggagacaatgaaggaagtgatgatgatggaaatgaaggagacaatgaaggaagtgatgatgatgaccgggacatcgagtactatgagaaggtgattgaagattttgacaaggaccaggccgactatgaagatgtgattgagatcatcagtgatgaatctgtggaggaggagggcatcgaggagggcatccagcaggatgaggacatctatgaggagggcaactatgaggaggagggctctgaagatgtgtgggaggagggggaggacagtgatgacagcgacctggaggatgtgctgcaggtgcccaacggctgggccaaccctgggaagaggggcaagacaggatag

SEQ ID NO: 174669 - DNA, 1062 bp, Artificial Sequence
  Description of Artificial Sequence: Synthetic coding sequence
atgccctggcccctgctgctgctgctggccgtgtctggggcccagaccacccggccctgcttccctggctgccagtgtgaggtggagaccttcggcctgtttgacagcttcagcctgaccagggtggactgcagcggcctgggcccccacatcatgcctgtgcccatccccctggacacagcccacctggacctgagcagcaaccggctggagatggtgaatgaatctgtgctggccggccctggctacaccaccctggccggcctggacctgagccacaacctgctgaccagcatcagccccacagccttcagccggctgcgctacctggagagcctggacctgagccacaacggcctgacagccctgcctgctgagagcttcaccagcagccccctgagtgatgtgaacctgagccacaaccagctgcgggaggtgtctgtgtctgccttcaccacccacagccagggccgggccctgcacgtggacctgagccacaacctgatccaccggctggtgccccaccccaccagggctggcctgcctgcccccaccatccagagcctgaacctggcctggaaccggctgcatgctgtgcccaacctgcgggacctgcccctgcgctacctgagcctggatggcaaccccctggccgtcatcggccctggggcctttgctggcctgggcggcctgacccacctgagcctggccagcctgcagaggctgcctgagctggcccccagcggcttccgggagctgcccggcctgcaggtgctggacctgagcggcaaccccaagctgaactgggccggggctgaggtgttcagcggcctgagcagcctgcaggagctggacctgagcggcaccaacctggtgcccctgcctgaggccctgctgctgcacctgcctgccctgcagagcgtgtctgtgggccaggatgtgcgctgccggcggctggtgcgggagggcacctaccccaggaggcctggcagcagccccaaggtggccctgcactgtgtggacacccgggacagcgctgcccggggccccaccatcctgtag

SEQ ID NO: 174670 - DNA, 966 bp, Artificial Sequence
  Description of Artificial Sequence: Synthetic coding sequence
atgccctggcccctgctgctgctgctggccgtgtctggggcccagaccacccggccctgcttccctggctgccagtgtgaggtggagaccttcggcctgtttgacagcttcagcctgaccagggtggactgcagcggcctgggcccccacatcatgcctgtgcccatccccctggacacagcccacctggacctgagcagcaaccggctggagatggtgaatgaatctgtgctggccggccctggctacaccaccctggccggcctggacctgagccacaacctgctgaccagcagccccctgagtgatgtgaacctgagccacaaccagctgcgggaggtgtctgtgtctgccttcaccacccacagccagggccgggccctgcacgtggacctgagccacaacctgatccaccggctggtgccccaccccaccagggctggcctgcctgcccccaccatccagagcctgaacctggcctggaaccggctgcatgctgtgcccaacctgcgggacctgcccctgcgctacctgagcctggatggcaaccccctggccgtcatcggccctggggcctttgctggcctgggcggcctgacccacctgagcctggccagcctgcagaggctgcctgagctggcccccagcggcttccgggagctgcccggcctgcaggtgctggacctgagcggcaaccccaagctgaactgggccggggctgaggtgttcagcggcctgagcagcctgcaggagctggacctgagcggcaccaacctggtgcccctgcctgaggccctgctgctgcacctgcctgccctgcagagcgtgtctgtgggccaggatgtgcgctgccggcggctggtgcgggagggcacctaccccaggaggcctggcagcagccccaaggtggccctgcactgtgtggacacccgggacagcgctgcccggggccccaccatcctgtag

SEQ ID NO: 174671 - DNA, 318 bp, Artificial Sequence
  Description of Artificial Sequence: Synthetic coding sequence
atgccctggcccctgctgctgctgctggccgtgtctggggcccagaccacccggccctgcttccctggctgccagtgtgaggtggagaccttcggcctgtttgacagcttcagcctgaccagggtggactgcagcggcctgggcccccacatcatgcctgtgcccatccccctggacacagcccacctggacctgagcagcaaccggctggagatggtgaatgaatctgtgctggccggccctggctacaccaccctggccggcctggacctgagccacaacctgctgaccagcatcagccccacagccttctcctag

SEQ ID NO: 174672 - DNA, 1062 bp, Artificial Sequence; identical to SEQ ID NO: 174669
  Description of Artificial Sequence: Synthetic coding sequence

SEQ ID NO: 174673 - DNA, 453 bp, Artificial Sequence
  Description of Artificial Sequence: Synthetic coding sequence
atgccctggcccctgctgctgctgctggccgtgtctggggcccagaccacccggccctgcttccctggctgccagtgtgaggtggagaccttcggcctgtttgacagcttcagcctgaccagggtggactgcagcggcctgggcccccacatcatgcctgtgcccatccccctggacacagcccacctggacctgagcagcaaccggctggagatggtgaatgaatctgtgctggccggccctggctacaccaccctggccggcctggacctgagccacaacctgctgaccagcatcagccccacagccttcagccggctgcgctacctggagagcctggacctgagccacaacggcctgacagccctgcctgctgagagcttcaccagcagccccctgagtgatgtgaacctgagccacaaccagctgcgggaggtgtctgtgtctgcctag

SEQ ID NO: 174674 - DNA, 2574 bp, Artificial Sequence
  Description of Artificial Sequence: Synthetic coding sequence
atggagagcgaggacctgagcggccgggagctgaccatcgacagcatcatgaacaaggtgcgggacatcaagaacaagttcaagaatgaagacctgacagatgagctgagcctgaacaagatctctgctgacaccacagacaacagcggcaccgtgaaccagatcatgatgatggccaacaaccctgaggactggctgagcctgctgctgaagctggagaagaacagcgtgcccctgagtgatgccctgctgaacaagctgattggccgctacagccaggccatcgaggccctgcccccagacaagtatggccagaatgaaagctttgcccgcatccaggtgcgctttgctgagctgaaggccatccaggagccagatgatgcccgggactacttccagatggcccgggccaactgcaagaagtttgcctttgtgcacatcagctttgcccagtttgagctgagccagggcaatgtgaagaagagcaagcagctgctgcagaaggctgtggagagaggagctgtgcccctggagatgctggagatcgccctgaggaacctgaacctgcagaagaagcagctgctgtctgaggaggagaagaagaacctgagcgccagcacagtgctgacagcccaggagagcttcagcggcagcctgggccacctgcagaacagaaacaacagctgtgacagccggggccagaccaccaaggcccgcttcctgtatggagagaacatgccaccccaggatgctgagatcggctacagaaacagcctgcggcagaccaacaagaccaagcagagctgccccttcggccgggtgcctgtgaacctgctgaacagcccagactgtgatgtgaagacagatgattctgtggtgccctgcttcatgaagaggcagaccagccgctcagaatgtcgggacctggtggtgcccggcagcaagcccagcggaaatgacagctgtgagctgaggaacctgaagtctgtgcagaacagccacttcaaggagcccctggtgtctgatgagaagagcagcgagctgatcatcacagacagcatcaccctgaagaacaagacagagagcagcctgctggccaagctggaggagaccaaggagtaccaggagcctgaggtgcctgagagcaaccagaagcagtggcagagcaagaggaagtctgagtgcatcaaccagaacccagctgccagcagcaaccactggcagatccctgagctggccaggaaggtgaacacagagcagaagcacaccacctttgagcagcccgtcttctctgtgtccaagcagagcccccccatcagcaccagcaagtggtttgaccccaagagcatctgcaagacccccagcagcaacaccctggatgactacatgagctgcttccgcacccctgtggtgaagaatgacttccccccagcctgccagctgagcaccccctacggccagcctgcctgcttccagcagcagcagcaccagatcctggccacccccctgcagaacctgcaggtgctggccagcagcagcgccaatgaatgcatctctgtgaagggccgcatctacagcatcctgaagcagatcggcagcggcggcagcagcaaggtgttccaggtgctgaatgagaagaagcagatctatgccatcaagtatgtgaacctggaggaggccgacaaccagaccctggacagctacagaaatgagatcgcctacctgaacaagctgcagcagcacagcgacaagatcatccggctgtatgactatgagatcacagaccagtacatctacatggtgatggagtgtggcaacatcgacctgaacagctggctgaagaagaagaagagcattgacccctgggagaggaagagctactggaagaacatgctggaggccgtgcacaccatccaccagcacggcatcgtgcacagcgacctgaagccagccaacttcctgattgtggatggcatgctgaagctgattgactttggaattgccaaccagatgcagcctgacaccacctctgtggtgaaggacagccaggtgggcaccgtgaactacatgcctcctgaggccatcaaggacatgagcagcagcagagaaaatggcaagagcaagagcaagatcagccccaagagtgatgtgtggagcctgggctgcatcctgtactacatgacctacggcaagacccccttccagcagatcatcaaccagatcagcaagctgcacgccatcatcgaccccaaccacgagattgagttcccagacatccctgagaaggacctgcaggatgtgctgaagtgctgcctgaagagggaccccaagcagaggatcagcatccctgagctgctggcccacccctacgtgcagatccagacccaccctgtgaaccagatggccaagggcaccacagaggagatgaagtatgtgctgggccagctggtgggcctgaacagccccaacagcatcctgaaggccgccaagaccctgtatgagcactacagcggcggggagagccacaacagcagcagcagcaagacctttgagaagaagaggggcaagaagtag

SEQ ID NO: 174675 - DNA, 420 bp, Artificial Sequence
  Description of Artificial Sequence: Synthetic coding sequence
atggagagcgaggacctgagcggccgggagctgaccatcgacagcatcatgaacaaggtgcgggacatcaagaacaagttcaagaatgaagacctgacagatgagctgagcctgaacaagatctctgctgacaccacagacaacagcggcaccgtgaaccagatcatgatgatggccaacaaccctgaggactggctgagcctgctgctgaagctggagaagaacagcgtgcccctgagtgatgccctgctgaacaagctgattggccgctacagccaggccatcgaggccctgcccccagacaagtatggccagaatgaaagctttgcccgcatccaggtgcgctttgctgagctgaaggccatccaggagccagatgatgcccgggactacttccagatggcccgggccaactgctag

SEQ ID NO: 174676 - DNA, 531 bp, Artificial Sequence
  Description of Artificial Sequence: Synthetic coding sequence
atggagagcgaggacctgagcggccgggagctgaccatcgacagcatcatgaacaaggtgcgggacatcaagaacaagttcaagaatgaagacctgacagatgagctgagcctgaacaagatctctgctgacaccacagacaacagcggcaccgtgaaccagatcatgatgatggccaacaaccctgaggactggctgagcctgctgctgaagctggagaagaacagcgtgcccctgagtgatgccctgctgaacaagctgattggccgctacagccaggccatcgaggccctgcccccagacaagtatggccagaatgaaagctttgcccgcatccaggtgcgctttgctgagctgaaggccatccaggagccagatgatgcccgggactacttccagatggcccgggccaactgcaagaagtttgcctttgtgcacatcagctttgcccagtttgagctgagccagggcaatgtgaagaagagcaagcagctgctgcagaaggctgtggagagaggagctgtgccctag

SEQ ID NO: 174677 - DNA, 453 bp, Artificial Sequence
  Description of Artificial Sequence: Synthetic coding sequence
atggagagcgaggacctgagcggccgggagctgaccatcgacagcatcatgaacaaggtgcgggacatcaagaacaagttcaagaatgaagacctgacagatgagctgagcctgaacaagatctctgctgacaccacagacaacagcggcaccgtgaaccagatcatgatgatggccaacaaccctgaggactggctgagcctgctgctgaagctggagaagaacagcgtgcccctgagtgatgccctgctgaacaagctgattggccgctacagccaggccatcgaggccctgcccccagacaagtatggccagaatgaaagctttgcccgcatccaggtgcgctttgctgagctgaaggccatccaggagccagatgatgcccgggactacttccagatggcccgggccaactgcaagaagtttgcctttgtgcacatcagctttgcctag

SEQ ID NO: 174678 - DNA, 492 bp, Artificial Sequence
  Description of Artificial Sequence: Synthetic coding sequence
atggccgagggcggcggccagaaccaccacgaggtggtgaagttcatggatgtgtaccagaggagctactgccaccccatcgagaccctggtggacatcttccaggagtacccagatgaaattgagtacatcttcaagcccagctgtgtgcccctgatgagatgtggcggctgctgcaatgatgagggcctggagtgtgtgcccacagaggagagcaacatcaccatgcagatcatgaggatcaagccccaccagggccagcacatcggggagatgtccttcctgcagcacaacaagtgtgaatgtcggcccaagaaggaccgggcccggcaggagaacccctgtggcccctgcagcgagaggaggaagcacctgtttgtgcaggacccccagacctgcaagtgcagctgcaagaacacagacagccgctgcaaggcccggcagctggagctgaatgaaagaacctgccgctgtgacaagcccaggaggtag

SEQ ID NO: 174679 - DNA, 1368 bp, Artificial Sequence
  Description of Artificial Sequence: Synthetic coding sequence
atgaccaccatggccgccgccaccctgctgcgggccaccccccacttcagcggcctggccgccggccgcaccttcctgctgcagggcctgctgcggctgctgaaggccccagccctgcccctgctgtgccggggcctggccgtggaggccaagaagacctacgtgcgggacaagccccacgtgaatgtgggcaccatcggccacgtggaccacggcaagaccaccctgacagctgccatcaccaagatcctggccgagggcggcggggccaagttcaagaagtatgaggagattgacaatgcccctgaggagcgggcccggggcatcaccatcaatgctgcccacgtggagtacagcacagctgcccggcactacgcccacacagactgccccggccacgccgactatgtgaagaacatgatcaccggcacagcccccctggatggctgcatcctggtggtggccgccaatgatggccccatgccccagacccgggagcacctgctgctggcccggcagatcggcgtggagcacgtggtggtgtatgtgaacaaggcagatgctgtgcaggacagcgagatggtggagctggtggagctggagatccgggagctgctgacagaatttggctacaagggggaggagacccctgtgattgtgggcagcgccctgtgtgccctggagggccgggaccctgagctgggcctgaagtctgtgcagaagctgctggatgctgtggacacctacatccctgtgcctgcccgggacctggagaagcccttcctgctgcctgtggaggccgtgtacagcgtgcccggccggggcaccgtggtgacaggcaccctggagcggggcatcctgaagaagggagatgaatgtgagctgctgggccacagcaagaacatcagaacagtggtgactggaattgagatgttccacaagagcctggagagagctgaggccggggacaacctgggcgccctggtgcggggcctgaagcgggaggacctgcggcggggcctggtgatggtgaagccaggcagcatcaagccccaccagaaggtggaggcccaggtgtacatcctgagcaaggaggagggcggccgccacaagccctttgtgagccacttcatgcctgtgatgttcagcctgacctgggacatggcctgccgcatcatcctgcccccagagaaggagctggccatgcctggagaggacctgaagttcaacctgatcctgcggcagcccatgatcctggagaagggccagcgcttcaccctgagagatggcaacagaaccatcggcaccggcctggtgaccaacaccctggccatgacagaggaggagaagaacatcaagtggggctag

SEQ ID NO: 174680 - DNA, 1611 bp, Artificial Sequence
  Description of Artificial Sequence: Synthetic coding sequence
atggccaccccagatgctggcctgcctggagctgagggcgtggagcccgccccctgggcccagctggaggccccagcccggctgctgctgcaggccctgcaggccggccctgagggcgcccggcggggcctgggcgtgctgcgggccctgggcagccggggctgggagccctttgactggggccgcctgctggaggccctgtgccgggaggagcctgtggtgcagggcccagatggccgcctggagctgaagcccctgctgctgcggctgccccgcatctgccagaggaacctgatgagcctgctgatggctgtgcggcccagcctgcctgagagcggcctgctgtctgtgctgcagatcgcccagcaggacctggccccagaccctgatgcctggctgcgggccctgggggagctgctgcggcgggacctgggcgtgggcacctccatggagggcgccagccccctgtctgagcgctgccagaggcagctgcagagcctgtgccggggcctgggcctgggcggccggcggctgaagagcccccaggccccagaccctgaggaggaggagaacagagacagccagcagcccgggaagaggaggaaggacagcgaggaggaggccgccagccctgagggcaagagggtgcccaagaggctgcgctgctgggaggaggaggaggaccacgagaaggagaggcctgagcacaagagcctggagagcctggctgatggcggcagcgccagccccatcaaggaccagcctgtgatggctgtgaagacaggagaagatggcagcaacctggatgatgccaagggcctggccgagagcctggagctgcccaaggccatccaggaccagctgccccggctgcagcagctgctgaagaccctggaggagggcctggagggcctggaggatgcccctcctgtggagctgcagctgctgcacgagtgcagccccagccagatggacctgctgtgtgcccagctgcagctgccccagctgagtgacctgggcctgctgcggctgtgcacctggctgctggccctgagcccagacctgagcctgagcaatgccaccgtgctgaccaggagcctcttcctgggccgcatcctgagcctgaccagcagcgccagccggctgctgaccacagccctgaccagcttctgtgccaagtacacctaccctgtgtgcagcgccctgctggaccctgtgctgcaggcccctggcaccggccctgcccagacagagctgctgtgctgcctggtgaagatggagagcctggagccagatgcccaggtgctgatgctgggccagatcctggagctgccctggaaggaggagaccttcctggtgctgcagagcctgctggagcggcaggtggagatgaccccagagaagttctctgtgctgatggagaagctgtgcaagaagggcctggccgccaccacctccatggcctatgccaagctgatgctgactgtgatgaccaagtaccaggccaacatcacagagacccagaggctgggcctggccatggccctggagcccaacaccaccttcctgaggaagagcctgaaggccgccctgaagcacctgggcccctag

SEQ ID NO: 174681 - DNA, 1470 bp, Artificial Sequence
  Description of Artificial Sequence: Synthetic coding sequence
atgcccctgagagatgagaccctgcgggaggtgtgggccagtgacagcggccacgaggaggagagcctgagccctgaggccccccggcggcccaagcagaggcctgccccagcccagaggctgaggaagaagaggacagaggcccctgagagcccctgccccaccggcagcaagcccaggaagccaggagaggaggaggaggaggaggaggatgaagaagatgaggaggaggaggccgaggagaagaaggagaagatcctgctgccccccaagaagcccctgcgggagaagagcagcgctgacctgaaggagcggcgggccaaggcccagggccccaggggggacctgggcagcccagaccccccacccaagcccctgcgggtgaggaacaaggaggccccagctggggagggcaccaagatgaggaagaccaagaagaagggcagcggggaggccgacaaggaccccagcggcagccctgccagcgccaggaagagccctgctgccatgttcctggtgggggagggcagcccagacaagaaggccctgaagaagaagggcacccccaagggggccaggaaggaggaggaggaggaggaggaggccgccaccgtcatcaagaagagcaaccagaagggcaaggccaagggcaagggcaagaagaaggccaaggaggagcgggcccccagcccccctgtggaggtggatgagccccgggagtttgtgctgcggcctgccccccagggccgcacagtgcgctgccgcctgacccgggacaagaagggcatggaccggggcatgtaccccagctacttcctgcacctggacacagagaagaaggtgttcctgctggccggcaggaagaggaagaggagcaagacagccaactacctgatcagcattgaccccaccaacctgagcagaggaggagagaacttcatcggcaagctgcggagcaacctgctgggcaaccgcttcaccgtgtttgacaatggccagaacccccagaggggctacagcaccaacgtggccagcctgcggcaggagctggccgccgtcatctatgagaccaacgtgctgggcttccggggccccaggaggatgaccgtcatcatccctggcatgtctgcagaaaatgaaagagtgcccatccggcccagaaatgccagtgatggcctgctggtgcgctggcagaacaagaccctggagagcctcatcgagctgcacaacaagccccctgtgtggaatgatgattctggcagctacaccctgaacttccagggccgggtgacccaggcctctgtgaagaacttccagatcgtgcatgctgatgatcctgactacatcgtgctgcagtttggccgggtggccgaggatgccttcaccctggactaccgctaccccctgtgtgccctgcaggcctttgccatcgccctgagcagctttgatggcaagctggcctgtgagtag

SEQ ID NO: 174682 - DNA, 561 bp, Artificial Sequence
  Description of Artificial Sequence: Synthetic coding sequence
atgcccctgagagatgagaccctgcgggaggtgtgggccagtgacagcggccacgaggaggagagcctgagccctgaggccccccggcggcccaagcagaggcctgccccagcccagaggctgaggaagaagaggacagaggcccctgagagcccctgccccaccggcagcaagcccaggaagccaggagaggaggaggaggaggaggaggatgaagaagatgaggaggaggaggccgaggagaagaaggagaagatcctgctgccccccaagaagcccctgcgggagaagagcagcgctgacctgaaggagcggcgggccaaggcccagggccccaggggggacctgggcagcccagaccccccacccaagcccctgcgggtgaggaacaaggaggccccagctggggagggcaccaagatgaggaagaccaagaagaagggcagcggggaggccgacaaggaccccagcggcagccctgccagcgccaggaagagccctgctgccatgttcctggtgggggagggcagcccagacaagaaggccctgaagaagaagtag

SEQ ID NO: 174683 - DNA, 3033 bp, Artificial Sequence
  Description of Artificial Sequence: Synthetic coding sequence
atgggcgcctatgcccgggccagcggcgtgtgtgcccggggctgcctggacagcgctggcccctggaccatgagccgggccctgcggccccccctgccccccctgtgcttcttcctgctgctgctggccgctgctggggcccgggccggcggctatgagacctgccccaccgtgcagcccaacatgctgaatgtgcacctgctgccccacacccatgatgatgtgggctggctgaagacagtggaccagtacttctacggcatcaagaatgacatccagcacgccggcgtgcagtacatcctggacagcgtcatcagcgccctgctggccgaccccacccggcgcttcatctacgtggagatcgccttcttcagccgctggtggcaccagcagaccaatgccacccaggaggtggtgcgggacctggtgcggcagggccgcctggagtttgccaacggcggctgggtgatgaatgatgaagctgccacccactatggagccatcgtggaccagatgaccctgggcctgcgcttcctggaggacacctttggaaatgatggccggccccgggtggcctggcacatcgaccccttcggccacagccgggagcaggccagcctgtttgcccagatgggctttgatggcttcttcttcggccgcctggactaccaggacaagtgggtgaggatgcagaagctggagatggagcaggtgtggagggccagcaccagcctgaagcccccaacagctgacctcttcaccggggtgctgcccaacggctacaaccccccaagaaacctgtgctgggatgtgctgtgtgtggaccagcccctggtggaggaccccaggagccctgagtacaatgccaaggagctggtggactacttcctgaatgtggccacagcccagggccgctactaccgcaccaaccacacagtgatgaccatgggcagtgacttccagtatgaaaatgccaacatgtggttcaagaacctggacaagctgatccggctggtgaatgcccaggccaagggcagctctgtgcacgtgctgtacagcaccccagcctgctacctgtgggagctgaacaaggccaacctgacctggagcgtgaagcatgatgacttcttcccctatgcagatggcccccaccagttctggacaggctacttcagcagcaggcctgccctgaagagatatgaaaggctgagctacaacttcctgcaggtgtgcaaccagctggaggccctggtgggcctggccgccaacgtgggcccctacggcagcggggacagcgcccccctgaatgaggccatggctgtgctgcagcaccatgatgctgtgtctggcaccagccggcagcacgtggccaatgactatgcccggcagctggccgccggctggggcccctgtgaggtgctgctgagcaatgccctggcccggctgcggggcttcaaggaccacttcaccttctgccagcagctgaacatcagcatctgccccctgagccagacagctgcccgcttccaggtgattgtgtacaaccccctgggcaggaaggtgaactggatggtgcggctgcctgtgtctgagggcgtgtttgtggtgaaggaccccaacggccgcacagtgcccagtgatgtggtgatcttccccagcagtgacagccaggcccaccccccagagctgctcttcagcgccagcctgcctgccctgggcttcagcacctacagcgtggcccaggtgccccgctggaagccccaggcccgggccccccagcccatccccaggaggtcctggagccctgccctgaccattgaaaatgagcacatccgggccacctttgatcctgacaccggcctgctgatggagatcatgaacatgaaccagcagctgctgctgcctgtgcggcagaccttcttctggtacaatgccagcattggagacaatgaaagtgaccaggccagcggggcctacatcttccggcccaaccagcagaagcccctgcctgtgagccgctgggcccagatccacctggtgaagacccccctggtgcaggaggtgcaccagaacttcagcgcctggtgcagccaggtggtgcggctgtacccaggccagaggcacctggagctggagtggagcgtgggccccatccctgtgggggacacctggggcaaggaggtgatcagcagatttgacacccccctggagaccaagggccgcttctacacagacagcaatggccgggagatcctggagaggagaagagactaccggcccacctggaagctgaaccagacagagcctgtggccggcaactactaccctgtgaacacccgcatctacatcacagatggcaacatgcagctgactgtgctgacagacaggagccagggcggcagcagcctgagagatggcagcctggagctgatggtgcaccggcggctgctgaaggatgatggccggggcgtgtctgagcccctgatggagaatggaagtggggcctgggtgcggggccgccacctggtgctgctggacacagcccaggccgctgctgctggccaccggctgctggccgagcaggaggtgctggccccccaggtggtgctggcccctgggggcggggccgcctacaacctgggcgccccacccaggacccagttcagcggcctgcggcgggacctgccccccagcgtgcacctgctgaccctggcctcctggggccctgagatggtgctgctgcggctggagcaccagtttgctgtgggggaggacagcggcaggaacctgagcgcccctgtgaccctgaacctgcgggacctcttcagcaccttcaccatcacccggctgcaggagaccaccctggtggccaaccagctgcgggaggccgccagccggctgaagtggaccaccaacacaggccccaccccccaccagaccccctaccagctggaccctgccaacatcaccctggagcccatggagatccgcaccttcctggcctctgtgcagtggaaggaggtggatggatag

SEQ ID NO: 174684 - DNA, 1158 bp, Artificial Sequence
  Description of Artificial Sequence: Synthetic coding sequence
atgcacgtgtgtgtgtgtgtgtgtgtgtgtgtgtacatgcctgtgtgtgtggatgcctgcatgtgctgtgaggccggccggcctgccttccgctccttcctgttcagcctgtgcagcgacctgggcgctgtgatcagcctgctgctgtggggccggcagctgtttgccctgtacagcggaaatgatgtgacagacatcagtgatgaccgcttccccaagcccccagaaattgccaacggctacgtggagcacctgttccgctaccagtgcaagaactactaccgcctgaggacagaaggagatggagtgtacaccctgaatgacaagaagcagtggatcaacaaggctgtgggggacaagctgcctgaatgtgaggccgtgtgtgggaagcccaagaacccagccaaccctgtgcagaggatcctgggcggccacctggatgccaagggcagcttcccctggcaggccaagatggtgagccaccacaacctgaccaccggggccaccctcatcaatgagcagtggctgctgaccacagccaagaacctcttcctgaaccacagtgaaaatgccacagccaaggacatcgcccccaccctgaccctgtatgtgggcaagaagcagctggtggagattgagaaggtggtgctgcaccccaactaccaccaggtggacatcggcctcatcaagctgaagcagaaggtgctggtgaatgaaagagtgatgcccatctgcctgcccagcaagaactatgcagaggtgggccgggtgggctacgtgtctggctggggccagagcgacaacttcaagctgacagaccacctgaagtatgtgatgctgcctgtggccgaccagtatgactgcatcacccactatgagggcagcacctgccccaagtggaaggcccccaagagccctgtgggcgtgcagcccatcctgaatgagcacaccttctgtgtgggcatgagcaagtaccaggaggacacctgctatggagatgctggcagcgcctttgctgtgcatgacctggaggaggacacctggtacgccgccggcatcctgagctttgacaagagctgtgctgtggccgagtatggagtgtatgtgaaggtgaccagcatccagcactgggtgcagaagaccatcgccgagaactag

SEQ ID NO: 174685 - DNA, 1329 bp, Artificial Sequence; identical to SEQ ID NO: 148061
  Description of Artificial Sequence: Synthetic coding sequence

SEQ ID NO: 174686 - DNA, 513 bp, Artificial Sequence
  Description of Artificial Sequence: Synthetic coding sequence
atgatgaagatgaggcaggccaagctggactaccagaggctgctgctggagaagaggcagaggaagaagaggctggagcccttcatggtgcagcccaaccctgaggcccggctgcggcgggccaagccccgggccagtgatgagcagacccccctggtgaactgccacaccccccacagcaatgtcatcctgcatggaattgatggccctgctgctgtgctgaagccagatgaggtgcacgcccccagcgtgagcagctctgtggtggaggaggatgctgagaacacagtggacacagccagcaagccaggcctgcaggagcggctgcagaagcatgacatcagcgagagcgtgaactttgatgaggagacagatggcatcagccagagcgcctgcctggagcggcccaacagcgccagcagccagaacagcaccttcagcagcttctgccagaagacagaggacaccggctaccgccacttccgcttctgctactgccggcccaccagctag

SEQ ID NO: 174687 - DNA, 801 bp, Artificial Sequence
  Description of Artificial Sequence: Synthetic coding sequence
atgctgaagaccccctggatcctgctgcccagccaggacttccgctctgtgtccaagtccatggacaccggcaccagcggcagcgccacagctgcccagcctgctgacaacctgctgggggacattgatgacctggaggactttgtgtacagccctgccccccagggcgtgacagtgcgctgccgcatcatccgggacaagaggggcatggaccggggcctcttccccacctactacatgtacctggagaaggaggagaaccagaagatcttcctgctggccgccaggaagaggaagaagagcaagacagccaactacctgatcagcattgatcctgtggacctgagccgggagggggagagctatgtgggcaagctgcggagcaacctgatgggcaccaagttcaccgtgtatgaccggggcatctgccccatgaagggccggggcctggtgggcgccgcccacacccggcaggagctggccgccatctcctacaaccacgacagcctgctgagccgctggcagaacagaaccatggagaacctggtggagctgcacaacaaggcccctgtgtggaacagcgacacccagagctatgtgctgaacttccggggccgggtgacccaggcctctgtgaagaacttccagatcgtgcacaagaatgaccctgactacatcgtgatgcagtttggccgggtggctgatgatgtgttcaccctggactacaactaccccctgtgtgctgtgcaggccttcggcatcggcctgagcagctttgacagcaagctggcctgtgagtag

SEQ ID NO: 174688 - DNA, 1506 bp, Artificial Sequence
  Description of Artificial Sequence: Synthetic coding sequence
atggaggccagccgctgccgcctgagccccagcggggacagcgtcttccacgaggagatgatgaagatgaggcaggccaagctggactaccagaggctgctgctggagaagaggcagaggaagaagaggctggagcccttcatggtgcagcccaaccctgaggcccggctgcggcgggccaagccccgggccagtgatgagcagacccccctggtgaactgccacaccccccacagcaatgtcatcctgcacggcattgatggccctgctgctgtgctgaagccagatgaggtgcacgcccccagcgtgagcagctctgtggtggaggaggatgctgaaaatacagtggacacagccagcaagccaggcctgcaggagcggctgcagaagcatgacatcagcgagagcgtgaactttgatgaggagacagatggcatcagccagagcgcctgcctggagcggcccaacagcgccagcagccagaacagcacagacaccggcaccagcggcagcgccacagctgcccagcctgctgacaacctgctgggggacattgatgacctggaggactttgtgtacagccctgccccccagggcgtgacagtgcgctgccgcatcatccgggacaagaggggcatggaccggggcctcttccccacctactacatgtacctggagaaggaggagaaccagaagatcttcctgctggccgccaggaagaggaagaagagcaagacagccaactacctgatcagcattgatcctgtggacctgagccgggagggggagagctatgtgggcaagctgcggagcaacctgatgggcaccaagttcaccgtgtatgaccggggcatctgccccatgaagggccggggcctggtgggcgccgcccacacccggcaggagctggccgccatctcctatgagaccaacgtgctgggcttcaagggccccaggaagatgtctgtcatcatccctggcatgaccctgaaccacaagcagatcccctaccagccccagaacaaccacgacagcctgctgagccgctggcagaacagaaccatggagaacctggtggagctgcacaacaaggcccctgtgtggaacagcgacacccagagctatgtgctgaacttccggggccgggtgacccaggcctctgtgaagaacttccagatcgtgcacaagaatgaccctgactacatcgtgatgcagtttggccgggtggctgatgatgtgttcaccctggactacaactaccccctgtgtgctgtgcaggccttcggcatcggcctgagcagctttgacaagtgcatccagaccctgaggatgcaggagctgtgtgagctgcaccggcagcaccacagcgctgccagcctggtgcacaggacagtgtgccagcgctgggtgggccacccctggaggctgctgccccagaccagcctgctgtggacagacctgagccccccacctgtggtgcctgccccccaccagatctccatgtag

SEQ ID NO: 174689 - DNA, 1269 bp, Artificial Sequence
  Description of Artificial Sequence: Synthetic coding sequence
atggccctgagtgatgagcctgctgctgggggccctgaggaggaggctgaagatgagaccctggcctttggagctgccctggaggccttcggggagagcgctgagacccgggccctgctgggccgcctgcgggaggtgcatggaggcggcgctgagcgggaggtggccctggagcgcttccgggagtggatgatgaacctgctgctggacatcgtgcaggaccagaccagccctgccagcctggtgcacctggccttcaagttcctgtacatcatcaccaaggtgcggggctacaagaccttcctgcggctcttcccccatgaggtggctgatgtggagcctgtgctggacctggtgaccatccagaaccccaaggaccacgaggcctgggagacccgctacatgctgctgctgtggctgtctgtgacctgcctgatcccctttgacttcagccggctggatggcaacctgctgacccagcccggccaggccaggatgagcatcatggaccgcatcctgcagattgctgagagctacctgattgtgtctgacaaggccagagatgctgctgctgtgctggtgagccgcttcatcaccaggccagatgtgaagcagagcaagatggccgagttcctggactggagcctgtgcaacctggcccggagcagcttccagaccatgcagggcgtcatcaccatggatggcaccctgcaggccctggcccagatcttcaagcacggcaagcgggaggactgcctgccctatgctgccaccgtgctgcgctgcctggatggctgccgcctgcctgagagcaaccagaccctgctgaggaagctgggcgtgaagctggtgcagaggctgggcctgaccttcctgaagcccaaggtggccgcctggagataccagaggggctgccgcagcctggccgccaacctgcagctgctgacccagggccagagcgagcagaagcccctcatcctgacagaagatgatgatgaagatgatgatgtgcctgagggcgtggagcgggtgattgagcagctgctggtgggcctgaaggacaaggacacagtggtgcgctggagcgctgccaagggcattggaaggatggccggccgcctgccccgggccctggctgatgatgtggtgggctctgtgctggactgcttctccttccaggagacagacaaggcctggcacggcggctgcctggccctggccgagctgggcagaagaggcctgctgctgcccagccggctggtggactag

SEQ ID NO: 174690 - DNA, 2997 bp, Artificial Sequence
  Description of Artificial Sequence: Synthetic coding sequence
atggatggcaccctgcaggccctggcccagatcttcaagcacggcaagcgggaggactgcctgccctatgctgccaccgtgctgcgctgcctggatggctgccgcctgcctgagagcaaccagaccctgctgaggaagctgggcgtgaagctggtgcagaggctgggcctgaccttcctgaagcccaaggtggccgcctggagataccagaggggctgccgcagcctggccgccaacctgcagctgctgacccagggccagagcgagcagaagcccctcatcctgacagaagatgatgatgaagatgatgatgtgcctgagggcgtggagcgggtgattgagcagctgctggtgggcctgaaggacaaggacacagtggtgcgctggagcgctgccaagggcattggaaggatggccggccgcctgccccgggccctggctgatgatgtggtgggctctgtgctggactgcttctccttccaggagacagacaaggcctggcacggcggctgcctggccctggccgagctgggcagaagaggcctgctgctgcccagccggctggtggatgtggtggccgtcatcctgaaggccctgacctatgatgagaagagaggagcctgcagcgtgggcaccaacgtgagagatgctgcctgctacgtgtgctgggcctttgcccgggcctatgagccccaggagctgaagccctttgtgacagccatcagcagcgccctggtgattgctgctgtgtttgaccgggacatcaactgccggcgggccgccagcgctgccttccaggagaatgtgggccggcagggcaccttcccccatggaattgacatcctgaccacagctgactactttgctgtgggcaacagaagcaactgcttcctggtgatctctgtgttcatcgccggcttccctgagtacacccagcccatgattgaccacctggtgaccatgaagatcagccactgggatggagtcatccgggagctggccgcccgggccctgcacaacctggcccagcaggcccctgagttcagcgccacccaggtgttcccccggctgctgtccatgaccctgagcccagacctgcacatgagacatggcagcatcctggcctgtgccgaggtggcctatgccctgtacaagctggccgcccaggagaacagacctgtgacagaccacctggatgagcaggccgtgcagggcctgaagcagatccaccagcagctgtatgaccggcagctgtaccggggcctgggcggccagctgatgaggcaggccgtgtgtgtgctgattgagaagctgagcctgagcaagatgcccttccggggggacacagtgattgatggctggcagtggctgatcaatgacaccctgcggcacctgcacctgatcagcagccacagccggcagcagatgaaggatgctgctgtgtctgccctggccgccctgtgcagcgagtactacatgaaggagcccggggaggccgaccctgccatccaggaggagctgatcacccagtacctggccgagctgaggaaccctgaggagatgacccgctgtggcttcagcctggccctgggcgccctgcccggcttcctgctgaagggccgcctgcagcaggtgctgaccggcctgcgggctgtgacccacaccagcccagaagatgtgtcctttgctgagagcagaagagatggcctgaaggccatcgcccgcatctgccagacagtgggcgtgaaggccggggccccagatgaggccgtgtgtggggagaatgtgtcccagatctactgtgccctgctgggctgcatggatgactacaccacagacagcagaggagatgtgggcacctgggtgaggaaggccgccatgaccagcctgatggacctgaccctgctgctggcccggagccagcctgagctgattgaggcccacacctgtgagcgcatcatgtgctgcgtggcccagcaggccagcgagaagattgaccgcttccgggcccacgccgccagcgtcttcctgaccctgctgcactttgacagcccccccatcccccacgtgccccacagaggagagctggagaagctgttccccaggagtgatgtggcctctgtgaactggagcgcccccagccaggccttcccccgcatcacccagctgctgggcctgcccacctaccgctaccacgtgctgctgggcctggtggtgtccctgggcggcctgacagagagcaccatccgccacagcacccagagcctgtttgagtacatgaagggcatccagagcgacccccaggccctgggcagcttcagcggcaccctgctgcagatctttgaggacaacctgctgaatgaaagagtgtctgtgcccctgctgaagaccctggaccacgtgctgacccacggctgctttgacatcttcaccacagaggaggaccacccctttgctgtgaagctgctggccctgtgcaagaaggagatcaagaacagcaaggacatccagaagctgctgtctggaattgctgtggacttccccagcgccaccctggtgtgtgtgggcaccgtgcagatgtatgcccacacccacctgcggctgggcgcccctggcccccactgtgcccacggcagcgccctgccccgcttctgtgagatggtgcagtttcctggagatgtgcggcggcaggccctgctgcagctgtgcctgctgctgtgccaccgcttccccctcatcaggaagaccacagccagccaggtgtatgagaccctgctgacctacagtgatgtggtgggcgcagatgtgctggatgaggtggtgacagtgctgagtgacacagcctgggatgctgagctggccgtggtgcgggagcagaggaaccggctgtgtgacctgctgggcgtgccccccagctggtgccccacctggtgcctgctgaagcctgtgctggagcccatcccccacccctgcctggtgaggatgagctgcagctag

SEQ ID NO: 174691 - DNA, 3579 bp, Artificial Sequence
  Description of Artificial Sequence: Synthetic coding sequence
atggccctgagtgatgagcctgctgctgggggccctgaggaggaggctgaagatgagaccctggcctttggagctgccctggaggccttcggggagagcgctgagacccgggccctgctgggccgcctgcgggaggtgcatggaggcggcgctgagcgggaggtggccctggagcgcttccgggtcatcatggacaagtaccaggagcagccccacctgctggacccccacctggagtggatgatgaacctgctgctggacatcgtgcaggaccagaccagccctgccagcctggtgcacctggccttcaagttcctgtacatcatcaccaaggtgcggggctacaagaccttcctgcggctcttcccccatgaggtggctgatgtggagcctgtgctggacctggtgaccatccagaaccccaaggaccacgaggcctgggagacccgctacatgctgctgctgtggctgtctgtgacctgcctgatcccctttgacttcagccggctggatggcaacctgctgacccagcccggccaggccaggatgagcatcatggaccgcatcctgcagattgctgagagctacctgattgtgtctgacaaggccagagatgctgctgctgtgctggtgagccgcttcatcaccaggccagatgtgaagcagagcaagatggccgagttcctggactggagcctgtgcaacctggcccggagcagcttccagaccatgcagggcgtcatcaccatggatggcaccctgcaggccctggcccagatcttcaagcacggcaagcgggaggactgcctgccctatgctgccaccgtgctgcgctgcctggatggctgccgcctgcctgagagcaaccagaccctgctgaggaagctgggcgtgaagctggtgcagaggctgggcctgaccttcctgaagcccaaggtggccgcctggagataccagaggggctgccgcagcctggccgccaacctgcagctgctgacccagggccagagcgagcagaagcccctcatcctgacagaagatgatgatgaagatgatgatgtgcctgagggcgtggagagggtcatcgagcagctgctggtgggcctgaaggacaaggacacagtggtgcgctggagcgctgccaagggcatcggccgcatggccggccgcctgccccgggccctggctgatgatgtggtgggctctgtgctggactgcttctccttccaggagacagacaaggcctggcatggaggctgcctggccctggccgagctgggccggcggggcctgctgctgcccagccggctggtggatgtggtggccgtcatcctgaaggccctgacctatgatgagaagagaggagcctgcagcgtgggcaccaacgtgagagatgctgcctgctacgtgtgctgggcctttgcccgggcctatgagccccaggagctgaagccctttgtgacagccatcagcagcgccctggtgattgctgctgtgtttgaccgggacatcaactgcagaagagctgccagcgctgccttccaggagaatgtgggccggcagggcaccttcccccacggcatcgacatcctgaccacagctgactactttgctgtgggcaacagaagcaactgcttcctggtgatcagcgtcttcatcgccggcttccctgagtacacccagcccatgattgaccacctggtgaccatgaagatcagccactgggatggagtcatccgggagctggccgcccgggccctgcacaacctggcccagcaggcccctgagttcagcgccacccaggtgttcccccggctgctgtccatgaccctgagcccagacctgcacatgagacatggcagcatcctggcctgtgccgaggtggcctatgccctgtacaagctggccgcccaggagaacagacctgtgacagaccacctggatgagcaggccgtgcagggcctgaagcagatccaccagcagctgtatgaccggcagctgtaccggggcctgggcggccagctgatgaggcaggccgtgtgtgtgctgattgagaagctgagcctgagcaagatgcccttccggggggacacagtgattgatggctggcagtggctgatcaatgacaccctgcggcacctgcacctgatcagcagccacagccggcagcagatgaaggatgctgctgtgtctgccctggccgccctgtgcagcgagtactacatgaaggagcctggagaggccgaccctgccatccaggaggagctgatcacccagtacctggccgagctgagaaatcctgaggagatgacccgctgtggcttcagcctggccctgggcgccctgcccggcttcctgctgaagggccgcctgcagcaggtgctgaccggcctgcgggctgtgacccacaccagcccagaagatgtgtcctttgctgagagcagaagagatggcctgaaggccatcgcccgcatctgccagacagtgggcgtgaaggccggggccccagatgaagctgtgtgtggagaaaatgtgtcccagatctactgtgccctgctgggctgcatggatgactacaccacagacagcagaggagatgtgggcacctgggtgaggaaggccgccatgaccagcctgatggacctgaccctgctgctggcccggagccagcctgagctgattgaggcccacacctgtgagcgcatcatgtgctgcgtggcccagcaggccagcgagaagattgaccgcttccgggcccatgctgcctctgtgttcctgaccctgctgcactttgacagcccccccatcccccacgtgccccacagaggagagctggagaagctgttccccaggagtgatgtggcctctgtgaactggagcgcccccagccaggccttcccccgcatcacccagctgctgggcctgcccacctaccgctaccacgtgctgctgggcctggtggtgtccctgggcggcctgacagagagcaccatccgccacagcacccagagcctgtttgagtacatgaagggcatccagagcgacccccaggccctgggcagcttcagcggcaccctgctgcagatctttgaggacaacctgctgaatgaaagagtgtctgtgcccctgctgaagaccctggaccacgtgctgacccacggctgctttgacatcttcaccacagaggaggaccacccctttgctgtgaagctgctggccctgtgcaagaaggagatcaagaacagcaaggacatccagaagctgctgagcggcattgctgtgttctgtgagatggtgcagtttcctggagatgtgcggcggcaggccctgctgcagctgtgcctgctgctgtgccaccgcttccccctcatcaggaagaccacagccagccaggtgtatgagaccctgctgacctacagtgatgtggtgggcgcagatgtgctggatgaggtggtgacagtgctgagtgacacagcctgggatgctgagctggccgtggtgcgggagcagaggaaccggctgtgtgacctgctgggcgtgccccggccccagctggtgccccagcccggggcctgctag

SEQ ID NO: 174692 - DNA, 936 bp, Artificial Sequence
  Description of Artificial Sequence: Synthetic coding sequence
atggccggccgcctgccccgggccctggctgatgatgtggtgggctctgtgctggactgcttctccttccaggagacagacaaggcctggcatggaggctgcctggccctggccgagctgggccggcggggcctgctgctgcccagccggctggtggatgtggtggccgtcatcctgaaggccctgacctatgatgagaagagaggagcctgcagcgtgggcaccaacgtgagagatgctgcctgctacgtgtgctgggcctttgcccgggcctatgagccccaggagctgaagccctttgtgacagccatcagcagcgccctggtgattgctgctgtgtttgaccgggacatcaactgcagaagagctgccagcgctgccttccaggagaatgtgggccggcagggcaccttcccccacggcatcgacatcctgaccacagctgactactttgctgtgggcaacagaagcaactgcttcctggtgatcagcgtcttcatcgccggcttccctgagtacacccagcccatgattgaccacctggtgaccatgaagatcagccactgggatggagtcatccgggagctggccgcccgggccctgcacaacctggcccagcaggcccctgagttcagcgccacccaggtgttcccccggctgctgtccatgaccctgagcccagacctgcacatgagacatggcagcatcctggcctgtgccgaggtggcctatgccctgtacaagctggccgcccaggagaacagacctgtgacagaccacctggatgagcaggccgtgcagggcctgaagcagatccaccagcagccctgcatctgctcctggggcctgatgagccctgagagcaaggccgagttctgtgtgtgtgtgtgccgcatcagcctgggccggcagtgtgtgcacctgagcggcctgtag

SEQ ID NO: 174693 - DNA, 2253 bp, Artificial Sequence
  Description of Artificial Sequence: Synthetic coding sequence
atggccctgagtgatgagcctgctgctgggggccctgaggaggaggctgaagatgagaccctggcctttggagctgccctggaggccttcggggagagcgctgagacccgggccctgctgggccgcctgcgggaggtgcatggaggcggcgctgagcgggaggtggccctggagcgcttccgggtcatcatggacaagtaccaggagcagccccacctgctggacccccacctggagtggatgatgaacctgctgctggacatcgtgcaggaccagaccagccctgccagcctggtgcacctggccttcaagttcctgtacatcatcaccaaggtgcggggctacaagaccttcctgcggctcttcccccatgaggtggctgatgtggagcctgtgctggacctggtgaccatccagaaccccaaggaccacgaggcctgggagacccgctacatgctgctgctgtggctgtctgtgacctgcctgatcccctttgacttcagccggctggatggcaacctgctgacccagcccggccaggccaggatgagcatcatggaccgcatcctgcagattgctgagagctacctgattgtgtctgacaaggccagagatgctgctgctgtgctggtgagccgcttcatcaccaggccagatgtgaagcagagcaagatggccgagttcctggactggagcctgtgcaacctggcccggagcagcttccagaccatgcagggcgtcatcaccatggatggcaccctgcaggccctggcccagatcttcaagcacggcaagcgggaggactgcctgccctatgctgccaccgtgctgcgctgcctggatggctgccgcctgcctgagagcaaccagaccctgctgaggaagctgggcgtgaagctggtgcagaggctgggcctgaccttcctgaagcccaaggtggccgcctggagataccagaggggctgccgcagcctggccgccaacctgcagctgctgacccagggccagagcgagcagaagcccctcatcctgacagaagatgatgatgaagatgatgatgtgcctgagggcgtggagagggtcatcgagcagctgctggtgggcctgaaggacaaggacacagtggtgcgctggagcgctgccaagggcatcggccgcatggccggccgcctgccccgggccctggctgatgatgtggtgggctctgtgctggactgcttctccttccaggagacagacaaggcctggcatggaggctgcctggccctggccgagctgggccggcggggcctgctgctgcccagccggctggtggatgtggtggccgtcatcctgaaggccctgacctatgatgagaagagaggagcctgcagcgtgggcaccaacgtgagagatgctgcctgctacgtgtgctgggcctttgcccgggcctatgagccccaggagctgaagccctttgtgacagccatcagcagcgccctggtgattgctgctgtgtttgaccgggacatcaactgcagaagagctgccagcgctgccttccaggagaatgtgggccggcagggcaccttcccccacggcatcgacatcctgaccacagctgactactttgctgtgggcaacagaagcaactgcttcctggtgatcagcgtcttcatcgccggcttccctgagtacacccagcccatgattgaccacctggtgaccatgaagatcagccactgggatggagtcatccgggagctggccgcccgggccctgcacaacctggcccagcaggcccctgagttcagcgccacccaggtgttcccccggctgctgtccatgaccctgagcccagacctgcacatgagacatggcagcatcctggcctgtgccgaggtggcctatgccctgtacaagctggccgcccaggagaacagacctgtgacagaccacctggatgagcaggccgtgcagggcctgaagcagatccaccagcagctgtatgaccggcagctgtaccggggcctgggcggccagctgatgaggcaggccgtgtgtgtgctgattgagaagctgagcctgagcaagatgcccttccggggggacacagtgattgatggctggcagtggctgatcaatgacagcctgtggctgctggtgggcctgggccggcccagccggctgcccagcgagaggcctgccccagctggcagccaccgcttcaagagcagctacccccacttcccccggggcaggaagttctgctag

SEQ ID NO: 174694 - DNA, 555 bp, Artificial Sequence
  Description of Artificial Sequence: Synthetic coding sequence
atgaagggcatccagagcgacccccaggccctgggcagcttcagcggcaccctgctgcagatctttgaggacaacctgctgaatgaaagagtgtctgtgcccctgctgaagaccctggaccacgtgctgacccacggctgctttgacatcttcaccacagaggaggaccacccctttgctgtgaagctgctggccctgtgcaagaaggagatcaagaacagcaaggacatccagaagctgctgagcggcattgctgtgttctgtgagatggtgcagtttcctggagatgtgcggcggcaggccctgctgcagctgtgcctgctgctgtgccaccgcttccccctcatcaggaagaccacagccagccaggtgtatgagaccctgctgacctacagtgatgtggtgggcgcagatgtgctggatgaggtggtgacagtgctgagtgacacagcctgggatgctgagctggccgtggtgcgggagcagaggaaccggctgtgtgacctgctgggcgtgccccggccccagctggtgccccagcccggggcctgctag

SEQ ID NO: 174695 - DNA, 1584 bp, Artificial Sequence
  Description of Artificial Sequence: Synthetic coding sequence
atgtctgacaccctgacagcagatgtgattggccggcgggtggaggtgaatggagagcacgccaccgtgcgctttgctggggtggtgccccctgtggccggcccctggctgggcgtggagtgggacaaccctgagcggggcaagcatgatggcagccatgagggcaccgtgtacttcaagtgccgccaccccactggaggcagcttcatccggcccaacaaggtgaactttggaacagacttcctgacagccatcaagaacagatatgtgctggaggatggccctgaggaggacaggaaggagcagatcgtgaccatcggcaacaagcctgtggagaccatcggctttgacagcatcatgaagcagcagagccagctgagcaagctgcaggaggtgtccctgaggaactgtgctgtgtcctgtgccggggagaagggcggcgtggccgaggcctgccccaacatcaggaaggtggacctgagcaagaacctgctgagctcctgggatgaagtcatccacatcgctgaccagctgcggcacctggaggtgctgaatgtgtctgagaacaagctgaagttccccagcggctctgtgctgaccggcaccctgtctgtgctgaaggtgctggtgctgaaccagacaggcatcacctgggccgaggtgctgcgctgtgtggccggctgccccggcctggaggagctgtacctggagagcaacaacatcttcatcagcgagcggcccacagatgtgctgcagacagtgaagctgctggacctgagcagcaaccagctgattgatgagaaccagctgtacctgattgcccacctgccccggctggagcagctgatcctgagtgacaccggcatcagcagcctgcacttcccagatgctggcatcggctgcaagacctccatgttccccagcctgaagtacctggtggtgaatgacaaccagatcagccagtggagcttcttcaatgagctggagaagctgcccagcctgcgggccctgagctgcctgaggaaccccctgaccaaggaggacaaggaggccgagacagcccggctgctgatcatcgccagcatcggccagctgaagaccctgaacaagtgtgagatcctgcctgaggagaggagaagagctgagctggactacaggaaggcctttggaaatgagtggaagcaggccggcggccacaaggaccctgagaagaaccggctgtctgaggagttcctgacagcccacccccgctaccagttcctgtgcctgaagtatggagcccctgaggactgggagctgaagacccagcagcccctgatgctgaagaaccagctgctgaccctgaagatcaagtacccccaccagctggaccagaaggtgctggagaagcagctgcccggctccatgaccatccagaaggtgaagggcctgctgagccggctgctgaaggtgcctgtgtctgacctgctgctgtcctatgagagccccaagaagccaggccgggagattgagctggagaatgacctgaagagcctgcagttctacagcgtggagaatggagactgcctgctggtgcgctggtag

SEQ ID NO: 174696 - DNA, 1584 bp, Artificial Sequence; identical to SEQ ID NO: 174695
  Description of Artificial Sequence: Synthetic coding sequence

SEQ ID NO: 174697 - DNA, 1737 bp, Artificial Sequence
  Description of Artificial Sequence: Synthetic coding sequence
atgtctgacaccctgacagcagatgtgattggccggcgggtggaggtgaatggagagcacgccaccgtgcgctttgctggggtggtgccccctgtggccggcccctggctgggcgtggagtgggacaaccctgagcggggcaagcatgatggcagccatgagggcaccgtgtacttcaagtgccgccaccccactggaggcagcttcatccggcccaacaaggtgaactttggaacagacttcctgacagccatcaagaacagatatgtgctggaggatggccctgaggaggacaggaaggagcagatcgtgaccatcggcaacaagcctgtggagaccatcggctttgacagcatcatgaagcagcagagccagctgagcaagctgcaggaggtgtccctgaggaactgtgctgtgtcctgtgccggggagaagggcggcgtggccgaggcctgccccaacatcaggaaggtggacctgagcaagaacctgctgagctcctgggatgaagtcatccacatcgctgaccagctgcggcacctggaggtgctgaatgtgtctgagaacaagctgaagttccccagcggctctgtgctgaccggcaccctgtctgtgctgaaggtgctggtgctgaaccagacaggcatcacctgggccgaggcccacgcccagtgtggcggcagccgccacggcctggacatgcagaaggatgccagcaagtttgtggacctgtgtgtgctgcagaagtgcagcaccagcaactgcatcatcagcgccaaggaccacacctccatgaggatgaatgtggccaaggtgctgcgctgtgtggccggctgccccggcctggaggagctgtacctggagagcaacaacatcttcatcagcgagcggcccacagatgtgctgcagacagtgaagctgctggacctgagcagcaaccagctgattgatgagaaccagctgtacctgattgcccacctgccccggctggagcagctgatcctgagtgacaccggcatcagcagcctgcacttcccagatgctggcatcggctgcaagacctccatgttccccagcctgaagtacctggtggtgaatgacaaccagatcagccagtggagcttcttcaatgagctggagaagctgcccagcctgcgggccctgagctgcctgaggaaccccctgaccaaggaggacaaggaggccgagacagcccggctgctgatcatcgccagcatcggccagctgaagaccctgaacaagtgtgagatcctgcctgaggagcggcggcgggcagagctggactacaggaaggcctttggaaatgagtggaagcaggccggcggccacaaggaccctgagaagaaccggctgtctgaggagttcctgacagcccacccccgctaccagttcctgtgcctgaagtacggggcccctgaggactgggagctgaagacccagcagcccctgatgctgaagaaccagctgctgaccctgaagatcaagtacccccaccagctggaccagaaggtgctggagaagcagctgcccggctccatgaccatccagaaggtgaagggcctgctgagccggctgctgaaggtgcctgtgtctgacctgctgctgtcctatgagagccccaagaagccaggccgggagattgagctggagaatgacctgaagagcctgcagttctacagcgtggagaatggagactgcctgctggtgcgctggtag

SEQ ID NO: 174698 - DNA, 2001 bp, Artificial Sequence
  Description of Artificial Sequence: Synthetic coding sequence
atgattcatgagctgctgctggccctgagcggctacccaggcagcatcttcacctggaacaagaggagcggcctgcaggtgtcccaggacttccccttcctgcaccccagcgagacctctgtgctgaaccggctgtgccgcctgggcacagactacatccgcttcacagagttcatcgagcagtacacaggccacgtgcagcagcaggaccaccaccccagccagcagggccagggcggcctgcacggcatctacctgcgggccttctgcaccggcctggacagcgtgctgcagccctaccggcaggccctgctggacctggagcaggagttcctgggggacccccacctgagcatcagccacgtgaactacttcctggaccagttccagctgctcttccccagcgtgatggtggtggtggagcagatcaagagccagaagatccacggctgccagatcctggagaccgtgtacaagcacagctgtggcggcctgccccctgtgcgcagcgccctggagaagatcctggccgtgtgccacggcgtgatgtacaagcagctgagcgcctggatgctgcacggcctgctgctggaccagcacgaggagttcttcatcaagcagggccccagcagtggaaatgtgtctgcccagcctgaggaggatgaggaggacctgggcattggaggcctgaccgggaagcagctgcgggagctgcaggacctgcggctcatcgaggaggagaacatgctggcccccagcctgaagcagttcagcctgcgggtggagatcctgcccagctacatccctgtgcgggtggccgagaagatcctgtttgtgggggagagcgtgcagatgtttgagaaccagaatgtgaacctgaccaggaagggcagcatcctgaagaaccaggaggacacctttgctgctgagctgcaccggctgaagcagcagcccctcttcagcctggtggactttgagcaggtggtggaccgcatccgcagcacagtggccgagcacctgtggaagctgatggtggaggagagtgacctgctgggccagctgaagatcatcaaggacttctacctgctgggccgcggggagctgttccaggccttcatcgacacagcccagcacatgctgaagaccccacccacagctgtgacagaacatgatgtgaatgtggccttccagcagagcgcccacaaggtgctgctggatgatgacaacctgctgcccctgctgcacctgaccatcgagtaccacggcaaggagcacaaggatgccacccaggcccgggagggccccagccgggagaccagcccccgggaggccccagccagcggctgggccgccctgggcctgagctacaaggtgcagtggcccctgcacatcctcttcaccccagctgtgctggagaagtacaacgtggtgttcaagtacctgctgtctgtgagaagagtgcaggccgagctgcagcactgctgggccctgcagatgcagaggaagcacctgaagagcaaccagacagatgccatcaagtggaggctgaggaaccacatggccttcctggtggacaacctgcagtactacctgcaggtggatgtgctggagagccagttcagccagctgctgcaccagatcaacagcacccgggactttgagagcatccggctggcccatgaccacttcctgagcaacctgctggcccagagcttcatcctgctgaagcctgtgttccactgcctgaatgagatcctggacctgtgccacagcttctgcagcctggtgtcccagaacctgggccccctggatgagcggggggccgcccagctgagcatcctggtgaagggcttcagccggcagagcagcctgctcttcaagatcctgagctctgtgaggaaccaccagatcaacagcgacctggcccagctgctgctgcggctggactacaacaagtactacacccaggccggcggcaccctgggcagctttggcatgtag

SEQ ID NO: 174699 - DNA, 660 bp, Artificial Sequence
  Description of Artificial Sequence: Synthetic coding sequence
atggctgacaaggccaagccagccaaggccgccaacagaacaccacccaagagccctggggaccccagcaaggacagagctgccaagaggctgagcctggagagcgagggcgctggggagggcgctgctgccagccctgagctgagcgccctggaggaggccttccgccgctttgctgtgcatggagatgcccgggccaccggccgggagatgcacggcaagaactggagcaagctgtgcaaggactgccaggtgattgatggaagaaatgtgacagtgacagatgtggacatcgtgttcagcaagatcaagggcaagagctgcaggaccatcacctttgagcagttccaggaggccctggaggagctggccaagaagcgcttcaaggacaagagcagcgaggaggccgtgcgggaggtgcacaggctcatcgagggcaaggcccccatcatcagcggcgtgaccaaggccatcagcagccccaccgtgtcccggctgacagacaccaccaagttcaccggcagccacaaggagagatttgaccccagcggcaagggcaagggcaaggccggccgggtggacctggtggatgaaagtggctacgtgtctggctacaagcacgccggcacctatgaccagaaggtgcagggcggcaagtag

SEQ ID NO: 174700 - DNA, 1071 bp, Artificial Sequence
  Description of Artificial Sequence: Synthetic coding sequence
atgagcaagctgtggaggcggggcagcaccagcggggccatggaggcccctgagcctggagaggccctggagctgagcctggccggggcccacggccatggagtgcacaagaagaagcacaagaagcacaagaagaagcacaagaagaagcaccaccaggaggaggatgctggccccacccagcccagccctgccaagccccagctgaagctgaagatcaagctgggcggccaggtgctgggcaccaagtctgtgcccaccttcaccgtcatccctgagggccccaggagccccagccccctgatggtggtggacaatgaggaggagcccatggagggcgtgcccctggagcagtaccgggcctggctggatgaggacagcaacctgagccccagccccctgcgggacctgagcggcggcctgggcggccaggaggaggaggaggagcagcgctggctggatgccctggagaagggggagctggatgacaacggggacctgaagaaggagatcaatgaaaggctgctgacagcccggcagagggccctgctgcagaaggcccggagccagcccagccccatgctgcccctgcctgtggccgagggctgccccccaccagccctgacagaggagatgctgctgaagcgggaggagcgggccaggaagaggcggctgcaggccgccaggagagctgaggagcacaagaaccagaccatcgagcggctgaccaagacagctgccaccagcggccggggcggccggggcggggcccggggggagaggagaggaggccgggctgctgccccagcccccatggtgcgctactgcagcggggcccagggcagcaccctgtccttccccccaggagtgcctgcccccacagctgtgtcccagaggcccagccccagcggccccccaccccgctgcagcgtgcccggctgcccccacccccggcgctatgcctgcagcaggacaggccaggccctgtgcagcctgcagtgctaccgcatcaacctgcagatgaggctgggcggccctgagggccctggcagccccctgctggccacctag

SEQ ID NO: 174701 - DNA, 1272 bp, Artificial Sequence
  Description of Artificial Sequence: Synthetic coding sequence
atggccggcaaggtgaagtgggtgacagacatcgagaagtctgtgctgatcaacaactttgagaagaggggctgggtgcaggtgacagaaaatgaagactggaacttctactggatgtctgtgcagaccatcagaaatgtgttttctgtggaggccggctaccgcctgagtgatgaccagatcgtgaaccacttccccaaccactatgagctgaccaggaaggacctgatggtgaagaacatcaagcgctacaggaaggagctggagaaggagggcagccccctggccgagaaggatgaaaatggcaagtacctgtacctggactttgtgcctgtgacctacatgctgcctgctgactacaacctgtttgtggaggagttcaggaagagccccagcagcacctggatcatgaagccctgtgggaaggcccagggcaagggcatcttcctgatcaacaagctgagccagatcaagaagtggagccgggacagcaagaccagcagctttgtgtcccagagcaacaaggaggcctacgtgatcagcctgtacatcaacaaccccctgctgattggaggcaggaagtttgacctgcggctgtatgtgctggtgtccacctaccggcccctgcgctgctacatgtacaagctgggcttctgccgcttctgcaccgtgaagtacacccccagcaccagcgagctggacaacatgtttgtgcacctgaccaacgtggccatccagaagcacggggaggactacaaccacatccacggcggcaagtggacagtgagcaacctgcggctgtacctggagagcacccggggcaaggaggtgaccagcaagctgtttgatgagatccactggatcatcgtgcagagcctgaaggctgtggcccctgtgatgaacaatgacaagcactgctttgagtgctacggctatgacatcatcattgatgacaagctgaagccctggctgattgaggtgaatgccagccccagcctgaccagcagcacagccaatgaccgcatcctgaagtacaacctgatcaatgacaccctgaacattgctgtgcccaacggggagatcccagactgcaagtggaacaagagcccccccaaggaggtgctgggcaactatgagatcctgtatgatgaggagctggcccagggagatggagctgaccgggagctgcggagccggcagggccagagcctgggcccccgggccggccgcagccgggacagcggccgggctgtgctgaccacctggaagtag

SEQ ID NO: 174702 - DNA, 1185 bp, Artificial Sequence
  Description of Artificial Sequence: Synthetic coding sequence
atggccggcaaggtgaagtgggtgacagacatcgagaagtctgtgctgatcaacaactttgagaagaggggctgggtgcaggtgacagaaaatgaagactggaacttctactggatgtctgtgcagaccatcagaaatgtgttttctgtggaggccggctaccgcctgagtgatgaccagatcgtgaaccacttccccaaccactatgagctgaccaggaaggacctgatggtgaagaacatcaagcgctacaggaaggagctggagaaggagggcagccccctggccgagaaggatgaaaatggcaagtacctgtacctggactttgtgcctgtgacctacatgctgcctgctgactacaacctgtttgtggaggagttcaggaagagccccagcagcacctggatcatgaagccctgtgggaaggcccagggcaagggcatcttcctgatcaacaagctgagccagatcaagaagtggagccgggacagcaagaccagcagctttgtgtcccagagcaacaaggaggcctacgtgatcagcctgtacatcaacaaccccctgctgattggaggcaggaagtttgacctgcggctgtatgtgctggtgtccacctaccggcccctgcgctgctacatgtacaagctgggcttctgccgcttctgcaccgtgaagtacacccccagcaccagcgagctggacaacatgtttgtgcacctgaccaacgtggccatccagaagcacggggaggactacaaccacatccacggcggcaagtggacagtgagcaacctgcggctgtacctggagagcacccggggcaaggaggtgaccagcaagctgtttgatgagatccactggatcatcgtgcagagcctgaaggctgtggccgtgaatgccagccccagcctgaccagcagcacagccaatgaccgcatcctgaagtacaacctgatcaatgacaccctgaacattgctgtgcccaatggagagatcccagactgcaagtggaacaagagcccccccaaggaggtgctgggcaactatgagatcctgtatgatgaggagctggcccagggagatggagctgaccgggagctgcggagccggcagggccagagcctgggccccagggctggccgcagccgggacagcggccgggctgtgctgaccacctggaagtag

SEQ ID NO: 174703 - DNA, 180 bp, Artificial Sequence
  Description of Artificial Sequence: Synthetic coding sequence
atggccggcaaggtgaagtgggtgacagacatcgagaagtctgtgctgatcaacaactttgagaagaggggctgggtgcaggtgacagaaaatgaagactggaacttctactggctgctggacctgcctgagttccgctaccgcagctgcctgaatgagttcccagacttccgggtgtag

SEQ ID NO: 174704 - DNA, 1068 bp, Artificial Sequence
  Description of Artificial Sequence: Synthetic coding sequence
atgccccaccagcccaccatcctgctgaacacagtgtctgccagcgccagcccctgcctgcaccctggggcccagaacatccccagccccaccggcctgccccgctgccgcagcggcagccacaccatcggccccttcagcagcttccagagcgctgcccacatctacagccagaagctgagccggcccagcagcgccaaggctgctggcagctgctacctgaacaagcaccacagcggcatcgccaagacccagaaggagggagaagatgccagcctgtacagcaagcgctacaaccagagcatggtgacagctgagctgcagaggctggccgagaagcaggccgcccggcagtacagccccagcagccacatcaacctgctgacccagcaggtgaccaacctgaacctggccaccggcatcatcaacagaagcagcgccagcgccccacccaccctgcggcccatcatcagccccagcggccccacctggagcacccagagcgacccccaggcccctgagaaccacagcagcagccctggcagccgcagcctgcagacaggaggctttgcctgggagggggaggtggagaacaacgtgtacagccaggccactggagtggtgccccagcacaagtaccaccccacagctggcagctaccagctgcagtttgccctgcagcagctggagcagcagaagctgcagagccggcagctgctggaccagagccgggcccggcaccaggccatcttcggcagccagaccctgcccaacagcaacctgtggaccatgaacaacggggccggctgccgcatcagcagcgccacagccagcggccagaagcccaccaccctgccccagaaggtggtgcccccacccagcagctgtgccagcctggtgcccaagcccccacccaaccacgagcaggtgctgcggcgggccaccagccagaaggccagcaagggcagcagcgctgagggccagctgaatggcctgcagagcagcctgaacccagctgcctttgtgcccatcaccagcagcacagtgaacagccacacagccctgtag

SEQ ID NO: 174705 - DNA, 3846 bp, Artificial Sequence
  Description of Artificial Sequence: Synthetic coding sequence
atgcccatcgtgatggcccgggacctggaggagacagccagcagcagtgaagatgaggaggtgatcagccaggaggaccacccctgcatcatgtggacaggaggctgccgccgcatccctgtgctggtgttccacgcagatgccatcctgaccaaggacaacaacatccgggtgattggagagcgctaccacctgagctacaagatcgtgaggacagacagccggctggtgcgcagcatcctgacagcccacggcttccacgaggtgcaccccagcagcacagactacaacctgatgtggacaggcagccacctgaagcccttcctgctgcggaccctgtctgaggcccagaaggtgaaccacttccccaggagctatgagctgaccaggaaggaccggctgtacaagaacatcatccgcatgcagcacacccacggcttcaaggccttccacatcctgccccagaccttcctgctgcctgcagaatatgcagagttctgcaacagctacagcaaggaccggggcccctggatcgtgaagcctgtggccagcagccggggccggggcgtgtacctgatcaacaaccccaaccagatcagcctggaggagaacatcctggtgagccgctacatcaacaaccccctgctgattgatgacttcaagtttgatgtgcggctgtatgtgctggtgaccagctatgaccccctggtgatctacctgtatgaggagggcctggccaggtttgccaccgtgcgctatgaccagggcgccaagaacatccggaaccagttcatgcacctgaccaactacagcgtgaacaagaagagcggggactatgtgtcctgtgatgatcctgaggtggaggactatggcaacaagtggagcatgtctgccatgctgcgctacctgaagcaggagggccgggacaccacagccctgatggcccacgtggaggacctgatcatcaagaccatcatctctgctgagctggccatcgccacagcctgcaagacctttgtgccccacaggagcagctgctttgagctgtatggctttgatgtgctgattgacagcaccctgaagccctggctgctggaggtgaacctgagccccagcctggcctgtgatgcccccctggacctgaagatcaaggcctccatgatcagtgacatgttcaccgtggtgggctttgtgtgccaggaccctgcccagagggccagcacccggcccatctaccccacctttgagagcagcagaagaaaccccttccagaagccccagcgctgccggcccctgagcgccagtgatgctgagatgaagaacctggtgggcagcgcccgggagaagggccctgggaagctgggcggctctgtgctgggcctgtccatggaggagatcaaggtgctgcggcgggtgaaggaggagaatgaccggcggggcggcttcatccgcatcttccccaccagcgagacctgggagatctacggcagctacctggagcacaagacctccatgaactacatgctggccaccaggctcttccaggacaggatgacagcagatggagcccctgagctgaagattgagagcctgaacagcaaggccaagctgcatgctgccctgtatgaaaggaagctgctgagcctggaggtgaggaagagaagaagaagaagcagccggctgcgggccatgaggcccaagtaccctgtgatcacccagcctgctgagatgaatgtgaagacagaaacagaaagtgaggaggaggaggaggtggccctggacaatgaagatgaggagcaggaggccagccaggaggagagcgctggcttcctgcgggagaaccaggccaagtacacccccagcctgacagccctggtggagaacacccccaaggagaacagcatgaaggtgcgggagtggaacaacaagggcggccactgctgcaagctggagacccaggagctggagcccaagttcaacctgatgcagatcctgcaggacaatggaaacctgagcaagatgcaggcccgcatcgccttcagcgcctacctgcagcacgtgcagatccggctgatgaaggacagcggcggccagaccttcagcgcctcctgggccgccaaggaggatgagcagatggagctggtggtgcgcttcctgaagagggccagcaacaacctgcagcacagcctgaggatggtgctgcccagccggcggctggccctgctggagcggcggcgcatcctggcccaccagctgggggacttcatcatcgtgtacaacaaggagacagagcagatggccgagaagaagagcaagaagaaggtggaggaggaggaggaggatggagtgaacatggagaacttccaggagttcatccggcaggccagcgaggccgagctggaggaggtgctgaccttctacacccagaagaacaagagcgcctctgtgttcctgggcacccacagcaagatcagcaagaacaacaacaactacagcgacagcggggccaagggggaccaccctgagaccatcatggaggaggtgaagatcaagccacccaagcagcagcagaccacagagatccacagcgacaagctgagccgcttcaccaccagcgctgagaaggaggccaagctggtgtacagcaacagcagcagcggccccacagccaccctgcagaagatccccaacacccacctgagctctgtgaccaccagtgacctgagccctggcccctgccaccacagcagcctgagccagatccccagcgccatccccagcatgccccaccagcccaccatcctgctgaacacagtgtctgccagcgccagcccctgcctgcaccctggggcccagaacatccccagccccaccggcctgccccgctgccgcagcggcagccacaccatcggccccttcagcagcttccagagcgctgcccacatctacagccagaagctgagccggcccagcagcgccaaggccggcagctgctacctgaacaagcaccacagcggcatcgccaagacccagaaggagggagaagatgccagcctgtacagcaagcgctacaaccagagcatggtgacagctgagctgcagaggctggccgagaagcaggccgcccggcagtacagccccagcagccacatcaacctgctgacccagcaggtgaccaacctgaacctggccaccggcatcatcaacagaagcagcgccagcgccccacccaccctgcggcccatcatcagccccagcggccccacctggagcacccagagcgacccccaggcccctgagaaccacagcagcagccctggcagccgcagcctgcagacaggaggctttgcctgggagggggaggtggagaacaacgtgtacagccaggccactggagtggtgccccagcacaagtaccaccccacagctggcagctaccagctgcagtttgccctgcagcagctggagcagcagaagctgcagagccggcagctgctggaccagagccgggcccggcaccaggccatcttcggcagccagaccctgcccaacagcaacctgtggaccatgaacaacggggccggctgccgcatcagcagcgccacagccagcggccagaagcccaccaccctgccccagaaggtggtgcccccacccagcagctgtgccagcctggtgcccaagcccccacccaaccacgagcaggtgctgcggcgggccaccagccagaaggccagcaagggcagcagcgctgagggccagctgaatggcctgcagagcagcctgaacccagctgcctttgtgcccatcaccagcagcacagatcctgcccacaccaagatctag

SEQ ID NO: 174706 - DNA, 2454 bp, Artificial Sequence
  Description of Artificial Sequence: Synthetic coding sequence
atgaaggagatcaaggtgctgcggcgggtgaaggaggagaatgaccggcggggcggcttcatccgcatcttccccaccagcgagacctgggagatctacggcagctacctggagcacaagacctccatgaactacatgctggccaccaggctcttccaggaccggggcaaccccaggaggagcctgctgaccggccgcaccaggatgacagcagatggagcccctgagctgaagattgagagcctgaacagcaaggccaagctgcacgccgccctgtatgaaaggaagctgctgagcctggaggtgaggaagagaagaagaagaagcagccggctgcgggccatgaggcccaagtaccctgtgatcacccagcctgctgagatgaatgtgaagacagaaacagagagcgaggaggaggaggaggtggccctggacaatgaagatgaggagcaggaggccagccaggaggagagcgctggcttcctgcgggagaaccaggccaagtacacccccagcctgacagccctggtggagaacacccccaaggaaaattccatgaaggtgcgggagtggaacaacaagggcggccactgctgcaagctggagacccaggagctggagcccaagttcaacctgatgcagatcctgcaggacaatggaaacctgagcaagatgcaggccagaattgccttcagcgcctacctgcagcacgtgcagatccggctgatgaaggacagcggcggccagaccttcagcgcctcctgggccgccaaggaggatgagcagatggagctggtggtgcgcttcctgaagagggccagcaacaacctgcagcacagcctgaggatggtgctgcccagccggcggctggccctgctggagcggcggcgcatcctggcccaccagctgggggacttcatcatcgtgtacaacaaggagacagagcagatggccgagaagaagagcaagaagaaggtggaggaggaggaggaggatggagtgaacatggagaacttccaggagttcatccggcaggccagcgaggccgagctggaggaggtgctgaccttctacacccagaagaacaagagcgccagcgtcttcctgggcacccacagcaagatcagcaagaacaacaacaactacagcgacagcggggccaagggggaccaccctgagaccatcatggaggaggtgaagatcaagccacccaagcagcagcagaccacagagatccacagcgacaagctgagccgcttcaccaccagcgctgagaaggaggccaagctggtgtacagcaacagcagcagcggccccacagccaccctgcagaagatccccaacacccacctgagctctgtgaccaccagtgacctgagccctggcccctgccaccacagcagcctgagccagatccccagcgccatccccagcatgccccaccagcccaccatcctgctgaacacagtgtctgccagcgccagcccctgcctgcaccctggggcccagaacatccccagccccaccggcctgccccgctgccgcagcggcagccacaccatcggccccttcagcagcttccagagcgctgcccacatctacagccagaagctgagccggcccagcagcgccaaggccggcagctgctacctgaacaagcaccacagcggcatcgccaagacccagaaggagggggaggatgccagcctgtacagcaagcgctacaaccagagcatggtgacagctgagctgcagaggctggccgagaagcaggccgcccggcagtacagccccagcagccacatcaacctgctgacccagcaggtgaccaacctgaacctggccaccggcatcatcaacagaagcagcgccagcgccccacccaccctgcggcccatcatcagccccagcggccccacctggagcacccagagcgacccccaggcccctgagaaccacagcagcagccctggcagccgcagcctgcagacaggaggctttgcctgggagggggaggtggagaacaacgtgtacagccaggccaccggggtggtgccccagcacaagtaccaccccacagctggcagctaccagctgcagtttgccctgcagcagctggagcagcagaagctgcagagccggcagctgctggaccagagccgggcccggcaccaggccatcttcggcagccagaccctgcccaacagcaacctgtggaccatgaacaatggagctggctgccgcatcagcagcgccacagccagcggccagaagcccaccaccctgccccagaaggtggtgcccccacccagcagctgtgccagcctggtgcccaagcccccacccaaccacgagcaggtgctgcggcgggccaccagccagaaggccagcaacacccgcttccgcagcagcttccagaactacctgtggtacttcttccaggccgtgtcctag

SEQ ID NO: 174707 - DNA, 2337 bp, Artificial Sequence
  Description of Artificial Sequence: Synthetic coding sequence
atggcccacgtggaggacctgatcatcaagaccatcatctctgctgagctggccatcgccacagcctgcaagacctttgtgccccacaggagcagctgctttgagctgtatggctttgatgtgctgattgacagcaccctgaagccctggctgctggaggtgaacctgagccccagcctggcctgtgatgcccccctggacctgaagatcaaggcctccatgatcagtgacatgttcaccgtggtgggctttgtgtgccaggaccctgcccagagggccagcacccggcccatctaccccacctttgagagcagcagaagaaaccccttccagaagccccagcgctgccggcccctgagcgccagtgatgctgagatgaagaacctggtgggcagcgcccgggagaagggccctgggaagctgggcggctctgtgctgggcctgtccatggaggagatcaaggtgctgcggcgggtgaaggaggagaatgacagaagaggaggcttcatccgcatcttccccaccagcgagacctgggagatctacggcagctacctggagcacaagacctccatgaactacatgctggccaccaggctcttccaggacaggatgacagcagatggagcccctgagctgaagattgagagcctgaacagcaaggccaagctgcacgccgccctgtatgaaaggaagctgctgagcctggaggtgaggaagagaagaagaagaagcagccggctgcgggccatgaggcccaagtaccctgtgatcacccagcctgctgagatgaatgtgaagacagaaacagagagcgaggaggaggaggaggtggccctggacaatgaagatgaggagcaggaggccagccaggaggagagcgctggcttcctgcgggagaaccaggccaagtacacccccagcctgacagccctggtggagaacacccccaaggaaaattccatgaaggtgcgggagtggaacaacaagggcggccactgctgcaagctggagacccaggagctggagcccaagttcaacctgatgcagatcctgcaggacaatggaaacctgagcaagatgcaggccagaattgccttcagcgcctacctgcagcacgtgcagatccggctgatgaaggacagcggcggccagaccttcagcgcctcctgggccgccaaggaggatgagcagatggagctggtggtgcgcttcctgaagagggccagcaacaacctgcagcacagcctgaggatggtgctgcccagccggcggctggccctgctggagcggcggcgcatcctggcccaccagctgggggacttcatcatcgtgtacaacaaggagacagagcagatggccgagaagaagagcaagaagaaggtggaggaggaggaggaggatggagtgaacatggagaacttccaggagttcatccggcaggccagcgaggccgagctggaggaggtgctgaccttctacacccagaagaacaagagcgccagcgtcttcctgggcacccacagcaagatcagcaagaacaacaacaactacagcgacagcggggccaagggggaccaccctgagaccatcatggaggaggtgaagatcaagccacccaagcagcagcagaccacagagatccacagcgacaagctgagccgcttcaccaccagcgctgagaaggaggccaagctggtgtacagcaacagcagcagcggccccacagccaccctgcagaagatccccaacacccacctgagctctgtgaccaccagtgacctgagccctggcccctgccaccacagcagcctgagccagatccccagcgccatccccagcatgccccaccagcccaccatcctgctgaacacagtgtctgccagcgccagcccctgcctgcaccctggggcccagaacatccccagccccaccggcctgccccgctgccgcagcggcagccacaccatcggccccttcagcagcttccagagcgctgcccacatctacagccagaagctgagccggcccagcagcgccaaggccggcagctgctacctgaacaagcaccacagcggcatcgccaagacccagaaggagggggaggatgccagcctgtacagcaagcgctacaaccagagcatggtgacagctgagctgcagaggctggccgagaagcaggccgcccggcagtacagccccagcagccacacagacccctggaagtatgacaggagcatccgcatgtgcagccccctgaacatcctggagcctgagttcaagaagtacctgatgggcatctacagcccccacagcagcaagaagaagaagaagtag

SEQ ID NO: 174708 - DNA, 1755 bp, Artificial Sequence
  Description of Artificial Sequence: Synthetic coding sequence
atgagaattggcacccccacagctggccctggccccagcgctgtgatggagggctgcctgggcgtggccgagctgaggaagctgagcaccttcagcgcctacctggaggaccacagctacaacgtggagcagatctggagggacattgaagatgtgatcatcaagaccctcatcagcgcccaccccatcatccgccacaactaccacacctgcttccccaaccacaccctgaacagcgcctgctttgagatcctgggctttgacatcctgctggaccacaagctgaagccctggctgctggaggtgaaccacagccccagcttcagcacagacagccggctggacaaggaggtgaaggatggcctgctgtatgacaccctggtgctgatcaacctggagagctgtgacaagaagaaggtgctggaggaggagcggcagaggggccagttcctgcagcagtgctgcagccgggagatgagaattgaggaggccaagggcttccgggctgtgcagctgaagaagacagagacctatgagaaggagaactgtggcggcttccgcctcatctaccccagcctgaacagcgagaagtatgagaagttcttccaggacaacaacagcctcttccagaacacagtggccagccgggcccgggaggagtatgcccggcagctgatccaggagctgcggctgaagcgggagaagaagcccttccagatgaagaagaaggtggagatgcagggcgagagcgctggggagcaggtgaggaagaagggcatgaggggctggcagcagaagcagcagcagaaggacaaggccgccacccaggccagcaagcagtacatccagcccctgaccctggtgtcctacaccccagacctgctgctgtctgtgcggggggagaggaagaatgaaacagacagcagcctgaaccaggaggcccccacagaggaggccagctctgtgttccccaagctgaccagcgccaagcccttcagcagcctgcctgacctgaggaacatcaacctgagcagcagcaagctggagcccagcaagcccaacttcagcatcaaggaggccaagagcgccagcgctgtgaatgtgttcaccggcaccgtgcacctgacctctgtggagaccaccccagagagcaccacccagctgagcatcagccccaagagcccccccaccctggccgtgacagccagcagcgagtacagcggccctgagacagacagagtggtgtccttcaagtgcaagaagcagcagaccccaccccacctgacccagaagaagatgctgaagagcttcctgcccaccaagagcaagagcttctgggagagccccaacaccaactggaccctgctgaagagtgacatgaacaagccccacctgatcagcgagctgctgaccaagctgcagctgagcggcaagctgtccttcttccctgcccactacaaccccaagctgggcatgaacaacctgagccagaaccccagcctgcccggggagtgccacagcagaagtgacagcagcggggagaagaggcagctggatgtgagcagcctgctgctgcagagcccccagagctacaacgtgaccctgcgggacctgctggtgattgccaccccagcccagctggacccccggccctgccgcagccacgccagcgccatgagggacccctgcatgcaggaccaggaggcctacagccactgcctgatcagcggccagaagggctgtgagaggagctag

SEQ ID NO: 174709 - DNA, 2532 bp, Artificial Sequence
  Description of Artificial Sequence: Synthetic coding sequence
atgccccagtgccccaccctggagagccaggagggagaaaattctgaggagaagggggacagcagcaaggaggaccccaaggagaccgtggccctggcctttgtgagagaaaatcctggggcccagaatggcctgcagaatgcccagcagcagggcaagaagaagaggaagaagaagaggctggtgatcaacctgagcagctgccgctatgagagcgtgcggcgggccgcccagcagtatggcttccgggagggcggagaagatgatgactggaccctgtactggacagactacagcgtgtccctggagcgggtgatggagatgaagagctaccagaagatcaaccacttccctggcatgtctgagatctgcaggaaggacctgctggccaggaacatgagcaggatgctgaagatgttccccaaggacttccgcttcttccccaggacctggtgcctgcctgctgactggggagacctgcagacctacagccgcagcaggaagaacaagacctacatctgcaagccagacagcggctgccagggcaagggcatcttcatcaccaggacagtgaaggagatcaagccaggagaggacatgatctgccagctgtacatcagcaagcccttcatcattgatggcttcaagtttgacctgcgcatctacgtgctggtgaccagctgtgaccccctgcgcatctttgtgtacaatgaaggcctggccaggtttgccaccaccagctacagccggccctgcacagacaacctggatgacatctgcatgcacctgaccaactacagcatcaacaagcacagcagcaacttcagcagagatgcccacagcggcagcaagaggaagctgagcaccttcagcgcctacctggaggaccacagctacaacgtggagcagatctggagggacattgaagatgtgatcatcaagaccctcatcagcgcccaccccatcatccgccacaactaccacacctgcttccccaaccacaccctgaacagcgcctgctttgagatcctgggctttgacatcctgctggaccacaagctgaagccctggctgctggaggtgaaccacagccccagcttcagcacagacagccggctggacaaggaggtgaaggatggcctgctgtatgacaccctggtgctgatcaacctggagagctgtgacaagaagaaggtgctggaggaggagcggcagaggggccagttcctgcagcagtgctgcagccgggagatgagaattgaggaggccaagggcttccgggctgtgcagctgaagaagacagagacctatgagaaggagaactgtggcggcttccgcctcatctaccccagcctgaacagcgagaagtatgagaagttcttccaggacaacaacagcctcttccagaacacagtggccagccgggcccgggaggagtatgcccggcagctgatccaggagctgcggctgaagcgggagaagaagcccttccagatgaagaagaaggtggagatgcagggcgagagcgctggggagcaggtgaggaagaagggcatgaggggctggcagcagaagcagcagcagaaggacaaggccgccacccaggccagcaagcagtacatccagcccctgaccctggtgtcctacaccccagacctgctgctgtctgtgcggggggagaggaagaatgaaacagacagcagcctgaaccaggaggcccccacagaggaggccagcagcgtcttccccaagctgaccagcgccaagcccttcagcagcctgcctgacctgaggaacatcaacctgagcagcagcaagctggagcccagcaagcccaacttcagcatcaaggaggccaagagcgccagcgctgtgaatgtgttcaccggcaccgtgcacctgacctctgtggagaccaccccagagagcaccacccagctgagcatcagccccaagagcccccccaccctggccgtgacagccagcagcgagtacagcggccctgagacagacagagtggtgtccttcaagtgcaagaagcagcagaccccaccccacctgacccagaagaagatgctgaagagcttcctgcccaccaagagcaagagcttctgggagagccccaacaccaactggaccctgctgaagagtgacatgaacaagccccacctgatcagcgagctgctgaccaagctgcagctgagcggcaagctgtccttcttccctgcccactacaaccccaagctgggcatgaacaacctgagccagaaccccagcctgcctggagagtgccacagcagaagtgacagcagtggagagaagaggcagctggatgtgagcagcctgctgctgcagagcccccagagctacaacgtgaccctgcgggacctgctggtgattgccaccccagcccagctggacccccggccctgccgcagccacgccagcgccatgagggacccctgcatgcaggaccaggaggcctacagccactgcctgatcagcggccagaagggctgtgagaggagctag

SEQ ID NO: 174710 - DNA, 558 bp, Artificial Sequence
  Description of Artificial Sequence: Synthetic coding sequence
cagcccatgggcgccctgctgctgcaccccagccggcggggccctgctggggtggtggcctcctggaccagcagccctgctggaagagatggcggcgtgggcattgctggggcctggtacttcccccgggccagcagccaggcccgggagatgccccagtgccccaccctggagagccaggagggagaaaattctgaggagaagggggacagcagcaaggaggaccccaaggagaccgtggccctggcctttgtgagagaaaatcctggggcccagaatggcctgcagaatgcccagcagcagggcaagaagaagaggaagaagaagaggatgcccctgaagaacagcaggaagaggcgcttcccctgcttcaagaaggccctgatctgccccggcaacctggtgcggctgcagtatgacagcaccatcctgacctaccaggaccccacagctgcctgtgccttccagttcctgttcaacatcagcccctgcctggcccccttccggctgattgatgagggcaagctggtgcacttcctgatccacagcttcccctag

SEQ ID NO: 174711 - DNA, 1710 bp, Artificial Sequence
  Description of Artificial Sequence: Synthetic coding sequence
atggagggctgcctgggcgtggccgagctgaggaagctgagcaccttcagcgcctacctggaggaccacagctacaacgtggagcagatctggagggacattgaagatgtgatcatcaagaccctcatcagcgcccaccccatcatccgccacaactaccacacctgcttccccaaccacaccctgaacagcgcctgctttgagatcctgggctttgacatcctgctggaccacaagctgaagccctggctgctggaggtgaaccacagccccagcttcagcacagacagccggctggacaaggaggtgaaggatggcctgctgtatgacaccctggtgctgatcaacctggagagctgtgacaagaagaaggtgctggaggaggagcggcagaggggccagttcctgcagcagtgctgcagccgggagatgagaattgaggaggccaagggcttccgggctgtgcagctgaagaagacagagacctatgagaaggagaactgtggcggcttccgcctcatctaccccagcctgaacagcgagaagtatgagaagttcttccaggacaacaacagcctcttccagaacacagtggccagccgggcccgggaggagtatgcccggcagctgatccaggagctgcggctgaagcgggagaagaagcccttccagatgaagaagaaggtggagatgcagggcgagagcgctggggagcaggtgaggaagaagggcatgaggggctggcagcagaagcagcagcagaaggacaaggccgccacccaggccagcaagcagtacatccagcccctgaccctggtgtcctacaccccagacctgctgctgtctgtgcggggggagaggaagaatgaaacagacagcagcctgaaccaggaggcccccacagaggaggccagcagcgtcttccccaagctgaccagcgccaagcccttcagcagcctgcctgacctgaggaacatcaacctgagcagcagcaagctggagcccagcaagcccaacttcagcatcaaggaggccaagagcgccagcgctgtgaatgtgttcaccggcaccgtgcacctgacctctgtggagaccaccccagagagcaccacccagctgagcatcagccccaagagcccccccaccctggccgtgacagccagcagcgagtacagcggccctgagacagacagagtggtgtccttcaagtgcaagaagcagcagaccccaccccacctgacccagaagaagatgctgaagagcttcctgcccaccaagagcaagagcttctgggagagccccaacaccaactggaccctgctgaagagtgacatgaacaagccccacctgatcagcgagctgctgaccaagctgcagctgagcggcaagctgtccttcttccctgcccactacaaccccaagctgggcatgaacaacctgagccagaaccccagcctgcctggagagtgccacagcagaagtgacagcagtggagagaagaggcagctggatgtgagcagcctgctgctgcagagcccccagagctacaacgtgaccctgcgggacctgctggtgattgccaccccagcccagctggacccccggccctgccgcagccacgccagcgccatgagggacccctgcatgcaggaccaggaggcctacagccactgcctgatcagcggccagaagggctgtgagaggagctag

SEQ ID NO: 174712 - DNA, 2676 bp, Artificial Sequence
  Description of Artificial Sequence: Synthetic coding sequence
atgggcgccctgctgctgcaccccagccggcggggccctgctggggtggtggcctcctggaccagcagccctgctggaagagatggcggcgtgggcattgctggggcctggtacttcccccgggccagcagccaggcccgggagatgccccagtgccccaccctggagagccaggagggagaaaattctgaggagaagggggacagcagcaaggaggaccccaaggagaccgtggccctggcctttgtgagagaaaatcctggggcccagaatggcctgcagaatgcccagcagcagggcaagaagaagaggaagaagaagaggctggtgatcaacctgagcagctgccgctatgagagcgtgcggcgggccgcccagcagtatggcttccgggagggcggagaagatgatgactggaccctgtactggacagactacagcgtgtccctggagcgggtgatggagatgaagagctaccagaagatcaaccacttccctggcatgtctgagatctgcaggaaggacctgctggccaggaacatgagcaggatgctgaagatgttccccaaggacttccgcttcttccccaggacctggtgcctgcctgctgactggggagacctgcagacctacagccgcagcaggaagaacaagacctacatctgcaagccagacagcggctgccagggcaagggcatcttcatcaccaggacagtgaaggagatcaagccaggagaggacatgatctgccagctgtacatcagcaagcccttcatcattgatggcttcaagtttgacctgcgcatctacgtgctggtgaccagctgtgaccccctgcgcatctttgtgtacaatgaaggcctggccaggtttgccaccaccagctacagccggccctgcacagacaacctggatgacatctgcatgcacctgaccaactacagcatcaacaagcacagcagcaacttcagcagagatgcccacagcggcagcaagaggaagctgagcaccttcagcgcctacctggaggaccacagctacaacgtggagcagatctggagggacattgaagatgtgatcatcaagaccctcatcagcgcccaccccatcatccgccacaactaccacacctgcttccccaaccacaccctgaacagcgcctgctttgagatcctgggctttgacatcctgctggaccacaagctgaagccctggctgctggaggtgaaccacagccccagcttcagcacagacagccggctggacaaggaggtgaaggatggcctgctgtatgacaccctggtgctgatcaacctggagagctgtgacaagaagaaggtgctggaggaggagcggcagaggggccagttcctgcagcagtgctgcagccgggagatgagaattgaggaggccaagggcttccgggctgtgcagctgaagaagacagagacctatgagaaggagaactgtggcggcttccgcctcatctaccccagcctgaacagcgagaagtatgagaagttcttccaggacaacaacagcctcttccagaacacagtggccagccgggcccgggaggagtatgcccggcagctgatccaggagctgcggctgaagcgggagaagaagcccttccagatgaagaagaaggtggagatgcagggcgagagcgctggggagcaggtgaggaagaagggcatgaggggctggcagcagaagcagcagcagaaggacaaggccgccacccaggccagcaagcagtacatccagcccctgaccctggtgtcctacaccccagacctgctgctgtctgtgcggggggagaggaagaatgaaacagacagcagcctgaaccaggaggcccccacagaggaggccagcagcgtcttccccaagctgaccagcgccaagcccttcagcagcctgcctgacctgaggaacatcaacctgagcagcagcaagctggagcccagcaagcccaacttcagcatcaaggaggccaagagcgccagcgctgtgaatgtgttcaccggcaccgtgcacctgacctctgtggagaccaccccagagagcaccacccagctgagcatcagccccaagagcccccccaccctggccgtgacagccagcagcgagtacagcggccctgagacagacagagtggtgtccttcaagtgcaagaagcagcagaccccaccccacctgacccagaagaagatgctgaagagcttcctgcccaccaagagcaagagcttctgggagagccccaacaccaactggaccctgctgaagagtgacatgaacaagccccacctgatcagcgagctgctgaccaagctgcagctgagcggcaagctgtccttcttccctgcccactacaaccccaagctgggcatgaacaacctgagccagaaccccagcctgcctggagagtgccacagcagaagtgacagcagtggagagaagaggcagctggatgtgagcagcctgctgctgcagagcccccagagctacaacgtgaccctgcgggacctgctggtgattgccaccccagcccagctggacccccggccctgccgcagccacgccagcgccatgagggacccctgcatgcaggaccaggaggcctacagccactgcctgatcagcggccagaagggctgtgagaggagctag

SEQ ID NO: 174713 - DNA, 306 bp, Artificial Sequence
  Description of Artificial Sequence: Synthetic coding sequence
atgccccagtgccccaccctggagagccaggagggagaaaattctgaggagaagggggacagcagcaaggaggaccccaaggagaccgtggccctggcctttgtgagagaaaatcctggggcccagaatggcctgcagaatgcccagcagcagggcaagaagaagaggaagaagaagaggctggtgatcaacctgagcagctgccgctatgagagcgtgcggcgggccgcccagcagtatggcttccgggagggcggagaagatgatgactggaccctgtactggacagactacagcgtgtcctag

SEQ ID NO: 174714 - DNA, 1356 bp, Artificial Sequence
  Description of Artificial Sequence: Synthetic coding sequence
atgagggagtgcatcagcatccacgtgggccaggccggcgtgcagattggaaatgcctgctgggagctgtactgcctggagcacggcatccagccagatggccagatgcccagcgacaagaccatcggcggcggagatgacagcttcaacaccttcttcagcgagaccggggccggcaagcacgtgcccagggctgtgtttgtggacctggagcccaccgtgattgatgaggtgaggacaggcacctaccggcagctgttccaccctgagcagctgatcaccgggaaggaggatgctgccaacaactatgcccggggccactacaccatcggcaaggagatcatcgacctggtgctggaccgcatcaggaagctggccgaccagtgcaccggcctgcagggcttcctggtgttccacagctttggaggcggcactggaagtggcttcaccagcctgctgatggagcggctgtctgtggactatggcaagaagagcaagctggagttcagcatctacccagccccccaggtgtccacagctgtggtggagccctacaacagcatcctgaccacccacaccaccctggagcacagcgactgtgccttcatggtggacaatgaggccatctatgacatctgcagaagaaacctggacatcgagcggcccacctacaccaacctgaaccggctgattggccagatcgtgagcagcatcacagccagcctgcgctttgatggagccctgaatgtggacctgacagagttccagaccaacctggtgccctacccccgcatccacttccccctggccacctacgcccctgtgatctctgctgagaaggcctaccacgagcagctgtctgtggccgagatcaccaatgcctgctttgagcccgccaaccagatggtgaagtgtgaccccaggcatggcaagtacatggcctgctgcctgctgtacagaggagatgtggtgcccaaggatgtgaatgctgccatcgccaccatcaagaccaagaggaccatccagtttgtggactggtgccccaccggcttcaaggtgggcatcaactaccagcccccaacagtggtgcctggaggagacctggccaaggtgcagagagctgtgtgcatgctgagcaacaccacagccatcgccgaggcctgggcccggctggaccacaagtttgacctgatgtatgccaagagggcctttgtgcactggtacgtgggggagggcatggaggagggggagttcagcgaggcccgggaggacatggccgccctggagaaggactatgaggaggtgggcgtggacagcgtggagggggagggggaggaggagggggaggagtactag

SEQ ID NO: 174715 - DNA, 1356 bp, Artificial Sequence; identical to SEQ ID NO: 174714
  Description of Artificial Sequence: Synthetic coding sequence

SEQ ID NO: 174716 - DNA, 1152 bp, Artificial Sequence
  Description of Artificial Sequence: Synthetic coding sequence
atgattgacctggagcccaccgtggtggatgaggtgcgggccggcacctaccggcagctgttccaccctgagcagctgatcaccgggaaggaggatgctgccaacaactatgcccggggccactacacagtgggcaaggagagcattgacctggtgctggaccgcatcaggaagctgacagatgcctgcagcggcctgcagggcttcctgatcttccacagctttggaggcggcactggaagtggcttcaccagcctgctgatggagcggctgagcctggactatggcaagaagagcaagctggagtttgccatctacccagccccccaggtgtccacagctgtggtggagccctacaacagcatcctgaccacccacaccaccctggagcacagcgactgtgccttcatggtggacaatgaggccatctatgacatctgcagaagaaacctggacatcgagcggcccacctacaccaacctgaacagactcatcagccagatcgtgagcagcatcacagccagcctgcgctttgatggagccctgaatgtggacctgacagagttccagaccaacctggtgccctacccccgcatccacttccccctggtgacctacgcccccatcatctctgctgagaaggcctaccacgagcagctgtctgtggccgagatcaccagcagctgctttgagcccaacagccagatggtgaagtgtgaccccaggcatggcaagtacatggcctgctgcatgctgtacagaggagatgtggtgcccaaggatgtgaatgtggccatcgccgccatcaagaccaagaggaccatccagtttgtggactggtgccccaccggcttcaaggtgggcatcaactaccagcccccaacagtggtgcctggaggagacctggccaaggtgcagagagctgtgtgcatgctgagcaacaccacagccatcgccgaggcctgggcccggctggaccacaagtttgacctgatgtatgccaagagggcctttgtgcactggtacgtgggggagggcatggaggagggggagttcagcgaggcccgggaggacctggccgccctggagaaggactatgaggaggtgggcacagacagctttgaggaggagaatgaaggagaggagttctag

SEQ ID NO: 174717 - DNA, 1350 bp, Artificial Sequence
  Description of Artificial Sequence: Synthetic coding sequence
atgagggagtgcatctctgtgcacgtgggccaggccggcgtgcagattggaaatgcctgctgggagctgttctgcctggagcacggcatccaggctgatggcacctttgatgcccaggccagcaagatcaatgatgatgacagcttcaccaccttcttcagcgagactggaaatggcaagcacgtgcccagggctgtgatgattgacctggagcccaccgtggtggatgaggtgcgggccggcacctaccggcagctgttccaccctgagcagctgatcaccgggaaggaggatgctgccaacaactatgcccggggccactacacagtgggcaaggagagcattgacctggtgctggaccgcatcaggaagctgacagatgcctgcagcggcctgcagggcttcctgatcttccacagctttggaggcggcactggaagtggcttcaccagcctgctgatggagcggctgagcctggactatggcaagaagagcaagctggagtttgccatctacccagccccccaggtgtccacagctgtggtggagccctacaacagcatcctgaccacccacaccaccctggagcacagcgactgtgccttcatggtggacaatgaggccatctatgacatctgcagaagaaacctggacatcgagcggcccacctacaccaacctgaacagactcatcagccagatcgtgagcagcatcacagccagcctgcgctttgatggagccctgaatgtggacctgacagagttccagaccaacctggtgccctacccccgcatccacttccccctggtgacctacgcccccatcatctctgctgagaaggcctaccacgagcagctgtctgtggccgagatcaccagcagctgctttgagcccaacagccagatggtgaagtgtgaccccaggcatggcaagtacatggcctgctgcatgctgtacagaggagatgtggtgcccaaggatgtgaatgtggccatcgccgccatcaagaccaagaggaccatccagtttgtggactggtgccccaccggcttcaaggtgggcatcaactaccagcccccaacagtggtgcctggaggagacctggccaaggtgcagagagctgtgtgcatgctgagcaacaccacagccatcgccgaggcctgggcccggctggaccacaagtttgacctgatgtatgccaagagggcctttgtgcactggtacgtgggggagggcatggaggagggggagttcagcgaggcccgggaggacctggccgccctggagaaggactatgaggaggtgggcacagacagctttgaggaggagaatgaaggagaggagttctag

SEQ ID NO: 174718 - DNA, 912 bp, Artificial Sequence
  Description of Artificial Sequence: Synthetic coding sequence
atggcccggcggggccctggctggaggcccctgctgctgctggtgctgctggccggggccgcccagggcggcctgtacttccggcggggccagacctgctaccggcccctgcggggagatggcctggcccccctgggccgcagcacctacccccggccccatgagtacctgagccctgctgacctgcccaagtcctgggactggagaaatgtggatggagtgaactatgccagcatcaccaggaaccagcacatcccccagtactgcggcagctgctgggcccacgccagcaccagcgccatggctgaccgcatcaacatcaagaggaagggggcctggcccagcaccctgctgtctgtgcagaatgtcatcgactgtggaaatgccggcagctgtgagggcggcaatgacctgtctgtgtgggactatgcccaccagcacggcatcccagatgagacctgcaacaactaccaggccaaggaccaggagtgtgacaagttcaaccagtgtggcacctgcaatgagttcaaggagtgccacgccatccggaactacaccctgtggagggtgggggactatggcagcctgagcggccgggagaagatgatggccgagatctatgccaacggccccatcagctgtggcatcatggccacagagcggctggccaactacacaggaggcatctatgcagagtaccaggacaccacctacatcaaccacgtggtgtctgtggccggctggggcatcagtgatggaacagagtactggatcgtgaggaacagctggggcgagccctggggcgagcggggctggctgagaattgtgaccagcacctacaaggatggcaagggggcccgctacaacctggccatcgaggagcactgcaccttcggggaccccatcgtgtag

SEQ ID NO: 174719 - DNA, 1338 bp, Artificial Sequence
  Description of Artificial Sequence: Synthetic coding sequence
atgagggagatcgtgcacatccaggccggccagtgtggcaaccagatcggggccaagttctgggaggtgatcagtgatgagcacggcatcgaccccaccggcagctaccatggagacagcgacctgcagctggagcgcatcaacgtgtactacaatgaggccactggaaacaagtatgtgccccgggccatcctggtggacctggagcccggcaccatggattctgtgcgcagcggccccttcggccagatcttccggccagacaactttgtgtttggccagagcggggccggcaacaactgggccaagggccactacacagaaggagctgagctggtggacagcgtgctggatgtggtgaggaaggagagcgagagctgtgactgcctgcagggcttccagctgacccacagcctgggcggcggcactggaagtggcatgggcaccctgctgatcagcaagatccgggaggagtacccagaccgcatcatgaacaccttctctgtgatgcccagccccaaggtgtctgacacagtggtggagccctacaatgccaccctgtctgtgcaccagctggtggagaacacagatgagacctactgcatcgacaatgaggccctgtatgacatctgcttccgcaccctgaagctgaccacccccacctacggggacctgaaccacctggtgtctgccaccatgtctggagtgaccacctgcctgcgcttccctggccagctgaatgctgacctgaggaagctggccgtgaacatggtgcccttcccccggctgcacttcttcatgcctggctttgcccccctgaccagccggggcagccagcagtaccgggccctgactgtgcctgagctgacccagcagatgtttgacagcaagaacatgatggccgcctgtgaccccaggcatggccgctacctgactgtggccgccatcttccggggccgcatgtccatgaaggaggtggatgagcagatgctgaatgtgcagaacaagaacagcagctactttgtggagtggatccccaacaacgtgaagacagctgtgtgtgacatccccccccggggcctgaagatgtctgccaccttcatcggcaacagcacagccatccaggagctgttcaagaggatcagcgagcagttcaccgccatgttccggaggaaggccttcctgcactggtacacaggagagggcatggatgagatggagttcacagaagctgagagcaacatgaatgacctggtgtctgagtaccagcagtaccaggatgccacagcagatgagcagggcgagtttgaggaggaggagggggaggatgaggcctag

SEQ ID NO: 174720 - DNA, 1353 bp, Artificial Sequence
  Description of Artificial Sequence: Synthetic coding sequence
atgagggagatcgtgcacatccaggccggccagtgtggcaaccagatcggggccaagttctgggaggtgatcagtgatgagcacggcatcgaccccagcggcaactacgtgggggacagcgacctgcagctggagcgcatctctgtgtactacaatgaggccagcagccacaagtatgtgccccgggccatcctggtggacctggagcccggcaccatggattctgtgcgcagcggggccttcggccacctgttccggccagacaacttcatcttcggccagagcggggccggcaacaactgggccaagggccactacacagaaggagctgagctggtggacagcgtgctggatgtggtgaggaaagaatgtgagaactgtgactgcctgcagggcttccagctgacccacagcctgggcggcggcactggaagtggcatgggcaccctgctgatcagcaaggtgcgggaggagtacccagaccgcatcatgaacaccttctctgtggtgcccagccccaaggtgtctgacacagtggtggagccctacaatgccaccctgagcatccaccagctggtggagaacacagatgagacctactgcatcgacaatgaggccctgtatgacatctgcttccgcaccctgaagctggccacccccacctacggggacctgaaccacctggtgtctgccaccatgtctggagtgaccaccagcctgcgcttccctggccagctgaatgctgacctgaggaagctggccgtgaacatggtgcccttcccccggctgcacttcttcatgcctggctttgcccccctgacagcccggggcagccagcagtaccgggccctgactgtgcctgagctgacccagcagatgtttgatgccaagaacatgatggccgcctgtgaccccaggcatggccgctacctgactgtggccaccgtcttccggggccgcatgtccatgaaggaggtggatgagcagatgctggccatccagagcaagaacagcagctactttgtggagtggatccccaacaacgtgaaggtggccgtgtgtgacatccccccccggggcctgaagatgagcagcaccttcatcggcaacagcacagccatccaggagctgttcaagaggatcagcgagcagttcaccgccatgttccggaggaaggccttcctgcactggtacacaggagagggcatggatgagatggagttcacagaagctgagagcaacatgaatgacctggtgtctgagtaccagcagtaccaggatgccacagctgaggaggagggggagatgtatgaagatgatgaggaggagagcgaggcccagggccccaagtag

SEQ ID NO: 174721 - DNA, 1137 bp, Artificial Sequence
  Description of Artificial Sequence: Synthetic coding sequence
atggattctgtgcgcagcggggccttcggccacctgttccggccagacaacttcatcttcggccagagcggggccggcaacaactgggccaagggccactacacagaaggagctgagctggtggacagcgtgctggatgtggtgaggaaagaatgtgagaactgtgactgcctgcagggcttccagctgacccacagcctgggcggcggcactggaagtggcatgggcaccctgctgatcagcaaggtgcgggaggagtacccagaccgcatcatgaacaccttctctgtggtgcccagccccaaggtgtctgacacagtggtggagccctacaatgccaccctgagcatccaccagctggtggagaacacagatgagacctactgcatcgacaatgaggccctgtatgacatctgcttccgcaccctgaagctggccacccccacctacggggacctgaaccacctggtgtctgccaccatgtctggagtgaccaccagcctgcgcttccctggccagctgaatgctgacctgaggaagctggccgtgaacatggtgcccttcccccggctgcacttcttcatgcctggctttgcccccctgacagcccggggcagccagcagtaccgggccctgactgtgcctgagctgacccagcagatgtttgatgccaagaacatgatggccgcctgtgaccccaggcatggccgctacctgactgtggccaccgtcttccggggccgcatgtccatgaaggaggtggatgagcagatgctggccatccagagcaagaacagcagctactttgtggagtggatccccaacaacgtgaaggtggccgtgtgtgacatccccccccggggcctgaagatgagcagcaccttcatcggcaacagcacagccatccaggagctgttcaagaggatcagcgagcagttcaccgccatgttccggaggaaggccttcctgcactggtacacaggagagggcatggatgagatggagttcacagaagctgagagcaacatgaatgacctggtgtctgagtaccagcagtaccaggatgccacagctgaggaggagggggagatgtatgaagatgatgaggaggagagcgaggcccagggccccaagtag

SEQ ID NO: 174722 - DNA, 1335 bp, Artificial Sequence
  Description of Artificial Sequence: Synthetic coding sequence
atgagggagatcgtgcacatccaggccggccagtgtggcaaccagatcggggccaagttctgggaggtgatcagtgatgagcacggcatcgaccccaccggcacctaccatggagacagcgacctgcagctggaccgcatctctgtgtactacaatgaggccactggaggcaagtatgtgccccgggccatcctggtggacctggagcccggcaccatggattctgtgcgcagcggccccttcggccagatcttccggccagacaactttgtgtttggccagagcggggccggcaacaactgggccaagggccactacacagaaggagctgagctggtggacagcgtgctggatgtggtgaggaaggaggccgagagctgtgactgcctgcagggcttccagctgacccacagcctgggcggcggcactggaagtggcatgggcaccctgctgatcagcaagatccgggaggagtacccagaccgcatcatgaacaccttctctgtggtgcccagccccaaggtgtctgacacagtggtggagccctacaatgccaccctgtctgtgcaccagctggtggagaacacagatgagacctactgcatcgacaatgaggccctgtatgacatctgcttccgcaccctgaagctgaccacccccacctacggggacctgaaccacctggtgtctgccaccatgtctggagtgaccacctgcctgcgcttccctggccagctgaatgctgacctgaggaagctggccgtgaacatggtgcccttcccccggctgcacttcttcatgcctggctttgcccccctgaccagccggggcagccagcagtaccgggccctgactgtgcctgagctgacccagcaggtgtttgatgccaagaacatgatggccgcctgtgaccccaggcatggccgctacctgactgtggccgctgtgttccggggccgcatgtccatgaaggaggtggatgagcagatgctgaatgtgcagaacaagaacagcagctactttgtggagtggatccccaacaacgtgaagacagctgtgtgtgacatccccccccggggcctgaagatggctgtgaccttcatcggcaacagcacagccatccaggagctgttcaagaggatcagcgagcagttcaccgccatgttccggaggaaggccttcctgcactggtacacaggagagggcatggatgagatggagttcacagaagctgagagcaacatgaatgacctggtgtctgagtaccagcagtaccaggatgccacagctgaggaggaggaggactttggagaggaggccgaggaggaggcctag

SEQ ID NO: 174723 - DNA, 1119 bp, Artificial Sequence
  Description of Artificial Sequence: Synthetic coding sequence
atggattctgtgcgcagcggccccttcggccagatcttccggccagacaactttgtgtttggccagagcggggccggcaacaactgggccaagggccactacacagaaggagctgagctggtggacagcgtgctggatgtggtgaggaaggaggccgagagctgtgactgcctgcagggcttccagctgacccacagcctgggcggcggcactggaagtggcatgggcaccctgctgatcagcaagatccgggaggagtacccagaccgcatcatgaacaccttctctgtggtgcccagccccaaggtgtctgacacagtggtggagccctacaatgccaccctgtctgtgcaccagctggtggagaacacagatgagacctactgcatcgacaatgaggccctgtatgacatctgcttccgcaccctgaagctgaccacccccacctacggggacctgaaccacctggtgtctgccaccatgtctggagtgaccacctgcctgcgcttccctggccagctgaatgctgacctgaggaagctggccgtgaacatggtgcccttcccccggctgcacttcttcatgcctggctttgcccccctgaccagccggggcagccagcagtaccgggccctgactgtgcctgagctgacccagcaggtgtttgatgccaagaacatgatggccgcctgtgaccccaggcatggccgctacctgactgtggccgctgtgttccggggccgcatgtccatgaaggaggtggatgagcagatgctgaatgtgcagaacaagaacagcagctactttgtggagtggatccccaacaacgtgaagacagctgtgtgtgacatccccccccggggcctgaagatggctgtgaccttcatcggcaacagcacagccatccaggagctgttcaagaggatcagcgagcagttcaccgccatgttccggaggaaggccttcctgcactggtacacaggagagggcatggatgagatggagttcacagaagctgagagcaacatgaatgacctggtgtctgagtaccagcagtaccaggatgccacagctgaggaggaggaggactttggagaggaggccgaggaggaggcctag

SEQ ID NO: 174724 - DNA, 1335 bp, Artificial Sequence; identical to SEQ ID NO: 174722
  Description of Artificial Sequence: Synthetic coding sequence

SEQ ID NO: 174725 - DNA, 1119 bp, Artificial Sequence; identical to SEQ ID NO: 174723
  Description of Artificial Sequence: Synthetic coding sequence

SEQ ID NO: 174726 - DNA, 1281 bp, Artificial Sequence
  Description of Artificial Sequence: Synthetic coding sequence
atgttctgggaggtgatcagtgatgagcacggcatcgaccccaccggcacctaccatggagacagcgacctgcagctggaccgcatctctgtgtactacaatgaggccactggaggcaagtatgtgccccgggccatcctggtggacctggagcccggcaccatggattctgtgcgcagcggccccttcggccagatcttccggccagacaactttgtgtttggccagagcggggccggcaacaactgggccaagggccactacacagaaggagctgagctggtggacagcgtgctggatgtggtgaggaaggaggccgagagctgtgactgcctgcagggcttccagctgacccacagcctgggcggcggcactggaagtggcatgggcaccctgctgatcagcaagatccgggaggagtacccagaccgcatcatgaacaccttctctgtggtgcccagccccaaggtgtctgacacagtggtggagccctacaatgccaccctgtctgtgcaccagctggtggagaacacagatgagacctactgcatcgacaatgaggccctgtatgacatctgcttccgcaccctgaagctgaccacccccacctacggggacctgaaccacctggtgtctgccaccatgtctggagtgaccacctgcctgcgcttccctggccagctgaatgctgacctgaggaagctggccgtgaacatggtgcccttcccccggctgcacttcttcatgcctggctttgcccccctgaccagccggggcagccagcagtaccgggccctgactgtgcctgagctgacccagcaggtgtttgatgccaagaacatgatggccgcctgtgaccccaggcatggccgctacctgactgtggccgctgtgttccggggccgcatgtccatgaaggaggtggatgagcagatgctgaatgtgcagaacaagaacagcagctactttgtggagtggatccccaacaacgtgaagacagctgtgtgtgacatccccccccggggcctgaagatggctgtgaccttcatcggcaacagcacagccatccaggagctgttcaagaggatcagcgagcagttcaccgccatgttccggaggaaggccttcctgcactggtacacaggagagggcatggatgagatggagttcacagaagctgagagcaacatgaatgacctggtgtctgagtaccagcagtaccaggatgccacagctgaggaggaggaggactttggagaggaggccgaggaggaggcctag

SEQ ID NO: 174727 - DNA, 1119 bp, Artificial Sequence; identical to SEQ ID NO: 174723
  Description of Artificial Sequence: Synthetic coding sequence

SEQ ID NO: 174728 - DNA, 1119 bp, Artificial Sequence; identical to SEQ ID NO: 174723
  Description of Artificial Sequence: Synthetic coding sequence

SEQ ID NO: 174729 - DNA, 1281 bp, Artificial Sequence; identical to SEQ ID NO: 174726
  Description of Artificial Sequence: Synthetic coding sequence

SEQ ID NO: 174730 - DNA, 1281 bp, Artificial Sequence; identical to SEQ ID NO: 174726
  Description of Artificial Sequence: Synthetic coding sequence

SEQ ID NO: 174731 - DNA, 1119 bp, Artificial Sequence; identical to SEQ ID NO: 174723
  Description of Artificial Sequence: Synthetic coding sequence

SEQ ID NO: 174732 - DNA, 1281 bp, Artificial Sequence; identical to SEQ ID NO: 174726
  Description of Artificial Sequence: Synthetic coding sequence

SEQ ID NO: 174733 - DNA, 1335 bp, Artificial Sequence; identical to SEQ ID NO: 174722
  Description of Artificial Sequence: Synthetic coding sequence

SEQ ID NO: 174734 - DNA, 1281 bp, Artificial Sequence; identical to SEQ ID NO: 174726
  Description of Artificial Sequence: Synthetic coding sequence

SEQ ID NO: 174735 - DNA, 1119 bp, Artificial Sequence; identical to SEQ ID NO: 174723
  Description of Artificial Sequence: Synthetic coding sequence

SEQ ID NO: 174736 - DNA, 1335 bp, Artificial Sequence; identical to SEQ ID NO: 174722
  Description of Artificial Sequence: Synthetic coding sequence

SEQ ID NO: 174737 - DNA, 1335 bp, Artificial Sequence; identical to SEQ ID NO: 174722
  Description of Artificial Sequence: Synthetic coding sequence

SEQ ID NO: 174738 - DNA, 1335 bp, Artificial Sequence; identical to SEQ ID NO: 174722
  Description of Artificial Sequence: Synthetic coding sequence

SEQ ID NO: 174739 - DNA, 1062 bp, Artificial Sequence
  Description of Artificial Sequence: Synthetic coding sequence
atgagggagatcgtgcacatccaggccggccagtgtggcaaccagatcggggccaagttctgggaggtgatcagtgatgagcacggcatcgaccccaccggcacctaccatggagacagcgacctgcagctgacccacagcctgggcggcggcaccggcagcggcatgggcaccctgctgatcagcaagatccgggaggagtacccagaccgcatcatgaacaccttctctgtggtgcccagccccaaggtgtctgacacagtggtggagccctacaatgccaccctgtctgtgcaccagctggtggagaacacagatgagacctactgcatcgacaatgaggccctgtatgacatctgcttccgcaccctgaagctgaccacccccacctatggagacctgaaccacctggtgtctgccaccatgtctggagtgaccacctgcctgcgcttccctggccagctgaatgctgacctgaggaagctggccgtgaacatggtgcccttcccccggctgcacttcttcatgcctggctttgcccccctgaccagccggggcagccagcagtaccgggccctgactgtgcctgagctgacccagcaggtgtttgatgccaagaacatgatggccgcctgtgaccccaggcatggccgctacctgactgtggccgctgtgttccggggccgcatgtccatgaaggaggtggatgagcagatgctgaatgtgcagaacaagaacagcagctactttgtggagtggatccccaacaacgtgaagacagctgtgtgtgacatccccccccggggcctgaagatggctgtgaccttcatcggcaacagcacagccatccaggagctgttcaagaggatcagcgagcagttcaccgccatgttccggaggaaggccttcctgcactggtacaccggggagggcatggatgagatggagttcacagaggccgagagcaacatgaatgacctggtgtctgagtaccagcagtaccaggatgccacagctgaggaggaggaggactttggagaggaggccgaggaggaggcctag

SEQ ID NO: 174740 - DNA, 1281 bp, Artificial Sequence; identical to SEQ ID NO: 174726
  Description of Artificial Sequence: Synthetic coding sequence

SEQ ID NO: 174741 - DNA, 1119 bp, Artificial Sequence; identical to SEQ ID NO: 174723
  Description of Artificial Sequence: Synthetic coding sequence

SEQ ID NO: 174742 - DNA, 1281 bp, Artificial Sequence; identical to SEQ ID NO: 174726
  Description of Artificial Sequence: Synthetic coding sequence

SEQ ID NO: 174743 - DNA, 1281 bp, Artificial Sequence; identical to SEQ ID NO: 174726
  Description of Artificial Sequence: Synthetic coding sequence

SEQ ID NO: 174744 - DNA, 1119 bp, Artificial Sequence; identical to SEQ ID NO: 174723
  Description of Artificial Sequence: Synthetic coding sequence

SEQ ID NO: 174745 - DNA, 1335 bp, Artificial Sequence; identical to SEQ ID NO: 174722
  Description of Artificial Sequence: Synthetic coding sequence

SEQ ID NO: 174746 - DNA, 732 bp, Artificial Sequence
  Description of Artificial Sequence: Synthetic coding sequence
atgagggagatcgtgcacatccaggccggccagtgtggcaaccagatcggggccaagttctgggaggtgatcagtgatgagcacggcatcgaccccaccggcacctaccatggagacagcgacctgcagctggaccgcatctctgtgtactacaatgaggccactggaggcaagtatgtgccccgggccatcctggtggacctggagcccggcaccatggattctgtgcgcagcggccccttcggccagatcttccggccagacaactttgtgtttggccagagcggggccggcaacaactgggccaagggccactacacagaaggagctgagctggtggacagcgtgctggatgtggtgaggaaggaggaggtggatgagcagatgctgaatgtgcagaacaagaacagcagctactttgtggagtggatccccaacaacgtgaagacagctgtgtgtgacatccccccccggggcctgaagatggctgtgaccttcatcggcaacagcacagccatccaggagctgttcaagaggatcagcgagcagttcaccgccatgttccggaggaaggccttcctgcactggtacaccggggagggcatggatgagatggagttcacagaggccgagagcaacatgaatgacctggtgtctgagtaccagcagtaccaggatgccacagctgaggaggaggaggactttggagaggaggccgaggaggaggcctag

SEQ ID NO: 174747 - DNA, 1119 bp, Artificial Sequence; identical to SEQ ID NO: 174723
  Description of Artificial Sequence: Synthetic coding sequence

SEQ ID NO: 174748 - DNA, 1119 bp, Artificial Sequence; identical to SEQ ID NO: 174723
  Description of Artificial Sequence: Synthetic coding sequence

SEQ ID NO: 174749 - DNA, 1335 bp, Artificial Sequence; identical to SEQ ID NO: 174722
  Description of Artificial Sequence: Synthetic coding sequence

SEQ ID NO: 174750 - DNA, 1119 bp, Artificial Sequence; identical to SEQ ID NO: 174723
  Description of Artificial Sequence: Synthetic coding sequence

SEQ ID NO: 174751 - DNA, 1119 bp, Artificial Sequence; identical to SEQ ID NO: 174723
  Description of Artificial Sequence: Synthetic coding sequence

SEQ ID NO: 174752 - DNA, 1119 bp, Artificial Sequence; identical to SEQ ID NO: 174723
  Description of Artificial Sequence: Synthetic coding sequence

SEQ ID NO: 174753 - DNA, 1119 bp, Artificial Sequence; identical to SEQ ID NO: 174723
  Description of Artificial Sequence: Synthetic coding sequence

SEQ ID NO: 174754 - DNA, 1119 bp, Artificial Sequence; identical to SEQ ID NO: 174723
  Description of Artificial Sequence: Synthetic coding sequence

SEQ ID NO: 174755 - DNA, 1119 bp, Artificial Sequence; identical to SEQ ID NO: 174723
  Description of Artificial Sequence: Synthetic coding sequence

SEQ ID NO: 174756 - DNA, 624 bp, Artificial Sequence
  Description of Artificial Sequence: Synthetic coding sequence
atgggcaccctgctgatcagcaagatccgggaggagtacccagaccgcatcatgaacaccttctctgtggtgcccagccccaaggtgtctgacacagtggtggagccctacaatgccaccctgtctgtgcaccagctggtggagaacacagatgagacctactgcatcgacaatgaggccctgtatgacatctgcttccgcaccctgaagctgaccacccccacctacggggacctgaaccacctggtgtctgccaccatgtctggagtgaccacctgcctgcgcttccctggccagctgaatgctgacctgaggaagctggccgtgaacatggtgcccttcccccggctgcacttcttcatgcctggctttgcccccctgaccagccggggcagccagcagtaccgggccctgactgtgcctgagctgacccagcaggtgtttgatgccaagaacatgatggccgcctgtgaccccaggcatggccgctacctgactgtggccgctgtgttccggggccgcatgtccatgaaggaggtggatgagcagatgctgaatgtgcagaacaagaacagcagctactttgtggagtggccccagcagtgccaggacagccggctgtag

SEQ ID NO: 174757 - DNA, 1248 bp, Artificial Sequence
  Description of Artificial Sequence: Synthetic coding sequence
atgagggagatcgtgcacatccaggccggccagtgtggcaaccagatcggggccaagttctgggaggtgatcagtgatgagcacggcatcgaccccaccggcacctaccatggagacagcgacctgcagctggaccgcatctctgtgtactacaatgaggccactggaggcaagtatgtgccccgggccatcctggtggacctggagcccggcaccatggattctgtgcgcagcggccccttcggccagatcttccggccagacaactttgtgtttggccagagcggggccggcaacaactgcctgcagggcttccagctgacccacagcctgggcggcggcactggaagtggcatgggcaccctgctgatcagcaagatccgggaggagtacccagaccgcatcatgaacaccttctctgtggtgcccagccccaaggtgtctgacacagtggtggagccctacaatgccaccctgtctgtgcaccagctggtggagaacacagatgagacctactgcatcgacaatgaggccctgtatgacatctgcttccgcaccctgaagctgaccacccccacctacggggacctgaaccacctggtgtctgccaccatgtctggagtgaccacctgcctgcgcttccctggccagctgaatgctgacctgaggaagctggccgtgaacatggtgcccttcccccggctgcacttcttcatgcctggctttgcccccctgaccagccggggcagccagcagtaccgggccctgactgtgcctgagctgacccagcaggtgtttgatgccaagaacatgatggccgcctgtgaccccaggcatggccgctacctgactgtggccgctgtgttccggggccgcatgtccatgaaggaggtggatgagcagatgctgaatgtgcagaacaagaacagcagctactttgtggagtggatccccaacaacgtgaagacagctgtgtgtgacatccccccccggggcctgaagatggctgtgaccttcatcggcaacagcacagccatccaggagctgttcaagaggatcagcgagcagttcaccgccatgttccggaggaaggccttcctgcactggtacacaggagagggcatggatgagatggagttcacagaagctgagagcaacatgaatgacctggtgtctgagtaccagcagtaccaggatgccacagctgaggaggaggaggactttggagaggaggccgaggaggagtag

SEQ ID NO: 174758 - DNA, 1062 bp, Artificial Sequence; identical to SEQ ID NO: 174739
  Description of Artificial Sequence: Synthetic coding sequence

SEQ ID NO: 174759 - DNA, 1062 bp, Artificial Sequence; identical to SEQ ID NO: 174739
  Description of Artificial Sequence: Synthetic coding sequence

SEQ ID NO: 174760 - DNA, 1308 bp, Artificial Sequence
  Description of Artificial Sequence: Synthetic coding sequence
atgagggagatcgtgcacatccaggccggccagtgtggcaaccagatcggggccaagttctgggaggtgatcagtgatgagcacggcatcgaccccaccggcacctaccatggagacagcgacctgcagctggaccgcatctctgtgtactacaatgaggccactggaggcaagtatgtgccccgggccatcctggtggacctggagcccggcaccatggattctgtgcgcagcggccccttcggccagatcttccggccagacaactttgtgtttggccagagcggggccggcaacaactgggccaagggccactacacagaaggagctgagctggtggacagcgtgctggatgtggtgaggaaggaggccgagagctgtgactgcctgcagggcttccagctgacccacagcctgggcggcggcactggaagtggcatgggcaccctgctgatcagcaagatccgggaggagtacccagaccgcatcatgaacaccttctctgtggtgcccagccccaaggtgtctgacacagtggtggagccctacaatgccaccctgtctgtgcaccagctggtggagaacacagatgagacctactgcatcgacaatgaggccctgtatgacatctgcttccgcaccctgaagctgaccacccccacctacggggacctgaaccacctggtgtctgccaccatgtctggagtgaccacctgcctgcgcttccctggccagctgaatgctgacctgaggaagctggccgtgaacatggtgcccttcccccggctgcacttcttcatgcctggctttgcccccctgaccagccggggcagccagcagtaccgggccctgactgtgcctgagctgacccagcaggtgtttgatgccaagaacatgatggccgcctgtgaccccaggcatggccgctacctgactgtggccgctgtgttccggggccgcatgtccatgaaggaggtggatgagcagatgctgaatgtgcagaacaagaacagcagctactttgtggagtggatccccaacaacgtgaagacagctgtgtgtgacatccccccccggggcctgaagatggctgtgaccttcatcggcaacagcacagccatccaggagctgttcaagaggatcagcgagcagttcaccgccatgttccggaggaaggccttcctgcactggtacacaggagagggcatggatgagatggagttcacagaagctgagagcaacatgaatgacctggtgtctgagtaccagcagtaccaggatgccacagctgagggcggcggcctgtag

SEQ ID NO: 174761 - DNA, 1308 bp, Artificial Sequence; identical to SEQ ID NO: 174760
  Description of Artificial Sequence: Synthetic coding sequence

SEQ ID NO: 174762 - DNA, 1308 bp, Artificial Sequence; identical to SEQ ID NO: 174760
  Description of Artificial Sequence: Synthetic coding sequence

SEQ ID NO: 174763 - DNA, 1248 bp, Artificial Sequence; identical to SEQ ID NO: 174757
  Description of Artificial Sequence: Synthetic coding sequence

SEQ ID NO: 174764 - DNA, 1248 bp, Artificial Sequence; identical to SEQ ID NO: 174757
  Description of Artificial Sequence: Synthetic coding sequence

SEQ ID NO: 174765 - DNA, 1248 bp, Artificial Sequence; identical to SEQ ID NO: 174757
  Description of Artificial Sequence: Synthetic coding sequence

SEQ ID NO: 174766 - DNA, 1308 bp, Artificial Sequence; identical to SEQ ID NO: 174760
  Description of Artificial Sequence: Synthetic coding sequence

SEQ ID NO: 174767 - DNA, 1308 bp, Artificial Sequence; identical to SEQ ID NO: 174760
  Description of Artificial Sequence: Synthetic coding sequence

SEQ ID NO: 174768 - DNA, 1308 bp, Artificial Sequence; identical to SEQ ID NO: 174760
  Description of Artificial Sequence: Synthetic coding sequence

SEQ ID NO: 174769 - DNA, 1062 bp, Artificial Sequence; identical to SEQ ID NO: 174739
  Description of Artificial Sequence: Synthetic coding sequence

SEQ ID NO: 174770 - DNA, 1248 bp, Artificial Sequence; identical to SEQ ID NO: 174757
  Description of Artificial Sequence: Synthetic coding sequence

SEQ ID NO: 174771 - DNA, 1308 bp, Artificial Sequence
  Description of Artificial Sequence: Synthetic coding sequence
atgagggagatcgtgcacatccaggccggccagtgtggcaaccagatcggggccaagttctgggaggtgatcagtgatgagcacggcatcgaccccaccggcacctaccatggagacagcgacctgcagctggaccgcatctctgtgtactacaatgaggccactggaggcaagtatgtgccccgggccatcctggtggacctggagcccggcaccatggattctgtgcgcagcggccccttcggccagatcttccggccagacaactttgtgtttggccagagcggggccggcaacaactgggccaagggccactacacagaaggagctgagctggtggacagcgtgctggatgtggtgaggaaggaggccgagagctgtgactgcctgcagggcttccagctgacccacagcctgggcggcggcactggaagtggcatgggcaccctgctgatcagcaagatccgggaggagtacccagaccgcatcatgaacaccttctctgtggtgcccagccccaaggtgtctgacacagtggtggagccctacaatgccaccctgtctgtgcaccagctggtggagaacacagatgagacctactgcatcgacaatgaggccctgtatgacatctgcttccgcaccctgaagctgaccacccccacctacggggacctgaaccacctggtgtctgccaccatgtctggagtgaccacctgcctgcgcttccctggccagctgaatgctgacctgaggaagctggccgtgaacatggtgcccttcccccggctgcacttcttcatgcctggctttgcccccctgaccagccggggcagccagcagtaccgggccctgactgtgcctgagctgacccagcaggtgtttgatgccaagaacatgatggccgcctgtgaccccaggcatggccgctacctgactgtggccgctgtgttccggggccgcatgtccatgaaggaggtggatgagcagatgctgaatgtgcagaacaagaacagcagctactttgtggagtggatccccaacaacgtgaagacagctgtgtgtgacatccccccccggggcctgaagatggctgtgaccttcatcggcaacagcacagccatccaggagctgttcaagaggatcagcgagcagttcaccgccatgttccggaggaaggccttcctgcactggtacacaggagagggcatggatgagatggagttcacagaagctgagagcaacatgaatgacctggtgtctgagtaccagcagtaccaggatgccacagctgaggagggcggcgtgtag

SEQ ID NO: 174772 - DNA, 1062 bp, Artificial Sequence; identical to SEQ ID NO: 174739
  Description of Artificial Sequence: Synthetic coding sequence

SEQ ID NO: 174773 - DNA, 1062 bp, Artificial Sequence; identical to SEQ ID NO: 174739
  Description of Artificial Sequence: Synthetic coding sequence

SEQ ID NO: 174774 - DNA, 1062 bp, Artificial Sequence; identical to SEQ ID NO: 174739
  Description of Artificial Sequence: Synthetic coding sequence

SEQ ID NO: 174775 - DNA, 1248 bp, Artificial Sequence; identical to SEQ ID NO: 174757
  Description of Artificial Sequence: Synthetic coding sequence

SEQ ID NO: 174776 - DNA, 1248 bp, Artificial Sequence; identical to SEQ ID NO: 174757
  Description of Artificial Sequence: Synthetic coding sequence

SEQ ID NO: 174777 - DNA, 1062 bp, Artificial Sequence; identical to SEQ ID NO: 174739
  Description of Artificial Sequence: Synthetic coding sequence

SEQ ID NO: 174778 - DNA, 1362 bp, Artificial Sequence
  Description of Artificial Sequence: Synthetic coding sequence
atgagcatcgtgacagtgcagctgggccagtgtggcaaccagattggatttgaggtgtttgatgccctgctgagtgacagccacagcagccagggcctgtgcagcatgagagaaaatgaggcctaccaggccagctgcaaggagcgcttcttcagcgaggaggagaatggagtgcccatcgcccgggctgtgctggtggacatggagcccaaggtgatcaaccagatgctgagcaaggccgcccagagcggccagtggaagtatggccagcacgcctgcttctgccagaagcagggcagcggcaacaactgggcctacggctacagcgtgcacggccccaggcatgaggagagcatcatgaacatcatcaggaaggaggtggagaagtgtgacagcttcagcggcttcttcatcatcatgtccatggccggcggcaccggcagcggcctgggcgcctttgtgacccagaacctggaggaccagtacagcaacagcctgaagatgaaccagatcatctggccctatggaactggagaggtgattgtgcagaactacaacagcatcctgaccctgagccacctgtaccgcagcagtgatgccctgctgctgcatgaaaatgatgccatccacaagatctgtgccaagctgatgaacatcaagcagatctccttcagtgacatcaaccaggtgctggcccaccagctgggctctgtgttccagcccacctacagcgctgagagcagcttccactacagaagaaaccccctgggggacctgatggagcacctggtgccccaccctgagttcaagatgctgtctgtgaggaacatcccccacatgtctgagaacagcctggcctacaccaccttcacctgggccggcctgctgaagcacctgcggcagatgctgatcagcaatgccaagatggaggagggcatcgacagacatgtgtggccacccctgagcggcctgccccccctgagcaagatgagcctgaacaaggacctgcacttcaacaccagcatcgccaacctggtgatcctgcggggcaaggatgtgcagagcgcagatgtggagggcttcaaggaccctgccctgtacacctcctggctgaagcctgtgaatgccttcaacgtgtggaagacccagagggccttcagcaaatatgagaagtctgctgtgctggtgagcaacagccagttcctggtgaagcccctggacatgattgtgggcaaggcctggaacatgtttgccagcaaggcctacatccaccagtacaccaagtttggaattgaggaggaggacttcctggacagcttcaccagcctggagcaggtggtggccagctactgcaacctgtag

SEQ ID NO: 174779 - DNA, 1197 bp, Artificial Sequence
  Description of Artificial Sequence: Synthetic coding sequence
atgagcatcgtgacagtgcagctgggccagtgtggcaaccagattggatttgaggtgtttgatgccctgctgagtgacagccacagcagccagggcctgtgcagcatgagagaaaatgaggcctaccaggccagctgcaaggagcgcttcttcagcgaggaggagaatggagtgcccatcgcccgggctgtgctggtggacatggagcccaaggtgatcaaccagatgctgagcaaggccgcccagagcggccagtggaagtatggccagcacgcctgcttctgccagaagcagggcagcggcaacaactgggcctacggctacagcgtgcacggccccaggcatgaggagagcatcatgaacatcatcaggaaggaggtggagaagtgtgacagcttcagcggcttcttcatcatcatgtccatggccggcggcaccggcagcggcctgggcgcctttgtgacccagaacctggaggaccagtacagcaacagcctgaagatgaaccagatcatctggccctatggaactggagaggtgattgtgcagaactacaacagcatcctgaccctgagccacctgtaccgcagcagtgatgccctgctgctgcatgaaaatgatgccatccacaagatctgtgccaagctgatgaacatcaagcagatctccttcagtgacatcaaccaggtgctggcccaccagctgggctctgtgttccagcccacctacagcgctgagagcagcttccactacagaagaaaccccctgggcatcgacagacatgtgtggccacccctgagcggcctgccccccctgagcaagatgagcctgaacaaggacctgcacttcaacaccagcatcgccaacctggtgatcctgcggggcaaggatgtgcagagcgcagatgtggagggcttcaaggaccctgccctgtacacctcctggctgaagcctgtgaatgccttcaacgtgtggaagacccagagggccttcagcaaatatgagaagtctgctgtgctggtgagcaacagccagttcctggtgaagcccctggacatgattgtgggcaaggcctggaacatgtttgccagcaaggcctacatccaccagtacaccaagtttggcatcgaggaggaggacttcctggacagcttcaccagcctggagcaggtggtggccagctactgcaacctgtag

SEQ ID NO: 174780 - DNA, 600 bp, Artificial Sequence
  Description of Artificial Sequence: Synthetic coding sequence
atgagcatcgtgacagtgcagctgggccagtgtggcaaccagattggatttgaggtgtttgatgccctgctgagtgacagccacagcagccagggcctgtgcagcatgagagaaaatgaggcctaccaggccagctgcaaggagcgcttcttcagcgaggaggagaatggaggcatcgacagacatgtgtggccacccctgagcggcctgccccccctgagcaagatgagcctgaacaaggacctgcacttcaacaccagcatcgccaacctggtgatcctgcggggcaaggatgtgcagagcgcagatgtggagggcttcaaggaccctgccctgtacacctcctggctgaagcctgtgaatgccttcaacgtgtggaagacccagagggccttcagcaaatatgagaagtctgctgtgctggtgagcaacagccagttcctggtgaagcccctggacatgattgtgggcaaggcctggaacatgtttgccagcaaggcctacatccaccagtacaccaagtttggaattgaggaggaggacttcctggacagcttcaccagcctggagcaggtggtggccagctactgcaacctgtag

SEQ ID NO: 174781 - DNA, 1056 bp, Artificial Sequence
  Description of Artificial Sequence: Synthetic coding sequence
atgagcatcgtgacagtgcagctgggccagtgtggcaaccagattggatttgaggtgtttgatgccctgctgagtgacagccacagcagccagggcctgtgcagcatgagagaaaatgaggcctaccaggccagctgcaaggagcgcttcttcagcgaggaggagaatggagtgcccatcgcccgggctgtgctggtggacatggagcccaaggtgatcaaccagatgctgagcaaggccgcccagagcggccagtggaagtatggccagcacgcctgcttctgccagaagcagggcagcggcaacaactgggcctacggctacagcgtgcacggccccaggcatgaggagagcatcatgaacatcatcaggaaggaggtggagaagtgtgacagcttcagcggcttcttcatcatcatgtccatggccggcggcaccggcagcggcctgggcgcctttgtgacccagaacctggaggaccagtacagcaacagcctgaagatgaaccagatcatctggccctatggaactggagaggtgattgtgcagaactacaacagcatcctgaccctgagccacctgtaccgcagcagtgatgccctgctgctgcatgaaaatgatgccatccacaagatctgtgccaagctgatgaacatcaagcagatctccttcagtgacatcaaccaggtgctggcccaccagctgggctctgtgttccagcccacctacagcgctgagagcagcttccactacagaagaaaccccctggagggcttcaaggaccctgccctgtacacctcctggctgaagcctgtgaatgccttcaacgtgtggaagacccagagggccttcagcaaatatgagaagtctgctgtgctggtgagcaacagccagttcctggtgaagcccctggacatgattgtgggcaaggcctggaacatgtttgccagcaaggcctacatccaccagtacaccaagtttggaattgaggaggaggacttcctggacagcttcaccagcctggagcaggtggtggccagctactgcaacctgtag

SEQ ID NO: 174782 - DNA, 1191 bp, Artificial Sequence
  Description of Artificial Sequence: Synthetic coding sequence
atgagcatcgtgacagtgcagctgggccagtgtggcaaccagattggatttgaggtgtttgatgccctgctgagtgacagccacagcagccagggcctgtgcagcatgagagaaaatgaggcctaccaggccagctgcaaggagcgcttcttcagcgaggaggagaatggagtgcccatcgcccgggctgtgctggtggacatggagcccaaggtgatcaaccagatgctgagcaaggccgcccagagcggccagtggaagtatggccagcacgcctgcttctgccagaagcagggcagcggcaacaactgggcctacggctacagcgtgcacggccccaggcatgaggagagcatcatgaacatcatcaggaaggaggtggagaagtgtgacagcttcagcggcttcttcatcatcatgtccatggccggcggcaccggcagcggcctgggcgcctttgtgacccagaacctggaggaccagtacagcaacagcctgaagatgaaccagatcatctggccctatggaactggagaggtgattgtgcagaactacaacagcatcctgaccctgagccacctgtaccgcagcagtgatgccctgctgctgcatgaaaatgatgccatccacaagatctgtgccaagctgatgaacatcaagcagatctccttcagtgacatcaaccaggtgctggcccaccagctgggctctgtgttccagcccacctacagcgctgagagcagcttccactacagaagaaaccccctgggggacctgatggagcacctggtgccccaccctgagttcaagatgctgtctgtgaggaacatcccccacatgtctgagaacagcctggcctacaccaccttcacctgggccggcctgctgaagcacctgcggcagatgctgatcagcaatgccaagatggaggagggcatcgacagacatgtgtggccacccctgagcggcctgccccccctgagcaagatgagcctgaacaaggacctgcacttcaacaccagcatcgccaacctggtgatcctgcggggcaaggatgtgcagagcgcagatgtgggcaagaagttccgggcctacatccaccagtacaccaagtttggcatcgaggaggaggacttcctggacagcttcaccagcctggagcaggtggtggccagctactgcaacctgtag

SEQ ID NO: 174783 - DNA, 714 bp, Artificial Sequence
  Description of Artificial Sequence: Synthetic coding sequence
atgaacatcaagcagatctccttcagtgacatcaaccaggtgctggcccaccagctgggctctgtgttccagcccacctacagcgctgagagcagcttccactacagaagaaaccccctgggggacctgatggagcacctggtgccccaccctgagttcaagatgctgtctgtgaggaacatcccccacatgtctgagaacagcctggcctacaccaccttcacctgggccggcctgctgaagcacctgcggcagatgctgatcagcaatgccaagatggaggagggcatcgacagacatgtgtggccacccctgagcggcctgccccccctgagcaagatgagcctgaacaaggacctgcacttcaacaccagcatcgccaacctggtgatcctgcggggcaaggatgtgcagagcgcagatgtggagggcttcaaggaccctgccctgtacacctcctggctgaagcctgtgaatgccttcaacgtgtggaagacccagagggccttcagcaaatatgagaagtctgctgtgctggtgagcaacagccagttcctggtgaagcccctggacatgattgtgggcaaggcctggaacatgtttgccagcaaggcctacatccaccagtacaccaagtttggaattgaggaggaggacttcctggacagcttcaccagcctggagcaggtggtggccagctactgcaacctgtag

SEQ ID NO: 174784 - DNA, 378 bp, Artificial Sequence
  Description of Artificial Sequence: Synthetic coding sequence
atgagcatcgtgacagtgcagctgggccagtgtggcaaccagattggatttgaggtgtttgatgccctgctgagtgacagccacagcagccagggcctgtgcagcatgagagaaaatgaggcctaccaggccagctgcaaggagcgcttcttcagcgaggaggagaatggagtgcccatcgcccgggctgtgctggtggacatggagcccaaggtgatcaaccagatgctgagcaaggccgcccagagcggccagtggaagtatggccagcacgcctgcttctgccagaagcagggcagcggcaacaactgggcctacggccgggacaaggacagcgcctgctacccagactggagcggcaccccaggcctgcagtag

SEQ ID NO: 174785 - DNA, 492 bp, Artificial Sequence
  Description of Artificial Sequence: Synthetic coding sequence
atgacccagagcgtggtggtgcaggtgggccagtgtggcaaccagatcggctgctgcttctgggacctggccctgcgggagcacgccgctgtgaaccagaagggcatctatgatgaggccatcagcagcttcttcagaaatgtggacaccagggtggtgggagatggcggcagcatcagcaagggcaagatctgcagcctgaaggcccgggctgtgctgattgacatggaggagggcgtggtgaatgagatcctgcagggccccctgagagatgtgtttgacaccaagcagctgatcacagacatcagcggcagcggcaacaactgggccgtgggccacaaggtgtttggcagcctgtaccaggaccagatcctggagaagttcaggaagtctgctgagcactgtgactgcctgcagtgcttcttcatcatccacagcatgggcggcggcaagatcttccacagctttgcctgcaacagcgtgaagggctag

SEQ ID NO: 174786 - DNA, 621 bp, Artificial Sequence
  Description of Artificial Sequence: Synthetic coding sequence
atggagagtgaccagaggaaggtggtgggagatggcggcagcatcagcaagggcaagatctgcagcctgaaggcccgggctgtgctgattgacatggaggagggcgtggtgaatgagatcctgcagggccccctgagagatgtgtttgacaccaagcagctgatcacagacatcagcggcagcggcaacaactgggccgtgggccacaaggtgtttggcagcctgtaccaggaccagatcctggagaagttcaggaagtctgctgagcactgtgactgcctgcagtgcttcttcatcatccacagcatgggcggcggcactggaagtggcctgggcaccttcctgctgaaggtgctggaggatgagttccctgaggtgtacagatttgtgaccagcatctaccccagcggggaggatgatgtgatcaccagcccctacaacagcatcctggccatgaaggagctgaatgagcacgccgactgtgtgctgcccatcgacaaccagagcctgtttgacatcatcagcaagattgacctgatggtgaacagcggcaagctgggcaccaccgtgaagcccaagagcctggtgaccagcagcagcggggccctgaagaagcagtag

SEQ ID NO: 174787 - DNA, 1428 bp, Artificial Sequence
  Description of Artificial Sequence: Synthetic coding sequence
atgacccagagcgtggtggtgcaggtgggccagtgtggcaaccagatcggctgctgcttctgggacctggccctgcgggagcacgccgctgtgaaccagaagggcatctatgatgaggccatcagcagcttcttcagaaatgtggacaccagggtggtgggagatggcggcagcatcagcaagggcaagatctgcagcctgaaggcccgggctgtgctgattgacatggaggagggcgtggtgaatgagatcctgcagggccccctgagagatgtgtttgacaccaagcagctgatcacagacatcagcggcagcggcaacaactgggccgtgggccacaaggtgtttggcagcctgtaccaggaccagatcctggagaagttcaggaagtctgctgagcactgtgactgcctgcagtgcttcttcatcatccacagcatgggcggcggcactggaagtggcctgggcaccttcctgctgaaggtgctggaggatgagttccctgaggtgtacagatttgtgaccagcatctaccccagcggggaggatgatgtgatcaccagcccctacaacagcatcctggccatgaaggagctgaatgagcacgccgactgtgtgctgcccatcgacaaccagagcctgtttgacatcatcagcaagattgacctgatggtgaacagcggcaagctgggcaccaccgtgaagcccaagagcctggtgaccagcagcagcggggccctgaagaagcagcacaagaagccctttgatgccatgaacaacatcgtggccaacctgctgctgaacctgaccagcagcgccaggtttgagggcagcctgaacatggacctgaatgagatctccatgaacctggtgcccttcccccagctgcactacctggtgagcagcctgacccccctgtacaccctgacagatgtgaacatccccccccggcggctggaccagatgttcagtgatgccttcagcaaggaccaccagctgctgcgggctgaccccaagcacagcctgtacctggcctgtgccctgatggtgagaggaaatgtgcagatcagtgacctgcggagaaatattgagcggctgaagcccagcctgcagtttgtgtcctggaaccaggagggctggaagaccagcctgtgcagcgtgccccctgtgggccacagccacagcctgctggccctggccaacaacacctgtgtgaagcccaccttcatggagctgaaggagcgcttcatgaggctgtacaagaagaaggcccacctgcaccactacctgcaggtggagggcatggaggagagctgcttcacagaagctgtgagcagcctgagcgccctgatccaggagtatgaccagctggatgccaccaagaacatgcctgtgcaggacctgccccggctgagcatcgccatgtag

SEQ ID NO: 174788 - DNA, 621 bp, Artificial Sequence; identical to SEQ ID NO: 174786
  Description of Artificial Sequence: Synthetic coding sequence

SEQ ID NO: 174789 - DNA, 1356 bp, Artificial Sequence
  Description of Artificial Sequence: Synthetic coding sequence
atgccccgggagatcatcaccctgcagctgggccagtgtggcaaccagattggatttgagttctggaagcagctgtgtgccgagcacggcatcagccctgagggcatcgtggaggagtttgccacagagggcacagacaggaaggatgtgttcttctaccaggctgatgatgagcactacatccccagggctgtgctgctggacctggagcccagggtcatccacagcatcctgaacagcccctatgccaagctgtacaaccctgagaacatctacctgtctgagcacggcggcggggccggcaacaactgggccagcggcttcagccagggcgagaagatccacgaggacatctttgacatcatcgaccgggaggctgatggcagtgacagcctggagggctttgtgctgtgccacagcattgctgggggcactggaagtggcctgggcagctacctgctggagcggctgaatgaccgctaccccaagaagctggtgcagacctacagcgtcttccccaaccaggatgagatgtctgatgtggtggtgcagccctacaacagcctgctgaccctgaagaggctgacccagaatgctgactgtgtggtggtgctggacaacacagccctgaacagaattgccacagaccggctgcacatccagaaccccagcttcagccagatcaaccagctggtgtccaccatcatgtctgccagcaccaccaccctgcgctacccaggctacatgaacaatgacctgattggcctgattgccagcctcatccccaccccccggctgcacttcctgatgacaggctacacccccctgaccacagaccagagcgtggcctctgtgaggaagaccaccgtgctggatgtgatgaggcggctgctgcagcccaagaatgtgatggtgtccacaggccgggaccggcagaccaaccactgctacatcgccatcctgaacatcatccagggcgaggtggaccccacccaggtgcacaagagcctgcagaggatccgggagaggaagctggccaacttcatcccctggggccctgccagcatccaggtggccctgagcaggaagagcccctacctgcccagcgcccaccgggtgtctggcctgatgatggccaaccacaccagcatcagcagcctgtttgagaggacctgccggcagtatgacaagctgaggaagcgggaggccttcctggagcagttcagaaaagaagacatgttcaaggacaactttgatgagatggacaccagccgggagatcgtgcagcagctgattgatgagtaccacgccgccaccaggccagactacatctcctggggcacccaggagcagtag

SEQ ID NO: 174790 - DNA, 1356 bp, Artificial Sequence
  Description of Artificial Sequence: Synthetic coding sequence
atgccccgggagatcatcaccctgcagctgggccagtgtggcaaccagattggatttgagttctggaagcagctgtgtgccgagcacggcatcagccctgagggcatcgtggaggagtttgccacagagggcacagacaggaaggatgtgttcttctaccaggctgatgatgagcactacatccccagggctgtgctgctggacctggagcccagggtcatccacagcatcctgaacagcccctatgccaagctgtacaaccctgagaacatctacctgtctgagcacggcggcggggccggcaacaactgggccagcggcttcagccagggcgagaagatccacgaggacatctttgacatcatcgaccgggaggctgatggcagtgacagcctggagggctttgtgctgtgccacagcattgctgggggcactggaagtggcctgggcagctacctgctggagcggctgaatgaccgctaccccaagaagctggtgcagacctacagcgtcttcccctaccaggatgagatgtctgatgtggtggtgcagccctacaacagcctgctgaccctgaagaggctgacccagaatgctgactgtgtggtggtgctggacaacacagccctgaacagaattgccacagaccggctgcacatccagaaccccagcttcagccagatcaaccagctggtgtccaccatcatgtctgccagcaccaccaccctgcgctacccaggctacatgaacaatgacctgattggcctgattgccagcctcatccccaccccccggctgcacttcctgatgacaggctacacccccctgaccacagaccagagcgtggcctctgtgaggaagaccaccgtgctggatgtgatgaggcggctgctgcagcccaagaatgtgatggtgtccacaggccgggaccggcagaccaaccactgctacatcgccatcctgaacatcatccagggcgaggtggaccccacccaggtgcacaagagcctgcagaggatccgggagaggaagctggccaacttcatcccctggggccctgccagcatccaggtggccctgagcaggaagagcccctacctgcccagcgcccaccgggtgtctggcctgatgatggccaaccacaccagcatcagcagcctgtttgagagcagctgccagcagtttgacaagctgaggaagagagatgccttcctggagcagttcagaaaagaagacatgttcaaggacaactttgatgagatggacaggagccgggaggtggtgcaggagctgattgatgagtaccacgccgccacccagcctgactacatctcctggggcacccaggagcagtag

SEQ ID NO: 174791 - DNA, 2001 bp, Artificial Sequence; identical to SEQ ID NO: 174698
  Description of Artificial Sequence: Synthetic coding sequence

SEQ ID NO: 174792 - DNA, 1029 bp, Artificial Sequence
  Description of Artificial Sequence: Synthetic coding sequence
atggtggtggtggagcagatcaagagccagaagatccacggctgccagatcctggagaccgtgtacaagcacagctgtggcggcctgccccctgtgcgcagcgccctggagaagatcctggccgtgtgccacggcgtgatgtacaagcagctgagcgcctggatgctgcacggcctgctgctggaccagcacgaggagttcttcatcaagcagggccccagcagtggaaatgtgtctgcccagcctgaggaggatgaggaggacctgggcattggaggcctgaccgggaagcagctgcgggagctgcaggacctgcggctcatcgaggaggagaacatgctggcccccagcctgaagcagttcagcctgcgggtggagatcctgcccagctacatccctgtgcgggtggccgagaagatcctgtttgtgggggagagcgtgcagatgtttgagaaccagaatgtgaacctgaccaggaagggcagcatcctgaagaaccaggaggacacctttgctgctgagctgcaccggctgaagcagcagcccctcttcagcctggtggactttgagcaggtggtggaccgcatccgcagcacagtggccgagcacctgtggaagctgatggtggaggagagtgacctgctgggccagctgaagatcatcaaggacttctacctgctgggccgcggggagctgttccaggccttcatcgacacagcccagcacatgctgaagaccccacccacagctgtgacagaacatgatgtgaatgtggccttccagcagagcgcccacaaggtgctgctggatgatgacaacctgctgcccctgctgcacctgaccatcgagtaccacggcaaggagcacaaggcagatgccacccaggcccgggagggccccagccgggagaccagcccccgggaggccccagccagcggctgggccgccctgggcctgagctacaaggtgcagtggcccctgcacatcctcttcaccccagctgtgctggagaagaaccggcagttctag

SEQ ID NO: 174793 - DNA, 3075 bp, Artificial Sequence
  Description of Artificial Sequence: Synthetic coding sequence
atggcccggcacggccccccctggagccggctggatgcccagcaggagagagatgtgcgggagctggtgcggggcgtggccggcctgcaggatgaagctgaccccaacttccagctggccctgaactttgcctggagcaacttccgcttccaccgcttcctggatgtgaacagccacaagattgagaagaccatcgagggcatctatgagaagtttgtgatccacagcgacctgagcaaggccgcctcctggaagaggctgacagaggagttcctgaatgcccccctgcccagcatcaaggagatcaagacagatgcccactacagcatcctgagcctgctgctgtgcctgagtgacagccccagcaacagcagctatgtggagaccccaagaaacaaggaggtggagaagaaggatgactttgactggggcaagtacctgatggaggatgaggagatggacatcggcccctacatggacacccccaactggagcgaggagagcgaggaggagaatgaccagcagcccctgagccgggaggacagcggcatccaggtggacaggacccccctggaggagcaggaccagaacaggaagctggacccctgcatctcctggaaggatgagccagatgaccgctcctggctggagcaccacgtggtgcaccagtactggacagcccggcccagccagttcccccacagcctgcacctgcacagcaacctggccgctgtgtgggaccagcacctgtacagcagtgaccccctgtatgtgcctgatgacagagtgctggtgacagagacccaggtgatccgggagaccctgtggctgctgtctggagtgaagaagctgttcatcttccagctgattgatggcaaggtgacagtgaggaacaacatcatcgtgacccacctgacccacagctgcctgcggtctgtgctggagcagattgctgcctacggccaggtggtgttccggctgcaggagttcattgatgaggtgatgggccacagcagcgagagcatgctgcccggcagcggctctgtgcccaagaagagcacagaggcccccttccgcacctaccaggccttcatgtgggccctgtacaagtacttcatctccttcaaggaggagctggccgagattgagaagtgcatcatcaacaatgacaccaccatcaccctggccatcgtggtggacaagctggccccccggctgagccagctgaaggtgctgcacaaggtgttcagcactggagtggccgaggtgcccccagacaccagaaatgtggtgcgggccagccacctgctgaacaccctgtacaaggccatcctggagtatgacaacgtgggggaggccagcgagcagacagtgtccctgctcttcagcctgtgggtggagaccgtgcggccctacctgcagacagtggatgagtggatcgtgcacggccacctgtgggatggagcccgggagttcatcatccagaggaacaagaatgtgcctgtgaaccaccgggacttctggtacgccacctacaccctgtacagcgtgtctgagaagacagaaaatgaggagaagatgtctgacaatgccagcgccagcagcggcagtgaccagggccccagcagccggcagcacaccatggtgtccttcctgaagcctgtgctgaagcagatcatcatggccggcaagtccatgcagctgctgaagaacctgcagtgtgccgagagcaccacctgccaggccggggccagagatgctgagaggaagagcctgtacaccctcttcctggagagcgtgcagagccggctgcggcacggggaggacagcaccccccaggtgctgacagagcagcaggccaccaaggagaacctgatgaagatgcagagcattgctgagagccacctggagctggatgatgtgcatgaccccctgctggccatcaactttgccaggatgtacctggagcagagcgacttccacgagaagtttgctggaggagatgtgtgtgtggacaggagcagcgagagcgtgacctgccagacctttgagctgaccctgcggagctgcctgtacccccacatcgacaagcagtacctggactgctgcggcaacctgatgcagaccctgaagaaggactaccgcctggtggagtacctgcaggccatgaggaacttcttcctgatggagggcggggacaccatgtatgacttctacaccagcatctttgacaagatccgggagaaggagacctggcagaatgtgtccttcctgaatgtgcagctgcaggaggccgtgggccagcgctacccagaggacagcagccggctgagcatcagctttgaaaatgtggacacagccaagaagaagctgcctgtgcacatcctggatggcctgaccctgagctacaaggtgccctggcctgtggacatcgtcatcagcctggagtgccagaagatctacaaccaggtgttcctgctgctgctgcagatcaagtgggccaagtacagcctggatgtgctgctgtttggagagctggtgtccacagctgagaagccccggctgaaggagggcctcatccacgagcaggacacagtggcccagtttggcccccagaaggagcctgtgcggcagcagatccacaggatgttcctgctgcgggtgaagctgatgcactttgtgaacagcctgcacaactacatcatgacccgcatcctgcacagcacaggcctggagttccagcaccaggtggaggaggccaaggacctggaccagctgatcaagatccactaccgctacctgagcaccatccatgaccgctgcctgctgcgggagaaggtgtcctttgtgaaggaggccatcatgaaggtgctgaacctggccctgatgtttgctgatggctggcaggccggcctgggcacctggaggatggagagcattgagaagatggagagtgacttcaagaactgccacatgttcctggtgaccatcctgaacaaggctgtgtgccggggcagcttcccccacctggagagcctggccctgagcctgatggccggcatggagcagagctag

SEQ ID NO: 174794 - DNA, 3075 bp, Artificial Sequence
  Description of Artificial Sequence: Synthetic coding sequence
atggcccggcacggccccccctggagccggctggatgcccagcaggagagagatgtgcgggagctggtgcggggcgtggccggcctgcaggatgaagctgaccccaacttccagctggccctgaactttgcctggagcaacttccgcttccaccgcttcctggatgtgaacagccacaagattgagaagaccatcgagggcatctatgagaagtttgtgatccacagcgacctgagcaaggccgcctcctggaagaggctgacagaggagttcctgaatgcccccctgcccagcatcaaggagatcaagacagatgcccactacagcatcctgagcctgctgctgtgcctgagtgacagccccagcaacagcagctatgtggagaccccaagaaacaaggaggtggagaagaaggatgactttgactggggcaagtacctgatggaggatgaggagatggacatcggcccctacatggacacccccaactggagcgaggagagcgaggaggagaatgaccagcagcccctgagccgggaggacagcggcatccaggtggacaggacccccctggaggagcaggaccagaacaggaagctggacccctgcatctcctggaaggatgagccagatgaccgctcctggctggagcaccacgtggtgcaccagtactggacagcccggcccagccagttcccccacagcctgcacctgcacagcaacctggccgctgtgtgggaccagcacctgtacagcagtgaccccctgtatgtgcctgatgacagagtgctggtgacagagacccaggtgatccgggagaccctgtggctgctgtctggagtgaagaagctgttcatcttccagctgattgatggcaaggtgacagtgaggaacaacatcatcgtgacccacctgacccacagctgcctgcggtctgtgctggagcagattgctgcctacggccaggtggtgttccggctgcaggagttcattgatgaggtgatgggccacagcagcgagagcatgctgcccggcagcggctctgtgcccaagaagagcacagaggcccccttccgcacctaccaggccttcatgtgggccctgtacaagtacttcatctccttcaaggaggagctggccgagattgagaagtgcatcatcaacaatgacaccaccatcaccctggccatcgtggtggacaagctggccccccggctgagccagctgaaggtgctgcacaaggtgttcagcactggagtggccgaggtgcccccagacaccagaaatgtggtgcgggccagccacctgctgaacaccctgtacaaggccatcctggagtatgacaacgtgggggaggccagcgagcagacagtgtccctgctcttcagcctgtgggtggagaccgtgcggccctacctgcagacagtggatgagtggatcgtgcacggccacctgtgggatggagcccgggagttcatcatccagaggaacaagaatgtgcctgtgaaccaccgggacttctggtacgccacctacaccctgtacagcgtgtctgagaagacagaaaatgaggagaagatgtctgacaatgccagcgccagcagcggcagtgaccagggccccagcagccggcagcacaccatggtgtccttcctgaagcctgtgctgaagcagatcatcatggccggcaagtccatgcagctgctgaagaacctgcagtgtgccgagagcaccacctgccaggccggggccagagatgctgagaggaagagcctgtacaccctcttcctggagagcgtgcagagccggctgcggcacggggaggacagcaccccccaggtgctgacagagcagcaggccaccaaggagaacctgatgaagatgcagagcattgctgagagccacctggagctggatgatgtgcatgaccccctgctggccatcaactttgccaggatgtacctggagcagagcgacttccacgagaagtttgctggaggagatgtgtgtgtggacaggagcagcgagagcgtgacctgccagacctttgagctgaccctgcggagctgcctgtacccccacatcgacaagcagtacctggactgctgcggcaacctgatgcagaccctgaagaaggactaccgcctggtggagtacctgcaggccatgaggaacttcttcctgatggagggcggggacaccatgtatgacttctacaccagcatctttgacaagatccgggagaaggagacctggcagaatgtgtccttcctgaatgtgcagctgcaggaggccgtgggccagcgctacccagaggacagcagccggctgagcatcagctttgaaaatgtggacacagccaagaagaagctgcctgtgcacatcctggatggcctgaccctgagctacaaggtgccctggcctgtggacatcgtcatcagcctggagtgccagaagatctacaaccaggtgttcctgctgctgctgcagatcaagtgggccaagtacagcctggatgtgctgctgtttggagagctggtgtccacagctgagaagccccggctgaaggagggcctcatccacgagcaggacacagtggcccagtttggcccccagaaggagcctgtgcggcagcagatccacaggatgttcctgctgcgggtgaagctgatgcactttgtgaacagcctgcacaactacatcatgacccgcatcctgcacagcacaggcctggagttccagcaccaggtggaggaggccaaggacctggaccagctgatcaagatccactaccgctacctgagcaccatccatgaccgctgcctgctgcgggagaaggtgtcctttgtgaaggaggccatcatgaaggtgctgaacctggccctgatgtttgctgatggctggcaggccggcctgggcacctggaggatggagagcattgagaagatggagagtgacttcaagaactgccacatgttcctggtgaccatcctgaacaaggctgtgtgccggggcagcttcccccactgtgagtacatcatgctgaagtacttctacctgtgcatcagcctgtag

SEQ ID NO: 174795 - DNA, 1431 bp, Artificial Sequence
  Description of Artificial Sequence: Synthetic coding sequence
atgtggacaggctacaagatcctgatcttctcctacctgaccacagagatctggatggagaagcagtacctgagccagcgggaggtggacctggaggcctacttcaccaggaaccacacagtgctgcagggcacccgcttcaagagggccatcttccagggccagtactgcaggaactttggctgctgtgaggacagagatgatggctgtgtgacagagttctacgccgccaatgccctgtgctactgtgacaagttctgtgaccgggagaacagcgactgctgcccagactacaagagcttctgccgggaggagaaggagtggccaccccacacccagccctggtacccagagggctgcttcaaggatggccagcactatgaggagggcagcgtcatcaaggagaactgcaacagctgcacctgcagcggccagcagtggaagtgcagccagcacgtgtgcctggtgcgctctgagctgattgagcaggtgaacaagggggactatggctggacagcccagaactacagccagttctggggcatgaccctggaggatggcttcaagttccggctgggcaccctgccccccagccccatgctgctgtccatgaatgagatgacagccagcctgcctgccaccacagacctgcctgagttctttgtggccagctacaagtggccaggctggacccacggccccctggaccagaagaactgtgccgcctcctgggccttcagcacagcctctgtggccgctgaccgcatcgccatccagagcaagggccgctacacagccaacctgagcccccagaacctgatcagctgctgtgccaagaacagacatggctgcaacagcggcagcattgaccgggcctggtggtacctgaggaagaggggcctggtgagccacgcctgctaccccctcttcaaggaccagaatgccaccaacaacggctgtgccatggccagcagaagtgatggccggggcaagagacatgccaccaagccctgccccaacaacgtggagaagagcaaccgcatctaccagtgcagccccccctacagagtgagcagcaatgaaacagagatcatgaaggagatcatgcagaatggacctgtgcaggccatcatgcaggtgcgggaggacttcttccactacaagacaggcatctaccgccacgtgaccagcaccaacaaggagagcgagaagtacaggaagctgcagacccatgctgtgaagctgaccggctggggcaccctgcggggggcccagggccagaaggagaagttctggattgctgccaacagctggggcaagtcctggggagaaaatggctacttccgcatcctgcggggcgtgaatgaaagtgacatcgagaagctgatcatcgccgcctggggccagctgaccagcagtgatgagccctag

SEQ ID NO: 174796 - DNA, 1008 bp, Artificial Sequence
  Description of Artificial Sequence: Synthetic coding sequence
atgtggacaggctacaagatcctgatcttctcctacctgaccacagagatctggatggagaagcagtacctgagccagcgggaggtggacctggaggcctacttcaccaggaaccacacagtgctgcagggcacccgcttcaagagggccatcttccagggccagtactgcaggaactttggctgctgtgaggacagagatgatggctgtgtgacagagttctacgccgccaatgccctgtgctactgtgacaagttctgtgaccgggagaacagcgactgctgcccagactacaagagcttctgccgggaggagaaggagtggccaccccacacccagccctggtacccagagggccgctggacagcccagaactacagccagttctggggcatgaccctggaggatggcttcaagttccggctgggcaccctgccccccagccccatgctgctgtccatgaatgagatgacccggctggtgtcccatgcctgctaccccctcttcaaggaccagaatgccaccaacaacggctgtgccatggccagcagaagtgatggccggggcaagagacatgccaccaagccctgccccaacaacgtggagaagagcaaccgcatctaccagtgcagccccccctacagagtgagcagcaatgaaacagagatcatgaaggagatcatgcagaatggacctgtgcaggccatcatgcaggtgcgggaggacttcttccactacaagacaggcatctacagacatgtgaccagcaccaacaaggagagcgagaagtacaggaagctgcagacccatgctgtgaagctgaccggctggggcaccctgcggggggcccagggccagaaggagaagttctggattgctgccaacagctggggcaagtcctggggagaaaatggctacttccgcatcctgcggggcgtgaatgaaagtgacatcgagaagctgatcatcgccgcctggggccagctgaccagcagtgatgagccctag

SEQ ID NO: 174797 - DNA, 612 bp, Artificial Sequence
  Description of Artificial Sequence: Synthetic coding sequence
atggagaagcagtacctgagccagcgggaggtggacctggaggcctacttcaccaggaaccacacagtgctgcagggcacccgcttcaagagggccatcttccagggccagtactgcaggaactttggctgctgtgaggacagagatgatggctgtgtgacagagttctacgccgccaatgccctgtgctactgtgacaagttctgtgaccgggagaacagcgactgctgcccagactacaagagcttctgccgggaggagaaggagtggccaccccacacccagccctggtacccagagggctgcttcaaggatggccagcactatgaggagggcagcgtcatcaaggagaactgcaacagctgcacctgcagcggccagcagtggaagtgcagccagcacgtgtgcctggtgcgctctgagctgattgagcaggtgaacaagggggactatggctggacagcccagaactacagccagttctggggcatgaccctggaggatggcttcaagttccggctgggcaccctgccccccagccccatgctgctgtccatgaatgagatgacagtgtctgtgcccagcgacagcaggatgtgcatgtacctgtag

SEQ ID NO: 174798 - DNA, 468 bp, Artificial Sequence
  Description of Artificial Sequence: Synthetic coding sequence
atggccagcagaagtgatggccggggcaagagacatgccaccaagccctgccccaacaacgtggagaagagcaaccgcatctaccagtgcagccccccctacagagtgagcagcaatgaaacagagatcatgaaggagatcatgcagaatggacctgtgcaggccatcatgcaggtgcgggaggacttcttccactacaagacaggcatctacagacatgtgaccagcaccaacaaggagagcgagaagtacaggaagctgcagacccatgctgtgaagctgaccggctggggcaccctgcggggggcccagggccagaaggagaagttctggattgctgccaacagctggggcaagtcctggggagaaaatggctacttccgcatcctgcggggcgtgaatgaaagtgacatcgagaagctgatcatcgccgcctggggccagctgaccagcagtgatgagccctag

SEQ ID NO: 174799 - DNA, 618 bp, Artificial Sequence
  Description of Artificial Sequence: Synthetic coding sequence
atgagggcctggatgtttgtgtccatgcaggccgagatctggatggagaagcagtacctgagccagcgggaggtggacctggaggcctacttcaccaggaaccacacagtgctgcagggcacccgcttcaagagggccatcttccagggccagtactgcaggaactttggctgctgtgaggacagagatgatggctgtgtgacagagttctacgccgccaatgccctgtgctactgtgacaagttctgtgaccgggagaacagcgactgctgcccagactacaagagcttctgccgggaggagaaggagtggccaccccacacccagccctggtacccagagggctgcttcaaggatggccagcactatgaggagggcagcgtcatcaaggagaactgcaacagctgcacctgcagcggccagcagtggaagtgcagccagcacgtgtgcctggtgcgctctgagctgattgagcaggtgaacaagggggactatggctggacagcccagaactacagccagttctggggcatgaccctggaggatggcttcaagttccggctgggcaccctgccccccagccccatgctgctgtccatgaatgagatgacagaatag

SEQ ID NO: 174800 - DNA, 3570 bp, Artificial Sequence
  Description of Artificial Sequence: Synthetic coding sequence
atgtctgtgaagagccccttcaacgtgatgagcaggaacaacctggaggccccaccctgcaagatgacagagcccttcaactttgagaagaatgaaaacaagctgccccctcatgagagcctgcggagccctggcaccctgcccaaccaccccaacttccggctgaagagcagtgaaaatggaaacaagaagaacaacttcctgctgtgtgagcagaccaagcagtacctggccagccaggaggacaacagcgtgagcagcaaccccaacggcatcaatggagaggtggtgggcagcaagggggacaggaagaagctgcctgctggcaacagcgtgagcccccccagcgctgagagcaacagcccccccaaggaggtgaacatcaagccaggcaacaacgtgcggcctgccaagagcaagaagctgaacaagctggtggagaacagcctgagcatcagcaaccctggcctcttcaccagcctgggcccccccctgcggagcaccacctgccaccgctgtggcctgtttggcagcctgcgctgcagccagtgcaagcagacctactactgcagcacagcctgccagaggcgggactggagcgcccacagcatcgtgtgcaggcctgtgcagcccaacttccacaagctggagaacaagagcagcattgagaccaaggatgtggaggtgaacaacaagagtgactgccccctgggcgtgaccaaggagatcgccatctgggccgagcgcatcatgttcagtgacctgcggagcctgcagctgaagaagaccatggagatcaagggcaccgtgacagagttcaagcaccctggggacttctacgtgcagctgtacagcagcgaggtgctggagtacatgaaccagctgagcgccagcctgaaggagacctacgccaacgtgcatgagaaggactacatccctgtgaagggggaggtgtgcatcgccaagtacacagtggaccagacctggaacagagccatcatccagaatgtggatgtgcagcagaagaaggcccacgtgctgtacattgattatggaaatgaggagatcatccccctgaaccgcatctaccacctgaacagaaatattgacctcttccccccctgtgccatcaagtgctttgtggccaacgtcatcccagctgagggcaactggagcagtgactgcatcaaggccaccaagcccctgctgatggagcagtactgcagcatcaagatcgtggacatcctggaggaggaggtggtgacctttgctgtggaggtggagctgcccaacagcggcaagctgctggaccacgtgctgattgagatgggctacggcctgaagcccagcggccaggacagcaagaaggaaaatgctgaccagagcgaccctgaagatgtgggcaagatgaccacagagaacaacatcgtggtggacaagagtgacctgatccccaaggtgctgaccctgaatgtgggagatgagttctgtggggtggtggcccacatccagaccccagaggacttcttctgccagcagctgcagagcggcaggaagctggccgagctgcaggccagcctgagcaagtactgtgaccagctgcccccaagaagtgacttctacccagccatcggggacatctgctgtgcccagttctctgaagatgaccagtggtaccgggcctctgtgctggcctatgccagcgaggagagcgtgctggtgggctacgtggactatggcaactttgagatcctgagcctgatgaggctgtgccccatcatccccaagctgctggagctgcccatgcaggccatcaagtgtgtgctggccggcgtgaagcccagcctgggcatctggaccccagaggccatctgcctgatgaagaagctggtgcagaacaagatcatcaccgtgaaggtggtggacaagctggagaacagcagcctggtggagctgattgacaagtctgagaccccccacgtgtctgtgtccaaggtgctgctggatgctggctttgctgtgggggagcagagcatggtgacagacaagcccagtgatgtgaaggagacctctgtgcccctgggcgtggagggcaaggtgaaccccctggagtggacctgggtggagctgggcgtggaccagacagtggatgtggtggtgtgtgtgatctacagccctggagagttctactgccacgtgctgaaggaggatgccctgaagaagctgaatgacctgaacaagagcctggccgagcactgccagcagaagctgcccaacggcttcaaggccgagatcggccagccctgctgtgccttctttgctggagatggctcctggtaccgggccctggtgaaggagatcctgcccaacggccacgtgaaggtgcactttgtggactatggcaacatcgaggaggtgacagcagatgagctgaggatgatcagcagcaccttcctgaacctgcccttccagggcatccgctgccagctggccgacatccagagcaggaacaagcactggagcgaggaggccatcacccgcttccagatgtgtgtggccggcatcaagctgcaggcccgggtggtggaggtgacagaaaatggaattggagtggagctgacagacctgagcacctgctacccccgcatcatcagtgatgtgctgattgatgagcacctggtgctgaagagcgccagcccccacaaggacctgcccaatgaccggctggtgaacaagcatgagctgcaggtgcacgtgcagggcctgcaggccaccagcagcgctgagcagtggaagaccatcgagctgcctgtggacaagaccatccaggccaacgtgctggagatcatcagccccaacctcttctacgccctgcccaagggcatgcctgagaaccaggagaagctgtgcatgctgacagctgagctgctggagtactgcaatgcccccaagagcaggcctccctaccggcccagaattggagatgcctgctgtgccaagtacaccagtgatgacttctggtacagagctgtggtgctgggcaccagtgacacagatgtggaggtgctgtatgctgactatggcaacatcgagaccctgcccctgtgccgggtgcagcccatcaccagcagccacctggccctgcccttccagatcatccgctgcagcctggagggcctgatggagctgaatggcagcagcagccagctgatcatcatgctgctgaagaacttcatgctgaaccagaatgtgatgctgtctgtgaagggcatcaccaagaatgtgcacacagtgtctgtggagaagtgcagtgaaaatggcaccgtggatgtggccgacaagctggtgaccttcggcctggccaagaacatcaccccccagaggcagagcgccctgaacacagagaagatgtacaggatgaactgctgctgcacagagctgcagaagcaggtggagaagcatgagcacatcctgctcttcctgctgaacaacagcaccaaccagaacaagttcatcgagatgaagaagctgctgaagaagacagccagcctgggcggcaagcccctgtag

SEQ ID NO: 174801 - DNA, 3315 bp, Artificial Sequence
  Description of Artificial Sequence: Synthetic coding sequence
atgtctgtgaagagccccttcaacgtgatgagcaggaacaacctggaggccccaccctgcaagatgacagagcccttcaactttgagaagaatgaaaacaagctgccccctcatgagagcctgcggagccctggcaccctgcccaaccaccccaacttccggctgaagagcagtgaaaatggaaacaagaagaacaacttcctgctgtgtgagcagaccaagcagtacctggccagccaggaggacaacagcgtgagcagcaaccccaacggcatcaatggagaggtggtgggcagcaagggggacaggaagaagctgcctgctggcaacagcgtgagcccccccagcgctgagagcaacagcccccccaaggaggtgaacatcaagccaggcaacaacgtgcggcctgccaagagcaagaagctgaacaagctggtggagaacagcctgagcatcagcaaccctggcctcttcaccagcctgggcccccccctgcggagcaccacctgccaccgctgtggcctgtttggcagcctgcgctgcagccagtgcaagcagacctactactgcagcacagcctgccagaggcgggactggagcgcccacagcatcgtgtgcaggcctgtgcagcccaacttccacaagctggagaacaagagcagcattgagaccaaggatgtggaggtgaacaacaagagtgactgccccctgggcgtgaccaaggagatcgccatctgggccgagcgcatcatgttcagtgacctgcggagcctgcagctgaagaagaccatggagatcaagggcaccgtgacagagttcaagcaccctggggacttctacgtgcagctgtacagcagcgaggtgctggagtacatgaaccagctgagcgccagcctgaaggagacctacgccaacgtgcatgagaaggactacatccctgtgaagggggaggtgtgcatcgccaagtacacagtggaccagacctggaacagagccatcatccagaatgtggatgtgcagcagaagaaggcccacgtgctgtacattgattatggaaatgaggagatcatccccctgaaccgcatctaccacctgaacagaaatattgacctcttccccccctgtgccatcaagtgctttgtggccaacgtcatcccagctgagggcaactggagcagtgactgcatcaaggccaccaagcccctgctgatggagcagtactgcagcatcaagatcgtggacatcctggaggaggaggtggtgacctttgctgtggaggtggagctgcccaacagcggcaagctgctggaccacgtgctgattgagatgggctacggcctgaagcccagcggccaggacagcaagaaggaaaatgctgaccagagcgaccctgaagatgtgggcaagatgaccacagagaacaacatcgtggtggacaagagtgacctgatccccaaggtgctgaccctgaatgtgggagatgagttctgtggggtggtggcccacatccagaccccagaggacttcttctgccagcagctgcagagcggcaggaagctggccgagctgcaggccagcctgagcaagtactgtgaccagctgcccccaagaagtgacttctacccagccatcggggacatctgctgtgcccagttctctgaagatgaccagtggtaccgggcctctgtgctggcctatgccagcgaggagagcgtgctggtgggctacgtggactatggcaactttgagatcctgagcctgatgaggctgtgccccatcatccccaagctgctggagctgcccatgcaggccatcaagtgtgtgctggccggcgtgaagcccagcctgggcatctggaccccagaggccatctgcctgatgaagaagctggtgcagaacaagatcatcaccgtgaaggtggtggacaagctggagaacagcagcctggtggagctgattgacaagtctgagaccccccacgtgtctgtgtccaaggtgctgctggatgctggctttgctgtgggggagcagagcatggtgacagacaagcccagtgatgtgaaggagacctctgtgcccctgggcgtggagggcaaggtgaaccccctggagtggacctgggtggagctgggcgtggaccagacagtggatgtggtggtgtgtgtgatctacagccctggagagttctactgccacgtgctgaaggaggatgccctgaagaagctgaatgacctgaacaagagcctggccgagcactgccagcagaagctgcccaacggcttcaaggccgagatcggccagccctgctgtgccttctttgctggagatggctcctggtaccgggccctggtgaaggagatcctgcccaacggccacgtgaaggtgcactttgtggactatggcaacatcgaggaggtgacagcagatgagctgaggatgatcagcagcaccttcctgaacctgcccttccagggcatccgctgccagctggccgacatccagagcaggaacaagcactggagcgaggaggccatcacccgcttccagatgtgtgtggccggcatcaagctgcaggcccgggtggtggaggtgacagaaaatggaattggagtggagctgacagacctgagcacctgctacccccgcatcatcagtgatgtgctgattgatgagcacctggtgctgaagagcgccagcccccacaaggacctgcccaatgaccggctggtgaacaagcatgagctgcaggtgcacgtgcagggcctgcaggccaccagcagcgctgagcagtggaagaccatcgagctgcctgtggacaagaccatccaggccaacgtgctggagatcatcagccccaacctcttctacgccctgcccaagggcatgcctgagaaccaggagaagctgtgcatgctgacagctgagctgctggagtactgcaatgcccccaagagcaggcctccctaccggcccagaattggagatgcctgctgtgccaagtacaccagtgatgacttctggtacagagctgtggtgctgggcaccagtgacacagatgtggaggtgctgtatgctgactatggcaacatcgagaccctgcccctgtgccgggtgcagcccatcaccagcagccacctggccctgcccttccagatcatccgctgcagcctggaggagaagatgtacaggatgaactgctgctgcacagagctgcagaagcaggtggagaagcatgagcacatcctgctcttcctgctgaacaacagcaccaaccagaacaagttcatcgagatgaagaagctgctgaagagctag

SEQ ID NO: 174802 - DNA, 3228 bp, Artificial Sequence
  Description of Artificial Sequence: Synthetic coding sequence
atgtctgtgaagagccccttcaacgtgatgagcaggaacaacctggaggccccaccctgcaagatgacagagcccttcaactttgagaagaatgaaaacaagctgccccctcatgagagcctgcggagccctggcaccctgcccaaccaccccaacttccggctgaagagcagtgaaaatggaaacaagaagaacaacttcctgctgtgtgagcagaccaagcagtacctggccagccaggaggacaacagcgtgagcagcaaccccaacggcatcaatggagaggtggtgggcagcaagggggacaggaagaagctgcctgctggcaacagcgtgagcccccccagcgctgagagcaacagcccccccaaggaggtgaacatcaagccaggcaacaacgtgcggcctgccaagagcaagaagctgaacaagctggtggagaacagcctgagcatcagcaaccctggcctcttcaccagcctgggcccccccctgcggagcaccacctgccaccgctgtggcctgtttggcagcctgcgctgcagccagtgcaagcagacctactactgcagcacagcctgccagaggcgggactggagcgcccacagcatcgtgtgcaggcctgtgcagcccaacttccacaagctggagaacaagagcagcattgagaccaaggatgtggaggtgaacaacaagagtgactgccccctgggcgtgaccaaggagatcgccatctgggccgagcgcatcatgttcagtgacctgcggagcctgcagctgaagaagaccatggagatcaagggcaccgtgacagagttcaagcaccctggggacttctacgtgcagctgtacagcagcgaggtgctggagtacatgaaccagctgagcgccagcctgaaggagacctacgccaacgtgcatgagaaggactacatccctgtgaagggggaggtgtgcatcgccaagtacacagtggaccagacctggaacagagccatcatccagaatgtggatgtgcagcagaagaaggcccacgtgctgtacattgattatggaaatgaggagatcatccccctgaaccgcatctaccacctgaacagaaatattgacctcttccccccctgtgccatcaagtgctttgtggccaacgtcatcccagctgagggcaactggagcagtgactgcatcaaggccaccaagcccctgctgatggagcagtactgcagcatcaagatcgtggacatcctggaggaggaggtggtgacctttgctgtggaggtggagctgcccaacagcggcaagctgctggaccacgtgctgattgagatgggctacggcctgaagcccagcggccaggacagcaagaaggaaaatgctgaccagagcgaccctgaagatgtgggcaagatgaccacagagaacaacatcgtggtggacaagagtgacctgatccccaaggtgctgaccctgaatgtgggagatgagttctgtggggtggtggcccacatccagaccccagaggacttcttctgccagcagctgcagagcggcaggaagctggccgagctgcaggccagcctgagcaagtactgtgaccagctgcccccaagaagtgacttctacccagccatcggggacatctgctgtgcccagttctctggagtgaagcccagcctgggcatctggaccccagaggccatctgcctgatgaagaagctggtgcagaacaagatcatcaccgtgaaggtggtggacaagctggagaacagcagcctggtggagctgattgacaagtctgagacccctcatgtgtctgtgtccaaggtgctgctggatgctggctttgctgtgggggagcagagcatggtgacagacaagcccagtgatgtgaaggagacctctgtgcccctgggcgtggagggcaaggtgaaccccctggagtggacctgggtggagctgggcgtggaccagacagtggatgtggtggtgtgtgtgatctacagccctggagagttctactgccacgtgctgaaggaggatgccctgaagaagctgaatgacctgaacaagagcctggccgagcactgccagcagaagctgcccaacggcttcaaggccgagatcggccagccctgctgtgccttctttgctgacatccagagcaggaacaagcactggagcgaggaggccatcacccgcttccagatgtgtgtggccggcatcaagctgcaggcccgggtggtggaggtgacagaaaatggaattggagtggagctgacagacctgagcacctgctacccccgcatcatcagtgatgtgctgattgatgagcacctggtgctgaagagcgccagcccccacaaggacctgcccaatgaccggctggtgaacaagcatgagctgcaggtgcacgtgcagggcctgcaggccaccagcagcgctgagcagtggaagaccatcgagctgcctgtggacaagaccatccaggccaacgtgctggagatcatcagccccaacctcttctacgccctgcccaagggcatgcctgagaaccaggagaagctgtgcatgctgacagctgagctgctggagtactgcaatgcccccaagagcaggcctccctaccggcccagaattggagatgcctgctgtgccaagtacaccagtgatgacttctggtacagagctgtggtgctgggcaccagtgacacagatgtggaggtgctgtatgctgactatggcaacatcgagaccctgcccctgtgccgggtgcagcccatcaccagcagccacctggccctgcccttccagatcatccgctgcagcctggagggcctgatggagctgaatggcagcagcagccagctgatcatcatgctgctgaagaacttcatgctgaaccagaatgtgatgctgtctgtgaagggcatcaccaagaatgtgcacacagtgtctgtggagaagtgcagtgaaaatggcaccgtggatgtggccgacaagctggtgaccttcggcctggccaagaacatcaccccccagaggcagagcgccctgaacacagagaagatgtacaggatgaactgctgctgcacagagctgcagaagcaggtggagaagcatgagcacatcctgctcttcctgctgaacaacagcaccaaccagaacaagttcatcgagatgaagaagctgctgaagaagacagccagcctgggcggcaagcccctgtag

SEQ ID NO: 174803 - DNA, 3342 bp, Artificial Sequence
  Description of Artificial Sequence: Synthetic coding sequence
atgtctgtgaagagccccttcaacgtgatgagcaggaacaacctggaggccccaccctgcaagatgacagagcccttcaactttgagaagaatgaaaacaagctgccccctcatgagagcctgcggagccctggcaccctgcccaaccaccccaacttccggctgaagagcagtgaaaatggaaacaagaagaacaacttcctgctgtgtgagcagaccaagcagtacctggccagccaggaggacaacagcgtgagcagcaaccccaacggcatcaatggagaggtggtgggcagcaagggggacaggaagaagctgcctgctggcaacagcgtgagcccccccagcgctgagagcaacagcccccccaaggaggtgaacatcaagccaggcaacaacgtgcggcctgccaagagcaagaagctgaacaagctggtggagaacagcctgagcatcagcaaccctggcctcttcaccagcctgggcccccccctgcggagcaccacctgccaccgctgtggcctgtttggcagcctgcgctgcagccagtgcaagcagacctactactgcagcacagcctgccagaggcgggactggagcgcccacagcatcgtgtgcaggcctgtgcagcccaacttccacaagctggagaacaagagcagcattgagaccaaggatgtggaggtgaacaacaagagtgactgccccctgggcgtgaccaaggagatcgccatctgggccgagcgcatcatgttcagtgacctgcggagcctgcagctgaagaagaccatggagatcaagggcaccgtgacagagttcaagcaccctggggacttctacgtgcagctgtacagcagcgaggtgctggagtacatgaaccagctgagcgccagcctgaaggagacctacgccaacgtgcatgagaaggactacatccctgtgaagggggaggtgtgcatcgccaagtacacagtggaccagacctggaacagagccatcatccagaatgtggatgtgcagcagaagaaggcccacgtgctgtacattgattatggaaatgaggagatcatccccctgaaccgcatctaccacctgaacagaaatattgacctcttccccccctgtgccatcaagtgctttgtggccaacgtcatcccagctgagggcaactggagcagtgactgcatcaaggccaccaagcccctgctgatggagcagtactgcagcatcaagatcgtggacatcctggaggaggaggtggtgacctttgctgtggaggtggagctgcccaacagcggcaagctgctggaccacgtgctgattgagatgggctacggcctgaagcccagcggccaggacagcaagaaggaaaatgctgaccagagcgaccctgaagatgtgggcaagatgaccacagagaacaacatcgtggtggacaagagtgacctgatccccaaggtgctgaccctgaatgtgggagatgagttctgtggggtggtggcccacatccagaccccagaggacttcttctgccagcagctgcagagcggcaggaagctggccgagctgcaggccagcctgagcaagtactgtgaccagctgcccccaagaagtgacttctacccagccatcggggacatctgctgtgcccagttctctgaagatgaccagtggtaccgggcctctgtgctggcctatgccagcgaggagagcgtgctggtgggctacgtggactatggcaactttgagatcctgagcctgatgaggctgtgccccatcatccccaagctgctggagctgcccatgcaggccatcaagtgtgtgctggccggcgtgaagcccagcctgggcatctggaccccagaggccatctgcctgatgaagaagctggtgcagaacaagatcatcaccgtgaaggtggtggacaagctggagaacagcagcctggtggagctgattgacaagtctgagaccccccacgtgtctgtgtccaaggtgctgctggatgctggctttgctgtgggggagcagagcatggtgacagacaagcccagtgatgtgaaggagacctctgtgcccctgggcgtggagggcaaggtgaaccccctggagtggacctgggtggagctgggcgtggaccagacagtggatgtggtggtgtgtgtgatctacagccctggagagttctactgccacgtgctgaaggaggatgccctgaagaagctgaatgacctgaacaagagcctggccgagcactgccagcagaagctgcccaacggcttcaaggccgagatcggccagccctgctgtgccttctttgctggagatggctcctggtaccgggccctggtgaaggagatcctgcccaacggccacgtgaaggtgcactttgtggactatggcaacatcgaggaggtgacagcagatgagctgaggatgatcagcagcaccttcctgaacctgcccttccagggcatccgctgccagctggccgacatccagagcaggaacaagcactggagcgaggaggccatcacccgcttccagatgtgtgtggccggcatcaagctgcaggcccgggtggtggaggtgacagaaaatggaattggagtggagctgacagacctgagcacctgctacccccgcatcatcagtgatgtgctgattgatgagcacctggtgctgaagagcgccagcccccacaaggacctgcccaatgaccggctggtgaacaagcatgagctgcaggtgcacgtgcagggcctgcaggccaccagcagcgctgagcagtggaagaccatcgagctgcctgtggacaagaccatccaggccaacgtgctggagatcatcagccccaacctcttctacgccctgcccaagggcatgcctgagaaccaggagaagctgtgcatgctgacagctgagctgctggagtactgcaatgcccccaagagcaggcctccctaccggcccagaattggagatgcctgctgtgccaagtacaccagtgatgacttctggtacagagctgtggtgctgggcaccagtgacacagatgtggaggtgctgtatgctgactatggcaacatcgagaccctgcccctgtgccgggtgcagcccatcaccagcagccacctggccctgcccttccagatcatccgctgcagcctggaggagaagatgtacaggatgaactgctgctgcacagagctgcagaagcaggtggagaagcatgagcacatcctgctcttcctgctgaacaacagcaccaaccagaacaagttcatcgagatgaagaagctgctgaagaagacagccagcctgggcggcaagcccctgtag

SEQ ID NO: 174804 - DNA, 2154 bp, Artificial Sequence
  Description of Artificial Sequence: Synthetic coding sequence
atgaaccagctgagcgccagcctgaaggagacctacgccaacgtgcatgagaaggactacatccctgtgaagggggaggtgtgcatcgccaagtacacagtggaccaggccatcaagtgctttgtggccaacgtcatcccagctgagggcaactggagcagtgactgcatcaaggccaccaagcccctgctgatggagcagtactgcagcatcaagatcgtggacatcctggaggaggaggtggtgacctttgctgtggaggtggagctgcccaacagcggcaagctgctggaccacgtgctgattgagatgggctacggcctgaagcccagcggccaggacagcaagaaggaaaatgctgaccagagcgaccctgaagatgtgggcaagatgaccacagagaacaacatcgtggtggacaagagtgacctgatccccaaggtgctgaccctgaatgtgggagatgagttctgtggggtggtggcccacatccagaccccagaggacttcttctgccagcagctgcagagcggcaggaagctggccgagctgcaggccagcctgagcaagtactgtgaccagctgccccccaggagtgacttctacccagccatcggggacatctgctgtgcccagttcagcggcgtgaagcccagcctgggcatctggaccccagaggccatctgcctgatgaagaagctggtgcagaacaagatcatcaccgtgaaggtggtggacaagctggagaacagcagcctggtggagctgattgacaagtctgagaccccccacgtgtctgtgtccaaggtgctgctggatgctggctttgctgtgggggagcagagcatggtgacagacaagcccagtgatgtgaaggagacctctgtgcccctgggcgtggagggcaaggtgaaccccctggagtggacctgggtggagctgggcgtggaccagacagtggatgtggtggtgtgtgtgatctacagccctggagagttctactgccacgtgctgaaggaggatgccctgaagaagctgaatgacctgaacaagagcctggccgagcactgccagcagaagctgcccaacggcttcaaggccgagatcggccagccctgctgtgccttctttgctggagatggctcctggtaccgggccctggtgaaggagatcctgcccaacggccacgtgaaggtgcactttgtggactatggcaacatcgaggaggtgacagcagatgagctgaggatgatcagcagcaccttcctgaacctgcccttccagggcatccgctgccagctggccgacatccagagcaggaacaagcactggagcgaggaggccatcacccgcttccagatgtgtgtggccggcatcaagctgcaggcccgggtggtggaggtgacagaaaatggaattggagtggagctgacagacctgagcacctgctacccccgcatcatcagtgatgtgctgattgatgagcacctggtgctgaagagcgccagcccccacaaggacctgcccaatgaccggctggtgaacaagcatgagctgcaggtgcacgtgcagggcctgcaggccaccagcagcgctgagcagtggaagaccatcgagctgcctgtggacaagaccatccaggccaacgtgctggagatcatcagccccaacctcttctacgccctgcccaagggcatgcctgagaaccaggagaagctgtgcatgctgacagctgagctgctggagtactgcaatgcccccaagagcaggcctccctaccggcccagaattggagatgcctgctgtgccaagtacaccagtgatgacttctggtacagagctgtggtgctgggcaccagtgacacagatgtggaggtgctgtatgctgactatggcaacatcgagaccctgcccctgtgccgggtgcagcccatcaccagcagccacctggccctgcccttccagatcatccgctgcagcctggaggagaagatgtacaggatgaactgctgctgcacagagctgcagaagcaggtggagaagcatgagcacatcctgctcttcctgctgaacaacagcaccaaccagaacaagttcatcgagatgaagaagctgctgaagaagacagccagcctgggcggcaagcccctgtag

SEQ ID NO: 174805 - DNA, 1956 bp, Artificial Sequence
  Description of Artificial Sequence: Synthetic coding sequence
atgctgcggctgcagatgacagatggccacatcagctgcacagctgtggagttctcctacatgagcaagatcagcctgaacaccccacctggcaccaaggtgaagctgtctggaattgtggacatcaagaatggcttcctgctgctgaatgacagcaacaccaccgtgctgggcggggaggtggagcacctgattgagaagtgggagctgcagaggagcctgagcaagcacaacagaagcaacatcggcacagagggcggccccccaccatttgtgcccttcggccagaagtgtgtgagccacgtgcaggtggacagccgggagctggacaggaggaagaccctgcaggtgaccatgcctgtgaagcccaccaatgacaatgatgaatttgagaagcagaggacagctgccatcgccgaggtggccaagagcaaggagaccaagaccttcggcggcggcggcggcggggcccggagcaacctgaacatgaatgctgctggcaacagaaaccgggaggtgctgcagaaggagaagagcaccaagtctgagggcaagcatgagggcgtgtaccgggagctggtggatgagaaggccctgaagcacatcacagagatgggcttcagcaaggaggccagccggcaggccctgatggacaatggaaacaacctggaggccgccctgaatgtgctgctgaccagcaacaagcagaagcctgtgatgggcccccccctgcggggccggggcaagggccggggccgcatccgctcagaagatgaggaggacctgggcaatgcccggcccagcgcccccagcaccctgtttgacttcctggagagcaagatgggcaccctgaatgtggaggagcccaagagccagccccagcagctgcaccagggccagtaccgcagcagcaacacagagcagaatggagtgaaggacaacaaccacctgcggcaccccccaagaaatgacacccggcagcccagaaatgagaagcccccacgcttccagagggacagccagaacagcaagtctgtgctggagggcagcggcctgcccaggaacagaggcagcgagcggcccagcaccagctctgtgtctgaggtgtgggccgaggaccgcatcaagtgtgaccggccctacagccgctatgacaggaccaaggacaccagctaccccctgggcagccagcacagtgatggagccttcaagaagagggacaacagcatgcagagccgcagcggcaagggccccagctttgctgaggccaaggagaaccccctgccccagggctctgtggactacaacaaccagaagaggggcaagcgggagagccagaccagcatcccagactacttctatgacaggaagagccagaccatcaacaatgaggccttcagcggcatcaagattgagaagcacttcaacgtgaacacagactaccagaaccctgtgcgcagcaacagcttcatcggcgtgcccaatggagaggtggagatgcccctgaagggcagaagaattggccccatcaagccagctggccctgtgacagctgtgccctgtgatgacaagatcttctacaacagcggccccaagagaagaagtggccccatcaagccagagaagatcctggagagcagcatccccatggagtatgccaagatgtggaagccaggagatgaatgttttgccctgtactgggaggacaacaagttctacagagctgaggtggaggccctgcacagcagcggcatgacagctgtggtgaagttcatcgactatggcaactatgaggaggtgctgctgagcaacatcaagcccatccagacagaggcctgggaggaggagggcacctatgaccagaccctggagttcagaagaggaggagatggccagccccggcgcagcacccggcccacccagcagttctaccagcccccccgggccaggaactag

SEQ ID NO: 174806 - DNA, 1956 bp, Artificial Sequence; identical to SEQ ID NO: 174805
  Description of Artificial Sequence: Synthetic coding sequence

SEQ ID NO: 174807 - DNA, 390 bp, Artificial Sequence
  Description of Artificial Sequence: Synthetic coding sequence
atgctgcggctgcagatgacagatggccacatcagctgcacagctgtggagttctcctacatgagcaagatcagcctgaacaccccacctggcaccaaggtgaagctgtctggaattgtggacatcaagaatggcttcctgctgctgaatgacagcaacaccaccgtgctgggcggggaggtggagcacctgattgagaagtgggagctgcagaggagcctgagcaagcacaacagaagcaacatcggcacagagggcggccccccaccatttgtgcccttcggccagaagtgtgtgagccacgtgcaggtggacagccgggagctggacaggaggaagaccctgcaggtgaccatgcctgtgaagcccaccaatgacaatgatgaatag

SEQ ID NO: 174808 - DNA, 1956 bp, Artificial Sequence; identical to SEQ ID NO: 174805
  Description of Artificial Sequence: Synthetic coding sequence

SEQ ID NO: 174809 - DNA, 2235 bp, Artificial Sequence
  Description of Artificial Sequence: Synthetic coding sequence
atggcccaggtggccggggccgccctgagccaggccggctggtacctgagtgatgagggcatcgaggcctgcaccagcagcccagacaaggtgaatgtgaatgacatcatcctgattgccctgaacacagacctgcggaccatcggcaagaagttcctgcccagcgacatcaacagcggcaaggtggagaagctggagggcccctgtgtgctgcagatccagaagatcagaaatgtggccgcccccaaggacaatgaggagagccaggccgcccccaggatgctgcggctgcagatgacagatggccacatcagctgcacagctgtggagttctcctacatgagcaagatcagcctgaacaccccacctggcaccaaggtgaagctgagcggcatcgtggacatcaagaatggcttcctgctgctgaatgacagcaacaccaccgtgctgggcggggaggtggagcacctgattgagaagtgggagctgcagaggagcctgagcaagcacaacagaagcaacattggaacagaaggaggccccccaccatttgtgcccttcggccagaagtgtgtgagccacgtgcaggtggacagccgggagctggacaggaggaagaccctgcaggtgaccatgcctgtgaagcccaccaatgacaatgatgaatttgagaagcagaggacagctgccatcgccgaggtggccaagagcaaggagaccaagacctttggaggcggcggcggcggggcccggagcaacctgaacatgaatgctgctggcaacagaaaccgggaggtgctgcagaaggagaagagcaccaagtctgagggcaagcatgaaggagtgtaccgggagctggtggatgagaaggccctgaagcacatcacagagatgggcttcagcaaggaggccagccggcaggccctgatggacaatggaaacaacctggaggccgccctgaatgtgctgctgaccagcaacaagcagaagcctgtgatgggcccccccctgcggggccggggcaagggccggggccgcatccgctcagaagatgaggaggacctgggcaatgcccggcccagcgcccccagcaccctgtttgacttcctggagagcaagatgggcaccctgaatgtggaggagcccaagagccagccccagcagctgcaccagggccagtaccgcagcagcaacacagagcagaatggagtgaaggacaacaaccacctgcggcaccccccaagaaatgacacccggcagcccagaaatgagaagccaccccgcttccagagggacagccagaacagcaagtctgtgctggagggcagcggcctgcccaggaacagaggcagcgagcggcccagcaccagctctgtgtctgaggtgtgggccgaggaccgcatcaagtgtgaccggccctacagccgctatgacaggaccaaggacaccagctaccccctgggcagccagcacagtgatggagccttcaagaagagggacaacagcatgcagagccgcagcggcaagggccccagctttgctgaggccaaggagaaccccctgccccagggctctgtggactacaacaaccagaagaggggcaagcgggagagccagaccagcatcccagactacttctatgacaggaagagccagaccatcaacaatgaggccttcagcggcatcaagattgagaagcacttcaacgtgaacacagactaccagaaccctgtgcgcagcaacagcttcatcggcgtgcccaacggggaggtggagatgcccctgaagggccgccgcatcggccccatcaagccagctggccctgtgacagctgtgccctgtgatgacaagatcttctacaacagcggccccaagaggaggagcggccccatcaagccagagaagatcctggagagcagcatccccatggagtatgccaagatgtggaagccaggagatgagtgctttgccctgtactgggaggacaacaagttctacagagctgaggtggaggccctgcacagcagcggcatgacagctgtggtgaagttcattgattatggcaactatgaggaggtgctgctgagcaacatcaagcccatccagacagaggcctgggaggaggagggcacctatgaccagaccctggagttcagaagaggaggagatggccagcccaggaggagcacccggcccacccagcagttctaccagcccccccgggccagaaattag

SEQ ID NO: 174810 - DNA, 3297 bp, Artificial Sequence
  Description of Artificial Sequence: Synthetic coding sequence
atgctggagggggacctggtgtccaagatgctgcgggctgtgctgcagagccacaagaatggagtggccctgccccggctgcagggcgagtaccgcagcctgactggagactggatccccttcaagcagctgggcttccccaccctggaggcctacctgcggtctgtgcctgctgtggtgcgcatcgagaccagccgctctggagagatcacctgctacgccatggcctgcacagaaacagccagaattgcccagctggtggcccggcagaggagcagcaagaggaagacaggccggcaggtgaactgccagatgagggtgaagaagaccatgcccttcttcctggagggcaagcccaaggccaccctgcggcagcccggctttgccagcaacttctctgtgggcaagaagcccaacccagcccccctgcgggacaagggcaacagcgtgggcgtgaagccagatgctgagatgagcccctacatgctgcacaccaccctgggcaatgaggccttcaaggacatccctgtgcagagacatgtgaccatgagcaccaacaaccgcttcagccccaaggccagcctgcagccccccctgcagatgcacctgagcaggaccagcaccaaggagatgtctgacaacctgaaccagacagtggagaagcccaacgtgaagcccccagccagctacacctacaagatggatgaggtgcagaaccgcatcaaggagatcctgaacaagcacaacaacggcatctggatcagcaagctgccccacttctacaaggagctgtacaaggaggacctgaaccagggcatcctgcagcagtttgagcactggccccacatctgcaccgtggagaagccctgcagcggcggccaggacctgctgctgtacccagccaagaggaagcagctgctgcggtctgagctggacacagagaaggtgcccctgagccccctgcccggccccaagcagaccccacccctgaagggctgccccaccgtgatggccggggacttcaaggagaaggtggccgacctgctggtgaagtacaccagcggcctgtgggccagcgccctgcccaaggcctttgaggagatgtacaaggtgaagttcccagaagatgccctgaagaacctggccagcctgagtgatgtgtgcagcattgactacatcagcggcaacccccagaaggccatcctgtatgccaagctgcccctgcccacagacaagatccagaaggatgctggccaggcccatggagacaatgacatcaaggccatggtggagcaggagtacctgcaggtggaggagagcattgctgagagcgccaacaccttcatggaggacatcaccgtgccccccctgatgatccccacagaggccagccccagcgtgctggtggtggagctgagcaacaccaatgaggtggtgatccgctacgtgggcaaggactacagcgctgcccaggagctgatggaggatgagatgaaggagtactacagcaagaaccccaagatcacccctgtgcaggccgtgaatgtgggccagctgctggccgtgaatgctgaggaggatgcctggctgcgggcccaggtgatcagcacagaggagaacaagatcaaggtgtgctacgtggactatggcttctctgaaaatgtggagaagagcaaggcctacaagctgaaccccaagttctgcagcctgtccttccaggccaccaagtgcaagctggccggcctggaggtgctgagtgatgatcctgacctggtgaaggtggtggagagcctgacctgtgggaagatctttgctgtggagatcctggacaaggctgacatccccctggtggtgctgtatgacaccagcggagaagatgacatcaacatcaatgccacctgcctgaaggccatctgtgacaagagcctggaggtgcacctgcaggtggatgccatgtacaccaacgtgaaggtgaccaacatctgcagtgatggcaccctgtactgccaggtgccctgcaagggcctgaacaagctgagtgacctgctgaggaagattgaggactacttccactgcaagcacatgaccagcgagtgctttgtgtccctgcccttctgtgggaagatctgcctcttccactgcaagggcaagtggctgcgggtggagatcaccaacgtgcacagcagccgggccctggatgtgcagttcctggacagcggcaccgtgacctctgtgaaggtgtctgagctgcgggagatccccccacgcttcctgcaggagatgattgccatccccccccaggccatcaagtgctgcctggccgacctgccccagagcatcggcatgtggaccccagatgctgtgctgtggctgcgggacagcgtgctgaactgcagcgactgcagcatcaaggtgaccaaggtggatgagacccggggcatcgcccacgtgtacctgttcacccccaagaacttcccagacccccacaggagcatcaaccggcagatcaccaatgctgacctgtggaagcaccagaaggatgtgttcctgagcgccatcagcagtggagctgacagccccaacagcaagaatggaaacatgcccatgagcggcaacacaggagagaacttcaggaagaacctgacagatgtgatcaagaagtccatggtggaccacaccagcgccttcagcacagaggagctgcccccacctgtgcacctgagcaagccaggagagcacatggatgtgtatgtgcctgtggcctgccaccctggctactttgtgatccagccctggcaggagatccacaagctggaggtgctgatggaggagatgatcctgtactacagcgtgtctgaggagcggcacatcgctgtggagaaggaccaggtgtatgctgccaaggtggagaacaagtggcaccgggtgctgctgaagggcatcctgaccaacggcctggtgtctgtgtatgagctggactatggcaagcatgagctggtgaacatcaggaaggtgcagcccctggtggacatgttcaggaagctgcccttccaggccgtgacagcccagctggccggcgtgaagtgcaaccagtggagcgaggaggcctccatggtgttcagaaatcatgtggagaagaagcccctggtggccctggtgcagacagtgattgaaaatgccaacccctgggacaggaaggtggtggtgtacctggtggacaccagcctgcctgacacagacacctggattcatgacttcatgtctgagtacctgattgagctgagcaaggtgaactag

SEQ ID NO: 174811 - DNA, 3075 bp, Artificial Sequence
  Description of Artificial Sequence: Synthetic coding sequence
atggcctgcacagaaacagccagaattgcccagctggtggcccggcagaggagcagcaagaggaagacaggccggcaggtgaactgccagatgagggtgaagaagaccatgcccttcttcctggagggcaagcccaaggccaccctgcggcagcccggctttgccagcaacttctctgtgggcaagaagcccaacccagcccccctgcgggacaagggcaacagcgtgggcgtgaagccagatgctgagatgagcccctacatgctgcacaccaccctgggcaatgaggccttcaaggacatccctgtgcagagacatgtgaccatgagcaccaacaaccgcttcagccccaaggccagcctgcagccccccctgcagatgcacctgagcaggaccagcaccaaggagatgtctgacaacctgaaccagacagtggagaagcccaacgtgaagcccccagccagctacacctacaagatggatgaggtgcagaaccgcatcaaggagatcctgaacaagcacaacaacggcatctggatcagcaagctgccccacttctacaaggagctgtacaaggaggacctgaaccagggcatcctgcagcagtttgagcactggccccacatctgcaccgtggagaagccctgcagcggcggccaggacctgctgctgtacccagccaagaggaagcagctgctgcggtctgagctggacacagagaaggtgcccctgagccccctgcccggccccaagcagaccccacccctgaagggctgccccaccgtgatggccggggacttcaaggagaaggtggccgacctgctggtgaagtacaccagcggcctgtgggccagcgccctgcccaaggcctttgaggagatgtacaaggtgaagttcccagaagatgccctgaagaacctggccagcctgagtgatgtgtgcagcattgactacatcagcggcaacccccagaaggccatcctgtatgccaagctgcccctgcccacagacaagatccagaaggatgctggccaggcccatggagacaatgacatcaaggccatggtggagcaggagtacctgcaggtggaggagagcattgctgagagcgccaacaccttcatggaggacatcaccgtgccccccctgatgatccccacagaggccagccccagcgtgctggtggtggagctgagcaacaccaatgaggtggtgatccgctacgtgggcaaggactacagcgctgcccaggagctgatggaggatgagatgaaggagtactacagcaagaaccccaagatcacccctgtgcaggccgtgaatgtgggccagctgctggccgtgaatgctgaggaggatgcctggctgcgggcccaggtgatcagcacagaggagaacaagatcaaggtgtgctacgtggactatggcttctctgaaaatgtggagaagagcaaggcctacaagctgaaccccaagttctgcagcctgtccttccaggccaccaagtgcaagctggccggcctggaggtgctgagtgatgatcctgacctggtgaaggtggtggagagcctgacctgtgggaagatctttgctgtggagatcctggacaaggctgacatccccctggtggtgctgtatgacaccagcggagaagatgacatcaacatcaatgccacctgcctgaaggccatctgtgacaagagcctggaggtgcacctgcaggtggatgccatgtacaccaacgtgaaggtgaccaacatctgcagtgatggcaccctgtactgccaggtgccctgcaagggcctgaacaagctgagtgacctgctgaggaagattgaggactacttccactgcaagcacatgaccagcgagtgctttgtgtccctgcccttctgtgggaagatctgcctcttccactgcaagggcaagtggctgcgggtggagatcaccaacgtgcacagcagccgggccctggatgtgcagttcctggacagcggcaccgtgacctctgtgaaggtgtctgagctgcgggagatccccccacgcttcctgcaggagatgattgccatccccccccaggccatcaagtgctgcctggccgacctgccccagagcatcggcatgtggaccccagatgctgtgctgtggctgcgggacagcgtgctgaactgcagcgactgcagcatcaaggtgaccaaggtggatgagacccggggcatcgcccacgtgtacctgttcacccccaagaacttcccagacccccacaggagcatcaaccggcagatcaccaatgctgacctgtggaagcaccagaaggatgtgttcctgagcgccatcagcagtggagctgacagccccaacagcaagaatggaaacatgcccatgagcggcaacacaggagagaacttcaggaagaacctgacagatgtgatcaagaagtccatggtggaccacaccagcgccttcagcacagaggagctgcccccacctgtgcacctgagcaagccaggagagcacatggatgtgtatgtgcctgtggcctgccaccctggctactttgtgatccagccctggcaggagatccacaagctggaggtgctgatggaggagatgatcctgtactacagcgtgtctgaggagcggcacatcgctgtggagaaggaccaggtgtatgctgccaaggtggagaacaagtggcaccgggtgctgctgaagggcatcctgaccaacggcctggtgtctgtgtatgagctggactatggcaagcatgagctggtgaacatcaggaaggtgcagcccctggtggacatgttcaggaagctgcccttccaggccgtgacagcccagctggccggcgtgaagtgcaaccagtggagcgaggaggcctccatggtgttcagaaatcatgtggagaagaagcccctggtggccctggtgcagacagtgattgaaaatgccaacccctgggacaggaaggtggtggtgtacctggtggacaccagcctgcctgacacagacacctggattcatgacttcatgtctgagtacctgattgagctgagcaaggtgaactag

SEQ ID NO: 174812 - DNA, 1257 bp, Artificial Sequence
  Description of Artificial Sequence: Synthetic coding sequence
atgtacaccaacgtgaaggtgaccaacatctgcagtgatggcaccctgtactgccaggtgccctgcaagggcctgaacaagctgagtgacctgctgaggaagattgaggactacttccactgcaagatcaccaacgtgcacagcagccgggccctggatgtgcagttcctggacagcggcaccgtgacctctgtgaaggtgtctgagctgcgggagatccccccacgcttcctgcaggagatgattgccatccccccccaggccatcaagtgctgcctggccgacctgccccagagcatcggcatgtggaccccagatgctgtgctgtggctgcgggacagcgtgctgaactgcagcgactgcagcatcaaggtgaccaaggtggatgagacccggggcatcgcccacgtgtacctgttcacccccaagaacttcccagacccccacaggagcatcaaccggcagatcaccaatgctgacctgtggaagcaccagaaggatgtgttcctgagcgccatcagcagtggagctgacagccccaacagcaagaatggaaacatgcccatgagcggcaacacaggagagaacttcaggaagaacctgacagatgtgatcaagaagtccatggtggaccacaccagcgccttcagcacagaggagctgcccccacctgtgcacctgagcaagccaggagagcacatggatgtgtatgtgcctgtggcctgccaccctggctactttgtgatccagccctggcaggagatccacaagctggaggtgctgatggaggagatgatcctgtactacagcgtgtctgaggagcggcacatcgctgtggagaaggaccaggtgtatgctgccaaggtggagaacaagtggcaccgggtgctgctgaagggcatcctgaccaacggcctggtgtctgtgtatgagctggactatggcaagcatgagctggtgaacatcaggaaggtgcagcccctggtggacatgttcaggaagctgcccttccaggccgtgacagcccagctggccggcgtgaagtgcaaccagtggagcgaggaggcctccatggtgttcagaaatcatgtggagaagaagcccctggtggccctggtgcagacagtgattgaaaatgccaacccctgggacaggaaggtggtggtgtacctggtggacaccagcctgcctgacacagacacctggattcatgacttcatgtctgagtacctgattgagctgagcaaggtgaactag

SEQ ID NO: 174813 - DNA, 2514 bp, Artificial Sequence
  Description of Artificial Sequence: Synthetic coding sequence
atgagcctgagccacctgtacagagatggagagggcagaattgatgatgatgatgatgagcgggagaactttgagatcacagactgggacctgcagaatgagttcaaccccaaccggcagaggcactggcagaccaaggaggaggccacctatggagtgtgggccgagcgggacagtgatgatgagcggcccagctttggaggcaagagggcccgggactacagcgcccctgtgaacttcatctctgctggcctgaagaagggagctgctgaggaggccgagctggaggacagtgatgatgaggagaagcctgtgaagcaggatgacttccccaaggactttggccccaggaagctgaagacaggaggcaacttcaagcccagccagaagggctttgctgggggcaccaagagcttcatggactttggctcctgggagcggcacaccaagggcatcggccagaagctgctgcagaagatgggctacgtgcccggccggggcctgggcaagaatgcccagggcatcatcaaccccatcgaggccaagcagaggaaaggaaaaggagctgtgggcgcctacggcagcgagaggaccacccagagcatgcaggacttccctgtggtggacagcgaggaggaggccgaggaggagttccagaaggagctgagccagtggaggaaggaccccagcggcagcaagaagaagcccaagtacagctacaagacagtggaggagctgaaggccaagggccgcatcagcaagaagctgacagccccccagaaggagctgagccaggtgaaggtgattgacatgacaggccgggagcagaaggtgtactacagctacagccagatcagccacaagcacaacgtgcctgatgatggcctgcccctgcagagccagcagctgccccagagcggcaaggaggccaaggcccctggctttgccctgcctgagctggagcacaacctgcagctgctgattgacctgacagagcaggagatcatccagaatgaccggcagctgcagtatgaaagagacatggtggtgaacctcttccacgagctggagaagatgacagaggtgctggaccacgaggagagggtcatcagcaacctgagcaaggtgctggagatggtggaggagtgtgaaagaaggatgcagcctgactgcagcaaccccctgaccctggatgaatgtgcccgcatctttgagaccctgcaggacaagtactatgaggagtacaggatgtctgacagagtggacctggccgtggccatcgtgtaccccctgatgaaggagtacttcaaggagtgggaccccctgaaggactgcacctatggaacagagatcatcagcaagtggaagagcctgctggagaatgaccagctgctgagccatggaggccaggacctgtctgcagatgccttccacaggctcatctgggaggtgtggatgccctttgtgaggaacatcgtgacccagtggcagcccaggaactgtgaccccatggtggacttcctggacagctgggtgcacatcatccctgtgtggatcctggacaacatcctggaccagctgatcttccccaagctgcagaaggaggtggagaactggaaccccctgacagacacagtgcccatccacagctggatccacccctggctgcccctgatgcaggcccggctggagcccctgtacagccccatccgcagcaagctgagcagcgccctgcagaagtggcaccccagcgacagcagcgccaagctgatcctgcagccctggaaggatgtgttcaccccaggctcctgggaggccttcatggtgaagaacatcgtgcccaagctgggcatgtgcctgggggagctggtgatcaacccccaccagcagcacatggatgccttctactgggtgattgactgggagggcatgatctctgtgagcagcctggtgggcctgctggagaagcacttcttccccaagtggctgcaggtgctgtgctcctggctgagcaacagccccaactatgaggagatcaccaagtggtacctgggctggaagtccatgttcagtgaccaggtgctggcccaccccagcgtgaaggacaagttcaatgaggccctggacatcatgaacagagctgtgagcagcaatgtgggcgcctacatgcagcccggggccagagaaaatattgcctacctgacccacacagaaagaaggaaggacttccagtatgaggccatgcaggagcggcgggaggccgagaacatggcccagaggggcatcggcgtggccgccagctctgtgcccatgaacttcaaggacctgattgagaccaaggccgaggagcacaacatcgtgttcatgcctgtgattggcaagagacatgagggcaagcagctgtacaccttcggcagaattgtcatctacatcgaccggggcgtggtgtttgtgcagggcgagaagacctgggtgcccaccagcctgcagagcctgattgacatggccaagtag

SEQ ID NO: 174814 - DNA, 2514 bp, Artificial Sequence; identical to SEQ ID NO: 174813
  Description of Artificial Sequence: Synthetic coding sequence

SEQ ID NO: 174815 - DNA, 2514 bp, Artificial Sequence; identical to SEQ ID NO: 174813
  Description of Artificial Sequence: Synthetic coding sequence

SEQ ID NO: 174816 - DNA, 2514 bp, Artificial Sequence; identical to SEQ ID NO: 174813
  Description of Artificial Sequence: Synthetic coding sequence

SEQ ID NO: 174817 - DNA, 267 bp, Artificial Sequence
  Description of Artificial Sequence: Synthetic coding sequence
atgagcctgagccacctgtacagagatggagagggcagaattgatgatgatgatgatgagcgggagaactttgagatcacagactgggacctgcagaatgagttcaaccccaaccggcagaggcactggcagaccaaggaggaggccacctatggagtgtgggccgagcgggacagtgatgatgagcggcccagctttggaggcaagagggcccgggactacagcgcccctgtgaacttcatctctgctggcctgaagaagggctag

SEQ ID NO: 174818 - DNA, 261 bp, Artificial Sequence
  Description of Artificial Sequence: Synthetic coding sequence
atgagcctgagccacctgtacagagatggagagggcagaattgatgatgatgatgatgagcgggagaactttgagatcacagactgggacctgcagaatgagttcaaccccaaccggcagaggcactggcagaccaaggaggaggccacctatggagtgtgggccgagcgggacagtgatgatgagcggcccagctttggaggcaagagggcccgggactacagcgcccctgtgaacttcatctctgctggcctgaagtag

SEQ ID NO: 174819 - DNA, 129 bp, Artificial Sequence
  Description of Artificial Sequence: Synthetic coding sequence
atgagcctgagccacctgtacagagatggagagggcagaattgatgatgatgatgatgagcgggagaactttgagatcacagactgggacctgcagaatgagttcaaccccaaccggcagaggcactag

SEQ ID NO: 174820 - DNA, 1569 bp, Artificial Sequence
  Description of Artificial Sequence: Synthetic coding sequence
atgagcctgagccacctgtacagagatggagagggcagaattgatgatgatgatgatgagcgggagaactttgagatcacagactgggacctgcagaatgagttcaacctcttccacgagctggagaagatgacagaggtgctggaccacgaggagagggtcatcagcaacctgagcaaggtgctggagatggtggaggagtgtgagaggaggatgcagcctgactgcagcaaccccctgaccctggatgaatgtgcccgcatctttgagaccctgcaggacaagtactatgaggagtacaggatgtctgacagagtggacctggccgtggccatcgtgtaccccctgatgaaggagtacttcaaggagtgggaccccctgaaggactgcacctacggcacagagatcatcagcaagtggaagagcctgctggagaatgaccagctgctgagccacggcggccaggacctgtctgcagatgccttccacaggctcatctgggaggtgtggatgccctttgtgagaaatattgtgacccagtggcagcccaggaactgtgaccccatggtggacttcctggacagctgggtgcacatcatccctgtgtggatcctggacaacatcctggaccagctgatcttccccaagctgcagaaggaggtggagaactggaaccccctgacagacacagtgcccatccacagctggatccacccctggctgcccctgatgcaggcccggctggagcccctgtacagccccatccgcagcaagctgagcagcgccctgcagaagtggcaccccagcgacagcagcgccaagctgatcctgcagccctggaaggatgtgttcaccccaggctcctgggaggccttcatggtgaagaacatcgtgcccaagctgggcatgtgcctgggggagctggtgatcaacccccaccagcagcacatggatgccttctactgggtgattgactgggagggcatgatctctgtgagcagcctggtgggcctgctggagaagcacttcttccccaagtggctgcaggtgctgtgctcctggctgagcaacagccccaactatgaggagatcaccaagtggtacctgggctggaagtccatgttcagtgaccaggtgctggcccaccccagcgtgaaggacaagttcaatgaggccctggacatcatgaacagagctgtgagcagcaatgtgggcgcctacatgcagcccggggcccgggagaacatcgcctacctgacccacacagagaggaggaaggacttccagtatgaggccatgcaggagcggcgggaggccgagaacatggcccagaggggcattggagtggccgccagctctgtgcccatgaacttcaaggacctgattgagaccaaggccgaggagcacaacatcgtgttcatgcctgtgattggcaagagacatgagggcaagcagctgtacaccttcggccgcatcgtcatctacatcgacagaggagtggtgtttgtgcagggcgagaagacctgggtgcccaccagcctgcagagcctgattgacatggccaagtag

SEQ ID NO: 174821 - DNA, 576 bp, Artificial Sequence
  Description of Artificial Sequence: Synthetic coding sequence
tgaggaagaggcctgggcaagaatgcccagggcatcatcaaccccatcgaggccaagcagaggaagggcaaaggagctgtgggcgcctacggcagcgagaggaccacccagagcatgcaggacttccctgtggtggacagcgaggaggaggccgaggagtggctgttcctggccgccagtgactgcatcctgctggtgcaggagttccagaaggagctgagccagtggaggaaggaccccagcggcagcaagaagaagcccaagtacagctacaagacagtggaggagctgaaggccaagggccgcatcagcaagaagctgacagccccccagaaggagctgagccaggtgaaggtgattgacatgacaggccgggagcagaaggtgtactacagctacagccagatcagccacaagcacaacgtgcctgatgatggcctgcccctgcagagccagcagctgccccagagcggcaaggaggccaaggcccctggctttgccctgcctgagctggagcacaacctgcagctgctgattgacctgacagagcaggagatcatccagaatgacagatag

SEQ ID NO: 174822 - DNA, 366 bp, Artificial Sequence
  Description of Artificial Sequence: Synthetic coding sequence
atgagcctgagccacctgtacagagatggagagggcagaattgatgatgatgatgatgagcgggagaactttgagatcacagactgggacctgcagaatgagttcaaccccaaccggcagaggcactggcagaccaaggaggaggccacctatggagtgtgggccgagcgggacagtgatgatgagcggcccagctttggaggcaagagggcccgggactacagcgcccctgtgaacttcatctctgctggcctgaagaagggagctgctgaggaggccgagctggaggacagtgatgatgaggagaagcctgtgaagcaggatgacttccccaaggactttggccccaggaagctgaagacctag

SEQ ID NO: 174823 - DNA, 723 bp, Artificial Sequence
  Description of Artificial Sequence: Synthetic coding sequence
atggaggagagcgtggtgcggcccagcgtgtttgtggtggatggccagacagacatccccttcacccggctgggccgcagccaccggcggcagagctgcagcgtggcccgggtgggcctgggcctgctgctgctgctgatgggcgccggcctggccgtgcagggctggttcctgctgcagctgcactggaggctgggggagatggtgacccggctgcctgatggccctgctggctcctgggagcagctgatccaggagaggaggagccatgaggtgaacccagctgcccacctgactggagccaacagcagcctgaccggcagcggcggccccctgctgtgggagacccagctgggcctggccttcctgcggggcctgagctaccatgatggagccctggtggtgaccaaggccggctactactacatctacagcaaggtgcagctgggcggcgtgggctgccccctgggcctggccagcaccatcacccacggcctgtacaagaggaccccccgctacccagaggagctggagctgctggtgtcccagcagagcccctgtggccgggccaccagcagcagccgggtgtggtgggacagcagcttcctgggcggcgtggtgcacctggaggccggggagaaggtggtggtgcgggtgctggatgagcggctggtgcggctgagagatggcaccaggagctactttggagccttcatggtgtag

SEQ ID NO: 174824 - DNA, 954 bp, Artificial Sequence
  Description of Artificial Sequence: Synthetic coding sequence
atgaggcgggccagccgggactacaccaagtacctgcggggcagcgaggagatgggcggcggccctggggcccctcatgagggccccctgcacgcccctcctcctccagccccccaccagcccccagctgccagccgctccatgtttgtggccctgctgggcctgggcctgggccaggtggtgtgcagcgtggccctcttcttctacttccgggcccagatggaccccaaccgcatcagtgaagatggcacccactgcatctaccgcatcctgcggctgcatgaaaatgctgacttccaggacaccaccctggagagccaggacaccaagctgatcccagacagctgccgccgcatcaagcaggccttccagggcgctgtgcagaaggagctgcagcacatcgtgggcagccagcacatccgggcagagaaggccatggtggatggctcctggctggacctggccaagaggagcaagctggaggcccagccctttgcccacctgaccatcaatgccacagacatccccagcggcagccacaaggtgtccctgagctcctggtaccatgaccggggctgggccaagatcagcaacatgaccttcagcaatggcaagctgattgtgaaccaggacggcttctactacctgtatgccaacatctgcttccgccaccacgagaccagcggggacctggccacagagtacctgcagctgatggtgtatgtgaccaagaccagcatcaagatccccagcagccacaccctgatgaagggcggcagcaccaagtactggagcggcaacagcgagttccacttctacagcatcaacgtgggcggcttcttcaagctgcggtctggagaggagatcagcattgaggtgagcaaccccagcctgctggaccctgaccaggatgccacctactttggagccttcaaggtgcgggacatcgactag

SEQ ID NO: 174825 - DNA, 735 bp, Artificial Sequence
  Description of Artificial Sequence: Synthetic coding sequence
atggaccccaaccgcatcagtgaagatggcacccactgcatctaccgcatcctgcggctgcatgaaaatgctgacttccaggacaccaccctggagagccaggacaccaagctgatcccagacagctgccgccgcatcaagcaggccttccagggcgctgtgcagaaggagctgcagcacatcgtgggcagccagcacatccgggcagagaaggccatggtggatggctcctggctggacctggccaagaggagcaagctggaggcccagccctttgcccacctgaccatcaatgccacagacatccccagcggcagccacaaggtgtccctgagctcctggtaccatgaccggggctgggccaagatcagcaacatgaccttcagcaatggcaagctgattgtgaaccaggacggcttctactacctgtatgccaacatctgcttccgccaccacgagaccagcggggacctggccacagagtacctgcagctgatggtgtatgtgaccaagaccagcatcaagatccccagcagccacaccctgatgaagggcggcagcaccaagtactggagcggcaacagcgagttccacttctacagcatcaacgtgggcggcttcttcaagctgcggagcggggaggagatcagcattgaggtgagcaaccccagcctgctggaccctgaccaggatgccacctactttggagccttcaaggtgcgggacattgattag

SEQ ID NO: 174826 - DNA, 735 bp, Artificial Sequence; identical to SEQ ID NO: 174825
  Description of Artificial Sequence: Synthetic coding sequence

SEQ ID NO: 174827 - DNA, 735 bp, Artificial Sequence; identical to SEQ ID NO: 174825
  Description of Artificial Sequence: Synthetic coding sequence

SEQ ID NO: 174828 - DNA, 735 bp, Artificial Sequence; identical to SEQ ID NO: 174825
  Description of Artificial Sequence: Synthetic coding sequence

SEQ ID NO: 174829 - DNA, 750 bp, Artificial Sequence
  Description of Artificial Sequence: Synthetic coding sequence
atggccgcccggcgcagccagaggagaagaggccggcggggggagcccggcacagccctgctggtgcccctggccctgggcctgggcctggccctggcctgcctgggcctgctgctggccgtggtgtccctgggcagccgggccagcctgagcgcccaggagcccgcccaggaggagctggtggccgaggaggaccaggaccccagcgagctgaacccccagacagaggagagccaggaccctgcccccttcctgaaccggctggtgcggccccggcgcagcgcccccaagggcaggaagacccgggcccggcgggccatcgccgcccactatgaggtgcaccccaggcctggccaggatggagcccaggccggcgtggatggcaccgtgtctggctgggaggaggcccgcatcaacagcagcagccccctgcgctacaaccggcagatcggggagttcatcgtgacccgggccggcctgtactacctgtactgccaggtgcactttgatgagggcaaggctgtgtacctgaagctggacctgctggtggatggagtgctggccctgcgctgcctggaggagttcagcgccacagctgccagcagcctgggcccccagctgcggctgtgccaggtgtctggcctgctggccctgcggcccggcagcagcctgcgcatccgcaccctgccctgggcccacctgaaggccgcccccttcctgacctacttcggcctcttccaggtgcactag

SEQ ID NO: 174830 - DNA, 993 bp, Artificial Sequence
  Description of Artificial Sequence: Synthetic coding sequence
atggccgcccggcgcagccagaggagaagaggccggcggggggagcccggcacagccctgctggtgcccctggccctgggcctgggcctggccctggcctgcctgggcctgctgctggccgtggtgtccctgggcagccgggccagcctgagcgcccaggagcccgcccaggaggagctggtggccgaggaggaccaggaccccagcgagctgaacccccagacagaggagagccaggaccctgcccccttcctgaaccggctggtgcggccccggcgcagcgcccccaagggcaggaagacccgggcccggcgggccatcgccgcccactatgaggtgcaccccaggcctggccaggatggagcccaggccggcgtggatggcaccgtgtctggctgggaggaggcccgcatcaacagcagcagccccctgcgctacaaccggcagatcggggagttcatcgtgacccgggccggcctgtactacctgtactgccagagcagtgatgccctggaggcctgggagaatggagagaggagcaggaagagaagagctgtgctgacccagaagcagaagaagcagcacagcgtgctgcacctggtgcccatcaatgccaccagcaaggatgacagtgatgtgacagaggtgatgtggcagcctgccctgcggcggggccggggcctgcaggcccagggctatggagtgcgcatccaggatgctggggtgtacctgctgtacagccaggtgctcttccaggatgtgaccttcaccatgggccaggtggtgtcccgggagggccagggccggcaggagaccctcttccgctgcatccgctccatgcccagccacccagaccgggcctacaacagctgctacagcgctggggtcttccacctgcaccagggcgacatcctgagcgtcatcatcccccgggcccgggccaagctgaacctgagcccccacggcaccttcctgggctttgtgaagctgtag

SEQ ID NO: 174831 - DNA, 723 bp, Artificial Sequence; identical to SEQ ID NO: 174823
  Description of Artificial Sequence: Synthetic coding sequence

SEQ ID NO: 174832 - DNA, 615 bp, Artificial Sequence
  Description of Artificial Sequence: Synthetic coding sequence
atggaggagagcgtggtgcggcccagcgtgtttgtggtggatggccagacagacatccccttcacccggctgggccgcagccaccggcggcagagctgcagcgtggccagagatggccctgctggctcctgggagcagctgatccaggagaggaggagccatgaggtgaacccagctgcccacctgactggagccaacagcagcctgaccggcagcggcggccccctgctgtgggagacccagctgggcctggccttcctgcggggcctgagctaccatgatggagccctggtggtgaccaaggccggctactactacatctacagcaaggtgcagctgggcggcgtgggctgccccctgggcctggccagcaccatcacccacggcctgtacaagaggaccccccgctacccagaggagctggagctgctggtgtcccagcagagcccctgtggccgggccaccagcagcagccgggtgtggtgggacagcagcttcctgggcggcgtggtgcacctggaggccggggagaaggtggtggtgcgggtgctggatgagcggctggtgcggctgagagatggcaccaggagctactttggagccttcatggtgtag

SEQ ID NO: 174833 - DNA, 525 bp, Artificial Sequence
  Description of Artificial Sequence: Synthetic coding sequence
atgaggcacttcctgagcaaggtgtacagcttccccatgaggaagctgatcctcttcctggtgtttcctgtggtgcggcagacccccacccagcacttcaagaaccagtttcctgccctgcactgggagcacgagctgggcctggccttcaccaagaacaggatgaactacaccaacaagttcctgctgatccctgagagcggggactacttcatctacagccaggtgaccttccggggcatgaccagcgagtgcagcgagatccggcaggccggccggcccaacaagccagacagcatcaccgtggtgatcaccaaggtgacagacagctacccagagcccacccagctgctgatgggcaccaagtctgtgtgtgaggtgggcagcaactggttccagcccatctacctgggcgccatgttcagcctgcaggagggggacaagctgatggtgaatgtgtctgacatcagcctggtggactacaccaaggaggacaagaccttctttggagccttcctgctgtag

SEQ ID NO: 174834 - DNA, 756 bp, Artificial Sequence
  Description of Artificial Sequence: Synthetic coding sequence
atggccgaggacctgggcctgagctttggagaaacagcctctgtggagatgctgcctgagcacggcagctgccggcccaaggcccggagcagcagcgcccgctgggccctgacctgctgcctggtgctgctgcccttcctggccggcctgaccacctacctgctggtgtcccagctgcgggcccagggcgaggcctgtgtgcagttccaggccctgaagggccaggagtttgcccccagccaccagcaggtgtatgcccccctgcgggcagatggagacaagccccgggcccacctgactgtggtgcggcagacccccacccagcacttcaagaaccagtttcctgccctgcactgggagcacgagctgggcctggccttcaccaagaacaggatgaactacaccaacaagttcctgctgatccctgagagcggggactacttcatctacagccaggtgaccttccggggcatgaccagtgaatgttctgagatccggcaggccggccggcccaacaagccagacagcatcaccgtggtgatcaccaaggtgacagacagctacccagagcccacccagctgctgatgggcaccaagtctgtgtgtgaggtgggcagcaactggttccagcccatctacctgggcgccatgttcagcctgcaggagggggacaagctgatggtgaatgtgtctgacatcagcctggtggactacaccaaggaggacaagaccttcttcggggccttcctgctgtag

SEQ ID NO: 174835 - DNA, 534 bp, Artificial Sequence
  Description of Artificial Sequence: Synthetic coding sequence
atgtgcctgagccacctggagaacatgcccctgagccacagcaggacccagggcgcccagaggagctcctggaagctgtggctgttctgcagcatcgtgatgctgctcttcctgtgcagcttctcctggctgatcttcatcttcctgcagctggagacagccaaggagccctgcatggccaagtttggccccctgcccagcaagtggcagatggccagcagcgagcccccctgtgtgaacaaggtgtctgactggaagctggagatcctgcagaatggcctgtacctgatctacggccaggtggccccaaatgccaactacaatgatgtggccccctttgaggtgcggctgtacaagaacaaggacatgatccagaccctgaccaacaagagcaagatccagaatgtgggcggcacctatgagctgcacgtgggggacaccatcgacctgatcttcaacagcgagcaccaggtgctgaagaacaacacctactggggcatcatcctgctggccaacccccagttcatctcctag

SEQ ID NO: 174836 - DNA, 600 bp, Artificial Sequence
  Description of Artificial Sequence: Synthetic coding sequence
atgaccctgcaccccagccccatcacctgtgagttcctgttcagcacagccctgatcagccccaagatgtgcctgagccacctggagaacatgcccctgagccacagcaggacccagggcgcccagaggagctcctggaagctgtggctgttctgcagcatcgtgatgctgctcttcctgtgcagcttctcctggctgatcttcatcttcctgcagctggagacagccaaggagccctgcatggccaagtttggccccctgcccagcaagtggcagatggccagcagcgagcccccctgtgtgaacaaggtgtctgactggaagctggagatcctgcagaatggcctgtacctgatctacggccaggtggccccaaatgccaactacaatgatgtggccccctttgaggtgcggctgtacaagaacaaggacatgatccagaccctgaccaacaagagcaagatccagaatgtgggcggcacctatgagctgcacgtgggggacaccatcgacctgatcttcaacagcgagcaccaggtgctgaagaacaacacctactggggcatcatcctgctggccaacccccagttcatctcctag

SEQ ID NO: 174837 - DNA, 552 bp, Artificial Sequence
  Description of Artificial Sequence: Synthetic coding sequence
atggagcgggtgcagcccctggaggagaatgtgggcaatgctgcccggcccaggtttgaaagaaacaagctgctgctggtggccagcgtcatccagggcctgggcctgctgctgtgcttcacctacatctgcctgcacttcagcgccctgcaggtgagccaccgctacccccgcatccagagcatcaaggtgcagttcacagagtacaagaaggagaagggcttcatcctgaccagccagaaggaggatgagatcatgaaggtgcagaacaacagcgtcatcatcaactgtgatggcttctacctgatcagcctgaagggctacttcagccaggaggtgaacatcagcctgcactaccagaaggatgaggagcccctcttccagctgaagaaggtgcgctctgtgaacagcctgatggtggccagcctgacctacaaggacaaggtgtacctgaatgtgaccacagacaacaccagcctggatgacttccacgtgaatggaggagagctgatcctgatccaccagaaccctggagagttctgtgtgctgtag

SEQ ID NO: 174838 - DNA, 402 bp, Artificial Sequence
  Description of Artificial Sequence: Synthetic coding sequence
atggtgagccaccgctacccccgcatccagagcatcaaggtgcagttcacagagtacaagaaggagaagggcttcatcctgaccagccagaaggaggatgagatcatgaaggtgcagaacaacagcgtcatcatcaactgtgatggcttctacctgatcagcctgaagggctacttcagccaggaggtgaacatcagcctgcactaccagaaggatgaggagcccctcttccagctgaagaaggtgcgctctgtgaacagcctgatggtggccagcctgacctacaaggacaaggtgtacctgaatgtgaccacagacaacaccagcctggatgacttccacgtgaatggaggagagctgatcctgatccaccagaaccctggagagttctgtgtgctgtag

SEQ ID NO: 174839 - DNA, 402 bp, Artificial Sequence; identical to SEQ ID NO: 174838
  Description of Artificial Sequence: Synthetic coding sequence

SEQ ID NO: 174840 - DNA, 765 bp, Artificial Sequence
  Description of Artificial Sequence: Synthetic coding sequence
atggagtatgccagtgatgccagcctggaccctgaggccccctggcccccagccccccgggcccgggcctgccgggtgctgccctgggccctggtggccggcctgctgctgctgctgctgctggccgccgcctgtgctgtgttcctggcctgcccctgggccgtgtctggggcccgggccagccctggcagcgctgccagcccccggctgcgggagggccctgagctgagcccagatgatcctgctggcctgctggacctgcggcagggcatgtttgcccagctggtggcccagaatgtgctgctgattgatggccccctgtcctggtacagcgaccccggcctggccggcgtgtccctgactggaggcctgagctacaaggaggacaccaaggagctggtggtggccaaggccggcgtgtactacgtgttcttccagctggagctgcggcgggtggtggccggggagggcagcggctctgtgtccctggccctgcacctgcagcccctgcggtctgctgctggagctgctgccctggccctgactgtggacctgcccccagccagcagcgaggccagaaattctgccttcggcttccagggccgcctgctgcacctgtctgctggccagaggctgggcgtgcacctgcacacagaggcccgggcccggcatgcctggcagctgacccagggcgccaccgtgctgggcctcttccgggtgaccccagagatcccagctggcctgcccagccccaggtctgagtag

SEQ ID NO: 174841 - DNA, 1851 bp, Artificial Sequence
  Description of Artificial Sequence: Synthetic coding sequence
atggccccccgggccaggagaagaagacccctgtttgccctgctgctgctgtgtgccctgctggcccggctgcaggtggccctgcagatcgccccaccctgcaccagcgagaagcactatgagcacctgggccgctgctgcaacaagtgtgagcccgggaagtacatgagcagcaagtgcaccaccaccagtgacagcgtgtgcctgccctgtggcccagatgagtacctggacagctggaatgaggaggacaagtgcctgctgcacaaggtgtgtgacaccgggaaggccctggtggccgtggtggccggcaacagcaccaccccccggcgctgtgcctgcacagctggctaccactggagccaggactgtgagtgctgcagaagaaacacagaatgtgcccctggcctgggcgcccagcaccccctgcagctgaacaaggacacagtgtgcaagccctgcctggccggctacttcagtgatgccttcagcagcacagacaagtgccggccctggaccaactgcaccttcctgggcaagagggtggagcaccacggcacagagaagagtgatgctgtgtgcagcagcagcctgcctgccaggaagcccccaaatgagccccacgtgtacctgcccggcctcatcatcctgctgctgtttgcctctgtggccctggtggccgccatcatctttggagtgtgctacaggaagaagggcaaggccctgacagccaacctgtggcactggatcaatgaggcctgtggccgcctgagcggggacaaggagagcagcggggacagctgtgtgtccacccacacagccaactttggccagcagggcgcctgtgagggcgtgctgctgctgaccctggaggagaagaccttccctgaggacatgtgctacccagaccagggcggcgtgtgccagggcacctgtgtgggcggcggcccctatgcccagggagaagatgccaggatgctgagcctggtgtccaagacagaaattgaagaagattccttccggcagatgcccacagaagatgagtacatggaccggcccagccagcccacagaccagctgctcttcctgacagagcccggcagcaagagcaccccacccttcagcgagcccctggaggtgggggagaatgacagcctgagccagtgcttcaccggcacccagagcacagtgggcagcgagagctgcaactgcacagagcccctgtgcaggacagactggacccccatgagcagcgagaactacctgcagaaggaggtggacagcggccactgcccccactgggccgccagccccagccccaactgggcagatgtgtgcaccggctgcaggaaccccccaggagaggactgtgagcccctggtgggcagccccaagaggggccccctgccccagtgtgcctacggcatgggcctgcccccagaggaggaggccagcaggacagaggcccgggaccagccagaagatggagcagatggccgcctgcccagcagcgcccgggccggggccggcagcggcagcagccctgggggccagagccctgccagcggaaatgtgacaggcaacagcaacagcaccttcatcagcagcggccaggtgatgaacttcaagggggacatcatcgtggtgtatgtgtcccagaccagccaggagggcgctgctgctgctgctgagcccatgggccggcctgtgcaggaggagaccctggcccggcgggacagctttgctggaaatggcccccgcttcccagacccctgtggcggccctgagggcctgcgggagcctgagaaggccagcaggcctgtgcaggagcagggcggggccaaggcctag

SEQ ID NO: 174842 - DNA, 780 bp, Artificial Sequence
  Description of Artificial Sequence: Synthetic coding sequence
atggcccgcatccccaagaccctgaagtttgtggtggtgattgtggccgtgctgctgcctgtgctggcctacagcgccaccacagcccggcaggaggaggtgccccagcagacagtggccccccagcagcagaggcacagcttcaagggggaggagtgcccagctggcagccacaggtctgagcacactggagcctgcaacccctgcacagagggcgtggactacaccaatgccagcaacaatgagcccagctgcttcccctgcaccgtgtgcaagagtgaccagaagcacaagagcagctgcaccatgacccgggacacagtgtgccagtgcaaggagggcaccttcagaaatgaaaacagccctgagatgtgcaggaagtgcagccgctgccccagcggggaggtgcaggtgagcaactgcacctcctgggatgacatccagtgtgtggaggagtttggagccaatgccaccgtggagaccccagctgctgaggagaccatgaacaccagccctggcaccccagccccagctgctgaggagaccatgaacaccagccctggcaccccagccccagctgctgaggagaccatgaccaccagccctggcaccccagccccagctgctgaggagaccatgaccaccagccctggcaccccagccccagctgctgaggagaccatgatcaccagccctggcaccccagccagcagccactacctgagctgcaccatcgtgggcatcatcgtgctgattgtgctgctgattgtgtttgtgtag

SEQ ID NO: 174843 - DNA, 474 bp, Artificial Sequence
  Description of Artificial Sequence: Synthetic coding sequence
atgacccgggacacagtgtgccagtgcaaggagggcaccttcagaaatgaaaacagccctgagatgtgcaggaagtgcagccgctgccccagcggggaggtgcaggtgagcaactgcacctcctgggatgacatccagtgtgtggaggagtttggagccaatgccaccgtggagaccccagctgctgaggagaccatgaacaccagccctggcaccccagccccagctgctgaggagaccatgaacaccagccctggcaccccagccccagctgctgaggagaccatgaccaccagccctggcaccccagccccagctgctgaggagaccatgaccaccagccctggcaccccagccccagctgctgaggagaccatgatcaccagccctggcaccccagccagcagccactacctgagctgcaccatcgtgggcatcatcgtgctgattgtgctgctgattgtgtttgtgtag

SEQ ID NO: 174844 - DNA, 834 bp, Artificial Sequence
  Description of Artificial Sequence: Synthetic coding sequence
atggcccgcatccccaagaccctgaagtttgtggtggtgattgtggccgtgctgctgcctgtgctggcctacagcgccaccacagcccggcaggaggaggtgccccagcagacagtggccccccagcagcagaggcacagcttcaagggggaggagtgcccagctggcagccacaggtctgagcacactggagcctgcaacccctgcacagagggcgtggactacaccaatgccagcaacaatgagcccagctgcttcccctgcaccgtgtgcaagagtgaccagaagcacaagagcagctgcaccatgacccgggacacagtgtgccagtgcaaggagggcaccttcagaaatgaaaacagccctgagatgtgcaggaagtgcagccgctgccccagcggggaggtgcaggtgagcaactgcacctcctgggatgacatccagtgtgtggaggagtttggagccaatgccaccgtggagaccccagctgctgaggagaccatgaacaccagccctggcaccccagccccagctgctgaggagaccatgaacaccagccctggcaccccagccccagctgctgaggagaccatgaccaccagccctggcaccccagccccagctgctgaggagaccatgaccaccagccctggcaccccagccccagctgctgaggagaccatgatcaccagccctggcaccccagccagcagccactacctgagctgcaccatcgtgggcatcatcgtgctgattgtgctgctgattgtgccctacctgaagaagaagaagaagaagaagctgaagaagaagcagaagaggaagagcaagtag

SEQ ID NO: 174845 - DNA, 1851 bp, Artificial Sequence; identical to SEQ ID NO: 174841
  Description of Artificial Sequence: Synthetic coding sequence

SEQ ID NO: 174846 - DNA, 966 bp, Artificial Sequence
  Description of Artificial Sequence: Synthetic coding sequence
ggcagccgggcccgctgggccacagaggccgctgaggccgccgccccagccagcctgagccgggccatggccccccgggccaggagaagaagacccctgtttgccctgctgctgctgtgtgccctgctggcccggctgcaggtggccctgcagatcgccccaccctgcaccagcgagaagcactatgagcacctgggccgctgctgcaacaagtgtgagcccgggaagtacatgagcagcaagtgcaccaccaccagtgacagcgtgtgcctgccctgtggcccagatgagtacctggacagctggaatgaggaggacaagtgcctgctgcacaaggtgtgtgacaccgggaaggccctggtggccgtggtggccggcaacagcaccaccccccggcgctgtgcctgcacagctggctaccactggagccaggactgtgagtgctgcagaagaaacacagaatgtgcccctggcctgggcgcccagcaccccctgcagctgaacaaggacacagtgtgcaagccctgcctggccggctacttcagtgatgccttcagcagcacagacaagtgccggccctggaccaactgcaccttcctgggcaagagggtggagcaccacggcacagagaagagtgatgctgtgtgcagcagcagcctgcctgccaggaagcccccaaatggaaatgtgactggaaacagcaacagcaccttcatcagcagcggccaggtgatgaacttcaagggggacatcatcgtggtgtatgtgtcccagaccagccaggagggcgctgctgctgctgctgagcccatgggccggcctgtgcaggaggagaccctggcccggcgggacagctttgctggaaatggcccccgcttcccagacccctgtggcggccctgagggcctgcgggagcctgagaaggccagcaggcctgtgcaggagcagggcggggccaaggcctag

SEQ ID NO: 174847 - DNA, 1206 bp, Artificial Sequence
  Description of Artificial Sequence: Synthetic coding sequence
atgaacaacctgctgtgctgtgccctggtgttcctggacatcagcatcaagtggaccacccaggagaccttcccccccaagtacctgcactatgatgaggagaccagccaccagctgctgtgtgacaagtgccccccaggcacctacctgaagcagcactgcacagccaagtggaagacagtgtgtgccccctgcccagaccactactacacagacagctggcacaccagtgatgaatgtctgtactgcagccctgtgtgcaaggagctgcagtatgtgaagcaggagtgcaacagaacccacaacagagtgtgtgagtgcaaggagggccgctacctggagattgagttctgcctgaagcacaggagctgccccccaggcttcggcgtggtgcaggccggcaccccagagaggaacacagtgtgcaagcgctgcccagatggcttcttcagcaatgagaccagcagcaaggccccctgcaggaagcacaccaactgcagcgtgtttggcctgctgctgacccagaagggaaatgccacccatgacaacatctgcagcggcaacagcgagagcacccagaagtgtggcattgatgtgaccctgtgtgaggaggccttcttccgctttgctgtgcccaccaagttcacccccaactggctgtctgtgctggtggacaacctgcccggcaccaaggtgaatgctgagagcgtggagcgcatcaagaggcagcacagcagccaggagcagaccttccagctgctgaagctgtggaagcaccagaacaaggaccaggacatcgtgaagaagatcatccaggacatcgacctgtgtgagaacagcgtgcagaggcacatcggccacgccaacctgacctttgagcagctgcggagcctgatggagagcctgcccgggaagaaggtgggcgctgaggacatcgagaagaccatcaaggcctgcaagcccagcgaccagatcctgaagctgctgagcctgtggaggatcaagaatggagaccaggacaccctgaagggcctgatgcacgccctgaagcacagcaagacctaccacttccccaagacagtgacccagagcctgaagaagaccatccgcttcctgcacagcttcaccatgtacaagctgtaccagaagctgttcctggagatgattggcaaccaggtgcagagcgtgaagatcagctgcctgtag

SEQ ID NO: 174848 - DNA, 390 bp, Artificial Sequence
  Description of Artificial Sequence: Synthetic coding sequence
atggcccggggcagcctgcggcggctgctgcggctgctggtgctgggcctgtggctggccctgctgcggtctgtggccggggagcaggcccctggaacagccccctgcagccggggcagctcctggagcgctgacctggacaagtgcatggactgtgccagctgccgggcccggccccacagcgacttctgcctgggctgtgccgccgcccccccagcccccttccggctgctgtggcccatcctgggcggggccctgagcctgacctttgtgctgggcctgctgagcggcttcctggtgtggaggcgctgcagaagaagagagaagttcaccacccccatcgaggagactggaggagagggctgcccagctgtggccctgatccagtag

SEQ ID NO: 174849 - DNA, 285 bp, Artificial Sequence
  Description of Artificial Sequence: Synthetic coding sequence
atggcccggggcagcctgcggcggctgctgcggctgctggtgctgggcctgtggctggccctgctgcggtctgtggccggggagcaggcccctggagctgctgcccccccagcccccttccggctgctgtggcccatcctgggcggggccctgagcctgacctttgtgctgggcctgctgagcggcttcctggtgtggaggcgctgcagaagaagagagaagttcaccacccccatcgaggagaccggcggggagggctgcccagctgtggccctgatccagtag

SEQ ID NO: 174850 - DNA, 882 bp, Artificial Sequence
  Description of Artificial Sequence: Synthetic coding sequence
atgagcggcctgggccgcagccggcggggcggccgcagccgggtggaccaggaggagcgcttcccccagggcctgtggacaggagtggccatgaggagctgcccagaggagcagtactgggaccccctgctgggcacctgcatgagctgcaagaccatctgcaaccaccagagccagaggacctgtgccgccttctgccgcagcctgagctgcaggaaggagcagggcaagttctatgaccacctgctgcgggactgcatcagctgtgccagcatctgtggccagcaccccaagcagtgtgcctacttctgtgagaacaagctgcggagccctgtgaacctgcccccagagctgcggcggcagaggtctggagaggtggagaacaacagcgacaacagcggccgctaccagggcctggagcaccggggcagcgaggccagccctgccctgcccggcctgaagctgtctgctgaccaggtggccctggtgtacagcaccctgggcctgtgcctgtgtgctgtgctgtgctgcttcctggtggccgtggcctgcttcctgaagaagagaggagacccctgcagctgccagcccaggagccggccccggcagagccctgccaagagcagccaggaccacgccatggaggccggcagccctgtgtccaccagccctgagcctgtggagacctgcagcttctgcttccctgagtgccgggcccccacccaggagagcgctgtgaccccaggcaccccagaccccacctgtgccggccgctggggctgccacaccaggaccaccgtgctgcagccctgcccccacatcccagattctggcctgggcatcgtgtgtgtgcctgcccaggagggcggccctggggcctag

SEQ ID NO: 174851 - DNA, 747 bp, Artificial Sequence
  Description of Artificial Sequence: Synthetic coding sequence
atgagcggcctgggccgcagccggcggggcggccgcagccgggtggaccaggaggagcgctggagcctgagctgcaggaaggagcagggcaagttctatgaccacctgctgcgggactgcatcagctgtgccagcatctgtggccagcaccccaagcagtgtgcctacttctgtgagaacaagctgcggagccctgtgaacctgcccccagagctgcggcggcagaggtctggagaggtggagaacaacagcgacaacagcggccgctaccagggcctggagcaccggggcagcgaggccagccctgccctgcccggcctgaagctgtctgctgaccaggtggccctggtgtacagcaccctgggcctgtgcctgtgtgctgtgctgtgctgcttcctggtggccgtggcctgcttcctgaagaagagaggagacccctgcagctgccagcccaggagccggccccggcagagccctgccaagagcagccaggaccacgccatggaggccggcagccctgtgtccaccagccctgagcctgtggagacctgcagcttctgcttccctgagtgccgggcccccacccaggagagcgctgtgaccccaggcaccccagaccccacctgtgccggcaggaagaccaagcccccacctgtgctgacagctggcaactgtggggtgcaccggcccccacctgagaccagcacaggcagcccccggggccagaggctgctgtggacccagtag

SEQ ID NO: 174852 - DNA, 555 bp, Artificial Sequence
  Description of Artificial Sequence: Synthetic coding sequence
atgaggcggggccccaggagcctgcggggcagagatgccccagcccccaccccctgtgtgcctgcagaatgttttgacctgctggtgcgccactgtgtggcctgtggcctgctgcggaccccccggcccaagccagctggggccagcagccctgcccccaggacagccctgcagccccaggagagcgtgggcgctggggccggggaggccgccctgcccctgcccggcctgctgtttggagccccagccctgctgggcctggccctggtgctggccctggtgctggtgggcctggtgtcctggaggcggcggcagaggcggctgcggggggccagcagcgctgaggccccagatggagacaaggatgcccctgagcccctggacaaggtgatcatcctgagccctggcatcagtgatgccacagccccagcctggcccccacctggagaggaccccggcaccaccccacctggccacagcgtgcctgtgcctgccacagagctgggcagcacagagctggtgaccaccaagacagctggccctgagcagcagtag

SEQ ID NO: 174853 - DNA, 852 bp, Artificial Sequence
  Description of Artificial Sequence: Synthetic coding sequence
atggagcccccaggggactggggccccccaccctggaggagcacccccaagacagatgtgctgcggctggtgctgtacctgaccttcctgggcgccccctgctacgccccagccctgcccagctgcaaggaggatgagtaccctgtgggcagcgagtgctgccccaagtgcagccctggctacagagtgaaggaggcctgtggggagctgactggaacagtgtgtgagccctgccccccaggcacctacatcgcccacctgaatggcctgagcaagtgcctgcagtgccagatgtgtgaccctgccatgggcctgcgggccagcaggaactgcagcaggacagaaaatgctgtgtgtggctgcagccctggccacttctgcatcgtgcaggatggagaccactgtgccgcctgccgggcctatgccaccagcagccctggccagagggtgcagaagggcggcacagagagccaggacaccctgtgccagaactgccccccaggcaccttcagccccaacggcaccctggaggagtgccagcaccagaccaagtgctcctggctggtgaccaaggccggggccggcaccagcagcagccactgggtgtggtggttcctgagcggcagcctggtgattgtcatcgtgtgcagcacagtgggcctcatcatctgtgtgaagaggaggaagcccagaggagatgtggtgaaggtgattgtgtctgtgcagaggaagaggcaggaggccgagggggaggccaccgtgattgaggccctgcaggcccccccagatgtgaccaccgtggccgtggaggagaccatccccagcttcaccggccgcagccccaaccactag

SEQ ID NO: 174854 - DNA, 522 bp, Artificial Sequence
  Description of Artificial Sequence: Synthetic coding sequence
atggagcccccaggggactggggccccccaccctggaggagcacccccaagacagatgtgctgcggctggtgctgtacctgaccttcctgggcgccccctgctacgccccagccctgcccagctgcaaggaggatgagtaccctgtgggcagcgagtgctgccccaagtgcagccctggctacagagtgaaggaggcctgtggggagctgactggaacagtgtgtgagccctgccccccaggcacctacatcgcccacctgaatggcctgagcaagtgcctgcagtgccagatgtgtgaccctgacatcggcagcccctgtgacctgcggggccggggccacctggaggccggggcccacctgagccctggccggcagaagggggagccagaccctgaggtggcctttgagagcctgtctgctgagccccacgcccggctgtccatggccagcgccccctgtggccaggccggcctgcacctgcgggacagagcagatggcaccccaggcggccgggcctag

SEQ ID NO: 174855 - DNA, 552 bp, Artificial Sequence
  Description of Artificial Sequence: Synthetic coding sequence
atggagcccccaggggactggggccccccaccctggaggagcacccccaagacagatgtgctgcggctggtgctgtacctgaccttcctgggcgccccctgctacgccccagccctgcccagctgcaaggaggatgagtaccctgtgggcagcgagtgctgccccaagtgcagccctggctacagagtgaaggaggcctgtggggagctgactggaacagtgtgtgagccctgccccccaggcacctacatcgcccacctgaatggcctgagcaagtgcctgcagtgccagatgtgtgaccctgccatgggcctgcgggccagcaggaactgcagcaggacagaaaatgctgtgtgtggctgcagccctggccacttctgcatcgtgcaggatggagaccactgtgccgcctgccgggcctatgccaccagcagccctggccagagggtgcagaagggcggcacagagagccaggacaccctgtgccagaactgccccccaggcaccttcagccccaacggcaccctggaggagtgccagcaccagacctag

SEQ ID NO: 174856 - DNA, 696 bp, Artificial Sequence
  Description of Artificial Sequence: Synthetic coding sequence
atggagcccccaggggactggggccccccaccctggaggagcacccccaagacagatgtgctgcggctggtgctgtacctgaccttcctgggcgccccctgctacgccccagccctgcccagctgcaaggaggatgagtaccctgtgggcagcgagtgctgccccaagtgcagccctggctacagagtgaaggaggcctgtggggagctgactggaacagtgtgtgagccctgccccccaggcacctacatcgcccacctgaatggcctgagcaagtgcctgcagtgccagatgtgtgaccctgccatgggcctgcgggccagcaggaactgcagcaggacagaaaatgctgtgtgtggctgcagccctggccacttctgcatcgtgcaggatggagaccactgtgccgcctgccgggcctatgccaccagcagccctggccagagggtgcagaagggcggcacagagagccaggacaccctgtgccagaactgccccccaggcaccttcagccccaacggcaccctggaggagtgccagcaccagaccaagtgctcctggctggtgaccaaggccggggccggcaccagcagcagccactgggtgtggtggttcctgagcggcagcctggtgattgtcatcgtgtgcagcacagtgggcctcatcatctgtgtgaagaggaggaagcccaggtag

SEQ ID NO: 174857 - DNA, 696 bp, Artificial Sequence; identical to SEQ ID NO: 174856
  Description of Artificial Sequence: Synthetic coding sequence

SEQ ID NO: 174858 - DNA, 696 bp, Artificial Sequence; identical to SEQ ID NO: 174856
  Description of Artificial Sequence: Synthetic coding sequence

SEQ ID NO: 174859 - DNA, 555 bp, Artificial Sequence
  Description of Artificial Sequence: Synthetic coding sequence
atgctgcagatggccggccagtgcagccagaatgagtactttgacagcctgctgcacgcctgcatcccctgccagctgcgctgcagcagcaacaccccacccctgacctgccagcgctactgcaatgcctctgtgaccaacagcgtgaagggcaccaatgccatcctgtggacctgcctgggcctgagcctcatcatcagcctggccgtgtttgtgctgatgttcctgctgaggaagatcaacagcgagcccctgaaggatgagttcaagaacacaggcagcggcctgctgggcatggccaacatcgacctggagaagagcaggactggagatgagatcatcctgccccggggcctggagtacacagtggaggagtgcacctgtgaggactgcatcaagagcaagcccaaggtggacagcgaccactgcttccccctgcctgccatggaggagggcgccaccatcctggtgaccaccaagaccaatgactactgcaagagcctgcctgctgccctgagcgccacagaaattgagaagagcatcagcgccaggtag

SEQ ID NO: 174860 - DNA, 408 bp, Artificial Sequence
  Description of Artificial Sequence: Synthetic coding sequence
atgctgcagatggccggccagtgcagccagaatgagtactttgacagcctgctgcacgcctgcatcccctgccagctgcgctgcagcagcaacaccccacccctgacctgccagcgctactgcaatgcccggagcggcctgctgggcatggccaacatcgacctggagaagagcaggactggagatgagatcatcctgccccggggcctggagtacacagtggaggagtgcacctgtgaggactgcatcaagagcaagcccaaggtggacagcgaccactgcttccccctgcctgccatggaggagggcgccaccatcctggtgaccaccaagaccaatgactactgcaagagcctgcctgctgccctgagcgccacagaaattgagaagagcatcagcgccaggtag

SEQ ID NO: 174861 - DNA, 417 bp, Artificial Sequence
  Description of Artificial Sequence: Synthetic coding sequence
atggccggccagtgcagccagaatgagtactttgacagcctgctgcacgcctgcatcccctgccagctgcgctgcagcagcaacaccccacccctgacctgccagcgctactgcaatgcctctgtgaccaacagcgtgaagggcaccaatgccatcctgtggacctgcctgggcctgagcctcatcatcagcctggccgtgtttgtgctgatgttcctgctgaggaagatcaacagcgagcccctgaaggatgagttcaagaacacagagatggagagccgctctgtggcccaggccggcgtgcagtggagggacctgaacagcctgcagcccctgcccctgggcttcaagcagttcagccacctgagcctgctgagcaactgggactaccgcatccgcagccctggccatggatag

SEQ ID NO: 174862 - DNA, 768 bp, Artificial Sequence
  Description of Artificial Sequence: Synthetic coding sequence
atggcccagcacggggccatgggcgccttccgggccctgtgtggcctggccctgctgtgtgccctgagcctgggccagaggcccactggaggccctggctgcggccctggccgcctgctgctgggcactggaacagatgcccgctgctgccgggtgcacaccacccgctgctgccgggactacccaggagaggagtgctgcagcgagtgggactgcatgtgtgtgcagcctgagttccactgtggggacccctgctgcaccacctgccgccaccacccctgccccccaggccagggcgtgcagagccagggcaagttctcctttggcttccagtgcatcgactgtgccagcggcaccttcagcggcggccacgagggccactgcaagccctggacagactgctgctggcgctgcagaagaagacccaagaccccagaggccgccagcagccccaggaagagcggggccagtgaccggcagaggcggcggggcggctgggagacctgtggctgtgagcccggccggcccccaggccccccaacagctgccagccccagccctggggccccccaggccgccggggccctgcggagcgccctgggccgggccctgctgccctggcagcagaagtgggtgcaggagggcggcagtgaccagaggcctggcccctgcagcagcgctgctgctgctggcccctgccggcgggagcgggagacccagagctggccacccagcagcctggccggcccagatggagtgggcagctag

SEQ ID NO: 174863 - DNA, 705 bp, Artificial Sequence
  Description of Artificial Sequence: Synthetic coding sequence
atggcccagcacggggccatgggcgccttccgggccctgtgtggcctggccctgctgtgtgccctgagcctgggccagaggcccactggaggccctggctgcggccctggccgcctgctgctgggcactggaacagatgcccgctgctgccgggtgcacaccacccgctgctgccgggactacccaggagaggagtgctgcagcgagtgggactgcatgtgtgtgcagcctgagttccactgtggggacccctgctgcaccacctgccgccaccacccctgccccccaggccagggcgtgcagagccagggcaagttctcctttggcttccagtgcatcgactgtgccagcggcaccttcagcggcggccacgagggccactgcaagccctggacagactgcacccagtttggcttcctgactgtgtttcctggcaacaagacccacaatgctgtgtgtgtgcccggcagccccccagctgagcccctgggctggctgactgtggtgctgctggccgtggccgcctgtgtgctgctgctgaccagcgcccagctgggcctgcacatctggcagctgaggaagacccagctgctgctggaggtgccccccagcacagaagatgcccggagctgccagtttcctgaggaggagcggggggagaggtctgctgaggagaagggccgcctgggggacctgtgggtgtag

SEQ ID NO: 174864 - DNA, 726 bp, Artificial Sequence
  Description of Artificial Sequence: Synthetic coding sequence
atggcccagcacggggccatgggcgccttccgggccctgtgtggcctggccctgctgtgtgccctgagcctgggccagaggcccactggaggccctggctgcggccctggccgcctgctgctgggcactggaacagatgcccgctgctgccgggtgcacaccacccgctgctgccgggactacccaggagaggagtgctgcagcgagtgggactgcatgtgtgtgcagcctgagttccactgtggggacccctgctgcaccacctgccgccaccacccctgccccccaggccagggcgtgcagagccagggcaagttctcctttggcttccagtgcatcgactgtgccagcggcaccttcagcggcggccacgagggccactgcaagccctggacagactgcacccagtttggcttcctgactgtgtttcctggcaacaagacccacaatgctgtgtgtgtgcccggcagccccccagctgagcccctgggctggctgactgtggtgctgctggccgtggccgcctgtgtgctgctgctgaccagcgcccagctgggcctgcacatctggcagctgcggagccagtgcatgtggccccgggagacccagctgctgctggaggtgccccccagcacagaagatgcccggagctgccagtttcctgaggaggagcggggggagaggtctgctgaggagaagggccgcctgggggacctgtgggtgtag

SEQ ID NO: 174865 - DNA, 834 bp, Artificial Sequence
  Description of Artificial Sequence: Synthetic coding sequence
atgtgtgtgggcgcccggcggctgggccggggcccctgtgccgccctgctgctgctgggcctgggcctgagcacagtgacaggcctgcactgtgtgggggacacctaccccagcaatgaccgctgctgccatgaatgtagacctggaaatggcatggtgagccgctgcagccgcagccagaacacagtgtgccggccctgtggccctggcttctacaatgatgtggtgagcagcaagccctgcaagccctgcacctggtgcaacctgcggagcggcagcgagaggaagcagctgtgcacagccacccaggacacagtgtgccgctgcagagctggcacccagcccctggacagctacaagccaggagtggactgtgccccctgccccccaggccacttcagccctggggacaaccaggcctgcaagccctggaccaactgcaccctggccggcaagcacaccctgcagcctgccagcaacagcagtgatgccatctgtgaagatcgggaccccccagccacccagccccaggagacccagggccccccagcccggcccatcaccgtgcagcccacagaggcctggcccaggaccagccagggccccagcaccaggcctgtggaggtgcctgggggccgggctgtggccgccatcctgggcctgggcctggtgctgggcctgctgggccccctggccatcctgctggccctgtacctgctgcggcgggaccagaggctgcccccagatgcccacaagcccccaggcggcggcagcttccgcacccccatccaggaggagcaggctgatgcccacagcaccctggccaagatctag

SEQ ID NO: 174866 - DNA, 399 bp, Artificial Sequence
  Description of Artificial Sequence: Synthetic coding sequence
tgaccaggggccccacccctgcccccaggggcccagacccggccccggccccggggcgtgggggagaccaccctggccatgtggccaggcctggccggcctgagccgcagcggcagcgagaggaagcagctgtgcacagccacccaggacacagtgtgccgctgcagagctggcacccagcccctggacagctacaagccaggagtggactgtgccccctgccccccaggccacttcagccctggggacaaccaggcctgcaagccctggaccaactgcaccctggccggcaagcacaccctgcagcctgccagcaacagcagtgatgccatctgtgaagatcgggaccccccagccacccagccccaggagacccagggccccccagcccggccctag

SEQ ID NO: 174867 - DNA, 423 bp, Artificial Sequence
  Description of Artificial Sequence: Synthetic coding sequence
atgagggccctggagggccctggcctgagcctgctgtgcctggtgctggccctgcctgccctgctgcctgtgcctgctgtgcggggcgtggccgagacccccacctacccctggagagatgctgagactggagagcggctggtgtgtgcccagtgccccccaggcacctttgtgcagaggccctgcagaagagacagccccaccacctgtggcccctgcccccccaggcactacacccagttctggaactacctggagcgctgccgctactgcaatgtgctgtgtggggagcgggaggaggaggcccgggcctgccacgccacccacaacagagcctgctgcggctgctgccgccgctgtgcctggccaggctgccccggctggagcggggcctctgtgtctgccagcagcctgtgcacctag

SEQ ID NO: 174868 - DNA, 903 bp, Artificial Sequence
  Description of Artificial Sequence: Synthetic coding sequence
atgagggccctggagggccctggcctgagcctgctgtgcctggtgctggccctgcctgccctgctgcctgtgcctgctgtgcggggcgtggccgagacccccacctacccctggagagatgctgagactggagagcggctggtgtgtgcccagtgccccccaggcacctttgtgcagaggccctgcagaagagacagccccaccacctgtggcccctgcccccccaggcactacacccagttctggaactacctggagcgctgccgctactgcaatgtgctgtgtggggagcgggaggaggaggcccgggcctgccacgccacccacaacagagcctgccgctgcaggacaggcttctttgcccatgctggcttctgcctggagcacgccagctgccccccaggggccggcgtgattgcccctggcacccccagccagaacacccagtgccagccctgccccccaggcaccttcagcgccagcagcagcagcagcgagcagtgccagccccacaggaactgcacagccctgggcctggccctgaatgtgcccggcagcagcagccatgacaccctgtgcaccagctgcaccggcttccccctgagcaccagggtgcctggagctgaggagtgtgagcgggccgtcatcgactttgtggccttccaggacatcagcatcaagaggctgcagaggctgctgcaggccctggaggcccctgagggctggggccccaccccccgggccggccgggccgccctgcagctgaagctgcggcggcggctgacagagctgctgggcgcccaggatggagccctgctggtgcggctgctgcaggccctgcgggtggccaggatgcctggcctggagaggtctgtgcgggagcgcttcctgcctgtgcactag

SEQ ID NO: 174869 - DNA, 903 bp, Artificial Sequence; identical to SEQ ID NO: 174868
  Description of Artificial Sequence: Synthetic coding sequence

SEQ ID NO: 174870 - DNA, 1788 bp, Artificial Sequence
  Description of Artificial Sequence: Synthetic coding sequence
atgagggtgctgctggccgccctgggcctgctcttcctgggcgccctgcgggccttcccccaggaccggccctttgaggacacctgccacggcaaccccagccactactatgacaaggctgtgcggcgctgctgctaccgctgccccatgggcctcttccccacccagcagtgcccccagaggcccacagactgcaggaagcagtgtgagccagactactacctggatgaggccgaccgctgcacagcctgtgtgacctgcagcagagatgacctggtggagaagaccccctgtgcctggaacagcagccgggtgtgtgaatgtcggcccggcatgttctgcagcaccagcgctgtgaacagctgtgcccgctgcttcttccacagcgtgtgcccagctggcatgattgtgaagtttcctggaacagcccagaagaacacagtgtgtgagcccgccagccctggggtgtccccagcctgtgccagccctgagaactgcaaggagcccagcagcggcaccatcccccaggccaagcccacccctgtgtccccagccaccagcagcgccagcaccatgcctgtgcggggcggcacccggctggcccaggaggccgccagcaagctgacccgggccccagacagccccagctctgtgggccggcccagcagtgaccccggcctgagccccacccagccctgcccagagggcagcggggactgcaggaagcagtgtgagccagactactacctggatgaagctggccgctgcacagcctgtgtgtcctgcagcagagatgacctggtggagaagaccccctgtgcctggaacagcagcaggacctgtgagtgcaggcctggcatgatctgtgccaccagcgccaccaacagccgggcccgctgtgtgccctaccccatctgtgccgctgagaccgtgaccaagccccaggacatggccgagaaggacaccacctttgaggccccacccctgggcacccagcctgactgcaaccccaccccagaaaatggagaggccccagccagcaccagccccacccagagcctgctggtggacagccaggccagcaagaccctgcccatccccaccagcgcccctgtggccctgagcagcacaggcaagcctgtgctggatgctggccctgtgctcttctgggtgatcctggtgctggtggtggtggtgggcagcagcgccttcctgctgtgccacagaagagcctgcaggaagaggatccggcagaagctgcacctgtgctaccctgtgcagaccagccagcccaagctggagctggtggacagccggcccaggaggagcagcacccagctgcggagcggggcctctgtgacagagcctgtggccgaggagcggggcctgatgagccagcccctgatggagacctgccacagcgtgggcgccgcctacctggagagcctgcccctgcaggatgccagccctgctgggggccccagcagcccccgggacctgcctgagccccgggtgtccacagagcacaccaacaacaagattgagaagatctacatcatgaaggctgacaccgtcatcgtgggcaccgtgaaggccgagctgcctgagggccggggcctggccggccctgctgagcctgagctggaggaggagctggaggccgaccacaccccccactacccagagcaggagacagagccccccctgggcagctgcagtgatgtgatgctgtctgtggaggaggagggcaaggaggaccccctgcccacagctgccagcggcaagtag

SEQ ID NO: 174871 - DNA, 399 bp, Artificial Sequence
  Description of Artificial Sequence: Synthetic coding sequence
atgagccagcccctgatggagacctgccacagcgtgggcgccgcctacctggagagcctgcccctgcaggatgccagccctgctgggggccccagcagcccccgggacctgcctgagccccgggtgtccacagagcacaccaacaacaagattgagaagatctacatcatgaaggctgacacagtgattgtgggcaccgtgaaggccgagctgcctgagggccggggcctggccggccctgctgagcctgagctggaggaggagctggaggccgaccacaccccccactacccagagcaggagacagagccccccctgggcagctgcagtgatgtgatgctgtctgtggaggaggagggcaaggaggaccccctgcccacagctgccagcggcaagtag

SEQ ID NO: 174872 - DNA, 1452 bp, Artificial Sequence
  Description of Artificial Sequence: Synthetic coding sequence
atgttctgcagcaccagcgctgtgaacagctgtgcccgctgcttcttccacagcgtgtgcccagctggcatgattgtgaagtttcctggaacagcccagaagaacacagtgtgtgagcccgccagccctggggtgtccccagcctgtgccagccctgagaactgcaaggagcccagcagcggcaccatcccccaggccaagcccacccctgtgtccccagccaccagcagcgccagcaccatgcctgtgcggggcggcacccggctggcccaggaggccgccagcaagctgacccgggccccagacagccccagctctgtgggccggcccagcagtgaccccggcctgagccccacccagccctgcccagagggcagcggggactgcaggaagcagtgtgagccagactactacctggatgaggccggccgctgcacagcctgtgtgtcctgcagcagagatgacctggtggagaagaccccctgtgcctggaacagcagcaggacctgtgaatgtcggcccggcatgatctgtgccaccagcgccaccaacagccgggcccgctgtgtgccctaccccatctgtgccgctgagaccgtgaccaagccccaggacatggccgagaaggacaccacctttgaggccccacccctgggcacccagcctgactgcaaccccaccccagaaaatggagaggccccagccagcaccagccccacccagagcctgctggtggacagccaggccagcaagaccctgcccatccccaccagcgcccctgtggccctgagcagcacaggcaagcctgtgctggatgctggccctgtgctcttctgggtgatcctggtgctggtggtggtggtgggcagcagcgccttcctgctgtgccaccggcgggcctgcaggaagaggatccggcagaagctgcacctgtgctaccctgtgcagaccagccagcccaagctggagctggtggacagccggccccggcgcagcagcaccctgcggagcggggcctctgtgacagagcctgtggccgaggagcggggcctgatgagccagcccctgatggagacctgccacagcgtgggcgccgcctacctggagagcctgcccctgcaggatgccagccctgctgggggccccagcagcccccgggacctgcctgagccccgggtgtccacagagcacaccaacaacaagattgagaagatctacatcatgaaggctgacaccgtcatcgtgggcaccgtgaaggccgagctgcctgagggccggggcctggccggccctgctgagcctgagctggaggaggagctggaggccgaccacaccccccactacccagagcaggagacagagccccccctgggcagctgcagtgatgtgatgctgtctgtggaggaggagggcaaggaggaccccctgcccacagctgccagcggcaagtag

SEQ ID NO: 174873 - DNA, 1437 bp, Artificial Sequence
  Description of Artificial Sequence: Synthetic coding sequence
atggcccccctgcggcccctgctgatcctggccctgctggcctgggtggccctggccgaccaggagagctgcaagggccgctgcacagagggcttcaacgtggacaagaagtgccagtgtgatgagctgtgcagctactaccagagctgctgcacagactacacagctgagtgcaagccccaggtgaccagaggagatgtgttcaccatgccagaagatgagtacacagtgtatgatgatggagaggagaagaacaatgccaccgtgcatgagcaggtgggcggccccagcctgaccagtgacctgcaggcccagagcaaaggaaatcctgagcagacccctgtgctgaagccagaggaggaggccccagcccctgaggtgggcgccagcaagccagagggcatcgacagcaggcctgagaccctgcaccctggccggccccagcccccagctgaggaggagctgtgcagcggcaagccctttgatgccttcacagacctgaagaatggcagcctgtttgccttccggggccagtactgctatgagctggatgagaaggctgtgcggcccggctaccccaagctgatcagagatgtgtggggcatcgagggccccattgatgctgccttcacccgcatcaactgccagggcaagacctacctgttcaagggcagccagtactggaggtttgaagatggagtgctggaccctgactaccccaggaacatcagtgatggctttgatggcatcccagacaacgtggatgctgccctggccctgcctgcccacagctacagcggccgggagcgggtgtacttcttcaagggcaagcagtactgggagtaccagttccagcaccagcccagccaggaggagtgtgagggcagcagcctgtctgctgtgtttgagcactttgccatgatgcagagggacagctgggaggacatctttgagctgctcttctggggccgcaccagcgctggcacccggcagccccagttcatcagccgggactggcacggcgtgcccggccaggtggatgctgccatggccggccgcatctacatcagcggcatggccccccggcccagcctggccaagaagcagcgcttccgccacaggaacaggaagggctaccgcagccagaggggccacagccggggcaggaaccagaacagccggcggcccagccgggccacctggctgagcctcttcagcagcgaggagagcaacctgggcgccaacaactatgatgactacaggatggactggctggtgcctgccacctgtgagcccatccagagcgtcttcttcttcagcggggacaagtactacagagtgaacctgcggacccggcgggtggacacagtggaccccccctaccccaggagcatcgcccagtactggctgggctgcccagcccctggccacctgtag

SEQ ID NO: 174874 - DNA, 639 bp, Artificial Sequence
  Description of Artificial Sequence: Synthetic coding sequence
atggccgaggccaagtactacctgatccagggcctggtgaacatgtgccagagcgccctgcaggacaagaaggacagctaccagcctgtgtgcaacatccccatcatcaccagcctgaaggaggaggagcggctcatcgagagcagcaccaagcctgtggtgaagctgctgtacaacagaagcaacaacaagtacagctacaccagcaacagtgatgaccacctgctgaagaacatcgagctgtttgacaagctgagcctgcgcttcaacggccgggtgctcttcatcaaggatgtgattggagatgagatctgctgctggagcttctacggccagggcaggaagctggccgaggtgtgctgcaccagcatcgtgtatgccacagagaagaagcagaccaaggtggagttccctgaggcccgcatctatgaggagaccctgaatgtgctgctgtatgagaccccccgggtgcctgacaacagcctgctggaggccaccagccgcagccgcagccaggccagccccagtgaagatgaggagacctttgagctgcgggacagagtgcggcgcatccacgtgaagcgctacagcacctatgatgaccggcagctgggccaccagagcacccaccgggactag

SEQ ID NO: 174875 - DNA, 1965 bp, Artificial Sequence
  Description of Artificial Sequence: Synthetic coding sequence
atgtctgaggccagcagcgaggacctggtgccccccctggaggccggggccgccccctaccgggaggaggaggaggccgccaagaagaagaaggagaagaagaagaagagcaagggcctggccaacgtgttctgtgtgttcaccaagggcaagaagaagaagggccagcccagcagcgctgagccagaagatgctgctggcagccggcagggcctggatggccccccacccaccgtggaggagctgaaggccgccctggagcggggccagctggaggccgcccggcccctgctggccctggagcgggagctggccgctgctgctgctgctgggggcgtgtctgaggaggagctggtgcggcggcagagcaaggtggaggccctgtatgagctgctgcgggaccaggtgctgggcgtgctgcggcggcccctggaggcccctcctgagcggctgcggcaggccctggccgtggtggccgagcaggagcgggaggaccggcaggccgctgctgctggccctggcaccagcggcctggccgccacccggccccggcgctggctgcagctgtggaggagaggagtggccgaggccgctgaggagaggatgggccagaggcctgctgctggagctgaggtgcctgagagcgtcttcctgcacctgggccgcaccatgaaggaggacctggaggccgtggtggagcggctgaagcccctcttccctgctgagtttggagtggtggccgcctatgcagagagctaccaccagcactttgctgcccacctggccgctgtggcccagtttgagctgtgtgagcgggacacctacatgctgctgctgtgggtgcagaacctgtacccaaatgacatcatcaacagccccaagctggtgggggagctgcagggcatgggcctgggcagcctgctgcccccccggcagatccggctgctggaggccaccttcctgagcagcgaggccgccaacgtgcgggagctgatggaccgggccctggagctggaggcccggcgctgggccgaggatgtgcccccccagaggctggatggccactgccacagcgagctggccatcgacatcatccagatcaccagccaggcccaggccaaggccgagagcatcaccctggacctgggcagccagatcaagagggtgctgctggtggagctgcctgccttcctgcggagctaccagagggccttcaatgagttcctggagcggggcaagcagctgaccaactaccgggccaacgtgattgccaacatcaacaactgcctgtccttcaggatgtccatggagcagaactggcaggtgccccaggacaccctgagcctgctgctgggccccctgggggagctgaagagccacggctttgacaccctgctgcagaacctgcacgaggacctgaagcccctcttcaagcgcttcacccacacccgctgggccgcccctgtggagaccctggagaacatcatcgccaccgtggacacccggctgcctgagttcagcgagctgcagggctgcttccgggaggagctgatggaggccctgcacctgcacctggtgaaggagtacatcatccagctgagcaagggccgcctggtgctgaagacagctgagcagcagcagcagctggccggctacatcctggccaatgctgacaccatccagcacttctgcacccagcacggcagccctgccacctggctgcagcctgccctgcccaccctggccgagatcatccggctgcaggaccccagcgccatcaagattgaggtggccacctacgccacctgctacccagacttcagcaagggccacctgagcgccatcctggccatcaagggcaacctgagcaacagcgaggtgaagaggatccgcagcatcctggatgtgtccatgggcgcccaggagcccagccggcccctcttcagcctcatcaaggtgggctag

SEQ ID NO: 174876 - DNA, 972 bp, Artificial Sequence
  Description of Artificial Sequence: Synthetic coding sequence
atggaccgggccctggagctggaggcccggcgctgggccgaggatgtgcccccccagaggctggatggccactgccacagcgagctggccatcgacatcatccagatcaccagccaggcccaggccaaggccgagagcatcaccctggacctgggcagccagatcaagagggtgctgctggtggagctgcctgccttcctgcggagctaccagagggccttcaatgagttcctggagcggggcaagcagctgaccaactaccgggccaacgtcatcgccaacatcaacaactgcctgtccttcaggatgtccatggagcagaactggcaggtgccccaggacaccctgagcctgctgctgggccccctgggggagctgaagagccacggctttgacaccctgctgcagaacctgcacgaggacctgaagcccctcttcaagcgcttcacccacacccgctgggccgcccctgtggagaccctggagaacatcatcgccaccgtggacacccggctgcctgagttcagcgagctgcagggctgcttccgggaggagctgatggaggccctgcacctgcacctggtgaaggagtacatcatccagctgagcaagggccgcctggtgctgaagacagctgagcagcagcagcagctggccggctacatcctggccaatgctgacaccatccagcacttctgcacccagcacggcagccctgccacctggctgcagcctgccctgcccaccctggccgagatcatccggctgcaggaccccagcgccatcaagattgaggtggccacctacgccacctgctacccagacttcagcaagggccacctgagcgccatcctggccatcaagggcaacctgagcaacagcgaggtgaagaggatccgcagcatcctggatgtgtccatgggcgcccaggagcccagccggcccctcttcagcctcatcaaggtgggctag

SEQ ID NO: 174877 - DNA, 600 bp, Artificial Sequence
  Description of Artificial Sequence: Synthetic coding sequence
atggaggccctgcacctgcacctggtgaaggagtacatcatccagctgagcaagggccgcctggtgctgaagacagctgagcagcagcagcagctggccggctacatcctggccaatgctgacaccatccagcacttctgcacccagcacggcagccctgccacctggctgcagcctgccctgcccaccctggccgagatcatccggctgcaggaccccagcgccatcaagattgaggtggccacctacgccacctgctacccagacttcagcaagggccacctgagcgccatcctggccatcaagggcaacctgagcaacagcgaggtgaagaggatccgcagcatcctggatgtgtccatgggcgcccaggagcccagccggcccctcttcagcctcatcaagcccagggctgctgtgtctggcatccagcagtggtggaatggccggcagaactggaagaggaagaaggagaagatgagcagccggctggccggggccttccgggtgctgtggagggctgtgtccacagccagcatcagaagacacatccaggtggccccccggcccctgcaggccggccctgccatgggcccctag

SEQ ID NO: 174878 - DNA, 120 bp, Artificial Sequence
  Description of Artificial Sequence: Synthetic coding sequence
atgtctgaggccagcagcgaggacctggtgccccccctggaggccggggccgccccctaccgggaggaggaggaggccgccaagaagaagaaggagaagaagaagaagagcaagggctag

SEQ ID NO: 174879 - DNA, 1965 bp, Artificial Sequence; identical to SEQ ID NO: 174875
  Description of Artificial Sequence: Synthetic coding sequence

SEQ ID NO: 174880 - DNA, 2373 bp, Artificial Sequence
  Description of Artificial Sequence: Synthetic coding sequence
atggccgagcaggtgctgccccaggccctgtacctgagcaacatgaggaaggctgtgaagatccgggagaggaccccagaggacatcttcaagcccaccaacggcatcatccaccacttcaagaccatgcaccgctacaccctggagatgttccgcacctgccagttctgcccccagttccgggagatcatccacaaggccctgattgacaggaacatccaggccaccctggagagccagaagaagctgaactggtgccgggaggtgaggaagctggtggccctgaagaccaatggagatggcaactgcctgatgcacgccaccagccagtacatgtggggcgtgcaggacacagacctggtgctgaggaaggccctcttcagcaccctgaaggagacagacaccaggaacttcaagttccgctggcagctggagagcctgaagagccaggagtttgtggagaccggcctgtgctatgacaccaggaactggaatgatgagtgggacaacctgatcaagatggccagcacagacacccccatggcccggagcggcctgcagtacaacagcctggaggagatccacatctttgtgctgtgcaacatcctgcggcggcccatcatcgtcatcagtgacaagatgctgcggagcctggagagcggcagcaactttgcccccctgaaggtgggcggcatctacctgcccctgcactggccagcccaggagtgctaccgctaccccatcgtgctgggctatgacagccaccactttgtgcccctggtgaccctgaaggacagcggccctgagatccgggctgtgcccctggtgaacagagaccggggccgctttgaggacctgaaggtgcacttcctgacagatcctgaaaatgagatgaaggagaagctgctgaaggagtacctgatggtgattgagatccctgtgcagggctgggaccacggcaccacccacctgatcaatgctgccaagctggatgaggccaacctgcccaaggagatcaacctggtggatgactactttgagctggtgcagcacgagtacaagaagtggcaggagaacagcgagcagggccggcgggagggccacgcccagaaccccatggagcccagcgtgccccagctgagcctgatggatgtgaagtgtgagacccccaactgccccttcttcatgtctgtgaacacccagcccctgtgccacgagtgcagcgagcggcggcagaagaaccagaacaagctgcccaagctgaacagcaagccaggccctgagggcctgcccggcatggccctgggcgccagcagaggagaggcctatgagcccctggcctggaaccctgaggagagcactggaggcccccacagcgccccacccacagcccccagccccttcctgttcagcgagaccacagccatgaagtgccgcagccctggctgccccttcaccctgaatgtgcagcacaacggcttctgtgagcgctgccacaatgcccggcagctgcacgccagccacgccccagaccacaccaggcacctggaccccgggaagtgccaggcctgcctgcaggatgtgaccaggaccttcaacggcatctgcagcacctgcttcaagaggaccacagctgaggccagcagcagcctgagcaccagcctgccccccagctgccaccagaggagcaagagtgaccccagccggctggtgcgcagccccagcccccacagctgccacagagctggaaatgatgccccagctggctgcctgagccaggccgcccggacccctggggacagaacaggcaccagcaagtgcaggaaggccggctgtgtgtacttcggcaccccagaaaataaaggcttctgcaccctgtgcttcatcgagtaccgggagaacaagcactttgctgctgccagcggcaaggtgagccccacagccagccgcttccagaacaccatcccctgcctgggcagagaatgtggcaccctgggcagcaccatgtttgagggctactgccagaagtgcttcatcgaggcccagaaccagcgcttccacgaggccaagaggacagaggagcagctgcggagcagccagaggagagatgtgcccaggaccacccagagcaccagccggcccaagtgtgcccgggccagctgcaagaacatcctggcctgccgctctgaggagctgtgcatggagtgccagcaccccaaccagaggatgggccctggggcccacagaggagagcccgccccagaagatcctcccaagcagcgctgccgggccccagcctgtgaccactttggaaatgccaagtgcaatggctactgcaatgaatgcttccagttcaagcagatgtatggatag

SEQ ID NO: 174881 - DNA, 489 bp, Artificial Sequence
  Description of Artificial Sequence: Synthetic coding sequence
atggccgagcaggtgctgccccaggccctgtacctgagcaacatgaggaaggctgtgaagatccgggagaggaccccagaggacatcttcaagcccaccaacggcatcatccaccacttcaagaccatgcaccgctacaccctggagatgttccgcacctgccagttctgcccccagttccgggagatcatccacaaggccctgattgacaggaacatccaggccaccctggagagccagaagaagctgaactggtgccgggaggtgaggaagctggtggccctgaagaccaatggagatggcaactgcctgatgcacgccaccagccagtacatgtggggcgtgcaggacacagacctggtgctgaggaaggccctcttcagcaccctgaaggagacagacaccaggaacttcaagttccgctggcagctggagagcctgaagagccaggagtttgtggagaccggcctgtgctatgacaccaggtag

SEQ ID NO: 174882 - DNA, 81 bp, Artificial Sequence
  Description of Artificial Sequence: Synthetic coding sequence
atggccgagcaggtgctgccccaggccctgtacctgagcaacatgaggaaggctgtgaagatccgggagaggaccccctag

SEQ ID NO: 174883 - DNA, 297 bp, Artificial Sequence
  Description of Artificial Sequence: Synthetic coding sequence
atggccgagcaggtgctgccccaggccctgtacctgagcaacatgaggaaggctgtgaagatccgggagaggaccccagaggacatcttcaagcccaccaacggcatcatccaccacttcaagaccatgcaccgctacaccctggagatgttccgcacctgccagttctgcccccagttccgggagatcatccacaaggccctgattgacaggaacatccaggccaccctggagagccagaagaagctgaactggtgccgggaggtgaggaagctggtggccctgaagaccaactag

SEQ ID NO: 174884 - DNA, 813 bp, Artificial Sequence
  Description of Artificial Sequence: Synthetic coding sequence
atggccgagcaggtgctgccccaggccctgtacctgagcaacatgaggaaggctgtgaagatccgggagaggaccccagaggacatcttcaagcccaccaacggcatcatccaccacttcaagaccatgcaccgctacaccctggagatgttccgcacctgccagttctgcccccagttccgggagatcatccacaaggccctgattgacaggaacatccaggccaccctggagagccagaagaagctgaactggtgccgggaggtgaggaagctggtggccctgaagaccaatggagatggcaactgcctgatgcacgccaccagccagtacatgtggggcgtgcaggacacagacctggtgctgaggaaggccctcttcagcaccctgaaggagacagacaccaggaacttcaagttccgctggcagctggagagcctgaagagccaggagtttgtggagaccggcctgtgctatgacaccaggaactggaatgatgagtgggacaacctgatcaagatggccagcacagacacccccatggcccggagcggcctgcagtacaacagcctggaggagatccacatctttgtgctgtgcaacatcctgcggcggcccatcatcgtcatcagtgacaagatgctgcggagcctggagagcggcagcaactttgcccccctgaaggtgggcggcatctacctgcccctgcactggccagcccaggagtgctaccgctaccccatcgtgctgggctatgacagccaccactttgtgcccctggtgaccctgaaggacagcggccctgacatctag

SEQ ID NO: 174885 - DNA, 2250 bp, Artificial Sequence
  Description of Artificial Sequence: Synthetic coding sequence
atggccgagcaggtgctgccccaggccctgtacctgagcaacatgaggaaggctgtgaagatccgggagaggaccccagaggacatcttcaagcccaccaacggcatcatccaccacttcaagaccatgcaccgctacaccctggagatgttccgcacctgccagttctgcccccagttccgggagatcatccacaaggccctgattgacaggaacatccaggccaccctggagagccagaagaagctgaactggtgccgggaggtgaggaagctggtggccctgaagaccaatggagatggcaactgcctgatgcacgccaccagccagtacatgtggggcgtgcaggacacagacctggtgctgaggaaggccctcttcagcaccctgaaggagacagacaccaggaacttcaagttccgctggcagctggagagcctgaagagccaggagtttgtggagaccggcctgtgctatgacaccaggaactggaatgatgagtgggacaacctgatcaagatggccagcacagacacccccatggcccggagcggcctgcagtacaacagcctggaggagatccacatctttgtgctgtgcaacatcctgcggcggcccatcatcgtcatcagtgacaagatgctgcggagcctggagagcggcagcaactttgcccccctgaaggtgggcggcatctacctgcccctgcactggccagcccaggagtgctaccgctaccccatcgtgctgggctatgacagccaccactttgtgcccctggtgaccctgaaggacagcggccctgagatccgggctgtgcccctggtgaacagagaccggggccgctttgaggacctgaaggtgcacttcctgacagatcctgaaaatgagatgaaggagaagctgctgaaggagtacctgatggtgattgagatccctgtgcagggctgggaccacggcaccacccacctgatcaatgctgccaagctggatgaggccaacctgcccaaggagatcaacctggtggatgactactttgagctggtgcagcacgagtacaagaagtggcaggagaacagcgagcagggccggcgggagggccacgcccagaaccccatggagcccagcgtgccccagctgagcctgatggatgtgaagtgtgagacccccaactgccccttcttcatgtctgtgaacacccagcccctgtgccacgagtgcagcgagcggcggcagaagaaccagaacaagctgcccaagctgaacagcaagccaggccctgagggcctgcccggcatggccctgggcgccagcagaggagaggcctatgagcccctggcctggaaccctgaggagagcactggaggcccccacagcgccccacccacagcccccagccccttcctgttcagcgagaccacagccatgaagtgccgcagccctggctgccccttcaccctgaatgtgcagcacaacggcttctgtgagcgctgccacaatgcccggcagctgcacgccagccacgccccagaccacaccaggcacctggaccccgggaagtgccaggcctgcctgcaggatgtgaccaggaccttcaacggcatctgcagcacctgcttcaagaggaccacagctgaggccagcagcagcctgagcaccagcctgccccccagctgccaccagaggagcaagagtgaccccagccggctggtgcgcagccccagcccccacagctgccacagagctggaaatgatgccccagctggctgcctgagccaggccgcccggacccctggggacagaacaggcaccagcaagtgcaggaaggccggctgtgtgtacttcggcaccccagaaaataaaggcttctgcaccctgtgcttcatcgagtaccgggagaacaagcactttgctgctgccagcggcaaggtgagccccacagccagccgcttccagaacaccatcccctgcctgggcagagaatgtggcaccctgggcagcaccatgtttgagggctactgccagaagtgcttcatcgaggcccagaaccagcgcttccacgaggccaagaggacagaggagcagctgcggagcagccagaggagagatgtgcccaggaccacccagagcaccagccggcccaagtgtgcccgggccagctgcaagaacatcctggcctgccgctctgaggagctgtgcatggagtgccagcaccagccagaagatggcccctggggccccccaggatag

SEQ ID NO: 174886 - DNA, 459 bp, Artificial Sequence
  Description of Artificial Sequence: Synthetic coding sequence
atggccgagcaggtgctgccccaggccctgtacctgagcaacatgaggaaggctgtgaagatccgggagaggaccccagaggacatcttcaagcccaccaacggcatcatccaccacttcaagaccatgcaccgctacaccctggagatgttccgcacctgccagttctgcccccagttccgggagatcatccacaaggccctgattgacaggaacatccaggccaccctggagagccagaagaagctgaactggtgccgggaggtgaggaagctggtggccctgaagaccaatggagatggcaactgcctgatgcacgccaccagccagtacatgtggggcgtgcaggacacagacctggtgctgaggaaggccctcttcagcaccctgaaggagacagacaccaggaacttcaagttccgctggcagctggagagccagatcagcggcatctgctag

SEQ ID NO: 174887 - DNA, 645 bp, Artificial Sequence
  Description of Artificial Sequence: Synthetic coding sequence
atggccgagcaggtgctgccccaggccctgtacctgagcaacatgaggaaggctgtgaagatccgggagaggaccccagaggacatcttcaagcccaccaacggcatcatccaccacttcaagaccatgcaccgctacaccctggagatgttccgcacctgccagttctgcccccagttccgggagatcatccacaaggccctgattgacaggaacatccaggccaccctggagagccagaagaagctgaactggtgccgggaggtgaggaagctggtggccctgaagaccaatggagatggcaactgcctgatgcacgccaccagccagtacatgtggggcgtgcaggacacagacctggtgctgaggaaggccctcttcagcaccctgaaggagacagacaccaggaacttcaagttccgctggcagctggagagcctgaagagccaggagtttgtggagaccggcctgtgctatgacaccaggaactggaatgatgagtgggacaacctgatcaagtggctgccccagacccacccctggccagaggtggacttcagcaccacccactggaagaagtacacctacctgagctttgccaccagcagcgagggccagagcctgtccttccagaccaagtgctag

SEQ ID NO: 174888 - DNA, 2010 bp, Artificial Sequence
  Description of Artificial Sequence: Synthetic coding sequence
atggccgagcaggtgctgccccaggccctgtacctgagcaacatgaggaaggctgtgaagatccgggagaggaccccagaggacatcttcaagcccaccaacggcatcatccaccacttcaagaccatgcaccgctacaccctggagatgttccgcacctgccagttctgcccccagttccgggagatcatccacaaggccctgattgacaggaacatccaggccaccctggagagccagaagaagctgaactggtgccgggaggtgaggaagctggtggccctgaagaccaatggagatggcaactgcctgatgcacgccaccagccagtacatgtggggcgtgcaggacacagacctggtgctgaggaaggccctcttcagcaccctgaaggagacagacaccaggaacttcaagttccgctggcagctggagagcctgaagagccaggagtttgtggagaccggcctgtgctatgacaccaggaactggaatgatgagtgggacaacctgatcaagatggccagcacagacacccccatggcccggagcggcctgcagtacaacagcctggaggagatccacatctttgtgctgtgcaacatcctgcggcggcccatcatcgtcatcagtgacaagatgctgcggagcctggagagcggcagcaactttgcccccctgaaggtgggcggcatctacctgcccctgcactggccagcccaggagtgctaccgctaccccatcgtgctgggctatgacagccaccactttgtgcccctggtgaccctgaaggacagcggccctgagatccgggctgtgcccctggtgaacagagaccggggccgctttgaggacctgaaggtgcacttcctgacagatcctgaaaatgagatgaaggagaagctgctgaaggagtacctgatggtgattgagatccctgtgcagggctgggaccacggcaccacccacctgatcaatgctgccaagctggatgaggccaacctgcccaaggagatcaacctggtggatgactactttgagctggtgcagcacgagtacaagaagtggcaggagaacagcgagcagggccggcgggagggccacgcccagaaccccatggagcccagcgtgccccagctgagcctgatggatgtgaagtgtgagacccccaactgccccttcttcatgtctgtgaacacccagcccctgtgccacgagtgcagcgagcggcggcagaagaaccagaacaagctgcccaagctgaacagcaagccaggccctgagggcctgcccggcatggccctgggcgccagcagaggagaggcctatgagcccctggcctggaaccctgaggagagcactggaggcccccacagcgccccacccacagcccccagccccttcctgttcagcgagaccacagccatgaagtgccgcagccctggctgccccttcaccctgaatgtgcagcacaacggcttctgtgagcgctgccacaatgcccggcagctgcacgccagccacgccccagaccacaccaggcacctggaccccgggaagtgccaggcctgcctgcaggatgtgaccaggaccttcaacggcatctgcagcacctgcttcaagaggaccacagctgaggccagcagcagcctgagcaccagcctgccccccagctgccaccagaggagcaagagtgaccccagccggctggtgcgcagccccagcccccacagctgccacagagctggaaatgatgccccagctggctgcctgagccaggccgcccggacccctggggacagaacaggcaccagcaagtgcaggaaggccggctgtgtgtacttcggcaccccagaaaataaaggcttctgcaccctcttccaccgggtgcagaggaagcagaccttctgctgctgcctgcgggagagccagagccacagcgtgcaggtgcctgagcaccacagcgtgcctggagagggcatgaggcacccctggaagcaccacgtgtag

SEQ ID NO: 174889 - DNA, 834 bp, Artificial Sequence
  Description of Artificial Sequence: Synthetic coding sequence
atgatcatcctgatctacctgttcctgctgctgtgggaggacacccagggctggggcttcaaggatggcatcttccacaacagcatctggctggagagagctgctggggtgtaccaccgggaggcccggagcggcaagtacaagctgacctacgccgaggccaaggctgtgtgtgaatttgagggcggccacctggccacctacaagcagctggaggccgccaggaagattggcttccacgtgtgtgccgccggctggatggccaagggccgggtgggctaccccatcgtgaagccaggccccaactgtggctttgggaagacaggcatcattgattatggcatccggctgaacagaagtgagcgctgggatgcctactgctacaacccccacgccaaggaatgtggcggcgtcttcacagaccccaagcagatcttcaagagccctggcttccccaatgaatatgaggacaaccagatctgctactggcacatccggctgaagtatggccagaggatccacctgtccttcctggactttgacctggaggatgaccccggctgcctggccgactatgtggagatctatgacagctatgatgatgtgcacggctttgtgggccgctactgtggagatgagctgcctgatgacatcatcagcactggaaatgtgatgaccctgaagttcctgagtgatgcctctgtgacagctgggggcttccagatcaagtatgtggccatggaccctgtgtccaagagcagccagggcaagaacaccagcaccaccagcacaggcaacaagaacttcctggccggccgcttcagccacctgtag

SEQ ID NO: 174890 - DNA, 567 bp, Artificial Sequence
  Description of Artificial Sequence: Synthetic coding sequence
atggccacagatgtgttcaacagcaagaacctggccgtgcaggcccagaagaagatcctgggcaagatggtgtccaagagcatcgccaccaccctgattgatgacaccagcagcgaggtgctggatgagctgtacagagtgacccgggagtacacccagaacaagaaggaggccgagaagatcatcaagaacctgatcaagacagtcatcaagctggccatcctgtacagaaacaaccagttcaaccaggatgagctggccctgatggagaagttcaagaagaaggtgcaccagctggccatgacagtggtgtccttccaccaggtggactacacctttgacagaaatgtgctgagccggctgctgaatgaatgtcgggagatgctgcaccagatcatccagaggcacctgacagccaagagccacggccgggtgaacaacgtgtttgaccacttcagtgactgtgagttcctggccgccctgtacaacccctttggaaacttcaagccccacctgcagaagctgtgtgatggcatcaacaagatgctggatgaggagaacatctag

SEQ ID NO: 174891 - DNA, 597 bp, Artificial Sequence
  Description of Artificial Sequence: Synthetic coding sequence
atgcacagcgaggccgaggagagcaaggaggtggccacagatgtgttcaacagcaagaacctggccgtgcaggcccagaagaagatcctgggcaagatggtgtccaagagcatcgccaccaccctgattgatgacaccagcagcgaggtgctggatgagctgtacagagtgacccgggagtacacccagaacaagaaggaggccgagaagatcatcaagaacctgatcaagacagtcatcaagctggccatcctgtacagaaacaaccagttcaaccaggatgagctggccctgatggagaagttcaagaagaaggtgcaccagctggccatgacagtggtgtccttccaccaggtggactacacctttgacagaaatgtgctgagccggctgctgaatgaatgtcgggagatgctgcaccagatcatccagaggcacctgacagccaagagccacggccgggtgaacaacgtgtttgaccacttcagtgactgtgagttcctggccgccctgtacaacccctttggaaacttcaagccccacctgcagaagctgtgtgatggcatcaacaagatgctggatgaggagaacatctag

SEQ ID NO: 174892 - DNA, 597 bp, Artificial Sequence; identical to SEQ ID NO: 174891
  Description of Artificial Sequence: Synthetic coding sequence

SEQ ID NO: 174893 - DNA, 555 bp, Artificial Sequence
  Description of Artificial Sequence: Synthetic coding sequence
atggagagcttcagcagcaagagcctggccctgcaggccgagaagaagctgctgagcaagatggccggccgctctgtggcccacctgttcattgatgagaccagcagcgaggtgctggatgagctgtacagagtgtccaaggagtacacccacagccggccccaggcccagagggtcatcaaggacctgatcaaggtggccatcaaggtggccgtgctgcacagaaatggcagctttggccccagcgagctggccctggccacccgcttccggcagaagctgcggcagggcgccatgacagccctgagctttggagaggtggacttcacctttgaagctgctgtgctggccggcctgctgacagagtgcagagatgtgctgctggagctggtggagcaccacctgacccccaagagccacggccgcatcagacatgtgtttgaccacttcagtgaccccggcctgctgacagccctgtatggccctgacttcacccagcacctgggcaagatctgtgatggcctgaggaagctgctggatgagggcaagctgtag

SEQ ID NO: 174894 - DNA, 1296 bp, Artificial Sequence
  Description of Artificial Sequence: Synthetic coding sequence
atgtaccgcaccaaggtgggcctgaaggaccggcagcagctgtacaagctgatcatcagccagctgctgtatgatggctacatcagcatcgccaacggcctcatcaatgagatcaagccccagagcgtgtgtgcccccagcgagcagctgctgcacctgatcaagctgggcatggagaatgatgacacagctgtgcagtatgccatcggccgcagtgacacagtggcccctggcactggaattgacctggagtttgatgctgatgtgcagaccatgagccctgaggcctctgaatatgagacctgctacgtgaccagccacaagggcccctgccgggtggccacctacagcagagatggccagctgattgccactggatctgcagatgccagcatcaagatcctggacacagagaggatgctggccaagagcgccatgcccatcgaggtgatgatgaatgaaacagcccagcagaacatggagaaccaccctgtgatccgcaccctgtatgaccacgtggatgaggtgacctgcctggccttccaccccacagagcagatcctggccagcggcagccgggactacaccctgaagctgtttgactacagcaagcccagcgccaagagggccttcaagtacatccaggaggccgagatgctgcggagcatctccttccaccccagcggggacttcatcctggtgggcacccagcaccccaccctgcggctgtatgacatcaacaccttccagtgctttgtgtcctgcaacccccaggaccagcacacagatgccatctgcagcgtgaactacaacagcagcgccaacatgtatgtgacaggcagcaaggatggctgcatcaagctgtgggatggagtgagcaaccgctgcatcaccacctttgagaaggcccatgatggagctgaggtgtgcagcgccatcttcagcaagaacagcaagtacatcctgagcagcggcaaggacagcgtggccaagctgtgggagatcagcactggaagaaccctggtgcgctacacaggagctggcctgagcggccggcaggtgcacaggacccaggccgtgttcaaccacacagaagattatgtgctgctgcctgatgagaggaccatcagcctgtgctgctgggacagcaggacagctgagaggaggaacctgctgagcctgggccacaacaacatcgtgcgctgcatcgtgcacagccccaccaaccctggcttcatgacctgcagtgatgacttccgggcccgcttctggtaccgccgcagcaccacagactag

SEQ ID NO: 174895 - DNA, 621 bp, Artificial Sequence
  Description of Artificial Sequence: Synthetic coding sequence
atggattctgctggccaggacatcaacctgaacagccccaacaagggcctgctgagtgacagcatgacagatgtgcctgtggacacaggagtggccgcccggaccccagctgtggagggcctgacagaggccgaggaggaggagctgcgggcagagctgaccaaggtggaggaggagatcgtgaccctgcggcaggtgctggccgccaaggagcggcactgtggggagctgaagaggcggctgggcctgagcaccctgggggagctgaagcagaacctgagccgctcctggcatgatgtgcaggtgagcagcgcctacgtgaagaccagcgagaagctgggggagtggaatgagaaggtgacccagagcgacctgtacaagaagacccaggagaccctgagccaggccggccagaagaccagcgctgccctgagcacagtgggcagcgccatcagcaggaagctgggggacatgagaaattctgccaccttcaagagctttgaggacagagtgggcaccatcaagagcaaggtggtgggggacagagaaaatggaagtgacaacctgcccagcagcgctggcagcggggacaagcccctgagtgaccctgcccccttctag

SEQ ID NO: 174896 - DNA, 561 bp, Artificial Sequence
  Description of Artificial Sequence: Synthetic coding sequence
atggattctgctggccaggacatcaacctgaacagccccaacaagggcctgctgagtgacagcatgacagatgtgcctgtggacacaggagtggccgcccggaccccagctgtggagggcctgacagaggccgaggaggaggagctgcgggcagagctgaccaaggtggaggaggagatcgtgaccctgcggcaggtgctggccgccaaggagcggcactgtggggagctgaagaggcggctgggcctgagcaccctgggggagctgaagcagaacctgagccgctcctggcatgatgtgcaggtgagcagcgcctacaagaagacccaggagaccctgagccaggccggccagaagaccagcgctgccctgagcacagtgggcagcgccatcagcaggaagctgggggacatgagaaattctgccaccttcaagagctttgaggacagagtgggcaccatcaagagcaaggtggtgggggacagagaaaatggaagtgacaacctgcccagcagcgctggcagcggggacaagcccctgagtgaccctgcccccttctag

SEQ ID NO: 174897 - DNA, 630 bp, Artificial Sequence
  Description of Artificial Sequence: Synthetic coding sequence
atggattctgctggccaggacatcaacctgaacagccccaacaagggcctgctgagtgacagcatgacagatgtgcctgtggacacaggagtggccgcccggaccccagctgtggagggcctgacagaggccgaggaggaggagctgcgggcagagctgaccaaggtggaggaggagatcgtgaccctgcggcaggtgctggccgccaaggagcggcactgtggggagctgaagaggcggctgggcctgagcaccctgggggagctgaagcagaacctgagccgctcctggcatgatgtgcaggtgagcagcgcctacaagaagacccaggagaccctgagccaggccggccagaagaccagcgctgccctgagcacagtgggcagcgccatcagcaggaagctgggggacatgagggcccaccccttcagccacagcttcagcagctacagcatccgccacagcatctccatgcctgccatgaggaacagcgccaccttcaagagctttgaagatagagtgggcaccatcaagagcaaggtggtgggggaccgggagaatggaagtgacaacctgcccagcagcgctggcagcggggacaagcccctgagtgaccctgcccccttctag

SEQ ID NO: 174898 - DNA, 663 bp, Artificial Sequence
  Description of Artificial Sequence: Synthetic coding sequence
atggattctgctggccaggacatcaacctgaacagccccaacaagggcctgctgagtgacagcatgacagatgtgcctgtggacacaggagtggccgcccggaccccagctgtggagggcctgacagaggccgaggaggaggagctgcgggcagagctgaccaaggtggaggaggagatcgtgaccctgcggcaggtgctggccgccaaggagcggcactgtggggagctgaagaggcggctgggcctgagcaccctgggggagctgaagcagaacctgagccgctcctggcatgatgtgcaggtgagcagcgcctacgtgaagaccagcgagaagctgggggagtggaatgagaaggtgacccagagcgacctgtacaagaagacccaggagaccctgagccaggccggccagaagaccagcgctgccctgagcacagtgggcagcgccatcagcaggaagctgggggacatgagcagctacagcatccgccacagcatctccatgcctgccatgagaaattctgccaccttcaagagctttgaggacagagtgggcaccatcaagagcaaggtggtgggggacagagaaaatggaagtgacaacctgcccagcagcgctggcagcggggacaagcccctgagtgaccctgcccccttctag

SEQ ID NO: 174899 - DNA, 603 bp, Artificial Sequence
  Description of Artificial Sequence: Synthetic coding sequence
atggattctgctggccaggacatcaacctgaacagccccaacaagggcctgctgagtgacagcatgacagatgtgcctgtggacacaggagtggccgcccggaccccagctgtggagggcctgacagaggccgaggaggaggagctgcgggcagagctgaccaaggtggaggaggagatcgtgaccctgcggcaggtgctggccgccaaggagcggcactgtggggagctgaagaggcggctgggcctgagcaccctgggggagctgaagcagaacctgagccgctcctggcatgatgtgcaggtgagcagcgcctacaagaagacccaggagaccctgagccaggccggccagaagaccagcgctgccctgagcacagtgggcagcgccatcagcaggaagctgggggacatgagcagctacagcatccgccacagcatctccatgcctgccatgagaaattctgccaccttcaagagctttgaggacagagtgggcaccatcaagagcaaggtggtgggggacagagaaaatggaagtgacaacctgcccagcagcgctggcagcggggacaagcccctgagtgaccctgcccccttctag

SEQ ID NO: 174900 - DNA, 492 bp, Artificial Sequence
  Description of Artificial Sequence: Synthetic coding sequence
atggattctgctggccagggcgtggccgcccggaccccagctgtggagggcctgacagaagctgaggaggaggagctgcgggcagagctgaccaaggtggaggaggagatcgtgaccctgcggcaggtgctggccgccaaggagcggcactgtggggagctgaagaggcggctgggcctgagcaccctgggggagctgaagcagaacctgagccgctcctggcatgatgtgcaggtgtcctctgcctacaagaagacccaggagaccctgagccaggccggccagaagaccagcgctgccctgagcacagtgggcagcgccatcagcaggaagctgggggacatgaggaacagcgccaccttcaagagctttgaagatagagtgggcaccatcaagagcaaggtggtgggggaccgggagaatggaagtgacaacctgcccagcagcgctggcagcggggacaagcccctgagtgaccctgcccccttctag

SEQ ID NO: 174901 - DNA, 3405 bp, Artificial Sequence
  Description of Artificial Sequence: Synthetic coding sequence
atgagatttggcagcaagatgatgcccatgttcctgactgtgtacctgagcaacaatgagcagcacttcacagaggtgcctgtgaccccagagaccatctgcagagatgtggtggacctgtgcaaggagcccggggagagtgactgccacctggccgaggtgtggtgtggcagcgagaggcctgtggccgacaatgaaagaatgtttgatgtgctgcagagatttggcagccagagaaatgaggtgcgcttcttcctgcggcatgagaggcctcctggccgggacatcgtgtctggccccaggagccaggaccccagcctgaagagaaatggagtgaaggtgcctggagagtacagaagaaaagaaaatggagtgaacagccccaggatggacctgaccctggccgagctgcaggagatggccagccggcagcagcagcagatcgaggcccagcagcagctgctggccaccaaggagcagaggctgaagttcctgaagcagcaggaccagaggcagcagcagcaggtggccgagcaggagaagctgaagaggctgaaggagattgctgagaaccaggaggccaagctgaagaaggtgcgggccctgaagggccacgtggagcagaagaggctgagcaatggcaagctggtggaggagattgagcagatgaacaacctcttccagcagaagcagcgggagctggtgctggccgtgtccaaggtggaggagctgacccggcagctggagatgctgaagaatggaagaattgacagccaccacgacaaccagagcgctgtggccgagctggaccggctgtacaaggagctgcagctgaggaacaagctgaaccaggagcagaatgccaagctgcagcagcagagagaatgtctgaacaagaggaacagcgaggtggccgtgatggacaagagggtgaatgagctgcgggaccggctgtggaagaagaaggccgccctgcagcagaaggagaacctgcctgtgtccagtgatggcaacctgccccagcaggccgccagcgcccccagccgggtggccgctgtgggcccctacatccagagcagcaccatgcccaggatgcccagcaggcctgagctgctggtgaagccagccctgcctgatggcagcctggtgatccaggccagcgagggccccatgaagatccagaccctgcccaacatgaggtctggagctgccagccagaccaagggcagcaagatccaccctgtgggccctgactggagccccagcaatgctgacctcttccccagccagggcagcgcctctgtgccccagagcactggaaatgccctggaccaggtggatgatggagaggtgcccctgcgggagaaggagaagaaggtgcggcccttctccatgtttgatgctgtggaccagagcaatgcccctccttcctttggcaccctgaggaagaaccagagcagcgaggacatcctgagagatgcccaggtggccaacaagaatgtggccaaggtgcccccacctgtgcccaccaagcccaagcagatcaacctgccctacttcggccagaccaaccagccccccagcgacatcaagccagatggcagcagccagcagctgagcacagtggtgcccagcatgggcaccaagcccaagccagctggccagcagccccgggtgctgctgagccccagcatccccagcgtgggccaggaccagaccctgagccctggcagcaagcaggagagccccccagctgctgctgtgcggcccttcaccccccagcccagcaaggacaccctgctgccccccttcaggaagccccagacagtggccgccagcagcatctacagcatgtacacccagcagcaggcccctgggaagaacttccagcaggccgtgcagagcgccctgaccaagacccacacccggggcccccacttcagctctgtgtatggcaagcctgtgattgctgctgcccagaaccagcagcagcaccctgagaacatctacagcaacagccagggcaagccaggcagccctgagcctgagacagagcctgtgtcctctgtgcaggagaaccatgaaaatgaaagaatcccccggcccctgagccccaccaagctgctgcccttcctgagcaacccctacagaaaccagagtgatgctgacctggaggccctgaggaagaagctgagcaatgccccccggcccctgaagaagaggagcagcatcacagagcctgagggccccaacggccccaacatccagaagctgctgtaccagaggaccaccatcgccgccatggagaccatctctgtgcccagctaccccagcaagagcgcctctgtgacagccagcagcgagagccctgtggagatccagaacccctacctgcacgtggagcctgagaaggaggtggtgtccctggtgcctgagagcctgagcccagaagatgtgggcaatgccagcacagaaaattctgacatgcctgcccccagccctggcctggactatgagcctgagggcgtgcctgacaacagccccaacctgcagaacaaccctgaggagcccaaccctgaggcccctcatgtgctggatgtgtacctggaggagtacccaccctacccacctccaccctaccccagcggggagcctgagggccctggagaggacagcgtgtccatgaggcctcctgagatcaccggccaggtgtccctgcccccaggcaagaggaccaacctgaggaagacaggcagcgagcgcatcgcccacggcatgagggtgaagttcaaccccctggccctgctgctggacagcagcctggagggggagtttgacctggtgcagaggatcatctatgaggtggatgaccccagcctgcccaatgatgagggcatcacagccctgcacaatgctgtgtgtgccggccacacagagatcgtgaagttcctggtgcagtttggagtgaatgtgaatgctgctgacagtgatggctggacccccctgcactgtgccgccagctgcaacaacgtgcaggtgtgcaagttcctggtggagagcggggctgctgtgtttgccatgacctacagcgacatgcagacagctgctgacaagtgtgaggagatggaggagggctacacccagtgcagccagttcctgtatggagtgcaggagaagatgggcatcatgaacaagggcgtcatctatgccctgtgggactatgagccccagaatgatgatgagctgcccatgaaggagggggactgcatgaccatcatccaccgggaggatgaagatgaaattgagtggtggtgggcccggctgaatgacaaggagggctacgtgcccaggaacctgctgggcctgtacccccgcatcaagccccggcagaggagcctggcctag

SEQ ID NO: 174902 - DNA, 3018 bp, Artificial Sequence
  Description of Artificial Sequence: Synthetic coding sequence
atggacctgaccctggccgagctgcaggagatggccagccggcagcagcagcagatcgaggcccagcagcagctgctggccaccaaggagcagaggctgaagttcctgaagcagcaggaccagaggcagcagcagcaggtggccgagcaggagaagctgaagaggctgaaggagattgctgagaaccaggaggccaagctgaagaaggtgcgggccctgaagggccacgtggagcagaagaggctgagcaatggcaagctggtggaggagattgagcagatgaacaacctcttccagcagaagcagcgggagctggtgctggccgtgtccaaggtggaggagctgacccggcagctggagatgctgaagaatggaagaattgacagccaccacgacaaccagagcgctgtggccgagctggaccggctgtacaaggagctgcagctgaggaacaagctgaaccaggagcagaatgccaagctgcagcagcagcgggagtgcctgaacaagagaaattctgaggtggccgtgatggacaagagggtgaatgagctgcgggaccggctgtggaagaagaaggccgccctgcagcagaaggagaacctgcctgtgtccagtgatggcaacctgccccagcaggccgccagcgcccccagccgggtggccgctgtgggcccctacatccagagcagcaccatgcccaggatgcccagcaggcctgagctgctggtgaagccagccctgcctgatggcagcctggtgatccaggccagcgagggccccatgaagatccagaccctgcccaacatgaggtctggggccgccagccagaccaagggcagcaagatccaccctgtgggccctgactggagccccagcaatgctgacctcttccccagccagggcagcgcctctgtgccccagagcactggaaatgccctggaccaggtggatgatggagaggtgcccctgcgggagaaggagaagaaggtgcggcccttctccatgtttgatgctgtggaccagagcaatgccccacccagctttggcaccctgaggaagaaccagagcagcgaggacatcctgagagatgcccaggtggccaacaagaatgtggccaaggtgcccccacctgtgcccaccaagcccaagcagatcaacctgccctacttcggccagaccaaccagcccccaagtgacatcaagccagatggcagcagccagcagctgagcacagtggtgcccagcatgggcaccaagcccaagccagctggccagcagccccgggtgctgctgagccccagcatccccagcgtgggccaggaccagaccctgagccctggcagcaagcaggagagccccccagctgctgctgtgcggcccttcaccccccagcccagcaaggacaccctgctgccccccttcaggaagccccagacagtggccgccagcagcatctacagcatgtacacccagcagcaggcccctgggaagaacttccagcaggccgtgcagagcgccctgaccaagacccacacccggggcccccacttcagctctgtgtatggcaagcctgtgattgctgctgcccagaaccagcagcagcaccctgagaacatctacagcaacagccagggcaagccaggcagccctgagcctgagacagagcctgtgtcctctgtgcaggagaaccatgaaaatgaaagaatcccccggcccctgagccccaccaagctgctgcccttcctgagcaacccctacagaaaccagagtgatgctgacctggaggccctgaggaagaagctgagcaatgccccccggcccctgaagaagaggagcagcatcacagagcctgagggccccaacggccccaacatccagaagctgctgtaccagaggaccaccatcgccgccatggagaccatctctgtgcccagctaccccagcaagagcgcctctgtgacagccagcagcgagagccctgtggagatccagaacccctacctgcacgtggagcctgagaaggaggtggtgtccctggtgcctgagagcctgagcccagaagatgtgggcaatgccagcacagagaacagcgacatgcctgcccccagccctggcctggactatgagcctgagggcgtgcctgacaacagccccaacctgcagaacaaccctgaggagcccaaccctgaggccccccacgtgctggatgtgtacctggaggagtacccaccctacccacctccaccctaccccagcggggagcctgagggccctggagaagattctgtgtccatgaggcctcctgagatcaccggccaggtgtccctgcccccaggcaagaggaccaacctgaggaagacaggcagcgagagaattgcccacggcatgagggtgaagttcaaccccctggccctgctgctggacagcagcctggagggggagtttgacctggtgcagaggatcatctatgaggtggatgaccccagcctgcccaatgatgagggcatcacagccctgcacaatgctgtgtgtgccggccacacagaaattgtgaagttcctggtgcagtttggagtgaatgtgaatgctgctgacagtgatggctggacccccctgcactgtgccgccagctgcaacaacgtgcaggtgtgcaagttcctggtggagagcggggctgctgtgtttgccatgacctacagcgacatgcagacagctgctgacaagtgtgaggagatggaggagggctacacccagtgcagccagttcctgtatggagtgcaggagaagatgggcatcatgaacaagggcgtcatctatgccctgtgggactatgagccccagaatgatgatgagctgcccatgaaggagggggactgcatgaccatcatccacagagaagatgaagatgaaattgagtggtggtgggcccggctgaatgacaaggagggctacgtgcccaggaacctgctgggcctgtacccccgcatcaagccccggcagaggagcctggcctag

SEQ ID NO: 174903 - DNA, 1104 bp, Artificial Sequence
  Description of Artificial Sequence: Synthetic coding sequence
atggagaccatctctgtgcccagctaccccagcaagagcgcctctgtgacagccagcagcgagagccctgtggagatccagaacccctacctgcacgtggagcctgagaaggaggtggtgtccctggtgcctgagagcctgagcccagaagatgtgggcaatgccagcacagagaacagcgacatgcctgcccccagccctggcctggactatgagcctgagggcgtgcctgacaacagccccaacctgcagaacaaccctgaggagcccaaccctgaggccccccacgtgctggatgtgtacctggaggagtacccaccctacccacctccaccctaccccagcggggagcctgagggccctggagaagattctgtgtccatgaggcctcctgagatcaccggccaggtgtccctgcccccaggcaagaggaccaacctgaggaagacaggcagcgagagaattgcccacggcatgagggtgaagttcaaccccctggccctgctgctggacagcagcctggagggggagtttgacctggtgcagaggatcatctatgaggtggatgaccccagcctgcccaatgatgagggcatcacagccctgcacaatgctgtgtgtgccggccacacagaaattgtgaagttcctggtgcagtttggagtgaatgtgaatgctgctgacagtgatggctggacccccctgcactgtgccgccagctgcaacaacgtgcaggtgtgcaagttcctggtggagagcggggctgctgtgtttgccatgacctacagcgacatgcagacagctgctgacaagtgtgaggagatggaggagggctacacccagtgcagccagttcctgtatggagtgcaggagaagatgggcatcatgaacaagggcgtcatctatgccctgtgggactatgagccccagaatgatgatgagctgcccatgaaggagggggactgcatgaccatcatccacagagaagatgaagatgaaattgagtggtggtgggcccggctgaatgacaaggagggctacgtgcccaggaacctgctgggcctgtacccccgcatcaagccccggcagaggagcctggcctag

SEQ ID NO: 174904 - DNA, 2043 bp, Artificial Sequence
  Description of Artificial Sequence: Synthetic coding sequence
atgaactttgagaccagccgctgtgccaccctgcagtactgcccagacccctacatccagagatttgtggagaccccagcccacttctcctggaaggagagctactaccgcagcaccatgagccagagcacccagaccaatgagttcctgagccctgaggtgttccagcacatctgggacttcctggagcagcccatctgcagcgtgcagcccatcgacctgaactttgtggatgagcccagtgaagatggagccaccaacaagattgagatctccatggactgcatccgcatgcaggacagcgacctgagtgaccccatgtggccccagtacaccaacctgggcctgctgaacagcatggaccagcagatccagaatggcagcagcagcaccagcccctacaacacagaccacgcccagaacagcgtgacagcccccagcccctatgcccagcccagcagcacctttgatgccctgagccccagccctgccatccccagcaacacagactacccaggcccccacagctttgatgtgtccttccagcagagcagcacagccaagagcgccacctggacctacagcacagagctgaagaagctgtactgccagatcgccaagacctgccccatccagatcaaggtgatgaccccaccaccccagggcgctgtgatccgggccatgcctgtgtacaagaaggccgagcacgtgacagaggtggtgaagcgctgccccaaccacgagctgagccgggagttcaatgaaggccagatcgccccacccagccacctgatccgggtggagggcaacagccacgcccagtatgtggaggaccccatcaccggccggcagagcgtgctggtgccctatgagcccccccaggtgggcacagagttcaccaccgtgctgtacaacttcatgtgcaacagcagctgtgtgggcggcatgaacagaagacccatcctgatcatcgtgaccctggagaccagagatggccaggtgctgggccgccgctgctttgaggcccgcatctgtgcctgccccggccgggacaggaaggcagatgaggacagcatcaggaagcagcaggtgtctgacagcaccaagaatggagatggcaccaagaggcccttccggcagaacacccacggcatccagatgaccagcatcaagaagagaagaagcccagatgatgagctgctgtacctgcctgtgcggggccgggagacctatgagatgctgctgaagatcaaggagagcctggagctgatgcagtacctgccccagcacaccatcgagacctaccggcagcagcagcagcagcagcaccagcacctgctgcagaagcagaccagcatccagagccccagcagctatggcaacagcagcccccccctgaacaagatgaacagcatgaacaagctgcccagcgtgtcccagctgatcaacccccagcagagaaatgccctgacccccaccaccatcccagatggcatgggcgccaacatccccatgatgggcacccacatgcccatggccggggacatgaatggcctgagccccacccaggccctgcccccacccctgtccatgcccagcaccagccactgcaccccacctccaccctaccccacagactgcagcatcgtgtccttcctggcccggctgggctgcagcagctgcctggactacttcaccacccagggcctgaccaccatctaccagatcgagcactacagcatggatgacctggccagcctgaagatccctgagcagttcagacatgccatctggaagggcatcctggaccaccggcagctgcacgagttcagcagccccagccacctgctgcggacccccagcagcgccagcacagtgtctgtgggcagcagcgagaccagaggagagcgggtgattgatgctgtgcgcttcaccctgcggcagaccatctccttccccccaagagatgagtggaatgacttcaactttgacatggatgcccggaggaacaagcagcagaggatcaaggaggagggggagtag

SEQ ID NO: 174905 - DNA, 1533 bp, Artificial Sequence
  Description of Artificial Sequence: Synthetic coding sequence
atgaactttgagaccagccgctgtgccaccctgcagtactgcccagacccctacatccagagatttgtggagaccccagcccacttctcctggaaggagagctactaccgcagcaccatgagccagagcacccagaccaatgagttcctgagccctgaggtgttccagcacatctgggacttcctggagcagcccatctgcagcgtgcagcccatcgacctgaactttgtggatgagcccagtgaagatggagccaccaacaagattgagatctccatggactgcatccgcatgcaggacagcgacctgagtgaccccatgtggccccagtacaccaacctgggcctgctgaacagcatggaccagcagatccagaatggcagcagcagcaccagcccctacaacacagaccacgcccagaacagcgtgacagcccccagcccctatgcccagcccagcagcacctttgatgccctgagccccagccctgccatccccagcaacacagactacccaggcccccacagctttgatgtgtccttccagcagagcagcacagccaagagcgccacctggacctacagcacagagctgaagaagctgtactgccagatcgccaagacctgccccatccagatcaaggtgatgaccccaccaccccagggcgctgtgatccgggccatgcctgtgtacaagaaggccgagcacgtgacagaggtggtgaagcgctgccccaaccacgagctgagccgggagttcaatgaaggccagatcgccccacccagccacctgatccgggtggagggcaacagccacgcccagtatgtggaggaccccatcaccggccggcagagcgtgctggtgccctatgagcccccccaggtgggcacagagttcaccaccgtgctgtacaacttcatgtgcaacagcagctgtgtgggcggcatgaacagaagacccatcctgatcatcgtgaccctggagaccagagatggccaggtgctgggccgccgctgctttgaggcccgcatctgtgcctgccccggccgggacaggaaggcagatgaggacagcatcaggaagcagcaggtgtctgacagcaccaagaatggagatggcaccaagaggcccttccggcagaacacccacggcatccagatgaccagcatcaagaagagaagaagcccagatgatgagctgctgtacctgcctgtgcggggccgggagacctatgagatgctgctgaagatcaaggagagcctggagctgatgcagtacctgccccagcacaccatcgagacctaccggcagcagcagcagcagcagcaccagcacctgctgcagaagcagaccagcatccagagccccagcagctatggcaacagcagcccccccctgaacaagatgaacagcatgaacaagctgcccagcgtgtcccagctgatcaacccccagcagagaaatgccctgacccccaccaccatcccagatggcatgggcgccaacagaagtggcaagtctgagaacccctag

SEQ ID NO: 174906 - DNA, 1761 bp, Artificial Sequence
  Description of Artificial Sequence: Synthetic coding sequence
atgctgtacctggagaacaatgcccagacccagttcagcgagccccagtacaccaacctgggcctgctgaacagcatggaccagcagatccagaatggcagcagcagcaccagcccctacaacacagaccacgcccagaacagcgtgacagcccccagcccctatgcccagcccagcagcacctttgatgccctgagccccagccctgccatccccagcaacacagactacccaggcccccacagctttgatgtgtccttccagcagagcagcacagccaagagcgccacctggacctacagcacagagctgaagaagctgtactgccagatcgccaagacctgccccatccagatcaaggtgatgaccccaccaccccagggcgctgtgatccgggccatgcctgtgtacaagaaggccgagcacgtgacagaggtggtgaagcgctgccccaaccacgagctgagccgggagttcaatgaaggccagatcgccccacccagccacctgatccgggtggagggcaacagccacgcccagtatgtggaggaccccatcaccggccggcagagcgtgctggtgccctatgagcccccccaggtgggcacagagttcaccaccgtgctgtacaacttcatgtgcaacagcagctgtgtgggcggcatgaacagaagacccatcctgatcatcgtgaccctggagaccagagatggccaggtgctgggccgccgctgctttgaggcccgcatctgtgcctgccccggccgggacaggaaggcagatgaggacagcatcaggaagcagcaggtgtctgacagcaccaagaatggagatggcaccaagaggcccttccggcagaacacccacggcatccagatgaccagcatcaagaagagaagaagcccagatgatgagctgctgtacctgcctgtgcggggccgggagacctatgagatgctgctgaagatcaaggagagcctggagctgatgcagtacctgccccagcacaccatcgagacctaccggcagcagcagcagcagcagcaccagcacctgctgcagaagcagaccagcatccagagccccagcagctatggcaacagcagcccccccctgaacaagatgaacagcatgaacaagctgcccagcgtgtcccagctgatcaacccccagcagagaaatgccctgacccccaccaccatcccagatggcatgggcgccaacatccccatgatgggcacccacatgcccatggccggggacatgaatggcctgagccccacccaggccctgcccccacccctgtccatgcccagcaccagccactgcaccccacctccaccctaccccacagactgcagcatcgtgtccttcctggcccggctgggctgcagcagctgcctggactacttcaccacccagggcctgaccaccatctaccagatcgagcactacagcatggatgacctggccagcctgaagatccctgagcagttcagacatgccatctggaagggcatcctggaccaccggcagctgcacgagttcagcagccccagccacctgctgcggacccccagcagcgccagcacagtgtctgtgggcagcagcgagaccagaggagagcgggtgattgatgctgtgcgcttcaccctgcggcagaccatctccttccccccaagagatgagtggaatgacttcaactttgacatggatgcccggaggaacaagcagcagaggatcaaggaggagggggagtag

SEQ ID NO: 174907 - DNA, 1788 bp, Artificial Sequence
  Description of Artificial Sequence: Synthetic coding sequence
atgaactttgagaccagccgctgtgccaccctgcagtactgcccagacccctacatccagagatttgtggagaccccagcccacttctcctggaaggagagctactaccgcagcaccatgagccagagcacccagaccaatgagttcctgagccctgaggtgttccagcacatctgggacttcctggagcagcccatctgcagcgtgcagcccatcgacctgaactttgtggatgagcccagtgaagatggagccaccaacaagattgagatctccatggactgcatccgcatgcaggacagcgacctgagtgaccccatgtggtacagcacagagctgaagaagctgtactgccagatcgccaagacctgccccatccagatcaaggtgatgaccccaccaccccagggcgccgtcatccgggccatgcctgtgtacaagaaggccgagcacgtgacagaggtggtgaagcgctgccccaaccacgagctgagccgggagttcaatgaaggccagatcgccccacccagccacctgatccgggtggagggcaacagccacgcccagtatgtggaggaccccatcaccggccggcagagcgtgctggtgccctatgagcccccccaggtgggcacagagttcaccaccgtgctgtacaacttcatgtgcaacagcagctgtgtgggcggcatgaacagaagacccatcctgatcatcgtgaccctggagaccagagatggccaggtgctgggccgccgctgctttgaggcccgcatctgtgcctgccccggccgggacaggaaggcagatgaagattccatcaggaagcagcaggtgtctgacagcaccaagaatggagatggcaccaagaggcccttccggcagaacacccacggcatccagatgaccagcatcaagaagaggaggagcccagatgatgagctgctgtacctgcctgtgcggggccgggagacctatgagatgctgctgaagatcaaggagagcctggagctgatgcagtacctgccccagcacaccatcgagacctaccggcagcagcagcagcagcagcaccagcacctgctgcagaagcagaccagcatccagagccccagcagctatggcaacagcagcccccccctgaacaagatgaacagcatgaacaagctgcccagcgtgtcccagctgatcaacccccagcagagaaatgccctgacccccaccaccatcccagatggcatgggcgccaacatccccatgatgggcacccacatgcccatggccggggacatgaatggcctgagccccacccaggccctgcccccacccctgtccatgcccagcaccagccactgcaccccacctccaccctaccccacagactgcagcatcgtgtccttcctggcccggctgggctgcagcagctgcctggactacttcaccacccagggcctgaccaccatctaccagatcgagcactacagcatggatgacctggccagcctgaagatccctgagcagttcagacatgccatctggaagggcatcctggaccaccggcagctgcacgagttcagcagccccagccacctgctgcggacccccagcagcgccagcacagtgtctgtgggcagcagcgagaccagaggagagcgggtgattgatgctgtgcgcttcaccctgcggcagaccatctccttccccccaagagatgagtggaatgacttcaactttgacatggatgcccggaggaacaagcagcagaggatcaaggaggagggggagtag

SEQ ID NO: 174908 - DNA, 1668 bp, Artificial Sequence
  Description of Artificial Sequence: Synthetic coding sequence
atgaactttgagaccagccgctgtgccaccctgcagtactgcccagacccctacatccagagatttgtggagaccccagcccacttctcctggaaggagagctactaccgcagcaccatgagccagagcacccagaccaatgagttcctgagccctgaggtgttccagcacatctgggacttcctggagcagcccatctgcagcgtgcagcccatcgacctgaactttgtggatgagcccagtgaagatggagccaccaacaagattgagatctccatggactgcatccgcatgcaggacagcgacctgagtgaccccatgtggccccagtacaccaacctgggcctgctgaacagcatggaccagcagatccagaatggcagcagcagcaccagcccctacaacacagaccacgcccagaacagcgtgacagcccccagcccctatgcccagcccagcagcacctttgatgccctgagccccagccctgccatccccagcaacacagactacccaggcccccacagctttgatgtgtccttccagcagagcagcacagccaagagcgccacctggacctacagcacagagctgaagaagctgtactgccagatcgccaagacctgccccatccagatcaaggtgatgaccccaccaccccagggcgctgtgatccgggccatgcctgtgtacaagaaggccgagcacgtgacagaggtggtgaagcgctgccccaaccacgagctgagccgggagttcaatgaaggccagatcgccccacccagccacctgatccgggtggagggcaacagccacgcccagtatgtggaggaccccatcaccggccggcagagcgtgctggtgccctatgagcccccccaggtgggcacagagttcaccaccgtgctgtacaacttcatgtgcaacagcagctgtgtgggcggcatgaacagaagacccatcctgatcatcgtgaccctggagaccagagatggccaggtgctgggccgccgctgctttgaggcccgcatctgtgcctgccccggccgggacaggaaggcagatgaggacagcatcaggaagcagcaggtgtctgacagcaccaagaatggagatggcaccaagaggcccttccggcagaacacccacggcatccagatgaccagcatcaagaagagaagaagcccagatgatgagctgctgtacctgcctgtgcggggccgggagacctatgagatgctgctgaagatcaaggagagcctggagctgatgcagtacctgccccagcacaccatcgagacctaccggcagcagcagcagcagcagcaccagcacctgctgcagaagcagaccagcatccagagccccagcagctatggcaacagcagcccccccctgaacaagatgaacagcatgaacaagctgcccagcgtgtcccagctgatcaacccccagcagagaaatgccctgacccccaccaccatcccagatggcatgggcgccaacatccccatgatgggcacccacatgcccatggccggggacatgaatggcctgagccccacccaggccctgcccccacccctgtccatgcccagcaccagccactgcaccccacctccaccctaccccacagactgcagcatcgtgcgcatctggcaggtgtag

SEQ ID NO: 174909 - DNA, 1251 bp, Artificial Sequence
  Description of Artificial Sequence: Synthetic coding sequence
atgctgtacctggagaacaatgcccagacccagttcagcgagccccagtacaccaacctgggcctgctgaacagcatggaccagcagatccagaatggcagcagcagcaccagcccctacaacacagaccacgcccagaacagcgtgacagcccccagcccctatgcccagcccagcagcacctttgatgccctgagccccagccctgccatccccagcaacacagactacccaggcccccacagctttgatgtgtccttccagcagagcagcacagccaagagcgccacctggacctacagcacagagctgaagaagctgtactgccagatcgccaagacctgccccatccagatcaaggtgatgaccccaccaccccagggcgctgtgatccgggccatgcctgtgtacaagaaggccgagcacgtgacagaggtggtgaagcgctgccccaaccacgagctgagccgggagttcaatgaaggccagatcgccccacccagccacctgatccgggtggagggcaacagccacgcccagtatgtggaggaccccatcaccggccggcagagcgtgctggtgccctatgagcccccccaggtgggcacagagttcaccaccgtgctgtacaacttcatgtgcaacagcagctgtgtgggcggcatgaacagaagacccatcctgatcatcgtgaccctggagaccagagatggccaggtgctgggccgccgctgctttgaggcccgcatctgtgcctgccccggccgggacaggaaggcagatgaggacagcatcaggaagcagcaggtgtctgacagcaccaagaatggagatggcaccaagaggcccttccggcagaacacccacggcatccagatgaccagcatcaagaagagaagaagcccagatgatgagctgctgtacctgcctgtgcggggccgggagacctatgagatgctgctgaagatcaaggagagcctggagctgatgcagtacctgccccagcacaccatcgagacctaccggcagcagcagcagcagcagcaccagcacctgctgcagaagcagaccagcatccagagccccagcagctatggcaacagcagcccccccctgaacaagatgaacagcatgaacaagctgcccagcgtgtcccagctgatcaacccccagcagagaaatgccctgacccccaccaccatcccagatggcatgggcgccaacagaagtggcaagtctgagaacccctag

SEQ ID NO: 174910 - DNA, 1386 bp, Artificial Sequence
  Description of Artificial Sequence: Synthetic coding sequence
atgctgtacctggagaacaatgcccagacccagttcagcgagccccagtacaccaacctgggcctgctgaacagcatggaccagcagatccagaatggcagcagcagcaccagcccctacaacacagaccacgcccagaacagcgtgacagcccccagcccctatgcccagcccagcagcacctttgatgccctgagccccagccctgccatccccagcaacacagactacccaggcccccacagctttgatgtgtccttccagcagagcagcacagccaagagcgccacctggacctacagcacagagctgaagaagctgtactgccagatcgccaagacctgccccatccagatcaaggtgatgaccccaccaccccagggcgctgtgatccgggccatgcctgtgtacaagaaggccgagcacgtgacagaggtggtgaagcgctgccccaaccacgagctgagccgggagttcaatgaaggccagatcgccccacccagccacctgatccgggtggagggcaacagccacgcccagtatgtggaggaccccatcaccggccggcagagcgtgctggtgccctatgagcccccccaggtgggcacagagttcaccaccgtgctgtacaacttcatgtgcaacagcagctgtgtgggcggcatgaacagaagacccatcctgatcatcgtgaccctggagaccagagatggccaggtgctgggccgccgctgctttgaggcccgcatctgtgcctgccccggccgggacaggaaggcagatgaggacagcatcaggaagcagcaggtgtctgacagcaccaagaatggagatggcaccaagaggcccttccggcagaacacccacggcatccagatgaccagcatcaagaagagaagaagcccagatgatgagctgctgtacctgcctgtgcggggccgggagacctatgagatgctgctgaagatcaaggagagcctggagctgatgcagtacctgccccagcacaccatcgagacctaccggcagcagcagcagcagcagcaccagcacctgctgcagaagcagaccagcatccagagccccagcagctatggcaacagcagcccccccctgaacaagatgaacagcatgaacaagctgcccagcgtgtcccagctgatcaacccccagcagagaaatgccctgacccccaccaccatcccagatggcatgggcgccaacatccccatgatgggcacccacatgcccatggccggggacatgaatggcctgagccccacccaggccctgcccccacccctgtccatgcccagcaccagccactgcaccccacctccaccctaccccacagactgcagcatcgtgcgcatctggcaggtgtag

SEQ ID NO: 174911 - DNA, 1464 bp, Artificial Sequence
  Description of Artificial Sequence: Synthetic coding sequence
atgaactttgagaccagccgctgtgccaccctgcagtactgcccagacccctacatccagagatttgtggagaccccagcccacttctcctggaaggagagctactaccgcagcaccatgagccagagcacccagaccaatgagttcctgagccctgaggtgttccagcacatctgggacttcctggagcagcccatctgcagcgtgcagcccatcgacctgaactttgtggatgagcccagtgaagatggagccaccaacaagattgagatctccatggactgcatccgcatgcaggacagcgacctgagtgaccccatgtggccccagtacaccaacctgggcctgctgaacagcatggaccagcagatccagaatggcagcagcagcaccagcccctacaacacagaccacgcccagaacagcgtgacagcccccagcccctatgcccagcccagcagcacctttgatgccctgagccccagccctgccatccccagcaacacagactacccaggcccccacagctttgatgtgtccttccagcagagcagcacagccaagagcgccacctggacctacagcacagagctgaagaagctgtactgccagatcgccaagacctgccccatccagatcaaggtgatgaccccaccaccccagggcgctgtgatccgggccatgcctgtgtacaagaaggccgagcacgtgacagaggtggtgaagcgctgccccaaccacgagctgagccgggagttcaatgaaggccagatcgccccacccagccacctgatccgggtggagggcaacagccacgcccagtatgtggaggaccccatcaccggccggcagagcgtgctggtgccctatgagcccccccaggtgggcacagagttcaccaccgtgctgtacaacttcatgtgcaacagcagctgtgtgggcggcatgaacagaagacccatcctgatcatcgtgaccctggagaccagagatggccaggtgctgggccgccgctgctttgaggcccgcatctgtgcctgccccggccgggacaggaaggcagatgaggacagcatcaggaagcagcaggtgtctgacagcaccaagaatggagatggcaccaagaggcccttccggcagaacacccacggcatccagatgaccagcatcaagaagagaagaagcccagatgatgagctgctgtacctgcctgtgcggggccgggagacctatgagatgctgctgaagatcaaggagagcctggagctgatgcagtacctgccccagcacaccatcgagacctaccggcagcagcagcagcagcagcaccagcacctgctgcagaagcacctgctgagcgcctgcttcagaaatgagctggtggagccccggcgggagacccccaagcagagtgatgtgttcttccgccacagcaagccacccaacagatctgtgtacccctag

SEQ ID NO: 174912 - DNA, 1182 bp, Artificial Sequence
  Description of Artificial Sequence: Synthetic coding sequence
atgctgtacctggagaacaatgcccagacccagttcagcgagccccagtacaccaacctgggcctgctgaacagcatggaccagcagatccagaatggcagcagcagcaccagcccctacaacacagaccacgcccagaacagcgtgacagcccccagcccctatgcccagcccagcagcacctttgatgccctgagccccagccctgccatccccagcaacacagactacccaggcccccacagctttgatgtgtccttccagcagagcagcacagccaagagcgccacctggacctacagcacagagctgaagaagctgtactgccagatcgccaagacctgccccatccagatcaaggtgatgaccccaccaccccagggcgctgtgatccgggccatgcctgtgtacaagaaggccgagcacgtgacagaggtggtgaagcgctgccccaaccacgagctgagccgggagttcaatgaaggccagatcgccccacccagccacctgatccgggtggagggcaacagccacgcccagtatgtggaggaccccatcaccggccggcagagcgtgctggtgccctatgagcccccccaggtgggcacagagttcaccaccgtgctgtacaacttcatgtgcaacagcagctgtgtgggcggcatgaacagaagacccatcctgatcatcgtgaccctggagaccagagatggccaggtgctgggccgccgctgctttgaggcccgcatctgtgcctgccccggccgggacaggaaggcagatgaggacagcatcaggaagcagcaggtgtctgacagcaccaagaatggagatggcaccaagaggcccttccggcagaacacccacggcatccagatgaccagcatcaagaagagaagaagcccagatgatgagctgctgtacctgcctgtgcggggccgggagacctatgagatgctgctgaagatcaaggagagcctggagctgatgcagtacctgccccagcacaccatcgagacctaccggcagcagcagcagcagcagcaccagcacctgctgcagaagcacctgctgagcgcctgcttcagaaatgagctggtggagccccggcgggagacccccaagcagagtgatgtgttcttccgccacagcaagccacccaacagatctgtgtacccctag

SEQ ID NO: 174913 - DNA, 2031 bp, Artificial Sequence
  Description of Artificial Sequence: Synthetic coding sequence
atgaactttgagaccagccgctgtgccaccctgcagtactgcccagacccctacatccagagatttgtggagaccccagcccacttctcctggaaggagagctactaccgcagcaccatgagccagagcacccagaccaatgagttcctgagccctgaggtgttccagcacatctgggacttcctggagcagcccatctgcagcgtgcagcccatcgacctgaactttgtggatgagcccagtgaagatggagccaccaacaagattgagatctccatggactgcatccgcatgcaggacagcgacctgagtgaccccatgtggccccagtacaccaacctgggcctgctgaacagcatggaccagcagatccagaatggcagcagcagcaccagcccctacaacacagaccacgcccagaacagcgtgacagcccccagcccctatgcccagcccagcagcacctttgatgccctgagccccagccctgccatccccagcaacacagactacccaggcccccacagctttgatgtgtccttccagcagagcagcacagccaagagcgccacctggacctacagcacagagctgaagaagctgtactgccagatcgccaagacctgccccatccagatcaaggtgatgaccccaccaccccagggcgctgtgatccgggccatgcctgtgtacaagaaggccgagcacgtgacagaggtggtgaagcgctgccccaaccacgagctgagccgggagttcaatgaaggccagatcgccccacccagccacctgatccgggtggagggcaacagccacgcccagtatgtggaggaccccatcaccggccggcagagcgtgctggtgccctatgagcccccccaggtgggcacagagttcaccaccgtgctgtacaacttcatgtgcaacagcagctgtgtgggcggcatgaacagaagacccatcctgatcatcgtgaccctggagaccagagatggccaggtgctgggccgccgctgctttgaggcccgcatctgtgcctgccccggccgggacaggaaggcagatgaggacagcatcaggaagcagcaggtgtctgacagcaccaagaatggagatgccttccggcagaacacccacggcatccagatgaccagcatcaagaagagaagaagcccagatgatgagctgctgtacctgcctgtgcggggccgggagacctatgagatgctgctgaagatcaaggagagcctggagctgatgcagtacctgccccagcacaccatcgagacctaccggcagcagcagcagcagcagcaccagcacctgctgcagaagcagaccagcatccagagccccagcagctatggcaacagcagcccccccctgaacaagatgaacagcatgaacaagctgcccagcgtgtcccagctgatcaacccccagcagagaaatgccctgacccccaccaccatcccagatggcatgggcgccaacatccccatgatgggcacccacatgcccatggccggggacatgaatggcctgagccccacccaggccctgcccccacccctgtccatgcccagcaccagccactgcaccccacctccaccctaccccacagactgcagcatcgtgtccttcctggcccggctgggctgcagcagctgcctggactacttcaccacccagggcctgaccaccatctaccagatcgagcactacagcatggatgacctggccagcctgaagatccctgagcagttcagacatgccatctggaagggcatcctggaccaccggcagctgcacgagttcagcagccccagccacctgctgcggacccccagcagcgccagcacagtgtctgtgggcagcagcgagaccagaggagagcgggtgattgatgctgtgcgcttcaccctgcggcagaccatctccttccccccaagagatgagtggaatgacttcaactttgacatggatgcccggaggaacaagcagcagaggatcaaggaggagggggagtag

SEQ ID NO: 174914 - DNA, 1506 bp, Artificial Sequence
  Description of Artificial Sequence: Synthetic coding sequence
atgctgtacctggagaacaatgcccagacccagttcagcgagtacagcacagagctgaagaagctgtactgccagatcgccaagacctgccccatccagatcaaggtgatgaccccaccaccccagggcgccgtcatccgggccatgcctgtgtacaagaaggccgagcacgtgacagaggtggtgaagcgctgccccaaccacgagctgagccgggagttcaatgaaggccagatcgccccacccagccacctgatccgggtggagggcaacagccacgcccagtatgtggaggaccccatcaccggccggcagagcgtgctggtgccctatgagcccccccaggtgggcacagagttcaccaccgtgctgtacaacttcatgtgcaacagcagctgtgtgggcggcatgaacagaagacccatcctgatcatcgtgaccctggagaccagagatggccaggtgctgggccgccgctgctttgaggcccgcatctgtgcctgccccggccgggacaggaaggcagatgaagattccatcaggaagcagcaggtgtctgacagcaccaagaatggagatggcaccaagaggcccttccggcagaacacccacggcatccagatgaccagcatcaagaagaggaggagcccagatgatgagctgctgtacctgcctgtgcggggccgggagacctatgagatgctgctgaagatcaaggagagcctggagctgatgcagtacctgccccagcacaccatcgagacctaccggcagcagcagcagcagcagcaccagcacctgctgcagaagcagaccagcatccagagccccagcagctatggcaacagcagcccccccctgaacaagatgaacagcatgaacaagctgcccagcgtgtcccagctgatcaacccccagcagagaaatgccctgacccccaccaccatcccagatggcatgggcgccaacatccccatgatgggcacccacatgcccatggccggggacatgaatggcctgagccccacccaggccctgcccccacccctgtccatgcccagcaccagccactgcaccccacctccaccctaccccacagactgcagcatcgtgtccttcctggcccggctgggctgcagcagctgcctggactacttcaccacccagggcctgaccaccatctaccagatcgagcactacagcatggatgacctggccagcctgaagatccctgagcagttcagacatgccatctggaagggcatcctggaccaccggcagctgcacgagttcagcagccccagccacctgctgcggacccccagcagcgccagcacagtgtctgtgggcagcagcgagaccagaggagagcgggtgattgatgctgtgcgcttcaccctgcggcagaccatctccttccccccaagagatgagtggaatgacttcaactttgacatggatgcccggaggaacaagcagcagaggatcaaggaggagggggagtag

SEQ ID NO: 174915 - DNA, 1749 bp, Artificial Sequence
  Description of Artificial Sequence: Synthetic coding sequence
atgctgtacctggagaacaatgcccagacccagttcagcgagccccagtacaccaacctgggcctgctgaacagcatggaccagcagatccagaatggcagcagcagcaccagcccctacaacacagaccacgcccagaacagcgtgacagcccccagcccctatgcccagcccagcagcacctttgatgccctgagccccagccctgccatccccagcaacacagactacccaggcccccacagctttgatgtgtccttccagcagagcagcacagccaagagcgccacctggacctacagcacagagctgaagaagctgtactgccagatcgccaagacctgccccatccagatcaaggtgatgaccccaccaccccagggcgctgtgatccgggccatgcctgtgtacaagaaggccgagcacgtgacagaggtggtgaagcgctgccccaaccacgagctgagccgggagttcaatgaaggccagatcgccccacccagccacctgatccgggtggagggcaacagccacgcccagtatgtggaggaccccatcaccggccggcagagcgtgctggtgccctatgagcccccccaggtgggcacagagttcaccaccgtgctgtacaacttcatgtgcaacagcagctgtgtgggcggcatgaacagaagacccatcctgatcatcgtgaccctggagaccagagatggccaggtgctgggccgccgctgctttgaggcccgcatctgtgcctgccccggccgggacaggaaggcagatgaggacagcatcaggaagcagcaggtgtctgacagcaccaagaatggagatgccttccggcagaacacccacggcatccagatgaccagcatcaagaagagaagaagcccagatgatgagctgctgtacctgcctgtgcggggccgggagacctatgagatgctgctgaagatcaaggagagcctggagctgatgcagtacctgccccagcacaccatcgagacctaccggcagcagcagcagcagcagcaccagcacctgctgcagaagcagaccagcatccagagccccagcagctatggcaacagcagcccccccctgaacaagatgaacagcatgaacaagctgcccagcgtgtcccagctgatcaacccccagcagagaaatgccctgacccccaccaccatcccagatggcatgggcgccaacatccccatgatgggcacccacatgcccatggccggggacatgaatggcctgagccccacccaggccctgcccccacccctgtccatgcccagcaccagccactgcaccccacctccaccctaccccacagactgcagcatcgtgtccttcctggcccggctgggctgcagcagctgcctggactacttcaccacccagggcctgaccaccatctaccagatcgagcactacagcatggatgacctggccagcctgaagatccctgagcagttcagacatgccatctggaagggcatcctggaccaccggcagctgcacgagttcagcagccccagccacctgctgcggacccccagcagcgccagcacagtgtctgtgggcagcagcgagaccagaggagagcgggtgattgatgctgtgcgcttcaccctgcggcagaccatctccttccccccaagagatgagtggaatgacttcaactttgacatggatgcccggaggaacaagcagcagaggatcaaggaggagggggagtag

SEQ ID NO: 174916 - DNA, 567 bp, Artificial Sequence
  Description of Artificial Sequence: Synthetic coding sequence
atgatcatctacagagacctgatcagccatgatgagatgttcagtgacatctacaagatccgggagattgctgatggcctgtgcctggaggtggagggcaagatggtgtccaggacagagggcaacattgatgacagcctcatcggcggcaatgccagcgctgagggccctgagggggagggcacagagagcaccgtcatcaccggggtggacatcgtgatgaaccaccacctgcaggagaccagcttcaccaaggaggcctacaagaagtacatcaaggactacatgaagagcatcaagggcaagctggaggagcagaggcctgagcgggtgaagcccttcatgaccggggctgctgagcagatcaagcacatcctggccaacttcaagaactaccagttcttcatcggggagaacatgaacccagatggcatggtggccctgctggactacagagaagatggagtgaccccctacatgatcttcttcaaggatggcctggagatggagaagtgtgtgtccaccaggaagtgggtgaagatcaacaacgtgaagaagaccttctag

SEQ ID NO: 174917 - DNA, 417 bp, Artificial Sequence
  Description of Artificial Sequence: Synthetic coding sequence
atggtgtccaggacagagggcaacattgatgacagcctcatcggcggcaatgccagcgctgagggccctgagggggagggcacagagagcaccgtcatcaccggggtggacatcgtgatgaaccaccacctgcaggagaccagcttcaccaaggaggcctacaagaagtacatcaaggactacatgaagagcatcaagggcaagctggaggagcagaggcctgagcgggtgaagcccttcatgaccggggctgctgagcagatcaagcacatcctggccaacttcaagaactaccagttcttcatcggggagaacatgaacccagatggcatggtggccctgctggactacagagaagatggagtgaccccctacatgatcttcttcaaggatggcctggagatggagaagtgctag

SEQ ID NO: 174918 - DNA, 417 bp, Artificial Sequence; identical to SEQ ID NO: 174917
  Description of Artificial Sequence: Synthetic coding sequence

SEQ ID NO: 174919 - DNA, 483 bp, Artificial Sequence
  Description of Artificial Sequence: Synthetic coding sequence
atgttcagtgacatctacaagatccgggagattgctgatggcctgtgcctggaggtggagggcaagatggtgtccaggacagagggcaacattgatgacagcctcatcggcggcaatgccagcgctgagggccctgagggggagggcacagagagcaccgtcatcaccggggtggacatcgtgatgaaccaccacctgcaggagaccagcttcaccaaggaggcctacaagaagtacatcaaggactacatgaagagcatcaagggcaagctggaggagcagaggcctgagcgggtgaagcccttcatgaccggggctgctgagcagatcaagcacatcctggccaacttcaagaactaccagttcttcatcggggagaacatgaacccagatggcatggtggccctgctggactacagagaagatggagtgaccccctacatgatcttcttcaaggatggcctggagatggagaagtgctag

SEQ ID NO: 174920 - DNA, 519 bp, Artificial Sequence
  Description of Artificial Sequence: Synthetic coding sequence
atgatcatctacagagacctgatcagccatgatgagatgttcagtgacatctacaagatccgggagattgctgatggcctgtgcctggaggtggagggcaagatggtgtccaggacagagggcaacattgatgacagcctcatcggcggcaatgccagcgctgagggccctgagggggagggcacagagagcaccgtcatcaccggggtggacatcgtgatgaaccaccacctgcaggagaccagcttcaccaaggaggcctacaagaagtacatcaaggactacatgaagagcatcaagggcaagctggaggagcagaggcctgagcgggtgaagcccttcatgaccggggctgctgagcagatcaagcacatcctggccaacttcaagaactaccagttcttcatcggggagaacatgaacccagatggcatggtggccctgctggactacagagaagatggagtgaccccctacatgatcttcttcaaggatggcctggagatggagaagtgctag

SEQ ID NO: 174921 - DNA, 1164 bp, Artificial Sequence
  Description of Artificial Sequence: Synthetic coding sequence
atggaggatgatgcccctgtgatctacggcctggagttccaggcccgggccctgaccccccagacagctgagacagatgccatccgcttcctggtgggcacccagagcctgaagtatgacaaccagatccacatcatcgactttgatgatgagaacaacatcatcaacaagaatgtgctgctgcaccaggccggggagatctggcacatcagcgccagccctgctgaccggggcgtgctgaccacctgctacaacagaacaagtgacagcaaggtgctgacctgtgccgctgtgtggaggatgcccaaggagctggagagcggcagccatgagagcccagatgacagcagcagcacagcccagaccctggagctgctgtgccacctggacaacacagcccacggcaacatggcctgtgtggtgtgggagcccatgggagatggcaagaagatcatcagcctggccgacaaccacatcctgctgtgggacctgcaggagagcagcagccaggccgtgctggccagcagcgccagcctggagggcaagggccagctgaagttcaccagcggccgctggagcccccaccacaactgcacccaggtggccacagccaatgacaccaccctgcggggctgggacaccaggtccatgagccagatctactgcattgaaaatgcccacggccagctggtgcgggacctggacttcaaccccaacaagcagtactacctggccagctgtggagatgactgcaaggtgaagttctgggacaccagaaatgtgacagagcctgtgaagaccctggaggagcacagccactgggtgtggaatgtgcgctacaaccacagccatgaccagctggtgctgaccggcagcagtgacagcagggtcatcctgagcaacatggtgtccatcagcagcgagcccttcggccacctggtggatgatgatgacatcagtgaccaggaggaccacaggtctgaggagaagagcaaggagcccctgcaggacaacgtcatcgccacctatgaggagcatgaagattctgtgtatgctgtggactggagcagcgctgacccctggctgtttgccagcctgtcctatgatggccgcctggtgatcaacagagtgccccgggccctgaagtaccacatcctgctgtag

SEQ ID NO: 174922 - DNA, 990 bp, Artificial Sequence
  Description of Artificial Sequence: Synthetic coding sequence
atggccgaggccggcaccggggagcccagccccagcgtggagggggagcacggcacagaatatgacaccctgcccagcgacacagtgtccctgagtgacagcgacagcgacctgagcctgcctggaggagctgaggtggaggccctgagccccatgggcctgcctggagaggaggacagcggcccagatgagccccccagcccccccagcggcctgctgcctgccaccgtgcagcccttccacctgcggggcatgagcagcaccttcagccagaggagccgggacatctttgactgcctggagggcgccgcccggcgggcccccagctctgtggcccacacctccatgtctgacaatggaggcttcaagaggcccctggcccccagcggccgcagccctgtggagggcctgggccgggcccacaggagccctgccagcccccgggtgccccctgtgcctgactatgtggcccaccctgagcgctggaccaagtacagcctggaggatgtgacagaggtgtctgagcagagcaaccaggccacagccctggccttcctgggcagccagagcctggccgcccccacagactgtgtgagcagcttcaaccaggaccccagcagctgtggggagggccgggtcatcttcaccaagcctgtgcggggcgtggaggcccggcatgagaggaagagggtgctgggcaaggtgggggagcccggccggggcggcctgggcaacccagccacagacagaggagagggccctgtggagctggcccacctggccggccctggcagccctgaggccgaggagtggggcagccaccacggcggcctgcaggaggtggaggccctgagcggctctgtgcacagcggctctgtgcccggcctgccccctgtggagaccgtgggcttccacggcagcaggaagaggagccgggaccacttcaggaacaagagcagcagcccagaagatcctggagctgaggtgtag

SEQ ID NO: 174923 - DNA, 798 bp, Artificial Sequence
  Description of Artificial Sequence: Synthetic coding sequence
atggccgaggccggcaccggcctgctgcctgccaccgtgcagcccttccacctgcggggcatgagcagcaccttcagccagaggagccgggacatctttgactgcctggagggcgccgcccggcgggcccccagctctgtggcccacacctccatgtctgacaatggaggcttcaagaggcccctggcccccagcggccgcagccctgtggagggcctgggccgggcccacaggagccctgccagcccccgggtgccccctgtgcctgactatgtggcccaccctgagcgctggaccaagtacagcctggaggatgtgacagaggtgtctgagcagagcaaccaggccacagccctggccttcctgggcagccagagcctggccgcccccacagactgtgtgagcagcttcaaccaggaccccagcagctgtggggagggccgggtcatcttcaccaagcctgtgcggggcgtggaggcccggcatgagaggaagagggtgctgggcaaggtgggggagcccggccggggcggcctgggcaacccagccacagacagaggagagggccctgtggagctggcccacctggccggccctggcagccctgaggccgaggagtggggcagccaccacggcggcctgcaggaggtggaggccctgagcggctctgtgcacagcggctctgtgcccggcctgccccctgtggagaccgtgggcttccacggcagcaggaagaggagccgggaccacttcaggaacaagagcagcagcccagaagatcctggagctgaggtgtag

SEQ ID NO: 174924 - DNA, 339 bp, Artificial Sequence
  Description of Artificial Sequence: Synthetic coding sequence
atggccgaggccggcaccggggagcccagccccagcgtggagggggagcacggcacagaatatgacaccctgcccagcgacacagtgtccctgagtgacagcgacagcgacctgagcctgcctggaggagctgaggtggaggccctgagccccatgggcctgcctggagaggaggacagcggcccagatgagccccccagcccccccagcggcctgctgcctgccaccgtgcagcccttccacctgcggggcatgagcagcaccttcagccagaggagccgggacatctttgactgcctggagggcgccgcccggcgggcccccagctctgtggcctag

SEQ ID NO: 174925 - DNA, 612 bp, Artificial Sequence
  Description of Artificial Sequence: Synthetic coding sequence
atggccgaggccggcaccggggagcccagccccagcgtggagggggagcacggcacagaatatgacaccctgcccagcgacacagtgtccctgagtgacagcgacagcgacctgagcctgcctggaggagctgaggtggaggccctgagccccatgggcctgcctggagaggaggacagcggcccagatgagccccccagcccccccagcggcctgctgcctgccaccgtgcagcccttccacctgcggggcatgagcagcaccttcagccagaggagccgggacatctttgactgcctggagggcgccgcccggcgggcccccagctctgtggcccacacctccatgtctgacaatggaggcttcaagaggcccctggcccccagcggccgcagccctgtggagggcctgggccgggcccacaggagccctgccagcccccgggtgccccctgtgcctgactatgtggcccaccctgagcgctggaccaagtacagcctggaggatgtgacagaggtgtctgagcagagcaaccaggccacagccctggccttcctgggcagccagagcctggccgcccccacagactgtgtgagcagcttcaaccagtag

SEQ ID NO: 174926 - DNA, 627 bp, Artificial Sequence
  Description of Artificial Sequence: Synthetic coding sequence
atggccgaggccggcaccggcctgctgcctgccaccgtgcagcccttccacctgcggggcatgagcagcaccttcagccagaggagccgggacatctttgactgcctggagggcgccgcccggcgggcccccagctctgtggcccacacctccatgtctgacaatggaggcttcaagaggcccctggcccccagcggccgcagccctgtggagggcctgggccgggcccacaggagccctgccagcccccgggtgccccctgtgcctgactatgtggcccaccctgagcgctggaccaagtacagcctggaggatgtgacagaggtgtctgagcagagcaaccaggccacagccctggccttcctgggcagccagagcctggccgcccccacagactgtgtgagcagcttcaaccaggaccccagcagctgtggggagggccgggtcatcttcaccaagcctgtgcggggcgtggaggcccggcatgagaggaagagggtgctgggcaaggtgggggagcccggccggggcggcctgggcaacccagccacagacagaggagagggccctgtggagctggcccacctggccggccctggcagccctgaggccgaggagtggggctag

SEQ ID NO: 174927 - DNA, 990 bp, Artificial Sequence; identical to SEQ ID NO: 174922
  Description of Artificial Sequence: Synthetic coding sequence

SEQ ID NO: 174928 - DNA, 333 bp, Artificial Sequence
  Description of Artificial Sequence: Synthetic coding sequence
atggccgaggccggcaccggggagcccagccccagcgtggagggggagcacggcacagaatatgacaccctgcccagcgacacagtgtccctgagtgacagcgacagcgacctgagcctgcctggaggagctgaggtggaggccctgagccccatgggcctgcctggagaggaggacagcggcccagatgagccccccagcccccccagcggcctgctgcctgccaccgtgcagcccttccacctgcggggcatgagcagcaccttcagccagaggagccgggacatctttgactgcctggagggcgccgcccggcgggcccccagcagctag

SEQ ID NO: 174929 - DNA, 576 bp, Artificial Sequence
  Description of Artificial Sequence: Synthetic coding sequence
atggccgaggccggcaccggggagcccagccccagcgtggagggggagcacggcacagaatatgacaccctgcccagcgacacagtgtccctgagtgacagcgacagcgacctgagcctgcctggaggagctgaggtggaggccctgagccccatgggcctgcctggagaggaggacagcggcccagatgagccccccagcccccccagcggcctgctgcctgccaccgtgcagcccttccacctgcggggcatgagcagcaccttcagccagaggagccgggacatctttgactgcctggagggcgccgcccggcgggcccccagctctgtggcccacacctccatgtctgacaatggaggcttcaagaggcccctggcccccagcggccgcagccctgtggagggcctgggccgggcccacaggagccctgccagcccccgggtgccccctgtgcctgactatgtggcccaccctgagcgctggaccaagtacagcctggaggatgtgacagaggtgtctgagcagagcaaccaggccacagccctggccttcctgggcagccagagcctgtag

SEQ ID NO: 174930 - DNA, 639 bp, Artificial Sequence
  Description of Artificial Sequence: Synthetic coding sequence
atgggccccatgtggaggatgagaggaggagccacccggcggggcagctgctgcggaggagatggagctgctgatggccggggccctggccgcagcggccgggcccggggcggcggcagccccagcggcggcggcggcggcgtgggctggaggggccgggcagatggagcccggcagcagctggaggagagatttgctgacctggccgccagccacctggaggccatccgggccagagatgagtgggaccggcagaatgcccggctgcggcaggagaatgcccggctgcggctggagaacagaaggctgaagcgggagaacagaagcctcttccggcaggccctgcggctgcccggggagggcggcaatggcaccccagctgaggcccggcgggtgcctgaggaggccagcaccaacagaagagcccgggacagcggccgggaggatgagcccggcagcccccgggccctgcgggcccggctggagaagctggaggccatgtacagaagagccctgctgcagctgcacctggagcagaggggcccccggcccagcggggacaaggaggagcagcccctgcaggagccagacagcggcctgcggagccgggacagcgagcccagcggcccctggctgtag

SEQ ID NO: 174931 - DNA, 1047 bp, Artificial Sequence
  Description of Artificial Sequence: Synthetic coding sequence
atgggcgcccggggggcccccagcagaagacggcaggccggccgccgcctgcgctacctgcccaccggcagcttccccttcctgctgctgctgctgctgctgtgcatccagctgggcggcggccagaagaagaaggagaacctgctggccgagaaggtggagcagctgatggagtggagcagccgccgcagcatcttcaggatgaatggagacaagttcaggaagttcatcaaggccccacccaggaactacagcatgattgtgatgttcaccgccctgcagccccagaggcagtgcagcgtgtgccggcaggccaatgaggagtaccagatcctggccaacagctggagatacagcagcgccttctgcaacaagctgttcttctccatggtggactatgatgagggcacagatgtgttccagcagctgaacatgaacagcgcccccaccttcatgcacttcccccccaagggccggcccaagagagctgacacctttgacctgcagagaattggatttgctgctgagcagctggccaagtggattgctgacagaacagatgtgcacatccgggtcttccggccccccaactacagcggcaccatcgccctggccctgctggtgtccctggtgggcggcctgctgtacctgcggaggaacaacctggagttcatctacaacaagacaggctgggccatggtgtccctgtgcatcgtgtttgccatgaccagcggccagatgtggaaccacatccggggccccccctatgcccacaagaacccccacaacggccaggtgtcctacatccacggcagcagccaggcccagtttgtggccgagagccacatcatcctggtgctgaatgctgccatcaccatgggcatggtgctgctgaatgaagctgccaccagcaaaggagatgtgggcaagaggcgcatcatctgcctggtgggcctgggcctggtggtgttcttcttctccttcctgctgagcatcttccgcagcaagtaccacggctacccctacagcgacctggactttgaatag

SEQ ID NO: 174932 - DNA, 1044 bp, Artificial Sequence
  Description of Artificial Sequence: Synthetic coding sequence
atgggcgcccggggggcccccagcagaagacggcaggccggccgccgcctgcgctacctgcccaccggcagcttccccttcctgctgctgctgctgctgctgtgcatccagctgggcggcggccagaagaagaaggagaacctgctggccgagaaggtggagcagctgatggagtggagcagccgccgcagcatcttcaggatgaatggagacaagttcaggaagttcatcaaggccccacccaggaactacagcatgattgtgatgttcaccgccctgcagccccagaggcagtgcagcgtgtgccggcaggccaatgaggagtaccagatcctggccaacagctggagatacagcagcgccttctgcaacaagctgttcttctccatggtggactatgatgagggcacagatgtgttccagcagctgaacatgaacagcgcccccaccttcatgcacttcccccccaagggccggcccaagagagctgacacctttgacctgcagagaattggatttgctgctgagcagctggccaagtggattgctgacagaacagatgtgcacatccgggtcttccggccccccaactacagcggcaccatcgccctggccctgctggtgtccctggtgggcggcctgctgtacctgcggaggaacaacctggagttcatctacaacaagacaggctgggccatggtgtccctgtgcatcgtgtttgccatgaccagcggccagatgtggaaccacatccggggccccccctatgcccacaagaacccccacaacggccaggtgtcctacatccacggcagcagccaggcccagtttgtggccgagagccacatcatcctggtgctgaatgctgccatcaccatgggcatggtgctgctgaatgaagctgccaccagcaaaggagatgtgggcaagaggcgcatcatctgcctggtgggcctgggcctggtggtgttcttcttctccttcctgctgagcatcttccgcagcaagtaccacggctacccctacagcttcctgatcaagtag

SEQ ID NO: 174933 - DNA, 1047 bp, Artificial Sequence; identical to SEQ ID NO: 174931
  Description of Artificial Sequence: Synthetic coding sequence

SEQ ID NO: 174934 - DNA, 1047 bp, Artificial Sequence; identical to SEQ ID NO: 174931
  Description of Artificial Sequence: Synthetic coding sequence

SEQ ID NO: 174935 - DNA, 534 bp, Artificial Sequence
  Description of Artificial Sequence: Synthetic coding sequence
atggcccaccctgtgcagagcgagttccccagcgcccaggagcccggcagcgctgccttcctggacctgcctgagatggagatcctgctgaccaaggccgagaacaaggatgacaagaccctgaacctgagcaagaccctgagcggccccctggacctggagcagaacagccagggcctgcccttcaaggccatcagcgagggccacctggaggcccccctgcccaggagccccagccgggccagcagccggcgggccagcagcatcgccaccaccagctatgcccaggaccaggaggccccccgggactacctgatcctggccgtggtggcctgcttctgccctgtgtggcccctgaacctgatccccctcatcatcagcatcatgagccgcagctccatgcagcagggcaatgtggatggagcccggcggctgggccgcctggcccggctgctgagcatcaccctcatcatcatgggcatcgtcatcatcatggtggccgtgacagtgaacttcaccgtgcagaagaagtag

SEQ ID NO: 174936 - DNA, 1173 bp, Artificial Sequence
  Description of Artificial Sequence: Synthetic coding sequence
atggctgtgtctgagagccagctgaagaagatggtgtccaagtacaagtacagagacctgactgtgcgggagaccgtgaatgtcatcaccctgtacaaggacctgaagcctgtgctggacagctatgtgttcaatgatggcagcagccgggagctgatgaacctgaccggcaccatccctgtgccctaccggggcaacacctacaacatccccatctgcctgtggctgctggacacctacccctacaacccccccatctgctttgtgaagcccaccagctccatgaccatcaagacaggcaagcacgtggatgccaacgggaagatctacctgccctacctgcacgagtggaagcacccccagagcgacctgctgggcctcatccaggtgatgattgtggtgtttggagatgagccccctgtgttcagccggcccatcagcgccagctacccaccctaccaggccaccggcccccccaacaccagctacatgcctggcatgcctgggggcatcagcccctaccccagcggctacccacccaaccccagcggctacccaggctgcccctacccacctgggggcccctacccagccaccaccagcagccagtaccccagccagccccctgtgaccaccgtgggccccagcagagatggcaccatcagcgaggacaccatccgggccagcctcatctctgctgtgtctgacaagctgcgctggaggatgaaggaggagatggaccgggcccaggccgagctgaatgccctgaagaggacagaggaggacctgaagaagggccaccagaagctggaggagatggtgacccggctggaccaggaggtggccgaggtggacaagaacatcgagctgctgaagaagaaggatgaggagctgagcagcgccctggagaagatggagaaccagagcgagaacaatgacattgatgaagtcatcatccccacagcccccctgtacaagcagatcctgaacctgtatgcagaagaaaatgccatcgaggacaccatcttctacctgggggaggccctgcggcggggcgtcatcgacctggatgtgttcctgaagcacgtgcggctgctgagcaggaagcagttccagctgcgggccctgatgcagaaggccaggaagacagctggcctgagtgacctgtactag

SEQ ID NO: 174937 - DNA, 858 bp, Artificial Sequence
  Description of Artificial Sequence: Synthetic coding sequence
atggctgtgtctgagagccagctgaagaagatggtgtccaagccccagagcgacctgctgggcctcatccaggtgatgattgtggtgtttggagatgagccccctgtgttcagccggcccatcagcgccagctacccaccctaccaggccactggaccacccaacaccagctacatgcctggcatgcctgggggcatcagcccctaccccagcggctacccacccaaccccagcggctacccaggctgcccctacccacctgggggcccctacccagccaccaccagcagccagtaccccagccagccccctgtgaccaccgtgggccccagcagagatggcaccatcagcgaggacaccatccgggccagcctcatctctgctgtgtctgacaagctgcgctggaggatgaaggaggagatggaccgggcccaggccgagctgaatgccctgaagaggacagaggaggacctgaagaagggccaccagaagctggaggagatggtgacccggctggaccaggaggtggccgaggtggacaagaacatcgagctgctgaagaagaaggatgaggagctgagcagcgccctggagaagatggagaaccagagtgaaaataatgacattgatgaggtgatcatccccacagcccccctgtacaagcagatcctgaacctgtatgcagaggagaatgccatcgaggacaccatcttctacctgggggaggccctgcggcggggcgtgattgacctggatgtgttcctgaagcacgtgcggctgctgagcaggaagcagttccagctgcgggccctgatgcagaaggccaggaagacagctggcctgagtgacctgtactag

SEQ ID NO: 174938 - DNA, 972 bp, Artificial Sequence
  Description of Artificial Sequence: Synthetic coding sequence
atggcccggggccctggcctggcccccccacccctgcggctgcccctgctgctgctggtgctggccgctgtgacaggccacacagctgcccaggacaactgcacctgccccaccaacaagatgacagtgtgcagcccagatggccctgggggccgctgccagtgccgggccctgggcagcggcatggctgtggactgcagcaccctgaccagcaagtgcctgctgctgaaggccaggatgtctgcccccaagaatgcccggaccctggtgcggcccagcgagcacgccctggtggacaatgatggcctgtatgaccctgactgtgaccctgagggccgcttcaaggcccggcagtgcaaccagacctctgtgtgctggtgtgtgaacagcgtgggcgtgcggaggacagacaagggggacctgagcctgcgctgtgatgagctggtgaggacccaccacatcctgattgacctgcggcaccggcccacagctggggccttcaaccacagcgacctggatgctgagctgcggcggctcttccgggagcgctaccgcctgcaccccaagtttgtggccgctgtgcactatgagcagcccaccatccagatcgagctgcggcagaacaccagccagaaggctgctggagatgtggacattggagatgctgcctactactttgagcgggacatcaagggggagagcctcttccagggccggggcggcctggacctgcgggtgcggggggagcccctgcaggtggagaggaccctcatctactacctggatgagatcccccccaagttctccatgaagaggctgacagctggcctgattgctgtgattgtggtggtggtggtggccctggtggccggcatggctgtgctggtgatcaccaacagaaggaagagcggcaagtacaagaaggtggagatcaaggagctgggggagctgaggaaggagcccagcctgtag

SEQ ID NO: 174939 - DNA, 1353 bp, Artificial Sequence
  Description of Artificial Sequence: Synthetic coding sequence
atgggcgcccctcctggctaccggcccagcgcctgggtgcacctgctgcaccagctgcccagggctgacttccagctgcggcctgtgcccagcgtgtttgccccccaggagcaggagtaccagcaggccctgctgctggtggccgccctggccggcctgggcctgggcctgagcctcatcttcatcgctgtgtacctgatccgcttctgctgctgccggcccccagagcccccaggcagcaagatccccagccctgggggcggctgtgtgacctggagctgcatcgtggccctgctggccggctgcacaggaattggaattggcttctacggcaacagcgagaccagtgatggagtgtcccagctgagcagcgccctgctgcacgccaaccacaccctgagcaccatcgaccacctggtgctggagaccgtggagcggctgggggaggccgtgaggacagagctgaccaccctggaggaggtgctggagcccaggacagagctggtggccgccgcccggggggcccggcggcaggccgaggccgccgcccagcagctgcagggcctggccttctggcagggcgtgcccctgagccccctgcaggtggccgagaatgtgtcctttgtggaggagtaccgctggctggcctacgtgctgctgctgctgctggagctgctggtgtgcctcttcaccctgctgggcctggccaagcagagcaagtggctggtgattgtgatgacagtgatgagcctgctggtgctggtgctgtcctggggctccatgggcctggaggccgccacagctgtgggcctgagtgacttctgcagcaacccagacccctacgtgctgaacctgacccaggaggagaccggcctgagcagtgacatcctgagctactacctgctgtgcaacagagctgtgagcaaccccttccagcagaggctgaccctgagccagagggccctggccaacatccacagccagctgctgggcctggagcgggaggccgtgccccagttccccagcgcccagaagcccctgctgagcctggaggagaccctgaatgtgacagagggcaacttccaccagctggtggccctgctgcactgccgcagcctgcacaaggactatggagctgccctgcggggcctgtgtgaagatgccctggagggcctgctcttcctgctgctcttcagcctgctgtctgctggggccctggccacagccctgtgcagcctgccccgggcctgggccctcttccccccatctgatgattatgatgacacagatgatgatgaccccttcaacccccaggagagcaagagatttgtgcagtggcagagcagcatctag

SEQ ID NO: 174940 - DNA, 1383 bp, Artificial Sequence
  Description of Artificial Sequence: Synthetic coding sequence
atgggcgcccctcctggctaccggcccagcgcctgggtgcacctgctgcaccagctgcccagggctgacttccagctgcggcctgtgcccagcgtgtttgccccccaggagcaggagtaccagcaggccctgctgctggtggccgccctggccggcctgggcctgggcctgagcctcatcttcatcgctgtgtacctgatccgcttctgctgctgccggcccccagagcccccaggcagcaagatccccagccctgggggcggctgtgtgacctggagctgcatcgtggccctgctggccggctgcacaggaattggaattggcttctacggcaacagcgagaccagtgatggagtgtcccagctgagcagcgccctgctgcacgccaaccacaccctgagcaccatcgaccacctggtgctggagaccgtggagcggctgggggaggccgtgaggacagagctgaccaccctggaggaggtgctggagcccaggacagagctggtggccgccgcccggggggcccggcggcaggccgaggccgccgcccagcagctgcagggcctggccttctggcagggcgtgcccctgagccccctgcaggtggccgagaatgtgtcctttgtggaggagtaccgctggctggcctacgtgctgctgctgctgctggagctgctggtgtgcctcttcaccctgctgggcctggccaagcagagcaagtggctggtgattgtgatgacagtgatgagcctgctggtgctggtgctgtcctggggctccatgggcctggaggccgccacagctgtgggcctgagtgacttctgcagcaacccagacccctacgtgctgaacctgacccaggaggagaccggcctgagcagtgacatcctgagctactacctgctgtgcaacagagctgtgagcaaccccttccagcagaggctgaccctgagccagagggccctggccaacatccacagccagctgctgggcctggagcgggaggccgtgccccagttccccagcgcccagaagcccctgctgagcctggaggagaccctgaatgtgacagagggcaacttccaccagctggtggccctgctgcactgccgcagcctgcacaaggactatggagctgccctgcggggcctgtgtgaagatgccctggagggcctgctcttcctgctgctcttcagcctgctgtctgctggggccctggccacagccctgtgcagcctgccccgggcctgggccctcttccccccaagaaaccccagcgccctgtgcagcggcagccggctgtctgagcccctgctgcctgctggcctggagcccggcagccccctgcgctccttccctggctgcagaagaagaccccactag

SEQ ID NO: 174941 - DNA, 1362 bp, Artificial Sequence
  Description of Artificial Sequence: Synthetic coding sequence
atgggcgcccctcctggctaccggcccagcgcctgggtgcacctgctgcaccagctgcccagggctgacttccagctgcggcctgtgcccagcgtgtttgccccccaggagcaggagtaccagcaggaccagagcagcctggccgtgacccagaggcccccacccaccacccccctgcaccggctgcggccccggccccggctgaccccagccctggcccggcggcccccagaggccgcccggggggacccccggccccagagccccccagaggccctgctgctggtggccgccctggccggcctgggcctgggcctgagcctcatcttcatcgctgtgtacctgatccgcttctgctgctgcaggcctcctgagcccccaggcagcaagatccccagccctgggggcggctgtgtgacctggagctgcatcgtggccctgctggccggctgcaccggcatcggcatcggcttctacggcaacagcgagaccagtgatggagtgtcccagctgagcagcgccctgctgcacgccaaccacaccctgagcaccatcgaccacctggtgctggagaccgtggagcggctgggggaggccgtgaggacagagctgaccaccctggaggaggtgctggagcccaggacagagctggtggccgccgcccggggggcccggcggcaggccgaggccgccgcccagcagctgcagggcctggccttctggcagggcgtgcccctgagccccctgcaggtggctgaaaatgtgtcctttgtggaggagtaccgctggctggcctacgtgctgctgctgctgctggagctgctggtgtgcctcttcaccctgctgggcctggccaagcagagcaagtggctggtgattgtgatgacagtgatgagcctgctggtgctggtgctgtcctggggctccatgggcctggaggccgccacagctgtgggcctgagtgacttctgcagcaacccagacccctacgtgctgaacctgacccaggaggagaccggcctgagcagcgaggccgacagcgtgcctgccagcagcggccagcaccccctgcctgctgctggccctggggcccggagctgtgcctctgtgcccttctctgctgaggccagcgctgtgctgggcggggacagtgaatgtgacaggaggaagttcccccctgtgggcggcacagccaccctgccccagcctgcccagggcctgtggtgcagccctgctggccctgtgagaagaagacctggccggcctgccctgcctgccaccctgctgcctgctgtgtgccgctctgctggccactgccccctgcagcctgcccccagcctgggccccctgcccacccagtag

SEQ ID NO: 174942 - DNA, 1356 bp, Artificial Sequence
  Description of Artificial Sequence: Synthetic coding sequence
atgggcgcccctcctggctaccggcccagcgcctgggtgcacctgctgcaccagctgcccagggctgacttccagctgcggcctgtgcccagcgtgtttgccccccaggagcaggagtaccagcaggccctgctgctggtggccgccctggccggcctgggcctgggcctgagcctcatcttcatcgctgtgtacctgatccgcttctgctgctgccggcccccagagcccccaggcagcaagatccccagccctgggggcggctgtgtgacctggagctgcatcgtggccctgctggccggctgcacaggaattggaattggcttctacggcaacagcgagaccagtgatggagtgtcccagctgagcagcgccctgctgcacgccaaccacaccctgagcaccatcgaccacctggtgctggagaccgtggagcggctgggggaggccgtgaggacagagctgaccaccctggaggaggtgctggagcccaggacagagctggtggccgccgcccggggggcccggcggcaggccgaggccgccgcccagcagctgcagggcctggccttctggcagggcgtgcccctgagccccctgcaggtggccgagaatgtgtcctttgtggaggagtaccgctggctggcctacgtgctgctgctgctgctggagctgctggtgtgcctcttcaccctgctgggcctggccaagcagagcaagtggctggtgattgtgatgacagtgatgagcctgctggtgctggtgctgtcctggggctccatgggcctggaggccgccacagctgtgggcctgagtgacttctgcagcaacccagacccctacgtgctgaacctgacccaggaggagaccggcctgagcagtgacatcctgagctactacctgctgtgcaacagagctgtgagcaaccccttccagcagaggctgaccctgagccagagggccctggccaacatccacagccagctgctgggcctggagcgggaggccgtgccccagttccccagcgcccagaagcccctgctgagcctggaggagaccctgaatgtgacagagggcaacttccaccagctggtggccctgctgcactgccgcagcctgcacaaggactatggagctgccctgcggggcctgtgtgaagatgccctggagggcctgctcttcctgctgctcttcagcctgctgtctgctggggccctggccacagccctgtgcagcctgccccgggcctgggccctcttccccccatctgatgattatgatgacacagatgatgatgaccccttcaacccccagcaggagagcaagagatttgtgcagtggcagagcagcatctag

SEQ ID NO: 174943 - DNA, 1155 bp, Artificial Sequence
  Description of Artificial Sequence: Synthetic coding sequence
atgacccggcggggcagaagaagaagcagccacttcctgggccccccagctggagctgctggctgcacccagaggaggagccgggagctggccgctgctgccatgagccaccagacaggcatccaggcctctgaagatgtgaaggagatctttgcccgggccagaaatggcaagtaccgcctgctgaagatcagcattgaaaatgagcagctggtgattggcagctacagccagcccagcgacagctgggacaaggactatgacagctttgtgctgcccctgctggaggacaagcagccctgctacatcctcttccggctggacagccagaatgcccagggctatgagtggatcttcatcgcctggagcccagaccacagccacgtgcggcagaagatgctgtatgctgccacccgggccaccctgaagaaggagtttggaggcggccacatcaaggatgaggtgtttggcaccgtgaaggaggatgtgtccctgcacggctacaagaagtacctgctgagccagagcagccctgcccccctgacagctgctgaggaggagctgcggcagatcaagatcaatgaggtgcagacagatgtgggcgtggacaccaagcaccagaccctgcagggcgtggccttccccatcagccgggaggccttccaggccctggagaagctgaacaaccggcagctgaactacgtgcagctggagattgacatcaagaatgagatcatcatcctggccaacaccaccaacacagagctgaaggacctgcccaagaggatccccaaggacagcgcccgctaccacttcttcctgtacaagcacagccatgaaggagactacctggagagcatcgtgttcatctacagcatgcctggctacacctgcagcatccgggagaggatgctgtacagcagctgcaagagccggctgctggagatcgtggagcggcagctgcagatggatgtgatcaggaagattgaaattgacaatggagatgagctgacagctgacttcctgtatgaggaggtgcaccccaagcagcacgcccacaagcagagctttgccaagcccaagggccctgctgggaagaggggcatccggcggctcatccggggccctgctgagacagaggccaccacagactag

SEQ ID NO: 174944 - DNA, 1053 bp, Artificial Sequence
  Description of Artificial Sequence: Synthetic coding sequence
atgagccaccagacaggcatccaggcctctgaagatgtgaaggagatctttgcccgggccagaaatggcaagtaccgcctgctgaagatcagcattgaaaatgagcagctggtgattggcagctacagccagcccagcgacagctgggacaaggactatgacagctttgtgctgcccctgctggaggacaagcagccctgctacatcctcttccggctggacagccagaatgcccagggctatgagtggatcttcatcgcctggagcccagaccacagccacgtgcggcagaagatgctgtatgctgccacccgggccaccctgaagaaggagtttggaggcggccacatcaaggatgaggtgtttggcaccgtgaaggaggatgtgtccctgcacggctacaagaagtacctgctgagccagagcagccctgcccccctgacagctgctgaggaggagctgcggcagatcaagatcaatgaggtgcagacagatgtgggcgtggacaccaagcaccagaccctgcagggcgtggccttccccatcagccgggaggccttccaggccctggagaagctgaacaaccggcagctgaactacgtgcagctggagattgacatcaagaatgagatcatcatcctggccaacaccaccaacacagagctgaaggacctgcccaagaggatccccaaggacagcgcccgctaccacttcttcctgtacaagcacagccatgaaggagactacctggagagcatcgtgttcatctacagcatgcctggctacacctgcagcatccgggagaggatgctgtacagcagctgcaagagccggctgctggagatcgtggagcggcagctgcagatggatgtgatcaggaagattgaaattgacaatggagatgagctgacagctgacttcctgtatgaggaggtgcaccccaagcagcacgcccacaagcagagctttgccaagcccaagggccctgctgggaagaggggcatccggcggctcatccggggccctgctgagacagaggccaccacagactag

SEQ ID NO: 174945 - DNA, 1074 bp, Artificial Sequence
  Description of Artificial Sequence: Synthetic coding sequence
atgagccaccagacaggcatccaggcctctgaagatgtgaaggagatctttgcccgggccagaaatggcaagtaccgcctgctgaagatcagcattgaaaatgagcagctggtgattggcagctacagccagcccagcgacagctgggacaaggactatgacagctttgtgctgcccctgctggaggacaagcagccctgctacatcctcttccggctggacagccagaatgcccagggctatgagtggatcttcatcgcctggagcccagaccacagccacgtgcggcagaagatgctgtatgctgccacccgggccaccctgaagaaggagtttggaggcggccacatcaaggatgaggtgtttggcaccgtgaaggaggatgtgtccctgcacggctacaagaagtacctgctgagccagagcagccctgcccccctgacagctgctgaggaggagctgcggcagatcaagatcaatgaaagccctgaggaccacatcggcgtgcagacagatgtgggcgtggacaccaagcaccagaccctgcagggcgtggccttccccatcagccgggaggccttccaggccctggagaagctgaacaaccggcagctgaactacgtgcagctggagattgacatcaagaatgagatcatcatcctggccaacaccaccaacacagagctgaaggacctgcccaagaggatccccaaggacagcgcccgctaccacttcttcctgtacaagcacagccatgaaggagactacctggagagcatcgtgttcatctacagcatgcctggctacacctgcagcatccgggagaggatgctgtacagcagctgcaagagccggctgctggagatcgtggagcggcagctgcagatggatgtgatcaggaagattgaaattgacaatggagatgagctgacagctgacttcctgtatgaggaggtgcaccccaagcagcacgcccacaagcagagctttgccaagcccaagggccctgctgggaagaggggcatcagaagactcatccggggccctgctgagacagaggccaccacagactag

SEQ ID NO: 174946 - DNA, 1050 bp, Artificial Sequence
  Description of Artificial Sequence: Synthetic coding sequence
atggcccaccagacaggcatccacgccacagaggagctgaaggagttctttgccaaggcccgggccggctctgtgcggctcatcaaggtggtgattgaagatgagcagctggtgctgggcgccagccaggagcctgtgggccgctgggaccaggactatgacagagctgtgctgcccctgctggatgcccagcagccctgctacctgctgtaccgcctggacagccagaatgcccagggctttgagtggctgttcctggcctggagcccagacaacagccctgtgcggctgaagatgctgtatgctgccacccgggccaccgtgaagaaggagtttggaggcggccacatcaaggatgagctgtttggcaccgtgaaggatgacctgagctttgctggctaccagaagcacctgagcagctgtgccgccccagcccccctgaccagcgctgagcgggagctgcagcagatccgcatcaatgaggtgaagacagagatctctgtggagagcaagcaccagaccctgcagggcctggccttccccctgcagcctgaggcccagagggccctgcagcagctgaagcagaagatggtgaactacatccagatgaagctggacctggagcgggagaccatcgagctggtgcacacagagcccacagatgtggcccagctgcccagccgggtgcccagagatgctgcccgctaccacttcttcctgtacaagcacacccatgaaggagaccccctggagagcgtggtgttcatctacagcatgcctggctacaagtgcagcatcaaggagaggatgctgtacagcagctgcaagagccggctgctggacagcgtggagcaggacttccacctggagatcgccaagaagattgaaattggagatggagctgagctgacagctgagttcctgtatgatgaggtgcaccccaagcagcacgccttcaagcaggcctttgccaagcccaagggccctgggggcaagaggggccacaagaggctcatccggggccctggagaaaatggagatgacagctag

SEQ ID NO: 174947 - DNA, 483 bp, Artificial Sequence
  Description of Artificial Sequence: Synthetic coding sequence
atggaggagggcagcagcagccctgtgtcccctgtggacagcctgggcaccagcgaggaggagctggagcggcagcccaagagatttggaaggaagaggcgctacagcaagaagagcagtgaagatggcagccccaccccaggcaagaggggcaagaagggcagccccagcgcccagagctttgaggagctgcagagccagaggatcctggccaacgtgcgggagcggcagaggacccagagcctgaatgaggcctttgctgccctgaggaagatcatccccaccctgcccagcgacaagctgagcaagatccagaccctgaagctggccgcccgctacatcgacttcctgtaccaggtgctgcagagtgatgagatggacaacaagatgaccagctgcagctatgtggcccacgagcggctgtcctatgccttctctgtgtggaggatggagggcgcctggagcatgtctgccagccactag

SEQ ID NO: 174948 - DNA, 1476 bp, Artificial Sequence
  Description of Artificial Sequence: Synthetic coding sequence
atgaacccagctgctgaggccgagttcaacatcctgctggccacagacagctacaaggtgacccactacaagcagtacccacccaacaccagcaaggtgtacagctactttgagtgccgggagaagaagacagagaacagcaagctgaggaaggtgaagtatgaggagaccgtcttctacggcctgcagtacatcctgaacaagtacctgaagggcaaggtggtgaccaaggagaagatccaggaggccaaggatgtgtacaaggagcacttccaggatgatgtgttcaatgagaagggctggaactacatcctggagaagtatgatggccacctgcccatcgagatcaaggctgtgcctgagggctttgtgatccccagaggaaatgtgctcttcaccgtggagaacacagatcctgagtgctactggctgaccaactggattgagaccatcctggtgcagagctggtaccccatcaccgtggccaccaacagccgggagcagaagaagatcctggccaagtacctgctggagaccagcggcaacctggatggcctggagtacaagctgcatgactttggctacagaggagtgagcagccaggagacagctggcatcggggccagcgcccacctggtgaacttcaagggcacagacacagtggccggcctggccctgatcaagaagtactacggcaccaaggaccctgtgcccggctacagcgtgcctgctgctgagcacagcaccatcacagcctggggcaaggaccacgagaaggatgcctttgagcacatcgtgacccagttcagctctgtgcctgtgtctgtggtgtctgacagctatgacatctacaatgcctgtgagaagatctggggcgaggacctgcggcacctgattgtgagccgcagcacccaggcccccctcatcatccggccagacagcggcaaccccctggacacagtgctgaaggtgctggagatcctgggcaagaagtttcctgtgacagagaacagcaagggctacaagctgctgcccccctacctgcgggtcatccagggagatggagtggacatcaacaccctgcaggagatcgtggagggcatgaagcagaagatgtggagcattgagaacatcgccttcggcagcggcggcggcctgctgcagaagctgacccgggacctgctgaactgcagcttcaagtgcagctatgtggtgaccaacggcctgggcatcaacgtgttcaaggaccctgtggccgaccccaacaagaggagcaagaagggccgcctgagcctgcacaggaccccagctggcaactttgtgaccctggaggagggcaaaggagacctggaggagtatggccaggacctgctgcacacagtgttcaagaatggcaaggtgaccaagagctacagctttgatgagatcaggaagaatgcccagctgaacatcgagctggaggccgcccaccactag

SEQ ID NO: 174949 - DNA, 672 bp, Artificial Sequence
  Description of Artificial Sequence: Synthetic coding sequence
atgaagctgcactacgtggccgtgctgaccctggccatcctgatgttcctgacctggctgcctgagagcctgagctgcaacaaggccctgtgtgccagtgatgtgtccaaatgtctcatccaggagctgtgccagtgcaggcctggagagggcaactgcagctgctgcaaggagtgcatgctgtgcctgggcgccctgtgggatgagtgctgtgactgtgtgggcatgtgcaaccccaggaactacagcgacaccccacccaccagcaagagcacagtggaggagctgcacgagcccatccccagcctcttccgggccctgacagaaggagacacccagctgaactggaacatcgtgtccttccctgtggccgaggagctgagccaccacgagaacctggtgtccttcctggagaccgtgaaccagccccaccaccagaatgtgtctgtgcccagcaacaacgtgcacgccccctacagcagtgacaaggagcacatgtgcaccgtggtgtactttgatgactgcatgagcatccaccagtgcaagatcagctgtgagagcatgggcgccagcaagtaccgctggttccacaatgcctgctgtgagtgcatcggcccagaatgtattgattatggcagcaagacagtgaagtgcatgaactgcatgttttag

SEQ ID NO: 174950 - DNA, 2451 bp, Artificial Sequence
  Description of Artificial Sequence: Synthetic coding sequence
atggctgtgtccctggatgatgatgtgcccctcatcctgaccctggatgagggcggcagcgcccccctggcccccagcaatggcctgggccaggaggagctgcccagcaagaatggaggcagctatgccatccatgacagccaggcccccagcctgagcagcggcggggagagcagccccagcagccctgcccacaactgggagatgaactaccaggaggccgccatctacctgcaggagggggagaacaatgacaagttcttcacccaccccaaggatgccaaggccctggccgcctacctgtttgcccacaaccacctgttctacctgatggagctggccacagccctgctgctgctgctgctgagcctgtgtgaggccccagctgtgcctgccctgcggctgggcatctacgtgcacgccaccctggagctgtttgccctgatggtggtggtgtttgagctgtgcatgaagctgcgctggctgggcctgcacaccttcatccgccacaagaggaccatggtgaagacctctgtgctggtggtgcagtttgtggaggccatcgtggtgctggtgcggcagatgagccacgtgcgggtgacccgggccctgcgctgcatcttcctggtggactgccgctactgcggcggcgtgagaagaaacctgcggcagatcttccagagcctgccccccttcatggacatcctgctgctgctgctcttcttcatgatcatctttgccatcctgggcttctacctgttcagccccaaccccagcgacccctacttcagcaccctggagaacagcatcgtgtccctgtttgtgctgctgaccacagccaacttcccagatgtgatgatgcccagctacagcaggaacccctggagctgtgtgttcttcatcgtgtacctgagcattgagctgtacttcatcatgaacctgctgctggccgtggtgtttgacaccttcaatgacatcgagaagaggaagttcaagagcctgctgctgcacaagaggacagccatccagcacgcctaccgcctgctgatcagccagaggaggcctgctggcatctcctaccggcagtttgagggcctgatgaggttctacaagcccaggatgtctgcccgggagcgctacctgaccttcaaggccctgaaccagaacaacacccccctgctgagcctgaaggacttctatgacatctatgaggtggccgccctgaagtggaaggccaagaagaaccgggagcactggtttgatgagctgcccaggacagccctgctgatcttcaagggcatcaacatcctggtgaagagcaaggccttccagtacttcatgtacctggtggtggccgtgaatggagtgtggatcctggtggagaccttcatgctgaagggcggcaacttcttcagcaagcacgtgccctggagctacctggtgttcctgaccatctacggcgtggagctgttcctgaaggtggccggcctgggccctgtggagtacctgagcagcggctggaacctgtttgacttctctgtgacagtgtttgccttcctgggcctgctggccctggccctgaacatggagcccttctacttcatcgtggtgctgcggcccctgcagctgctgcggctcttcaagctgaaggagcgctacagaaatgtgctggacaccatgtttgagctgctgcccaggatggccagcctgggcctgaccctgctgatcttctactacagctttgccatcgtgggcatggagttcttctgtggcatcgtgttccccaactgctgcaacaccagcacagtggctgatgcctaccgctggaggaaccacacagtgggcaacagaacagtggtggaggagggctactactacctgaacaactttgacaacatcctgaacagctttgtgaccctgtttgagctgactgtggtgaacaactggtacatcatcatggagggcgtgaccagccagaccagccactggagccggctgtacttcatgaccttctacatcgtgaccatggtggtgatgaccatcatcgtggccttcatcctggaggcctttgtgttcaggatgaactacagcaggaagaaccaggacagcgaggtggatggcggcatcaccctggagaaggagatcagcaaggaggagctggtggccgtgctggagctgtaccgggaggcccggggggccagcagtgatgtgacccggctgctggagaccctgagccagatggagcgctaccagcagcacagcatggtgttcctgggccgccgcagcaggaccaagagtgacctgagcctgaagatgtaccaggaggagatccaggagtggtatgaggagcacgcccgggagcaggagcagcagaggcagctgagcagcagcgctgccccagctgcccagcagcccccaggcagccggcagaggagccagacagtgacctag

SEQ ID NO: 174951 - DNA, 2247 bp, Artificial Sequence
  Description of Artificial Sequence: Synthetic coding sequence
atgaactaccaggaggccgccatctacctgcaggagggggagaacaatgacaagttcttcacccaccccaaggatgccaaggccctggccgcctacctgtttgcccacaaccacctgttctacctgatggagctggccacagccctgctgctgctgctgctgagcctgtgtgaggccccagctgtgcctgccctgcggctgggcatctacgtgcacgccaccctggagctgtttgccctgatggtggtggtgtttgagctgtgcatgaagctgcgctggctgggcctgcacaccttcatccgccacaagaggaccatggtgaagacctctgtgctggtggtgcagtttgtggaggccatcgtggtgctggtgcggcagatgagccacgtgcgggtgacccgggccctgcgctgcatcttcctggtggactgccgctactgcggcggcgtgagaagaaacctgcggcagatcttccagagcctgccccccttcatggacatcctgctgctgctgctcttcttcatgatcatctttgccatcctgggcttctacctgttcagccccaaccccagcgacccctacttcagcaccctggagaacagcatcgtgtccctgtttgtgctgctgaccacagccaacttcccagatgtgatgatgcccagctacagcaggaacccctggagctgtgtgttcttcatcgtgtacctgagcattgagctgtacttcatcatgaacctgctgctggccgtggtgtttgacaccttcaatgacatcgagaagaggaagttcaagagcctgctgctgcacaagaggacagccatccagcacgcctaccgcctgctgatcagccagaggaggcctgctggcatctcctaccggcagtttgagggcctgatgaggttctacaagcccaggatgtctgcccgggagcgctacctgaccttcaaggccctgaaccagaacaacacccccctgctgagcctgaaggacttctatgacatctatgaggtggccgccctgaagtggaaggccaagaagaaccgggagcactggtttgatgagctgcccaggacagccctgctgatcttcaagggcatcaacatcctggtgaagagcaaggccttccagtacttcatgtacctggtggtggccgtgaatggagtgtggatcctggtggagaccttcatgctgaagggcggcaacttcttcagcaagcacgtgccctggagctacctggtgttcctgaccatctacggcgtggagctgttcctgaaggtggccggcctgggccctgtggagtacctgagcagcggctggaacctgtttgacttctctgtgacagtgtttgccttcctgggcctgctggccctggccctgaacatggagcccttctacttcatcgtggtgctgcggcccctgcagctgctgcggctcttcaagctgaaggagcgctacagaaatgtgctggacaccatgtttgagctgctgcccaggatggccagcctgggcctgaccctgctgatcttctactacagctttgccatcgtgggcatggagttcttctgtggcatcgtgttccccaactgctgcaacaccagcacagtggctgatgcctaccgctggaggaaccacacagtgggcaacagaacagtggtggaggagggctactactacctgaacaactttgacaacatcctgaacagctttgtgaccctgtttgagctgactgtggtgaacaactggtacatcatcatggagggcgtgaccagccagaccagccactggagccggctgtacttcatgaccttctacatcgtgaccatggtggtgatgaccatcatcgtggccttcatcctggaggcctttgtgttcaggatgaactacagcaggaagaaccaggacagcgaggtggatggcggcatcaccctggagaaggagatcagcaaggaggagctggtggccgtgctggagctgtaccgggaggcccggggggccagcagtgatgtgacccggctgctggagaccctgagccagatggagcgctaccagcagcacagcatggtgttcctgggccgccgcagcaggaccaagagtgacctgagcctgaagatgtaccaggaggagatccaggagtggtatgaggagcacgcccgggagcaggagcagcagaggcagctgagcagcagcgctgccccagctgcccagcagcccccaggcagccggcagaggagccagacagtgacctag

SEQ ID NO: 174952 - DNA, 2667 bp, Artificial Sequence
  Description of Artificial Sequence: Synthetic coding sequence
atggagagctgctacatcgcccaggccggcctggagctgctgggcagcagcagcagccccaccctgaccagccagagcgctgagatcacagaagatgccagcaatggaggagtgtctgagcagcacccctggcccagcggctttgagcgggagctgaagccagagaccatcagcagccctggctaccacatcctgcgggccaccggggaggagaacatggctgtgtccctggatgatgatgtgcccctcatcctgaccctggatgagggcggcagcgcccccctggcccccagcaatggcctgggccaggaggagctgcccagcaagaatggaggcagctatgccatccatgacagccaggcccccagcctgagcagcggcggggagagcagccccagcagccctgcccacaactgggagatgaactaccaggaggccgccatctacctgcaggagggggagaacaatgacaagttcttcacccaccccaaggatgccaaggccctggccgcctacctgtttgcccacaaccacctgttctacctgatggagctggccacagccctgctgctgctgctgctgagcctgtgtgaggccccagctgtgcctgccctgcggctgggcatctacgtgcacgccaccctggagctgtttgccctgatggtggtggtgtttgagctgtgcatgaagctgcgctggctgggcctgcacaccttcatccgccacaagaggaccatggtgaagacctctgtgctggtggtgcagtttgtggaggccatcgtggtgctggtgcggcagatgagccacgtgcgggtgacccgggccctgcgctgcatcttcctggtggactgccgctactgcggcggcgtgagaagaaacctgcggcagatcttccagagcctgccccccttcatggacatcctgctgctgctgctcttcttcatgatcatctttgccatcctgggcttctacctgttcagccccaaccccagcgacccctacttcagcaccctggagaacagcatcgtgtccctgtttgtgctgctgaccacagccaacttcccagatgtgatgatgcccagctacagcaggaacccctggagctgtgtgttcttcatcgtgtacctgagcattgagctgtacttcatcatgaacctgctgctggccgtggtgtttgacaccttcaatgacatcgagaagaggaagttcaagagcctgctgctgcacaagaggacagccatccagcacgcctaccgcctgctgatcagccagaggaggcctgctggcatctcctaccggcagtttgagggcctgatgaggttctacaagcccaggatgtctgcccgggagcgctacctgaccttcaaggccctgaaccagaacaacacccccctgctgagcctgaaggacttctatgacatctatgaggtggccgccctgaagtggaaggccaagaagaaccgggagcactggtttgatgagctgcccaggacagccctgctgatcttcaagggcatcaacatcctggtgaagagcaaggccttccagtacttcatgtacctggtggtggccgtgaatggagtgtggatcctggtggagaccttcatgctgaagggcggcaacttcttcagcaagcacgtgccctggagctacctggtgttcctgaccatctacggcgtggagctgttcctgaaggtggccggcctgggccctgtggagtacctgagcagcggctggaacctgtttgacttctctgtgacagtgtttgccttcctgggcctgctggccctggccctgaacatggagcccttctacttcatcgtggtgctgcggcccctgcagctgctgcggctcttcaagctgaaggagcgctacagaaatgtgctggacaccatgtttgagctgctgcccaggatggccagcctgggcctgaccctgctgatcttctactacagctttgccatcgtgggcatggagttcttctgtggcatcgtgttccccaactgctgcaacaccagcacagtggctgatgcctaccgctggaggaaccacacagtgggcaacagaacagtggtggaggagggctactactacctgaacaactttgacaacatcctgaacagctttgtgaccctgtttgagctgactgtggtgaacaactggtacatcatcatggagggcgtgaccagccagaccagccactggagccggctgtacttcatgaccttctacatcgtgaccatggtggtgatgaccatcatcgtggccttcatcctggaggcctttgtgttcaggatgaactacagcaggaagaaccaggacagcgaggtggatggcggcatcaccctggagaaggagatcagcaaggaggagctggtggccgtgctggagctgtaccgggaggcccggggggccagcagtgatgtgacccggctgctggagaccctgagccagatggagcgctaccagcagcacagcatggtgttcctgggccgccgcagcaggaccaagagtgacctgagcctgaagatgtaccaggaggagatccaggagtggtatgaggagcacgcccgggagcaggagcagcagaggcagctgagcagcagcgctgccccagctgcccagcagcccccaggcagccggcagaggagccagacagtgacctag

SEQ ID NO: 174953 - DNA, 2667 bp, Artificial Sequence; identical to SEQ ID NO: 174952
  Description of Artificial Sequence: Synthetic coding sequence

SEQ ID NO: 174954 - DNA, 258 bp, Artificial Sequence
  Description of Artificial Sequence: Synthetic coding sequence
atggctgtgtccctggatgatgatgtgcccctcatcctgaccctggatgagggcggcagcgcccccctggcccccagcaatggcctgggccaggaggagctgcccagcaagaatggaggcagctatgccatccatgacagccaggcccccagcctgagcagcggcggggagagcagccccagcagccctgcccacaactgggagatgaactaccaggaggccgccatctacctgcaggagggggagaacaatgactag

SEQ ID NO: 174955 - DNA, 303 bp, Artificial Sequence
  Description of Artificial Sequence: Synthetic coding sequence
atggctgtgtccctggatgatgatgtgcccctcatcctgaccctggatgagggcggcagcgcccccctggcccccagcaatggcctgggccaggaggagctgcccagcaagaggcgctgctgcatgctgtgcagcagcaagcagaagccctggatcccctgcagggtcatcagtgatgtggcctgcaaggccgccagctgctttgagggcgccagcggcccctgtgacatctccatgtgggagtgctacagagtgtgcaagcagatggctgctgccatgcccagcaccaccccccggccctag

SEQ ID NO: 174956 - DNA, 2259 bp, Artificial Sequence
  Description of Artificial Sequence: Synthetic coding sequence
atggccgagccccaggccgagagcgagcccctgctgggcggggcccggggcggcggcggggactggccagctggcctgaccacctaccgcagcatccaggtgggccctggagctgctgcccgctgggacctgtgcatcgaccaggccgtggtgttcattgaagatgccatccagtaccgcagcatcaaccaccgggtggatgccagctccatgtggctgtaccgccgctactacagcaatgtgtgccagaggaccctgtccttcaccatcttcctgatcctcttcctggccttcatcgagacccccagcagcctgaccagcacagcagatgtgcgctacagagctgccccctgggagcccccctgtggcctgacagaatctgtggaggtgctgtgcctgctggtgtttgctgctgacctgtctgtgaagggctacctgtttggctgggcccacttccagaagaacctgtggctgctgggctacctggtggtgctggtggtgtccctggtggactggacagtgtccctgagcctggtgtgccacgagcccctgcgcatccggcggctgctgcggcccttcttcctgctgcagaacagctccatgatgaagaagaccctgaagtgcatccgctggagcctgcctgagatggcctctgtgggcctgctgctggccatccacctgtgcctcttcaccatgtttggcatgctgctgtttgctgggggcaagcaggatgatggccaggaccgggagcggctgacctacttccagaacctgcctgagagcctgaccagcctgctggtgctgctgaccacagccaacaacccagatgtgatgatcccagcctacagcaagaacagagcctatgccatcttcttcatcgtgttcaccgtcatcggcagcctcttcctgatgaacctgctgacagccatcatctacagccagttccggggctacctgatgaagagcctgcagaccagcctcttcagaagaaggctgggcacccgggccgcctttgaggtgctgagctccatggtgggggagggcggggccttcccccaggccgtgggcgtgaagccccagaacctgctgcaggtgctgcagaaggtgcagctggacagcagccacaagcaggccatgatggagaaggtgcgctcctatggctctgtgctgctgtctgctgaggagttccagaagctgttcaatgagctggacagatctgtggtgaaggagcacccccccaggcctgagtaccagagccccttcctgcagagcgcccagttcctgtttggccactactactttgactacctgggcaacctgattgccctggccaacctggtgtccatctgtgtgttcctggtgctggatgctgatgtgctgcctgctgagagagatgacttcatcctgggcatcctgaactgtgtgttcatcgtgtactacctgctggagatgctgctgaaggtgtttgccctgggcctgcggggctacctgagctaccccagcaatgtgtttgatggcctgctgactgtggtgctgctggtgctggagatcagcaccctggccgtgtaccgcctgccccaccctggctggaggcctgagatggtgggcctgctgagcctgtgggacatgaccaggatgctgaacatgctgattgtgttccgcttcctgcgcatcatccccagcatgaagctgatggctgtggtggccagcacagtgctgggcctggtgcagaacatgagggccttcggcggcatcctggtggtggtgtactacgtgtttgccatcatcggcatcaacctcttccggggcgtgattgtggccctgcccggcaacagcagcctggccccagccaacggcagcgccccctgtggcagctttgagcagctggagtactgggccaacaactttgatgactttgctgctgccctggtgaccctgtggaacctgatggtggtgaacaactggcaggtgttcctggatgcctaccgccgctacagcggcccctggagcaagatctactttgtgctgtggtggctggtgagcagcgtcatctgggtgaacctcttcctggccctgatcctggagaacttcctgcacaagtgggaccccaggagccacctgcagcccctggccggcaccccagaggccacctaccagatgacagtggagctgctcttccgggacatcctggaggagcctggagaagatgagctgacagagcggctgagccagcacccccacctgtggctgtgcaggtag

SEQ ID NO: 174957 - DNA, 1407 bp, Artificial Sequence
  Description of Artificial Sequence: Synthetic coding sequence
atgtggctgtaccgccgctactacagcaatgtgtgccagaggaccctgtccttcaccatcttcctgatcctcttcctggccttcatcgagacccccagcagcctgaccagcacagcagatgtgcgctacagagctgccccctgggagcccccctgtggcctgacagaatctgtggaggtgctgtgcctgctggtgtttgctgctgacctgtctgtgaagggctacctgtttggctgggcccacttccagaagaacctgtggctgctgggctacctggtggtgctggtggtgtccctggtggactggacagtgtccctgagcctggtgtgccacgagcccctgcgcatccggcggctgctgcggcccttcttcctgctgcagaacagctccatgatgaagaagaccctgaagtgcatccgctggagcctgcctgagatggcctctgtgggcctgctgctggccatccacctgtgcctcttcaccatgtttggcatgctgctgtttgctgggggcaagcaggatgatggccaggaccgggagcggctgacctacttccagaacctgcctgagagcctgaccagcctgctggtgctgctgaccacagccaacaacccagatgtgatgatcccagcctacagcaagaacagagcctatgccatcttcttcatcgtgttcaccgtcatcggcagcctcttcctgatgaacctgctgacagccatcatctacagccagttccggggctacctgatgaagagcctgcagaccagcctcttcagaagaaggctgggcacccgggccgcctttgaggtgctgagctccatggtgggggagggcggggccttcccccaggccacccggcggggccccagcaccagcctgcgcttctgccgggcccccagcagcagcagcgccaccaccaccctgaccacctggggcaccagcagcccctggcagacctggtgcccctttgcctgctcctggtgctggatgcagatgtgctgcctgctgtctgtgatgaccagctcctggggcttcagcacagccagcagcctgtgcaccacctgctggcgctgctgcagccgcagcctgccctgggcctgtgagggcacctgccccaccccagccacctgcctgaccggcagcagccccctgagctgctggaggcctgagatggtgggcctgctgagcctgtgggacatgaccaggatgctgaacatgctgattgtgttccgcttcctgcgcatcatccccagcatgaagctgatggctgtggtggccagcacagtgctgggcctggtgcagaacatgagggcctttggaggcatcctggtgcccggcccctgccagtggctgggcgccctgtgggagctgcgggccgccggcgtgctgggccagcagctgaggtag

SEQ ID NO: 174958 - DNA, 1584 bp, Artificial Sequence
  Description of Artificial Sequence: Synthetic coding sequence
atgatcctgagcagctacaacaccatccagagcgtcttctgctgctgctgctgctgcagcgtgcagaagaggcagatgaggacccagatcagcctgagcacagatgaggagctgcctgagaagtacacccagaggcggcggccctggctgagccagctgagcaacaagaagcagagcaacacaggccgggtgcagcccagcaagaggaagcccctgccccccctgccccccagcgaggtggccgaggagaagatccaggtgaaggccctgtatgacttcctgccccgggagccctgcaacctggccctgcggcgggcagaggagtacctgatcctggagaagtacaacccccactggtggaaggcccgggaccggctgggcaatgaaggcctcatccccagcaactacgtgacagagaacaagatcaccaacctggagatctatgagtggtaccacaggaacatcaccaggaaccaggccgagcacctgctgcggcaggagagcaaggagggcgccttcatcgtgcgggacagccgccacctgggcagctacaccatctctgtgttcatgggcgcccggcgcagcacagaggccgccatcaagcactaccagatcaagaagaatgacagcggccagtggtacgtggccgagagacatgccttccagagcatccctgagctgatctggtaccaccagcacaatgctgctggcctgatgacccggctgcgctaccctgtgggcctgatgggcagctgcctgcctgccacagctggcttctcctatgagaagtgggagattgaccccagcgagctggccttcatcaaggagatcggcagcggccagtttggagtggtgcacctgggggagtggaggagccacatccaggtggccatcaaggccatcaatgaaggctccatgtctgaggaggacttcatcgaggaggccaaggtgatgatgaagctgagccacagcaagctggtgcagctgtatggagtgtgcatccagaggaagcccctgtacatcgtgacagagttcatggagaatggctgcctgctgaactacctgagagaaaataaaggcaagctgaggaaggagatgctgctgtctgtgtgccaggacatctgtgagggcatggagtacctggagagaaatggctacatccaccgggacctggccgccaggaactgcctggtgagcagcacctgcatcgtgaagatcagtgactttggcatgacccgctacgtgctggatgatgaatatgtgtcctcctttggagccaagttccccatcaagtggagccccccagaggtgttcctgttcaacaagtacagcagcaagagtgatgtgtggagctttggagtgctgatgtgggaggtgttcacagagggcaagatgccctttgagaacaagagcaacctgcaggtggtggaggccatcagcgagggcttccggctgtaccggccccacctggcccccatgagcatctatgaggtgatgtacagctgctggcatgagaagccagagggccggcccacctttgctgagctgctgcgggctgtgacagaaattgctgagacctggtag

SEQ ID NO: 174959 - DNA, 342 bp, Artificial Sequence
  Description of Artificial Sequence: Synthetic coding sequence
atgggcggcctggagccctgcagccggctgctgctgctgcccctgctgctggccgtgtctggcctgcggcctgtgcaggcccaggcccagagcgactgcagctgcagcacagtgtcccctggggtgctggccggcatcgtgatgggagacctggtgctgactgtgctgattgccctggccgtgtacttcctgggccgcctggtgccccggggccgcggggctgctgaggccgccaccaggaagcagaggatcacagaaacagagagcccctaccaggagctgcagggccagaggagtgatgtgtacagcgacctgaacacccagaggccctactacaagtag

SEQ ID NO: 174960 - DNA, 339 bp, Artificial Sequence
  Description of Artificial Sequence: Synthetic coding sequence
atgggcggcctggagccctgcagccggctgctgctgctgcccctgctgctggccgtgtctggcctgcggcctgtgcaggcccaggcccagagcgactgcagctgcagcacagtgtcccctggggtgctggccggcatcgtgatgggagacctggtgctgactgtgctgattgccctggccgtgtacttcctgggccgcctggtgccccggggccgcggggctgctgaggccaccaggaagcagaggatcacagaaacagagagcccctaccaggagctgcagggccagaggagtgatgtgtacagcgacctgaacacccagaggccctactacaagtag

SEQ ID NO: 174961 - DNA, 309 bp, Artificial Sequence
  Description of Artificial Sequence: Synthetic coding sequence
atgggcggcctggagccctgcagccggctgctgctgctgcccctgctgctggccgtgtctgactgcagctgcagcacagtgtccccaggagtgctggccggcatcgtgatgggagacctggtgctgactgtgctgattgccctggccgtgtacttcctgggccgcctggtgccccggggcagaggagctgctgaggccgccaccaggaagcagaggatcacagaaacagagagcccctaccaggagctgcagggccagaggagtgatgtgtacagcgacctgaacacccagaggccctactacaagtag

SEQ ID NO: 174962 - DNA, 339 bp, Artificial Sequence; identical to SEQ ID NO: 174960
  Description of Artificial Sequence: Synthetic coding sequence

SEQ ID NO: 174963 - DNA, 2673 bp, Artificial Sequence
  Description of Artificial Sequence: Synthetic coding sequence
atggccctgcggcgctccatgggccggcccggcctgccccccctgcccctgcccccaccaccccggctgggcctgctgctggccgccctggccagcctgctgctgcctgagagcgctgctgctggcctgaagctgatgggcgcccctgtgaagctgactgtgtcccagggccagcctgtgaagctgaactgcagcgtggagggcatggaggagccagacatccagtgggtgaaggatggagctgtggtgcagaacctggaccagctgtacatccctgtgtctgagcagcactggattggcttcctgagcctgaagtctgtggagaggagtgatgctggccgctactggtgccaggtggaggatggaggagaaacagagatcagccagcctgtgtggctgactgtggagggcgtgcccttcttcaccgtggagcccaaggacctggccgtgcccccaaatgcccccttccagctgagctgtgaggccgtgggccccccagagcctgtgaccatcgtgtggtggaggggcaccaccaagattggaggccctgcccccagccccagcgtgctgaatgtgactggagtgacccagagcaccatgttcagctgtgaggcccacaacctgaagggcctggccagcagcaggacagccaccgtgcacctgcaggccctgcctgctgcccccttcaacatcaccgtgaccaagctgagcagcagcaatgcctctgtggcctggatgcctggagcagatggccgggccctgctgcagagctgcaccgtgcaggtgacccaggcccctgggggctgggaggtgctggccgtggtggtgcctgtgccccccttcacctgcctgctgcgggacctggtgcctgccaccaactacagcctgcgggtgcgctgtgccaatgccctgggccccagcccctatgctgactgggtgcccttccagaccaagggcctggccccagccagcgccccccagaacctgcacgccatcagaacagacagcggcctcatcctggagtgggaggaggtgattcctgaggcccccctggagggccccctgggcccctacaagctgtcctgggtgcaggacaatggcacccaggatgagctgactgtggagggcacccgggccaacctgaccggctgggacccccagaaggacctgattgtgcgggtgtgtgtgtccaatgctgtgggctgcggcccctggagccagcccctggtggtgagcagccatgacagagctggccagcagggccccccccacagcaggacctcctgggtgcctgtggtgctgggcgtgctgacagccctggtgacagctgctgccctggccctgatcctgctgaggaagaggaggaaggagacccgcttcggccaggcctttgacagcgtgatggcccggggggagcctgctgtgcacttccgggccgcccggagcttcaaccgggagaggcctgagagaattgaggccaccctggacagcctgggcatcagtgatgagctgaaggagaagctggaggatgtgctgatccctgagcagcagttcaccctgggccgcatgctgggcaagggggagtttggatctgtgcgggaggcccagctgaagcaggaggatggcagctttgtgaaggtggccgtgaagatgctgaaggctgacatcatcgccagcagtgacatcgaggagttcctgcgggaggccgcctgcatgaaggagtttgaccacccccacgtggccaagctggtgggcgtgtccctgcggagccgggccaagggccgcctgcccatccccatggtgatcctgcccttcatgaagcacggggacctgcacgccttcctgctggccagccgcatcggggagaaccccttcaacctgcccctgcagaccctcatccgcttcatggtggacatcgcctgtggcatggagtacctgagcagcaggaacttcatccaccgggacctggccgccaggaactgcatgctggccgaggacatgacagtgtgtgtggccgactttggcctgagcaggaagatctacagcggggactactaccggcagggctgtgccagcaagctgcctgtgaagtggctggccctggagagcctggccgacaacctgtacacagtgcagagtgatgtgtgggccttcggcgtgaccatgtgggagatcatgacccggggccagaccccctatgccggcattgaaaatgctgagatctacaactacctgattggaggcaaccggctgaagcagcccccagagtgcatggaggatgtgtatgacctgatgtaccagtgctggagcgctgaccccaagcagaggcccagcttcacctgcctgaggatggagctggagaacatcctgggccagctgtctgtgctgagcgccagccaggaccccctgtacatcaacatcgagcgggcagaggagcccacagctgggggcagcctggagctgcccggccgggaccagccctacagcggggctggagatggcagcggcatgggcgctgtgggcggcacccccagcgactgccgctacatcctgaccccaggcggcctggccgagcagcccggccaggccgagcaccagcctgagagccccctgaatgagacccagaggctgctgctgctgcagcagggcctgctgccccacagcagctgctag

SEQ ID NO: 174964 - DNA, 2529 bp, Artificial Sequence
  Description of Artificial Sequence: Synthetic coding sequence
atggaggagccagacatccagtgggtgaaggatggagctgtggtgcagaacctggaccagctgtacatccctgtgtctgagcagcactggattggcttcctgagcctgaagtctgtggagaggagtgatgctggccgctactggtgccaggtggaggatggaggagaaacagagatcagccagcctgtgtggctgactgtggagggcgtgcccttcttcaccgtggagcccaaggacctggccgtgcccccaaatgcccccttccagctgagctgtgaggccgtgggccccccagagcctgtgaccatcgtgtggtggaggggcaccaccaagattggaggccctgcccccagccccagcgtgctgaatgtgactggagtgacccagagcaccatgttcagctgtgaggcccacaacctgaagggcctggccagcagcaggacagccaccgtgcacctgcaggccctgcctgctgcccccttcaacatcaccgtgaccaagctgagcagcagcaatgcctctgtggcctggatgcctggagcagatggccgggccctgctgcagagctgcaccgtgcaggtgacccaggcccctgggggctgggaggtgctggccgtggtggtgcctgtgccccccttcacctgcctgctgcgggacctggtgcctgccaccaactacagcctgcgggtgcgctgtgccaatgccctgggccccagcccctatgctgactgggtgcccttccagaccaagggcctggccccagccagcgccccccagaacctgcacgccatcagaacagacagcggcctcatcctggagtgggaggaggtgattcctgaggcccccctggagggccccctgggcccctacaagctgtcctgggtgcaggacaatggcacccaggatgagctgactgtggagggcacccgggccaacctgaccggctgggacccccagaaggacctgattgtgcgggtgtgtgtgtccaatgctgtgggctgcggcccctggagccagcccctggtggtgagcagccatgacagagctggccagcagggccccccccacagcaggacctcctgggtgcctgtggtgctgggcgtgctgacagccctggtgacagctgctgccctggccctgatcctgctgaggaagaggaggaaggagacccgcttcggccaggcctttgacagcgtgatggcccggggggagcctgctgtgcacttccgggccgcccggagcttcaaccgggagaggcctgagagaattgaggccaccctggacagcctgggcatcagtgatgagctgaaggagaagctggaggatgtgctgatccctgagcagcagttcaccctgggccgcatgctgggcaagggggagtttggatctgtgcgggaggcccagctgaagcaggaggatggcagctttgtgaaggtggccgtgaagatgctgaaggctgacatcatcgccagcagtgacatcgaggagttcctgcgggaggccgcctgcatgaaggagtttgaccacccccacgtggccaagctggtgggcgtgtccctgcggagccgggccaagggccgcctgcccatccccatggtgatcctgcccttcatgaagcacggggacctgcacgccttcctgctggccagccgcatcggggagaaccccttcaacctgcccctgcagaccctcatccgcttcatggtggacatcgcctgtggcatggagtacctgagcagcaggaacttcatccaccgggacctggccgccaggaactgcatgctggccgaggacatgacagtgtgtgtggccgactttggcctgagcaggaagatctacagcggggactactaccggcagggctgtgccagcaagctgcctgtgaagtggctggccctggagagcctggccgacaacctgtacacagtgcagagtgatgtgtgggccttcggcgtgaccatgtgggagatcatgacccggggccagaccccctatgccggcattgaaaatgctgagatctacaactacctgattggaggcaaccggctgaagcagcccccagagtgcatggaggatgtgtatgacctgatgtaccagtgctggagcgctgaccccaagcagaggcccagcttcacctgcctgaggatggagctggagaacatcctgggccagctgtctgtgctgagcgccagccaggaccccctgtacatcaacatcgagcgggcagaggagcccacagctgggggcagcctggagctgcccggccgggaccagccctacagcggggctggagatggcagcggcatgggcgctgtgggcggcacccccagcgactgccgctacatcctgaccccaggcggcctggccgagcagcccggccaggccgagcaccagcctgagagccccctgaatgagacccagaggctgctgctgctgcagcagggcctgcacacagtggccgtgagcccccaggccgagggcatcggggccatctggccagccctggtggccacagagctggccgactag

SEQ ID NO: 174965 - DNA, 741 bp, Artificial Sequence
  Description of Artificial Sequence: Synthetic coding sequence
atgaccatggacaagtctgagctggtgcagaaggccaagctggccgagcaggccgagagatatgatgacatggccgccgccatgaaggctgtgacagagcagggccacgagctgagcaatgaggagaggaacctgctgtctgtggcctacaagaatgtggtgggcgcccggcgcagctcctggagggtcatcagcagcattgagcagaagacagaaagaaatgagaagaagcagcagatgggcaaggagtaccgggagaagattgaggccgagctgcaggacatctgcaatgatgtgctggagctgctggacaagtacctgatccccaatgccacccagcctgagagcaaggtgttctacctgaagatgaagggggactacttccgctacctgtctgaggtggccagcggggacaacaagcagaccaccgtgagcaacagccagcaggcctaccaggaggcctttgagatcagcaagaaggagatgcagcccacccaccccatccggctgggcctggccctgaacttctctgtgttctactatgagatcctgaacagccctgagaaggcctgcagcctggccaagacagcctttgatgaggccatcgccgagctggacaccctgaatgaggagagctacaaggacagcaccctcatcatgcagctgctgcgggacaacctgaccctgtggaccagcgagaaccagggagatgaaggagatgctggggagggagaaaattag

SEQ ID NO: 174966 - DNA, 741 bp, Artificial Sequence; identical to SEQ ID NO: 174965
  Description of Artificial Sequence: Synthetic coding sequence

SEQ ID NO: 174967 - DNA, 303 bp, Artificial Sequence
  Description of Artificial Sequence: Synthetic coding sequence
atgaccatggacaagtctgagctggtgcagaaggccaagctggccgagcaggccgagagatatgatgacatggccgccgccatgaaggctgtgacagagcagggccacgagctgagcaatgaggagaggaacctgctgtctgtggcctacaagaatgtggtgggcgcccggcgcagctcctggagggtcatcagcagcattgagcagaagacagaaagaaatgagaagaagcagcagatgggcaaggagtaccgggagaagattgaggccgagctgcaggacatctgcaatgatgtgctgtag

SEQ ID NO: 174968 - DNA, 225 bp, Artificial Sequence
  Description of Artificial Sequence: Synthetic coding sequence
atgaccatggacaagtctgagctggtgcagaaggccaagctggccgagcaggccgagagatatgatgacatggccgccgccatgaaggctgtgacagagcagggccacgagctgagcaatgaggagaggaacctgctgtctgtggcctacaagaatgtggtgggcgcccggcgcagctcctggagggtcatcagcagcattgagcagaagacagaaagaaattag

SEQ ID NO: 174969 - DNA, 768 bp, Artificial Sequence
  Description of Artificial Sequence: Synthetic coding sequence
atggatgaccgggaggacctggtgtaccaggccaagctggccgagcaggccgagagatatgatgagatggtggagagcatgaagaaggtggccggcatggatgtggagctgactgtggaggagaggaacctgctgtctgtggcctacaagaatgtgattggagcccggcgggcctcctggaggatcatcagcagcattgagcagaaggaggagaacaagggcggggaggacaagctgaagatgatccgggagtaccggcagatggtggagacagagctgaagctgatctgctgtgacatcctggatgtgctggacaagcacctgatcccagctgccaacacaggagagagcaaggtgttctactacaagatgaagggggactaccaccgctacctggccgagtttgccactggaaatgacaggaaggaggccgctgagaacagcctggtggcctacaaggccgccagtgacatcgccatgacagagctgccccccacccaccccatccggctgggcctggccctgaacttcagcgtcttctactatgagatcctgaacagcccagaccgggcctgccgcctggccaaggccgcctttgatgatgccatcgccgagctggacaccctgtctgaggagagctacaaggacagcaccctcatcatgcagctgctgcgggacaacctgaccctgtggaccagtgacatgcagggagatggagaggagcagaacaaggaggccctgcaggatgtggaggatgagaaccagtag

SEQ ID NO: 174970 - DNA, 702 bp, Artificial Sequence
  Description of Artificial Sequence: Synthetic coding sequence
atggtggagagcatgaagaaggtggccggcatggatgtggagctgactgtggaggagaggaacctgctgtctgtggcctacaagaatgtgattggagcccggcgggcctcctggaggatcatcagcagcattgagcagaaggaggagaacaagggcggggaggacaagctgaagatgatccgggagtaccggcagatggtggagacagagctgaagctgatctgctgtgacatcctggatgtgctggacaagcacctgatcccagctgccaacacaggagagagcaaggtgttctactacaagatgaagggggactaccaccgctacctggccgagtttgccactggaaatgacaggaaggaggccgctgagaacagcctggtggcctacaaggccgccagtgacatcgccatgacagagctgccccccacccaccccatccggctgggcctggccctgaacttcagcgtcttctactatgagatcctgaacagcccagaccgggcctgccgcctggccaaggccgcctttgatgatgccatcgccgagctggacaccctgtctgaggagagctacaaggacagcaccctcatcatgcagctgctgcgggacaacctgaccctgtggaccagtgacatgcagggagatggagaggagcagaacaaggaggccctgcaggatgtggaggatgagaaccagtag

SEQ ID NO: 174971 - DNA, 744 bp, Artificial Sequence
  Description of Artificial Sequence: Synthetic coding sequence
atggtggaccgggagcagctggtgcagaaggcccggctggccgagcaggccgagagatatgatgacatggctgctgccatgaagaatgtgacagagctgaatgagcccctgagcaatgaggagaggaacctgctgtctgtggcctacaagaatgtggtgggcgcccggcgcagctcctggagggtcatcagcagcattgagcagaagaccagcgcagatggaaatgagaagaagattgagatggtgcgggcctaccgggagaagattgagaaggagctggaggccgtgtgccaggatgtgctgagcctgctggacaactacctgatcaagaactgcagcgagacccagtatgagagcaaggtgttctacctgaagatgaagggggactactaccgctacctggccgaggtggccactggagagaagagggccaccgtggtggagagcagcgagaaggcctacagcgaggcccacgagatcagcaaggagcacatgcagcccacccaccccatccggctgggcctggccctgaactacagcgtcttctactatgagatccagaatgcccctgagcaggcctgccacctggccaagacagcctttgatgatgccatcgccgagctggacaccctgaatgaagattcctacaaggacagcaccctcatcatgcagctgctgcgggacaacctgaccctgtggaccagtgaccagcaggatgatgatggaggagagggcaacaactag

SEQ ID NO: 174972 - DNA, 624 bp, Artificial Sequence
  Description of Artificial Sequence: Synthetic coding sequence
atggtggaccgggagcagctggtgcagaaggcccggctggccgagcaggccgagagatatgatgacatggctgctgccatgaagaatgtgacagagctgaatgagcccctgagcaatgaggagaggaacctgctgtctgtggcctacaagaatgtggtgggcgcccggcgcagctcctggagggtcatcagcagcattgagcagaagaccagcgcagatggaaatgagaagaagattgagatggtgcgggcctaccgggagaagattgagaaggagctggaggccgaggtggccactggagagaagagggccaccgtggtggagagcagcgagaaggcctacagcgaggcccacgagatcagcaaggagcacatgcagcccacccaccccatccggctgggcctggccctgaactacagcgtcttctactatgagatccagaatgcccctgagcaggcctgccacctggccaagacagcctttgatgatgccatcgccgagctggacaccctgaatgaagattcctacaaggacagcaccctcatcatgcagctgctgcgggacaacctgaccctgtggaccagtgaccagcaggatgatgatggaggagagggcaacaactag

SEQ ID NO: 174973 - DNA, 678 bp, Artificial Sequence
  Description of Artificial Sequence: Synthetic coding sequence
atggctgctgccatgaagaatgtgacagagctgaatgagcccctgagcaatgaggagaggaacctgctgtctgtggcctacaagaatgtggtgggcgcccggcgcagctcctggagggtcatcagcagcattgagcagaagaccagcgcagatggaaatgagaagaagattgagatggtgcgggcctaccgggagaagattgagaaggagctggaggccgtgtgccaggatgtgctgagcctgctggacaactacctgatcaagaactgcagcgagacccagtatgagagcaaggtgttctacctgaagatgaagggggactactaccgctacctggccgaggtggccactggagagaagagggccaccgtggtggagagcagcgagaaggcctacagcgaggcccacgagatcagcaaggagcacatgcagcccacccaccccatccggctgggcctggccctgaactacagcgtcttctactatgagatccagaatgcccctgagcaggcctgccacctggccaagacagcctttgatgatgccatcgccgagctggacaccctgaatgaagattcctacaaggacagcaccctcatcatgcagctgctgcgggacaacctgaccctgtggaccagtgaccagcaggatgatgatggaggagagggcaacaactag

SEQ ID NO: 174974 - DNA, 738 bp, Artificial Sequence
  Description of Artificial Sequence: Synthetic coding sequence
atggacaagaatgagctggtgcagaaggccaagctggccgagcaggccgagagatatgatgacatggccgcctgcatgaagtctgtgacagagcagggcgctgagctgagcaatgaggagaggaacctgctgtctgtggcctacaagaatgtggtgggcgcccggcgcagctcctggagggtggtgagcagcattgagcagaagacagaaggagctgagaagaagcagcagatggcccgggagtaccgggagaagattgaaacagagctgcgggacatctgcaatgatgtgctgagcctgctggagaagttcctgatccccaatgccagccaggccgagagcaaggtgttctacctgaagatgaagggggactactaccgctacctggccgaggtggccgctggagatgacaagaagggcatcgtggaccagagccagcaggcctaccaggaggcctttgagatcagcaagaaggagatgcagcccacccaccccatccggctgggcctggccctgaacttctctgtgttctactatgagatcctgaacagccctgagaaggcctgcagcctggccaagacagcctttgatgaggccatcgccgagctggacaccctgtctgaggagagctacaaggacagcaccctcatcatgcagctgctgcgggacaacctgaccctgtggaccagtgacacccagggagatgaagctgaggccggggagggcggggagaactag

SEQ ID NO: 174975 - DNA, 507 bp, Artificial Sequence
  Description of Artificial Sequence: Synthetic coding sequence
atggcccgggagtaccgggagaagattgaaacagagctgcgggacatctgcaatgatgtgctgagcctgctggagaagttcctgatccccaatgccagccaggccgagagcaaggtgttctacctgaagatgaagggggactactaccgctacctggccgaggtggccgctggagatgacaagaagggcatcgtggaccagagccagcaggcctaccaggaggcctttgagatcagcaagaaggagatgcagcccacccaccccatccggctgggcctggccctgaacttcagcgtcttctactatgagatcctgaacagccctgagaaggcctgcagcctggccaagacagcctttgatgaggccatcgccgagctggacaccctgtctgaggagagctacaaggacagcaccctcatcatgcagctgctgcgggacaacctgaccctgtggaccagtgacacccagggagatgaggccgaggccggggagggcggagaaaattag

SEQ ID NO: 174976 - DNA, 738 bp, Artificial Sequence; identical to SEQ ID NO: 174974
  Description of Artificial Sequence: Synthetic coding sequence

SEQ ID NO: 174977 - DNA, 738 bp, Artificial Sequence; identical to SEQ ID NO: 174974
  Description of Artificial Sequence: Synthetic coding sequence

SEQ ID NO: 174978 - DNA, 738 bp, Artificial Sequence; identical to SEQ ID NO: 174974
  Description of Artificial Sequence: Synthetic coding sequence

SEQ ID NO: 174979 - DNA, 738 bp, Artificial Sequence; identical to SEQ ID NO: 174974
  Description of Artificial Sequence: Synthetic coding sequence

SEQ ID NO: 174980 - DNA, 738 bp, Artificial Sequence; identical to SEQ ID NO: 174974
  Description of Artificial Sequence: Synthetic coding sequence

SEQ ID NO: 174981 - DNA, 297 bp, Artificial Sequence
  Description of Artificial Sequence: Synthetic coding sequence
atggacaagaatgagctggtgcagaaggccaagctggccgagcaggccgagagatatgatgacatggccgcctgcatgaagtctgtgacagagcagggcgctgagctgagcaatgaggagaggaacctgctgtctgtggcctacaagaatgtggtgggcgcccggcgcagctcctggagggtggtgagcagcattgagcagaagacagaaggagctgagaagaagcagcagatggcccgggagtaccgggagaagattgaaacagagctgcgggacatctgcaatgatgtgctgtag

SEQ ID NO: 174982 - DNA, 738 bp, Artificial Sequence; identical to SEQ ID NO: 174974
  Description of Artificial Sequence: Synthetic coding sequence

SEQ ID NO: 174983 - DNA, 279 bp, Artificial Sequence
  Description of Artificial Sequence: Synthetic coding sequence
atggacaagaatgagctggtgcagaaggccaagctggccgagcaggccgagagatatgatgacatggccgcctgcatgaagtctgtgacagagcagggcgctgagctgagcaatgaggagaggaacctgctgtctgtggcctacaagaatgtggtgggcgcccggcgcagctcctggagggtggtgagcagcattgagcagaagacagaaggagctgagaagaagcagcagatggcccgggagtaccgggagaagattgaaacagagctgcgggactag

SEQ ID NO: 174984 - DNA, 738 bp, Artificial Sequence; identical to SEQ ID NO: 174974
  Description of Artificial Sequence: Synthetic coding sequence

SEQ ID NO: 174985 - DNA, 507 bp, Artificial Sequence; identical to SEQ ID NO: 174975
  Description of Artificial Sequence: Synthetic coding sequence

SEQ ID NO: 174986 - DNA, 378 bp, Artificial Sequence
  Description of Artificial Sequence: Synthetic coding sequence
atgaagggggactactaccgctacctggccgaggtggccgctggagatgacaagaagggcatcgtggaccagagccagcaggcctaccaggaggcctttgagatcagcaagaaggagatgcagcccacccaccccatccggctgggcctggccctgaacttctctgtgttctactatgagatcctgaacagccctgagaaggcctgcagcctggccaagacagcctttgatgaggccatcgccgagctggacaccctgtctgaggagagctacaaggacagcaccctcatcatgcagctgctgcgggacaacctgaccctgtggaccagtgacacccagggagatgaagctgaggccggggagggcggggagaactag

SEQ ID NO: 174987 - DNA, 414 bp, Artificial Sequence
  Description of Artificial Sequence: Synthetic coding sequence
atggacaagaatgagctggtgcagaaggccaagctggccgagcaggccgagagatatgatgacatggccgcctgcatgaagtctgtgacagagcagggcgctgagctgagcaatgaggagaggaacctgctgtctgtggcctacaagaatgtggtgggcgcccggcgcagctcctggagggtggtgagcagcattgagcagaagacagaaggagctgagaagaagcagcagatggcccgggagtaccgggagaagattgaaacagagctgcgggacatctgcaatgatgtgctgagcctgctggagaagttcctgatccccaatgccagccaggccgagagcaaggtgttctacctgaagatgaagggggactactaccgctacctggccgaggtggccgctggagatgactag

SEQ ID NO: 174988 - DNA, 741 bp, Artificial Sequence
  Description of Artificial Sequence: Synthetic coding sequence
atggacaagaatgagctggtgcagaaggccaagctggccgagcaggccgagagatatgatgacatggccgcctgcatgaagtctgtgacagagcagggcgctgagctgagcaatgaggagaggaacctgctgtctgtggcctacaagaatgtggtgggcgcccggcgcagctcctggagggtggtgagcagcattgagcagaagacagaaggagctgagaagaagcagcagatggcccgggagtaccgggagaagattgaaacagagctgcgggacatctgcaatgatgtgctgagcctgctggagaagttcctgatccccaatgccagccaggccgagagcaaggtgttctacctgaagatgaagggggactactaccgctacctggccgaggtggccgctggagatgacaagaaggtgcgcttcggcgtgtcctacccaggcatcgtggaccagagccagcaggcctaccaggaggcctttgagatcagcaagaaggagatgcagcccacccaccccatccggctgggcctggccctgaacttctctgtgttctactatgagatcctgaacagccctgagaaggcctgcagcctggccaagacagcctttgatgaggccatcgccgagctggacaccctgtctgaggagagctacaaggacagcaccctcatcatgcagctgctgcgggacaacctgaccctgtggaccagtgacacccagggagatgaagctgagtag

SEQ ID NO: 174989 - DNA, 513 bp, Artificial Sequence
  Description of Artificial Sequence: Synthetic coding sequence
atgagccagccctgcaggaagctgtggaggcacaactatgagaccagcagctgcatcgagttcctgaagagcctgctggagaagttcctgatccccaatgccagccaggccgagagcaaggtgttctacctgaagatgaagggggactactaccgctacctggccgaggtggccgctggagatgacaagaagggcatcgtggaccagagccagcaggcctaccaggaggcctttgagatcagcaagaaggagatgcagcccacccaccccatccggctgggcctggccctgaacttcagcgtcttctactatgagatcctgaacagccctgagaaggcctgcagcctggccaagacagcctttgatgaggccatcgccgagctggacaccctgtctgaggagagctacaaggacagcaccctcatcatgcagctgctgcgggacaacctgaccctgtggaccagtgacacccagggagatgaggccgaggccggggagggcggagaaaattag

SEQ ID NO: 174990 - DNA, 378 bp, Artificial Sequence; identical to SEQ ID NO: 174986
  Description of Artificial Sequence: Synthetic coding sequence

SEQ ID NO: 174991 - DNA, 228 bp, Artificial Sequence
  Description of Artificial Sequence: Synthetic coding sequence
atggacaagaatgagctggtgcagaaggccaagctggccgagcaggccgagagatatgatgacatggccgcctgcatgaagtctgtgacagagcagggcgctgagctgagcaatgaggagaggaacctgctgtctgtggcctacaagaatgtggtgggcgcccggcgcagctcctggagggtggtgagcagcattgagcagaagacagaaggagctgagaagaagtag

SEQ ID NO: 174992 - DNA, 393 bp, Artificial Sequence
  Description of Artificial Sequence: Synthetic coding sequence
gtcttctacctgaagatgaagggggactactaccgctacctggccgaggtggccgctggagatgacaagaagggcatcgtggaccagagccagcaggcctaccaggaggcctttgagatcagcaagaaggagatgcagcccacccaccccatccggctgggcctggccctgaacttcagcgtcttctactatgagatcctgaacagccctgagaaggcctgcagcctggccaagacagcctttgatgaggccatcgccgagctggacaccctgtctgaggagagctacaaggacagcaccctcatcatgcagctgctgcgggacaacctgaccctgtggaccagtgacacccagggagatgaggccgaggccggggagggcggagaaaattag

SEQ ID NO: 174993 - DNA, 159 bp, Artificial Sequence
  Description of Artificial Sequence: Synthetic coding sequence
atggacaagaatgagctggtgcagaaggccaagctggccgagcaggccgagagatatgatgacatggccgcctgcatgaagtctgtgacagagcagggcgctgagctgagcaatgaggagaggaacctgctgtctgtggcctacaagaatgtggtgtag

SEQ ID NO: 174994 - DNA, 1224 bp, Artificial Sequence
  Description of Artificial Sequence: Synthetic coding sequence
atgcccaccccagatgccaccaccccccaggccaagggcttcagaagagctgtgtctgagctggatgccaagcaggccgaggccatcatggtgcggggccagagcccccgcttcatcggccggcggcagagcctgattgaagatgccaggaaggagcgggaggccgctgtggccgctgctgctgctgctgtgcccagcgagcccggggaccccctggaggccgtggcctttgaggagaaggagggcaaggctgtgctgaacctgctcttcagcccccgggccaccaagcccagcgccctgagcagagctgtgaaggtgtttgagacctttgaggccaagatccaccacctggagaccaggcctgcccagaggcccagggctgggggcccccacctggagtactttgtgcggctggaggtgagaagaggagacctggccgccctgctgagcggcgtgcggcaggtgtctgaagatgtgcgcagccctgctggccccaaggtgccctggttccccaggaaggtgtctgagctggacaagtgccaccacctggtgaccaagtttgatcctgacctggacctggaccaccctggcttcagtgaccaggtgtaccggcagaggaggaagctgattgctgagatcgccttccagtacagacatggagaccccatcccccgggtggagtacacagctgaggagatcgccacctgggactgctgccacgagctgctgggccacgtgcccatgctggccgacaggacctttgcccagttcagccaggacatcggcctggccagcctgggcgccagtgatgaggagattgagaagctgagcaccctgtactggttcaccgtggagtttggcctgtgcaagcagaatggagaggtgaaggcctacggggccggcctgctgagcagctatggagagctgctgcactgcctgtctgaggagcctgagatccgggcctttgatcctgaggccgctgctgtgcagccctaccaggaccagacctaccagagcgtgtactttgtgtctgagagcttcagtgatgccaaggacaagctgcggagctatgccagccgcatccagaggcccttctctgtgaagtttgacccctacaccctggccattgatgtgctggacagcccccaggccgtgcggcgcagcctggagggcgtgcaggatgagctggacaccctggcccacgccctgagcgccatcggctag

SEQ ID NO: 174995 - DNA, 1494 bp, Artificial Sequence
  Description of Artificial Sequence: Synthetic coding sequence
atgcccaccccagatgccaccaccccccaggccaagggcttcagaagagctgtgtctgagctggatgccaagcaggccgaggccatcatgagcccccgcttcatcggccggcggcagagcctgattgaagatgccaggaaggagcgggaggccgctgtggccgctgctgctgctgctgtgcccagcgagcccggggaccccctggaggccgtggcctttgaggagaaggagggcaaggctgtgctgaacctgctcttcagcccccgggccaccaagcccagcgccctgagcagagctgtgaaggtgtttgagacctttgaggccaagatccaccacctggagaccaggcctgcccagaggcccagggctgggggcccccacctggagtactttgtgcggctggaggtgagaagaggagacctggccgccctgctgagcggcgtgcggcaggtgtctgaagatgtgcgcagccctgctggccccaaggtgccctggttccccaggaaggtgtctgagctggacaagtgccaccacctggtgaccaagtttgatcctgacctggacctggaccaccctggcttcagtgaccaggtgtaccggcagaggaggaagctgattgctgagatcgccttccagtacagacatggagaccccatcccccgggtggagtacacagctgaggagatcgccacctggaaggaggtgtacaccaccctgaagggcctgtatgccacccacgcctgtggggagcacctggaggcctttgccctgctggagcgcttcagcggctaccgggaggacaacatcccccagctggaggatgtgagccgcttcctgaaggagaggacaggcttccagctgcggcctgtggccggcctgctgagcgcccgggacttcctggccagcctggccttccgggtcttccagtgcacccagtacatcagacatgccagcagccccatgcacagccctgagccagactgctgccacgagctgctgggccacgtgcccatgctggccgacaggacctttgcccagttcagccaggacatcggcctggccagcctgggcgccagtgatgaggagattgagaagctgagcaccctgtactggttcaccgtggagtttggcctgtgcaagcagaatggagaggtgaaggcctacggggccggcctgctgagcagctatggagagctgctgcactgcctgtctgaggagcctgagatccgggcctttgatcctgaggccgctgctgtgcagccctaccaggaccagacctaccagagcgtgtactttgtgtctgagagcttcagtgatgccaaggacaagctgcggagctatgccagccgcatccagaggcccttctctgtgaagtttgacccctacaccctggccattgatgtgctggacagcccccaggccgtgcggcgcagcctggagggcgtgcaggatgagctggacaccctggcccacgccctgagcgccatcggctag

SEQ ID NO: 174996 - DNA, 1575 bp, Artificial Sequence
  Description of Artificial Sequence: Synthetic coding sequence
atgcccaccccagatgccaccaccccccaggccaagggcttcagaagagctgtgtctgagctggatgccaagcaggccgaggccatcatgggcgcccctggccccagcctgaccggcagcccctggccaggcacagctgccccagctgccagctacacccccacccccaggagcccccgcttcatcggccggcggcagagcctgattgaagatgccaggaaggagcgggaggccgctgtggccgctgctgctgctgctgtgcccagcgagcccggggaccccctggaggccgtggcctttgaggagaaggagggcaaggctgtgctgaacctgctcttcagcccccgggccaccaagcccagcgccctgagcagagctgtgaaggtgtttgagacctttgaggccaagatccaccacctggagaccaggcctgcccagaggccccgggccggcggcccccacctggagtactttgtgcggctggaggtgcggcggggggacctggccgccctgctgtctggagtgcggcaggtgtctgaagatgtgcgcagccctgctggccccaaggtgccctggttccccaggaaggtgtctgagctggacaagtgccaccacctggtgaccaagtttgatcctgacctggacctggaccaccctggcttcagtgaccaggtgtaccggcagaggaggaagctgattgctgagatcgccttccagtaccgccacggggaccccatcccccgggtggagtacacagctgaggagatcgccacctggaaggaggtgtacaccaccctgaagggcctgtatgccacccacgcctgtggggagcacctggaggcctttgccctgctggagcgcttcagcggctaccgggaggacaacatcccccagctggaggatgtgagccgcttcctgaaggagaggacaggcttccagctgcggcctgtggccggcctgctgagcgcccgggacttcctggccagcctggccttccgggtcttccagtgcacccagtacatcagacatgccagcagccccatgcacagccctgagccagactgctgccacgagctgctgggccacgtgcccatgctggccgacaggacctttgcccagttcagccaggacatcggcctggccagcctgggcgccagtgatgaggagattgagaagctgagcaccctgtactggttcaccgtggagtttggcctgtgcaagcagaatggagaggtgaaggcctatggagctggcctgctgagcagctatggagagctgctgcactgcctgtctgaggagcctgagatccgggcctttgatcctgaggccgctgctgtgcagccctaccaggaccagacctaccagagcgtgtactttgtgtctgagagcttcagtgatgccaaggacaagctgcggagctatgccagccgcatccagaggcccttctctgtgaagtttgacccctacaccctggccattgatgtgctggacagcccccaggccgtgagaagaagcctggagggcgtgcaggatgagctggacaccctggcccacgccctgagcgccatcggctag

SEQ ID NO: 174997 - DNA, 1587 bp, Artificial Sequence
  Description of Artificial Sequence: Synthetic coding sequence
atgcccaccccagatgccaccaccccccaggccaagggcttcagaagagctgtgtctgagctggatgccaagcaggccgaggccatcatggtgcggggccagggcgcccctggccccagcctgaccggcagcccctggccaggcacagctgccccagctgccagctacacccccacccccaggagcccccgcttcatcggccggcggcagagcctgattgaagatgccaggaaggagcgggaggccgctgtggccgctgctgctgctgctgtgcccagcgagcccggggaccccctggaggccgtggcctttgaggagaaggagggcaaggctgtgctgaacctgctcttcagcccccgggccaccaagcccagcgccctgagcagagctgtgaaggtgtttgagacctttgaggccaagatccaccacctggagaccaggcctgcccagaggccccgggccggcggcccccacctggagtactttgtgcggctggaggtgcggcggggggacctggccgccctgctgtctggagtgcggcaggtgtctgaagatgtgcgcagccctgctggccccaaggtgccctggttccccaggaaggtgtctgagctggacaagtgccaccacctggtgaccaagtttgatcctgacctggacctggaccaccctggcttcagtgaccaggtgtaccggcagaggaggaagctgattgctgagatcgccttccagtaccgccacggggaccccatcccccgggtggagtacacagctgaggagatcgccacctggaaggaggtgtacaccaccctgaagggcctgtatgccacccacgcctgtggggagcacctggaggcctttgccctgctggagcgcttcagcggctaccgggaggacaacatcccccagctggaggatgtgagccgcttcctgaaggagaggacaggcttccagctgcggcctgtggccggcctgctgagcgcccgggacttcctggccagcctggccttccgggtcttccagtgcacccagtacatcagacatgccagcagccccatgcacagccctgagccagactgctgccacgagctgctgggccacgtgcccatgctggccgacaggacctttgcccagttcagccaggacatcggcctggccagcctgggcgccagtgatgaggagattgagaagctgagcaccctgtactggttcaccgtggagtttggcctgtgcaagcagaatggagaggtgaaggcctatggagctggcctgctgagcagctatggagagctgctgcactgcctgtctgaggagcctgagatccgggcctttgatcctgaggccgctgctgtgcagccctaccaggaccagacctaccagagcgtgtactttgtgtctgagagcttcagtgatgccaaggacaagctgcggagctatgccagccgcatccagaggcccttctctgtgaagtttgacccctacaccctggccattgatgtgctggacagcccccaggccgtgagaagaagcctggagggcgtgcaggatgagctggacaccctggcccacgccctgagcgccatcggctag

SEQ ID NO: 174998 - DNA, 3564 bp, Artificial Sequence
  Description of Artificial Sequence: Synthetic coding sequence
atgcccctgcggcactggggcatggcccggggcagcaagcctgtgggagatggagcccagcccatggccgccatgggcggcctgaaggtgctgctgcactgggccggccctgggggcggggagccctgggtgaccttcagcgagagcagcctgacagctgaggaggtgtgcatccacatcgcccacaaggtgggcatcaccccaccctgcttcaacctgtttgccctgtttgatgcccaggcccaggtgtggctgccccccaaccacatcctggagatccccagagatgccagcctgatgctgtacttccgcatccgcttctacttcaggaactggcacggcatgaacccccgggagcctgctgtgtaccgctgtggccccccaggcacagaggccagcagtgaccagacagcccagggcatgcagctgctggaccctgccagctttgagtacctgtttgagcagggcaagcatgaatttgtgaatgatgtggccagcctgtgggagctgagcacagaggaggagatccaccacttcaagaatgaaagcctgggcatggccttcctgcacctgtgccacctggccctgcggcacggcatccccctggaggaggtggccaagaagaccagcttcaaggactgcatccccaggagcttccgccgccacatccggcagcacagcgccctgacccggctgcggctgagaaatgtgttccgccgcttcctgcgggacttccagcccggccgcctgagccagcagatggtgatggtgaagtacctggccaccctggagcggctggccccccgcttcggcacagagcgggtgcctgtgtgccacctgcggctgctggcccaggccgagggggagccctgctacatccgggacagcggcgtggcccccacagatcctggccctgagagcgctgctggcccccccacccatgaggtgctggtgactggaactggaggcatccagtggtggcctgtggaggaggaggtgaacaaggaggagggcagcagcggcagcagtggaagaaacccccaggccagcctgtttgggaagaaggccaaggcccacaaggctgtgggccagcctgctgaccggccccgggagcccctgtgggcctacttctgtgacttccgggacatcacccacgtggtgctgaaggagcactgtgtgtccatccaccggcaggacaacaagtgcctggagctgagcctgcccagcagagctgctgccctgagctttgtgtccctggtggatggctacttccggctgacagctgacagcagccactacctgtgccacgaggtggccccaccccggctggtgatgagcatcagagatggcatccacggccccctgctggagccctttgtgcaggccaagctgcggccagaagatggcctgtacctgatccactggagcaccagccacccctaccgcctcatcctgactgtggcccagaggagccaggccccagatggcatgcagagcctgcggctgaggaagttccccatcgagcagcaggatggagcctttgtgctggagggctggggccgctccttccccagcgtgcgggagctgggcgccgccctgcagggctgcctgctgcgggctggagatgactgcttcagcctgcggcgctgctgcctgccccagcctggagagaccagcaacctgatcatcatgagaggagcccgggccagccccaggaccctgaacctgagccagctgtccttccaccgggtggaccagaaggagatcacccagctgagccacctgggccagggcaccaggaccaacgtgtatgagggccgcctgcgggtggagggcagcggggaccctgaggagggcaagatggatgatgaggaccccctggtgcccggccgggaccggggccaggagctgcgggtggtgctgaaggtgctggaccccagccaccacgacatcgccctggccttctatgaaacagccagcctgatgagccaggtgagccacacccacctggcctttgtgcacggcgtgtgtgtgcggggccctgagaacatcatggtgacagaatatgtggagcacggccccctggatgtgtggctgcggcgggagcggggccacgtgcccatggcctggaagatggtggtggcccagcagctggccagcgccctgagctacctggagaacaagaacctggtgcacggcaatgtgtgtggcaggaacatcctgctggcccggctgggcctggccgagggcaccagccccttcatcaagctgagtgaccccggggtgggcctgggcgccctgagccgggaggagcgggtggagcgcatcccctggctggcccctgagtgcctgcctggaggagccaacagcctgagcacagccatggacaagtggggctttggagccaccctgctggagatctgctttgatggagaggcccccctgcagagccgcagccccagcgagaaggagcacttctaccagaggcagcaccggctgcctgagcccagctgcccccagctggccaccctgaccagccagtgcctgacctatgagcccacccagaggcccagcttccgcaccatcctgcgggacctgacccggctgcagccccacaacctggctgatgtgctgactgtgaacccagacagccctgccagtgaccccaccgtcttccacaagcgctacctgaagaagatccgggacctgggggagggccactttgggaaggtgtccctgtactgctatgaccccaccaatgatggcactggagagatggtggccgtgaaggccctgaaggctgactgtggcccccagcacaggagcggctggaagcaggagattgacatcctgcggaccctgtaccacgagcacatcatcaagtacaagggctgctgtgaggaccagggcgagaagagcctgcagctggtgatggagtatgtgcccctgggcagcctgcgggactacctgcccaggcacagcatcggcctggcccagctgctgctgtttgcccagcagatctgtgagggcatggcctacctgcacgcccagcactacatccaccgggacctggccgccagaaatgtgctgctggacaatgaccggctggtgaagattggagactttggcctggccaaggctgtgcctgagggccacgagtactacagagtgagagaagatggagacagccctgtgttctggtacgccccagaatgtctgaaggagtacaagttctactatgccagtgatgtgtggagctttggagtgaccctgtatgagctgctgacccactgtgacagcagccagagcccccccaccaagttcctggagctgattggcatcgcccagggccagatgacagtgctgcggctgacagagctgctggagcggggggagcggctgcccaggccagacaagtgcccctgtgaggtgtaccacctgatgaagaactgctgggagacagaggccagcttccggcccacctttgaaaatctcatccccatcctgaagacagtgcatgagaagtaccagggccaggcccccagcgtcttctctgtgtgctag

SEQ ID NO: 174999 - DNA, 3564 bp, Artificial Sequence; identical to SEQ ID NO: 174998
  Description of Artificial Sequence: Synthetic coding sequence

SEQ ID NO: 175000 - DNA, 357 bp, Artificial Sequence
  Description of Artificial Sequence: Synthetic coding sequence
atgcccctgcggcactggggcatggcccggggcagcaagcctgtgggagatggagcccagcccatggccgccatgggcggcctgaaggtgctgctgcactgggccggccctgggggcggggagccctgggtgaccttcagcgagagcagcctgacagctgaggaggtgtgcatccacatcgcccacaaggtgggcatcaccccaccctgcttcaacctgtttgccctgtttgatgcccaggcccaggtgtggctgccccccaaccacatcctggagatccccagagatgccagcctgatgctgtacttccgcatccgcttctacttcaggaactggcacggcatgaaccccaggtag

SEQ ID NO: 175001 - DNA, 2805 bp, Artificial Sequence
  Description of Artificial Sequence: Synthetic coding sequence
atggtgatggtgaagtacctggccaccctggagcggctggcccccaggtttggaacagagcgggtgcctgtgtgccacctgcggctgctggcccaggccgagggggagccctgctacatccgggacagcggcgtggcccccacagaccccggccctgagagcgctgctggcccccccacccatgaggtgctggtgacaggcaccggcggcatccagtggtggcctgtggaggaggaggtgaacaaggaggagggcagcagcggcagcagcggcaggaacccccaggccagcctgtttgggaagaaggccaaggcccacaaggctgtgggccagcctgctgaccggccccgggagcccctgtgggcctacttctgtgacttccgggacatcacccacgtggtgctgaaggagcactgtgtgtccatccaccggcaggacaacaagtgcctggagctgagcctgcccagcagagctgctgccctgagctttgtgtccctggtggatggctacttccggctgacagctgacagcagccactacctgtgccacgaggtggccccaccccggctggtgatgagcatcagagatggcatccacggccccctgctggagccctttgtgcaggccaagctgcggccagaagatggcctgtacctgatccactggagcaccagccacccctaccgcctcatcctgactgtggcccagaggagccaggccccagatggcatgcagagcctgcggctgaggaagttccccatcgagcagcaggatggagcctttgtgctggagggctggggccgctccttccccagcgtgcgggagctgggcgccgccctgcagggctgcctgctgcgggctggagatgactgcttcagcctgcggcgctgctgcctgccccagcccggggagaccagcaacctgatcatcatgagaggagcccgggccagccccaggaccctgaacctgagccagctgtccttccaccgggtggaccagaaggagatcacccagctgagccacctgggccagggcaccaggaccaacgtgtatgagggccgcctgcgggtggagggcagcggggaccctgaggagggcaagatggatgatgaggaccccctggtgcccggccgggaccggggccaggagctgcgggtggtgctgaaggtgctggaccccagccaccacgacatcgccctggccttctatgaaacagccagcctgatgagccaggtgagccacacccacctggcctttgtgcatggagtgtgtgtgcggggccctgagaacatcatggtgacagaatatgtggagcacggccccctggatgtgtggctgcggcgggagcggggccacgtgcccatggcctggaagatggtggtggcccagcagctggccagcgccctgagctacctggagaacaagaacctggtgcatggaaatgtgtgtggcaggaacatcctgctggcccggctgggcctggccgagggcaccagccccttcatcaagctgagtgaccccggggtgggcctgggcgccctgagccgggaggagcgggtggagcgcatcccctggctggccccagaatgtctgcccggcggggccaacagcctgagcacagccatggacaagtggggctttggagccaccctgctggagatctgctttgatggagaggcccccctgcagagccgcagccccagcgagaaggagcacttctaccagaggcagcaccggctgcctgagcccagctgcccccagctggccaccctgaccagccagtgcctgacctatgagcccacccagaggcccagcttccgcaccatcctgcgggacctgacccggctgcagccccacaacctggctgatgtgctgactgtgaacccagacagccctgccagtgaccccaccgtcttccacaagcgctacctgaagaagatccgggacctgggggagggccactttgggaaggtgtccctgtactgctatgaccccaccaatgatggcaccggggagatggtggccgtgaaggccctgaaggctgactgtggcccccagcacaggagcggctggaagcaggagattgacatcctgcggaccctgtaccacgagcacatcatcaagtacaagggctgctgtgaggaccagggcgagaagagcctgcagctggtgatggagtatgtgcccctgggcagcctgcgggactacctgcccaggcacagcatcggcctggcccagctgctgctgtttgcccagcagatctgtgagggcatggcctacctgcacgcccagcactacatccaccgggacctggccgccagaaatgtgctgctggacaatgaccggctggtgaagatcggggactttggcctggccaaggctgtgcctgagggccacgagtactacagagtgcgggaggatggagacagccctgtgttctggtacgcccctgagtgcctgaaggagtacaagttctactatgccagtgatgtgtggagctttggagtgaccctgtatgagctgctgacccactgtgacagcagccagagcccccccaccaagttcctggagctgattggaattgcccagggccagatgacagtgctgcggctgacagagctgctggagcggggggagcggctgcccaggccagacaagtgcccctgtgaggtgtaccacctgatgaagaactgctgggagacagaggccagcttccggcccacctttgagaacctgatccccatcctgaagacagtgcatgagaagtaccagggccaggcccccagcgtcttctctgtgtgctag

SEQ ID NO: 175002 - DNA, 1986 bp, Artificial Sequence
  Description of Artificial Sequence: Synthetic coding sequence
atgctgcctgaggccggcagcctgtggctgctgaagctgctgcgggacatccagctggcccagttctactggcccatcctggaggagctgaatgtgaccaggcctgagcactttgattttgtgaagccagaggacctggatggcatcggcatgggccggcctgcccagaggcggctgtctgaggccctgaagaggctgcggagcggccccaagagcaagaactgggtgtacaagatcctgggcggctttgcccctgagcacaaggagcccaccctgcccagcgacagccccaggcacctgcctgagcctgagggcggcctgaagtgcctgatccctgagggcgctgtgtgccgcggggagctgctgggcagcggctgctttggagtggtgcaccggggcctgtggaccctgcccagcggcaagtctgtgcctgtggccgtgaagagcctgcgggtgggccctgagggccccatgggcacagagctgggggacttcctgcgggaggtgtctgtgatgatgaacctggagcacccccacgtgctgcggctgcacggcctggtgctgggccagcccctgcagatggtgatggagctggcccccctgggcagcctgcacgcccggctgacagccccagcccccaccccacccctgctggtggccctgctgtgcctcttcctgcggcagctggccggggccatggcctacctgggcgcccggggcctggtgcaccgggacctggccaccaggaacctgctgctggccagccccaggaccatcaaggtggccgactttggcctggtgcggcccctgggcggggcccggggccgctacgtgatgggcggcccccggcccatcccctatgcctggtgtgcccctgagagcctgcggcatggagccttcagcagcgccagtgatgtgtggatgtttggagtgaccctgtgggagatgttcagcggcggggaggagccctgggccggcgtgcccccctacctgatcctgcagaggctggaggaccgggcccggctgcccaggcctcccctgtgcagccgggccctgtacagcctggccctgcgctgctgggccccccaccctgctgaccggcccagcttcagccacctggagggcctgctgcaggaggccggccccagcgaggcctgctgcgtgagagatgtgacagagcccggggccctgaggatggagactggagaccccatcaccgtcatcgagggcagcccagacagcaccatctggaagggccagaatggaagaaccttcaaggtgggcagcttccctgccagcgctgtgaccctggctgatgctgggggcctgcctgccaccaggcctgtgcaccggggcaccccagcccggggggaccagcaccctggcagcattgatggagacaggaagaaggccaacctgtgggatgcccccccagcccggggccagaggaggaacatgcccctggagaggatgaagggcatcagccgcagcctggagagcgtgctgagcctgggcccccggcccactggaggcggcagcagccccccagagatccggcaggcccgggctgtgccccagggccccccaggcctgccccccaggcctcccctgagcagcagcagcccccagcccagccagcccagccgggagcggctgccctggcccaagaggaagccaccccacaaccaccccatgggcatgcctggggccaggaaggccgccgccctgagcggcggcctgctgagtgaccctgagctgcagaggaagatcatggaggtggagctgtctgtgcacggcgtgacccaccaggagtgccagacagccctgggcgccactggaggagatgtggtgtctgccatccggaacctgaaggtggaccagctgttccacctgagcagccgcagcagagctgactgctggaggatcctggagcactaccagtgggacctgtctgctgccagccgctacgtgctggcccggccctag

SEQ ID NO: 175003 - DNA, 1986 bp, Artificial Sequence; identical to SEQ ID NO: 175002
  Description of Artificial Sequence: Synthetic coding sequence

SEQ ID NO: 175004 - DNA, 1587 bp, Artificial Sequence
  Description of Artificial Sequence: Synthetic coding sequence
atgcagcctgaggagggcaccggctggctgctggagctgctgtctgaggtgcagctgcagcagtacttcctgcggctgagagatgacctgaatgtgacccggctgagccactttgaatatgtgaagaatgaagacctggagaagattggcatgggccggcccggccagaggcggctgtgggaggccgtgaagaggaggaaggccctgtgcaagaggaagtcctggatgagcaaggtgttttctgggaagaggctggaggccgagttccccccccaccacagccagagcaccttcaggaagaccagccctgcccctgggggccctgctggggagggccccctgcagagcctgacctgcctgattggagagaaggacctgcggctgctggagaagctgggagatggcagctttggagtggtgagaagaggagagtgggatgcccccagcggcaagacagtgtctgtggccgtgaagtgcctgaagccagatgtgctgagccagcctgaggccatggatgacttcatccgggaggtgaatgccatgcacagcctggaccacaggaacctgatccggctgtatggagtggtgctgaccccacccatgaagatggtgacagagctggcccccctgggcagcctgctggaccggctgaggaagcaccagggccacttcctgctgggcaccctgagccgctatgctgtgcaggtggccgagggcatgggctacctggagagcaagcgcttcatccaccgggacctggccgccaggaacctgctgctggccacccgggacctggtgaagatcggggactttggcctgatgagggccctgccccagaatgatgaccactacgtgatgcaggagcacaggaaggtgccctttgcctggtgtgcccctgagagcctgaagaccaggaccttcagccacgccagtgacacctggatgtttggagtgaccctgtgggagatgttcacctacggccaggagccctggattggcctgaatggcagccagatcctgcacaagattgacaaggagggggagcggctgcccaggcctgaggactgcccccaggacatctacaacgtgatggtgcagtgctgggcccacaagccagaagatcggcccacctttgtggccctgcgggacttcctgctggaggcccagcccacagacatgagggccctgcaggactttgaggagccagacaagctgcacatccagatgaatgatgtgatcaccgtcatcgagggccgggcagagaactactggtggaggggccagaacaccaggaccctgtgtgtgggccccttccccagaaatgtggtgacctctgtggccggcctgagcgcccaggacatcagccagcccctgcagaacagcttcatccacactggacatggagacagcgaccccaggcactgctggggcttcccagacagaattgatgagtgccccttcagcgccttcagccctggccaccccccagctgagacctgtggccaggtgctgtggacaggccggcgggaggcctgtgccagtgacccccggctgcaccctgtgagcagcaggaccaagggcctgtag

SEQ ID NO: 175005 - DNA, 3117 bp, Artificial Sequence
  Description of Artificial Sequence: Synthetic coding sequence
atgcagcctgaggagggcaccggctggctgctggagctgctgtctgaggtgcagctgcagcagtacttcctgcggctgagagatgacctgaatgtgacccggctgagccactttgaatatgtgaagaatgaagacctggagaagattggcatgggccggcccggccagaggcggctgtgggaggccgtgaagaggaggaaggccctgtgcaagaggaagtcctggatgagcaaggtgttttctgggaagaggctggaggccgagttccccccccaccacagccagagcaccttcaggaagaccagccctgcccctgggggccctgctggggagggccccctgcagagcctgacctgcctgattggagagaaggacctgcggctgctggagaagctgggagatggcagctttggagtggtgagaagaggagagtgggatgcccccagcggcaagacagtgtctgtggccgtgaagtgcctgaagccagatgtgctgagccagcctgaggccatggatgacttcatccgggaggtgaatgccatgcacagcctggaccacaggaacctgatccggctgtatggagtggtgctgaccccacccatgaagatggtgacagagctggcccccctgggcagcctgctggaccggctgaggaagcaccagggccacttcctgctgggcaccctgagccgctatgctgtgcaggtggccgagggcatgggctacctggagagcaagcgcttcatccaccgggacctggccgccaggaacctgctgctggccacccgggacctggtgaagatcggggactttggcctgatgagggccctgccccagaatgatgaccactacgtgatgcaggagcacaggaaggtgccctttgcctggtgtgcccctgagagcctgaagaccaggaccttcagccacgccagtgacacctggatgtttggagtgaccctgtgggagatgttcacctacggccaggagccctggattggcctgaatggcagccagatcctgcacaagattgacaaggagggggagcggctgcccaggcctgaggactgcccccaggacatctacaacgtgatggtgcagtgctgggcccacaagccagaagatcggcccacctttgtggccctgcgggacttcctgctggaggcccagcccacagacatgagggccctgcaggactttgaggagccagacaagctgcacatccagatgaatgatgtgatcaccgtcatcgagggccgggcagagaactactggtggaggggccagaacaccaggaccctgtgtgtgggccccttccccagaaatgtggtgacctctgtggccggcctgagcgcccaggacatcagccagcccctgcagaacagcttcatccacactggacatggagacagcgaccccaggcactgctggggcttcccagacagaattgatgagctgtacctgggcaaccccatggaccccccagacctgctgtctgtggagctgagcaccagccggcccccccagcacctgggcggcgtgaagaagcccacctatgaccctgtgtctgaggaccaggaccccctgagcagtgacttcaagaggctgggcctgaggaagccaggcctgccccggggcctgtggctggccaagcccagcgcccgggtgcccggcaccaaggccagccggggcagcggggctgaggtgaccctgattgactttggagaggagcctgtggtgcctgccctgcggccctgtgcccccagcctggcccagctggccatggatgcctgcagcctgctggatgagaccccaccccagagccccacccgggccctgccccggcccctgcaccccacccctgtggtggactgggatgcccggcccctgcccccacctccagcctatgatgatgtggcccaggatgaagatgactttgagatctgcagcatcaacagcaccctggtgggcgccggcgtgcctgctggccccagccagggccagaccaactatgcctttgtgcctgagcaggcccggcccccaccacccctggaggacaacctcttcctgcccccccagggcggcggcaagccacccagcagcgcccagacagctgagatcttccaggccctgcagcaggagtgcatgaggcagctgcaggccccagctggcagccctgcccccagccccagccctggaggagatgacaagccccaggtgcccccccgggtgcccatccccccccggcccacccggccccacgtgcagctgagccctgcccctcctggagaggaggagaccagccagtggccaggccctgccagccccccccgggtgcccccccgggagcccctgagcccccagggcagcaggacccccagccccctggtgcccccaggcagcagccccctgcccccccggctgagcagcagccctgggaagaccatgcccaccacccagagctttgccagtgaccccaagtatgccaccccccaggtgatccaggcccctggcccccgggccggcccctgcatcctgcccatcgtgagagatggcaagaaggtgagcagcacccactactacctgctgcctgagcggcccagctacctggagcgctaccagcgcttcctgcgggaggcccagagccctgaggagcccacccccctgcctgtgcccctgctgctgcccccacccagcaccccagccccagctgcccccacagccaccgtgcggcccatgccccaggccgccctggaccccaaggccaacttcagcaccaacaacagcaaccctggggcccggcccccaccaccccgggccacagcccggctgccccagaggggctgccctggagatggccctgaggccggccggcctgctgacaagatccagatggccatggtgcacggcgtgaccacagaggagtgccaggccgccctgcagtgccacggctggagcgtgcagagagctgcccagtacctgaaggtggagcagctgtttggcctgggcctgcggcccagaggagagtgccacaaggtgctggagatgtttgactggaacctggagcaggccggctgccacctgctgggctcctggggccctgcccaccacaagaggtag

SEQ ID NO: 175006 - DNA, 3261 bp, Artificial Sequence
  Description of Artificial Sequence: Synthetic coding sequence
atgctggaggcccggccccccaggacccagggcagtgatgctgctggagctgctgctggccggggcctgcgggccctgctgctgagcctgacagctgctgctggcatctggggctccatgggagagaggtctgcctaccagaggctggccggcggggaggagggcccccagaggctgggcggcggccgcatgcagcctgaggagggcaccggctggctgctggagctgctgtctgaggtgcagctgcagcagtacttcctgcggctgagagatgacctgaatgtgacccggctgagccactttgaatatgtgaagaatgaagacctggagaagattggcatgggccggcccggccagaggcggctgtgggaggccgtgaagaggaggaaggccctgtgcaagaggaagtcctggatgagcaaggtgttcagcggcaagaggctggaggccgagttccccccccaccacagccagagcaccttcaggaagaccagccctgcccctgggggccctgctggggagggccccctgcagagcctgacctgcctgattggagagaaggacctgcggctgctggagaagctgggagatggcagctttggagtggtgcggcggggggagtgggatgcccccagcggcaagacagtgtctgtggccgtgaagtgcctgaagccagatgtgctgagccagcctgaggccatggatgacttcatccgggaggtgaatgccatgcacagcctggaccacaggaacctgatccggctgtatggagtggtgctgaccccacccatgaagatggtgacagagctggcccccctgggcagcctgctggaccggctgaggaagcaccagggccacttcctgctgggcaccctgagccgctatgctgtgcaggtggccgagggcatgggctacctggagagcaagcgcttcatccaccgggacctggccgccaggaacctgctgctggccacccgggacctggtgaagattggagactttggcctgatgagggccctgccccagaatgatgaccactacgtgatgcaggagcacaggaaggtgccctttgcctggtgtgcccctgagagcctgaagaccaggaccttcagccacgccagtgacacctggatgtttggagtgaccctgtgggagatgttcacctacggccaggagccctggattggcctgaatggcagccagatcctgcacaagattgacaaggagggggagcggctgcccaggcctgaggactgcccccaggacatctacaacgtgatggtgcagtgctgggcccacaagccagaggaccggcccacctttgtggccctgcgggacttcctgctggaggcccagcccacagacatgagggccctgcaggactttgaggagccagacaagctgcacatccagatgaatgatgtgatcaccgtgattgagggccgggcagagaactactggtggaggggccagaacaccaggaccctgtgtgtgggccccttccccagaaatgtggtgacctctgtggccggcctgagcgcccaggacatcagccagcccctgcagaacagcttcatccacacaggccacggggacagcgaccccaggcactgctggggcttcccagacagaattgatgagctgtacctgggcaaccccatggaccccccagacctgctgtctgtggagctgagcaccagcaggcctccccagcacctgggcggcgtgaagcgggagcccccaccccggcccccccagcctgccttcttcacccagaagcccacctatgaccctgtgtctgaggaccaggaccccctgagcagtgacttcaagaggctgggcctgaggaagccaggcctgccccggggcctgtggctggccaagcccagcgcccgggtgcccggcaccaaggccagccggggcagcggggctgaggtgaccctgattgactttggagaggagcctgtggtgcctgccctgcggccctgtgcccccagcctggcccagctggccatggatgcctgcagcctgctggatgagaccccaccccagagccccacccgggccctgccccggcccctgcaccccacccctgtggtggactgggatgcccggcccctgcccccacctccagcctatgatgatgtggcccaggatgaagatgactttgagatctgcagcatcaacagcaccctggtgggcgccggcgtgcctgctggccccagccagggccagaccaactatgcctttgtgcctgagcaggcccggcccccaccacccctggaggacaacctcttcctgcccccccagggcggcggcaagccacccagcagcgcccagacagctgagatcttccaggccctgcagcaggagtgcatgaggcagctgcaggccccagctggcagccctgcccccagccccagccctggaggagatgacaagccccaggtgcccccccgggtgcccatccccccccggcccacccggccccacgtgcagctgagccctgcccctcctggagaggaggagaccagccagtggccaggccctgccagccccccccgggtgcccccccgggagcccctgagcccccagggcagcaggacccccagccccctggtgcccccaggcagcagccccctgcccccccggctgagcagcagccctgggaagaccatgcccaccacccagagctttgccagtgaccccaagtatgccaccccccaggtgatccaggcccctggcccccgggccggcccctgcatcctgcccatcgtgagagatggcaagaaggtgagcagcacccactactacctgctgcctgagcggcccagctacctggagcgctaccagcgcttcctgcgggaggcccagagccctgaggagcccacccccctgcctgtgcccctgctgctgcccccacccagcaccccagccccagctgcccccacagccaccgtgcggcccatgccccaggccgccctggaccccaaggccaacttcagcaccaacaacagcaaccctggggcccggcccccaccaccccgggccacagcccggctgccccagaggggctgccctggagatggccctgaggccggccggcctgctgacaagatccagatggtggagcagctgtttggcctgggcctgcggcccagaggagagtgccacaaggtgctggagatgtttgactggaacctggagcaggccggctgccacctgctgggctcctggggccctgcccaccacaagaggtag

SEQ ID NO: 175007 - DNA, 3117 bp, Artificial Sequence; identical to SEQ ID NO: 175005
  Description of Artificial Sequence: Synthetic coding sequence

SEQ ID NO: 175008 - DNA, 294 bp, Artificial Sequence
  Description of Artificial Sequence: Synthetic coding sequence
atgcagcctgaggagggcaccggctggctgctggagctgctgtctgaggtgcagctgcagcagtacttcctgcggctgagagatgacctgaatgtgacccggctgagccactttgaatatgtgaagaatgaagacctggagaagattggcatgggccggcccggccagaggcggctgtgggaggccgtgaagaggaggaaggccctgtgcaagaggaagtcctggatgagcaaggtgttttctgggaagaggctggaggccgagttccccccccaccacagccagagcacctag

SEQ ID NO: 175009 - DNA, 1827 bp, Artificial Sequence
  Description of Artificial Sequence: Synthetic coding sequence
atgagccaggagggggactatggccgctggaccatcagcagcagtgatgagagcgaggaggagaagcccaagccagacaagcccagcaccagcagcctgctgtgtgcccggcagggcgccgccaatgagccccgctacacctgcagcgaggcccagaaggccgcccacaagaggaagatcagccctgtgaagttcagcaacacagacagcgtgctgccccccaagaggcagaagagcggcagccaggaggacctgggctggtgcctgagcagcagtgatgatgagctgcagcctgagatgccccagaagcaggccgagaaggtggtgatcaagaaggagaaggacatcagcgccccaaatgatggaacagcccagaggacagagaaccacggggccccagcctgccaccggctgaaggaggaggaggatgaatatgagaccagcggggagggccaggacatctgggacatgctggacaagggcaaccccttccagttctacctgaccagggtgtctggagtgaagcccaagtacaacagcggggccctgcacatcaaggacatcctgagccccctgtttggcaccctggtgtcctctgcccagttcaactactgctttgatgtggactggctggtgaagcagtacccacctgagttcaggaagaagcccatcctgctggtgcacggggacaagcgggaggccaaggcccacctgcacgcccaggccaagccctatgagaacatcagcctgtgccaggccaagctggacatcgccttcggcacccaccacaccaagatgatgctgctgctgtatgaggagggcctgcgggtggtgatccacaccagcaacctgattcatgctgactggcaccagaagacccagggcatctggctgagccccctgtaccccagaattgctgatggcacccacaagagcggggagagccccacccacttcaaggctgacctgatctcctacctgatggcctacaatgcccccagcctgaaggagtggattgatgtgatccacaagcatgacctgtctgagaccaacgtgtacctgattggcagcaccccaggccgcttccagggcagccagaaggacaactggggccacttccggctgaagaagctgctgaaggaccacgccagctccatgcccaatgctgagagctggcctgtggtgggccagttcagctctgtgggcagcctgggcgcagatgagagcaagtggctgtgcagcgagttcaaggagagcatgctgaccctgggcaaggagagcaagacccctgggaagagctctgtgcccctgtacctgatctaccccagcgtggagaatgtgaggaccagcctggagggctacccagctgggggcagcctgccctacagcatccagacagctgagaagcagaactggctgcacagctacttccacaagtggagcgctgagaccagcggccgcagcaatgccatgccccacatcaagacctacatgaggcccagcccagacttcagcaagatcgcctggttcctggtgaccagcgccaacctgagcaaggccgcctggggcgccctggagaagaatggcacccagctgatgatccgctcctatgagctgggcgtgctcttcctgcccagcgccttcggcctggacagcttcaaggtgaagcagaagttctttgctggcagccaggagcccatggccaccttccctgtgccctatgacctgcccccagagctgtatggcagcaaggaccggccctggatctggaacatcccctacgtgaaggccccagacacccacggcaacatgtgggtgcccagctag

SEQ ID NO: 175010 - DNA, 1110 bp, Artificial Sequence
  Description of Artificial Sequence: Synthetic coding sequence
atggtgatcagcgagcggctgcggctgacctccatgccccggcccagcctgaccaggaccagcctgagcgccaggaagatgatgctgctgctgtatgaggagggcctgcgggtggtgatccacaccagcaacctgattcatgctgactggcaccagaagacccagggcatctggctgagccccctgtaccccagaattgctgatggcacccacaagtctggagagagccccacccacttcaaggctgacctgatctcctacctgatggcctacaatgcccccagcctgaaggagtggattgatgtgatccacaagcatgacctgtctgagaccaacgtgtacctgattggcagcaccccaggccgcttccagggcagccagaaggacaactggggccacttccggctgaagaagctgctgaaggaccacgccagctccatgcccaatgctgagagctggcctgtggtgggccagttcagctctgtgggcagcctgggcgcagatgagagcaagtggctgtgcagcgagttcaaggagagcatgctgaccctgggcaaggagagcaagaccccaggcaagagctctgtgcccctgtacctgatctaccccagcgtggagaatgtgaggaccagcctggagggctacccagctgggggcagcctgccctacagcatccagacagctgagaagcagaactggctgcacagctacttccacaagtggagcgctgagaccagcggccgcagcaatgccatgccccacatcaagacctacatgaggcccagcccagacttcagcaagatcgcctggttcctggtgaccagcgccaacctgagcaaggccgcctggggcgccctggagaagaatggcacccagctgatgatccgctcctatgagctgggcgtgctcttcctgcccagcgccttcggcctggacagcttcaaggtgaagcagaagttctttgctggcagccaggagcccatggccaccttccctgtgccctatgacctgcccccagagctgtatggcagcaaggaccggccctggatctggaacatcccctacgtgaaggccccagacacccacggcaacatgtgggtgcccagctag

SEQ ID NO: 175011 - DNA, 1827 bp, Artificial Sequence; identical to SEQ ID NO: 175009
  Description of Artificial Sequence: Synthetic coding sequence

SEQ ID NO: 175012 - DNA, 897 bp, Artificial Sequence
  Description of Artificial Sequence: Synthetic coding sequence
atgagccaggagggggactatggccgctggaccatcagcagcagtgatgagagcgaggaggagaagcccaagccagacaagcccagcaccagcagcctgctgtgtgcccggcagggcgccgccaatgagccccgctacacctgcagcgaggcccagaaggccgcccacaagaggaagatcagccctgtgaagttcagcaacacagacagcgtgctgccccccaagaggcagaagagcggcagccaggaggacctgggctggtgcctgagcagcagtgatgatgagctgcagcctgagatgccccagaagcaggccgagaaggtggtgatcaagaaggagaaggacatcagcgccccaaatgatggaacagcccagaggacagagaaccacggggccccagcctgccaccggctgaaggaggaggaggatgaatatgagaccagcggggagggccaggacatctgggacatgctggacaagggcaaccccttccagttctacctgaccagggtgtctggagtgaagcccaagtacaacagcggggccctgcacatcaaggacatcctgagccccctgtttggcaccctggtgtcctctgcccagttcaactactgctttgatgtggactggctggtgaagcagtacccacctgagttcaggaagaagcccatcctgctggtgcacggggacaagcgggaggccaaggcccacctgcacgcccaggccaagccctatgagaacatcagcctgtgccaggccaagctggacatcgccttcggcacccaccacaccaagatgatgctgctgctgtatgaggagggcctgcgggtggtgatccacaccagcaacctgattcatgctgactggcaccagaagacccagggcacccacctgtag

SEQ ID NO: 175013 - DNA, 441 bp, Artificial Sequence
  Description of Artificial Sequence: Synthetic coding sequence
atgagccaggagggggactatggccgctggaccatcagcagcagtgatgagagcgaggaggagaagcccaagccagacaagcccagcaccagcagcctgctgtgtgcccggcagggcgccgccaatgagccccgctacacctgcagcgaggcccagaaggccgcccacaagaggaagatcagccctgtgaagttcagcaacacagacagcgtgctgccccccaagaggcagaagagcggcagccaggaggacctgggctggtgcctgagcagcagtgatgatgagctgcagcctgagatgccccagaagcaggccgagaaggtggtgatcaagaaggagaaggacatcagcgccccaaatgatggaacagcccagaggacagagaaccacggggccccagcctgccaccggctgaaggaggaggaggatgaatatgaatag

SEQ ID NO: 175014 - DNA, 447 bp, Artificial Sequence
  Description of Artificial Sequence: Synthetic coding sequence
atgagccaggagggggactatggccgctggaccatcagcagcagtgatgagagcgaggaggagaagcccaagccagacaagcccagcaccagcagcctgctgtgtgcccggcagggcgccgccaatgagccccgctacacctgcagcgaggcccagaaggccgcccacaagaggaagatcagccctgtgaagttcagcaacacagacagcgtgctgccccccaagaggcagaagagcggcagccaggaggacctgggctggtgcctgagcagcagtgatgatgagctgcagcctgagatgccccagaagcaggccgagaaggtggtgatcaagaaggagaaggacatcagcgccccaaatgatggaacagcccagaggacagagaaccacggggccccagcctgccaccggctgaaggaggaggaggatgaatatgagaccagctag

SEQ ID NO: 175015 - DNA, 840 bp, Artificial Sequence
  Description of Artificial Sequence: Synthetic coding sequence
atgagccaggagggggactatggccgctggaccatcagcagcagtgatgagagcgaggaggagaagcccaagccagacaagcccagcaccagcagcctgctgtgtgcccggcagggcgccgccaatgagccccgctacacctgcagcgaggcccagaaggccgcccacaagaggaagatcagccctgtgaagttcagcaacacagacagcgtgctgccccccaagaggcagaagagcggcagccaggaggacctgggctggtgcctgagcagcagtgatgatgagctgcagcctgagatgccccagaagcaggccgagaaggtggtgatcaagaaggagaaggacatcagcgccccaaatgatggaacagcccagaggacagagaaccacggggccccagcctgccaccggctgaaggaggaggaggatgaatatgagaccagcggggagggccaggacatctgggacatgctggacaagggcaaccccttccagttctacctgaccagggtgtctggagtgaagcccaagtacaacagcggggccctgcacatcaaggacatcctgagccccctgtttggcaccctggtgtcctctgcccagttcaactactgctttgatgtggactggctggtgaagcagtacccacctgagttcaggaagaagcccatcctgctggtgcacggggacaagcgggaggccaaggcccacctgcacgcccaggccaagccctatgagaacatcagcctgtgccaggccaagctggacatcgccttcggcacccaccacaccaagatgatgctgctgctgtatgaggagggcctgcgggtggtgatctag

SEQ ID NO: 175016 - DNA, 486 bp, Artificial Sequence
  Description of Artificial Sequence: Synthetic coding sequence
atgagccaggagggggactatggccgctggaccatcagcagcagtgatgagagcgaggaggagaagcccaagccagacaagcccagcaccagcagcctgctgtgtgcccggcagggcgccgccaatgagccccgctacacctgcagcgaggcccagaaggccgcccacaagaggaagatcagccctgtgaagttcagcaacacagacagcgtgctgccccccaagaggcagaagagcggcagccaggaggacctgggctggtgcctgagcagcagtgatgatgagctgcagcctgagatgccccagaagcaggccgagaaggtggtgatcaagaaggagaaggacatcagcgccccaaatgatggaacagcccagaggacagagaaccacggggccccagcctgccaccggctgaaggaggaggaggatgaatatgagaccagcggggagggccaggacatctgggacatgctggacaagggctag

SEQ ID NO: 175017 - DNA, 456 bp, Artificial Sequence
  Description of Artificial Sequence: Synthetic coding sequence
atgagccaggagggggactatggccgctggaccatcagcagcagtgatgagagcgaggaggagaagcccaagccagacaagcccagcaccagcagcctgctgtgtgcccggcagggcgccgccaatgagccccgctacacctgcagcgaggcccagaaggccgcccacaagaggaagatcagccctgtgaagttcagcaacacagacagcgtgctgccccccaagaggcagaagagcggcagccaggaggacctgggctggtgcctgagcagcagtgatgatgagctgcagcctgagatgccccagaagcaggccgagaaggtggtgatcaagaaggagaaggacatcagcgccccaaatgatggaacagcccagaggacagagaaccacggggccccagcctgccaccggctgaaggaggaggaggatgaatatgagaccagcggggagggctag

SEQ ID NO: 175018 - DNA, 1113 bp, Artificial Sequence
  Description of Artificial Sequence: Synthetic coding sequence
atggtgggcaagctgaagcagaacctgctgctggcctgcctggtgatcagctctgtgaccgtcttctacctgggccagcacgccatggagtgccaccacagaattgaggagaggagccagcctgtgaagctggagagcaccaggaccaccgtgaggacaggcctggacctgaaggccaacaagacctttgcctaccacaaggacatgcccctcatcttcatcggcggcgtgcccaggagcggcaccaccctgatgagggccatgctggatgcccacccagacatccgctgtggggaggagaccagggtcatcccccgcatcctggccctgaagcagatgtggagccgcagcagcaaggagaagatccggctggatgaagctggggtgacagatgaggtgctggacagcgccatgcaggccttcctgctggagatcatcgtgaagcatggagagcccgccccctacctgtgcaacaaggacccctttgccctgaagagcctgacctacctgagccgcctcttccccaatgccaagttcctgctgatggtgagagatggccgggcctctgtgcacagcatgatcagcaggaaggtgaccatcgccggctttgacctgaacagctacagagactgcctgaccaagtggaacagagccatcgagaccatgtacaaccagtgcatggaggtgggctacaagaagtgcatgctggtgcactatgagcagctggtgctgcaccctgagcgctggatgaggaccctgctgaagttcctgcagatcccctggaaccacagcgtgctgcaccacgaggagatgattggcaaggccggcggcgtgtccctgagcaaggtggagaggagcacagaccaggtgatcaagcctgtgaatgtgggcgccctgagcaagtgggtgggcaagatccccccagatgtgctgcaggacatggctgtgattgcccccatgctggccaagctgggctatgacccctatgccaacccccccaactacggcaagccagaccccaagatcatcgagaacaccaggagagtgtacaagggggagttccagctgcctgacttcctgaaggagaagccccagacagagcaggtggagtag

SEQ ID NO: 175019 - DNA, 129 bp, Artificial Sequence
  Description of Artificial Sequence: Synthetic coding sequence
atggtgggcaagctgaagcagaacctgctgctggcctgcctggtgatcagctctgtgaccgtcttctacctgggccagcacgccatggagtgccaccacagaattgaggagaggagccagcctgtgtag

SEQ ID NO: 175020 - DNA, 423 bp, Artificial Sequence
  Description of Artificial Sequence: Synthetic coding sequence
atggtgggcaagctgaagcagaacctgctgctggcctgcctggtgatcagctctgtgaccgtcttctacctgggccagcacgccatggagtgccaccacagaattgaggagaggagccagcctgtgaagctggagagcaccaggaccaccgtgaggacaggcctggacctgaaggccaacaagacctttgcctaccacaaggacatgcccctcatcttcatcggcggcgtgcccaggagcggcaccaccctgatgagggccatgctggatgcccacccagacatccgctgtggggaggagaccagggtcatcccccgcatcctggccctgaagcagatgtggagccgcagcagcaaggagaagatccggctggatgaagctggggtgacagatgaggtgctggacagcgccatgcaggcctag

SEQ ID NO: 175021 - DNA, 1083 bp, Artificial Sequence
  Description of Artificial Sequence: Synthetic coding sequence
atggtgggcaagctgaagcagaacctgctgctggcctgcctggtgatcagctctgtgaccgtcttctacctgggccagcacgccatggagtgccaccacagaattgaggagaggagccagcctgtgaagctggagagcaccaggaccaccgtgaggacaggcctggacctgaaggccaacaagacctttgcctaccacaaggacatgcccctcatcttcatcggcggcgtgcccaggagcggcaccaccctgatgagggccatgctggatgcccacccagacatccgctgtggggaggagaccagggtcatcccccgcatcctggccctgaagcagatgtggagccgcagcagcaaggagaagatccggctggatgaagctggggtgacagatgaggtgctggacagcgccatgcaggccttcctgctggagatcatcgtgaagcatggagagcccgccccctacctgtgcaacaaggacccctttgccctgaagagcctgacctacctgagccgcctcttccccaatgccaagttcctgctgatggtgagagatggccgggcctctgtgcacagcatgatcagcaggaaggtgaccatcgccggctttgacctgaacagctacagagactgcctgaccaagtggaacagagccatcgagaccatgtacaaccagtgcatggaggtgggctacaagaagtgcatgctggtgcactatgagcagctggtgctgcaccctgagcgctggatgaggaccctgctgaagttcctgcagatcccctggaaccacagcgtgctgcaccacgaggagatgattggcaaggccggcggcgtgtccctgagcaaggtggagaggagcacagaccaggtgatcaagcctgtgaatgtgggcgccctgagcaagtgggtgggcaagatccccccagatgtgctgcaggacatggctgtgattgcccccatgctggccaagctgggctatgacccctatgccaacccccccaactacggcaagccagaccccaagatcatcgagaacacccggcgggagcggctgctgcccttccagcagaagggcaacagctag

SEQ ID NO: 175022 - DNA, 1134 bp, Artificial Sequence
  Description of Artificial Sequence: Synthetic coding sequence
atgaggctgtctgtgcggcgggtgctgctggccgccggctgtgccctggtgctggtgctggccgtgcagctgggccagcaggtgctggagtgcagagctgtgctggccggcctgcggagccccaggggggccatgaggcctgagcaggaggagctggtgatggtgggcaccaaccacgtggagtaccgctatggcaaggccatgcccctcatctttgtgggcggcgtgcccaggagcggcaccaccctgatgagggccatgctggatgcccaccctgaggtgcgctgtggggaggagacccgcatcatcccccgggtgctggccatgaggcaggcctggagcaagagcggccgggagaagctgcggctggatgaggccggcgtgacagatgaggtgctggatgctgccatgcaggccttcatcctggaggtgattgccaagcacggggagcccgcccgggtgctgtgcaacaaggaccccttcaccctgaagagctctgtgtacctgagccgcctcttccccaacagcaagttcctgctgatggtgagagatggccgggcctctgtgcacagcatgatcaccaggaaggtgaccatcgccggctttgacctgagcagctacagagactgcctgaccaagtggaacaaggccatcgaggtgatgtatgcccagtgcatggaggtgggcaaggagaagtgcctgcctgtgtactatgagcagctggtgctgcacccccggcgcagcctgaagctgatcctggacttcctgggcatcgcctggagcgatgctgtgctgcaccacgaggacctgattggcaagccaggcggcgtgtccctgagcaagattgaaagaagcacagaccaggtgatcaagcctgtgaacctggaggccctgagcaagtggacaggccacatccctggagatgtggtgcgggacatggcccagatcgcccccatgctggcccagctgggctatgacccctatgccaacccccccaactacggcaacccagaccccttcgtcatcaacaacacccagagggtgctgaagggggactacaagaccccagccaacctgaagggctacttccaggtgaaccagaacagcaccagcagccacctgggcagcagctag

SEQ ID NO: 175023 - DNA, 1134 bp, Artificial Sequence; identical to SEQ ID NO: 175022
  Description of Artificial Sequence: Synthetic coding sequence

SEQ ID NO: 175024 - DNA, 1134 bp, Artificial Sequence; identical to SEQ ID NO: 175022
  Description of Artificial Sequence: Synthetic coding sequence

SEQ ID NO: 175025 - DNA, 195 bp, Artificial Sequence
  Description of Artificial Sequence: Synthetic coding sequence
atgaggctgtctgtgcggcgggtgctgctggccgccggctgtgccctggtgctggtgctggccgtgcagctgggccagcaggtgctggagtgcagagctgtgctggccggcctgcggagccccaggggggccatgaggcctgagcaggaggagctggtgatggtgggcaccaaccacgtggagtaccgctactag

SEQ ID NO: 175026 - DNA, 429 bp, Artificial Sequence
  Description of Artificial Sequence: Synthetic coding sequence
atgaggctgtctgtgcggcgggtgctgctggccgccggctgtgccctggtgctggtgctggccgtgcagctgggccagcaggtgctggagtgcagagctgtgctggccggcctgcggagccccaggggggccatgaggcctgagcaggaggagctggtgatggtgggcaccaaccacgtggagtaccgctatggcaaggccatgcccctcatctttgtgggcggcgtgcccaggagcggcaccaccctgatgagggccatgctggatgcccaccctgaggtgcgctgtggggaggagacccgcatcatcccccgggtgctggccatgaggcaggcctggagcaagagcggccgggagaagctgcggctggatgaggccggcgtgacagatgaggtgctggatgctgccatgcaggccttcatcctgtag

SEQ ID NO: 175027 - DNA, 144 bp, Artificial Sequence
  Description of Artificial Sequence: Synthetic coding sequence
atgaggctgtctgtgcggcgggtgctgctggccgccggctgtgccctggtgctggtgctggccgtgcagctgggccagcaggtgctggagtgcagagctgtgctggccggcctgcggagccccaggggggccatgaggccctag

SEQ ID NO: 175028 - DNA, 147 bp, Artificial Sequence
  Description of Artificial Sequence: Synthetic coding sequence
atgaggctgtctgtgcggcgggtgctgctggccgccggctgtgccctggtgctggtgctggccgtgcagctgggccagcaggtgctggagtgcagagctgtgctggccggcctgcggagccccaggggggccatgaggcctgagtag

SEQ ID NO: 175029 - DNA, 363 bp, Artificial Sequence
  Description of Artificial Sequence: Synthetic coding sequence
atgaggctgtctgtgcggcgggtgctgctggccgccggctgtgccctggtgctggtgctggccgtgcagctgggccagcaggtgctggagtgcagagctgtgctggccggcctgcggagccccaggggggccatgaggcctgagcaggaggagctggtgatggtgggcaccaaccacgtggagtaccgctatggcaaggccatgcccctcatctttgtgggcggcgtgcccaggagcggcaccaccctgatgagggccatgctggatgcccaccctgaggtgcgctgtggggaggagacccgcatcatcccccgggtgctggccatgaggcaggcctggagcaagagcggccgggagaagtag

SEQ ID NO: 175030 - DNA, 933 bp, Artificial Sequence
  Description of Artificial Sequence: Synthetic coding sequence
atgcccctcatctttgtgggcggcgtgcccaggagcggcaccaccctgatgagggccatgctggatgcccaccctgaggtgcgctgtggggaggagacccgcatcatcccccgggtgctggccatgaggcaggcctggagcaagagcggccgggagaagctgcggctggatgaagctggggtgacagatgaggtgctggatgctgccatgcaggccttcatcctggaggtgattgccaagcatggagagcccgcccgggtgctgtgcaacaaggaccccttcaccctgaagagctctgtgtacctgagccgcctcttccccaacagcaagttcctgctgatggtgagagatggccgggcctctgtgcacagcatgatcaccaggaaggtgaccatcgccggctttgacctgagcagctacagagactgcctgaccaagtggaacaaggccatcgaggtgatgtatgcccagtgcatggaggtgggcaaggagaagtgcctgcctgtgtactatgagcagctggtgctgcaccccaggaggagcctgaagctgatcctggacttcctgggcatcgcctggagcgatgctgtgctgcaccatgaagatctcatcggcaagccaggaggagtgtccctgagcaagattgaaagaagcacagaccaggtgatcaagcctgtgaacctggaggccctgagcaagtggacaggccacatccctggagatgtggtgcgggacatggcccagatcgcccccatgctggcccagctgggctatgacccctatgccaacccccccaactacggcaacccagacccctttgtgatcaacaacacccagagggtgctgaagggggactacaagaccccagccaacctgaagggctacttccaggtgaaccagaacagcaccagcagccacctgggcagcagctag

SEQ ID NO: 175031 - DNA, 1587 bp, Artificial Sequence
  Description of Artificial Sequence: Synthetic coding sequence
atgggagatgcccccagccctgaggagaagctgcacctgatcaccaggaacctgcaggaggtgctgggggaggagaagctgaaggagatcctgaaggagcgggagctgaagatctactggggcacagccaccaccgggaagccccacgtggcctactttgtgcccatgagcaagattgctgacttcctgaaggccggctgtgaggtgaccatcctgtttgctgacctgcacgcctacctggacaacatgaaggccccctgggagctgctggagctgcgggtgtcctactatgaaaatgtcatcaaggccatgctggagagcattggagtgcccctggagaagctgaagttcatcaagggcacagactaccagctgagcaaggagtacaccctggatgtgtaccgcctgagctctgtggtgacccagcacgacagcaagaaggccggggctgaggtggtgaagcaggtggagcaccccctgctgagcggcctgctgtacccaggcctgcaggccctggatgaggagtacctgaaggtggatgcccagtttggaggcatcgaccagaggaagatcttcacctttgctgagaagtacctgcctgccctgggctacagcaagagggtgcacctgatgaaccccatggtgcccggcctgaccggcagcaagatgagcagcagcgaggaggagagcaagattgacctgctggacagaaaagaagatgtgaagaagaagctgaagaaggccttctgtgagcctggaaatgtggagaacaacggggtgctgtccttcatcaagcacgtgctcttccccctgaagtcagaatttgtgatcctgagagatgagaagtggggcggcaacaagacctacacagcctacgtggacctggagaaggactttgctgctgaggtggtgcaccctggggacctgaagaacagcgtggaggtggccctgaacaagctgctggaccccatccgggagaagttcaacaccccagccctgaagaagctggccagcgctgcctacccagaccccagcaagcagaagcccatggccaagggccctgccaagaacagcgagcctgaggaggtgatccccagccggctggacatccgggtgggcaagatcatcaccgtggagaagcacccagatgctgacagcctgtatgtggagaagattgatgtgggggaggccgagcccaggacagtggtgtctggcctggtgcagtttgtgcccaaggaggagctgcaggaccggctggtggtggtgctgtgcaacctgaagccccagaagatgagaggagtggagagccagggcatgctgctgtgtgccagcattgagggcatcaaccggcaggtggagcccctggaccccccagctggcagcgcccctggagagcacgtgtttgtgaagggctatgagaagggccagccagatgaggagctgaagcccaagaagaaggtgtttgagaagctgcaggccgacttcaagatcagcgaggagtgcatcgcccagtggaagcagaccaacttcatgaccaagctgggcagcatcagctgcaagagcctgaagggcggcaacatctcctag

SEQ ID NO: 175032 - DNA, 1434 bp, Artificial Sequence
  Description of Artificial Sequence: Synthetic coding sequence
atggccgcccccatcctgcggagcttctcctggggccgctggagcggcaccctgaacctgtctgtgctgctgcccctgggcctgaggaaggcccacagcggggcccagggcctgctggccgcccagaaggcccggggcctcttcaaggacttcttccctgagaccggcaccaagattgagctgcctgagctgtttgaccggggcacagccagcttcccccagaccatctactgcggctttgaccccacagctgacagcctgcacgtgggccacctgctggccctgctgggcctcttccacctgcagagagctggccacaacgtgattgccctggtgggcggggccacagcccggctgggggaccccagcggccgcaccaaggagcgggaggccctggagacagagcgggtgcgggccaatgcccgggccctgcggctgggcctggaggccctggccgccaaccaccagcagctgttcacagatggccgctcctggggcagcttcaccgtgctggacaacagcgcctggtaccagaagcagcacctggtggacttcctggccgctgtgggcggccacttcaggatgggcaccctgctgagccggcagagcgtgcagctgcggctgaagagccctgagggcatgagcctggccgagttcttctaccaggtgctgcaggcctatgacttctactacctgttccagagatatggctgccgggtgcagctgggcggcagtgaccagctgggcaacatcatgagcggctatgagttcatcaacaagctgaccggggaggatgtgtttggcatcaccgtgcccctcatcaccagcaccaccggggccaagctgggcaagtctgctggaaatgctgtgtggctgaacagagacaagaccagcccctttgagctgtaccagttctttgtgcggcagccagatgattctgtggagcgctacctgaagctgttcaccttcctgcccctgcctgagattgaccacatcatgcagctgcacgtgaaggagcctgagcggcggggcccccagaagaggctggccgctgaggtgaccaagctggtgcacggccgggagggcctggacagcgccaagcgctgcacccaggccctgtaccacagcagcattgatgccctggaggtgatgtctgaccaggagctgaaggagctgttcaaggaggcccccttcagcgagttcttcctggaccccggcacctctgtgctggacacctgcaggaaggccaatgccatcccagatggcccccggggctacaggatgatcacagagggcggcgtgtccatcaaccaccagcaggtgaccaaccctgagagcgtgctgattgtgggccagcacatcctgaagaatggcctgagcctgctgaagattggcaagaggaacttctacatcatcaagtggctgcagctgtag

SEQ ID NO: 175033 - DNA, 723 bp, Artificial Sequence
  Description of Artificial Sequence: Synthetic coding sequence
atggccgagtacctggccagcatctttggaacagagaaggacaaggtgaactgcagcttctacttcaagatcggggcctgcagacatggagaccgctgcagccggctgcacaacaagcccaccttcagccagaccatcgccctgctgaacatctacagaaacccccagaacagcagccagagcgcagatggcctgcgctgtgctgtgtctgatgtggagatgcaggagcactatgatgagttctttgaggaggtgttcacagagatggaggagaagtatggagaggtggaggagatgaatgtgtgtgacaacctgggggaccacctggtgggcaatgtgtatgtgaagttccggcgggaggaggatgctgagaaggccgtcatcgacctgaacaaccgctggttcaacggccagcccatccacgccgagctgagccctgtgacagacttccgggaggcctgctgccggcagtatgagatgggagagtgcacccggggcggcttctgcaacttcatgcacctgaagcccatcagccgggagctgcggcgggagctgtatggaagaagaaggaagaagcacaggagccgcagccgcagccgggagcggcgcagccgcagccgggaccggggccggggcggcggcggcggcggcggcggcggcggcggcggccgggagcgggacagaagaagaagccgggaccgggagaggagcggccgcttctag

SEQ ID NO: 175034 - DNA, 723 bp, Artificial Sequence
  Description of Artificial Sequence: Synthetic coding sequence
atggccgagtacctggccagcatctttggaacagagaaggacaaggtgaactgcagcttctacttcaagatcggggcctgcagacatggagaccgctgcagccggctgcacaacaagcccaccttcagccagaccatcctgatccagaacatctacagaaacccccagaacagcgcccagacagcagatggcagccactgtgctgtgtctgatgtggagatgcaggagcactatgatgagttctttgaggaggtgttcacagagatggaggagaagtatggagaggtggaggagatgaatgtgtgtgacaacctgggggaccacctggtgggcaatgtgtatgtgaagttccggcgggaggaggatgctgagaaggccgtcatcgacctgaacaaccgctggttcaacggccagcccatccacgccgagctgagccctgtgacagacttccgggaggcctgctgccggcagtatgagatgggagagtgcacccggggcggcttctgcaacttcatgcacctgaagcccatcagccgggagctgcggcgggagctgtatggaagaagaaggaagaagcacaggagccgcagccgcagccgggagcggcgcagccgcagccgggaccggggccggggcggcggcggcggcggcggcggcggcggcggcggccgggagcgggacagaagaagaagccgggaccgggagaggagcggccgcttctag

SEQ ID NO: 175035 - DNA, 504 bp, Artificial Sequence
  Description of Artificial Sequence: Synthetic coding sequence
atgcaggagcactatgatgagttctttgaggaggtgttcacagagatggaggagaagtacggggaggtggaggagatgaatgtgtgtgacaacctgggggaccacctggtgggcaatgtgtatgtgaagttcagaagagaggaggatgctgagaaggctgtgattgacctgaacaaccgctggttcaacggccagcccatccatgctgagctgagccctgtgacagacttccgggaggcctgctgccggcagtatgagatgggagaatgtacccggggcggcttctgcaacttcatgcacctgaagcccatcagccgggagctgcggcgggagctgtatggaagaagaaggaagaagcacaggagccgcagccgcagccgggagaggaggagccgcagccgggaccggggccggggcggcggcggcggcggcggcggcggcggcggcggccgggagcgggacagaagaagaagccgggaccgggagaggagcggccgcttctag

SEQ ID NO: 175036 - DNA, 504 bp, Artificial Sequence; identical to SEQ ID NO: 175035
  Description of Artificial Sequence: Synthetic coding sequence

SEQ ID NO: 175037 - DNA, 1218 bp, Artificial Sequence
  Description of Artificial Sequence: Synthetic coding sequence
atgtttgtgcaggaggagaagatctttgctgggaaggtgctgcggctgcacatctgtgccagtgatggagctgagtggctggaggaggccacagaggacacctctgtggagaagctgaaggagcgctgcctgaagcactgtgcccacggcagcctggaggaccccaagagcatcacccaccacaagctgattcatgctgccagcgagcgggtgctgagtgatgcccggaccatcctggaggagaacatccaggaccaggatgtgctgctgctgatcaagaagagggcccccagccccctgcccaagatggctgatgtgtctgctgaggagaagaagaagcaggaccagaaggccccagacaaggaggccatcctgcgggccacagccaacctgcccagctacaacatggacagagctgctgtgcagaccaacatgagggacttccagacagagctgaggaagatcctggtgtccctcatcgaggtggcccagaagctgctggccctgaacccagatgctgtggagctgttcaagaaggccaatgccatgctggatgaagatgaagatgagcgggtggatgaagctgccctgcggcagctgacagagatgggcttcccagaaaatagagccaccaaggccctgcagctgaaccacatgtctgtgccccaggccatggagtggctgattgaacatgctgaggaccccaccatcgacacccccctgcccggccaggcccctcctgaggccgagggcgccacagctgctgccagcgaggccgctgctggggccagcgccacagatgaggaggccagagatgagctgacagagatcttcaagaagatccggaggaagcgggagttccgggcagatgcccgggctgtgatcagcctgatggagatgggctttgatgagaaggaggtgattgatgccctgcgggtgaacaacaaccagcagaatgctgcctgtgagtggctgctgggggacaggaagcccagccctgaggagctggacaagggcatcgaccctgacagccccctcttccaggccatcctggacaaccctgtggtgcagctgggcctgaccaaccccaagaccctgctggcctttgaggacatgctggagaaccccctgaacagcacccagtggatgaatgaccctgagaccggccctgtgatgctgcagatcagccgcatcttccagaccctgaacagaacatag

SEQ ID NO: 175038 - DNA, 540 bp, Artificial Sequence
  Description of Artificial Sequence: Synthetic coding sequence
atggccgccagccaggtgctgggggagaagatcaacatcctgtctggagagaccgtgaaggccggggaccgggaccccctgggcaatgactgcccagagcaggaccggctgccccagaggtcctggaggcagaagtgtgccagctatgtgctggccctgcggccctggagcttcagcgccagcctgacccctgtggccctgggcagcgccctggcctaccgcagccacggcgtgctggacccccggctgctggtgggctgtgctgtggccgtgctggccgtgcatggagctggcaacctggtgaacacctactatgacttcagcaaaggaattgaccacaagaagagtgatgacaggaccctggtggaccgcatcctggagccccaggatgtggtgcgctttggagtcttcctgtacaccctgggctgtgtgtgtgccgcctgcctgtactacctgagccccctgaagctggagcacctggccctgatctactttggaggcctgagcggcagcttcctgtacacaggagtgctgatctag

SEQ ID NO: 175039 - DNA, 1017 bp, Artificial Sequence
  Description of Artificial Sequence: Synthetic coding sequence
atggccgccagccaggtgctgggggagaagatcaacatcctgtctggagagaccgtgaaggccggggaccgggaccccctgggcaatgactgcccagagcaggaccggctgccccagaggtcctggaggcagaagtgtgccagctatgtgctggccctgcggccctggagcttcagcgccagcctgacccctgtggccctgggcagcgccctggcctaccgcagccacggcgtgctggacccccggctgctggtgggctgtgctgtggccgtgctggccgtgcatggagctggcaacctggtgaacacctactatgacttcagcaaaggaattgaccacaagaagagtgatgacaggaccctggtggaccgcatcctggagccccaggatgtggtgcgctttggagtcttcctgtacaccctgggctgtgtgtgtgccgcctgcctgtactacctgagccccctgaagctggagcacctggccctgatctactttggaggcctgagcggcagcttcctgtacacaggaggcatcggcttcaagtatgtggccctgggggacctgatcatcctgatcaccttcggccccctggccgtgatgtttgcctatgccatccaggtgggcagcctggccatcttccccctggtgtatgccatccccctggccctgagcacagaggccatcctgcacagcaacaacacccgggacatggagagtgaccgggaggccggcatcgtgaccctggccatcctgattggccccaccttctcctacatcctgtacaacaccctgctcttcctgccctacctggtgttcagcatcctggccacccactgcaccatcagcctggccctgcccctgctgaccatccccatggccttcagcctggagcggcagttccgcagccaggccttcaacaagctgccccagaggacagccaagctgaacctgctgctgggcctcttctacgtgtttggcatcatcctggccccagctggcagcctgcccaagatctag

SEQ ID NO: 175040 - DNA, 3405 bp, Artificial Sequence
  Description of Artificial Sequence: Synthetic coding sequence
atgtctgagccccaccgggtgcagttcaccagcctgcccggcagcctgaacccagccttcctgaagaagagcaggaaggaggaggccggggccggggagcagcaccaggactgtgagcctgctgctgctgctgtgcgcatcaccctgaccctgtttgagccagaccacaagcgctgcccagagttcttctacccagagctggtgaagaacatccggggcaaggtgaagggcctgcagcccggggacaagaagaaggacctgagtgaccccttcaatgatgaggagaaggagcggcacaaggtggaggccctggccaggaagtttgaggagaagtatggaggcaagaagaggaggaaggaccgcatccaggacctgattgacatgggctacggctatgatgaaagtgacagcttcatcgacaacagcgaggcctatgatgagctggtgcctgccagcctgaccaccaagtatggaggcttctacatcaacagcggcaccctgcagttccggcaggccagcgagagtgaagatgacttcatcaaggagaagaagaagaagagccccaagaagaggaagctgaaggagggcggggagaagatcaagaagaagaagaaggatgacacctatgacaaggagaagaagagcaagaagagcaagttcagcaaggccggcttcaccgccctgaatgccagcaaggagaagaagaagaagaagtacagcggggccctgtctgtgaaggagatgctgaagaagttccagaaggagaaggaggcccagaagaagcgggaggaggagcacaagcctgtggccgtgcccagcgctgaggcccagggcctgcgggagctggagggcgccagtgaccccctgctgagcctgtttggcagcaccagtgacaatgacctgctgcaggccgccacagccatggacagcctgacagacctggacctggagcacctgctgtctgagagccctgagggcagccccttccgggacatggatgatggcagtgacagcctgggcgtgggcctggaccaggagttccggcagcccagcagcctgcctgagggcctgcctgcccccctggagaagagggtgaaggagctggcccaggccgcccgggctgctgagggggagagccggcagaagttcttcacccaggacatcaatggcatcctgctggacatcgaggcccagacccgggagctgagcagccaggtgcgcagcggcgtgtatgcctacctggccagcttcctgccctgcagcaaggatgccctgctgaagagggccaggaagctgcacctgtatgagcagggcggccgcctgaaggagcccctgcagaagctgaaggaggccatcggccgggccatgcctgagcagatggccaagtaccaggatgagtgccaggcccacacccaggccaaggtggccaagatgctggaggaggagaaggacaaggagcagagggaccgcatctgcagtgatgaggaggaggatgaggagaagggcggccgccgcatcatgggccccaggaagaagttccagtggaatgatgagatccgggagctgctgtgccaggtggtgaagatcaagctggagagccaggacctggagaggaacaacaaggcccaggcctgggaggactgtgtgaagggcttcctggatgctgaggtgaagcccctgtggcccaagggctggatgcaggcccggaccctcttcaaggagagccggcggggccacggccacctgaccagcatcctggccaagaagaaggtgatggcccccagcaagatcaaggtgaaggagagcagcaccaagccagacaagaaggtgtctgtgcccagcggccagattggaggccccatcgccctgcccagcgaccaccagacaggaggcctgagcatcggggccagcagccgggagctgcccagccaggccagcggcggcctggccaaccccccacctgtgaacctggaggacagcctggatgaagatctcatcagaaatcctgccagctctgtggaggccgtgtccaaggagctggccgccctgaacagcagagctgctggcaacagcgagttcaccctgcctgcccccagcaaggccccagctgagaaggtgggcggcgtgctgtgcacagaggagaagaggaactttgccaagcccagccccagcgcccctcctccagccagcagcctgcagagccccctgaacttcctggccgagcaggccctggccctgggccagagcagccaggagaagaagccagagagcagcggctacaaggagctgagctgccaggcccccctgaacaagggcctgcctgaggtgcaccagagcaaggccaagcaccacagcctgcccaggaccagccacggcccccaggtggccgtgcctgtgcccggcccccaggtgaaggtgttccacgccggcacccagcagcagaagaacttcaccccacccagcccctttgccaacaagctgcagggccccaaggccagccccacccagtgccacaggagcctgctgcagctggtgaagacagctgccaagggccagggcttccaccccagcgccccagccaccagcggcggcctgagcgccagcagcagcagcagccacaagaccccagccagcagcagcagcgccctgagccacccagccaagccccacagcgtgagcagcgctggcagcagctacaagaacaacccctttgccagcagcatcagcaagcatggagtgagcagcggcagcagcagcagcggcggcacccctgtgcagagctctgtgtctggcagcctggtgcccggcatccagcccccatctgtgggccaggccaccagcaggcctgtgcccagcagcgctgggaagaagatgcctgtgtcccagaagctgaccctggtggcccctcctgggggccccaacggggacagcagcggcggcacccagggcgtggccaagctgctgaccagccccagcctgaagcccagcgctgtgtcctctgtgaccagcagcaccagcctgagcaaaggagccagcggcaccgtgctgctggccggcagcagcctgatggccagcccctacaagagcagcagccccaagctgagcggggccatgagcagcaacagcctgggcatcatcacccctgtgcccatccctgtgcacgtgctgtccttctctgctgacagcagcgccaaggccggcgtgtccaaggatgccatcgtgactggacctgcccctggcagcttccaccacggcctgggccacagcctgctggccggcctgcacagcagcccccctcatgctgcccccctgccccatgctgctgtgcccacccacatcccccagagcctgcccggggccagccagctgcacggcaagggccctgctgtgcccaggaagctgtag

SEQ ID NO: 175041 - DNA, 3405 bp, Artificial Sequence; identical to SEQ ID NO: 175040
  Description of Artificial Sequence: Synthetic coding sequence

SEQ ID NO: 175042 - DNA, 3315 bp, Artificial Sequence
  Description of Artificial Sequence: Synthetic coding sequence
atgtctgagccccaccgggtgcagttcaccagcctgcccggcagcctgaacccagccttcctgaagaagagcaggaaggaggaggccggggccggggagcagcaccaggactgtgagcctgctgctgctgctgtgcgcatcaccctgaccctgtttgagccagaccacaagcgctgcccagagttcttctacccagagctggtgaagaacatccggggcaaggtgaagggcctgcagcccggggacaagaagaaggacctgagtgaccccttcaatgatgaggagaaggagcggcacaaggtggaggccctggccaggaagtttgaggagaagtatggaggcaagaagaggaggaaggaccgcatccaggacctgattgacatgggctacggctatgatgaaagtgacagcttcatcgacaacagcgaggcctatgatgagctggtgcctgccagcctgaccaccaagtatggaggcttctacatcaacagcggcaccctgcagttccggcaggccagcgagagtgaagatgacttcatcaaggagaagaagaagaagagccccaagaagaggaagctgaaggagggcggggagaagatcaagaagaagaagaaggatgacacctatgacaaggagaagaagagcaagaagagcaagttcagcaaggccggcttcaccgccctgaatgccagcaaggagaagaagaagaagaagtacagcggggccctgtctgtgaaggagatgctgaagaagttccagaaggagaaggaggcccagaagaagcgggaggaggagcacaagcctgtggccgtgcccagcgctgaggcccagggcctgcgggagctggagggcgccagtgaccccctgctgagcctgtttggcagcaccagtgacaatgacctgctgcaggccgccacagccatggacagcctgacagacctggacctggagcacctgctgtctgagagccctgagggcagccccttccgggacatggatgatggcagtgacagcctgggcgtgggcctggaccaggagttccggcagcccagcagcctgcctgagggcctgcctgcccccctggagaagagggtgaaggagctggcccaggccgcccgggctgctgagggggagagccggcagaagttcttcacccaggacatcaatggcatcctgctggacatcgaggcccagacccgggagctgagcagccaggtgcgcagcggcgtgtatgcctacctggccagcttcctgccctgcagcaaggatgccctgctgaagagggccaggaagctgcacctgtatgagcagggcggccgcctgaaggagcccctgcagaagctgaaggaggccatcggccgggccatgcctgagcagatggccaagtaccaggatgagtgccaggcccacacccaggccaaggtggccaagatgctggaggaggagaaggacaaggagcagagggaccgcatctgcagtgatgaggaggaggatgaggagaagggcggccgccgcatcatgggccccaggaagaagttccagtggaatgatgagatccgggagctgctgtgccaggtggtgaagatcaagctggagagccaggacctggagaggaacaacaaggcccaggcctgggaggactgtgtgaagggcttcctggatgctgaggtgaagcccctgtggcccaagggctggatgcaggcccggaccctcttcaaggagagccggcggggccacggccacctgaccagcatcctggccaagaagaaggtgatggcccccagcaagatcaaggtgaaggagagcagcaccaagccagacaagaaggtgtctgtgcccagcggccagattggaggccccatcgccctgcccagcgaccaccagacaggaggcctgagcatcggggccagcagccgggagctgcccagccaggccagcggcggcctggccaaccccccacctgtgaacctggaggacagcctggatgaagatctcatcagaaatcctgccagctctgtggaggccgtgtccaaggagctggccgccctgaacagcagagctgctggcaacagcgagttcaccctgcctgcccccagcaaggccccagctgagaaggtgggcggcgtgctgtgcacagaggagaagaggaactttgccaagcccagccccagcgcccctcctccagccagcagcctgcagagccccctgaacttcctggccgagcaggccctggccctgggccagagcagccaggagaagaagccagagagcagcggctacaaggagctgagctgccaggcccccctgaacaagggcctgcctgaggtgcaccagagcaaggccaagcaccacagcctgcccaggaccagccacggcccccaggtggccgtgcctgtgcccggcccccaggtgaaggtgttccacgccggcacccagcagcagaagaacttcaccccacccagcccctttgccaacaagctgcagggccccaaggccagccccacccagtgccacaggagcctgctgcagctggtgaagacagctgccaagggccagggcttccaccccagcgccccagccaccagcggcggcctgagcgccagcagcagcagcagccacaagaccccagccagcagcagcagcgccctgagccacccagccaagccccacagcgtgagcagcgctggcagcagctacaagaacaacccctttgccagcagcatcagcaagcatggagtgagcagcggcagcagcagcagcggcggcacccctgtgcagagctctgtgtctggcagcctggtgcccggcatccagcccccatctgtgggccaggccaccagcaggcctgtgcccagcagcgctgggaagaagatgcctgtgtcccagaagctgaccctggtggcccctcctgggggccccaacggggacagcagcggcggcacccagggcgtggccaagctgctgaccagccccagcctgaagcccagcgctgtgtcctctgtgaccagcagcaccagcctgagcaaaggagccagcggcaccgtgctgctggccggcagcagcctgatggccagcccctacaagagcagcagccccaagctgagcggggccatgagcagcaacagcctgggcatcatcacccctgtgcccatccctgtgcacgtgctgtccttctctgctgacagcagcgccaaggccggcgtgtccaaggatgccatcgtgactggacctgcccctggcagcttccaccacggcctgggccacagcgccagccagctgcacggcaagggccctgctgtgcccaggaagctgtag

SEQ ID NO: 175043 - DNA, 3795 bp, Artificial Sequence
  Description of Artificial Sequence: Synthetic coding sequence
atgagcctgcagcgggagccccccaggcctgagcccccaccacccttcccccccctgcccctgcagcccccaccaccccgggagagcgccagcagagctgagcagccccccaggcctccccgggagaccgtgcggctggagctggtgctgaaggaccccacagatgagagctgtgtggagttctcctacccagagctgctgctgtgtggggagcagaggaagaagctgatccacacagaggaccccttcaatgatgagcaccaggagcggcaggaggtggagatgctggccaagaagtttgagatgaagtatggaggcaagcccaggaagcacaggaaggaccggctgcaggacctgattgacatcggcttcggctatgatgaaacagaccccttcatcgacaacagcgaggcctatgatgagctggtgcctgccagcctgaccaccaagtatggaggcttctacatcaacacaggcaccctgcagttccggcaggccagtgacacagaagaagatgacatcacagacaaccagaagcacaagccacccaaggtgcccaagatcaaggaggatgacatcgagatgaagaagaggaagaggaaggaggagggggagaaggagaagaagcccaggaagaaggtgcccaagcagctgggcgtggtggccctgaacagccacaagtctgagaagaagaagaagcgctacaaggacagcctgagcctggccgccatgatcaggaagttccagaaggagaaggatgccctgaagaaggagagcaaccccaaggtgcctgtgaccctgagcacccccagcctgaacaagccaccctgtgccgccgccgccctgggcaatgatgtgcctgacctgaacctgagcagcggggaccctgacctgcccatctttgtgtccaccaatgaacatgagctgttccaggaggccgagaatgccctggagatgctggatgactttgattttgaccggctgctggatgctgccagtgatggcagccccctgtctgagagcggcggggagaatggcaccaccacccagcccacctacaccagccaggtgatgcccaaggtggtgcccaccctgcctgagggcctgcctgtgctgctggagaagagaattgaggacctgcgggtggccgccaagctgtttgatgaggagggcaggaagaagttcttcacccaggacatgaacaacatcctgctggacatcgagctgcagctgcaggagctgggccctgtgatccgcagcggcgtgtacagccacctggaggcctttgtgccctgcaacaaggagaccctggtgaagaggctgaagaagctgcacctgaatgtgcaggatgaccggctgcgggagcccctgcagaagctgaagctggccgtgtccaatgtgatgcctgagcagctgttcaagtaccaggaggactgccaggcccggagccaggccaagtgtgccaagctgcagacagatgaggagcgggagaagaatggaagtgaagaagatgatgatgagaagccaggcaagagggtcatcggccccaggaagaagttccactgggatgacaccatccgcaccctgctgtgcaacctggtggagatcaagctgggctgctatgagctggagcccaacaagagccagagcgctgaggactacctgaagagcttcatggagacagaggtgaagcccctgtggcccaagggctggatgcaggccaggatgctgttcaaggagagccgctctgtgcacaaccacctgaccagcgccccagccaagaagaaggtgatcccagcccccaagcccaaggtgaaggaggtgatggtgaagaccctgcccctgcacagcttccccaccatgctgaaggagtgcagccccaagaaggaccagaagacccccaccagcctggtggcctctgtgtctggcccccccaccagcagcagcacagctgccatcgctgctgccagcagcagcagcgccccagcccaggagaccatctgcctggatgacagcctggatgaggacctgtccttccacagccccagcctggacctggtgtctgaggccctggccgtcatcaacaacggcaacaagggcccccctgtgggcagccgcatctccatgcccaccaccaagccccggcccggcctgcgggaggagaagctggccagcatcatgagcaagctgcccctggccacccccaagaagctggacagcacccagaccacccacagcagcagcctgattgctggccacacaggccctgtgcccaagaagccccaggacctggcccacacaggcatcagcagcggcctgattgctggcagcagcatccagaaccccaaggtgtccctggagcccctgcctgcccggctgctgcagcagggcctgcagaggagcagccagatccacaccagcagcagcagccagacccacgtgagcagcagcagccaggcccagattgctgccagcagccacgccctgggcaccagcgaggcccaggatgccagcagcctgacccaggtgaccaaggtgcaccagcacagcgctgtgcagcagaactacgtgagccccctgcaggccaccatcagcaagagccagaccaaccctgtggtgaagctgagcaacaacccccagctgagctgcagcagcagcctcatcaagaccagtgacaagcccctgatgtaccgcctgcccctgagcacccccagccctggaaatggcagccagggcagccaccccctggtgtccaggacagtgcccagcaccaccaccagcagcaactacctggccaaggccatggtgtcccagatcagcacccagggcttcaagagccccttctccatggccgccagccccaagctggccgccagccccaagccagccaccagccccaagcccctgcccagccccaagcccagcgccagccccaagcccagcctgagcgccaagcccagcgtgtccaccaagctgatcagcaagagcaaccccacccccaagcccaccgtgagccccagcagcagcagccccaatgccctggtggcccagggcagccacagcagcaccaacagccctgtgcacaagcagcccagcggcatgaacatcagccggcagagccccaccctgaacctgctgcccagcagcaggaccagcggcctgccccccaccaagaacctgcaggcccccagcaagctgaccaacagcagcagcacaggcaccgtgggcaagaacagcctgtctggaattgccatgaatgtgcctgccagccggggcagcaacctgaacagcagcggggccaacagaaccagcctgagcggcggcactggaagtggcacccagggcgccaccaagcccctgagcaccccccaccggcccagcacagccagcggcagctctgtggtgacagcctctgtgcagagcacagctggggccagcctgctggccaatgccagccccctgaccctgatgaccagccccctgtctgtgaccaaccagaatgtgaccccatttggcatgctgggcggcctggtgcctgtgaccatgcccttccagttccccctggagatctttggatttggaacagacacagctggggtgaccaccaccagcggcagcaccagcgctgccttccaccacagcctgacccagaacctgctgaagggcctgcagcctggaggagcccagcacgccgccaccctgagccacagccccctgcctgcccacctgcagcaggccttccatgatggcggccagagcaagggggacaccaagctgcccaggaagagccagtag

SEQ ID NO: 175044 - DNA, 4044 bp, Artificial Sequence
  Description of Artificial Sequence: Synthetic coding sequence
atggccgagcccaggagagtggccttcatcagcctgagccctgtgagaagaagagaggccgagtacccaggccctgagcgggagcctgagtacccccgggagcccccccggctggagccccagccctaccgggagcccgcccgggcagagcccccagccccccgggagcccgcccccaggagtgatgcccagccccccagccgggagaagcccctgccccagcgggaggtgtccagagctgagccccccatgagcctgcagcgggagccccccaggcctgagcccccaccacccttcccccccctgcccctgcagcccccaccaccccgggagagcgccagcagagctgagcagcccccccggcccccccgggagaccgtgcggctggagctggtgctgaaggaccccacagatgagagctgtgtggagttctcctacccagagctgctgctgtgtggggagcagaggaagaagctgatccacacagaggaccccttcaatgatgagcaccaggagcggcaggaggtggagatgctggccaagaagtttgagatgaagtatggaggcaagcccaggaagcacaggaaggaccggctgcaggacctgattgatattggatttggctatgatgaaacagaccccttcatcgacaacagcgaggcctatgatgagctggtgcctgccagcctgaccaccaagtatggaggcttctacatcaacacaggcaccctgcagttccggcaggccagtgacacagaggaggatgacatcacagacaaccagaagcacaagccacccaaggtgcccaagatcaaggaggatgacatcgagatgaagaagaggaagaggaaggaggagggggagaaggagaagaagcccaggaagaaggtgcccaagcagctgggcgtggtggccctgaacagccacaagtctgagaagaagaagaagcgctacaaggacagcctgagcctggccgccatgatcaggaagttccagaaggagaaggatgccctgaagaaggagagcaaccccaaggtgcctgtgaccctgagcacccccagcctgaacaagccaccctgtgccgctgctgccctgggcaatgatgtgcctgacctgaacctgagcagcggggaccctgacctgcccatctttgtgtccaccaatgagcacgagctgttccaggaggctgaaaatgccctggagatgctggatgactttgattttgaccggctgctggatgctgccagtgatggcagccccctgtctgagagcggaggagaaaatggcaccaccacccagcccacctacaccagccaggtgatgcccaaggtggtgcccaccctgcctgagggcctgcctgtgctgctggagaagagaattgaggacctgcgggtggccgccaagctgtttgatgaggagggcaggaagaagttcttcacccaggacatgaacaacatcctgctggacatcgagctgcagctgcaggagctgggccctgtgatccgctctggagtgtacagccacctggaggcctttgtgccctgcaacaaggagaccctggtgaagaggctgaagaagctgcacctgaatgtgcaggatgaccggctgcgggagcccctgcagaagctgaagctggccgtgtccaatgtgatgcctgagcagctgttcaagtaccaggaggactgccaggcccggagccaggccaagtgtgccaagctgcagacagatgaggagcgggagaagaatggcagcgaggaggatgatgatgagaagccaggcaagagggtgattggccccaggaagaagttccactgggatgacaccatccgcaccctgctgtgcaacctggtggagatcaagctgggctgctatgagctggagcccaacaagagccagagcgctgaggactacctgaagagcttcatggagacagaggtgaagcccctgtggcccaagggctggatgcaggccaggatgctgttcaaggagagccgctctgtgcacaaccacctgaccagcgccccagccaagaagaaggtgatcccagcccccaagcccaaggtgaaggaggtgatggtgaagaccctgcccctgcacagcttccccaccatgctgaaggaatgtagccccaagaaggaccagaagacccccaccagcctggtggcctctgtgtctggcccccccaccagcagcagcacagctgccatcgccgccgccagcagcagcagcgccccagcccaggagaccatctgcctggatgacagcctggatgaggacctgtccttccacagccccagcctggacctggtgtctgaggccctggccgtcatcaacaatggaaacaagggcccccctgtgggcagccgcatctccatgcccaccaccaagcccaggcctggcctgcgggaggagaagctggccagcatcatgagcaagctgcccctggccacccccaagaagctggacagcacccagaccacccacagcagcagcctgattgctggccacactggacctgtgcccaagaagccccaggacctggcccacacaggcatcagcagcggcctgattgctggcagcagcatccagaaccccaaggtgtccctggagcccctgcctgcccggctgctgcagcagggcctgcagaggagcagccagatccacaccagcagcagcagccagacccacgtgagcagcagcagccaggcccagattgctgccagcagccacgccctgggcaccagcgaggcccaggatgccagcagcctgacccaggtgaccaaggtgcaccagcacagcgctgtgcagcagaactacgtgagccccctgcaggccaccatcagcaagagccagaccaaccctgtggtgaagctgagcaacaacccccagctgagctgcagcagcagcctcatcaagaccagtgacaagcccctgatgtaccgcctgcccctgagcacccccagccctggaaatggcagccagggcagccaccccctggtgtccaggacagtgcccagcaccaccaccagcagcaactacctggccaaggccatggtgtcccagatcagcacccagggcttcaagagccccttctccatggccgccagccccaagctggccgccagccccaagccagccaccagccccaagcccctgcccagccccaagcccagcgccagccccaagcccagcctgagcgccaagcccagcgtgtccaccaagctgatcagcaagagcaaccccacccccaagcccaccgtgagccccagcagcagcagccccaatgccctggtggcccagggcagccacagcagcaccaacagccctgtgcacaagcagcccagcggcatgaacatcagccggcagagccccaccctgaacctgctgcccagcagcaggaccagcggcctgccccccaccaagaacctgcaggcccccagcaagctgaccaacagcagcagcactggaacagtgggcaagaacagcctgagcggcatcgccatgaatgtgcctgccagccggggcagcaacctgaacagcagcggggccaacagaaccagcctgagcggcggcaccggcagcggcacccagggcgccaccaagcccctgagcaccccccaccggcccagcacagccagcggcagctctgtggtgacagcctctgtgcagagcacagctggggccagcctgctggccaatgccagccccctgaccctgatgaccagccccctgtctgtgaccaaccagaatgtgacccccttcggcatgctgggcggcctggtgcctgtgaccatgcccttccagttccccctggagatcttcggcttcggcacagacacagctggggtgaccaccaccagcggcagcaccagcgctgccttccaccacagcctgacccagaacctgctgaagggcctgcagcccggcggggcccagcacgccgccaccctgagccacagccccctgcctgcccacctgcagcaggccttccatgatggcggccagagcaaaggagacaccaagctgcccaggaagagccagtag

SEQ ID NO: 175045 - DNA, 1686 bp, Artificial Sequence
  Description of Artificial Sequence: Synthetic coding sequence
atggccgagagcggggagagcggcggccccccaggcagccaggacagcgctgctggagctgagggcgctggggccccagctgctgctgccagcgctgagcccaagatcatgaaggtgacagtgaagacccccaaggagaaggaggagtttgctgtgcctgagaacagctctgtgcagcagttcaaggaggagatcagcaagcgcttcaagagccacacagaccagctggtgctgatctttgctgggaagatcctgaaggaccaggacaccctgagccagcacggcatccatgatggcctgactgtgcacctggtgatcaagacccagaaccggccccaggaccacagcgcccagcagaccaacacagctggcagcaatgtgaccaccagcagcacccccaacagcaacagcaccagcggcagcgccaccagcaaccccttcggcctgggcggcctgggcggcctggccggcctgagcagcctgggcctgaacaccaccaacttcagcgagctgcagagccagatgcagaggcagctgctgagcaaccctgagatgatggtgcagatcatggagaacccctttgtgcagagcatgctgagcaacccagacctgatgaggcagctgatcatggccaacccccagatgcagcagctgatccagagaaatcctgagatcagccacatgctgaacaacccagacatcatgaggcagaccctggagctggccagaaatcctgccatgatgcaggagatgatgaggaaccaggaccgggccctgagcaacctggagagcatccctgggggctacaatgccctgcggaggatgtacacagacatccaggagcccatgctgtctgctgcccaggagcagtttggaggcaacccctttgccagcctggtgagcaacaccagcagtggagagggcagccagcccagcaggacagaaaatagagaccccctgcccaacccctgggccccccagaccagccagagcagcagcgccagcagcggcacagccagcacagtgggcggcaccaccggcagcacagccagcggcaccagcggccagagcaccacagcccccaacctggtgcctggggtgggcgcctccatgttcaacaccccaggcatgcagagcctgctgcagcagatcacagagaacccccagctgatgcagaacatgctgagcgccccctacatgaggtccatgatgcagagcctgagccagaacccagacctggccgcccagatgcagaacccagacaccctgagcgccatgagcaacccccgggccatgcaggccctgctgcagatccagcagggcctgcagaccctggccacagaggcccctggcctcatccctggcttcaccccaggcctgggcgccctgggcagcactggaggcagcagcggcaccaacggcagcaatgccacccccagcgagaacaccagccccacagctggcaccacagagcccggccaccagcagttcatccagcagatgctgcaggccctggccggcgtgaacccccagctgcagaaccctgaggtgcgcttccagcagcagctggagcagctgagcgccatgggcttcctgaaccgggaggccaacctgcaggccctgattgccaccggcggggacatcaatgctgccatcgagcggctgctgggcagccagcccagctag

SEQ ID NO: 175046 - DNA, 1770 bp, Artificial Sequence
  Description of Artificial Sequence: Synthetic coding sequence
atggccgagagcggggagagcggcggccccccaggcagccaggacagcgctgctggagctgagggcgctggggccccagctgctgctgccagcgctgagcccaagatcatgaaggtgacagtgaagacccccaaggagaaggaggagtttgctgtgcctgagaacagctctgtgcagcagttcaaggaggagatcagcaagcgcttcaagagccacacagaccagctggtgctgatctttgctgggaagatcctgaaggaccaggacaccctgagccagcacggcatccatgatggcctgactgtgcacctggtgatcaagacccagaaccggccccaggaccacagcgcccagcagaccaacacagctggcagcaatgtgaccaccagcagcacccccaacagcaacagcaccagcggcagcgccaccagcaaccccttcggcctgggcggcctgggcggcctggccggcctgagcagcctgggcctgaacaccaccaacttcagcgagctgcagagccagatgcagaggcagctgctgagcaaccctgagatgatggtgcagatcatggagaacccctttgtgcagagcatgctgagcaacccagacctgatgaggcagctgatcatggccaacccccagatgcagcagctgatccagagaaatcctgagatcagccacatgctgaacaacccagacatcatgaggcagaccctggagctggccagaaatcctgccatgatgcaggagatgatgaggaaccaggaccgggccctgagcaacctggagagcatccctgggggctacaatgccctgcggaggatgtacacagacatccaggagcccatgctgtctgctgcccaggagcagtttggaggcaacccctttgccagcctggtgagcaacaccagcagtggagagggcagccagcccagcaggacagaaaatagagaccccctgcccaacccctgggccccccagaccagccagagcagcagcgccagcagcggcacagccagcacagtgggcggcaccaccggcagcacagccagcggcaccagcggccagagcaccacagcccccaacctggtgcctggggtgggcgcctccatgttcaacaccccaggcatgcagagcctgctgcagcagatcacagagaacccccagctgatgcagaacatgctgagcgccccctacatgaggtccatgatgcagagcctgagccagaacccagacctggccgcccagatgatgctgaacaaccccctgtttgctggcaacccccagctgcaggagcagatgaggcagcagctgcccaccttcctgcagcagatgcagaacccagacaccctgagcgccatgagcaacccccgggccatgcaggccctgctgcagatccagcagggcctgcagaccctggccacagaggcccctggcctcatccctggcttcaccccaggcctgggcgccctgggcagcactggaggcagcagcggcaccaacggcagcaatgccacccccagcgagaacaccagccccacagctggcaccacagagcccggccaccagcagttcatccagcagatgctgcaggccctggccggcgtgaacccccagctgcagaaccctgaggtgcgcttccagcagcagctggagcagctgagcgccatgggcttcctgaaccgggaggccaacctgcaggccctgattgccaccggcggggacatcaatgctgccatcgagcggctgctgggcagccagcccagctag

SEQ ID NO: 175047 - DNA, 1875 bp, Artificial Sequence
  Description of Artificial Sequence: Synthetic coding sequence
atggctgaaaatggagagagcagcggccccccccggcccagccggggccctgctgctgcccagggcagcgctgctgccccagctgagcccaagatcatcaaggtgacagtgaagacccccaaggagaaggaggagtttgctgtgcctgagaacagctctgtgcagcagttcaaggaggccatcagcaagcgcttcaagagccagacagaccagctggtgctgatctttgctgggaagatcctgaaggaccaggacaccctcatccagcacggcatccatgatggcctgactgtgcacctggtgatcaagagccagaaccggccccagggccagagcacccagcccagcaatgctgctggcaccaacaccaccagcgccagcacccccaggagcaacagcacccccatcagcaccaacagcaaccccttcggcctgggcagcctgggcggcctggccggcctgagcagcctgggcctgagcagcaccaacttcagcgagctgcagagccagatgcagcagcagctgatggccagccctgagatgatgatccagatcatggagaacccctttgtgcagagcatgctgagcaacccagacctgatgaggcagctgatcatggccaacccccagatgcagcagctgatccagagaaatcctgagatcagccacctgctgaacaacccagacatcatgaggcagaccctggagatcgccagaaatcctgccatgatgcaggagatgatgaggaaccaggacctggccctgagcaacctggagagcatccctgggggctacaatgccctgcggaggatgtacacagacatccaggagcccatgctgaatgctgcccaggagcagtttggaggcaacccctttgcctctgtgggcagcagcagcagcagtggagagggcacccagcccagcaggacagaaaatagagaccccctgcccaacccctgggcccctcctccagccacccagagcagcgccaccaccagcaccaccaccagcacaggcagcggcagcggcaacagcagcagcaatgccaccggcaacacagtggccgccgccaactacgtggccagcatcttcagcaccccaggcatgcagagcctgctgcagcagatcacagagaacccccagctgatccagaacatgctgagcgccccctacatgaggtccatgatgcagagcctgagccagaacccagacctggccgcccagatgatgctgaacagccccctcttcaccgccaacccccagctgcaggagcagatgaggccccagctgcctgccttcctgcagcagatgcagaacccagacaccctgagcgccatgagcaacccccgggccatgcaggccctgatgcagatccagcagggcctgcagaccctggccacagaggcccctggcctcatccccagcttcaccccaggagtgggcgtgggcgtgctgggcacagccatcggccctgtgggccctgtgacccccatcggccccatcggccccatcgtgcccttcacccccatcggccccatcggccccatcggccccactggacctgctgcccctcctggcagcacaggcagcggcggccccaccggccccaccgtgagcagcgctgcccccagcgagaccaccagccccaccagcgagagcggccccaaccagcagttcatccagcagatggtgcaggccctggccggggccaatgccccccagctgcccaaccctgaggtgcgcttccagcagcagctggagcagctgaatgccatgggcttcctgaaccgggaggccaacctgcaggccctgattgccactggaggagacatcaatgctgccatcgagcggctgctgggcagccagcccagctag

SEQ ID NO: 175048 - DNA, 1467 bp, Artificial Sequence
  Description of Artificial Sequence: Synthetic coding sequence
atggctgaaaatggagagagcagcggccccccccggcccagccggggccctgctgctgcccagggcagcgctgctgccccagctgagcccaagatcatcaaggtgacagtgaagacccccaaggagaaggaggagtttgctgtgcctgagaacagctctgtgcagcagttcaaggaggccatcagcaagcgcttcaagagccagacagaccagctggtgctgatctttgctgggaagatcctgaaggaccaggacaccctcatccagcacggcatccatgatggcctgactgtgcacctggtgatcaagagccagaaccggccccagggccagagcacccagcccagcaatgctgctggcaccaacaccaccagcgccagcacccccaggagcaacagcacccccatcagcaccaacagcaaccccttcggcctgggcagcctgggcggcctggccggcctgagcagcctgggcctgagcagcaccaacttcagcgagctgcagagccagatgcagcagcagctgatggccagccctgagatgatgatccagatcatggagaacccctttgtgcagagcatgctgagcaacccagacctgatgaggcagctgatcatggccaacccccagatgcagcagctgatccagagaaatcctgagatcagccacctgctgaacaacccagacatcatgaggcagaccctggagatcgccagaaatcctgccatgatgcaggagatgatgaggaaccaggacctggccctgagcaacctggagagcatccctgggggctacaatgccctgcggaggatgtacacagacatccaggagcccatgctgaatgctgcccaggagcagtttggaggcaacccctttgcctctgtgggcagcagcagcagcagtggagagggcacccagcccagcaggacagaaaatagagaccccctgcccaacccctgggcccctcctccagccacccagagcagcgccaccaccagcaccaccaccagcacaggcagcggcagcggcaacagcagcagcaatgccaccggcaacacagtggccgccgccaactacgtggccagcatcttcagcaccccaggcatgcagagcctgctgcagcagatcacagagaacccccagctgatccagaacatgctgagcgccccctacatgaggtccatgatgcagagcctgagccagaacccagacctggccgcccagatgatgctgaacagccccctcttcaccgccaacccccagctgcaggagcagatgaggccccagctgcctgccttcctgcagcagatgcagaacccagacaccctgagcgccatgagcaaccccaccagcagcagcttcagcaagtggtgccggccctggctggagcagatgctgcacagctgccgcatccagaagagtgacttcagcaacaactggaacagcagcacccagtggggcagctag

SEQ ID NO: 175049 - DNA, 1968 bp, Artificial Sequence
  Description of Artificial Sequence: Synthetic coding sequence
atggccaagggcggggaggccctgccccagggcagccctgcccctgtgcaggacccccacctgatcaaggtgacagtgaagacccccaaggacaaggaggacttctctgtgacagacacctgcaccatccagcagctgaaggaggagatcagccagcgcttcaaggcccacccagaccagctggtgctgatctttgctgggaagatcctgaaggaccctgacagcctggcccagtgtggggtgagagatggcctgactgtgcacctggtgatcaagaggcagcaccgggccatgggaaatgaatgtcctgctgcctctgtgcccacccagggccccagccctggcagcctgccccagcccagcagcatctacccagcagatggccccccagccttcagcctgggcctgctgaccggcctgagccggctgggcctggcctaccggggcttcccagaccagcccagcagcctgatgaggcagcacgtgtctgtgcctgagtttgtgacccagctgattgatgaccccttcatccctggcctgctgagcaacacaggcctggtgcggcagctggtgctggacaacccccacatgcagcagctgatccagcacaaccctgagatcggccacatcctgaacaaccctgagatcatgaggcagaccctggagttcctgagaaatcctgccatgatgcaggagatgatccgcagccaggacagagtgctgagcaacctggagagcatccctgggggctacaacgtgctgtgcaccatgtacacagacatcatggaccccatgctgaatgctgtgcaggagcagtttggaggcaacccctttgccacagccaccacagacaatgccaccaccaccaccagccagcccagcaggatggagaactgtgaccccctgcccaacccctggaccagcacccacggcggcagcggcagccggcagggccggcaggatggagaccaggatgccccagacatccggaaccgcttccccaacttcctgggcatcatccggctgtatgactacctgcagcagctgcacgagaacccccagagcctgggcacctacctgcagggcacagccagcgccctgagccagagccaggagcccccacccagcgtgaacagagtgccccccagcagccccagcagccaggagcccggcagcggccagcccctgcctgaggagagcgtggccatcaagggccgcagcagctgcccagccttcctgcgctaccccacagagaacagcacaggccagggcggggaccaggatggagctgggaagagcagcacaggccacagcaccaacctgcctgacctggtgtctggcctgggggacagcgccaacagagtgccctttgcccccctgtccttcagccccacagctgccatccctggcatccctgagcccccctggctgcccagccctgcctaccccaggagcctgcggccagatggcatgaacccagccccccagctgcaggatgagatccagccccagctgcccctgctgatgcacctgcaggccgccatggccaacccccgggccctgcaggccctgcggcagatcgagcagggcctgcaggtgctggccacagaggccccccggctgctgctgtggttcatgccctgcctggccggcaccggctctgtggccggcggcatcgagagccgggaggaccccctgatgtctgaggaccccctgcccaaccccccacctgaggtgtttcctgccctggacagcgctgagctgggcttcctgagcccccccttcctgcacatgctgcaggacctggtgtccaccaacccccagcagctgcagcctgaggcccacttccaggtgcagctggagcagctgcgctccatgggcttcctgaaccgggaggccaacctgcaggccctgattgccactggaggagatgtggatgctgctgtggagaagctgcggcagagctag

SEQ ID NO: 175050 - DNA, 666 bp, Artificial Sequence
  Description of Artificial Sequence: Synthetic coding sequence
atggccaagggcggggaggccctgccccagggcagccctgcccctgtgcaggacccccacctgatcaaggtgacagtgaagacccccaaggacaaggaggacttctctgtgacagacacctgcaccatccagcagctgaaggaggagatcagccagcgcttcaaggcccacccagaccagctggtgctgatctttgctgggaagatcctgaaggaccctgacagcctggcccagtgtggggtgagagatggcctgactgtgcacctggtgatcaagaggcagcaccgggccatgggaaatgaatgtcctgctgcctctgtgcccacccagggccccagccctggcagcctgccccagcccagcagcatctacccagcagatggccccccagccttcagcctgggcctgctgaccggcctgagccggctgggcctggcctaccggggcttcccagaccagcccagcagcctgatgaggcagcacgtgtctgtgcctgagtttgtgacccagctgattgatgaccccttcatccctggcctgctgagcaacacaggcctggtgcggcagctggtgctggacaacccccacatgcagcagctgatccagcacaaccctgagatcggccacatcctgaacaaccctgagatcatgaggcagaccctgtag

SEQ ID NO: 175051 - DNA, 681 bp, Artificial Sequence
  Description of Artificial Sequence: Synthetic coding sequence
atggccgagcccagcggggctgagaccaggcctcccatccgggtgacagtgaagacccccaaggacaaggaggagatcgtcatctgtgaccgggcctctgtgaaggagttcaaggaggagatcagccgccgcttcaaggcccagcaggaccagctggtgctgatctttgctgggaagatcctgaaggatggagacaccctgaaccagcacggcatcaaggatggcctgactgtgcacctggtgatcaagaccccccagaaggcccaggaccctgcccctcctgctgcccccagcctgcctgctgctgatgctgagccccgggtgaccctgcacccctaccagagccccagccatgctggcattgctgctgaccctgctggcaccacagacctggccgaccggggcccctgggccggcacccagccctggctgctgtgggacatcccagaccccagcaccctgagccggcagcagaggagagtgtatgcccggggcccccacttcctgaccagccacgccagccacatcttcagcaacagaggcttccagaggcctgctgccacccacgccgcagatgatcctgccttcggctggaagtggaagctgactggagcagatgcccggtctgagatctctgctgctgctggagctgcccagctgcacggcctgcaccagagctag

SEQ ID NO: 175052 - DNA, 1806 bp, Artificial Sequence
  Description of Artificial Sequence: Synthetic coding sequence
atggccgagcccagcggggctgagaccaggcctcccatccgggtgacagtgaagacccccaaggacaaggaggagatcgtcatctgtgaccgggcctctgtgaaggagttcaaggaggagatcagccgccgcttcaaggcccagcaggaccagctggtgctgatctttgctgggaagatcctgaaggatggagacaccctgaaccagcacggcatcaaggatggcctgactgtgcacctggtgatcaagaccccccagaaggcccaggaccctgctgctgccacagccagcagccccagcaccccagaccctgccagcgcccccagcaccaccccagccagccctgccaccccagcccagcccagcaccagcggcagcgccagcagtgatgctggcagcggcagccgccgcagcagcggcggcggccccagccctggagctggggagggcagccccagcgccacagccagcatcctgagcggctttggaggcatcctgggcctgggcagcctgggcctgggcagcgccaacttcatggagctgcagcagcagatgcagaggcagctgatgagcaaccctgagatgctgagccagatcatggagaaccccctggtgcaggacatgatgagcaacccagacctgatgaggcacatgatcatggccaacccccagatgcagcagctgatggagagaaatcctgagatcagccacatgctgaacaaccctgagctgatgaggcagaccatggagctggccagaaatcctgccatgatgcaggagatgatgaggaaccaggaccgggccctgagcaacctggagagcatccctgggggctacaatgccctgcggaggatgtacacagacatccaggagcccatgttttctgctgcccgggagcagtttggaaacaaccccttcagcagcctggccggcaacagcgacagcagcagcagccagcccctgaggacagagaaccgggagcccctgcccaacccctggagccccagcccccccaccagccaggcccctggcagcggcggggagggcaccggcggcagcggcaccagccaggtgcaccccaccgtgagcaaccccttcggcatcaatgctgccagcctgggcagcggcatgttcaacagccctgagatgcaggccctgctgcagcagatcagcgagaacccccagctgatgcagaatgtcatcagcgccccctacatgaggtccatgatgcagaccctggcccagaacccagactttgctgcccagatgatggtgaatgtgcccctgtttgctggcaacccccagctgcaggagcagctgcggctgcagctgcctgtgttcctgcagcagatgcagaaccctgagagcctgagcatcctgaccaacccccgggccatgcaggccctgctgcagatccagcagggcctgcagaccctgcagacagaggcccctggcctggtgcccagcctgggcagctttggcatcagcaggaccccagcccccagcgctggcagcaatgccggcagcaccccagaggcccccaccagcagccctgccaccccagccaccagcagccccactggagccagcagcgcccagcagcagctgatgcagcagatgatccagctgctggccggcagcggcaacagccaggtgcagaccccagaggtgcgcttccagcagcagctggagcagctgaacagcatgggcttcatcaaccgggaggccaacctgcaggccctgattgccaccggcggggacatcaatgctgccatcgagcggctgctgggcagccagctgtcctag

SEQ ID NO: 175053 - DNA, 336 bp, Artificial Sequence
  Description of Artificial Sequence: Synthetic coding sequence
atggccggcaagcaggccgtgtctgccagcggcaagtggctggatggcatcaggaagtggtactacaatgctgctggcttcaacaagctgggcctgatgagagatgacaccatctatgaagatgaagatgtgaaggaggccatccggcggctgcctgaaaatctctacaatgacaggatgttccgcatcaagagggccctggacctgaacctgaagcaccagatcctgcccaaggagcagtggaccaagtatgaggaggagaacttctacctggagccctacctgaaggaggtgatccgggagaggaaggagcgggaggagtgggccaagaagtag

SEQ ID NO: 175054 - DNA, 1443 bp, Artificial Sequence
  Description of Artificial Sequence: Synthetic coding sequence
atggccgcctctgtggtgtgcagagctgccacagctggggcccaggtgctgctgcgggcccggcgcagccctgccctgctgcggaccccagccctgcggagcacagccacctttgcccaggccctgcagtttgtgcctgagacccaggtgtccctgctggacaatggcctgcgggtggccagcgagcagagcagccagcccacctgcaccgtgggcgtgtggattgatgtgggcagcagatttgaaacagagaagaacaatggagctggctacttcctggagcacctggccttcaagggcaccaagaacagacctggcagcgccctggagaaggaggtggagagcatgggcgcccacctgaatgcctacagcacccgggagcacacagcctactacatcaaggccctgagcaaggacctgcccaaggctgtggagctgctgggggacatcgtgcagaactgcagcctggaggacagccagatcgagaaggagagagatgtgatcctgcgggagatgcaggagaatgatgcctccatgagagatgtggtgttcaactacctgcacgccacagccttccagggcacccccctggcccaggccgtggagggccccagtgaaaatgtgaggaagctgagcagagctgacctgacagagtacctgagcacccactacaaggcccccaggatggtgctggccgccgccggcggcgtggagcaccagcagctgctggacctggcccagaagcacctgggcggcatcccctggacctatgcagaagatgctgtgcccaccctgaccccctgccgcttcaccggcagcgagatccgccacagagatgatgccctgccctttgcccacgtggccatcgctgtggagggccctggctgggccagcccagacaacgtggccctgcaggtggccaatgccatcatcggccactatgactgcacctacggcggcggcgtgcacctgagcagccccctggccagcggggctgtggccaacaagctgtgccagagcttccagaccttcagcatctgctacgccgagaccggcctgctgggcgcccactttgtgtgtgacaggatgaagattgatgacatgatgtttgtgctgcagggccagtggatgaggctgtgcaccagcgccacagagagcgaggtggcccggggcaagaacatcctgagaaatgccctggtgagccacctggatggcaccacccctgtgtgtgaagatattggccgcagcctgctgacctacggccgccgcatccccctggccgagtgggagagcagaattgctgaggtggatgcctctgtggtgcgggagatctgcagcaagtacatctatgaccagtgcccagctgtggccggctacggccccatcgagcagctgcctgactacaaccgcatccgcagcggcatgttctggctgcgcttctag

SEQ ID NO: 175055 - DNA, 1362 bp, Artificial Sequence
  Description of Artificial Sequence: Synthetic coding sequence
atgaagctgctgaccagggctggcagcttcagccgcttctacagcctgaaggtggcccccaaggtgaaggccacagctgccccagctggggccccaccccagccccaggacctggagttcaccaagctgcccaacggcctggtgattgccagcctggagaactacagccctgtgtccagaattggcctcttcatcaaggccggcagccgctatgaggacttcagcaacctgggcaccacccacctgctgcggctgaccagcagcctgaccaccaagggggccagcagcttcaagatcacccggggcattgaagctgtgggcggcaagctgtctgtgacagccacccgggagaacatggcctacacagtggagtgcctgcggggagatgtggacatcctgatggagttcctgctgaatgtgaccacagcccctgagttccgccgctgggaggtggccgacctgcagccccagctgaagattgacaaggctgtggccttccagaacccccagacccacgtgattgagaacctgcatgctgctgcctacagaaatgccctggccaaccccctgtactgcccagactacagaattggcaaggtgaccagcgaggagctgcactactttgtgcagaaccacttcaccagcgccaggatggccctgattggcctgggcgtgagccaccctgtgctgaagcaggtggccgagcagttcctgaacatgaggggcggcctgggcctgagcggggccaaggccaactacagaggaggagagatccgggagcagaatggagacagcctggtgcatgctgcctttgtggccgagagcgctgtggccggcagcgctgaggccaatgccttctctgtgctgcagcacgtgctgggcgccggcccccacgtgaagaggggcagcaacaccaccagccacctgcaccaggccgtggccaaggccacccagcagccctttgatgtgtctgccttcaatgccagctacagcgacagcggcctgtttggcatctacaccatcagccaggccacagctgctggagatgtgatcaaggccgcctacaaccaggtgaagaccatcgcccagggcaacctgagcaacacagatgtgcaggccgccaagaacaagctgaaggccggctacctgatgtctgtggagagcagcgagtgcttcctggaggaggtgggcagccaggccctggtggccggcagctacatgccacccagcacagtgctgcagcagattgacagcgtggccaatgctgacatcatcaatgctgccaagaagtttgtgtctggccagaagtccatggccgccagcggcaacctgggccacaccccatttgtggatgagctgtag

SEQ ID NO: 175056 - DNA, 276 bp, Artificial Sequence
  Description of Artificial Sequence: Synthetic coding sequence
atgggcctggaggatgagcagaagatgctgacagaaagtggggaccctgaggaggaggaggaggaggaggaggagctggtggaccccctgaccaccgtgcgggagcagtgtgagcagctggagaagtgtgtgaaggcccgggagcggctggagctgtgtgatgagcgggtgagcagccgcagccacacagaggaggactgcacagaggagctgtttgacttcctgcacgcccgggaccactgtgtggcccacaagctgttcaacaacctgaagtag

SEQ ID NO: 175057 - DNA, 249 bp, Artificial Sequence
  Description of Artificial Sequence: Synthetic coding sequence
atgggccgggagtttggaaacctgaccaggatgagacatgtgatctcctacagcctgagcccctttgagcagagggcctacccccacgtgttcaccaagggcatccccaacgtgctgcggcgcatccgggagagcttcttccgggtggtgccccagtttgtggtgttctacctgatctacacctggggcacagaggagtttgagaggagcaagaggaagaacccagctgcctatgaaaatgacaagtag

SEQ ID NO: 175058 - DNA, 249 bp, Artificial Sequence; identical to SEQ ID NO: 175057
  Description of Artificial Sequence: Synthetic coding sequence

SEQ ID NO: 175059 - DNA, 249 bp, Artificial Sequence; identical to SEQ ID NO: 175057
  Description of Artificial Sequence: Synthetic coding sequence

SEQ ID NO: 175060 - DNA, 387 bp, Artificial Sequence
  Description of Artificial Sequence: Synthetic coding sequence
atgcagatctttgtgaagaccctgaccgggaagaccatcaccctggaggtggagcccagcgacaccattgaaaatgtgaaggccaagatccaggacaaggagggcatccccccagaccagcagaggctcatctttgctgggaagcagctggaggatggccgcaccctgagtgactacaacatccagaaggagagcaccctgcacctggtgctgcggctgcggggcggcatcatcgagcccagcctgcggcagctggcccagaagtacaactgtgacaagatgatctgcaggaagtgctacgcccggctgcaccccagggctgtgaactgcaggaagaagaagtgtggccacaccaacaacctgcggcccaagaagaaggtgaagtag

SEQ ID NO: 175061 - DNA, 387 bp, Artificial Sequence; identical to SEQ ID NO: 175060
  Description of Artificial Sequence: Synthetic coding sequence

SEQ ID NO: 175062 - DNA, 1872 bp, Artificial Sequence
  Description of Artificial Sequence: Synthetic coding sequence
atggctgctggggagacccagctgtatgccaaggtgagcaacaagctgaagagccgcagcagccccagcctgctggagcccctgctggccatgggcttccctgtgcacacagccctgaaggccctggccgccactggaaggaagacagctgaggaggccctggcctggctgcatgaccactgcaatgaccccagcctggatgaccccatcccccaggagtatgccctcttcctgtgccccaccggccccctgctggagaagctgcaggagttctggagggagagcaagaggcagtgtgccaagaacagagcccacgaggtgttcccccacgtgaccctgtgtgacttcttcacctgtgaggaccagaaggtggagtgcctgtatgaggccctgaagagagctggggaccggctgctgggcagcttccccacagctgtgcccctggccctgcacagcagcatctcctacctgggcttctttgtgtctggcagccctgcagatgtgatccgggagtttgccatgacctttgccacagaggccagcctgctggccgactgcagcgtgaagccctgcaccaagcagctgcacctgaccctggcccacaagttctacccccaccaccagaggaccctggagcagctggcccgggccatccccctgggccacagctgccagtggacagctgccctgtacagccgggacatgagatttgtgcactaccagaccctgcgggccctcttccagtacaagccccagaatgtggatgagctgaccctgagccctggggactacatctttgtggaccccacccagcaggatgaggccagcgagggctgggtgattggcatcagccagaggacaggctgccggggcttcctgcctgagaactacacagaccgggccagcgagagtgacacctgggtgaagcacaggatgtacaccttcagcctggccacagacctgaacagcaggaaggatggagaggccagcagccgctgcagcggggagttcctgccccagacagcccggagcctgagcagcctgcaggccctgcaggccaccgtggccaggaagtctgtgctggtggtgagacatggagagcgggtggaccagatctttgggaaggcctggctgcagcagtgcagcaccccagatggcaagtactacagaccagacctgaacttcccctgcagcctgcccaggaggagccggggcatcaaggactttgaaaatgacccccccctgagcagctgtggcatcttccagagcagaattgctggagatgccctgctggacagcggcatccgcatcagctctgtgtttgccagccctgccctgcgctgtgtgcagacagccaagctgatcctggaggagctgaagctggagaagaagatcaagatccgggtggagcccggcatctttgagtggaccaagtgggaggccggcaagaccacccccaccctgatgagcctggaggagctgaaggaggccaacttcaacatcgacacagactacagacctgccttccccctgagcgccctgatgcctgctgagagctaccaggagtacatggaccgctgcacagcctccatggtgcagatcgtgaacacctgcccccaggacaccggggtcatcctgattgtgagccacggcagcaccctggacagctgcacccggcccctgctgggcctgcccccccgggagtgtggggactttgcccagctggtgaggaagatccccagcctgggcatgtgcttctgtgaggagaacaaggaggagggcaagtgggagctggtgaacccccctgtgaagaccctgacccacggggccaatgctgccttcaactggaggaactggatcagcggcaactag

SEQ ID NO: 175063 - DNA, 1986 bp, Artificial Sequence
  Description of Artificial Sequence: Synthetic coding sequence
atggctgctggggagacccagctgtatgccaaggtgagcaacaagctgaagagccgcagcagccccagcctgctggagcccctgctggccatgggcttccctgtgcacacagccctgaaggccctggccgccactggaaggaagacagctgaggaggccctggcctggctgcatgaccactgcaatgaccccagcctggatgaccccatcccccaggagtatgccctcttcctgtgccccaccggccccctgctggagaagctgcaggagttctggagggagagcaagaggcagtgtgccaagaacagagcccacgaggtgttcccccacgtgaccctgtgtgacttcttcacctgtgaggaccagaaggtggagtgcctgtatgaggccctgaagagagctggggaccggctgctgggcagcttccccacagctgtgcccctggccctgcacagcagcatctcctacctgggcttctttgtgtctggcagccctgcagatgtgatccgggagtttgccatgacctttgccacagaggccagcctgctggccggcacctctgtgagccgcttctggatcttcagccaggtgcccggccacggccccaacctgcggctgagcaacctgacccgggccagctttgtgagccactacatcctgcagaagtactgcagcgtgaagccctgcaccaagcagctgcacctgaccctggcccacaagttctacccccaccaccagaggaccctggagcagctggcccgggccatccccctgggccacagctgccagtggacagctgccctgtacagccgggacatgagatttgtgcactaccagaccctgcgggccctcttccagtacaagccccagaatgtggatgagctgaccctgagccctggggactacatctttgtggaccccacccagcaggatgaggccagcgagggctgggtgattggcatcagccagaggacaggctgccggggcttcctgcctgagaactacacagaccgggccagcgagagtgacacctgggtgaagcacaggatgtacaccttcagcctggccacagacctgaacagcaggaaggatggagaggccagcagccgctgcagcggggagttcctgccccagacagcccggagcctgagcagcctgcaggccctgcaggccaccgtggccaggaagtctgtgctggtggtgagacatggagagcgggtggaccagatctttgggaaggcctggctgcagcagtgcagcaccccagatggcaagtactacagaccagacctgaacttcccctgcagcctgcccaggaggagccggggcatcaaggactttgaaaatgacccccccctgagcagctgtggcatcttccagagcagaattgctggagatgccctgctggacagcggcatccgcatcagctctgtgtttgccagccctgccctgcgctgtgtgcagacagccaagctgatcctggaggagctgaagctggagaagaagatcaagatccgggtggagcccggcatctttgagtggaccaagtgggaggccggcaagaccacccccaccctgatgagcctggaggagctgaaggaggccaacttcaacatcgacacagactacagacctgccttccccctgagcgccctgatgcctgctgagagctaccaggagtacatggaccgctgcacagcctccatggtgcagatcgtgaacacctgcccccaggacaccggggtcatcctgattgtgagccacggcagcaccctggacagctgcacccggcccctgctgggcctgcccccccgggagtgtggggactttgcccagctggtgaggaagatccccagcctgggcatgtgcttctgtgaggagaacaaggaggagggcaagtgggagctggtgaacccccctgtgaagaccctgacccacggggccaatgctgccttcaactggaggaactggatcagcggcaactag

SEQ ID NO: 175064 - DNA, 369 bp, Artificial Sequence
  Description of Artificial Sequence: Synthetic coding sequence
atggctgctggggagacccagctgtatgccaaggtgagcaacaagctgaagagccgcagcagccccagcctgctggagcccctgctggccatgggcttccctgtgcacacagccctgaaggccctggccgccactggaaggaagacagctgaggaggccctggcctggctgcatgaccactgcaatgaccccagcctggatgaccccatcccccaggagtatgccctcttcctgtgccccaccggccccctgctggagaagctgcaggagttctggagggagagcaagaggcagtgtgccaagaacagagcccacgaggtgttcccccacgtgaccctgtgtgacttcttcaccggccctgctgtgtag

SEQ ID NO: 175065 - DNA, 1581 bp, Artificial Sequence
  Description of Artificial Sequence: Synthetic coding sequence
atggctgctggggagacccagctgtatgccaaggtgagcaacaagctgaagagccgcagcagccccagcctgctggagcccctgctggccatgggcttccctgtgcacacagccctgaaggccctggccgccactggaaggaagacagctgaggaggccctggcctggctgcatgaccactgcaatgaccccagcctggatgaccccatcccccaggagtatgccctcttcctgtgccccaccggccccctgctggagaagctgcaggagttctggagggagagcaagaggcagtgtgccaagaacagagcccacgaggtgttcccccacgtgaccctgtgtgacttcttcacctgtgaggaccagaaggtggagtgcctgtatgaggccctgaagagagctggggaccggctgctgggcagcttccccacagctgtgcccctggccctgcacagcagcatctcctacctgggcttctttgtgtctggcagccctgcagatgtgatccgggagtttgccatgacctttgccacagaggccagcctgctggccgactgcagcgtgaagccctgcaccaagcagctgcacctgaccctggcccacaagttctacccccaccaccagaggaccctggagcagctggcccgggccatccccctgggccacagctgccagtggacagctgccctgtacagccgggacatgagatttgtgcactaccagaccctgcgggccctcttccagtacaagccccagaatgtggatgagctgaccctgagccctggggactacatctttgtggaccccacccagcaggatgaggccagcgagggctgggtgattggcatcagccagaggacaggctgccggggcttcctgcctgagaactacacagaccgggccagcgagagtgacacctgggtgaagcacaggatgtacaccttcagcctggccacagacctgaacagcaggaaggatggagaggccagcagccgctgcagcggggagttcctgccccagacagcccggagcctgagcagcctgcaggccctgcaggccaccgtggccaggaagtctgtgctggtggtgagacatggagagcgggtggaccagatctttgggaaggcctggctgcagcagtgcagcaccccagatggcaagtactacagaccagacctgaacttcccctgcagcctgcccaggaggagccggggcatcaaggactttgaaaatgacccccccctgagcagctgtggcatcttccagagcagaattgctggagatgccctgctggacagcggcatccgcatcagctctgtgtttgccagccctgccctgcgctgtgtgcagacagccaagctgatcctggaggagctgaagctggagaagaagatcaagatccgggtggagcccggcatctttgagtggaccaagtgggaggccggcaagaccacccccaccctgatgagcctggaggagctgaaggaggccaacttcaacatcgacacagactaccgcagcctgccctgggcctgtgcctctgtgaagaagatcaagaggaaagaaaatggctcctggtag

SEQ ID NO: 175066 - DNA, 1950 bp, Artificial Sequence
  Description of Artificial Sequence: Synthetic coding sequence
atggcccagtatggccaccccagccccctgggcatggccgcccgggaggagctgtacagcaaggtgaccccaagaagaaaccggcagcagaggcctggcaccatcaagcacggcagcgccctggatgtgctgctgtccatgggcttcccccgggcccgggcccagaaggccctggccagcactggaggccgctctgtgcaggccgcctgtgactggctgttcagccacgtgggggaccccttcctggatgaccccctgccccgggagtatgtgctgtacctgcggcccaccggccccctggcccagaagctgagtgacttctggcagcagagcaagcagatctgtgggaagaacaaggcccacaacatcttcccccacatcaccctgtgccagttcttcatgtgtgaggacagcaaggtggatgccctgggggaggccctgcagaccaccgtgagccgctggaagtgcaagttcagcgcccccctgcccctggagctgtacaccagcagcaacttcatcggcctgtttgtgaaggaggacagcgctgaggtgctgaagaagtttgctgctgactttgctgctgaggccgccagcaagacagaggtgcacgtggagccccacaagaagcagctgcacgtgaccctggcctaccacttccaggccagccacctgcccaccctggagaagctggcccagaacattgatgtgaagctgggctgtgactgggtggccaccatcttcagccgggacatccgctttgccaaccacgagaccctgcaggtgatctacccctacaccccccagaatgatgatgagctggagctggtgcctggggacttcatcttcatgagccccatggagcagaccagcaccagcgagggctggatctacggcaccagcctgaccaccggctgcagcggcctgctgcctgagaactacatcaccaaggcagatgaatgttccacctggatcttccacggcagctacagcatcctgaacaccagcagcagcaacagcctgacctttggagatggagtgctggagcggcggccctatgaggaccagggcctgggggagaccacccccctgaccatcatctgccagcccatgcagcccctgcgggtgaacagccagcccggcccccagaagcgctgcctgtttgtgtgcagacatggagagaggatggatgtggtgtttgggaagtactggctgagccagtgctttgatgccaagggccgctacatccgcaccaacctgaacatgccccacagcctgccccagaggtctgggggcttccgggactatgagaaggatgcccccatcaccgtgtttggctgcatgcaggcccggctggtgggggaggccctgctggagagcaacaccatcatcgaccacgtgtactgcagccccagcctgcgctgtgtgcagacagcccacaacatcctgaagggcctgcagcaggagaaccacctgaagatccgggtggagcccggcctgtttgagtggaccaagtgggtggccggcagcaccctgcctgcctggatcccccccagcgagctggccgccgccaacctgtctgtggacaccacctaccggccccacatccccatcagcaagctggtggtgtctgagagctatgacacctacatcagccgctccttccaggtgaccaaggagatcatcagcgagtgcaagagcaaaggaaacaacatcctgattgtggcccacgccagcagcctggaggcctgcacctgccagctgcagggcctgagcccccagaacagcaaggactttgtgcagatggtgaggaagatcccctacctgggcttctgcagctgtgaggagctgggggagaccggcatctggcagctgacagatcctcccatcctgcccctgacccacggccccactggaggcttcaactggagggagaccctgctgcaggagtag

SEQ ID NO: 175067 - DNA, 1509 bp, Artificial Sequence
  Description of Artificial Sequence: Synthetic coding sequence
atggccagcaagaagctgggcgctgacttccacggcaccttctcctacctggatgatgtgcccttcaagacaggagacaagttcaagaccccagccaaggtgggcctgcccatcggcttcagcctgcctgactgcctgcaggtggtgcgggaggtgcagtatgacttcagcctggagaagaagaccatcgagtgggccgaggagatcaagaagattgaggaggccgagcgggaggccgagtgcaagattgctgaggccgaggccaaggtgaacagcaagagcggccctgagggggacagcaagatgtccttcagcaagacccacagcacagccaccatgcccccacccatcaaccccatcctggccagcctgcagcacaacagcatcctgacccccaccagggtgagcagcagcgccaccaagcagaaggtgctgagccccccccacatcaaggctgacttcaacctggccgactttgaatgtgaggaggacccctttgacaacctggagctgaagaccattgatgagaaggaggagctgaggaacatcctggtgggcaccaccggccccatcatggcccagctgctggacaacaacctgccccggggcggcagcggctctgtgctgcaggatgaggaggtgctggccagcctggagcgggccaccctggacttcaagcccctgcacaagcccaacggcttcatcaccctgccccagctgggcaactgtgagaagatgagcctgagcagcaaggtgtccctgccccccatcccagctgtgagcaacatcaagagcctgtccttccccaagctggacagtgatgacagcaaccagaagacagccaagctggccagcaccttccacagcaccagctgcctgagaaatggcaccttccagaacagcctgaagcccagcacccagagcagcgccagcgagctgaatggccaccacaccctgggcctgagcgccctgaacctggacagcggcacagagatgcctgccctgaccagcagccagatgcccagcctgtctgtgctgtctgtgtgcacagaggagagcagcccccccaacacaggccccaccgtgaccccacccaacttctctgtgtcccaggtgcccaacatgcccagctgcccccaggcctacagcgagctgcagatgctgagccccagcgagcggcagtgtgtggagaccgtggtgaacatgggctacagctatgaatgtgtgctgcgggccatgaagaagaagggggagaacatcgagcagatcctggactacctgtttgcccacggccagctgtgtgagaagggctttgaccccctgctggtggaggaggccctggagatgcaccagtgcagcgaggagaagatgatggagttcctgcagctgatgagcaagttcaaggagatgggctttgagctgaaggacatcaaggaggtgctgctgctgcacaacaatgaccaggacaatgccctggaggacctgatggcccgggccggggccagctag

SEQ ID NO: 175068 - DNA, 1509 bp, Artificial Sequence; identical to SEQ ID NO: 175067
  Description of Artificial Sequence: Synthetic coding sequence

SEQ ID NO: 175069 - DNA, 1326 bp, Artificial Sequence
  Description of Artificial Sequence: Synthetic coding sequence
atggccagcaagaagctgggcgctgacttccacggcaccttctcctacctggatgatgtgcccttcaagacaggagacaagttcaagaccccagccaaggtgggcctgcccatcggcttcagcctgcctgactgcctgcaggtggtgcgggaggtgcagtatgacttcagcctggagaagaagaccatcgagtgggccgaggagatcaagaagattgaggaggccgagcgggaggccgagtgcaagattgctgaggccgaggccaaggtgaacagcaagagcggccctgagggggacagcaagatgtccttcagcaagacccacagcacagccaccatgcccccacccatcaaccccatcctggccagcctgcagcacaacagcatcctgacccccaccagggtgagcagcagcgccaccaagcagaaggtgctgagccccccccacatcaaggctgacttcaacctggccgactttgaatgtgaggaggacccctttgacaacctggagctgaagaccattgatgagaaggaggagctgaggaacatcctggtgggcaccaccggccccatcatggcccagctgctggacaacaacctgccccggggcggcagcggctctgtgctgcaggatgaggaggtgctggccagcctggagcgggccaccctggacttcaagcccctgcacaagcccaacggcttcatcaccctgccccagctgggcaactgtgagaagatgagcctgagcagcaaggtgtccctgccccccatcccagctgtgagcaacatcaagagcctgtccttccccaagctggacagtgatgacagcaaccagaagacagccaagctggccagcaccttccacagcaccagctgcctgagaaatggcaccttccagaacagcctgaagcccagcacccagagcagcgccagcgagctgaatggccaccacaccctgggcctgagcgccctgaacctggacagcggcacagagatgcctgccctgaccagcagccagatgcccagcctgtctgtgctgtctgtgtgcacagaggagagcagcccccccaacacaggccccaccatcctggactacctgtttgcccacggccagctgtgtgagaagggctttgaccccctgctggtggaggaggccctggagatgcaccagtgcagcgaggagaagatgatggagttcctgcagctgatgagcaagttcaaggagatgggctttgagctgaaggacatcaaggaggtgctgctgctgcacaacaatgaccaggacaatgccctggaggacctgatggcccgggccggggccagctag

SEQ ID NO: 175070 - DNA, 1509 bp, Artificial Sequence; identical to SEQ ID NO: 175067
  Description of Artificial Sequence: Synthetic coding sequence

SEQ ID NO: 175071 - DNA, 1509 bp, Artificial Sequence; identical to SEQ ID NO: 175067
  Description of Artificial Sequence: Synthetic coding sequence

SEQ ID NO: 175072 - DNA, 1617 bp, Artificial Sequence
  Description of Artificial Sequence: Synthetic coding sequence
atgtctggagctgtgcggggcagaagaagagaggtgggcctgcagcacggcggctgcggcactggaggcggctatggagatggcctggcccggagcggccagagctggcgctggtggaggagcctgagcctgggcgctgtgggcagcagcgctggaacagagcccggccggcctgctggggccagcaccttccggctgctgcggcggcggcagcagaggcacagcggcagcaagtggctgctgcgctcctgggtgcagatcttcatgtatgacttcagcctggagaagaagaccatcgagtgggccgaggagatcaagaagattgaggaggccgagcgggaggccgagtgcaagattgctgaggccgaggccaaggtgaacagcaagagcggccctgagggggacagcaagatgtccttcagcaagacccacagcacagccaccatgcccccacccatcaaccccatcctggccagcctgcagcacaacagcatcctgacccccaccagggtgagcagcagcgccaccaagcagaaggtgctgagccccccccacatcaaggctgacttcaacctggccgactttgaatgtgaggaggacccctttgacaacctggagctgaagaccattgatgagaaggaggagctgaggaacatcctggtgggcaccaccggccccatcatggcccagctgctggacaacaacctgccccggggcggcagcggctctgtgctgcaggatgaggaggtgctggccagcctggagcgggccaccctggacttcaagcccctgcacaagcccaacggcttcatcaccctgccccagctgggcaactgtgagaagatgagcctgagcagcaaggtgtccctgccccccatcccagctgtgagcaacatcaagagcctgtccttccccaagctggacagtgatgacagcaaccagaagacagccaagctggccagcaccttccacagcaccagctgcctgagaaatggcaccttccagaacagcctgaagcccagcacccagagcagcgccagcgagctgaatggccaccacaccctgggcctgagcgccctgaacctggacagcggcacagagatgcctgccctgaccagcagccagatgcccagcctgtctgtgctgtctgtgtgcacagaggagagcagcccccccaacacaggccccaccgtgaccccacccaacttctctgtgtcccaggtgcccaacatgcccagctgcccccaggcctacagcgagctgcagatgctgagccccagcgagcggcagtgtgtggagaccgtggtgaacatgggctacagctatgaatgtgtgctgcgggccatgaagaagaagggggagaacatcgagcagatcctggactacctgtttgcccacggccagctgtgtgagaagggctttgaccccctgctggtggaggaggccctggagatgcaccagtgcagcgaggagaagatgatggagttcctgcagctgatgagcaagttcaaggagatgggctttgagctgaaggacatcaaggaggtgctgctgctgcacaacaatgaccaggacaatgccctggaggacctgatggcccgggccggggccagctag

SEQ ID NO: 175073 - DNA, 1701 bp, Artificial Sequence
  Description of Artificial Sequence: Synthetic coding sequence
atgtctggagctgtgcggggcagaagaagagaggtgggcctgcagcacggcggctgcggcactggaggcggctatggagatggcctggcccggagcggccagagctggcgctggtggaggagcctgagcctgggcgctgtgggcagcagcgctggaacagagcccggccggcctgctggggccagcaccttccggctgctgcggcggcggcagcagaggcacagcggcaccttctcctacctggatgatgtgcccttcaagacaggagacaagttcaagaccccagccaaggtgggcctgcccatcggcttcagcctgcctgactgcctgcaggtggtgcgggaggtgcagtatgacttcagcctggagaagaagaccatcgagtgggccgaggagatcaagaagattgaggaggccgagcgggaggccgagtgcaagattgctgaggccgaggccaaggtgaacagcaagagcggccctgagggggacagcaagatgtccttcagcaagacccacagcacagccaccatgcccccacccatcaaccccatcctggccagcctgcagcacaacagcatcctgacccccaccagggtgagcagcagcgccaccaagcagaaggtgctgagccccccccacatcaaggctgacttcaacctggccgactttgaatgtgaggaggacccctttgacaacctggagctgaagaccattgatgagaaggaggagctgaggaacatcctggtgggcaccaccggccccatcatggcccagctgctggacaacaacctgccccggggcggcagcggctctgtgctgcaggatgaggaggtgctggccagcctggagcgggccaccctggacttcaagcccctgcacaagcccaacggcttcatcaccctgccccagctgggcaactgtgagaagatgagcctgagcagcaaggtgtccctgccccccatcccagctgtgagcaacatcaagagcctgtccttccccaagctggacagtgatgacagcaaccagaagacagccaagctggccagcaccttccacagcaccagctgcctgagaaatggcaccttccagaacagcctgaagcccagcacccagagcagcgccagcgagctgaatggccaccacaccctgggcctgagcgccctgaacctggacagcggcacagagatgcctgccctgaccagcagccagatgcccagcctgtctgtgctgtctgtgtgcacagaggagagcagcccccccaacacaggccccaccgtgaccccacccaacttctctgtgtcccaggtgcccaacatgcccagctgcccccaggcctacagcgagctgcagatgctgagccccagcgagcggcagtgtgtggagaccgtggtgaacatgggctacagctatgaatgtgtgctgcgggccatgaagaagaagggggagaacatcgagcagatcctggactacctgtttgcccacggccagctgtgtgagaagggctttgaccccctgctggtggaggaggccctggagatgcaccagtgcagcgaggagaagatgatggagttcctgcagctgatgagcaagttcaaggagatgggctttgagctgaaggacatcaaggaggtgctgctgctgcacaacaatgaccaggacaatgccctggaggacctgatggcccgggccggggccagctag

SEQ ID NO: 175074 - DNA, 690 bp, Artificial Sequence
  Description of Artificial Sequence: Synthetic coding sequence
atgcagatctttgtgaagaccctgaccgggaagaccatcaccctggaggtggagcccagcgacaccattgaaaatgtgaaggccaagatccaggacaaggagggcatccccccagaccagcagaggctcatctttgctgggaagcagctggaggatggccgcaccctgagtgactacaacatccagaaggagagcaccctgcacctggtgctgcggctgcggggcggcatgcagatctttgtgaagaccctgaccgggaagaccatcaccctggaggtggagcccagcgacaccattgaaaatgtgaaggccaagatccaggacaaggagggcatccccccagaccagcagaggctcatctttgctgggaagcagctggaggatggccgcaccctgagtgactacaacatccagaaggagagcaccctgcacctggtgctgcggctgcggggcggcatgcagatctttgtgaagaccctgaccgggaagaccatcaccctggaggtggagcccagcgacaccattgaaaatgtgaaggccaagatccaggacaaggagggcatccccccagaccagcagaggctcatctttgctgggaagcagctggaggatggccgcaccctgagtgactacaacatccagaaggagagcaccctgcacctggtgctgcggctgcggggcggctgctag

SEQ ID NO: 175075 - DNA, 690 bp, Artificial Sequence; identical to SEQ ID NO: 175074
  Description of Artificial Sequence: Synthetic coding sequence

SEQ ID NO: 175076 - DNA, 690 bp, Artificial Sequence; identical to SEQ ID NO: 175074
  Description of Artificial Sequence: Synthetic coding sequence

SEQ ID NO: 175077 - DNA, 462 bp, Artificial Sequence
  Description of Artificial Sequence: Synthetic coding sequence
atgcagatctttgtgaagaccctgaccgggaagaccatcaccctggaggtggagcccagcgacaccattgaaaatgtgaaggccaagatccaggacaaggagggcatccccccagaccagcagaggctcatctttgctgggaagcagctggaggatggccgcaccctgagtgactacaacatccagaaggagagcaccctgcacctggtgctgcggctgcggggcggcatgcagatctttgtgaagaccctgaccgggaagaccatcaccctggaggtggagcccagcgacaccattgaaaatgtgaaggccaagatccaggacaaggagggcatccccccagaccagcagaggctcatctttgctgggaagcagctggaggatggccgcaccctgagtgactacaacatccagaaggagagcaccctgcacctggtgctgcggctgcggggcggctgctag

SEQ ID NO: 175078 - DNA, 2058 bp, Artificial Sequence
  Description of Artificial Sequence: Synthetic coding sequence
atgcagatctttgtgaagaccctgaccgggaagaccatcaccctggaggtggagcccagcgacaccattgaaaatgtgaaggccaagatccaggacaaggagggcatccccccagaccagcagaggctcatctttgctgggaagcagctggaggatggccgcaccctgagtgactacaacatccagaaggagagcaccctgcacctggtgctgcggctgcggggcggcatgcagatctttgtgaagaccctgaccgggaagaccatcaccctggaggtggagcccagcgacaccattgaaaatgtgaaggccaagatccaggacaaggagggcatccccccagaccagcagaggctcatctttgctgggaagcagctggaggatggccgcaccctgagtgactacaacatccagaaggagagcaccctgcacctggtgctgcggctgcggggcggcatgcagatctttgtgaagaccctgaccgggaagaccatcaccctggaggtggagcccagcgacaccattgaaaatgtgaaggccaagatccaggacaaggagggcatccccagcgaccagcagaggctcatctttgctgggaagcagctggaggatggccgcaccctgagtgactacaacatccagaaggagagcaccctgcacctggtgctgcggctgcggggcggcatgcagatctttgtgaagaccctgaccgggaagaccatcaccctggaggtggagcccagcgacaccattgaaaatgtgaaggccaagatccaggacaaggagggcatccccccagaccagcagaggctcatctttgctgggaagcagctggaggatggccgcaccctgagtgactacaacatccagaaggagagcaccctgcacctggtgctgcggctgcggggcggcatgcagatctttgtgaagaccctgaccgggaagaccatcaccctggaggtggagcccagcgacaccattgaaaatgtgaaggccaagatccaggacaaggagggcatccccccagaccagcagaggctcatctttgctgggaagcagctggaggatggccgcaccctgagtgactacaacatccagaaggagagcaccctgcacctggtgctgcggctgcggggcggcatgcagatctttgtgaagaccctgaccgggaagaccatcaccctggaggtggagcccagcgacaccattgaaaatgtgaaggccaagatccaggacaaggagggcatccccccagaccagcagaggctcatctttgctgggaagcagctggaggatggccgcaccctgagtgactacaacatccagaaggagagcaccctgcacctggtgctgcggctgcggggcggcatgcagatctttgtgaagaccctgaccgggaagaccatcaccctggaggtggagcccagcgacaccattgaaaatgtgaaggccaagatccaggacaaggagggcatccccccagaccagcagaggctcatctttgctgggaagcagctggaggatggccgcaccctgagtgactacaacatccagaaggagagcaccctgcacctggtgctgcggctgcggggcggcatgcagatctttgtgaagaccctgaccgggaagaccatcaccctggaggtggagcccagcgacaccattgaaaatgtgaaggccaagatccaggacaaggagggcatccccccagaccagcagaggctcatctttgctgggaagcagctggaggatggccgcaccctgagtgactacaacatccagaaggagagcaccctgcacctggtgctgcggctgcggggcggcatgcagatctttgtgaagaccctgaccgggaagaccatcaccctggaggtggagcccagcgacaccattgaaaatgtgaaggccaagatccaggacaaggagggcatccccccagaccagcagaggctcatctttgctgggaagcagctggaggatggccgcaccctgagtgactacaacatccagaaggagagcaccctgcacctggtgctgcggctgcggggcggcgtgtag

SEQ ID NO: 175079 - DNA, 450 bp, Artificial Sequence
  Description of Artificial Sequence: Synthetic coding sequence
atgcagatctttgtgaagaccctgaccgggaagaccatcaccctggaggtggagcccagcgacaccattgaaaatgtgaaggccaagatccaggacaaggagggcatccccccagaccagcagaggctcatctttgctgggaagcagctggaggatggccgcaccctgagtgactacaacatccagaaggagagcaccctgcacctggtgctgcggctgcggggcggcatgcagatctttgtgaagaccctgaccgggaagaccatcaccctggaggtggagcccagcgacaccattgaaaatgtgaaggccaagatccaggacaaggagggcatccccccagaccagcagaggctcatctttgctgggaagcagctggaggatggccgcaccctgagtgactacaacatccagaaggagagcaccctgcacctggtgctgcggctgtag

SEQ ID NO: 175080 - DNA, 372 bp, Artificial Sequence
  Description of Artificial Sequence: Synthetic coding sequence
atgcagatctttgtgaagaccctgaccgggaagaccatcaccctggaggtggagcccagcgacaccattgaaaatgtgaaggccaagatccaggacaaggagggcatccccccagaccagcagaggctcatctttgctgggaagcagctggaggatggccgcaccctgagtgactacaacatccagaaggagagcaccctgcacctggtgctgcggctgcggggcggcatgcagatctttgtgaagaccctgaccgggaagaccatcaccctggaggtggagcccagcgacaccattgaaaatgtgaaggccaagatccaggacaaggagggcatccccccagaccagcagaggctcatctttgctggatag

SEQ ID NO: 175081 - DNA, 2058 bp, Artificial Sequence; identical to SEQ ID NO: 175078
  Description of Artificial Sequence: Synthetic coding sequence

SEQ ID NO: 175082 - DNA, 486 bp, Artificial Sequence
  Description of Artificial Sequence: Synthetic coding sequence
atgcagatctttgtgaagaccctgaccgggaagaccatcaccctggaggtggagcccagcgacaccattgaaaatgtgaaggccaagatccaggacaaggagggcatccccccagaccagcagaggctcatctttgctgggaagcagctggaggatggccgcaccctgagtgactacaacatccagaaggagagcaccctgcacctggtgctgcggctgcggggcggcatgcagatctttgtgaagaccctgaccgggaagaccatcaccctggaggtggagcccagcgacaccattgaaaatgtgaaggccaagatccaggacaaggagggcatccccccagaccagcagaggctcatctttgctgggaagcagctggaggatggccgcaccctgagtgactacaacatccagaaggagagcaccctgcacctggtgctgcggctgcggggcggcatgcagatctttgtgaagaccctgacctag

SEQ ID NO: 175083 - DNA, 405 bp, Artificial Sequence
  Description of Artificial Sequence: Synthetic coding sequence
atgcagatctttgtgaagaccctgaccgggaagaccatcaccctggaggtggagcccagcgacaccattgaaaatgtgaaggccaagatccaggacaaggagggcatccccccagaccagcagaggctcatctttgctgggaagcagctggaggatggccgcaccctgagtgactacaacatccagaaggagagcaccctgcacctggtgctgcggctgcggggcggcatgcagatctttgtgaagaccctgaccgggaagaccatcaccctggaggtggagcccagcgacaccattgaaaatgtgaaggccaagatccaggacaaggagggcatccccccagaccagcagaggctcatctttgctgggaagcagctggaggatggccgcaccctgagtgactag

SEQ ID NO: 175084 - DNA, 510 bp, Artificial Sequence
  Description of Artificial Sequence: Synthetic coding sequence
atgcagatctttgtgaagaccctgaccgggaagaccatcaccctggaggtggagcccagcgacaccattgaaaatgtgaaggccaagatccaggacaaggagggcatccccccagaccagcagaggctcatctttgctgggaagcagctggaggatggccgcaccctgagtgactacaacatccagaaggagagcaccctgcacctggtgctgcggctgcggggcggcatgcagatctttgtgaagaccctgaccgggaagaccatcaccctggaggtggagcccagcgacaccattgaaaatgtgaaggccaagatccaggacaaggagggcatccccagcgaccagcagaggctcatctttgctgggaagcagctggaggatggccgcaccctgagtgactacaacatccagaaggagagcaccctgcacctggtgctgcggctgcggggcggcatgcagatctttgtgaagaccctgaccgggaagaccatcaccctggaggtgtag

SEQ ID NO: 175085 - DNA, 468 bp, Artificial Sequence
  Description of Artificial Sequence: Synthetic coding sequence
atgcagatctttgtgaagaccctgaccgggaagaccatcaccctggaggtggagcccagcgacaccattgaaaatgtgaaggccaagatccaggacaaggagggcatccccccagaccagcagaggctcatctttgctgggaagcagctggaggatggccgcaccctgagtgactacaacatccagaaggagagcaccctgcacctggtgctgcggctgcggggcggcatgcagatctttgtgaagaccctgaccgggaagaccatcaccctggaggtggagcccagcgacaccattgaaaatgtgaaggccaagatccaggacaaggagggcatccccccagaccagcagaggctcatctttgctgggaagcagctggaggatggccgcaccctgagtgactacaacatccagaaggagagcaccctgcacctggtgctgcggctgcggggcggcatgcagatctag

SEQ ID NO: 175086 - DNA, 186 bp, Artificial Sequence
  Description of Artificial Sequence: Synthetic coding sequence
atgcagatctttgtgaagaccctgaccgggaagaccatcaccctggaggtggagcccagcgacaccattgaaaatgtgaaggccaagatccaggacaaggagggcatccccccagaccagcagaggctcatctttgctgggaagcagctggaggatggccgcaccctgagtgactacaacatctag

SEQ ID NO: 175087 - DNA, 1830 bp, Artificial Sequence
  Description of Artificial Sequence: Synthetic coding sequence
atgcagatctttgtgaagaccctgaccgggaagaccatcaccctggaggtggagcccagcgacaccattgaaaatgtgaaggccaagatccaggacaaggagggcatccccccagaccagcagaggctcatctttgctgggaagcagctggaggatggccgcaccctgagtgactacaacatccagaaggagagcaccctgcacctggtgctgcggctgcggggcggcatgcagatctttgtgaagaccctgaccgggaagaccatcaccctggaggtggagcccagcgacaccattgaaaatgtgaaggccaagatccaggacaaggagggcatccccagcgaccagcagaggctcatctttgctgggaagcagctggaggatggccgcaccctgagtgactacaacatccagaaggagagcaccctgcacctggtgctgcggctgcggggcggcatgcagatctttgtgaagaccctgaccgggaagaccatcaccctggaggtggagcccagcgacaccattgaaaatgtgaaggccaagatccaggacaaggagggcatccccccagaccagcagaggctcatctttgctgggaagcagctggaggatggccgcaccctgagtgactacaacatccagaaggagagcaccctgcacctggtgctgcggctgcggggcggcatgcagatctttgtgaagaccctgaccgggaagaccatcaccctggaggtggagcccagcgacaccattgaaaatgtgaaggccaagatccaggacaaggagggcatccccccagaccagcagaggctcatctttgctgggaagcagctggaggatggccgcaccctgagtgactacaacatccagaaggagagcaccctgcacctggtgctgcggctgcggggcggcatgcagatctttgtgaagaccctgaccgggaagaccatcaccctggaggtggagcccagcgacaccattgaaaatgtgaaggccaagatccaggacaaggagggcatccccccagaccagcagaggctcatctttgctgggaagcagctggaggatggccgcaccctgagtgactacaacatccagaaggagagcaccctgcacctggtgctgcggctgcggggcggcatgcagatctttgtgaagaccctgaccgggaagaccatcaccctggaggtggagcccagcgacaccattgaaaatgtgaaggccaagatccaggacaaggagggcatccccccagaccagcagaggctcatctttgctgggaagcagctggaggatggccgcaccctgagtgactacaacatccagaaggagagcaccctgcacctggtgctgcggctgcggggcggcatgcagatctttgtgaagaccctgaccgggaagaccatcaccctggaggtggagcccagcgacaccattgaaaatgtgaaggccaagatccaggacaaggagggcatccccccagaccagcagaggctcatctttgctgggaagcagctggaggatggccgcaccctgagtgactacaacatccagaaggagagcaccctgcacctggtgctgcggctgcggggcggcatgcagatctttgtgaagaccctgaccgggaagaccatcaccctggaggtggagcccagcgacaccattgaaaatgtgaaggccaagatccaggacaaggagggcatccccccagaccagcagaggctcatctttgctgggaagcagctggaggatggccgcaccctgagtgactacaacatccagaaggagagcaccctgcacctggtgctgcggctgcggggcggcgtgtag

SEQ ID NO: 175088 - DNA, 411 bp, Artificial Sequence
  Description of Artificial Sequence: Synthetic coding sequence
atgcagatctttgtgaagaccctgaccgggaagaccatcaccctggaggtggagcccagcgacaccattgaaaatgtgaaggccaagatccaggacaaggagggcatccccccagaccagcagaggctcatctttgctgggaagcagctggaggatggccgcaccctgagtgactacaacatccagaaggagagcaccctgcacctggtgctgcggctgcggggcggcatgcagatctttgtgaagaccctgaccgggaagaccatcaccctggaggtggagcccagcgacaccattgaaaatgtgaaggccaagatccaggacaaggagggcatccccccagaccagcagaggctcatctttgctgggaagcagctggaggatggccgcaccctgagtgactacaactag

SEQ ID NO: 175089 - DNA, 672 bp, Artificial Sequence
  Description of Artificial Sequence: Synthetic coding sequence
atgcagctgaagcccatggagatcaaccctgagatgctgaacaaggtgctgagccggctgggcgtggccggccagtggaggtttgtggatgtgctgggcctggaggaggagagcctgggctctgtgcctgccccagcctgtgccctgctgctgctcttccccctgacagcccagcacgagaacttcaggaagaagcagatcgaggagctgaagggccaggaggtgagccccaaggtgtacttcatgaagcagaccatcggcaacagctgtggcaccatcggcctcatccatgctgtggccaacaaccaggacaagctgggctttgaagatggctctgtgctgaagcagttcctgtctgaaacagagaagatgagcccagaagatcgggccaagtgctttgagaagaatgaggccatccaggccgcccatgatgctgtggcccaggagggccagtgccgggtggatgacaaggtgaacttccacttcatcctcttcaacaacgtggatggccacctgtatgagctggatggccgcatgcccttccctgtgaaccacggggccagcagcgaggacaccctgctgaaggatgctgccaaggtgtgccgggagttcacagagcgggagcagggcgaggtgcgcttctctgctgtggccctgtgcaaggccgcctag

SEQ ID NO: 175090 - DNA, 642 bp, Artificial Sequence
  Description of Artificial Sequence: Synthetic coding sequence
atgcagctgaagcccatggagatcaaccctgagatgctgaacaaggtgctgagccggctgggcgtggccggccagtggaggtttgtggatgtgctgggcctggaggaggagagcctgggctctgtgcctgccccagcctgtgccctgctgctgctcttccccctgacagcccagcacgagaacttcaggaagaagcagatcgaggagctgaagggccaggaggtgagccccaaggtgtacttcatgaagcagaccatcggcaacagctgtggcaccatcggcctcatccatgctgtggccaacaaccaggacaagctgggctttgaagatggctctgtgctgaagcagttcctgtctgaaacagagaagatgagcccagaagatcgggccaagtgctttgagaagaatgaggccatccaggccgcccatgatgctgtggcccaggagggccagtgccgggtggatgacaaggtgaacttccacttcatcctcttcaacaacgtggatggccacctgtatgagctggatggccgcatgcccttccctgtgaaccacggggccagcagcgaggacaccctgctgaaggatgctgccaaggtgtgccgggagttcacagagcgggagcagggcgaggtgaggtag

SEQ ID NO: 175091 - DNA, 177 bp, Artificial Sequence
  Description of Artificial Sequence: Synthetic coding sequence
atgcagctgaagcccatggagatcaaccctgagatgctgaacaaggtgctgagccggctgggcgtggccggccagtggaggtttgtggatgtgctgggcctggaggaggagagcctgggctctgtgcctgccccagcctgtgccctgctgctgctcttccccctgacagcccagtag

SEQ ID NO: 175092 - DNA, 756 bp, Artificial Sequence
  Description of Artificial Sequence: Synthetic coding sequence
atggtgcccaggcctgtgtgtgctgtgctgctgctcttccccatcacagagaagtatgaggtgttcagaacagaggaggaggagaagatcaagagccagggccaggatgtgaccagctctgtgtacttcatgaagcagaccatcagcaatgcctgtggcaccatcggcctcatccacgccatcgccaacaacaaggacaagatgcactttgagagcggcagcaccctgaagaagttcctggaggagagcgtgtccatgagccctgaggagcgggcccgctacctggagaactatgatgccatccgggtgacccatgagaccagcgcccacgagggccagacagagagcagcagccccagcagcagccagccccacagcagccactgcaggaccaaggccagcagcctgtgccaccacgccagcctgccctgggtgaagagaaatcatgtgggccctgccaaggccaccagccccagcctgcggctgcggcgctggaggcccttcctgcggctgcccagcctgggcctgcacagcgtggcccccagcattgatgagaaggtggacctgcacttcatcgccctggtgcacgtggatggccacctgtatgagctggatggcaggaagcccttccccatcaaccacggggagaccagtgatgagaccctgctggaggatgccatcgaggtgtgcaagaagttcatggagcgggaccctgatgagctgcgcttcaatgccatcgccctgtctgctgcctag

SEQ ID NO: 175093 - DNA, 693 bp, Artificial Sequence
  Description of Artificial Sequence: Synthetic coding sequence
atggagggccagcgctggctgcccctggaggccaaccctgaggtgaccaaccagttcctgaagcagctgggcctgcaccccaactggcagtttgtggatgtgtatggcatggaccctgagctgctgtccatggtgcccaggcctgtgtgtgctgtgctgctgctcttccccatcacagagaagtatgaggtgttcagaacagaggaggaggagaagatcaagagccagggccaggatgtgaccagctctgtgtacttcatgaagcagaccatcagcaatgcctgtggcaccatcggcctcatccacgccatcgccaacaacaaggacaagatgcactttgaaagtggcagcaccctgaagaagttcctggaggagagcgtgtccatgagccctgaggagcgggcccgctacctggagaactatgatgccatccgggtgacccatgagaccagcgcccacgagggccagacagaggcccccagcattgatgagaaggtggacctgcacttcatcgccctggtgcacgtggatggccacctgtatgagctggatggcaggaagcccttccccatcaaccacggggagaccagtgatgagaccctgctggaggatgccatcgaggtgtgcaagaagttcatggagcgggaccctgatgagctgcgcttcaatgccatcgccctgtctgctgcctag

SEQ ID NO: 175094 - DNA, 687 bp, Artificial Sequence
  Description of Artificial Sequence: Synthetic coding sequence
acagaggaggaggagaagatcaagagccagggccaggatgtgaccagctctgtgtacttcatgaagcagaccatcagcaatgcctgtggcaccatcggcctcatccacgccatcgccaacaacaaggacaagatgcactttgaaagtggcagcaccctgaagaagttcctggaggagagcgtgtccatgagccctgaggagcgggcccgctacctggagaactatgatgccatccgggtgacccatgagaccagcgcccacgagggccagacagagagcagcagccccagcagcagccagccccacagcagccactgcaggaccaaggccagcagcctgtgccaccacgccagcctgccctgggtgaagaggaaccacgtgggccctgccaaggccaccagccccagcctgcggctgcggcgctggaggcccttcctgcggctgcccagcctgggcctgcacagcgtggcccccagcattgatgagaaggtggacctgcacttcatcgccctggtgcacgtggatggccacctgtatgagctggatggcaggaagcccttccccatcaaccacggggagaccagtgatgagaccctgctggaggatgccatcgaggtgtgcaagaagttcatggagcgggaccctgatgagctgcgcttcaatgccatcgccctgtctgctgcctag

SEQ ID NO: 175095 - DNA, 981 bp, Artificial Sequence
  Description of Artificial Sequence: Synthetic coding sequence
atgactggaaatgctggggagtggtgcctgatggagagtgaccccggggtcttcacagagctgatcaagggcttcggctgccgcggggcccaggtggaggagatctggagcctggagccagaaaattttgagaagctgaagcctgtgcacggcctcatcttcctgttcaagtggcagcccggggaggagcctgctggctctgtggtgcaggacagccggctggacaccatcttctttgccaagcaggtgatcaacaatgcctgtgccacccaggccatcgtgtctgtgctgctgaactgcacccaccaggatgtgcacctgggggagaccctgtctgagttcaaggagttcagccagagctttgatgctgccatgaagggcctggccctgagcaacagtgatgtgatccggcaggtgcacaacagctttgcccggcagcagatgtttgaatttgacaccaagaccagcgccaaggaggaggatgccttccactttgtgtcctatgtgcctgtgaatggccgcctgtatgagctggatggcctgcgggagggccccatcgacctgggcgcctgcaaccaggatgactggatctctgctgtgcggcctgtgattgagaagaggatccagaagtacagcgagggggagatccgcttcaacctgatggccatcgtgtctgacaggaagatgatctatgagcagaagattgctgagctgcagaggcagctggccgaggagcccatggacacagaccagggcaacagcatgctgagcgccatccagagcgaggtggccaagaaccagatgctgattgaggaggaggtgcagaagctgaagcgctacaagattgagaacatccggaggaagcacaactacctgcccttcatcatggagctgctgaagaccctggccgagcaccagcagctgatccccctggtggagaagtttgagaagcactttgagaagaccctgctgggcaagtag

SEQ ID NO: 175096 - DNA, 951 bp, Artificial Sequence
  Description of Artificial Sequence: Synthetic coding sequence
atgactggaaatgctggggagtggtgcctgatggagagtgaccccggggtcttcacagagctgatcaagggcttcggctgccgcggggcccaggtggaggagatctggagcctggagccagaaaattttgagaagctgaagcctgtgcacggcctcatcttcctgttcaagtggcagcccggggaggagcctgctggctctgtggtgcaggacagccggctggacaccatcttctttgccaagcaggtgatcaacaatgcctgtgccacccaggccatcgtgtctgtgctgctgaactgcacccaccaggatgtgcacctgggggagaccctgtctgagttcaaggagttcagccagagctttgatgctgccatgaagggcctggccctgagcaacagtgatgtgatccggcaggtgcacaacagctttgcccggcagcagatgtttgaatttgacaccaagaccagcgccaaggaggaggatgccttccactttgtgtcctatgtgcctgtgaatggccgcctgtatgagctggatggcctgcgggagggccccatcgacctgggcgcctgcaaccaggatgactggatctctgctgtgcggcctgtgattgagaagaggatccagaagtacagcgagggggagatccgcttcaacctgatggccatcgtgtctgacaggaagatgatctatgagcagaagattgctgagctgcagaggcagctggccgaggagcccatggacacagaccagggcaacagcatgctgagcgccatccagagcgaggtggccaagaaccagatgctgattgaggaggaggtgcagaagctgaagcgctacaagattgagaacatccggaggaagcacaactacctgcccttcatcatggagctgctgaagaccctggccgagcaccagcagctgatccccctggtggagaagggcaagtag

SEQ ID NO: 175097 - DNA, 1107 bp, Artificial Sequence
  Description of Artificial Sequence: Synthetic coding sequence
gcccggggcggcagcggccgctgtgtggcccgggccatgactggaaatgctggggagtggtgcctgatggagagtgaccccggggtcttcacagagctgatcaagggcttcggctgccgcggggcccaggtggaggagatctggagcctggagccagaaaattttgagaagctgaagcctgtgcacggcctcatcttcctgttcaagtggcagcccggggaggagcctgctggctctgtggtgcaggacagccggctggacaccatcttctttgccaagcaggtgatcaacaatgcctgtgccacccaggccatcgtgtctgtgctgctgaactgcacccaccaggatgtgcacctgggggagaccctgtctgagttcaaggagttcagccagagctttgatgctgccatgaagggcctggccctgagcaacagtgatgtgatccggcaggtgcacaacagctttgcccggcagcagatgtttgaatttgacaccaagaccagcgccaaggaggaggatgccttccactttgtgtcctatgtgcctgtgaatggccgcctgtatgagctggatggcctgcgggagggccccatcgacctgggcgcctgcaaccaggatgactggatctctgctgtgcggcctgtgattgagaagaggatccagaaggatggcttcagcccctgctgccccggctggagccagaccccagagctgaagcccagcgcctgcctggacctgcccaagtggtacagcgagggggagatccgcttcaacctgatggccatcgtgtctgacaggaagatgatctatgagcagaagattgctgagctgcagaggcagctggccgaggaggagcccatggacacagaccagggcaacagcatgctgagcgccatccagagcgaggtggccaagaaccagatgctgattgaggaggaggtgcagaagctgaagcgctacaagattgagaacatccggaggaagcacaactacctgcccttcatcatggagctgctgaagaccctggccgagcaccagcagctgatccccctggtggagaaggccaaggagaagcagaatgccaagaaggcccaggagaccaagtag

SEQ ID NO: 175098 - DNA, 1068 bp, Artificial Sequence
  Description of Artificial Sequence: Synthetic coding sequence
atgactggaaatgctggggagtggtgcctgatggagagtgaccccggggtcttcacagagctgatcaagggcttcggctgccgcggggcccaggtggaggagatctggagcctggagccagaaaattttgagaagctgaagcctgtgcacggcctcatcttcctgttcaagtggcagcccggggaggagcctgctggctctgtggtgcaggacagccggctggacaccatcttctttgccaagcaggtgatcaacaatgcctgtgccacccaggccatcgtgtctgtgctgctgaactgcacccaccaggatgtgcacctgggggagaccctgtctgagttcaaggagttcagccagagctttgatgctgccatgaagggcctggccctgagcaacagtgatgtgatccggcaggtgcacaacagctttgcccggcagcagatgtttgaatttgacaccaagaccagcgccaaggaggaggatgccttccactttgtgtcctatgtgcctgtgaatggccgcctgtatgagctggatggcctgcgggagggccccatcgacctgggcgcctgcaaccaggatgactggatctctgctgtgcggcctgtgattgagaagaggatccagaaggatggcttcagcccctgctgccccggctggagccagaccccagagctgaagcccagcgcctgcctggacctgcccaagtggtacagcgagggggagatccgcttcaacctgatggccatcgtgtctgacaggaagatgatctatgagcagaagattgctgagctgcagaggcagctggccgaggagcccatggacacagaccagggcaacagcatgctgagcgccatccagagcgaggtggccaagaaccagatgctgattgaggaggaggtgcagaagctgaagcgctacaagattgagaacatccggaggaagcacaactacctgcccttcatcatggagctgctgaagaccctggccgagcaccagcagctgatccccctggtggagaaggccaaggagaagcagaatgccaagaaggcccaggagaccaagtag

SEQ ID NO: 175099 - DNA, 579 bp, Artificial Sequence
  Description of Artificial Sequence: Synthetic coding sequence
atgaagggcctggccctgagcaacagtgatgtgatccggcaggtgcacaacagctttgcccggcagcagatgtttgaatttgacaccaagaccagcgccaaggaggaggatgccttccactttgtgtcctatgtgcctgtgaatggccgcctgtatgagctggatggcctgcgggagggccccatcgacctgggcgcctgcaaccaggatgactggatctctgctgtgcggcctgtgattgagaagaggatccagaagtacagcgagggggagatccgcttcaacctgatggccatcgtgtctgacaggaagatgatctatgagcagaagattgctgagctgcagaggcagctggccgaggagcccatggacacagaccagggcaacagcatgctgagcgccatccagagcgaggtggccaagaaccagatgctgattgaggaggaggtgcagaagctgaagcgctacaagattgagaacatccggaggaagcacaactacctgcccttcatcatggagctgctgaagaccctggccgagcaccagcagctgatccccctggtggagaagatcttctag

SEQ ID NO: 175100 - DNA, 987 bp, Artificial Sequence
  Description of Artificial Sequence: Synthetic coding sequence
atgactggaaatgctggggagtggtgcctgatggagagtgaccccggggtcttcacagagctgatcaagggcttcggctgccgcggggcccaggtggaggagatctggagcctggagccagaaaattttgagaagctgaagcctgtgcacggcctcatcttcctgttcaagtggcagcccggggaggagcctgctggctctgtggtgcaggacagccggctggacaccatcttctttgccaagcaggtgatcaacaatgcctgtgccacccaggccatcgtgtctgtgctgctgaactgcacccaccaggatgtgcacctgggggagaccctgtctgagttcaaggagttcagccagagctttgatgctgccatgaagggcctggccctgagcaacagtgatgtgatccggcaggtgcacaacagctttgcccggcagcagatgtttgaatttgacaccaagaccagcgccaaggaggaggatgccttccactttgtgtcctatgtgcctgtgaatggccgcctgtatgagctggatggcctgcgggagggccccatcgacctgggcgcctgcaaccaggatgactggatctctgctgtgcggcctgtgattgagaagaggatccagaagtacagcgagggggagatccgcttcaacctgatggccatcgtgtctgacaggaagatgatctatgagcagaagattgctgagctgcagaggcagctggccgaggagcccatggacacagaccagggcaacagcatgctgagcgccatccagagcgaggtggccaagaaccagatgctgattgaggaggaggtgcagaagctgaagcgctacaagattgagaacatccggaggaagcacaactacctgcccttcatcatggagctgctgaagaccctggccgagcaccagcagctgatccccctggtggagaaggccaaggagaagcagaatgccaagaaggcccaggagaccaagtag

SEQ ID NO: 175101 - DNA, 990 bp, Artificial Sequence
  Description of Artificial Sequence: Synthetic coding sequence
atgactggaaatgctggggagtggtgcctgatggagagtgaccccggggtcttcacagagctgatcaagggcttcggctgccgcggggcccaggtggaggagatctggagcctggagccagaaaattttgagaagctgaagcctgtgcacggcctcatcttcctgttcaagtggcagcccggggaggagcctgctggctctgtggtgcaggacagccggctggacaccatcttctttgccaagcaggtgatcaacaatgcctgtgccacccaggccatcgtgtctgtgctgctgaactgcacccaccaggatgtgcacctgggggagaccctgtctgagttcaaggagttcagccagagctttgatgctgccatgaagggcctggccctgagcaacagtgatgtgatccggcaggtgcacaacagctttgcccggcagcagatgtttgaatttgacaccaagaccagcgccaaggaggaggatgccttccactttgtgtcctatgtgcctgtgaatggccgcctgtatgagctggatggcctgcgggagggccccatcgacctgggcgcctgcaaccaggatgactggatctctgctgtgcggcctgtgattgagaagaggatccagaagtacagcgagggggagatccgcttcaacctgatggccatcgtgtctgacaggaagatgatctatgagcagaagattgctgagctgcagaggcagctggccgaggaggagcccatggacacagaccagggcaacagcatgctgagcgccatccagagcgaggtggccaagaaccagatgctgattgaggaggaggtgcagaagctgaagcgctacaagattgagaacatccggaggaagcacaactacctgcccttcatcatggagctgctgaagaccctggccgagcaccagcagctgatccccctggtggagaaggccaaggagaagcagaatgccaagaaggcccaggagaccaagtag

SEQ ID NO: 175102 - DNA, 954 bp, Artificial Sequence
  Description of Artificial Sequence: Synthetic coding sequence
atggagagtgaccccggggtcttcacagagctgatcaagggcttcggctgccgcggggcccaggtggaggagatctggagcctggagccagaaaattttgagaagctgaagcctgtgcacggcctcatcttcctgttcaagtggcagcccggggaggagcctgctggctctgtggtgcaggacagccggctggacaccatcttctttgccaagcaggtgatcaacaatgcctgtgccacccaggccatcgtgtctgtgctgctgaactgcacccaccaggatgtgcacctgggggagaccctgtctgagttcaaggagttcagccagagctttgatgctgccatgaagggcctggccctgagcaacagtgatgtgatccggcaggtgcacaacagctttgcccggcagcagatgtttgaatttgacaccaagaccagcgccaaggaggaggatgccttccactttgtgtcctatgtgcctgtgaatggccgcctgtatgagctggatggcctgcgggagggccccatcgacctgggcgcctgcaaccaggatgactggatctctgctgtgcggcctgtgattgagaagaggatccagaagtacagcgagggggagatccgcttcaacctgatggccatcgtgtctgacaggaagatgatctatgagcagaagattgctgagctgcagaggcagctggccgaggaggagcccatggacacagaccagggcaacagcatgctgagcgccatccagagcgaggtggccaagaaccagatgctgattgaggaggaggtgcagaagctgaagcgctacaagattgagaacatccggaggaagcacaactacctgcccttcatcatggagctgctgaagaccctggccgagcaccagcagctgatccccctggtggagaagtttgagaagcactttgagaagaccctgctgggcaagtag

SEQ ID NO: 175103 - DNA, 300 bp, Artificial Sequence
  Description of Artificial Sequence: Synthetic coding sequence
tgaaacctgatggccatcgtgtctgacaggaagatgatctatgagcagaagattgctgagctgcagaggcagctggccgaggagcccatggacacagaccagggcaacagcatgctgagcgccatccagagcgaggtggccaagaaccagatgctgattgaggaggaggtgcagaagctgaagcgctacaagattgagaacatccggaggaagcacaactacctgcccttcatcatggagctgctgaagaccctggccgagcaccagcagctgatccccctggtggagaagatcttctag

SEQ ID NO: 175104 - DNA, 498 bp, Artificial Sequence
  Description of Artificial Sequence: Synthetic coding sequence
atggtgcggcccggcctggccaggatgagcctgccccgctgctggttccgctacccaggctggacaggagctgaggccggccggggccgggccatcgtgtcccggcggctgcccagcctgaacccctgggatgctggggagagacatggaggcctggtgcgcatctgtgccagcctgggcccccacaagaggctgcctgctggcctgccccagtgcccccacctgtacctggccgctgaccccctggacccccagaggcggcaggagaagagctgtgccgccctgggcaatgacaagaggcggcagccagatggccagaggcagccccagcagcagcagcagccccactgccggcggggcttccaggccccagccctgcccaaccccctgcgggtgctgcagggcctgggccgggtgtccatgagcctgggctggctggagcggcccccagccctgagcagagctgctggctgccgcggggcccaggtggaggagtag

SEQ ID NO: 175105 - DNA, 657 bp, Artificial Sequence
  Description of Artificial Sequence: Synthetic coding sequence
tgactgtctgagttcaaggagttcagccagagctttgatgctgccatgaagggcctggccctgagcaacagtgatgtgatccggcaggtgcacaacagctttgcccggcagcagatgtttgaatttgacaccaagaccagcgccaaggaggaggatgccttccactttgtgtcctatgtgcctgtgaatggccgcctgtatgagctggatggcctgcgggagggccccatcgacctgggcgcctgcaaccaggatgactggatctctgctgtgcggcctgtgattgagaagaggatccagaagtacagcgagggggagatccgcttcaacctgatggccatcgtgtctgacaggaagatgatctatgagcagaagattgctgagctgcagaggcagctggccgaggaggagcccatggacacagaccagggcaacagcatgctgagcgccatccagagcgaggtggccaagaaccagatgctgattgaggaggaggtgcagaagctgaagcgctacaagattgagaacatccggaggaagcacaactacctgcccttcatcatggagctgctgaagaccctggccgagcaccagcagctgatccccctggtggagaagtttgagaagcactttgagaagaccctgctgggcaagtag

SEQ ID NO: 175106 - DNA, 777 bp, Artificial Sequence
  Description of Artificial Sequence: Synthetic coding sequence
atgagcctgggctggctggagcggcccccagccctgagcagagctgctggctgccgcggggcccaggtggaggagatctggagcctggagcctgagaactttgagaagctgaagcctgtgcacggcctcatcttcctgttcaagtggcagcctggagaggagcccgccggctctgtggtgcaggacagccggctggacaccatcttctttgccaagcaggtgatcaacaatgcctgtgccacccaggccatcgtgtctgtgctgctgaactgcacccaccaggatgtgcacctgggggagaccctgtctgagttcaaggagttcagccagagctttgatgctgccatgaagggcctggccctgagcaacagtgatgtgatccggcaggtgcacaacagctttgcccggcagcagatgtttgaatttgacaccaagaccagcgccaaggaggaggatgccttccactttgtgtcctatgtgcctgtgaatggccgcctgtatgagctggatggcctgcgggagggccccatcgacctgggcgcctgcaaccaggatgactggatctctgctgtgcggcctgtgattgagaagaggatccagaagtacagcgagggggagatccgcttcaacctgatggccatcgtgtctgacaggaagatgatctatgagcagaagattgctgagctgcagaggcagctggccgaggagcccatggacacagaccagggcaacagcatgctgagcgccatccagagcgaggtggccaagaaccagtag

SEQ ID NO: 175107 - DNA, 552 bp, Artificial Sequence
  Description of Artificial Sequence: Synthetic coding sequence
tgacagcagatgtttgaatttgacaccaagaccagcgccaaggaggaggatgccttccactttgtgtcctatgtgcctgtgaatggccgcctgtatgagctggatggcctgcgggagggccccatcgacctgggcgcctgcaaccaggatgactggatctctgctgtgcggcctgtgattgagaagaggatccagaagtacagcgagggggagatccgcttcaacctgatggccatcgtgtctgacaggaagatgatctatgagcagaagattgctgagctgcagaggcagctggccgaggaggagcccatggacacagaccagggcaacagcatgctgagcgccatccagagcgaggtggccaagaaccagatgctgattgaggaggaggtgcagaagctgaagcgctacaagattgagaacatccggaggaagcacaactacctgcccttcatcatggagctgctgaagaccctggccgagcaccagcagctgatccccctggtggagaagtttgagaagcactttgagaagaccctgctgggcaagtag

SEQ ID NO: 175108 - DNA, 348 bp, Artificial Sequence
  Description of Artificial Sequence: Synthetic coding sequence
tgagaaggagagatccgcttcaacctgatggccatcgtgtctgacaggaagatgatctatgagcagaagattgctgagctgcagaggcagctggccgaggagcccatggacacagaccagggcaacagcatgctgagcgccatccagagcgaggtggccaagaaccagatgctgattgaggaggaggtgcagaagctgaagcgctacaagattgagaacatccggaggaagcacaactacctgcccttcatcatggagctgctgaagaccctggccgagcaccagcagctgatccccctggtggagaagtttgagaagcactttgagaagaccctgctgggcaagtag

SEQ ID NO: 175109 - DNA, 582 bp, Artificial Sequence
  Description of Artificial Sequence: Synthetic coding sequence
atgaagggcctggccctgagcaacagtgatgtgatccggcaggtgcacaacagctttgcccggcagcagatgtttgaatttgacaccaagaccagcgccaaggaggaggatgccttccactttgtgtcctatgtgcctgtgaatggccgcctgtatgagctggatggcctgcgggagggccccatcgacctgggcgcctgcaaccaggatgactggatctctgctgtgcggcctgtgattgagaagaggatccagaagtacagcgagggggagatccgcttcaacctgatggccatcgtgtctgacaggaagatgatctatgagcagaagattgctgagctgcagaggcagctggccgaggaggagcccatggacacagaccagggcaacagcatgctgagcgccatccagagcgaggtggccaagaaccagatgctgattgaggaggaggtgcagaagctgaagcgctacaagattgagaacatccggaggaagcacaactacctgcccttcatcatggagctgctgaagaccctggccgagcaccagcagctgatccccctggtggagaagatcttctag

SEQ ID NO: 175110 - DNA, 498 bp, Artificial Sequence
  Description of Artificial Sequence: Synthetic coding sequence
atggccccaaatgccagctgcctgtgtgtgcacgtgcgctctgaggagtgggacctgatgacctttgatgccaacccctatgattctgtgaagaagatcaaggagcacgtgcgcagcaagaccaaggtgcctgtgcaggaccaggtgctgctgctgggcagcaagatcctgaagccccggcgcagcctgagcagctatggcatcgacaaggagaagaccatccacctgaccctgaaggtggtgaagcccagtgatgaggagctgcccctcttcctggtggagagcggagatgaggccaagaggcacctgctgcaggtgagaagaagcagctctgtggcccaggtgaaggccatgattgagaccaagacaggcatcatccctgagacccagatcgtgacctgcaatggcaagaggctggaggatggcaagatgatggctgactatggcatcaggaagggcaacctgctcttcctggcctgctactgcattggaggatag

SEQ ID NO: 175111 - DNA, 498 bp, Artificial Sequence
  Description of Artificial Sequence: Synthetic coding sequence
atggccccaaatgccagctgcctgtgtgtgcacgtgcgctctgaggagtgggacctgatgacctttgatgccaacccctatgattctgtgaagaagatcaaggagcacgtgcgcagcaagaccaaggtgcctgtgcaggaccaggtgctgctgctgggcagcaagatcctgaagccccggcgcagcctgagcagctatggcatcgacaaggagaagaccatccacctgaccctgaaggtggtgaagcccagtgatgaggagctgcccctcttcctggtggagagcggagatgaggccaagaggcacctgctgcaggtgagaagaagcagctctgtggcccaggtgaaggccatgattgagaccaagacaggcatcatccctgagacccagatcgtgacctgcaatggcaagaggctggaggatggcaagatgatggctgactatggcatcaggaagggcaacctgctcttcctggccagctactgcattggaggatag

SEQ ID NO: 175112 - DNA, 498 bp, Artificial Sequence
  Description of Artificial Sequence: Synthetic coding sequence
atggccccaaatgccagctgcctgtgtgtgcacgtgcgctctgaggagtgggacctgatgacctttgatgccaacccctatgattctgtgaagaagatcaaggagcacgtgcgcagcaagaccaaggtgcctgtgcaggaccaggtgctgctgctgggcagcaagatcctgaagccccggcgcagcctgagcagctatggaacagacaaggagaagaccatccacctgaccctgaaggtggtgaagcccagtgatgaggagctgcccctcttcctggtggagagcggagatgaggccaagaggcacctgctgcaggtgagaagaagcagctctgtggcccaggtgaaggccatgattgagaccaagacaggcatcatccctgagacccagatcgtgacctgcaatggcaagaggctggaggatggcaagatgatggctgactatggcatcaggaagggcaacctgctcttcctggccagctactgcattggaggatag

SEQ ID NO: 175113 - DNA, 498 bp, Artificial Sequence; identical to SEQ ID NO: 175112
  Description of Artificial Sequence: Synthetic coding sequence

SEQ ID NO: 175114 - DNA, 498 bp, Artificial Sequence; identical to SEQ ID NO: 175110
  Description of Artificial Sequence: Synthetic coding sequence

SEQ ID NO: 175115 - DNA, 498 bp, Artificial Sequence; identical to SEQ ID NO: 175112
  Description of Artificial Sequence: Synthetic coding sequence

SEQ ID NO: 175116 - DNA, 498 bp, Artificial Sequence; identical to SEQ ID NO: 175111
  Description of Artificial Sequence: Synthetic coding sequence

SEQ ID NO: 175117 - DNA, 705 bp, Artificial Sequence
  Description of Artificial Sequence: Synthetic coding sequence
atgggcggctgtgtgggcgcccagcacgacagcagcggcagcctgaatgaaaattctgagggcaccggggtggccctgggcaggaaccagcccctgaagaaggagaagcccaagtggaagagtgactaccccatgacagatggccagctgcggagcaagagagatgagttctgggacacagccccagcctttgagggcaggaaggagatctgggatgccctgaaggctgctgcccacgcctttgagagcaatgaccacgagctggcccaggccatcattgatggagccaacatcaccctgccccacggggccctgacagaatgttatgatgagctgggcaaccgctaccagctgcctgtgtactgcctggccccacccatcaacatgattgaggagaagagtgacatcgagaccctggacatccctgagcccccacccaacagcggctatgagtgccagctgcggctgcggctgagcacaggcaaggacctgaagctggtggtgcgcagcacagacacagtgttccacatgaagaggcggctgcatgctgctgagggcgtggagcccggcagccagcgctggttcttcagcggccggcccctgacagacaagatgaagtttgaggagctgaagatccccaaggactatgtggtgcaggtgattgtgtcccagcctgtgcagaaccccacccctgtggagaactag

SEQ ID NO: 175118 - DNA, 924 bp, Artificial Sequence
  Description of Artificial Sequence: Synthetic coding sequence
atgttctccttcaacatgtttgaccaccccatccccagggtcttccagaaccgcttcagcacccagtaccgctgcttctctgtgtccatgctggccggccccaatgacagaagtgatgtggagaagggcggcaagatcatcatgcctccttctgccctggaccagctgagccggctgaacatcacctaccccatgctgttcaagctgaccaacaagaacagcgacaggatgacccactgcggcgtgctggagtttgtggctgatgagggcatctgctacctgccccactggatgatgcagaacctgctgctggaggagggcggcctggtgcaggtggagagcgtgaacctgcaggtggccacctacagcaagttccagccccagagcccagacttcctggacatcaccaaccccaaggctgtgctggagaatgccctgaggaactttgcctgcctgaccactggagatgtgattgccatcaactacaatgagaagatctatgagctgcgggtgatggagaccaagccagacaaggctgtgtccatcattgaatgtgacatgaatgtggactttgatgcccccctgggctacaaggagcctgagcggcaggtgcagcacgaggagagcacagaaggagaggccgaccacagcggctacgccggggagctgggcttccgggccttcagcggcagcggcaaccggctggatggcaagaagaagggcgtggagcccagccccagccccatcaagccaggggacatcaagaggggcatccccaactatgagttcaagctgggcaagatcaccttcatccggaacagccggcccctggtgaagaaggtggaggaggatgaggccggcggccgctttgtggccttcagcggggagggccagagcctgaggaagaagggcaggaagccctag

SEQ ID NO: 175119 - DNA, 891 bp, Artificial Sequence
  Description of Artificial Sequence: Synthetic coding sequence
atgttctccttcaacatgtttgaccaccccatccccagggtcttccagaaccgcttcagcacccagtaccgctgcttctctgtgtccatgctggccggccccaatgacagaagtgatgtggagaagggcggcaagagccggctgaacatcacctaccccatgctgttcaagctgaccaacaagaacagcgacaggatgacccactgcggcgtgctggagtttgtggctgatgagggcatctgctacctgccccactggatgatgcagaacctgctgctggaggagggcggcctggtgcaggtggagagcgtgaacctgcaggtggccacctacagcaagttccagccccagagcccagacttcctggacatcaccaaccccaaggctgtgctggagaatgccctgaggaactttgcctgcctgaccactggagatgtgattgccatcaactacaatgagaagatctatgagctgcgggtgatggagaccaagccagacaaggctgtgtccatcattgaatgtgacatgaatgtggactttgatgcccccctgggctacaaggagcctgagcggcaggtgcagcacgaggagagcacagaaggagaggccgaccacagcggctacgccggggagctgggcttccgggccttcagcggcagcggcaaccggctggatggcaagaagaagggcgtggagcccagccccagccccatcaagccaggggacatcaagaggggcatccccaactatgagttcaagctgggcaagatcaccttcatccggaacagccggcccctggtgaagaaggtggaggaggatgaagctgggggccgctttgtggccttctctggagagggccagagcctgaggaagaagggcaggaagccctag

SEQ ID NO: 175120 - DNA, 1032 bp, Artificial Sequence
  Description of Artificial Sequence: Synthetic coding sequence
atgttctccttcaacatgtttgaccaccccatccccagggtcttccagaaccgcttcagcacccagtaccgctgcttctctgtgtccatgctggccggccccaatgacagaagtgatgtggagaagggcggcaagatcatcatgcctccttctgccctggaccagctgagccggctgaacatcacctaccccatgctgttcaagctgaccaacaagaacagcgacaggatgacccactgcggcgtgctggagtttgtggctgatgagggcatctgctacctgccccactgggtggtgtaccgcctgagcctggagagagatggcctgaagagcctggaggtggccgaggtgtctggcagtgactacttccccagccccttctgtggcctggaggtgtggatgatgcagaacctgctgctggaggagggcggcctggtgcaggtggagagcgtgaacctgcaggtggccacctacagcaagttccagccccagagcccagacttcctggacatcaccaaccccaaggctgtgctggagaatgccctgaggaactttgcctgcctgaccactggagatgtgattgccatcaactacaatgagaagatctatgagctgcgggtgatggagaccaagccagacaaggctgtgtccatcattgaatgtgacatgaatgtggactttgatgcccccctgggctacaaggagcctgagcggcaggtgcagcacgaggagagcacagaaggagaggccgaccacagcggctacgccggggagctgggcttccgggccttcagcggcagcggcaaccggctggatggcaagaagaagggcgtggagcccagccccagccccatcaagccaggggacatcaagaggggcatccccaactatgagttcaagctgggcaagatcaccttcatccggaacagccggcccctggtgaagaaggtggaggaggatgaggccggcggccgctttgtggccttcagcggggagggccagagcctgaggaagaagggcaggaagccctag

SEQ ID NO: 175121 - DNA, 801 bp, Artificial Sequence
  Description of Artificial Sequence: Synthetic coding sequence
atgttctccttcaacatgtttgaccaccccatccccagggtcttccagaaccgcttcagcacccagtaccgctgcttctctgtgtccatgctggccggccccaatgacagaagtgatgtggagaagggcggcaagatcatcatgcctccttctgccctggaccagctgagccggctgaacatcacctaccccatgctgttcaagctgaccaacaagaacagcgacaggatgacccactgcggcgtgctggagtttgtggctgatgagggcatctgctacctgccccactggatgatgcagaacctgctgctggaggagggcggcctggtgcaggtggagagcgtgaacctgcaggtggccacctacagcaagttccagccccagagcccagacttcctggacatcaccaaccccaaggctgtgctggagaatgccctgaggaactttgcctgcctgaccactggagatgtgattgccatcaactacaatgagaagatctatgagctgcgggtgatggagaccaagccagacaaggctgtgtccatcattgaatgtgacatgaatgtggactttgatgcccccctgggctacaaggagcctgagcggcaggtgcagcacgaggagagcacagaaggagaggccgaccacagcggctacgccggggagctgggcttccgggccttcagcggcagcggcaaccggctggatggcaagaagaagggcgtggagcccagccccagccccatcaagccaggggacatcaagaggggcatccccaactatgagttcaagctgggctag

SEQ ID NO: 175122 - DNA, 1053 bp, Artificial Sequence
  Description of Artificial Sequence: Synthetic coding sequence
atgctgcccctgcctgacctggacctgtggcccctggaccggctgcccagccccatcaagaggaagccccagaccctgggcagcctgaagagcagccagggcatcgtggaggagaccagcgaggagggcaacagcgtgcctgccagccagagcgtggccgccctgaccagcaagaggagcctggtgctgatgcctgagagcagcgctgaggagatcaccgtgtgcccagagacccagctgagcagcagcgagacctttgacctggagcgggaggtgtccccaggcagccgggacatcctggatggagtgcgcatcatcatggctgacaaggaggtgggcaacaaggaggatgctgagaaggaggtggccatcagcaccttcagcagcagcaaccaggtgtcctgccccctgtgtgaccagtgcttcccccccaccaagattgaaagacatgccatgtactgcaatggcctgatggaggaggacacagaggtgctgacccggcggcagaaggaggccaagaccaagagtgacagcggcacagctgcccagaccagcctggacatcgacaagaatgagaagtgctacctgtgcaagagcctggtgcccttccgggagtaccagtgccacgtggacagctgcctgcagctggccaaggctgaccagggagatggccctgagggcagcggccgggcctgcagcacagtggagggcaagtggcagcagaggctgaagaaccccaaggagaagggccacagcgagggccgcctgctgtccttcctggagcagagcgagcacaagaccagtgatgctgacatcaagagcagcgagactggagccttccgggtgcccagccctggcatggaggaggccggctgcagccgggagatgcagagcagcttcacccggcgggacctgaatgaaagccctgtgaagagctttgtgtccatcagcgaggccacagactgcctggtggacttcaagaagcaggtgacagtgcagcccggcagcaggaccaggaccaaggccggccggggcagaagaaggaagttctag

SEQ ID NO: 175123 - DNA, 2163 bp, Artificial Sequence
  Description of Artificial Sequence: Synthetic coding sequence
atgcccaggaggaagaagaaggtgaaggaggtgtctgagagcaggaacctggagaagaaggatgtggagaccaccagctctgtgtctgtgaagaggaagaggcggctggaggatgccttcatcgtcatcagtgacagtgatggagaggagcccaaggaggagaatggcctgcagaagaccaagaccaagcagagcaacagagccaagtgcctggccaagaggaagatcgcccagatgacagaggaggagcagtttgccctggccctgaagatgtctgagcaggaggcccgggaggtgaacagccaggaggaggaggaggaggagctgctgaggaaggccatcgccgagagcctgaacagctgccggcccagtgatgccagcgccaccaggagccggcccctggccaccggccccagcagccagagccaccaggagaagaccacagacagcggcctgacagagggcatctggcagctggtgccccccagcctcttcaagggcagccacatcagccagggcaatgaggccgaggagcgggaggagccctgggaccacacagagaagacagaggaggagcctgtgtctggcagcagcggctcctgggaccagagcagccagcctgtgtttgaaaatgtgaatgtgaagagctttgaccgctgcaccggccacagcgctgagcacacccagtgtgggaagccccaggagagcacaggccggggcagcgccttcctgaaggctgtgcagggcagcggggacaccagccgccactgcctgcccaccctggctgatgccaagggcctgcaggacaccggcggcaccgtgaactacttctggggcatccccttctgcccagatggagtggaccccaaccagtacaccaaggtgatcctgtgccagctggaggtgtaccagaagagcctgaagatggcccagaggcagctgctgaacaagaagggctttggagagcctgtgctgccccggccccccagcctcatccagaatgaatgtggccagggcgagcaggccagcgagaagaatgaatgcatcagcgaggacatgggagatgaggacaaggaggagcggcaggagagccgggccagtgactggcacagcaagaccaaggacttccaggagagcagcatcaagagcctgaaggagaagctgctgctggaggaggagcccaccaccagccacggccagagcagccagggcatcgtggaggagaccagcgaggagggcaacagcgtgcctgccagccagagcgtggccgccctgaccagcaagaggagcctggtgctgatgcctgagagcagcgctgaggagatcaccgtgtgcccagagacccagctgagcagcagcgagacctttgacctggagcgggaggtgtccccaggcagccgggacatcctggatggagtgcgcatcatcatggctgacaaggaggtgggcaacaaggaggatgctgagaaggaggtggccatcagcaccttcagcagcagcaaccaggtgtcctgccccctgtgtgaccagtgcttcccccccaccaagattgaaagacatgccatgtactgcaatggcctgatggaggaggacacagaggtgctgacccggcggcagaaggaggccaagaccaagagtgacagcggcacagctgcccagaccagcctggacatcgacaagaatgagaagtgctacctgtgcaagagcctggtgcccttccgggagtaccagtgccacgtggacagctgcctgcagctggccaaggctgaccagggagatggccctgagggcagcggccgggcctgcagcacagtggagggcaagtggcagcagaggctgaagaaccccaaggagaagggccacagcgagggccgcctgctgtccttcctggagcagagcgagcacaagaccagtgatgctgacatcaagagcagcgagactggagccttccgggtgcccagccctggcatggaggaggccggctgcagccgggagatgcagagcagcttcacccggcgggacctgaatgaaagccctgtgaagagctttgtgtccatcagcgaggccacagactgcctggtggacttcaagaagcaggtgacagtgcagcccggcagcaggaccaggaccaaggccggccggggcagaagaaggaagttctag

SEQ ID NO: 175124 - DNA, 1929 bp, Artificial Sequence
  Description of Artificial Sequence: Synthetic coding sequence
atgacagaggaggagcagtttgccctggccctgaagatgtctgagcaggaggcccgggaggtgaacagccaggaggaggaggaggaggagctgctgaggaaggccatcgccgagagcctgaacagctgccggcccagtgatgccagcgccaccaggagccggcccctggccaccggccccagcagccagagccaccaggagaagaccacagacagcggcctgacagagggcatctggcagctggtgccccccagcctcttcaagggcagccacatcagccagggcaatgaggccgaggagcgggaggagccctgggaccacacagagaagacagaggaggagcctgtgtctggcagcagcggctcctgggaccagagcagccagcctgtgtttgaaaatgtgaatgtgaagagctttgaccgctgcaccggccacagcgctgagcacacccagtgtgggaagccccaggagagcacaggccggggcagcgccttcctgaaggctgtgcagggcagcggggacaccagccgccactgcctgcccaccctggctgatgccaagggcctgcaggacaccggcggcaccgtgaactacttctggggcatccccttctgcccagatggagtggaccccaaccagtacaccaaggtgatcctgtgccagctggaggtgtaccagaagagcctgaagatggcccagaggcagctgctgaacaagaagggctttggagagcctgtgctgccccggccccccagcctcatccagaatgaatgtggccagggcgagcaggccagcgagaagaatgaatgcatcagcgaggacatgggagatgaggacaaggaggagcggcaggagagccgggccagtgactggcacagcaagaccaaggacttccaggagagcagcatcaagagcctgaaggagaagctgctgctggaggaggagcccaccaccagccacggccagagcagccagggcatcgtggaggagaccagcgaggagggcaacagcgtgcctgccagccagagcgtggccgccctgaccagcaagaggagcctggtgctgatgcctgagagcagcgctgaggagatcaccgtgtgcccagagacccagctgagcagcagcgagacctttgacctggagcgggaggtgtccccaggcagccgggacatcctggatggagtgcgcatcatcatggctgacaaggaggtgggcaacaaggaggatgctgagaaggaggtggccatcagcaccttcagcagcagcaaccaggtgtcctgccccctgtgtgaccagtgcttcccccccaccaagattgaaagacatgccatgtactgcaatggcctgatggaggaggacacagaggtgctgacccggcggcagaaggaggccaagaccaagagtgacagcggcacagctgcccagaccagcctggacatcgacaagaatgagaagtgctacctgtgcaagagcctggtgcccttccgggagtaccagtgccacgtggacagctgcctgcagctggccaaggctgaccagggagatggccctgagggcagcggccgggcctgcagcacagtggagggcaagtggcagcagaggctgaagaaccccaaggagaagggccacagcgagggccgcctgctgtccttcctggagcagagcgagcacaagaccagtgatgctgacatcaagagcagcgagactggagccttccgggtgcccagccctggcatggaggaggccggctgcagccgggagatgcagagcagcttcacccggcgggacctgaatgaaagccctgtgaagagctttgtgtccatcagcgaggccacagactgcctggtggacttcaagaagcaggtgacagtgcagcccggcagcaggaccaggaccaaggccggccggggcagaagaaggaagttctag

SEQ ID NO: 175125 - DNA, 2160 bp, Artificial Sequence
  Description of Artificial Sequence: Synthetic coding sequence
atgcccaggaggaagaagaaggtgaaggaggtgtctgagagcaggaacctggagaagaaggatgtggagaccaccagctctgtgtctgtgaagaggaagaggcggctggaggatgccttcatcgtcatcagtgacagtgatggagaggagcccaaggaggagaatggcctgcagaagaccaagaccaagcagagcaacagagccaagtgcctggccaagaggaagatcgcccagatgacagaggaggagcagtttgccctggccctgaagatgtctgagcaggaggcccgggaggtgaacagccaggaggaggaggaggaggagctgctgaggaaggccatcgccgagagcctgaacagctgccggcccagtgatgccagcgccaccaggagccggcccctggccaccggccccagcagccagagccaccaggagaagaccacagacagcggcctgacagagggcatctggcagctggtgccccccagcctcttcaagggcagccacatcagccagggcaatgaggccgaggagcgggaggagccctgggaccacacagagaagacagaggaggagcctgtgtctggcagcagcggctcctgggaccagagcagccagcctgtgtttgaaaatgtgaatgtgaagagctttgaccgctgcaccggccacagcgctgagcacacccagtgtgggaagccccaggagagcacaggccggggcagcgccttcctgaaggctgtgcagggcagcggggacaccagccgccactgcctgcccaccctggctgatgccaagggcctgcaggacaccggcggcaccgtgaactacttctggggcatccccttctgcccagatggagtggaccccaaccagtacaccaaggtgatcctgtgccagctggaggtgtaccagaagagcctgaagatggcccagaggcagctgctgaacaagaagggctttggagagcctgtgctgccccggccccccagcctcatccagaatgaatgtggccagggcgagcaggccagcgagaagaatgaatgcatcagcgaggacatgggagatgaggacaaggaggagcggcaggagagccgggccagtgactggcacagcaagaccaaggacttccaggagagcagcatcaagagcctgaaggagaagctgctgctggaggaggagcccaccaccagccacggccagagcagccagggcatcgtggaggagaccagcgaggagggcaacagcgtgcctgccagccagagcgtggccgccctgaccagcaagaggagcctggtgctgatgcctgagagcagcgctgaggagatcaccgtgtgcccagagacccagctgagcagcagcgagacctttgacctggagcgggaggtgtccccaggcagccgggacatcctggatggagtgcgcatcatcatggctgacaaggaggtgggcaacaaggaggatgctgagaaggaggtggccatcagcaccttcagcagcagcaaccaggtgtcctgccccctgtgtgaccagtgcttcccccccaccaagattgaaagacatgccatgtactgcaatggcctgatggaggaggacacagtgctgacccggcggcagaaggaggccaagaccaagagtgacagcggcacagctgcccagaccagcctggacatcgacaagaatgagaagtgctacctgtgcaagagcctggtgcccttccgggagtaccagtgccacgtggacagctgcctgcagctggccaaggctgaccagggagatggccctgagggcagcggccgggcctgcagcacagtggagggcaagtggcagcagaggctgaagaaccccaaggagaagggccacagcgagggccgcctgctgtccttcctggagcagagcgagcacaagaccagtgatgctgacatcaagagcagcgagaccggggccttccgggtgcccagccctggcatggaggaggccggctgcagccgggagatgcagagcagcttcacccggcgggacctgaatgaaagccctgtgaagagctttgtgtccatcagcgaggccacagactgcctggtggacttcaagaagcaggtgacagtgcagcccggcagcaggaccaggaccaaggccggccggggcagaagaaggaagttctag

SEQ ID NO: 175126 - DNA, 96 bp, Artificial Sequence
  Description of Artificial Sequence: Synthetic coding sequence
atgcccaggaggaagaagaaggtgaaggaggtgtctgagagcaggaacctggagaagaaggatgtggagaccaccagctctgtgtctgtgaagtag

SEQ ID NO: 175127 - DNA, 270 bp, Artificial Sequence
  Description of Artificial Sequence: Synthetic coding sequence
atgcccaggaggaagaagaaggtgaaggaggtgtctgagagcaggaacctggagaagaaggatgtggagaccaccagctctgtgtctgtgaagaggaagaggcggctggaggatgccttcatcgtcatcagtgacagtgatggagaggagcccaaggaggagaatggcctgcagaagaccaagaccaagcagagcaacagagccaagtgcctggccaagaggaagatcgcccagatgacagaggaggagcagtttgccctggccctgtag

SEQ ID NO: 175128 - DNA, 474 bp, Artificial Sequence
  Description of Artificial Sequence: Synthetic coding sequence
atgcccaggaggaagaagaaggtgaaggaggtgtctgagagcaggaacctggagaagaaggatgtggagaccaccagctctgtgtctgtgaagaggaagaggcggctggaggatgccttcatcgtcatcagtgacagtgatggagaggagcccaaggaggagaatggcctgcagaagaccaagaccaagcagagcaacagagccaagtgcctggccaagaggaagatcgcccagatgacagaggaggagcagtttgccctggccctgaagatgtctgagcaggaggcccgggaggtgaacagccaggaggaggaggaggaggagctgctgaggaaggccatcgccgagagcctgaacagctgccggcccagtgatgccagcgccaccaggagccggcccctggccaccggccccagcagccagagccaccaggagaagaccacagacagcggcctgacagagggcatctggtag

SEQ ID NO: 175129 - DNA, 2160 bp, Artificial Sequence; identical to SEQ ID NO: 175125
  Description of Artificial Sequence: Synthetic coding sequence

SEQ ID NO: 175130 - DNA, 5250 bp, Artificial Sequence
  Description of Artificial Sequence: Synthetic coding sequence
atggctgatgaggaggccggcggcacagagaggatggagatctctgctgagctgccccagaccccccagaggctggcctcctggtgggaccagcaggtggacttctacacagccttcctgcaccacctggcccagctggtgcctgagatctactttgctgagatggaccctgacctggagaagcaggaggagagcgtgcagatgagcatcttcacccccctggagtggtacctgtttggagaagatcctgacatctgcctggagaagctgaagcacagcggggccttccagctgtgtggccgggtcttcaagtctggagagaccacctacagctgccgggactgtgccatcgaccccacctgtgtgctgtgcatggactgcttccaggacagcgtgcacaagaaccaccgctacaagatgcacaccagcactggaggcggcttctgtgactgtggggacacagaggcctggaagacaggccccttctgtgtgaaccacgagcccggccgggccggcaccatcaaggagaacagccgctgccccctgaatgaggaggtgattgtgcaggccaggaagatcttccccagcgtcatcaagtatgtggtggagatgaccatctgggaggaggagaaggagctgcccccagagctgcagatccgggagaagaatgaaagatactactgtgtgctcttcaatgatgagcaccacagctatgaccacgtgatctacagcctgcagagggccctggactgtgagctggccgaggcccagctgcacaccacagccatcgacaaggagggccggcgggctgtgaaggccggggcctatgctgcctgccaggaggccaaggaggacatcaagagccacagtgaaaatgtgtcccagcaccccctgcacgtggaggtgctgcacagcgagatcatggcccaccagaagtttgccctgcggctgggctcctggatgaacaagatcatgagctacagcagtgacttccggcagatcttctgccaggcctgcctgcgggaggagccagacagcgagaacccctgcctgatcagccggctgatgctgtgggatgccaagctgtacaagggggccaggaagatcctgcacgagctgatcttcagcagcttcttcatggagatggagtacaagaagctgtttgccatggagtttgtgaagtactacaagcagctgcagaaggagtacatcagtgatgaccatgacaggagcatcagcatcacagccctgtctgtgcagatgttcaccgtgcccaccctggcccggcacctgattgaggagcagaatgtcatcagcgtcatcacagagaccctgctggaggtgctgcctgagtacctggacaggaacaacaagttcaacttccagggctacagccaggacaagctgggccgggtgtatgctgtgatctgtgacctgaagtacatcctgatcagcaagcccaccatctggacagagcggctgaggatgcagttcctggagggcttccgctccttcctgaagatcctgacctgcatgcagggcatggaggagatccggcggcaggtgggccagcacatcgaggtggaccctgactgggaggccgccatcgccatccagatgcagctgaagaacatcctgctgatgttccaggagtggtgtgcctgtgatgaggagctgctgctggtggcctacaaggagtgccacaaggctgtgatgcgctgcagcaccagcttcatcagcagcagcaagacagtggtgcagagctgtggccacagcctggagaccaagagctacagagtgtctgaggacctggtgtccatccacctgcccctgagcaggaccctggccggcctgcacgtgcggctgagccggctgggcgctgtgtcccggctgcacgagtttgtgtcctttgaggacttccaggtggaggtgctggtggagtaccccctgcgctgcctggtgctggtggcccaggtggtggccgagatgtggaggagaaatggcctgagcctcatcagccaggtgttctactaccaggatgtgaagtgccgggaggagatgtatgacaaggacatcatcatgctgcagattggagccagcctgatggaccccaacaagttcctgctgctggtgctgcagagatatgagctggccgaggccttcaacaagaccatcagcaccaaggaccaggacctgatcaagcagtacaacaccctcatcgaggagatgctgcaggtgctgatctacatcgtgggggagagatatgtgcctggggtgggcaatgtgaccaaggaggaggtgaccatgagggagatcatccacctgctgtgcatcgagcccatgccccacagcgccatcgccaagaacctgcctgaaaatgaaaataatgagaccggcctggagaatgtcatcaacaaggtggccaccttcaagaagccaggagtgtctggccacggcgtgtatgagctgaaggatgagagcctgaaggacttcaacatgtacttctaccactacagcaagacccagcacagcaaggccgagcacatgcagaagaagaggaggaagcaggagaacaaggatgaggccctgcccccacctcctcctcctgagttctgcccagccttcagcaaggtgatcaacctgctgaactgtgacatcatgatgtacatcctgaggacagtgtttgagcgggccatcgacacagacagcaacctgtggacagagggcatgctgcagatggccttccacatcctggccctgggcctgctggaggagaagcagcagctgcagaaggcccctgaggaggaggtgacctttgacttctaccacaaggccagccggctgggcagcagcgccatgaacatccagatgctgctggagaagctgaagggcatcccccagctggagggccagaaggacatgatcacctggatcctgcagatgtttgacacagtgaagaggctgcgggagaagagctgcctgattgtggccaccaccagcggcagcgagagcatcaagaatgatgagatcacccatgacaaggagaaggccgagaggaagaggaaggccgaggccgcccggctgcaccggcagaagatcatggcccagatgtctgccctgcagaagaacttcatcgagacccacaagctgatgtatgacaacaccagcgagatgcctgggaaggaggacagcatcatggaggaggagagcaccccagctgtgtctgactacagccgcatcgccctgggccccaagaggggccccagcgtgacagagaaggaggtgctgacctgcatcctgtgccaggaggagcaggaggtgaagattgagaacaatgccatggtgctgagcgcctgtgtgcagaagagcacagccctgacccagcaccggggcaagcccatcgagctgtctggagaggccctggaccccctcttcatggaccctgacctggcctacggcacctacacaggcagctgtggccacgtgatgcatgctgtgtgctggcagaagtactttgaggccgtgcagctgagcagccagcagaggatccacgtggacctgtttgacctggagagcggggagtacctgtgccccctgtgcaagagcctgtgcaacacagtcatccccatcatccccctgcagccccagaagatcaacagtgaaaatgctgatgccctggcccagctgctgaccctggcccgctggatccagacagtgctggcccgcatcagcggctacaacatcagacatgccaagggggagaaccccatccccatcttcttcaaccagggcatgggagacagcaccctggagttccacagcatcctgagctttggagtggagagcagcatcaagtacagcaacagcatcaaggagatggtgatcctgtttgccaccaccatctaccgcatcggcctgaaggtgcccccagatgagcgggacccccgggtgcccatgctgacctggagcacctgtgccttcaccatccaggccatcgagaacctgctgggagatgagggcaagcccctgtttggagccctgcagaaccggcagcacaacggcctgaaggccctgatgcagtttgctgtggcccagaggatcacctgcccccaggtgctgatccagaagcacctggtgcggctgctgtctgtggtgctgcccaacatcaagtctgaggacaccccctgcctgctgagcattgacctcttccacgtgctggtgggcgctgtgctggccttccccagcctgtactgggatgatcctgtggacctgcagcccagctctgtgagcagcagctacaaccacctgtacctgttccacctgatcaccatggcccacatgctgcagatcctgctgactgtggacaccggcctgcccctggcccaggtgcaggaggacagcgaggaggcccacagcgccagcagcttctttgctgagatcagccagtacaccagcggcagcatcggctgtgacatccctggctggtacctgtgggtgtccctgaagaatggcatcaccccctacctgcgctgtgccgccctcttcttccactacctgctgggcgtgaccccacctgaggagctgcacaccaacagcgctgagggggagtacagcgccctgtgcagctacctgagcctgcccaccaacctcttcctgctcttccaggagtactgggacacagtgcggcccctgctgcagcgctggtgtgccgaccctgccctgctgaactgcctgaagcagaagaacacagtggtgcgctaccccaggaagaggaacagcctgattgagctgcctgatgactacagctgcctgctgaaccaggccagccacttccgctgccccaggtctgcagatgatgagaggaagcaccctgtgctgtgcctcttctgtggggccatcctgtgcagccagaacatctgctgccaggagatcgtgaatggagaggaggtgggcgcctgcatcttccacgccctgcactgtggggccggcgtgtgcatcttcctgaagatccgggagtgccgggtggtgctggtggagggcaaggcccggggctgtgcctacccagccccctacctggatgaatatggagaaacagaccccggcctgaagaggggcaaccccctgcacctgagccgggagcgctacaggaagctgcacctggtgtggcagcagcactgcatcatcgaggagatcgcccggagccaggagaccaaccagatgctgtttggcttcaactggcagctgctgtag

SEQ ID NO: 175131 - DNA, 2412 bp, Artificial Sequence
  Description of Artificial Sequence: Synthetic coding sequence
atggctgatgaggaggccggcggcacagagaggatggagatctctgctgagctgccccagaccccccagaggctggcctcctggtgggaccagcaggtggacttctacacagccttcctgcaccacctggcccagctggtgcctgagatctactttgctgagatggaccctgacctggagaagcaggaggagagcgtgcagatgagcatcttcacccccctggagtggtacctgtttggagaagatcctgacatctgcctggagaagctgaagcacagcggggccttccagctgtgtggccgggtcttcaagtctggagagaccacctacagctgccgggactgtgccatcgaccccacctgtgtgctgtgcatggactgcttccaggacagcgtgcacaagaaccaccgctacaagatgcacaccagcactggaggcggcttctgtgactgtggggacacagaggcctggaagacaggccccttctgtgtgaaccacgagcccggccgggccggcaccatcaaggagaacagccgctgccccctgaatgaggaggtgattgtgcaggccaggaagatcttccccagcgtcatcaagtatgtggtggagatgaccatctgggaggaggagaaggagctgcccccagagctgcagatccgggagaagaatgaaagatactactgtgtgctcttcaatgatgagcaccacagctatgaccacgtgatctacagcctgcagagggccctggactgtgagctggccgaggcccagctgcacaccacagccatcgacaaggagggccggcgggctgtgaaggccggggcctatgctgcctgccaggaggccaaggaggacatcaagagccacagtgaaaatgtgtcccagcaccccctgcacgtggaggtgctgcacagcgagatcatggcccaccagaagtttgccctgcggctgggctcctggatgaacaagatcatgagctacagcagtgacttccggcagatcttctgccaggcctgcctgcgggaggagccagacagcgagaacccctgcctgatcagccggctgatgctgtgggatgccaagctgtacaagggggccaggaagatcctgcacgagctgatcttcagcagcttcttcatggagatggagtacaagaagctgtttgccatggagtttgtgaagtactacaagcagctgcagaaggagtacatcagtgatgaccatgacaggagcatcagcatcacagccctgtctgtgcagatgttcaccgtgcccaccctggcccggcacctgattgaggagcagaatgtcatcagcgtcatcacagagaccctgctggaggtgctgcctgagtacctggacaggaacaacaagttcaacttccagggctacagccaggacaagctgggccgggtgtatgctgtgatctgtgacctgaagtacatcctgatcagcaagcccaccatctggacagagcggctgaggatgcagttcctggagggcttccgctccttcctgaagatcctgacctgcatgcagggcatggaggagatccggcggcaggtgggccagcacatcgaggtggaccctgactgggaggccgccatcgccatccagatgcagctgaagaacatcctgctgatgttccaggagtggtgtgcctgtgatgaggagctgctgctggtggcctacaaggagtgccacaaggctgtgatgcgctgcagcaccagcttcatcagcagcagcaagacagtggtgcagagctgtggccacagcctggagaccaagagctacagagtgtctgaggacctggtgtccatccacctgcccctgagcaggaccctggccggcctgcacgtgcggctgagccggctgggcgctgtgtcccggctgcacgagtttgtgtcctttgaggacttccaggtggaggtgctggtggagtaccccctgcgctgcctggtgctggtggcccaggtggtggccgagatgtggaggagaaatggcctgagcctcatcagccaggtgttctactaccaggatgtgaagtgccgggaggagatgtatgacaaggacatcatcatgctgcagattggagccagcctgatggaccccaacaagttcctgctgctggtgctgcagagatatgagctggccgaggccttcaacaagaccatcagcaccaaggaccaggacctgatcaagcagtacaacaccctcatcgaggagatgctgcaggtgctgatctacatcgtgggggagagatatgtgcctggggtgggcaatgtgaccaaggaggaggtgaccatgagggagatcatccacctgctgtgcatcgagcccatgccccacagcgccatcgccaagaacctgcctgaaaatgagacccgctgcatccggccctggagcctgtag

SEQ ID NO: 175132 - DNA, 3042 bp, Artificial Sequence
  Description of Artificial Sequence: Synthetic coding sequence
atggctgatgaggaggccggcggcacagagaggatggagatctctgctgagctgccccagaccccccagaggctggcctcctggtgggaccagcaggtggacttctacacagccttcctgcaccacctggcccagctggtgcctgagatctactttgctgagatggaccctgacctggagaagcaggaggagagcgtgcagatgagcatcttcacccccctggagtggtacctgtttggagaagatcctgacatctgcctggagaagctgaagcacagcggggccttccagctgtgtggccgggtcttcaagtctggagagaccacctacagctgccgggactgtgccatcgaccccacctgtgtgctgtgcatggactgcttccaggacagcgtgcacaagaaccaccgctacaagatgcacaccagcactggaggcggcttctgtgactgtggggacacagaggcctggaagacaggccccttctgtgtgaaccacgagcccggccgggccggcaccatcaaggagaacagccgctgccccctgaatgaggaggtgattgtgcaggccaggaagatcttccccagcgtcatcaagtatgtggtggagatgaccatctgggaggaggagaaggagctgcccccagagctgcagatccgggagaagaatgaaagatactactgtgtgctcttcaatgatgagcaccacagctatgaccacgtgatctacagcctgcagagggccctggactgtgagctggccgaggcccagctgcacaccacagccatcgacaaggagggccggcgggctgtgaaggccggggcctatgctgcctgccaggaggccaaggaggacatcaagagccacagtgaaaatgtgtcccagcaccccctgcacgtggaggtgctgcacagcgagatcatggcccaccagaagtttgccctgcggctgggctcctggatgaacaagatcatgagctacagcagtgacttccggcagatcttctgccaggcctgcctgcgggaggagccagacagcgagaacccctgcctgatcagccggctgatgctgtgggatgccaagctgtacaagggggccaggaagatcctgcacgagctgatcttcagcagcttcttcatggagatggagtacaagaagctgtttgccatggagtttgtgaagtactacaagcagctgcagaaggagtacatcagtgatgaccatgacaggagcatcagcatcacagccctgtctgtgcagatgttcaccgtgcccaccctggcccggcacctgattgaggagcagaatgtcatcagcgtcatcacagagaccctgctggaggtgctgcctgagtacctggacaggaacaacaagttcaacttccagggctacagccaggacaagctgggccgggtgtatgctgtgatctgtgacctgaagtacatcctgatcagcaagcccaccatctggacagagcggctgaggatgcagttcctggagggcttccgctccttcctgaagatcctgacctgcatgcagggcatggaggagatccggcggcaggtgggccagcacatcgaggtggaccctgactgggaggccgccatcgccatccagatgcagctgaagaacatcctgctgatgttccaggagtggtgtgcctgtgatgaggagctgctgctggtggcctacaaggagtgccacaaggctgtgatgcgctgcagcaccagcttcatcagcagcagcaagacagtggtgcagagctgtggccacagcctggagaccaagagctacagagtgtctgaggacctggtgtccatccacctgcccctgagcaggaccctggccggcctgcacgtgcggctgagccggctgggcgctgtgtcccggctgcacgagtttgtgtcctttgaggacttccaggtggaggtgctggtggagtaccccctgcgctgcctggtgctggtggcccaggtggtggccgagatgtggaggagaaatggcctgagcctcatcagccaggtgttctactaccaggatgtgaagtgccgggaggagatgtatgacaaggacatcatcatgctgcagattggagccagcctgatggaccccaacaagttcctgctgctggtgctgcagagatatgagctggccgaggccttcaacaagaccatcagcaccaaggaccaggacctgatcaagcagtacaacaccctcatcgaggagatgctgcaggtgctgatctacatcgtgggggagagatatgtgcctggggtgggcaatgtgaccaaggaggaggtgaccatgagggagatcatccacctgctgtgcatcgagcccatgccccacagcgccatcgccaagaacctgcctgaaaatgaaaataatgagaccggcctggagaatgtcatcaacaaggtggccaccttcaagaagccaggagtgtctggccacggcgtgtatgagctgaaggatgagagcctgaaggacttcaacatgtacttctaccactacagcaagacccagcacagcaaggccgagcacatgcagaagaagaggaggaagcaggagaacaaggatgaggccctgcccccacctcctcctcctgagttctgcccagccttcagcaaggtgatcaacctgctgaactgtgacatcatgatgtacatcctgaggacagtgtttgagcgggccatcgacacagacagcaacctgtggacagagggcatgctgcagatggccttccacatcctggccctgggcctgctggaggagaagcagcagctgcagaaggcccctgaggaggaggtgacctttgacttctaccacaaggccagccggctgggcagcagcgccatgaacatccagatgctgctggagaagctgaagggcatcccccagctggagggccagaaggacatgatcacctggatcctgcagatgtttgacacagtgaagaggctgcgggagaagagctgcctgattgtggccaccaccagcggcagcgagagcatcaagaatgatgagatcctgcaccactag

SEQ ID NO: 175133 - DNA, 1728 bp, Artificial Sequence
  Description of Artificial Sequence: Synthetic coding sequence
atgtatgccggcaacatccccatctacaagacagagagccgcagcagaaatgagcagggcatggaccccatcacccggcaggtgggccagcacatcgagatggagcctgagtgggaggccgccttcaccctgcagatgaagctgacccacgtgatctccatgatgcaggactggtgtgccagtgatgagaaggtgctgattgaggcctacaagaagtgcctggccgtgctgatgcagtgccacggcggctacacagatggagagcagcccatcaccctgagcatctgtggccacagcgtggagaccatccgctactgtgtgtcccaggagaaggtgtccatccacctgcctgtgtcccggctgctggccggcctgcacgtgctgctgagcaagtctgaggtggcctacaagtttcctgagctgctgcccctgtctgagctgagcccccccatgctgattgagcaccccctgcgctgcctggtgctgtgtgcccaggtgcacgccggcatgtggaggagaaatggcttcagcctggtgaaccagatctactactaccacaacgtgaagtgcagaagagagatgtttgacaaggatgtggtgatgctgcagacaggagtgtccatgatggaccccaaccacttcctgatgatcatgctgagcagatttgagctgtaccagatcttcagcaccccagactatggcaagcgcttcagcagcgagatcacccacaaggatgtggtgcagcagaacaacaccctcatcgaggagatgctgtacctgatcatcatgctggtgggggagcgcttcagccctggggtgggccaggtgaatgccacagatgagatcaagcgggagatcatccaccagctgagcatcaagcccatggcccacagcgagctggtgaagagcctgcctgaagatgagaacaaggagaccggcatggagagcgtcatcgaggccgtggcccacttcaagaagccaggcctgaccggccggggcatgtatgagctgaagccagaatgtgccaaggagttcaacctgtacttctaccacttcagcagagctgagcagagcaaggccgaggaggcccagaggaagctgaagaggcagaaccgggaggacacagccctgcccccacctgtgctgccccccttctgccccctgtttgccagcctggtgaacatcctgcagagtgatgtgatgctgtgcatcatgggcaccatcctgcagtgggccgtggagcacaacggctacgcctggagcgagagcatgctgcagagggtgctgcacctgattggcatggccctgcaggaggagaagcagcacctggagaatgtgacagaggagcacgtggtgaccttcaccttcacccagaagatcagcaagccaggagaggcccccaagaacagccccagcatcctggccatgctggagaccctgcagaatgccccctacctggaggtgcacaaggacatgatccgctggatcctgaagaccttcaatgctgtgaagaagatgagggagagcagccccaccagccctgtggccgagacagagggcaccatcatggaggagcacaacttccgggtgcagggcaccaagaccaagctgcggggccgggagaagcagaggctgcctgactgtgccgagaagaggtcctggctgcgctgcctgaagtgcagcggcatcctgctgatgaagaccaagaacagcttcagccgccactag

SEQ ID NO: 175134 - DNA, 5268 bp, Artificial Sequence
  Description of Artificial Sequence: Synthetic coding sequence
atggccagcgagctggagcctgaggtgcaggccatcgacaggagcctgctggagtgcagcgctgaggagattgctgggaagtggctgcaggccacagacctgacccgggaggtgtaccagcacctggcccactacgtgcccaagatctactgccggggccccaaccccttcccccagaaggaggacatgctggcccagcacgtgctgctgggccccatggagtggtacctgtgtggggaggaccctgccttcggcttccccaagctggagcaggccaacaagcccagccacctgtgtggccgggtcttcaaggtgggggagcccacctacagctgccgggactgtgctgtggaccccacctgtgtgctgtgcatggagtgcttcctgggcagcatccaccgggaccaccgctacaggatgaccaccagcggcggcggcggcttctgtgactgtggggacacagaggcctggaaggagggcccctactgccagaagcatgagctgaacaccagcgagattgaggaggaggaggaccccctggtgcacctgtctgaagatgtgattgcccggacctacaacatctttgccatcaccttccgctatgctgtggagatcctgacctgggagaaggagagcgagctgcctgctgacctggagatggtggagaagagtgacacctactactgcatgctgttcaatgatgaggtgcacacctatgagcaggtgatctacaccctgcagaaggctgtgaactgcacccagaaggaggccatcggctttgccaccaccgtggacagagatggaagaagatctgtgcgctacggggacttccagtactgtgagcaggccaagtctgtgattgtgaggaacaccagccggcagaccaagcccctgaaggtgcaggtgatgcacagcagcatcgtggcccaccagaactttggcctgaagctgctgtcctggctgggcagcatcatcggctacagtgatggcctgcggcgcatcctgtgccaggtgggcctgcaggagggcccagatggagagaacagcagcctggtggaccggctgatgctgagtgacagcaagctgtggaagggggcccggtctgtgtaccaccagctgttcatgagcagcctgctgatggacctgaagtacaagaagctgtttgctgtgcgctttgccaagaactaccagcagctgcagagggacttcatggaggatgaccacgagagagctgtgtctgtgacagccctgtctgtgcagttcttcaccgcccccaccctggccaggatgctgatcacagaggagaacctgatgagcatcatcatcaagaccttcatggaccacctgcggcacagagatgcccagggccgcttccagtttgagcgctacacagccctgcaggccttcaagttccggcgggtgcagagcctcatcctggacctgaagtatgtgctgatcagcaagcccacagagtggagcgatgagctgcggcagaagttcctggagggctttgatgccttcctggagctgctgaagtgcatgcagggcatggaccccatcacccggcaggtgggccagcacatcgagatggagcctgagtgggaggccgccttcaccctgcagatgaagctgacccacgtgatctccatgatgcaggactggtgtgccagtgatgagaaggtgctgattgaggcctacaagaagtgcctggccgtgctgatgcagtgccacggcggctacacagatggagagcagcccatcaccctgagcatctgtggccacagcgtggagaccatccgctactgtgtgtcccaggagaaggtgtccatccacctgcctgtgtcccggctgctggccggcctgcacgtgctgctgagcaagtctgaggtggcctacaagtttcctgagctgctgcccctgtctgagctgagcccccccatgctgattgagcaccccctgcgctgcctggtgctgtgtgcccaggtgcacgccggcatgtggaggagaaatggcttcagcctggtgaaccagatctactactaccacaacgtgaagtgcagaagagagatgtttgacaaggatgtggtgatgctgcagacaggagtgtccatgatggaccccaaccacttcctgatgatcatgctgagcagatttgagctgtaccagatcttcagcaccccagactatggcaagcgcttcagcagcgagatcacccacaaggatgtggtgcagcagaacaacaccctcatcgaggagatgctgtacctgatcatcatgctggtgggggagcgcttcagccctggggtgggccaggtgaatgccacagatgagatcaagcgggagatcatccaccagctgagcatcaagcccatggcccacagcgagctggtgaagagcctgcctgaagatgagaacaaggagaccggcatggagagcgtcatcgaggccgtggcccacttcaagaagccaggcctgaccggccggggcatgtatgagctgaagccagaatgtgccaaggagttcaacctgtacttctaccacttcagcagagctgagcagagcaaggccgaggaggcccagaggaagctgaagaggcagaaccgggaggacacagccctgcccccacctgtgctgccccccttctgccccctgtttgccagcctggtgaacatcctgcagagtgatgtgatgctgtgcatcatgggcaccatcctgcagtgggccgtggagcacaacggctacgcctggagcgagagcatgctgcagagggtgctgcacctgattggcatggccctgcaggaggagaagcagcacctggagaatgtgacagaggagcacgtggtgaccttcaccttcacccagaagatcagcaagccaggagaggcccccaagaacagccccagcatcctggccatgctggagaccctgcagaatgccccctacctggaggtgcacaaggacatgatccgctggatcctgaagaccttcaatgctgtgaagaagatgagggagagcagccccaccagccctgtggccgagacagagggcaccatcatggaggagagcagccgggacaaggacaaggccgagaggaagaggaaggccgagatcgcccggctgcggcgggagaagatcatggcccagatgtctgagatgcagaggcacttcattgatgagaacaaggagctgttccagcagaccctggagctggatgccagcaccagcgctgtgctggaccacagccctgtggccagtgacatgaccctgacagccctgggccctgcccagacccaggtgcctgagcagaggcagtttgtgacctgcatcctgtgccaggaggagcaggaggtgaaggtggagagccgggccatggtgctggccgcctttgtgcagaggagcacagtgctgagcaagaacagaagcaagttcatccaggaccctgagaagtatgaccccctcttcatgcacccagacctgagctgtggcacccacaccagcagctgtggccacatcatgcacgcccactgctggcagcgctactttgattctgtgcaggccaaggagcagaggcggcagcagaggctgcggctgcacaccagctatgatgtggagaatggagagttcctgtgccccctgtgtgagtgcctgagcaacacagtcatccccctgctgctgccccccaggaacatcttcaacaaccggctgaacttcagtgaccagcccaacctgacccagtggatccgcaccatcagccagcagatcaaggccctgcagttcctgaggaaggaggagagcacccccaacaatgccagcaccaagaacagtgaaaatgtggatgagctgcagctgcctgagggcttccggccagacttccggcccaagatcccctacagcgagagcatcaaggagatgctgaccaccttcggcacagccacctacaaggtgggcctgaaggtgcaccccaatgaggaggacccccgggtgcccatcatgtgctggggcagctgtgcctacaccatccagagcattgagcgcatcctgagtgatgaggacaagcccctgtttggccccctgccctgccgcctggatgactgcctgcggagcctgaccaggtttgctgctgcccactggacagtggcctctgtgtctgtggtgcagggccacttctgcaagctgtttgccagcctggtgcccaatgacagccatgaggagctgccctgcatcctggacatcgacatgttccacctgctggtgggcctggtgctggccttccctgccctgcagtgccaggacttcagcggcatcagcctgggcactggagacctgcacatcttccacctggtgaccatggcccacatcatccagatcctgctgaccagctgcacagaggagaatggcatggaccaggagaaccccccctgtgaggaggagagcgctgtgctggccctgtacaagaccctgcaccagtacacaggcagcgccctgaaggagatccccagcggctggcacctgtggaggtctgtgcgggccggcatcatgcccttcctgaagtgcagcgccctcttcttccactacctgaatggagtgcccagccccccagacatccaggtgcccggcaccagccactttgagcacctgtgcagctacctgagcctgcccaacaacctgatctgcctcttccaggagaacagcgagatcatgaacagcctgattgaatcctggtgcaggaacagcgaggtgaagcgctacctggagggggagagagatgccatccgctacccccgggagagcaacaagctgatcaacctgcctgaggactacagcagcctcatcaaccaggccagcaacttcagctgccccaagagcggcggggacaagagccgggcccccaccctgtgcctggtgtgtggcagcctgctgtgcagccagagctactgctgccagacagagctggagggggaggatgtgggcgcctgcacagcccacacctacagctgtggcagcggcgtgggcatcttcctgcgggtgcgggagtgccaggtgctcttcctggccggcaagaccaagggctgcttctacagccccccctacctggatgattatggagaaacagaccagggcctgcggcggggcaaccccctgcacctgtgcaaggagcgcttcaagaagatccagaagctgtggcaccagcacagcgtgacagaggagattggacatgcccaggaggccaaccagaccctggtgggcatcgactggcagcacctgtag

SEQ ID NO: 175135 - DNA, 5268 bp, Artificial Sequence
  Description of Artificial Sequence: Synthetic coding sequence
atggccagcgagctggagcctgaggtgcaggccatcgacaggagcctgctggagtgcagcgctgaggagattgctgggaagtggctgcaggccacagacctgacccgggaggtgtaccagcacctggcccactacgtgcccaagatctactgccggggccccaaccccttcccccagaaggaggacatgctggcccagcacgtgctgctgggccccatggagtggtacctgtgtggggaggaccctgccttcggcttccccaagctggagcaggccaacaagcccagccacctgtgtggccgggtcttcaaggtgggggagcccacctacagctgccgggactgtgctgtggaccccacctgtgtgctgtgcatggagtgcttcctgggcagcatccaccgggaccaccgctacaggatgaccaccagcggcggcggcggcttctgtgactgtggggacacagaggcctggaaggagggcccctactgccagaagcatgagctgaacaccagcgagattgaggaggaggaggaccccctggtgcacctgtctgaagatgtgattgcccggacctacaacatctttgccatcaccttccgctatgctgtggagatcctgacctgggagaaggagagcgagctgcctgctgacctggagatggtggagaagagtgacacctactactgcatgctgttcaatgatgaggtgcacacctatgagcaggtgatctacaccctgcagaaggctgtgaactgcacccagaaggaggccatcggctttgccaccaccgtggacagagatggaagaagatctgtgcgctacggggacttccagtactgtgagcaggccaagtctgtgattgtgaggaacaccagccggcagaccaagcccctgaaggtgcaggtgatgcacagcagcatcgtggcccaccagaactttggcctgaagctgctgtcctggctgggcagcatcatcggctacagtgatggcctgcggcgcatcctgtgccaggtgggcctgcaggagggcccagatggagagaacagcagcctggtggaccggctgatgctgagtgacagcaagctgtggaagggggcccggtctgtgtaccaccagctgttcatgagcagcctgctgatggacctgaagtacaagaagctgtttgctgtgcgctttgccaagaactatgaaaggctgcagagcgactatgtgacagatgaccatgaccgggagttctctgtggccgacctgtctgtgcagatcttcaccgtgcccagcctggccaggatgctgatcacagaggagaacctgatgagcatcatcatcaagaccttcatggaccacctgcggcacagagatgcccagggccgcttccagtttgagcgctacacagccctgcaggccttcaagttccggcgggtgcagagcctcatcctggacctgaagtatgtgctgatcagcaagcccacagagtggagcgatgagctgcggcagaagttcctggagggctttgatgccttcctggagctgctgaagtgcatgcagggcatggaccccatcacccggcaggtgggccagcacatcgagatggagcctgagtgggaggccgccttcaccctgcagatgaagctgacccacgtgatctccatgatgcaggactggtgtgccagtgatgagaaggtgctgattgaggcctacaagaagtgcctggccgtgctgatgcagtgccacggcggctacacagatggagagcagcccatcaccctgagcatctgtggccacagcgtggagaccatccgctactgtgtgtcccaggagaaggtgtccatccacctgcctgtgtcccggctgctggccggcctgcacgtgctgctgagcaagtctgaggtggcctacaagtttcctgagctgctgcccctgtctgagctgagcccccccatgctgattgagcaccccctgcgctgcctggtgctgtgtgcccaggtgcacgccggcatgtggaggagaaatggcttcagcctggtgaaccagatctactactaccacaacgtgaagtgcagaagagagatgtttgacaaggatgtggtgatgctgcagacaggagtgtccatgatggaccccaaccacttcctgatgatcatgctgagcagatttgagctgtaccagatcttcagcaccccagactatggcaagcgcttcagcagcgagatcacccacaaggatgtggtgcagcagaacaacaccctcatcgaggagatgctgtacctgatcatcatgctggtgggggagcgcttcagccctggggtgggccaggtgaatgccacagatgagatcaagcgggagatcatccaccagctgagcatcaagcccatggcccacagcgagctggtgaagagcctgcctgaagatgagaacaaggagaccggcatggagagcgtcatcgaggccgtggcccacttcaagaagccaggcctgaccggccggggcatgtatgagctgaagccagaatgtgccaaggagttcaacctgtacttctaccacttcagcagagctgagcagagcaaggccgaggaggcccagaggaagctgaagaggcagaaccgggaggacacagccctgcccccacctgtgctgccccccttctgccccctgtttgccagcctggtgaacatcctgcagagtgatgtgatgctgtgcatcatgggcaccatcctgcagtgggccgtggagcacaacggctacgcctggagcgagagcatgctgcagagggtgctgcacctgattggcatggccctgcaggaggagaagcagcacctggagaatgtgacagaggagcacgtggtgaccttcaccttcacccagaagatcagcaagccaggagaggcccccaagaacagccccagcatcctggccatgctggagaccctgcagaatgccccctacctggaggtgcacaaggacatgatccgctggatcctgaagaccttcaatgctgtgaagaagatgagggagagcagccccaccagccctgtggccgagacagagggcaccatcatggaggagagcagccgggacaaggacaaggccgagaggaagaggaaggccgagatcgcccggctgcggcgggagaagatcatggcccagatgtctgagatgcagaggcacttcattgatgagaacaaggagctgttccagcagaccctggagctggatgccagcaccagcgctgtgctggaccacagccctgtggccagtgacatgaccctgacagccctgggccctgcccagacccaggtgcctgagcagaggcagtttgtgacctgcatcctgtgccaggaggagcaggaggtgaaggtggagagccgggccatggtgctggccgcctttgtgcagaggagcacagtgctgagcaagaacagaagcaagttcatccaggaccctgagaagtatgaccccctcttcatgcacccagacctgagctgtggcacccacaccagcagctgtggccacatcatgcacgcccactgctggcagcgctactttgattctgtgcaggccaaggagcagaggcggcagcagaggctgcggctgcacaccagctatgatgtggagaatggagagttcctgtgccccctgtgtgagtgcctgagcaacacagtcatccccctgctgctgccccccaggaacatcttcaacaaccggctgaacttcagtgaccagcccaacctgacccagtggatccgcaccatcagccagcagatcaaggccctgcagttcctgaggaaggaggagagcacccccaacaatgccagcaccaagaacagtgaaaatgtggatgagctgcagctgcctgagggcttccggccagacttccggcccaagatcccctacagcgagagcatcaaggagatgctgaccaccttcggcacagccacctacaaggtgggcctgaaggtgcaccccaatgaggaggacccccgggtgcccatcatgtgctggggcagctgtgcctacaccatccagagcattgagcgcatcctgagtgatgaggacaagcccctgtttggccccctgccctgccgcctggatgactgcctgcggagcctgaccaggtttgctgctgcccactggacagtggcctctgtgtctgtggtgcagggccacttctgcaagctgtttgccagcctggtgcccaatgacagccatgaggagctgccctgcatcctggacatcgacatgttccacctgctggtgggcctggtgctggccttccctgccctgcagtgccaggacttcagcggcatcagcctgggcactggagacctgcacatcttccacctggtgaccatggcccacatcatccagatcctgctgaccagctgcacagaggagaatggcatggaccaggagaaccccccctgtgaggaggagagcgctgtgctggccctgtacaagaccctgcaccagtacacaggcagcgccctgaaggagatccccagcggctggcacctgtggaggtctgtgcgggccggcatcatgcccttcctgaagtgcagcgccctcttcttccactacctgaatggagtgcccagccccccagacatccaggtgcccggcaccagccactttgagcacctgtgcagctacctgagcctgcccaacaacctgatctgcctcttccaggagaacagcgagatcatgaacagcctgattgaatcctggtgcaggaacagcgaggtgaagcgctacctggagggggagagagatgccatccgctacccccgggagagcaacaagctgatcaacctgcctgaggactacagcagcctcatcaaccaggccagcaacttcagctgccccaagagcggcggggacaagagccgggcccccaccctgtgcctggtgtgtggcagcctgctgtgcagccagagctactgctgccagacagagctggagggggaggatgtgggcgcctgcacagcccacacctacagctgtggcagcggcgtgggcatcttcctgcgggtgcgggagtgccaggtgctcttcctggccggcaagaccaagggctgcttctacagccccccctacctggatgattatggagaaacagaccagggcctgcggcggggcaaccccctgcacctgtgcaaggagcgcttcaagaagatccagaagctgtggcaccagcacagcgtgacagaggagattggacatgcccaggaggccaaccagaccctggtgggcatcgactggcagcacctgtag

SEQ ID NO: 175136 - DNA, 1320 bp, Artificial Sequence
  Description of Artificial Sequence: Synthetic coding sequence
atggccagcgagctggagcctgaggtgcaggccatcgacaggagcctgctggagtgcagcgctgaggagattgctgggaagtggctgcaggccacagacctgacccgggaggtgtaccagcacctggcccactacgtgcccaagatctactgccggggccccaaccccttcccccagaaggaggacatgctggcccagcacgtgctgctgggccccatggagtggtacctgtgtggggaggaccctgccttcggcttccccaagctggagcaggccaacaagcccagccacctgtgtggccgggtcttcaaggtgggggagcccacctacagctgccgggactgtgctgtggaccccacctgtgtgctgtgcatggagtgcttcctgggcagcatccaccgggaccaccgctacaggatgaccaccagcggcggcggcggcttctgtgactgtggggacacagaggcctggaaggagggcccctactgccagaagcatgagctgaacaccagcgagattgaggaggaggaggaccccctggtgcacctgtctgaagatgtgattgcccggacctacaacatctttgccatcaccttccgctatgctgtggagatcctgacctgggagaaggagagcgagctgcctgctgacctggagatggtggagaagagtgacacctactactgcatgctgttcaatgatgaggtgcacacctatgagcaggtgatctacaccctgcagaaggctgtgaactgcacccagaaggaggccatcggctttgccaccaccgtggacagagatggaagaagatctgtgcgctacggggacttccagtactgtgagcaggccaagtctgtgattgtgaggaacaccagccggcagaccaagcccctgaaggtgcaggtgatgcacagcagcatcgtggcccaccagaactttggcctgaagctgctgtcctggctgggcagcatcatcggctacagtgatggcctgcggcgcatcctgtgccaggtgggcctgcaggagggcccagatggagagaacagcagcctggtggaccggctgatgctgagtgacagcaagctgtggaagggggcccggtctgtgtaccaccagctgttcatgagcagcctgctgatggacctgaagtacaagaagctgtttgctgtgcgctttgccaagaactatgaaaggctgcagagcgactatgtgacagatgaccatgaccgggagttctctgtggccgacctgtctgtgcagatcttcaccgtgcccagcctcttcagcatctctgctggccgcagcggcagccccctgtag

SEQ ID NO: 175137 - DNA, 5667 bp, Artificial Sequence
  Description of Artificial Sequence: Synthetic coding sequence
atggctgctgctgctgctgctgctgtgggcggccagcagcccagccagcctgagctgcctgcccctggcctggccctggacaaggccgccacagctgcccacctgaaggccgccctgagcaggccagacaacagagctggagctgaggagctgcaggccctgctggagcgggtgctgtctgctgagcggcccctggccgctgctgctggaggagaagatgctgctgctgctgggggcggcggcggccctggagctgctgaggaggaggccctggagtggtgcaagtgcctgctggccggcggcggcggctatgatgagttctgtgccgctgtgcgggcctatgaccctgctgccctgtgtggcctggtgtggacagccaactttgtggcctaccgctgcaggacctgtggcatcagcccctgcatgagcctgtgtgccgagtgcttccaccagggcgaccacactggacatgacttcaacatgttccgcagccaggccggcggggcctgtgactgtggggacagcaatgtgatgagggagagcggcttctgcaagaggcaccagatcaagagcagcagcaacatcccctgtgtgcccaaggacctgctgatgatgtctgaatttgtgctgccccgcttcatcttctgcctgatccagtacctgcgggagggctacaatgaacctgctgctgatggccccagcgagaaggacctgaacaaggtgctgcagctgctggagccccagatctccttcctggaggacctgaccaagatgggcggggccatgaggtctgtgctgacccaggtgctgaccaaccagcagaactacaaggacctgaccagcggcctgggagaaaatgcctgtgtgaagaagagccatgagaagtacctgattgccctgaagagcagcggcctgacctacccagaggacaagctggtgtatggagtgcaggagcccagcgctggcaccagcagcctggccgtgcagggcttcatcggggccaccggcaccctgggccaggtggacagcagtgatgaagatgaccaggacggcagccagggcctgggcaagaggaagagggtgaagctgagcagcggcaccaaggaccagagcatcatggatgtgctgaagcacaagagcttcctggaggagctgctcttctggaccatcaagtatgagttcccccagaagatggtgaccttcctgctgaacatgctgcctgaccaggagtacaaggtggccttcaccaagacctttgtgcagcactacgccttcatcatgaagaccctgaagaagagccatgaaagtgacaccatgagcaacagaattgtgcacatctctgtgcagctgttcagcaatgaggagctggcccggcaggtgacagaggagtgccagctgctggacatcatggtgacagtgctgctgtacatgatggagagctgcctgatcaagtctgagctgcaggatgaggagaacagcctgcacgtggtggtgaactgtggggaggccctgctgaagaacaacacctactggcccctggtgtctgacttcatcaacatcctgagccaccagagcgtggccaagcgcttcctggaggaccacggcctgctggtgacctggatgaactttgtgtccttcttccagggcatgaacctgaacaagcgggagctgaatgagcacgtggagtttgagagccagacctactatgctgcctttgctgctgagctggaggcctgtgcccagcccatgtggggcctgctgagccactgcaaggtgcgggagacccaggagtacaccagaaatgtggtgcgctactgcctggaggccctgcaggactggtttgatgccatcaactttgtggatgagcccgcccccaaccaggtgaccttccacctgcccctgcaccgctactatgccatgttcctgagcaaggctgtgaagtgccaggagctggacctggacagcgtgctgcctgaccaggagatgctgatgaagctgatgatccaccccctgcagatccaggccagcctggccgagatccacagcaacatgtgggtgagaaatggcctgcagatcaagggccaggccatgacctacgtgcagagccacttctgcaacagcatgattgatcctgacatctacctgctgcaggtgtgtgccagccggctggaccctgactacttcatcagctctgtgtttgagcgcttcaaggtggtggacctgctgaccatggccagccagcaccagaacacagtgctggatgctgagcacgagaggtccatgctggagggcgccctgaccttcctggtgatcctgctgagcctgcggctgcacctgggcatgtctgatgatgagatcctgcgggcagagatggtggcccagctgtgcatgaatgacaggacccacagcagcctgctggacctgatccctgagaaccccaaccccaagagcggcatcatccctggcagctacagctttgagagcgtgctgtctgctgtggccgacttcaaggcccctgtgtttgagcccggcggctccatgcagcagggcatgtacacccccaaggccgaggtgtgggaccaggagtttgatcctgtgatggtgatcctgaggacagtgtacagaagagatgtgcagagcgccatggaccgctacacagccttcctgaagcagagcggcaagtttcctggcaacccctggccaccctacaagaagaggaccagcctgcaccccagctacaagggcctgatgaggctgctgcactgcaagaccctgcacatcgtgctcttcaccctgctgtacaagatcctgatggaccaccagaacctgtctgagcacgtgctgtgcatggtgctgtacctgattgagctgggcctggagaacagcgctgaggaggagagtgatgaggaggcctctgtgggcggccctgagcgctgccacgacagctggttccctggcagcaacctggtgagcaacatgaggcacttcatcaactacgtgcgggtgcgggtgcctgagacagcccctgaggtgaagagggacagccctgccagcaccagcagtgacaacctgggcagcctgcagaacagcggcacagcccaggtgttcagcctggtggccgagaggaggaagaagttccaggagatcatcaacagaagcagcagcgaggccaaccaggtggtgcggcccaagaccagcagcaagtggagcgcccctggcagcgccccccagctgaccacagccatcctggagatcaaggagagcatcctgagcctgctgatcaagctgcaccacaagctgagcggcaagcagaacagctactacccaccctggctggatgacatcgagatcctgatccagcctgagatccccaagtacagccatggagatggcatcacagctgtggagcgcatcctgctgaaggccgccagccagagcaggatgaacaagaggatcatcgaggagatctgcaggaaggtgaccccacctgtgccccccaagaaggtgacagctgctgagaagaagaccctggacaaggaggagcggcggcagaaggcccgggagcggcagcagaagctgctggccgagtttgccagccggcagaagagcttcatggagacagccatggatgtggacagcccagaaaatgacatccccatggagatcaccacagctgagccccaggtgtctgaggccgtgtatgactgtgtgatctgtggccagagcggccccagcagtgaagatcggcccaccggcctggtggtgctgctgcaggccagctctgtgctgggccagtgccgggacaacgtggagcccaagaagctgcccatcagcgaggaggagcagatctacccctgggacacctgtgccgctgtgcatgatgtgcggctgagcctgctgcagcgctacttcaaggacagcagctgcctgctggccgtgtccatcggctgggagggcggcgtgtatgtgcagacctgtggccacaccctgcacatcgactgccacaagagctacatggagagcctgagaaatgaccaggtgctgcagggcttctctgtggacaagggggagttcacctgccccctgtgccggcagtttgccaacagcgtgctgccctgctacccaggcagcaatgtggagaacaacccctggcagaggcccagcaacaagagcatccaggacctgatcaaggaggtggaggagctgcagggccggcctggggccttccccagcgagaccaacctgagcaaggagatggagagcgtgatgaaggacatcaagaacaccacccagaagaagtacagagactacagcaagaccccaggcagcccagacaatgacttcctgttcatgtacagcgtggcccggaccaacctggagctggagctgatccacagaggaggcaacctgtgcagcggcggggccagcacagctgggaagaggagctgcctgaaccagctgttccacgtgctggccctgcacatgaggctgtacagcattgacagcgagtacaacccctggaggaagctgacccagctggaggagatgaacccccagctgggctatgaggagcagcagcctgaggtgcccatcctgtaccatgatgtgaccagcctgctgctgatccagatcctgatgatgccccagcccctgaggaaggaccacttcacctgcatcgtgaaggtgctcttcaccctgctgtacacccaggccctggccgccctgtctgtgaagtgcagcgaggaggacagaagtgcctggaagcacgccggggccctgaagaagagcacctgtgatgctgagaagagctatgaggtgctgctgagctttgtgatcagcgagctgttcaagggcaagctgtaccacgaggagggcacccaggagtgtgccatggtgaaccccatcgcctggagccctgagagcatggagaagtgcctgcaggacttctgcctgcccttcctgcgcatcaccagcctgctgcagcaccacctgtttggagaggacctgcccagctgccaggaggaggaggagttctctgtgctggccagctgcctgggcctgctgcccaccttctaccagacagagcaccccttcatcagcgccagctgcctggactggcctgtgcctgcctttgacatcatcacccagtggtgctttgagatcaagagcttcacagaaagacatgctgagcagggcaaggccctgctgatccaggagagcaagtggaagctgccccacctgctgcagctgcctgagaactacaacaccatcttccagtactaccacaggaagacctgcagcgtgtgcaccaaggtgcccaaggaccctgctgtgtgcctggtgtgtggcacctttgtgtgcctgaagggcctgtgctgcaagcagcagagctactgtgaatgtgtgctgcacagccagaactgtggggccggcaccggcatcttcctgctgatcaatgccagcgtcatcatcatcatccggggccaccgcttctgcctgtggggctctgtgtacctggatgcccacggggaggaggaccgggacctgcggcggggcaagcccctgtacatctgcaaggagcgctacaaggtgctggagcagcagtggatcagccacacctttgaccacatcaacaagcgctggggcccccactacaacggcctgtag

SEQ ID NO: 175138 - DNA, 2130 bp, Artificial Sequence
  Description of Artificial Sequence: Synthetic coding sequence
atgattgccagcaagcagaggcagttcacagaggtgttccgcatcatgagcagcaccttcagccagagccgcttcctgtatgctgctgtggtgacagacagcccagaaaatgacatccccatggagatcaccacagctgagccccaggtgtctgaggccgtgtatgactgtgtgatctgtggccagagcggccccagcagcgaggaccggcccaccggcctggtggtgctgctgcaggccagctctgtgctgggccagtgccgggacaacgtggagcccaagaagctgcccatcagcgaggaggagcagatctacccctgggacacctgtgccgctgtgcatgatgtgcggctgagcctgctgcagcgctacttcaaggacagcagctgcctgctggccgtgtccatcggctgggagggcggcgtgtatgtgcagacctgtggccacaccctgcacatcgactgccacaagagctacatggagagcctgagaaatgaccaggtgctgcagggcttctctgtggacaagggggagttcacctgccccctgtgccggcagtttgccaacagcgtgctgccctgctacccaggcagcaatgtggagaacaacccctggcagaggcccagcaacaagagcatccaggacctgatcaaggaggtggaggagctgcagggccggcctggggccttccccagcgagaccaacctgagcaaggagatggagagcgtgatgaaggacatcaagaacaccacccagaagaagtacagagactacagcaagaccccaggcagcccagacaatgacttcctgttcatgtacagcgtggcccggaccaacctggagctggagctgatccaccggggcggcaacctgtgcagcggcggggccagcacagctgggaagaggagctgcctgaaccagctgttccacgtgctggccctgcacatgaggctgtacagcattgattctgagtacaacccctggaggaagctgacccagctggaggagatgaacccccagctgggctatgaggagcagcagcctgaggtgcccatcctgtaccatgatgtgaccagcctgctgctgatccagatcctgatgatgccccagcccctgaggaaggaccacttcacctgcatcgtgaaggtgctcttcaccctgctgtacacccaggccctggccgccctgtctgtgaagtgcagtgaagaagatagaagtgcctggaagcatgctggggccctgaagaagagcacctgtgatgctgagaagagctatgaggtgctgctgagctttgtgatcagcgagctgttcaagggcaagctgtaccacgaggagggcacccaggagtgtgccatggtgaaccccatcgcctggagccctgagagcatggagaagtgcctgcaggacttctgcctgcccttcctgcgcatcaccagcctgctgcagcaccacctgtttggagaggacctgcccagctgccaggaggaggaggagttctctgtgctggccagctgcctgggcctgctgcccaccttctaccagacagagcaccccttcatcagcgccagctgcctggactggcctgtgcctgcctttgacatcatcacccagtggtgctttgagatcaagagcttcacagaaagacatgctgagcagggcaaggccctgctgatccaggagagcaagtggaagctgccccacctgctgcagctgcctgagaactacaacaccatcttccagtactaccacaggaagacctgcagcgtgtgcaccaaggtgcccaaggaccctgctgtgtgcctggtgtgtggcacctttgtgtgcctgaagggcctgtgctgcaagcagcagagctactgtgaatgtgtgctgcacagccagaactgtggggccggcaccggcatcttcctgctgatcaatgccagcgtcatcatcatcatccggggccaccgcttctgcctgtggggctctgtgtacctggatgcccatggagaggaggaccgggacctgcggcggggcaagcccctgtacatctgcaaggagcgctacaaggtgctggagcagcagtggatcagccacacctttgaccacatcaacaagcgctggggcccccactacaacggcctgtag

SEQ ID NO: 175139 - DNA, 5667 bp, Artificial Sequence; identical to SEQ ID NO: 175137
  Description of Artificial Sequence: Synthetic coding sequence

SEQ ID NO: 175140 - DNA, 5754 bp, Artificial Sequence
  Description of Artificial Sequence: Synthetic coding sequence
atggctgctgctgctgctgctgctgtgggcggccagcagcccagccagcctgagctgcctgcccctggcctggccctggacaaggccgccacagctgcccacctgaaggccgccctgagcaggccagacaacagagctggagctgaggagctgcaggccctgctggagcgggtgctgtctgctgagcggcccctggccgctgctgctggaggagaagatgctgctgctgctgggggcggcggcggccctggagctgctgaggaggaggccctggagtggtgcaagtgcctgctggccggcggcggcggctatgatgagttctgtgccgctgtgcgggcctatgaccctgctgccctgtgtggcctggtgtggacagccaactttgtggcctaccgctgcaggacctgtggcatcagcccctgcatgagcctgtgtgccgagtgcttccaccagggcgaccacactggacatgacttcaacatgttccgcagccaggccggcggggcctgtgactgtggggacagcaatgtgatgagggagagcggcttctgcaagaggcaccagatcaagagcagcagcaacatcccctgtgtgcccaaggacctgctgatgatgtctgaatttgtgctgccccgcttcatcttctgcctgatccagtacctgcgggagggctacaatgaacctgctgctgatggccccagcgagaaggacctgaacaaggtgctgcagctgctggagccccagatctccttcctggaggacctgaccaagatgggcggggccatgaggtctgtgctgacccaggtgctgaccaaccagcagaactacaaggacctgaccagcggcctgggagaaaatgcctgtgtgaagaagagccatgagaagtacctgattgccctgaagagcagcggcctgacctacccagaggacaagctggtgtatggagtgcaggagcccagcgctggcaccagcagcctggccgtgcagggcttcatcggggccaccggcaccctgggccaggtggacagcagtgatgaagatgaccaggacggcagccagggcctgggcaagaggaagagggtgaagctgagcagcggcaccaaggaccagagcatcatggatgtgctgaagcacaagagcttcctggaggagctgctcttctggaccatcaagtatgagttcccccagaagatggtgaccttcctgctgaacatgctgcctgaccaggagtacaaggtggccttcaccaagacctttgtgcagcactacgccttcatcatgaagaccctgaagaagagccatgaaagtgacaccatgagcaacagaattgtgcacatctctgtgcagctgttcagcaatgaggagctggcccggcaggtgacagaggagtgccagctgctggacatcatggtgacagtgctgctgtacatgatggagagctgcctgatcaagtctgagctgcaggatgaggagaacagcctgcacgtggtggtgaactgtggggaggccctgctgaagaacaacacctactggcccctggtgtctgacttcatcaacatcctgagccaccagagcgtggccaagcgcttcctggaggaccacggcctgctggtgacctggatgaactttgtgtccttcttccagggcatgaacctgaacaagcgggagctgaatgagcacgtggagtttgagagccagacctactatgctgcctttgctgctgagctggaggcctgtgcccagcccatgtggggcctgctgagccactgcaaggtgcgggagacccaggagtacaccagaaatgtggtgcgctactgcctggaggccctgcaggactggtttgatgccatcaactttgtggatgagcccgcccccaaccaggtgaccttccacctgcccctgcaccgctactatgccatgttcctgagcaaggctgtgaagtgccaggagctggacctggacagcgtgctgcctgaccaggagatgctgatgaagctgatgatccaccccctgcagatccaggccagcctggccgagatccacagcaacatgtgggtgagaaatggcctgcagatcaagggccaggccatgacctacgtgcagagccacttctgcaacagcatgattgatcctgacatctacctgctgcaggtgtgtgccagccggctggaccctgactacttcatcagctctgtgtttgagcgcttcaaggtggtggacctgctgaccatggccagccagcaccagaacacagtgctggatgctgagcacgagaggtccatgctggagggcgccctgaccttcctggtgatcctgctgagcctgcggctgcacctgggcatgtctgatgatgagatcctgcgggcagagatggtggcccagctgtgcatgaatgacaggacccacagcagcctgctggacctgatccctgagaaccccaaccccaagagcggcatcatccctggcagctacagctttgagagcgtgctgtctgctgtggccgacttcaaggcccctgtgtttgagcccggcggctccatgcagcagggcatgtacacccccaaggccgaggtgtgggaccaggagtttgatcctgtgatggtgatcctgaggacagtgtacagaagagatgtgcagagcgccatggaccgctacacagccttcctgaagcagagcggcaagtttcctggcaacccctggccaccctacaagaagaggaccagcctgcaccccagctacaagggcctgatgaggctgctgcactgcaagaccctgcacatcgtgctcttcaccctgctgtacaagatcctgatggaccaccagaacctgtctgagcacgtgctgtgcatggtgctgtacctgattgagctgggcctggagaacagcgctgaggaggagagtgatgaggaggcctctgtgggcggccctgagcgctgccacgacagctggttccctggcagcaacctggtgagcaacatgaggcacttcatcaactacgtgcgggtgcgggtgcctgagacagcccctgaggtgaagagggacagccctgccagcaccagcagtgacaacctgggcagcctgcagaacagcggcacagcccaggtgttcagcctggtggccgagaggaggaagaagttccaggagatcatcaacagaagcagcagcgaggccaaccaggtggtgcggcccaagaccagcagcaagtggagcgcccctggcagcgccccccagctgaccacagccatcctggagatcaaggagagcatcctgagcctgctgatcaagctgcaccacaagctgagcggcaagcagaacagctactacccaccctggctggatgacatcgagatcctgatccagcctgagatccccaagtacagccatggagatggcatcacagctgtggagcgcatcctgctgaaggccgccagccagagcaggatgaacaagaggatcatcgaggagatctgcaggaaggtgaccccacctgtgccccccaagaaggtgacagctgctgagaagaagaccctggacaaggaggagcggcggcagaaggcccgggagcggcagcagaagctgctggccgagtttgccagccggcagaagagcttcatggagacagccatggatgtggacagcccagaaaatgacatccccatggagatcaccacagctgagccccaggtgtctgaggccgtgtatgactgtgtgatctgtggccagagcggccccagcagtgaagatcggcccaccggcctggtggtgctgctgcaggccagctctgtgctgggccagtgccgggacaacgtggagcccaagaagctgcccatcagcgaggaggagcagatctacccctgggacacctgtgccgctgtgcatgatgtgcggctgagcctgctgcagcgctacttcaaggacagcagctgcctgctggccgtgtccatcggctgggagggcggcgtgtatgtgcagacctgtggccacaccctgcacatcgactgccacaagagctacatggagagcctgagaaatgaccaggtgctgcagggcttctctgtggacaagggggagttcacctgccccctgtgccggcagtttgccaacagcgtgctgccctgctacccaggcagcaatgtggagaacaacccctggcagaggcccagcaacaagagcatccaggacctgatcaaggaggtggaggagctgcagggccggcctggggccttccccagcgagaccaacctgagcaaggagatggagagcgtgatgaaggacatcaagaacaccacccagaagaagtacagagactacagcaagaccccaggcagcccagacaatgacttcctgttcatgtacagcgtggcccggaccaacctggagctggagctgatccacagaggaggcaacctgtgcagcggcggggccagcacagctgggaagaggagctgcctgaacttctgcttcatcatcttccccttcaccaagtctgagatcatcctgtgccagtacaggaagagccatgacaaggtgtaccccaagtaccagctgttccacgtgctggccctgcacatgaggctgtacagcattgattctgagtacaacccctggaggaagctgacccagctggaggagatgaacccccagctgggctatgaggagcagcagcctgaggtgcccatcctgtaccatgatgtgaccagcctgctgctgatccagatcctgatgatgccccagcccctgaggaaggaccacttcacctgcatcgtgaaggtgctcttcaccctgctgtacacccaggccctggccgccctgtctgtgaagtgcagtgaagaagatagaagtgcctggaagcatgctggggccctgaagaagagcacctgtgatgctgagaagagctatgaggtgctgctgagctttgtgatcagcgagctgttcaagggcaagctgtaccacgaggagggcacccaggagtgtgccatggtgaaccccatcgcctggagccctgagagcatggagaagtgcctgcaggacttctgcctgcccttcctgcgcatcaccagcctgctgcagcaccacctgtttggagaggacctgcccagctgccaggaggaggaggagttctctgtgctggccagctgcctgggcctgctgcccaccttctaccagacagagcaccccttcatcagcgccagctgcctggactggcctgtgcctgcctttgacatcatcacccagtggtgctttgagatcaagagcttcacagaaagacatgctgagcagggcaaggccctgctgatccaggagagcaagtggaagctgccccacctgctgcagctgcctgagaactacaacaccatcttccagtactaccacaggaagacctgcagcgtgtgcaccaaggtgcccaaggaccctgctgtgtgcctggtgtgtggcacctttgtgtgcctgaagggcctgtgctgcaagcagcagagctactgtgaatgtgtgctgcacagccagaactgtggggccggcaccggcatcttcctgctgatcaatgccagcgtcatcatcatcatccggggccaccgcttctgcctgtggggctctgtgtacctggatgcccatggagaggaggaccgggacctgcggcggggcaagcccctgtacatctgcaaggagcgctacaaggtgctggagcagcagtggatcagccacacctttgaccacatcaacaagcgctggggcccccactacaacggcctgtag

SEQ ID NO: 175141 - DNA, 1278 bp, Artificial Sequence
  Description of Artificial Sequence: Synthetic coding sequence
atggccggggctgagggcgccgccggccggcagagcgagctggagcctgtggtgtccctggtggatgtgctggaggaggatgaggagctggagaatgaggcctgtgctgtgctgggcggcagtgacagcgagaagtgcagctacagccagggctctgtgaagaggcaggccctgtatgcctgcagcacctgcaccccagagggggaggagcccgccggcatctgcctggcctgcagctatgaatgtcatggcagccacaagctgtttgagctgtacaccaagaggaacttccgctgtgactgtggcaacagcaagttcaagaacctggagtgcaagctgctgcctgacaaggccaaggtgaacagcggcaacaagtacaatgacaacttcttcggcctgtactgcatctgcaagaggccctacccagaccctgaagatgagatcccagatgagatgatccagtgtgtggtgtgtgaggactggttccacggccgccacctgggcgccatccccccagagagcggggacttccaggagatggtgtgccaggcctgcatgaagcgctgcagcttcctgtgggcctatgctgcccagctggccgtgaccaagatcagcacagaagatgatggcctggtgagaaatattgatggcatcggggaccaggaggtgatcaagccagaaaatggagagcaccaggacagcaccctgaaggaggatgtgcctgagcagggcaaggatgatgtgcgggaggtgaaggtggagcagaacagcgagccctgtgccggcagcagcagcgagagtgacctgcagacagtgttcaagaatgaaagcctgaatgctgagagcaagagcggctgcaagctgcaggagctgaaggccaagcagctgatcaagaaggacacagccacctactggcccctgaactggaggagcaagctgtgcacctgccaggactgcatgaagatgtatggagacctggatgtgctcttcctgacagatgaatatgacacagtgctggcctatgagaacaagggcaagatcgcccaggccacagacagaagtgaccccctgatggacaccctgagctccatgaacagagtgcagcaggtggagctgatctgtgagtacaatgacctgaagacagagctgaaggactacctgaagagatttgctgatgagggcaccgtggtgaagcgggaggacatccagcagttctttgaggagttccagagcaagaagagaagaagagtggatggcatgcagtactactgcagctag

SEQ ID NO: 175142 - DNA, 1050 bp, Artificial Sequence
  Description of Artificial Sequence: Synthetic coding sequence
atgaggcgggccctgtcctgggccgccgccacccccaggtctgcccccaccctgaggaacttccgctgtgactgtggcaacagcaagttcaagaacctggagtgcaagctgctgcctgacaaggccaaggtgaacagcggcaacaagtacaatgacaacttcttcggcctgtactgcatctgcaagaggccctacccagaccctgaagatgagatcccagatgagatgatccagtgtgtggtgtgtgaggactggttccacggccgccacctgggcgccatccccccagagagcggggacttccaggagatggtgtgccaggcctgcatgaagcgctgcagcttcctgtgggcctatgctgcccagctggccgtgaccaagatcagcacagaagatgatggcctggtgagaaatattgatggcatcggggaccaggaggtgatcaagccagaaaatggagagcaccaggacagcaccctgaaggaggatgtgcctgagcagggcaaggatgatgtgcgggaggtgaaggtggagcagaacagcgagccctgtgccggcagcagcagcgagagtgacctgcagacagtgttcaagaatgaaagcctgaatgctgagagcaagagcggctgcaagctgcaggagctgaaggccaagcagctgatcaagaaggacacagccacctactggcccctgaactggaggagcaagctgtgcacctgccaggactgcatgaagatgtatggagacctggatgtgctcttcctgacagatgaatatgacacagtgctggcctatgagaacaagggcaagatcgcccaggccacagacagaagtgaccccctgatggacaccctgagctccatgaacagagtgcagcaggtggagctgatctgtgagtacaatgacctgaagacagagctgaaggactacctgaagagatttgctgatgagggcaccgtggtgaagcgggaggacatccagcagttctttgaggagttccagagcaagaagagaagaagagtggatggcatgcagtactactgcagctag

SEQ ID NO: 175143 - DNA, 1083 bp, Artificial Sequence
  Description of Artificial Sequence: Synthetic coding sequence
atgaggcgggccctgtcctgggccgccgccacccccaggtctgcccccaccctgaggaacttccgctgtgactgtggcaacagcaagttcaagaacctggagtgcaagctgctgcctgacaaggccaaggtgaacagcggcaacaagtacaatgacaacttcttcggcctgtactgcatctgcaagaggccctacccagaccctgaagatgagatcccagatgagatgatccagtgtgtggtgtgtgaggactggttccacggccgccacctgggcgccatccccccagagagcggggacttccaggagatggtgtgccaggcctgcatgaagcgctgcagcttcctgtgggcctatgctgcccagctggccgtgaccaagatcagcacagaagatgatggcctggtgagaaatattgatggcatcggggaccaggaggtgatcaagccagaaaatggagagcaccaggacagcaccctgaaggaggatgtgcctgagcagggcaaggatgatgtgcgggaggtgaaggtggagcagaacagcgagccctgtgccggcagcagcagcgagagtgacctgcagacagtgttcaagaatgaaagcctgaatgctgagagcaagagcggctgcaagctgcaggagctgaaggccaagcagctgatcaagaaggacacagccacctactggcccctgaactggaggagcaagctgtgcacctgccaggactgcatgaagatgtatggagacctggatgtgctcttcctgacagatgaatatgacacagtgctggcctatgagaacaagggcaagatcgcccaggccacagacagaagtgaccccctgatggacaccctgagctccatgaacagagtgcagcaggtggagctgatctgtgagtacaatgacctgaagacagagctgaaggactacctgaagagatttgctgatgagggcaccgtggtgaagcgggaggacatccagcagttctttgaggagttccagaagaaggagaagaagagcggctgggatgctgtgctgctgcagctggagtggagcatgaagctgagccacagcagccagtag

SEQ ID NO: 175144 - DNA, 2121 bp, Artificial Sequence
  Description of Artificial Sequence: Synthetic coding sequence
atggccagccctgctgacagctgcatccagttcaccaggcatgccagtgatgtgctgctgaacctgaaccggctgcggagccgggacatcctgacagatgtggtgattgtggtgtcccgggagcagttccgggcccacaagacagtgctgatggcctgcagcggcctcttctacagcatcttcacagaccagctgaagtgcaacctgagcgtcatcaacctggaccctgagatcaaccctgagggcttctgcatcctgctggacttcatgtacaccagccggctgaacctgcgggagggcaacatcatggctgtgatggccacagccatgtacctgcagatggagcacgtggtggacacctgcaggaagttcatcaaggccagcgaggccgagatggtgtctgccatcaagccaccccgggaggagttcctgaacagcaggatgctgatgccccaggacatcatggcctaccggggccgggaggtggtggagaacaacctgcccctgcggagcgcccctggctgtgagagccgggcctttgcccccagcctgtacagcggcctgagcaccccaccagccagctacagcatgtacagccacctgcctgtgagcagcctgctcttcagtgatgaggagttcagagatgtgaggatgcctgtggccaaccccttccccaaggagcgggccctgccctgtgacagcgcccggcctgtgcctggagagtacagccggcccaccctggaggtgagccccaacgtgtgccacagcaacatctacagccccaaggagaccatccctgaggaggcccggagtgacatgcactacagcgtggccgagggcctgaagccagctgcccccagcgccagaaatgccccctacttcccctgtgacaaggccagcaaggaggaggagcggcccagcagtgaagatgagatcgccctgcactttgagcccccaaatgcccccctgaacaggaagggcctggtgagcccccagagcccccagaagagtgactgccagcccaacagccccacagagagctgcagcagcaagaatgcctgcatcctgcaggccagcggcagccccccagccaagagccccacagaccccaaggcctgcaactggaagaagtacaagttcatcgtgctgaacagcctgaaccagaatgccaagccagagggccctgagcaggccgagctgggccgcctgagcccccgggcctacacagcccccccagcctgccagccccccatggagcctgagaacctggacctgcagagccccaccaagctgagcgccagcggggaggacagcaccatcccccaggccagccggctgaacaacatcgtgaacagatccatgacaggcagccccaggagcagcagcgagagccacagccccctgtacatgcacccccccaagtgcaccagctgtggcagccagagcccccagcacgccgagatgtgcctgcacacagctggccccaccttccctgaggagatgggagagacccagagcgagtacagcgacagcagctgtgaaaatggagccttcttctgcaatgaatgtgactgccgcttcagcgaggaggccagcctgaagaggcacaccctgcagacccacagcgacaagccctacaagtgtgaccgctgccaggccagcttccgctacaagggcaacctggccagccacaagacagtgcacactggagagaagccctaccgctgcaacatctgtggggcccagttcaacagacctgccaacctgaagacccacacccgcatccacagcggggagaagccctacaagtgtgagacctgtggggccaggtttgtgcaggtggcccacctgcgggcccacgtgctgatccacactggagagaagccctacccctgtgagatctgtggcacccgcttccgccacctgcagaccctgaagagccacctgcgcatccacactggagagaagccctaccactgtgagaagtgcaacctgcacttccgccacaagagccagctgcggctgcacctgcggcagaagcatggagccatcaccaacaccaaggtgcagtacagagtgtctgccacagacctgcccccagagctgcccaaggcctgctag

SEQ ID NO: 175145 - DNA, 2619 bp, Artificial Sequence
  Description of Artificial Sequence: Synthetic coding sequence
atgaggtctgtgtgccacaggtctggagagccccagagtgatgacatcgaggccagcaggatgaagagagctgctgccaagcacctgattgaaagatactaccaccagctgacagagggctgtggaaatgaggcctgcaccaatgagttctgtgccagctgccccaccttcctgaggatggacaacaatgctgctgccatcaaggccctggagctgtacaagatcaatgccaagctgtgtgacccccaccccagcaagaagggggccagcagcgcctacctggagaacagcaagggggcccccaacaacagctgcagcgagatcaagatgaacaagaagggggccagaattgacttcaaggatgtgacctacctgacagaggagaaggtgtatgagatcctggagctgtgccgggagcgggaggactacagccccctcatccgggtcatcggccgggtcttcagcagcgctgaggccctggtgcagagcttcaggaaggtgaagcagcacaccaaggaggagctgaagagcctgcaggccaaggatgaggacaaggatgaagatgagaaggagaaggccgcctgcagcgctgctgccatggaggaggacagcgaggccagcagcagcagaattggagacagcagccagggcgacaacaacctgcagaagctgggcccagatgatgtgtctgtggacattgatgccatcagaagagtgtacacccggctgctgagcaatgagaagattgaaacagccttcctgaatgccctggtgtacctgagccccaacgtggagtgtgacctgacctaccacaacgtgtacagccgggaccccaactacctgaacctcttcatcatcgtgatggagaacagaaacctgcacagccctgagtacctggagatggccctgcccctcttctgcaaggccatgagcaagctgcccctggccgcccagggcaagctgatccggctgtggagcaagtacaatgctgaccagatccggaggatgatggagaccttccagcagctgatcacctacaaggtgatcagcaatgagttcaacagcaggaacctggtgaatgatgatgatgccatcgtggccgccagcaagtgcctgaagatggtgtactatgccaacgtggtgggcggggaggtggacaccaaccacaatgaggaggatgatgaggagcccatccctgagagcagcgagctgaccctgcaggagctgctgggggaggagaggaggaacaagaagggcccccgggtggaccccctggagacagagctgggcgtgaagaccctggactgcaggaagcccctcatcccctttgaggagttcatcaatgagcccctgaatgaggtgctggagatggacaaggactacaccttcttcaaggtggagacagagaacaagttctccttcatgacctgccccttcatcctgaatgctgtgaccaagaacctgggcctgtactatgacaaccgcatccgcatgtacagcgagcggcgcatcaccgtgctgtacagcctggtgcagggccagcagctgaacccctacctgcggctgaaggtgagaagagaccacatcattgatgatgccctggtgcggctggagatgattgccatggagaacccagctgacctgaagaagcagctgtatgtggagtttgaaggagagcagggcgtggatgaaggaggagtgtccaaggagttcttccagctggtggtggaggagatcttcaacccagacatcggcatgttcacctatgatgagagcaccaagctgttctggttcaaccccagcagctttgaaacagagggccagttcaccctcatcggcatcgtgctgggcctggccatctacaacaactgcatcctggatgtgcacttccccatggtggtgtacaggaagctgatgggcaagaagggcaccttccgggacctgggggacagccaccctgtgctgtaccagagcctgaaggacctgctggagtatgagggcaatgtggaggatgacatgatgatcaccttccagatcagccagacagacctgtttggaaaccccatgatgtatgacctgaaggaaaatggagacaagatccccatcaccaatgaaaataggaaggagtttgtgaacctgtacagcgactacatcctgaacaagtctgtggagaagcagttcaaggccttcagaagaggcttccacatggtgaccaatgaaagccccctgaagtacctgttccggcctgaggagattgagctgctgatctgtggcagcaggaacctggacttccaggccctggaggagaccacagaatatgatggcggctacacccgggacagcgtgctgatccgggagttctgggagatcgtgcacagcttcacagatgagcagaagaggctcttcctgcagttcaccactggaacagaccgggcccctgtgggcggcctgggcaagctgaagatgatcatcgccaagaatggaccagacacagagcggctgcccaccagccacacctgcttcaacgtgctgctgctgcctgagtacagcagcaaggagaagctgaaggagcggctgctgaaggccatcacctacgccaagggcttcggcatgctgtag

SEQ ID NO: 175146 - DNA, 2628 bp, Artificial Sequence
  Description of Artificial Sequence: Synthetic coding sequence
atggagaagctgcaccagtgctactggaagtctggagagccccagagtgatgacatcgaggccagcaggatgaagagagctgctgccaagcacctgattgagcgctactaccaccagctgacagagggctgtggaaatgaggcctgcaccaatgagttctgtgccagctgccccaccttcctgaggatggacaacaatgctgctgccatcaaggccctggagctgtacaagatcaatgccaagctgtgtgacccccaccccagcaagaagggggccagcagcgcctacctggagaacagcaaaggagcccccaacaacagctgcagcgagatcaagatgaacaagaagggggccagaattgacttcaaggatgtgacctacctgacagaggagaaggtgtatgagatcctggagctgtgccgggagcgggaggactacagccccctcatccgggtgattggccgggtcttcagcagcgctgaggccctggtgcagagcttcaggaaggtgaagcagcacaccaaggaggagctgaagagcctgcaggccaaggatgaggacaaggatgaagatgagaaggagaaggccgcctgcagcgctgctgccatggaggaggacagcgaggccagcagcagccgcatcggggacagcagccagggcgacaacaacctgcagaagctgggcccagatgatgtgtctgtggacattgatgccatccggcgggtgtacacccggctgctgagcaatgagaagattgaaacagccttcctgaatgccctggtgtacctgagccccaacgtggagtgtgacctgacctaccacaacgtgtacagccgggaccccaactacctgaacctcttcatcatcgtgatggagaacagaaacctgcacagccctgagtacctggagatggccctgcccctcttctgcaaggccatgagcaagctgcccctggccgcccagggcaagctgatccggctgtggagcaagtacaatgctgaccagatccggaggatgatggagaccttccagcagctgatcacctacaaggtgatcagcaatgagttcaacagcaggaacctggtgaatgatgatgatgccatcgtggccgccagcaagtgcctgaagatggtgtactatgccaacgtggtgggcggggaggtggacaccaaccacaatgaagaagatgatgaggagcccatccctgagagcagcgagctgaccctgcaggagctgctgggggaggagaggaggaacaagaagggcccccgggtggaccccctggagacagagctgggcgtgaagaccctggactgcaggaagcccctcatcccctttgaggagttcatcaatgagcccctgaatgaggtgctggagatggacaaggactacaccttcttcaaggtggagacagagaacaagttctccttcatgacctgccccttcatcctgaatgctgtgaccaagaacctgggcctgtactatgacaaccgcatccgcatgtacagcgagcggcgcatcaccgtgctgtacagcctggtgcagggccagcagctgaacccctacctgcggctgaaggtgcggcgggaccacatcattgatgatgccctggtgcggctggagatgattgccatggagaacccagctgacctgaagaagcagctgtatgtggagtttgaaggagagcagggcgtggatgagggcggcgtgtccaaggagttcttccagctggtggtggaggagatcttcaacccagacatcggcatgttcacctatgatgagagcaccaagctgttctggttcaaccccagcagctttgaaacagagggccagttcaccctgattggaattgtgctgggcctggccatctacaacaactgcatcctggatgtgcacttccccatggtggtgtacaggaagctgatgggcaagaagggcaccttccgggacctgggggacagccaccctgtgctgtaccagagcctgaaggacctgctggagtatgagggcaatgtggaggatgacatgatgatcaccttccagatcagccagacagacctgtttggaaaccccatgatgtatgacctgaaggaaaatggagacaagatccccatcaccaatgaaaataggaaggagtttgtgaacctgtacagcgactacatcctgaacaagtctgtggagaagcagttcaaggccttccggcggggcttccacatggtgaccaatgaaagccccctgaagtacctgttccggcctgaggagattgagctgctgatctgtggcagcaggaacctggacttccaggccctggaggagaccacagaatatgatggcggctacacccgggacagcgtgctgatccgggagttctgggagatcgtgcacagcttcacagatgagcagaagaggctcttcctgcagttcaccaccggcacagaccgggcccctgtgggcggcctgggcaagctgaagatgatcatcgccaagaatggaccagacacagagcggctgcccaccagccacacctgcttcaacgtgctgctgctgcctgagtacagcagcaaggagaagctgaaggagcggctgctgaaggccatcacctacgccaagggcttcggcatgctgtag

SEQ ID NO: 175147 - DNA, 2559 bp, Artificial Sequence
  Description of Artificial Sequence: Synthetic coding sequence
atgaagagagctgctgccaagcacctgattgaaagatactaccaccagctgacagagggctgtggaaatgaggcctgcaccaatgagttctgtgccagctgccccaccttcctgaggatggacaacaatgctgctgccatcaaggccctggagctgtacaagatcaatgccaagctgtgtgacccccaccccagcaagaagggggccagcagcgcctacctggagaacagcaagggggcccccaacaacagctgcagcgagatcaagatgaacaagaagggggccagaattgacttcaaggatgtgacctacctgacagaggagaaggtgtatgagatcctggagctgtgccgggagcgggaggactacagccccctcatccgggtcatcggccgggtcttcagcagcgctgaggccctggtgcagagcttcaggaaggtgaagcagcacaccaaggaggagctgaagagcctgcaggccaaggatgaggacaaggatgaagatgagaaggagaaggccgcctgcagcgctgctgccatggaggaggacagcgaggccagcagcagcagaattggagacagcagccagggcgacaacaacctgcagaagctgggcccagatgatgtgtctgtggacattgatgccatcagaagagtgtacacccggctgctgagcaatgagaagattgaaacagccttcctgaatgccctggtgtacctgagccccaacgtggagtgtgacctgacctaccacaacgtgtacagccgggaccccaactacctgaacctcttcatcatcgtgatggagaacagaaacctgcacagccctgagtacctggagatggccctgcccctcttctgcaaggccatgagcaagctgcccctggccgcccagggcaagctgatccggctgtggagcaagtacaatgctgaccagatccggaggatgatggagaccttccagcagctgatcacctacaaggtgatcagcaatgagttcaacagcaggaacctggtgaatgatgatgatgccatcgtggccgccagcaagtgcctgaagatggtgtactatgccaacgtggtgggcggggaggtggacaccaaccacaatgaggaggatgatgaggagcccatccctgagagcagcgagctgaccctgcaggagctgctgggggaggagaggaggaacaagaagggcccccgggtggaccccctggagacagagctgggcgtgaagaccctggactgcaggaagcccctcatcccctttgaggagttcatcaatgagcccctgaatgaggtgctggagatggacaaggactacaccttcttcaaggtggagacagagaacaagttctccttcatgacctgccccttcatcctgaatgctgtgaccaagaacctgggcctgtactatgacaaccgcatccgcatgtacagcgagcggcgcatcaccgtgctgtacagcctggtgcagggccagcagctgaacccctacctgcggctgaaggtgagaagagaccacatcattgatgatgccctggtgcggctggagatgattgccatggagaacccagctgacctgaagaagcagctgtatgtggagtttgaaggagagcagggcgtggatgaaggaggagtgtccaaggagttcttccagctggtggtggaggagatcttcaacccagacatcggcatgttcacctatgatgagagcaccaagctgttctggttcaaccccagcagctttgaaacagagggccagttcaccctcatcggcatcgtgctgggcctggccatctacaacaactgcatcctggatgtgcacttccccatggtggtgtacaggaagctgatgggcaagaagggcaccttccgggacctgggggacagccaccctgtgctgtaccagagcctgaaggacctgctggagtatgagggcaatgtggaggatgacatgatgatcaccttccagatcagccagacagacctgtttggaaaccccatgatgtatgacctgaaggaaaatggagacaagatccccatcaccaatgaaaataggaaggagtttgtgaacctgtacagcgactacatcctgaacaagtctgtggagaagcagttcaaggccttcagaagaggcttccacatggtgaccaatgaaagccccctgaagtacctgttccggcctgaggagattgagctgctgatctgtggcagcaggaacctggacttccaggccctggaggagaccacagaatatgatggcggctacacccgggacagcgtgctgatccgggagttctgggagatcgtgcacagcttcacagatgagcagaagaggctcttcctgcagttcaccactggaacagaccgggcccctgtgggcggcctgggcaagctgaagatgatcatcgccaagaatggaccagacacagagcggctgcccaccagccacacctgcttcaacgtgctgctgctgcctgagtacagcagcaaggagaagctgaaggagcggctgctgaaggccatcacctacgccaagggcttcggcatgctgtag

SEQ ID NO: 175148 - DNA, 2559 bp, Artificial Sequence; identical to SEQ ID NO: 175147
  Description of Artificial Sequence: Synthetic coding sequence

SEQ ID NO: 175149 - DNA, 3252 bp, Artificial Sequence
  Description of Artificial Sequence: Synthetic coding sequence
atgttctcctttgaaggagacttcaagacccggcccaaggtgtccctgggcggggccagcaggaaggaggagaaggccagcctgctgcacaggacccaggaggagaggaggaagcgggaggaggagcggcggcggctgaagaatgccatcatcatccagagcttcatccggggctacagagacaggaagcagcagtacagcatccagaggtctgcctttgacagatgtgccaccctgagccagagcggcggggccttccccatcgccaacggccccaacctgaccctgctggtgcggcagctgctcttcttctacaagcagaatgaagacagcaagaggctcatctggctgtaccagaacctgatcaagcacagcagcctgtttgtgaagcagctggatggcagcgagcggctgacctgcctcttccagatcaagaggctgatgagcctgtgctgccgcctgctgcagaactgcaatgatgacagcctgaatgtggccctgcccatgaggatgctggaggtgttcagcagcgagaacacctacctgcctgtgctgcaggatgccagctatgtggtgtctgtgattgagcagatcctgcactacatgatccacaacggctactaccgcagcctgtacctgctgatcaacagcaagctgcccagcagcattgagtacagcgacctgagccgggtgcccatcgccaagatcctgctggagaatgtgctgaagcccctgcacttcacctacaacagctgcccagagggcgcccggcagcaggtgttcaccgccttcacagaggagttcctggccgcccccttcacagaccagatcttccacttcatcatcccagccctggctgatgcccagaccgtcttcccctatgagcccttcctgaatgccctgctgctgattgagagccgctgcagcaggaagagcggcggggccccctggctgttctactttgtgctgactgtgggggagaactacctgggcgccctgtctgaggagggcctgctggtgtacctgcgggtgctgcagaccttcctgagccagctgcctgtgtccccagccagcgccagctgccacgacagcgccagtgacagcgaggaggagagcgaggaggccgacaagcccagcagcccagaagatggccgcctgtctgtgtcctacatcacagaggagtgcctgaagaagctggacaccaagcagcagaccaacaccctgctgaacctggtgtggagggacagcgccagcgaggaggtgttcaccaccatggcctctgtgtgccacaccctgatggtgcagcacaggatgatggtgcccaaggtgcggctgctgtacagcctggccttcaatgcccgcttcctgcggcacctgtggttcctgatcagctccatgagcaccaggatgatcaccggctccatggtgcccctgctgcaggtgatcagccggggcagccccatgagctttgaggacagcagccgcatcatccccctcttctacctgttcagcagcctcttcagccacagcctcatcagcatccatgacaatgagttcttcggggaccccatcgaggtggtgggccagaggcagagctccatgatgcccttcaccctggaggagctgatcatgctgagccgctgcctgagagatgcctgcctgggcatcatcaagctggcctacccagagaccaagccagaggtgcgggaggagtacatcacagccttccagagcattggagtgaccaccagcagcgagatgcagcagtgcatccagatggagcagaagcgctggatccagctgttcaaggtgatcaccaacctggtgaagatgctgaagagccgggacaccaggaggaacttctgcccccccaaccactggctgtctgagcaggaggacatcaaggctgacaaggtgacccagctgtatgtgcctgccagcagacatgtgtggaggttccggaggatgggcagaattggccccctgcagagcaccctggatgtgggcctggagagcccccccctgtctgtgtctgaggagcggcagctggccgtgctgacagagctgccctttgtggtgccctttgaggagcgggtgaagatcttccagaggctcatctatgctgacaagcaggaggtgcagggagatggccccttcctggatggcatcaacgtgaccatcagaagaaactacatctatgaagatgcctatgacaagctgagcccagaaaatgaaccagacctgaagaagaggatccgggtgcacctgctgaatgcccacggcctggatgaagctggcattgatggcggcggcatcttccgggagttcctgaatgagctgctgaagagcggcttcaaccccaaccagggcttcttcaagaccaccaatgaaggcctgctgtaccccaacccagctgcccagatgctggtgggggacagctttgcccggcactactacttcctgggccgcatgctgggcaaggccctgtatgagaacatgctggtggagctgccctttgctggcttcttcctgagcaagctgctgggcaccagcgcagatgtggacatccaccacctggccagcctggaccctgaggtgtacaagaacctgctcttcctgaagagctatgaagatgatgtggaggagctgggcctgaacttcaccgtggtgaacaatgacctgggggaggcccaggtggtggagctgaagtttggaggcaaggacatccctgtgaccagcgccaacagaattgcctacatccacctggtggccgactaccgcctgaaccggcagatccggcagcactgcctggccttccggcagggcctggccaacgtggtgtccctggagtggctgaggatgtttgaccagcaggagatccaggtgctgatcagcggggcccaggtgcccatcagcctggaggacctgaagagcttcaccaactacagcggcggctacagcgctgaccaccctgtgatcaaggtgttctggagggtggtggagggcttcacagatgaggagaagaggaagctgctgaagtttgtgaccagctgcagcaggcctcccctgctgggcttcaaggagctgtacccagccttctgcatccacaatggaggcagtgacctggagcggctgcccacagccagcacctgcatgaacctgctgaagctgcctgagttctatgatgagaccctgctgcggagcaagctgctgtatgccattgaatgtgccgccggctttgagctgtcctag

SEQ ID NO: 175150 - DNA, 1215 bp, Artificial Sequence
  Description of Artificial Sequence: Synthetic coding sequence
atgttctcctttgaaggagacttcaagacccggcccaaggtgtccctgggcggggccagcaggaagtacagcatccagaggtctgcctttgacagatgtgccaccctgagccagagcggcggggccttccccatcgccaacggccccaacctgaccctgctggtgcggcagctgctcttcttctacaagcagaatgaagacagcaagaggctcatctggctgtaccagaacctgatcaagcacagcagcctgtttgtgaagcagctggatggcagcgagcggctgacctgcctcttccagatcaagaggctgatgagcctgtgctgccgcctgctgcagaactgcaatgatgacagcctgaatgtggccctgcccatgaggatgctggaggtgttcagcagcgagaacacctacctgcctgtgctgcaggatgccagctatgtggtgtctgtcatcgagcagatcctgcactacatgatccacaacggctactaccgcagcctgtacctgctgatcaacagcaagctgcccagcagcattgagtacagcgacctgagccgggtgcccatcgccaagatcctgctggagaatgtgctgaagcccctgcacttcacctacaacagctgcccagagggcgcccggcagcaggtgttcaccgccttcacagaggagttcctggccgcccccttcacagaccagatcttccacttcatcatcccagccctggctgatgcccagacagtgttcccctatgagcccttcctgaatgccctgctgctgattgagagccgctgcagcaggaagtctggaggagccccctggctgttctactttgtgctgactgtgggggagaactacctgggcgccctgtctgaggagggcctgctggtgtacctgcgggtgctgcagaccttcctgagccagctgcctgtgtccccagccagcgccagctgccatgattctgccagtgacagcgaggaggagagcgaggaggccgacaagcccagcagcccagaagatggccgcctgtctgtgtcctacatcacagaagaatgtctgaagaagctggacaccaagcagcagaccaacaccctgctgaacctggtgtggagggacagcgccagcgaggaggtgttcaccaccatggcctctgtgtgccacaccctgatggtgcagcacaggatgatggtgcccaaggtgcgggtgtacaagtag

SEQ ID NO: 175151 - DNA, 192 bp, Artificial Sequence
  Description of Artificial Sequence: Synthetic coding sequence
atggccgcccccctgtctgtggaggtggagtttggcagcagccctggctgcctcttcctgtggagcagctttgctgaggtggtgcgcagcagctgcctgactgtgctgagaaatattgagagcctgtgcctggacagaagaaatcctggcaccagcggcacctgcagcagcggcagccgccgcatctgctag

SEQ ID NO: 175152 - DNA, 192 bp, Artificial Sequence
  Description of Artificial Sequence: Synthetic coding sequence
atggccgcccccctgtctgtggaggtggagtttggaggcggcgctgagctgctgtttgatggcatcaagaagcaccgggtgaccctgcccggccaggaggagccctgggacatccggaacctgctgatctggatcaagaagaacctgctgaaggagaggcctgagctgttcatccagggcgacagcgtgtag

SEQ ID NO: 175153 - DNA, 306 bp, Artificial Sequence
  Description of Artificial Sequence: Synthetic coding sequence
atggccgcccccctgtctgtggaggtggagtttggaggcggcgctgagctgctgtttgatggcatcaagaagcaccgggtgaccctgcccggccaggaggagccctgggacatccggaacctgctgatctggatcaagaagaacctgctgaaggagaggcctgagctgttcatccagggcgacagcgtgcggcccggcatcctggtgctgatcaatgatgctgactgggagctgctgggggagctggactaccagctgcaggaccaggacagcgtgctcttcatcagcaccctgcatggaggatag

SEQ ID NO: 175154 - DNA, 441 bp, Artificial Sequence
  Description of Artificial Sequence: Synthetic coding sequence
atggccgcccccctgtctgtggaggtggagtttggaggcggcgctgagctgctgtttgatggcatcaagaagcaccgggtgaccctgcccggccaggaggagccctgggacatccggaacctgctgatctggatcaagaagaacctgctgaaggagaggcctgagctgttcatccagggcgacagcgtgcggcccggcatcctggtgctgatcaatgatgctgactgggagctgctggtgtccaccctgggggacatccccccaccagccccagccctggccgcctctgtgggcaagcgctgggccagcccccaggcccacatcgagtggctgggcaaccccccaccccacagcagccccaccctgcggctgctggagagccccaccccaggagaggagggcatgggctcctggggccacggcagcaccccacccagctag

SEQ ID NO: 175155 - DNA, 2358 bp, Artificial Sequence
  Description of Artificial Sequence: Synthetic coding sequence
atgcctggggtcatccccagcgagagcaatggcctgagccggggcagccccagcaagaagaaccggctgagcctgaagttcttccagaagaaggagaccaagagggccctggacttcacagacagccaggagaatgaggagaaggccagcgagtaccgggccagcgagattgaccaggtggtgcctgctgcccagagcagccccatcaactgtgagaagcgggagaacctgctgccctttgtgggcctgaacaacctgggcaacacctgctacctgaacagcatcctgcaggtgctgtacttctgccccggcttcaagtctggagtgaagcacctgttcaacatcatcagcaggaagaaggaggccctgaaggatgaggccaaccagaaggacaagggcaactgcaaggaggacagcctggccagctatgagctgatctgcagcctgcagagcctcatcatctctgtggagcagctgcaggccagcttcctgctgaaccctgagaagtacacagatgagctggccacccagccccggcggctgctgaacaccctgcgggagctgaaccccatgtatgagggctacctgcagcatgatgcccaggaggtgctgcagtgcatcctgggcaacatccaggagacctgccagctgctgaagaaggaggaggtgaagaatgtggccgagctgcccaccaaggtggaggagatcccccaccccaaggaggagatgaatggcatcaacagcattgagatggacagcatgaggcacagcgaggacttcaaggagaagctgcccaagggaaatggcaagaggaagagtgacacagaatttggaaacatgaagaagaaggtgaagctgagcaaggagcaccagagcctggaggagaaccagaggcagaccaggagcaagaggaaggccaccagtgacaccctggagagcccccccaagatcatccccaagtacatcagtgaaaatgaaagcccccggcccagccagaagaagagccgggtgaagatcaactggctgaagagcgccaccaagcagcccagcatcctgagcaagttctgcagcctgggcaagatcaccaccaaccagggcgtgaagggccagagcaaagaaaatgaatgtgaccctgaggaggacctgggcaaatgtgagagtgacaacaccaccaacggctgcggcctggagagccctggcaacacagtgacccctgtgaatgtgaatgaggtgaagcccatcaacaagggggaggagcagattggatttgagctggtggagaagctgttccagggccagctggtgctgcggacccgctgcctggagtgtgagagcctgacagaaagaagagaggacttccaggacatctctgtgcctgtgcaggaggatgagctgagcaaggtggaggagagcagcgagatcagccctgagcccaagacagagatgaagaccctgcgctgggccatcagccagtttgcctctgtggagcgcatcgtgggggaggacaagtacttctgtgagaactgccaccactacacagaagctgagaggagcctgctgtttgacaagatgcctgaggtgatcaccatccacctgaagtgctttgctgccagcggcctggagtttgactgctatggaggcggcctgagcaagatcaacacccccctgctgacccccctgaagctgagcctggaggagtggagcaccaagcccaccaatgacagctatggcctgtttgctgtggtgatgcacagcggcatcaccatcagcagcggccactacacagcctctgtgaaggtgacagacctgaacagcctggagctggacaagggcaactttgtggtggaccagatgtgtgaaattggcaagccagagcccctgaatgaggaggaggcccggggcgtggtggagaactacaatgatgaggaggtgtccatccgggtgggcggcaacacccagcccagcaaggtgctgaacaagaagaatgtggaggccatcggcctgctgggcggccagaagagcaaggctgactatgagctgtacaacaaggccagcaacccagacaaggtggccagcacagcctttgctgaaaatagaaattctgagaccagtgacaccaccggcacccatgaaagtgacaggaacaaggagagcagtgaccagacaggcatcaacatcagcggctttgagaacaagatctcctatgtggtgcagagcctgaaggagtatgagggcaagtggctgctgtttgatgattctgaggtgaaggtgacagaggagaaggacttcctgaacagcctgagccccagcaccagccccaccagcaccccctacctgctcttctacaagaagctgtag

SEQ ID NO: 175156 - DNA, 2358 bp, Artificial Sequence; identical to SEQ ID NO: 175155
  Description of Artificial Sequence: Synthetic coding sequence

SEQ ID NO: 175157 - DNA, 264 bp, Artificial Sequence
  Description of Artificial Sequence: Synthetic coding sequence
atgcctggggtcatccccagcgagagcaatggcctgagccggggcagccccagcaagaagaaccggctgagcctgaagttcttccagaagaaggagaccaagagggccctggacttcacagacagccaggagaatgaggagaaggccagcgagtaccgggccagcgagattgaccaggtggtgcctgctgcccagagcagccccatcaactgtgagaagcgggagaacctgctgccctttgtgggcctgaacaacctgggctag

SEQ ID NO: 175158 - DNA, 561 bp, Artificial Sequence
  Description of Artificial Sequence: Synthetic coding sequence
atgcctggggtcatccccagcgagagcaatggcctgagccggggcagccccagcaagaagaaccggctgagcctgaagttcttccagaagaaggagaccaagagggccctggacttcacagacagccaggagaatgaggagaaggccagcgagtaccgggccagcgagattgaccaggtggtgcctgctgcccagagcagccccatcaactgtgagaagcgggagaacctgctgccctttgtgggcctgaacaacctgggcaacacctgctacctgaacagcatcctgcaggtgctgtacttctgccccggcttcaagtctggagtgaagcacctgttcaacatcatcagcaggaagaaggaggccctgaaggatgaggccaaccagaaggacaagggcaactgcaaggaggacagcctggccagctatgagctgatctgcagcctgcagagcctcatcatctctgtggagcagctgcaggccagcttcctgctgaaccctgagaagtacacagatgagctggccacccagccccggcggctgctgaacaccctgaggtag

SEQ ID NO: 175159 - DNA, 663 bp, Artificial Sequence
  Description of Artificial Sequence: Synthetic coding sequence
atgcccctgactggagtgggccctggcagctgccggcggcagatcatccgggccctgtgcctgctgctgctgctgctgcacgccggcagcgccaagaacatctggaagagggccctgcctgcccggctggccgagaagagcagagctgaggaggccggggcccctgggggcccccggcagcccagggctgaccgctgccccccaccacccaggaccctgcccccaggggcctgccaggccgcccgctgccaggccgacagcgagtgccccaggcaccggcgctgctgctacaacggctgtgcctatgcctgcctggaggccgtgcccccacctcctgtgctggactggctggtgcagcccaagccccgctggctgggcggcaatggctggctgctggatggccctgaggaggtgctgcaggccgaggcctgcagcaccacagaagatggagctgagcccctgctgtgccccagcggctatgagtgccacatcctgagccctggagatgtggccgagggcatccccaacagaggccagtgtgtgaagcagaggcggcaggctgatggccgcatcctgcggcacaagctgtacaaggagtacccagagggggacagcaagaatgtggccgagcccggccggggccagcagaagcacttccagtag

SEQ ID NO: 175160 - DNA, 687 bp, Artificial Sequence
  Description of Artificial Sequence: Synthetic coding sequence
atgtaccacctgatgaagttcatccccctgtacagcaaggtgcagaggccctgcaccagcacccccatgattgacagctttgtgcggctgatgaatgagttcaccaacatgcctgtgccccccaagccccggcaggccctgggggacaagatcgtgcgggacatccggcctggagctgcctttgagcccacctacatctaccgcctgctgactgtgaacaagagcagcctgtctgagaagggccggcaggaggatgctgaggagtacctgggcttcatcctgaatggcctgcacgaggagatgctgaacctgaagaagctgctgagccccagcaatgagaagctgaccatcagcaatggccccaagaaccacagcgtgaatgaggaggagcaggaggagcagggcgagggctctgaagatgagtgggagcaggtgggccccaggaacaagacctctgtgacccggcaggccgactttgtgcagacccccatcaccggcttctggtggacccaccaggtgtgtggcctgcctgctgagttcaagaggatctgccactttgctgccatcttccacgtggccgtgggctaccctgtgcggcaggacacccacagccctggctgcaccggggagctgggcggcaagaggatctgcccccggctgtaccacaagaaccagacccggggctag

SEQ ID NO: 175161 - DNA, 189 bp, Artificial Sequence
  Description of Artificial Sequence: Synthetic coding sequence
atggccctgcacagcccccagtacatctttggagacttctccccagatgagttcaaccagttctttgtgacccccaggagctctgtggaggacaagaacatccgggagctgagcctggtgtccatgaagagcctgaaccctgtgaccctgtgccgggagcccccagccaccgtcttccaggcccactag

SEQ ID NO: 175162 - DNA, 2472 bp, Artificial Sequence
  Description of Artificial Sequence: Synthetic coding sequence
atgaagaggcacaggcctgtgagcagcagtgacagcagtgatgagagccccagcaccagcttcaccagcggctccatgtaccgcatcaagagcaagatccccaatgagcacaagaagccagctgaggtgttcaggaaggacctgatcagcgccatgaagctgcctgacagccaccacatcaacccagacagctactacctgtttgctgacacctggaaggaggagtgggagaagggcgtgcaggtgcctgccagcccagacacagtgccccagcccagcctgcgcatcatcgccgagaaggtgaaggatgtgctcttcatccggcccaggaagtacatccactgcagcagcccagacaccacagagcccggctacatcaacatcatggagctggccgcctctgtgtgccgctatgacctggatgacatggacatcttctggctgcaggagctgaatgaagacctggccgagatgggctgcggccctgtggatgagaacctgatggagaagacagtggaggtgctggagcggcactgccacgagaacatgaaccacgccattgaaacagaggagggcctgggcattgaatatgatgaagatgtgatctgtgatgtgtgccgcagcccagattctgaggagggcaatgacatggtgttctgtgacaagtgcaatgtgtgtgtgcaccaggcctgctacggcatcctgaaggtgcctgagggctcctggctgtgccgcagctgtgtgctgggcatctacccccagtgtgtgctgtgccccaagaagggcggggccctgaagaccaccaagacaggcaccaagtgggcccacgtgtcctgtgccctgtggatccctgaggtgtccatcgcctgcccagagaggatggagcccatcaccaagatcagccacatcccccccagccgctgggccctggtgtgcaacctgtgcaagctgaagacaggagcctgcatccagtgcagcatcaagagctgcatcacagccttccacgtgacctgtgcctttgagcacggcctggagatgaagaccatcctggatgaaggagatgaggtgaagttcaagagctactgcctgaagcacagccagaaccggcagaagctgggggaggccgagtacccccaccaccgggccaaggagcagagccaggccaagtctgagaagaccagcctgcgggcccagaagctgcgggagctggaggaggagttctacagcctggtgcgggtggaggatgtggccgctgagctgggcatgcccaccctggccgtggacttcatctacaactactggaagctgaagaggaagagcaacttcaacaagcccctcttcccccccaaggaggatgaggagaatggcctggtgcagcccaaggaggagagcatccacaccaggatgaggatgttcatgcacctgcggcaggacctggagcgggtgaggaacctgtgctacatgatcagcagaagagagaagctgaagctgagccacaacaagatccaggagcagatcttcggcctgcaggtgcagctgctgaaccaggagattgatgctggcctgcccctgaccaatgccctggagaacagcctcttctaccccccaccccgcatcaccctgaagctgaagatgcccaagagcaccccagaggaccacaggaacagcagcacagaaacagaccagcagccccacagcccagacagcagcagctctgtgcacagcatccggaacatgcaggtgccccaggagagcctggagatgaggaccaagagctacccccgctaccccctggagagcaagaacaaccggctgctggccagcctgagccacagccgctctgaggccaaggagagcagccctgcctggaggacccccagcagcgagtgctaccacggccagagcctgggcaagcccctggtgctgcaggccgccctgcacggccagagcagcattggaaatggcaagagccagcccaacagcaagtttgccaagagcaatggcctggagggctcctggagcggaaatgtgacccagaaggacagcagcagcgagatgttctgtgaccaggagcccgtcttcagcccccacctggtgtcccagggcagcttcaggaagagcacagtggagcacttcagccgctccttcaaggagaccaccaaccgctgggtgaagaacacagaggacctgcagtgctacgtgaagcccaccaagaacatgagccccaaggagcagttctggggccggcaggtgctgcggcgctctgctggccgggccccctaccaggagaatgatggctactgcccagacctggagctgagtgacagcgaggccgagagtgatggcaacaaggagaaggtgcgggtgaggaaggacagcagtgacagagaaaatcctcctcatgacagccggcgggactgccacggcaagagcaagacccaccccctgagccacagctccatgcagaggtag

SEQ ID NO: 175163 - DNA, 2763 bp, Artificial Sequence
  Description of Artificial Sequence: Synthetic coding sequence
atggccaccgtggccgccaacccagctgctgctgctgctgctgtggccgctgctgctgctgtgacagaagatcgggagccccagcacgaggagctgcccggcctggacagccagtggaggcagattgaaaatggagagagcggccgggagcggcccctgcgggccggggagagctggttcctggtggagaagcactggtacaagcagtgggaggcctacgtgcagggcggggaccaggacagcagcaccttccctggctgcatcaacaatgccaccctcttccaggatgagatcaactggaggctgaaggagggcctggtggagggggaggactatgtgctgctgcctgctgctgcctggcactacctggtgtcctggtacggcctggagcacggccagccccccatcgagaggaaggtgattgagctgcccaacatccagaaggtggaggtgtaccctgtggagctgctgctggtgcgccacaatgacctgggcaagagccacacagtgcagttcagccacacagacagcatcggcctggtgctgaggacagcccgggagcgcttcctggtggagccccaggaggacacccggctgtgggccaagaacagcgagggcagcctggaccggctgtatgacacccacatcaccgtgctggatgctgccctggagaccggccagctgatcatcatggagaccaggaagaaggatggcacctggcccagcgcccagctgcacgtgatgaacaacaacatgtctgaagaagatgaggacttcaagggccagcccggcatctgtggcctgaccaacctgggcaacacctgcttcatgaacagcgccctgcagtgcctgagcaatgtgccccagctgacagagtacttcctgaacaactgctacctggaggagctgaacttcaggaaccccctgggcatgaagggggagattgctgaggcctatgctgacctggtgaagcaggcctggagcggccaccacaggagcatcgtgccccacgtgttcaagaacaaggtgggccactttgccagccagttcctgggctaccagcagcacgacagccaggagctgctgtccttcctgctggatggcctgcacgaggacctgaacagagtgaagaagaaggagtatgtggagctgtgtgatgctgctggccgcccagaccaggaggtggcccaggaggcctggcagaaccacaagagaagaaatgattctgtgattgtggacaccttccacggcctcttcaagagcaccctggtgtgcccagactgtggaaatgtgtctgtgacctttgaccccttctgctacctgtctgtgcccctgcccatcagccacaagagggtgctggaggtgttcttcatccccatggaccccaggaggaagccagagcagcaccggctggtggtgcccaagaagggcaagatcagtgacctgtgtgtggccctgagcaagcacacaggcatcagccctgagaggatgatggtggctgatgtgttcagccaccgcttctacaagctgtaccagctggaggagcccctgagcagcatcctggacagagatgacatctttgtgtatgaggtgtctggaagaattgaggccatcgagggcagcagagaagatattgtggtgcctgtgtacctgcgggagaggaccccagcccgggactacaacaacagctactacggcctgatgctgtttggccaccccctgctggtgtctgtgccccgggaccgcttcacctgggagggcctgtacaacgtgctgatgtaccgcctgagccgctacgtgaccaagcccaacagtgatgatgaagatgatggagatgagaaggaggatgatgaggaggacaaggatgatgtgcccggccccagcactggaggcagcctgcgggaccctgagcctgagcaggccggccccagcagtggagtgaccaaccgctgccccttcctgctggacaactgcctgggcaccagccagtggcccccaagaagaagaaggaagcagctgttcaccctgcagacagtgaacagcaatggcaccagtgacaggaccaccagccctgaggaggtgcacgcccagccctacatcgccatcgactgggagcctgagatgaagaagcgctactatgatgaggtggaggccgagggctacgtgaagcatgactgtgtgggctacgtgatgaagaaggcccctgtgcggctgcaggagtgcatcgagctgttcaccaccgtggagaccctggagaaggagaacccctggtactgccccagctgcaagcagcaccagctggccaccaagaagctggacctgtggatgctgcctgagatcctgatcatccacctgaagcgcttctcctacaccaagttcagccgggagaagctggacaccctggtggagttccccatccgggacctggacttcagcgagtttgtgatccagccccagaatgaaagcaaccctgagctgtacaagtatgacctgattgctgtgagcaaccactacggcggcatgagagatggccactacaccacctttgcctgcaacaaggacagcggccagtggcactactttgatgacaacagcgtgtcccctgtgaatgaaaaccagatcgagagcaaggccgcctacgtgctcttctaccagaggcaggatgtggcccggcggctgctgagccctgctggcagcagcggggccccagccagccctgcctgcagcagcccccccagcagcgagttcatggatgtgaactag

SEQ ID NO: 175164 - DNA, 1113 bp, Artificial Sequence
  Description of Artificial Sequence: Synthetic coding sequence
atggagatcctgatgacagtgtccaagtttgccagcatctgcaccatgggcgccaatgccagcgccctggagaaggagatcggccctgagcagtttcctgtgaatgagcactacttcggcctggtgaactttggaaacacctgctactgcaacagcgtgctgcaggccctgtacttctgccggcccttccgggagaaggtgctggcctacaagagccagcccaggaagaaggagagcctgctgacctgcctggccgacctcttccacagcatcgccacccagaagaagaaggtgggcgtcatcccccccaagaagttcatcacccggctgaggaaagaaaatgagctgtttgacaactacatgcagcaggatgcccacgagttcctgaactacctgctgaacaccatcgctgacatcctgcaggaggagaggaagcaggagaagcagaatggccgcctgcccaatggaaacatcgacaatgaaaacaacaacagcaccccagaccccacctgggtgcatgagatcttccagggcaccctgaccaatgagacccgctgcctgacctgtgagaccatcagcagcaaggatgaggacttcctggacctgtctgtggatgtggagcagaacaccagcatcacccactgcctgcggggcttcagcaacacagagaccctgtgcagcgagtacaagtactactgtgaagaatgtcgcagcaagcaggaggcccacaagaggatgaaggtgaagaagctgcccatgatcctggccctgcacctgaagcgcttcaagtacatggaccagctgcaccgctacaccaagctgagctacagagtggtgttccccctggagctgcggctcttcaacaccagcggagatgccaccaacccagacaggatgtatgacctggtggccgtggtggtgcactgcggcagcggccccaacagaggccactacatcgccatcgtgaagagccatgacttctggctgctgtttgatgatgacatcgtggagaagattgatgcccaggccatcgaggagttctacggcctgaccagtgacatcagcaagaacagcgagagcggctacatcctcttctaccagagccgggactag

SEQ ID NO: 175165 - DNA, 2592 bp, Artificial Sequence
  Description of Artificial Sequence: Synthetic coding sequence
atgcagaggagaggagccctgtttggcatgcctgggggcagcggcggcaggaagatggctgctggggacatcggggagctgctggtgccccacatgcccaccatccgggtgcccaggtctggggacagagtgtacaagaatgaatgtgccttctcctatgacagccccaacagcgagggcggcctgtatgtgtgcatgaacaccttcctggccttcggccgggagcacgtggagcggcacttcaggaagacaggccagagcgtgtacatgcacctgaagagacatgtgcgggagaaggtgcggggggccagcggcggggccctgcccaagagaagaaacagcaagatcttcctggacctggacacagatgatgacctgaacagtgatgattatgaatatgaagatgaggccaagctggtgatcttcccagaccactatgagatcgccctgcccaacatcgaggagctgcctgccctggtgaccatcgcctgtgatgctgtgctgagcagcaagagcccctacaggaagcaggaccctgacacctgggagaatgagctgcctgtgtccaaatatgccaacaacctgacccagctggacaacggggtgcgcatccccccatctggctggaagtgtgcccgctgtgacctgcgggagaacctgtggctgaacctgacagatggctctgtgctgtgtgggaagtggttctttgacagcagcggcggcaatggccacgccctggagcactacagagacatgggctaccccctggccgtgaagctgggcaccatcaccccagatggagcagatgtgtacagcttccaggaggaggagcctgtgctggacccccacctggccaagcacctggcccactttggaattgacatgctgcacatgcatggaacagaaaatggcctgcaggacaatgacatcaagctgcgggtgtctgagtgggaggtgatccaggagagcggcaccaagctgaagcccatgtatggccctggctacacaggcctgaagaacctgggcaacagctgctacctgagctctgtgatgcaggccatcttcagcatccctgagttccagagggcctacgtgggcaacctgccccgcatctttgactacagccccctggaccccacccaggacttcaacacccagatgaccaagctgggccacggcctgctgagcggccagtacagcaagccccctgtgaagtctgagctgattgagcaggtgatgaaggaggagcacaagccccagcagaatggcatcagccccaggatgttcaaggcctttgtgtccaagagccaccctgagttcagcagcaaccggcagcaggatgcccaggagttcttcctgcacctggtgaacctggtggagaggaaccgcatcggcagcgagaaccccagtgatgtgttccgcttcctggtggaggagcgcatccagtgctgccagaccaggaaggtgcgctacacagagcgggtggactacctgatgcagctgcctgtggccatggaggccgccaccaacaaggatgagctgattgcctatgagctgacccggcgggaggccgaggccaacagaagacccctgcctgagctggtgcgggccaagatccccttcagcgcctgcctgcaggccttcagcgagccagaaaatgtggatgacttctggagcagcgccctgcaggccaagtctgctggggtgaagaccagcagatttgccagcttccctgagtacctggtggtgcagatcaagaagttcaccttcggcctggactgggtgcccaagaagtttgatgtgtccattgacatgccagacctgctggacatcaaccacctgcgggcccggggcctgcagcctggagaggaggagctgcctgacatcagcccccccatcgtcatcccagatgacagcaaggaccggctgatgaaccagctgattgaccccagcgacattgatgagagctctgtgatgcagctggccgagatgggcttccccctggaggcctgcaggaaggctgtgtacttcaccggcaacatgggcgctgaggtggccttcaactggatcatcgtgcacatggaggagccagactttgctgagcccctgaccatgcctggctacggcggggccgccagcgctggggcctctgtgtttggagccagcggcctggacaaccagcccccagaggagatcgtggccatcatcacctccatgggcttccagaggaaccaggccatccaggccctgcgggccaccaacaacaacctggagcgggccctggactggatcttcagccaccctgagtttgaggaggacagcgactttgtgattgagatggagaacaatgccaatgccaacatcatcagcgaggccaagccagagggcccccgggtgaaggatggcagcggcacctatgagctgtttgccttcatcagccacatgggcaccagcaccatgagcggccactacatctgccacatcaagaaggagggccgctgggtgatctacaatgaccacaaggtgtgtgccagcgagcggccccccaaggacctgggctacatgtacttctaccgccgcatccccagctag

SEQ ID NO: 175166 - DNA, 1485 bp, Artificial Sequence
  Description of Artificial Sequence: Synthetic coding sequence
atgcccctgtacagcgtgacagtgaagtggggcaaggagaagtttgaaggagtggagctgaacacagatgagccccccatggtgttcaaggcccagctgtttgccctgactggagtgcagcctgcccggcagaaggtgatggtgaagggcggcaccctgaaggatgatgactggggcaacatcaagatcaagaatggcatgaccctgctgatgatgggcagcgcagatgccctgcctgaggagcccagcgccaagacagtgtttgtggaggacatgacagaggagcagctggccagcgccatggagctgccctgtggcctgaccaacctgggcaacacctgctacatgaatgccaccgtgcagtgcatccgctctgtgcctgagctgaaggatgccctgaagagatatgctggggccctgcgggccagcggggagatggccagcgcccagtacatcacagctgccctgcgggacctgtttgacagcatggacaagaccagcagcagcatcccccccatcatcctgctgcagttcctgcacatggccttcccccagtttgctgagaagggggagcagggccagtacctgcagcaggatgccaatgaatgctggatccagatgatgagggtgctgcagcagaagctggaggccattgaagatgacagcgtgaaggagacagacagcagcagcgccagcgctgccacccccagcaagaagaagagcctgattgaccagttctttggagtggagtttgagaccaccatgaagtgcacagagagcgaggaggaggaggtgaccaagggcaaggagaaccagctgcagctgagctgcttcatcaaccaggaggtgaagtacctgttcaccggcctgaagctgcggctgcaggaggagatcaccaagcagagccccaccctgcagagaaatgccctgtacatcaagagcagcaagatcagccggctgcctgcctacctgaccatccagatggtgcgcttcttctacaaggagaaggagagcgtgaatgccaaggtgctgaaggatgtgaagttccccctgatgctggacatgtatgagctgtgcaccccagagctgcaggagaagatggtgtccttccgcagcaagttcaaggacctggaggacaagaaggtgaaccagcagcccaacaccagtgacaagaagagcagcccccagaaggaggtgaagtatgagcccttctcctttgctgatgacatcggcagcaacaactgtggctactatgacctgcaggccgtgctgacccaccagggccgcagcagcagcagcggccactacgtgtcctgggtgaagaggaagcaggatgagtggatcaagtttgatgatgacaaggtgtccatcgtgaccccagaggacatcctgcggctgagcggcggcggggactggcacatcgcctacgtgctgctgtatggccccaggagagtggagatcatggaggaggagagcgagcagtag

SEQ ID NO: 175167 - DNA, 1380 bp, Artificial Sequence
  Description of Artificial Sequence: Synthetic coding sequence
atgcccctgtacagcgtgacagtgaagtggggcaaggagaagtttgaaggagtggagctgaacacagatgagccccccatggtgttcaaggcccagctgtttgccctgactggagtgcagcctgcccggcagaaggtgatggtgaagggcggcaccctgaaggatgatgactggggcaacatcaagatcaagaacatggagctgccctgtggcctgaccaacctgggcaacacctgctacatgaatgccaccgtgcagtgcatccgctctgtgcctgagctgaaggatgccctgaagagatatgctggggccctgcgggccagcggggagatggccagcgcccagtacatcacagctgccctgcgggacctgtttgacagcatggacaagaccagcagcagcatcccccccatcatcctgctgcagttcctgcacatggccttcccccagtttgctgagaagggggagcagggccagtacctgcagcaggatgccaatgaatgctggatccagatgatgagggtgctgcagcagaagctggaggccattgaagatgattctgtgaaggagacagacagcagcagcgccagcgctgccacccccagcaagaagaagagcctgattgaccagttcttcggcgtggagtttgagaccaccatgaagtgcacagaaagtgaggaggaggaggtgaccaagggcaaggagaaccagctgcagctgagctgcttcatcaaccaggaggtgaagtacctgttcaccggcctgaagctgcggctgcaggaggagatcaccaagcagagccccaccctgcagagaaatgccctgtacatcaagagcagcaagatcagccggctgcctgcctacctgaccatccagatggtgcgcttcttctacaaggagaaggagagcgtgaatgccaaggtgctgaaggatgtgaagttccccctgatgctggacatgtatgagctgtgcaccccagagctgcaggagaagatggtgtccttccgcagcaagttcaaggacctggaggacaagaaggtgaaccagcagcccaacaccagtgacaagaagagcagcccccagaaggaggtgaagtatgagcccttctcctttgctgatgacatcggcagcaacaactgtggctactatgacctgcaggccgtgctgacccaccagggccgcagcagcagcagcggccactacgtgtcctgggtgaagaggaagcaggatgagtggatcaagtttgatgatgacaaggtgtccatcgtgaccccagaggacatcctgcggctgagcggcggcggggactggcacatcgcctacgtgctgctgtatggcccccggcgggtggagatcatggaggaggagagcgagcagtag

SEQ ID NO: 175168 - DNA, 1452 bp, Artificial Sequence
  Description of Artificial Sequence: Synthetic coding sequence
atgcccctgtacagcgtgacagtgaagtggggcaaggagaagtttgaaggagtggagctgaacacagatgagccccccatggtgttcaaggcccagctgtttgccctgactggagtgcagcctgcccggcagaaggtgatggtgaagggcggcaccctgaagggcatgaccctgctgatgatgggcagcgcagatgccctgcctgaggagcccagcgccaagacagtgtttgtggaggacatgacagaggagcagctggccagcgccatggagctgccctgtggcctgaccaacctgggcaacacctgctacatgaatgccaccgtgcagtgcatccgctctgtgcctgagctgaaggatgccctgaagagatatgctggggccctgcgggccagcggggagatggccagcgcccagtacatcacagctgccctgcgggacctgtttgacagcatggacaagaccagcagcagcatcccccccatcatcctgctgcagttcctgcacatggccttcccccagtttgctgagaagggggagcagggccagtacctgcagcaggatgccaatgaatgctggatccagatgatgagggtgctgcagcagaagctggaggccattgaagatgattctgtgaaggagacagacagcagcagcgccagcgctgccacccccagcaagaagaagagcctgattgaccagttcttcggcgtggagtttgagaccaccatgaagtgcacagaaagtgaggaggaggaggtgaccaagggcaaggagaaccagctgcagctgagctgcttcatcaaccaggaggtgaagtacctgttcaccggcctgaagctgcggctgcaggaggagatcaccaagcagagccccaccctgcagagaaatgccctgtacatcaagagcagcaagatcagccggctgcctgcctacctgaccatccagatggtgcgcttcttctacaaggagaaggagagcgtgaatgccaaggtgctgaaggatgtgaagttccccctgatgctggacatgtatgagctgtgcaccccagagctgcaggagaagatggtgtccttccgcagcaagttcaaggacctggaggacaagaaggtgaaccagcagcccaacaccagtgacaagaagagcagcccccagaaggaggtgaagtatgagcccttctcctttgctgatgacatcggcagcaacaactgtggctactatgacctgcaggccgtgctgacccaccagggccgcagcagcagcagcggccactacgtgtcctgggtgaagaggaagcaggatgagtggatcaagtttgatgatgacaaggtgtccatcgtgaccccagaggacatcctgcggctgagcggcggcggggactggcacatcgcctacgtgctgctgtatggcccccggcgggtggagatcatggaggaggagagcgagcagtag

SEQ ID NO: 175169 - DNA, 1380 bp, Artificial Sequence; identical to SEQ ID NO: 175167
  Description of Artificial Sequence: Synthetic coding sequence

SEQ ID NO: 175170 - DNA, 2382 bp, Artificial Sequence
  Description of Artificial Sequence: Synthetic coding sequence
atgcctgctggccctgtgcaggccgtgcccccacctcctcctgtgcccacagagcccaagcagcccacagaggaggaggccagcagcaaagaagattctgcccccagcaagcctgtggtgggcatcatctacccacctcctgaggtgaggaacatcgtggacaagacagccagctttgtggccagaaatggacctgagtttgaggcccgcatccggcagaatgagatcaacaaccccaagttcaacttcctgaaccccaatgacccctaccacgcctactaccgccacaaggtgtctgagttcaaggagggcaaggcccaggagcccagcgctgccatccccaaggtgatgcagcagcagcagcagaccacccagcagcagctgccccagaaggtgcaggcccaggtgatccaggagaccatcgtgcccaaggagcccccacctgagtttgagttcatcgctgacccccccagcatcagcgcctttgacctggatgtggtgaagctgacagcccagtttgtggccagaaatggccggcagttcctgacccagctgatgcagaaggagcagaggaactaccagtttgacttcctgcggccccagcacagcctcttcaactacttcaccaagctggtggagcagtacaccaagatcctgatcccccccaagggcctcttcagcaagctgaagaaggaggccgagaacccccgggaggtgctggaccaggtgtgctacagagtggagtgggccaagttccaggagcgggagaggaagaaggaggaggaggagaaggagaaggagcgggtggcctatgcccagattgactggcatgactttgtggtggtggagaccgtggacttccagcccaatgagcagggcaacttccccccacccaccaccccagaggagctgggcgcccgcatcctgatccaggagagatatgagaagtttggagagagcgaggaggtggagatggaggtggagagtgatgaggaggatgacaagcaggagaaggccgaggagccccccagccagctggaccaggacacccaggtgcaggacatggatgagggcagtgatgatgaggaggagggccagaaggtgcccccacctcctgagacccccatgcccccacccctgccccccaccccagaccaggtgattgtgaggaaggactatgaccccaaggccagcaagcccctgcccccagccccagccccagatgagtacctggtgagccccatcaccggggagaagatcccagccagcaagatgcaggagcacatgagaattggcctgctggacccccgctggctggagcagagggacaggagcatccgggagaagcagagtgatgatgaggtgtatgcccctggcctggacatcgagagcagcctgaagcagctggccgagaggagaacagacatctttggagtggaggagacagccatcggcaagaagatcggggaggaggagatccagaagccagaggagaaggtgacctgggatggccacagcggctccatggcccggacccagcaggccgcccaggccaacatcaccctgcaggagcagatcgaggccatccacaaggccaagggcctggtgcctgaagatgacaccaaggagaagattggccccagcaagcccaatgagatcccccagcagcccccaccacccagcagcgccaccaacatccccagcagcgccccacccatcacctctgtgcccaggcctcccaccatgcctcctcctgtgaggaccaccgtggtgtctgctgtgcctgtgatgccccggccccccatggcctctgtggtgcggctgcccccaggcagcgtcatcgcccccatgccacccatcatccacgccccccgcatcaacgtggtgcccatgccacccagcgccccacccatcatggccccccggcccccacccatgattgtgcccacagcctttgtgcctgcccctcctgtggcccctgtgcctgccccagcccccatgcctcctgtgcaccccccaccacccatggaggatgagcccaccagcaagaagctgaagacagaggacagcctgatgcctgaggaggagttcctgcggaggaacaagggccctgtgtccatcaaggtgcaggtgcccaacatgcaggacaagacagagtggaagctgaatggccaggtgctggtgttcaccctgcccctgacagaccaggtgtctgtcatcaaggtgaagatccacgaggccaccggcatgcctgctgggaagcagaagctgcagtatgagggcatcttcatcaaggacagcaacagcctggcctactacaacatggccaatggagctgtgatccacctggccctgaaggagcggggcggcaggaagaagtag

SEQ ID NO: 175171 - DNA, 732 bp, Artificial Sequence
  Description of Artificial Sequence: Synthetic coding sequence
accatccgggtgaaggacagcctcatctgtgtggactgtgccatggagagcagcaggaacagctccatgctgaccctgcccctgagcctgtttgatgtggacagcaagcccctgaagaccctggaggatgccctgcactgcttcttccagccccgggagctgagcagcaagagcaagtgcttctgtgagaactgtgggaagaagacccggggcaagcaggtgctgaagctgacccacctgccccagaccctgaccatccacctgatgaggttcagcatccggaacagccagaccaggaagatctgccacagcctgtacttcccccagagcctggacttcagccagatcctgcccatgaagcgggagagctgtgatgctgaggagcagagcggcggccagtatgagctgtttgctgtgattgcccacgtgggcatggctgacagcggccactactgtgtgtacatcagaaatgctgtggatggcaagtggttctgcttcaatgacagcaacatctgcctggtgtcctgggaggacatccagtgcacctacggcaaccccaactaccactggccacccttcctgtgccacgcctgcatcctgattgaagatggagagtacctgcggctcttccggcctgccaacatccggcagttcaccagccgggaggagacctgggtggagtgctggtgtgtgctgaccctgcagtgcaagcagctgcagcaggtgtggtag

SEQ ID NO: 175172 - DNA, 1698 bp, Artificial Sequence
  Description of Artificial Sequence: Synthetic coding sequence
atgccccaggccagcgagcaccggctgggccgcacccgggagccccctgtgaacatccagccccgggtgggcagcaagctgccctttgccccccgggcccggagcaaggagaggagaaatcctgccagcggccccaaccccatgctgcggcccctgcccccccggcccggcctgcctgatgagcggctgaagaagctggagctgggccggggccgcaccagcggcccccggccccggggccccctgcgggctgaccacggcgtgcccctgcccggcagccccccacccaccgtggccctgcccctgcccagcaggaccaacctggcccggagcaagtctgtgagcagcggggacctgcggcccatgggcatcgccctgggcggccaccggggcaccggggagctgggcgccgccctgagccggctggccctgcggcctgagccccccaccctgcggcgcagcaccagcctgcggcggctgggcggcttccctggcccccccaccctcttcagcatcagaacagagcccccagccagccacggcagcttccacatgatcagcgcccggagcagcgagcccttctacagtgatgacaagatggcccaccacaccctgctgctgggcagcggccacgtgggcctgaggaacctgggcaacacctgcttcctgaatgctgtgctgcagtgcctgagcagcacccggcccctgcgggacttctgcctgcggcgggacttccggcaggaggtgcctgggggcggccgggcccaggagctgacagaggcctttgctgatgtgattggagccctgtggcacccagacagctgtgaggccgtgaaccccacccgcttccgggctgtgttccagaagtatgtgcccagcttcagcggctacagccagcaggatgcccaggagttcctgaagctgctgatggagcggctgcacctggagatcaacagaagaggccggcgggccccacccatcctggccaacggccctgtgcccagccccccccggcggggcggggccctgctggaggagcctgagctgagtgatgatgaccgggccaacctgatgtggaagcgctacctggagcgggaggacagcaagatcgtggacctgtttgtgggccagctgaagagctgcctgaagtgccaggcctgtggctaccgcagcaccacctttgaggtgttctgtgacctgagcctgcccatccccaagaagggctttgctgggggcaaggtgtccctgcgggactgcttcaacctcttcaccaaggaggaggagctggagagtgaaaatgcccctgtgtgtgaccgctgccggcagaagaccaggagcaccaagaagctgactgtgcagcgcttcccccgcatcctggtgctgcacctgaaccgcttcagcgccagccggggcagcatcaagaagagctctgtgggcgtggacttccccctgcagaggctgagcctgggggactttgccagtgacaaggccggcagccctgtgtaccagctgtatgccctgtgcaaccacagcggctctgtgcactacggccactacacagccctgtgccgctgccagacaggctggcacgtgtacaatgacagccgggtgtcccctgtgtctgagaaccaggtggccagcagcgagggctacgtgctcttctaccagctgatgcaggagcccccacgctgcctgtag

SEQ ID NO: 175173 - DNA, 1656 bp, Artificial Sequence
  Description of Artificial Sequence: Synthetic coding sequence
atgccccaggccagcgagcaccggctgggccgcacccgggagccccctgtgaacatccagccccgggtgggcagcaagctgccctttgccccccgggcccggagcaaggagaggagaaatcctgccagcggccccaaccccatgctgcggcccctgcccccccggcccggcctgcctgatgagcggctgaagaagctggagctgggccggggccgcaccagcggcccccggccccggggccccctgcgggctgaccacggcgtgcccctgcccggcagccccccacccaccgtggccctgcccctgcccagcaggaccaacctggcccggagcaagtctgtgagcagcggggacctgcggcccatgggcatcgccctgggcggccaccggggcaccggggagctgggcgccgccctgagccggctggccctgcggcctgagccccccaccctgcggcgcagcaccagcctgcggcggctgggcggcttccctggcccccccaccctcttcagcatcagaacagagcccccagccagccacggcagcttccacatgatcagcgcccggagcagcgagcccttctacagtgatgacaagatggcccaccacaccctgctgctgggcagcggccacgtgggcctgaggaacctgggcaacacctgcttcctgaatgctgtgctgcagtgcctgagcagcacccggcccctgcgggacttctgcctgcggcgggacttccggcaggaggtgcctgggggcggccgggcccaggagctgacagaggcctttgctgatgtgattggagccctgtggcacccagacagctgtgaggccgtgaaccccacccgcttccgggctgtgttccagaagtatgtgcccagcttcagcggctacagccagcaggatgcccaggagttcctgaagctgctgatggagcggctgcacctggagatcaacagaagaggccggcgggccccacccatcctggccaacggccctgtgcccagccccccccggcggggcggggccctgctggaggagcctgagctgagtgatgatgaccgggccaacctgatgtggaagcgctacctggagcgggaggacagcaagatcgtggacctgtttgtgggccagctgaagagctgcctgaagtgccaggcctgtggctaccgcagcaccacctttgaggtgttctgtgacctgagcctgcccatccccaagaagggctttgctgggggcaaggtgtccctgcgggactgcttcaacctcttcaccaaggaggaggagctggagagtgaaaatgcccctgtgtgtgaccgctgccggcagaagaccaggagcaccaagaagctgactgtgcagcgcttcccccgcatcctggtgctgcacctgaaccgcttcagcgccagccggggcagcatcaagaagagctctgtgggcgtggacttccccctgcagaggctgagcctgggggactttgccagtgacaaggccggctctgtgcactacggccactacacagccctgtgccgctgccagacaggctggcacgtgtacaatgacagccgggtgtcccctgtgtctgagaaccaggtggccagcagcgagggctacgtgctcttctaccagctgatgcaggagcccccacgctgcctgtag

SEQ ID NO: 175174 - DNA, 1698 bp, Artificial Sequence; identical to SEQ ID NO: 175172
  Description of Artificial Sequence: Synthetic coding sequence

SEQ ID NO: 175175 - DNA, 1578 bp, Artificial Sequence
  Description of Artificial Sequence: Synthetic coding sequence
atggtgtccaggcctgagcctgagggggaggccatggatgctgagctggccgtggcccctcctggctgcagccacctgggcagcttcaaggtggacaactggaagcagaacctgcgggccatctaccagtgctttgtgtggagcggcacagctgaggccaggaagaggaaggccaagagctgcatctgccacgtgtgtggggtgcacctgaaccggctgcacagctgcctgtactgtgtgttcttcggctgcttcaccaagaagcacatccatgaacatgccaaggccaagaggcacaacctggccatcgacctgatgtatggaggcatctactgcttcctgtgccaggactacatctatgacaaggacatggagatcatcgccaaggaggagcagaggaaggcctggaagatgcagggcgtgggggagaagttcagcacctgggagcccaccaagcgggagctggagctgctgaagcacaaccccaagaggaggaagatcaccagcaactgcaccatcggcctgcggggcctcatcaacctgggcaacacctgcttcatgaactgcatcgtgcaggccctgacccacacccccctgctgcgggacttcttcctgagtgacagacaccgctgtgagatgcagagccccagcagctgcctggtgtgtgagatgagcagcctcttccaggagttctacagcggccacaggagcccccacatcccctacaagctgctgcacctggtgtggacccacgcccggcacctggccggctatgagcagcaggatgcccacgagttcctgattgctgccctggatgtgctgcaccgccactgcaagggagatgacaatggcaagaaggccaacaaccccaaccactgcaactgcatcatcgaccagatcttcaccggcggcctgcagagtgatgtgacctgccaggtgtgccacggcgtgtccaccaccatcgaccccttctgggacatcagcctggacctgcccggcagcagcacccccttctggcccctgagccctggcagcgagggcaatgtggtgaatggagagagccacgtgtctggcaccaccaccctgacagactgcctgcggcgcttcaccaggcctgagcacctgggcagcagcgccaagatcaagtgcagcggctgccacagctaccaggagagcaccaagcagctgaccatgaagaagctgcccatcgtggcctgcttccacctgaagagatttgagcacagcgccaagctgcggaggaagatcaccacctacgtgtccttccccctggagctggacatgacccccttcatggccagcagcaaggagagcaggatgaatggccagtaccagcagcccacagacagcctgaacaatgacaacaagtacagcctgtttgctgtggtgaaccaccagggcaccctggagagcggccactacaccagcttcatccggcagcacaaggaccagtggttcaagtgtgatgatgccatcatcaccaaggccagcatcaaggatgtgctggacagcgagggctacctgctcttctaccacaagcagttcctggagtatgaatag

SEQ ID NO: 175176 - DNA, 1782 bp, Artificial Sequence
  Description of Artificial Sequence: Synthetic coding sequence
gctgctgctgcccggggccgctgcctgccctgcagcctgcccagcgccatcgcccagccccacctgtgcccagccagcgccctgtgcagcagaagacctggcctgggccagcccggccagccccccagcagcccccatgctgccctggccagcagcagcccccccagccccccacctccagcccggggccgggccctgccccccatggtgtccaggcctgagcctgagggggaggccatggatgctgagctggccgtggcccctcctggctgcagccacctgggcagcttcaaggtggacaactggaagcagaacctgcgggccatctaccagtgctttgtgtggagcggcacagctgaggccaggaagaggaaggccaagagctgcatctgccacgtgtgtggggtgcacctgaaccggctgcacagctgcctgtactgtgtgttcttcggctgcttcaccaagaagcacatccatgaacatgccaaggccaagaggcacaacctggccatcgacctgatgtatggaggcatctactgcttcctgtgccaggactacatctatgacaaggacatggagatcatcgccaaggaggagcagaggaaggcctggaagatgcagggcgtgggggagaagttcagcacctgggagcccaccaagcgggagctggagctgctgaagcacaaccccaagaggaggaagatcaccagcaactgcaccatcggcctgcggggcctcatcaacctgggcaacacctgcttcatgaactgcatcgtgcaggccctgacccacacccccctgctgcgggacttcttcctgagtgacagacaccgctgtgagatgcagagccccagcagctgcctggtgtgtgagatgagcagcctcttccaggagttctacagcggccacaggagcccccacatcccctacaagctgctgcacctggtgtggacccacgcccggcacctggccggctatgagcagcaggatgcccacgagttcctgattgctgccctggatgtgctgcaccgccactgcaagggagatgacaatggcaagaaggccaacaaccccaaccactgcaactgcatcatcgaccagatcttcaccggcggcctgcagagtgatgtgacctgccaggtgtgccacggcgtgtccaccaccatcgaccccttctgggacatcagcctggacctgcccggcagcagcacccccttctggcccctgagccctggcagcgagggcaatgtggtgaatggagagagccacgtgtctggcaccaccaccctgacagactgcctgcggcgcttcaccaggcctgagcacctgggcagcagcgccaagatcaagtgcagcggctgccacagctaccaggagagcaccaagcagctgaccatgaagaagctgcccatcgtggcctgcttccacctgaagagatttgagcacagcgccaagctgcggaggaagatcaccacctacgtgtccttccccctggagctggacatgacccccttcatggccagcagcaaggagagcaggatgaatggccagtaccagcagcccacagacagcctgaacaatgacaacaagtacagcctgtttgctgtggtgaaccaccagggcaccctggagagcggccactacaccagcttcatccggcagcacaaggaccagtggttcaagtgtgatgatgccatcatcaccaaggccagcatcaaggatgtgctggacagcgagggctacctgctcttctaccacaagcagttcctggagtatgaatag

SEQ ID NO: 175177 - DNA, 1542 bp, Artificial Sequence
  Description of Artificial Sequence: Synthetic coding sequence
atggcccctggctggcccagcctgtctgctggcagccggcaggaggccccccagctggccgccggcggcagcgcctaccaggccgtgggccggcagttccagccccgggccacagccctgcagggccccagccaggccaagagctgcatctgccacgtgtgtggggtgcacctgaaccggctgcacagctgcctgtactgtgtgttcttcggctgcttcaccaagaagcacatccatgaacatgccaaggccaagaggcacaacctggccatcgacctgatgtatggaggcatctactgcttcctgtgccaggactacatctatgacaaggacatggagatcatcgccaaggaggagcagaggaaggcctggaagatgcagggcgtgggggagaagttcagcacctgggagcccaccaagcgggagctggagctgctgaagcacaaccccaagaggaggaagatcaccagcaactgcaccatcggcctgcggggcctcatcaacctgggcaacacctgcttcatgaactgcatcgtgcaggccctgacccacacccccctgctgcgggacttcttcctgagtgacagacaccgctgtgagatgcagagccccagcagctgcctggtgtgtgagatgagcagcctcttccaggagttctacagcggccacaggagcccccacatcccctacaagctgctgcacctggtgtggacccacgcccggcacctggccggctatgagcagcaggatgcccacgagttcctgattgctgccctggatgtgctgcaccgccactgcaagggagatgacaatggcaagaaggccaacaaccccaaccactgcaactgcatcatcgaccagatcttcaccggcggcctgcagagtgatgtgacctgccaggtgtgccacggcgtgtccaccaccatcgaccccttctgggacatcagcctggacctgcccggcagcagcacccccttctggcccctgagccctggcagcgagggcaatgtggtgaatggagagagccacgtgtctggcaccaccaccctgacagactgcctgcggcgcttcaccaggcctgagcacctgggcagcagcgccaagatcaagtgcagcggctgccacagctaccaggagagcaccaagcagctgaccatgaagaagctgcccatcgtggcctgcttccacctgaagagatttgagcacagcgccaagctgcggaggaagatcaccacctacgtgtccttccccctggagctggacatgacccccttcatggccagcagcaaggagagcaggatgaatggccagtaccagcagcccacagacagcctgaacaatgacaacaagtacagcctgtttgctgtggtgaaccaccagggcaccctggagagcggccactacaccagcttcatccggcagcacaaggaccagtggttcaagtgtgatgatgccatcatcaccaaggccagcatcaaggatgtgctggacagcgagggctacctgctcttctaccacaagcagttcctggagtatgaatag

SEQ ID NO: 175178 - DNA, 7863 bp, Artificial Sequence
  Description of Artificial Sequence: Synthetic coding sequence
atggagagcgaggaggagcagcacatgaccaccctgctgtgcatgggcttcagtgaccctgccaccatcaggaaggccctgcggctggccaagaatgacatcaatgaagctgtggccctgctgaccaatgaaagacctggcctggactatggaggctatgagcccatggacagcggcggcggccccagccctggccctgggggcggccccagaggagatggcggcggagatggcggcggcggcggccccagccggggcggcagcactggaggcggcggcggctttgatcctcctccagcctaccacgaggtggtggatgctgagaagaatgatgaaaatggaaactgcagcggggagggcatcgagttccccaccaccaacctgtatgagctggagagccgggtgctgacagaccactggagcatcccctacaagcgggaggagagcctgggcaagtgcctgctggccagcacctacctggcccggctgggcctgtctgagagtgatgagaactgccgccgcttcatggaccgctgcatgcctgaggccttcaagaagctgctgaccagcagcgctgtgcacaagtggggcacagagatccacgagggcatctacaacatgctgatgctgctgattgagctggtggccgagcgcatcaagcaggaccccatccccaccggcctgctgggcgtgctgaccatggccttcaacccagacaatgagtaccacttcaagaacaggatgaaggtgtcccagaggaactgggccgaggtgtttggagagggcaacatgtttgctgtgtcccctgtgtccaccttccagaaggagccccacggctgggtggtggacctggtgaacaagtttggagagctgggcggctttgctgccatccaggccaagctgcacagcgaggacatcgagctgggcgctgtgtctgccctgatccagcccctgggcgtgtgtgccgagtacctgaacagctctgtggtgcagcccatgctggaccccgtcatcctgaccaccatccaggatgtgcgctctgtggaggagaaggacctgaaggacaagaggctggtgtccatccctgagctgctgtctgctgtgaagctgctgtgcatgaggttccagcctgacctggtgaccatcgtggatgacctgcggctggacatcctgctgaggatgctgaagagcccccacttcagcgccaagatgaacagcctgaaggaggtgaccaagctgattgaggacagcaccctgagcaagtctgtgaagaatgccatcgacacagaccggctgctggactggctggtggagaacagcgtgctgagcatcgccctggagggcaacatcgaccaggcccagtactgtgaccgcatcaagggcatcatcgagctgctgggcagcaagctgagcctggatgagctgaccaagatctggaagatccagagcggccagagcagcacagtgattgagaacatccacaccatcatcgctgctgctgctgtgaagttcaacagcgaccagctgaaccacctgtttgtgctgatccagaagtcctgggagacagaaagtgacagagtgcggcagaagctgctgagcctgattggccgcatcggccgggaggccaggtttgagaccaccagcggcaaggtgctggatgtgctgtgggagctggcccacctgcccaccctgcccagcagcctcatccagcaggccctggaggagcacctgaccatcctgagtgatgcctatgctgtgaaggaggccatcaagaggagctacatcatcaagtgcatcgaggacatcaagaggcctggagagtggagcggcctggagaagaacaagaaggatggcttcaagagcagccagctgaacaacccccagtttgtgtgggtggtgcctgccctgcggcagctgcacgagatcaccaggagcttcatcaagcagacctaccagaagcaggacaagagcatcatccaggacctgaagaagaactttgagatcgtgaagctggtgacaggcagcctgattgcctgccaccggctggccgctgctgtggccggccctgggggcctgagcggcagcaccctggtggatggccgctacacctaccgggagtacctggaggcccacctgaagttcctggccttcttcctgcaggaggccaccctgtacctgggctggaacagagccaaggagatctgggagtgcctggtgacaggccaggatgtgtgtgagctggaccgggagatgtgctttgagtggttcaccaagggccagcacgacctggagagtgatgtgcagcagcagctgttcaaggagaagatcctgaagctggagagctatgagatcaccatgaatggcttcaacctcttcaagaccttctttgaaaatgtgaacctgtgtgaccaccggctgaagaggcagggcgcccagctgtatgtggagaagctggagctgattggcatggacttcatctggaagatcgccatggagagcccagatgaggagatcgccaatgaggccatccagctgatcatcaactacagctacatcaacctgaacccccggctgaagaaggacagcgtgtccctgcacaagaagttcatcgctgactgctacacccggctggaggccgccagcagcgccctgggcggccccaccctgacccatgctgtgacccgggccaccaagatgctgacagccacagccatgcccaccgtggccacctctgtgcagagcccctaccgcagcaccaagctggtgatcatcgagcggctgctgctgctggccgagcgctacgtgatcaccatcgaggacttctacagcgtgcccaggaccatcctgccccatggagccagcttccacggccacctgctgaccctgaatgtgacctatgagagcaccaaggacaccttcaccgtggaggcccacagcaatgagaccatcggctctgtgcgctggaagatcgccaagcagctgtgcagccctgtggacaacatccagatcttcaccaatgacagcctgctgactgtgaacaaggaccagaagctgctgcaccagctgggcttcagtgatgagcagatcctgactgtgaagaccagcggcagcggcaccccatctggcagcagcgctgacagcagcaccagcagcagcagcagcagcagcggggtcttcagcagcagctatgccatggagcaggagaagagcctgcccggggtggtgatggccctggtgtgcaatgtgtttgacatgctgtaccagctggccaacctggaggagccccgcatcaccctgcgggtgaggaagctgctgctgctgatccccacagatcctgccatccaggaggccctggaccagctggacagcctgggcaggaagaagaccctgctgtctgagagcagcagccagagcagcaagagccccagcctgagcagcaagcagcagcaccagcccagcgccagcagcatcctggagagcctcttccgcagctttgcccctggcatgagcaccttccgggtgctgtacaacctggaggtgctgagcagcaagctgatgcccacagcagatgatgacatggcccggagctgtgccaagagcttctgtgagaacttcctgaaggccggcggcctgagcctggtggtgaatgtgatgcagagggacagcatccccagcgaggtggactatgagacccggcagggcgtgtacagcatctgcctgcagctggcccgcttcctgctggtgggccagaccatgcccaccctgctggatgaggacctgaccaaggatggcatcgaggccctgagcagccggcccttcagaaatgtgtcccggcagaccagccggcagatgagcctgtgtggcaccccagagaagagcagctaccggcagctgtctgtgtctgacaggagcagcatccgggtggaggagatcatcccagctgcccgggtggccatccagaccatggaggtgtctgacttcaccagcacagtggcctgcttcatgaggctgtcctgggccgctgctgctggccgcctggacctggtgggcagcagccagcccatcaaggagagcaacagcctgtgcccagctggcatccggaaccggctgagcagcagcggcagcaactgcagcagcggcagcgagggggagcctgtggccctgcacgccggcatctgtgtgcggcagcagagcgtgtccaccaaggacagcctgattgctggggaggccctgagcctgctggtgacctgcctgcagctgcggagccagcagctggccagcttctacaacctgccctgtgtggccgacttcatcatcgacatcctgctgggcagccccagcgctgagatcagaagagtggcctgtgaccagctgtacaccctgagccagacagacaccagcgcccacccagatgtgcagaagcccaaccagttcctgctgggcgtcatcctgacagcccagctgcccctgtggagccccaccagcatcatgagaggagtgaaccagaggctgctgagccagtgcatggagtactttgacctgcgctgccagctgctggatgacctgaccaccagcgagatggagcagctgcgcatcagccctgccaccatgctggaggatgagatcacctggctggacaactttgagcccaacagaacagcagaatgtgagaccagcgaggccgacaacatcctgctggccggccacctgcggctcatcaagaccctgctgagcctgtgtggggctgagaaggagatgctgggcagcagcctcatcaagcccctgctggatgacttcctgttccgggccagccgcatcatcctgaacagccacagccctgctggcagcgctgccatcagccagcaggacttccaccccaagtgcagcacagccaacagccggctggccgcctatgaggtgctggtgatgctggccgacagcagccccagcaacctgcagatcatcatcaaggagctgctgtccatgcaccaccagcctgaccctgccctgaccaaggagtttgactacctgccccctgtggacagccgcagcagcagcggctttgtgggcctgagaaatggaggagccacctgctacatgaatgctgtgttccagcagctgtacatgcagcccggcctgcctgagagcctgctgtctgtggatgatgacacagacaacccagatgacagcgtcttctaccaggtgcagagcctgtttggccacctgatggagagcaagctgcagtactacgtgcctgagaacttctggaagatcttcaagatgtggaacaaggagctgtatgtgcgggagcagcaggatgcctatgagttcttcaccagcctgattgaccagatggatgagtacctgaagaagatgggccgggaccagatcttcaagaacaccttccagggcatctacagcgaccagaagatctgcaaggactgcccccacagatatgagcgggaggaggccttcatggccctgaacctgggcgtgaccagctgccagagcctggagatcagcctggaccagtttgtgcggggggaggtgctggagggcagcaatgcctactactgtgagaagtgcaaggagaagaggatcaccgtgaagaggacctgcatcaagagcctgcccagcgtgctggtgatccacctgatgagatttggatttgactgggagagcggccgcagcatcaagtatgatgagcagatccgcttcccctggatgctgaacatggagccctacacagtgtctggcatggcccggcaggacagcagcagcgaggtgggagaaaatggccgctctgtggaccagggcggcggcggcagccccaggaagaaggtggccctgacagagaactatgagctggtgggcgtcatcgtgcacagcggccaggcccacgccggccactactacagcttcatcaaggaccggcggggctgtgggaagggcaagtggtacaagttcaatgacaccgtcatcgaggagtttgacctgaatgatgagaccctggagtatgaatgttttggaggagagtaccggcccaaggtgtatgaccagaccaacccctacacagatgtgagaagacgctactggaatgcctacatgctgttctaccagagggtgtctgaccagaacagccctgtgctgcccaagaagagccgggtgtctgtggtgcggcaggaggccgaggacctgagcctgagcgcccccagcagccctgagatcagcccccagagcagcccccggccccaccggcccaacaatgaccggctgagcatcctgaccaagctggtgaagaagggggagaagaagggcctgtttgtggagaagatgcctgcccgcatctaccagatggtgagagatgagaacctgaagttcatgaagaacagagatgtgtacagcagtgactacttctcctttgtgctgagcctggccagcctgaatgccaccaagctgaagcacccctactacccctgcatggccaaggtgtccctgcagctggccatccagttcctgttccagacctacctgcggaccaagaagaagctgcgggtggacacagaggagtggatcgccaccatcgaggccctgctgagcaagagctttgatgcctgccagtggctggtggagtacttcatcagcagcgagggccgggagctgatcaagatcttcctgctggagtgcaatgtgcgggaggtgcgggtggccgtggccaccatcctggagaagaccctggacagcgccctcttctaccaggacaagctgaagagcctgcaccagctgctggaggtgctgctggccctgctggacaaggatgtgcctgagaactgcaagaactgtgcccagtacttcttcctgttcaacacctttgtgcagaagcagggcatccgggccggggacctgctgctgcggcacagcgccctgcggcacatgatctccttcctgctgggcgccagccggcagaacaaccagatccgccgctggagcagcgcccaggcccgggagtttggaaacctgcacaacacagtggccctgctggtgctgcacagtgatgtgagcagccagagaaatgtggcccctggcatcttcaagcagaggcctcccatcagcatcgcccccagcagccccctgctgcccctgcacgaggaggtggaggccctgctcttcatgtctgagggcaagccctacctgctggaggtgatgtttgccctgcgggagctgaccggcagcctgctggccctgattgagatggtggtgtactgctgcttctgcaatgagcacttctccttcaccatgctgcacttcatcaagaaccagctggagacagcccctcctcatgagctgaagaacaccttccagctgctgcacgagatcctggtgattgaggaccccatccaggtggagcgggtgaagtttgtgtttgaaacagaaaatggcctgctggccctgatgcaccacagcaaccacgtggacagcagccgctgctaccagtgtgtgaagttcctggtgaccctggcccagaagtgcccagctgccaaggagtacttcaaggagaacagccaccactggagctgggccgtgcagtggctgcagaagaagatgtctgagcactactggaccccccagagcaatgtgtccaatgagaccagcacaggcaagaccttccagaggaccatcagcgcccaggacaccctggcctatgccacagccctgctgaatgagaaggagcagagcggcagcagcaatggaagtgagagcagccctgccaatgaaaatggagacagacacctgcagcagggcagcgagagccccatgatgattggagagctgcggagtgacctggatgatgtggacccctag

SEQ ID NO: 175179 - DNA, 7383 bp, Artificial Sequence
  Description of Artificial Sequence: Synthetic coding sequence
atgaccaccctgctgtgcatgggcttcagtgaccctgccaccatcaggaaggccctgcggctggccaagaatgacatcaatgaagctgtggccctgctgaccaatgaaagacctggcctggactatggaggctatgagcccatggacagcggcggcctgtctgagagtgatgagaactgccgccgcttcatggaccgctgcatgcctgaggccttcaagaagctgctgaccagcagcgctgtgcacaagtggggcacagagatccacgagggcatctacaacatgctgatgctgctgattgagctggtggccgagcgcatcaagcaggaccccatccccaccggcctgctgggcgtgctgaccatggccttcaacccagacaatgagtaccacttcaagaacaggatgaaggtgtcccagaggaactgggccgaggtgtttggagagggcaacatgtttgctgtgtcccctgtgtccaccttccagaaggagccccacggctgggtggtggacctggtgaacaagtttggagagctgggcggctttgctgccatccaggccaagctgcacagcgaggacatcgagctgggcgctgtgtctgccctgatccagcccctgggcgtgtgtgccgagtacctgaacagctctgtggtgcagcccatgctggaccccgtcatcctgaccaccatccaggatgtgcgctctgtggaggagaaggacctgaaggacaagaggctggtgtccatccctgagctgctgtctgctgtgaagctgctgtgcatgaggttccagcctgacctggtgaccatcgtggatgacctgcggctggacatcctgctgaggatgctgaagagcccccacttcagcgccaagatgaacagcctgaaggaggtgaccaagctgattgaggacagcaccctgagcaagtctgtgaagaatgccatcgacacagaccggctgctggactggctggtggagaacagcgtgctgagcatcgccctggagggcaacatcgaccaggcccagtactgtgaccgcatcaagggcatcatcgagctgctgggcagcaagctgagcctggatgagctgaccaagatctggaagatccagagcggccagagcagcacagtgattgagaacatccacaccatcatcgctgctgctgctgtgaagttcaacagcgaccagctgaaccacctgtttgtgctgatccagaaggtgctggatgtgctgtgggagctggcccacctgcccaccctgcccagcagcctcatccagcaggccctggaggagcacctgaccatcctgagtgatgcctatgctgtgaaggaggccatcaagaggagctacatcatcaagtgcatcgaggacatcaagaggagcagccagctgaacaacccccagtttgtgtgggtggtgcctgccctgcggcagctgcacgagatcaccaggagcttcatcaagcagacctaccagaagcaggacaagagcatcatccaggacctgaagaagaactttgagatcgtgaagctggtgacaggcagcctgattgcctgccaccggctggccgctgctgtggccggccctgggggcctgagcggcagcaccctggtggatggccgctacacctaccgggagtacctggaggcccacctgaagttcctggccttcttcctgcaggaggccaccctgtacctgggctggaacagagccaaggagatctgggagtgcctggtgacaggccaggatgtgtgtgagctggaccgggagatgtgctttgagtggttcaccaagggccagcacgacctggagagtgatgtgcagcagcagctgttcaaggagaagatcctgaagctggagagctatgagatcaccatgaatggcttcaacctcttcaagaccttctttgaaaatgtgaacctgtgtgaccaccggctgaagaggcagggcgcccagctgtatgtggagaagctggagctgattggcatggacttcatctggaagatcgccatggagagcccagatgaggagatcgccaatgaggccatccagctgatcatcaactacagctacatcaacctgaacccccggctgaagaaggacagcgtgtccctgcacaagaagttcatcgctgactgctacacccggctggaggccgccagcagcgccctgggcggccccaccctgacccatgctgtgacccgggccaccaagatgctgacagccacagccatgcccaccgtggccacctctgtgcagagcccctaccgcagcaccaagctggtgatcatcgagcggctgctgctgctggccgagcgctacgtgatcaccatcgaggacttctacagcgtgcccaggaccatcctgccccatggagccagcttccacggccacctgctgaccctgaatgtgacctatgagagcaccaaggacaccttcaccgtggaggcccacagcaatgagaccatcggctctgtgcgctggaagatcgccaagcagctgtgcagccctgtggacaacatccagatcttcaccaatgacagcctgctgactgtgaacaaggaccagaagctgctgcaccagctgggcttcagtgatgagcagatcctgactgtgaagaccagcggcagcggcaccccatctggcagcagcgctgacagcagcaccagcagcagcagcagcagcagcggggtcttcagcagcagctatgccatggagcaggagaagagcctgcccggggtggtgatggccctggtgtgcaatgtgtttgacatgctgtaccagctggccaacctggaggagccccgcatcaccctgcgggtgaggaagctgctgctgctgatccccacagatcctgccatccaggaggccctggaccagctggacagcctgggcaggaagaagaccctgctgtctgagagcagcagccagagcagcaagagccccagcctgagcagcaagcagcagcaccagcccagcgccagcagcatcctggagagcctcttccgcagctttgcccctggcatgagcaccttccgggtgctgtacaacctggaggtgctgagcagcaagctgatgcccacagcagatgatgacatggcccggagctgtgccaagagcttctgtgagaacttcctgaaggccggcggcctgagcctggtggtgaatgtgatgcagagggacagcatccccagcgaggtggactatgagacccggcagggcgtgtacagcatctgcctgcagctggcccgcttcctgctggtgggccagaccatgcccaccctgctggatgaggacctgaccaaggatggcatcgaggccctgagcagccggcccttcagaaatgtgtcccggcagaccagccggcagatgagcctgtgtggcaccccagagaagagcagctaccggcagctgtctgtgtctgacaggagcagcatccgggtggaggagatcatcccagctgcccgggtggccatccagaccatggaggtgtctgacttcaccagcacagtggcctgcttcatgaggctgtcctgggccgctgctgctggccgcctggacctggtgggcagcagccagcccatcaaggagagcaacagcctgtgcccagctggcatccggaaccggctgagcagcagcggcagcaactgcagcagcggcagcgagggggagcctgtggccctgcacgccggcatctgtgtgcggcagcagagcgtgtccaccaaggacagcctgattgctggggaggccctgagcctgctggtgacctgcctgcagctgcggagccagcagctggccagcttctacaacctgccctgtgtggccgacttcatcatcgacatcctgctgggcagccccagcgctgagatcagaagagtggcctgtgaccagctgtacaccctgagccagacagacaccagcgcccacccagatgtgcagaagcccaaccagttcctgctgggcgtcatcctgacagcccagctgcccctgtggagccccaccagcatcatgagaggagtgaaccagaggctgctgagccagtgcatggagtactttgacctgcgctgccagctgctggatgacctgaccaccagcgagatggagcagctgcgcatcagccctgccaccatgctggaggatgagatcacctggctggacaactttgagcccaacagaacagcagaatgtgagaccagcgaggccgacaacatcctgctggccggccacctgcggctcatcaagaccctgctgagcctgtgtggggctgagaaggagatgctgggcagcagcctcatcaagcccctgctggatgacttcctgttccgggccagccgcatcatcctgaacagccacagccctgctggcagcgctgccatcagccagcaggacttccaccccaagtgcagcacagccaacagccggctggccgcctatgaggtgctggtgatgctggccgacagcagccccagcaacctgcagatcatcatcaaggagctgctgtccatgcaccaccagcctgaccctgccctgaccaaggagtttgactacctgccccctgtggacagccgcagcagcagcggctttgtgggcctgagaaatggaggagccacctgctacatgaatgctgtgttccagcagctgtacatgcagcccggcctgcctgagagcctgctgtctgtggatgatgacacagacaacccagatgacagcgtcttctaccaggtgcagagcctgtttggccacctgatggagagcaagctgcagtactacgtgcctgagaacttctggaagatcttcaagatgtggaacaaggagctgtatgtgcgggagcagcaggatgcctatgagttcttcaccagcctgattgaccagatggatgagtacctgaagaagatgggccgggaccagatcttcaagaacaccttccagggcatctacagcgaccagaagatctgcaaggactgcccccacagatatgagcgggaggaggccttcatggccctgaacctgggcgtgaccagctgccagagcctggagatcagcctggaccagtttgtgcggggggaggtgctggagggcagcaatgcctactactgtgagaagtgcaaggagaagaggatcaccgtgaagaggacctgcatcaagagcctgcccagcgtgctggtgatccacctgatgagatttggatttgactgggagagcggccgcagcatcaagtatgatgagcagatccgcttcccctggatgctgaacatggagccctacacagtgtctggcatggcccggcaggacagcagcagcgaggtgggagaaaatggccgctctgtggaccagggcggcggcggcagccccaggaagaaggtggccctgacagagaactatgagctggtgggcgtcatcgtgcacagcggccaggcccacgccggccactactacagcttcatcaaggaccggcggggctgtgggaagggcaagtggtacaagttcaatgacaccgtcatcgaggagtttgacctgaatgatgagaccctggagtatgaatgttttggaggagagtaccggcccaaggtgtatgaccagaccaacccctacacagatgtgagaagacgctactggaatgcctacatgctgttctaccagagggtgtctgaccagaacagccctgtgctgcccaagaagagccgggtgtctgtggtgcggcaggaggccgaggacctgagcctgagcgcccccagcagccctgagatcagcccccagagcagcccccggccccaccggcccaacaatgaccggctgagcatcctgaccaagctggtgaagaagggggagaagaagggcctgtttgtggagaagatgcctgcccgcatctaccagatggtgagagatgagaacctgaagttcatgaagaacagagatgtgtacagcagtgactacttctcctttgtgctgagcctggccagcctgaatgccaccaagctgaagcacccctactacccctgcatggccaaggtgtccctgcagctggccatccagttcctgttccagacctacctgcggaccaagaagaagctgcgggtggacacagaggagtggatcgccaccatcgaggccctgctgagcaagagctttgatgcctgccagtggctggtggagtacttcatcagcagcgagggccgggagctgatcaagatcttcctgctggagtgcaatgtgcgggaggtgcgggtggccgtggccaccatcctggagaagaccctggacagcgccctcttctaccaggacaagctgaagagcctgcaccagctgctggaggtgctgctggccctgctggacaaggatgtgcctgagaactgcaagaactgtgcccagtacttcttcctgttcaacacctttgtgcagaagcagggcatccgggccggggacctgctgctgcggcacagcgccctgcggcacatgatctccttcctgctgggcgccagccggcagaacaaccagatccgccgctggagcagcgcccaggcccgggagtttggaaacctgcacaacacagtggccctgctggtgctgcacagtgatgtgagcagccagagaaatgtggcccctggcatcttcaagcagaggcctcccatcagcatcgcccccagcagccccctgctgcccctgcacgaggaggtggaggccctgctcttcatgtctgagggcaagccctacctgctggaggtgatgtttgccctgcgggagctgaccggcagcctgctggccctgattgagatggtggtgtactgctgcttctgcaatgagcacttctccttcaccatgctgcacttcatcaagaaccagctggagacagcccctcctcatgagctgaagaacaccttccagctgctgcacgagatcctggtgattgaggaccccatccaggtggagcgggtgaagtttgtgtttgaaacagaaaatggcctgctggccctgatgcaccacagcaaccacgtggacagcagccgctgctaccagtgtgtgaagttcctggtgaccctggcccagaagtgcccagctgccaaggagtacttcaaggagaacagccaccactggagctgggccgtgcagtggctgcagaagaagatgtctgagcactactggaccccccagagcaatgtgtccaatgagaccagcacaggcaagaccttccagaggaccatcagcgcccaggacaccctggcctatgccacagccctgctgaatgagaaggagcagagcggcagcagcaatggaagtgagagcagccctgccaatgaaaatggagacagacacctgcagcagggcagcgagagccccatgatgattggagagctgcggagtgacctggatgatgtggacccctag

SEQ ID NO: 175180 - DNA, 2742 bp, Artificial Sequence
  Description of Artificial Sequence: Synthetic coding sequence
atggccgccctcttcctgcggggctttgtgcagatcggcaactgcaagacaggcatcagcaagagcaaggaggccttcattgaagctgtggagaggaagaagaaggaccggctggtgctgtacttcaagagcggcaagtacagcaccttccggctgagtgacaacatccagaatgtggtgctgaagagctaccggggcaaccagaaccacctgcacctgaccctgcagaacaacaacggcctcttcatcgagggcctgagcagcacagatgctgagcagctgaagatcttcctggacagagtgcaccagaatgaggtgcagccccctgtgcggcctgggaagggcggctctgtgttcagcagcaccacccagaaggagatcaacaagaccagcttccacaaggtggatgagaagagcagcagcaagagctttgagatcgccaagggcagcggcaccggggtgctgcagaggatgcccctgctgaccagcaagctgaccctgacctgtggggagctgtctgagaaccagcacaagaagaggaagaggatgctgagcagcagcagcgagatgaatgaggagttcctgaaggagaacaacagcgtggagtacaagaagagcaaggctgactgcagccgctgtgtgtcctacaaccgggagaagcagctgaagctgaaggagctggaggagaacaagaagctggagtgtgagagcagctgcatcatgaatgccaccggcaacccctacctggatgacatcggcctgctgcaggccctgacagagaagatggtgctggtgttcctgctgcagcagggctacagtgatggctacaccaagtgggacaagctgaagctgttctttgagctgtttcctgagaagatctgccacggcctgcccaacctgggcaacacctgctacatgaatgctgtgctgcagagcctgctgagcatccccagctttgctgatgacctgctgaaccagagcttcccctggggcaagatccccctgaatgccctgaccatgtgcctggcccggctgctcttcttcaaggacacctacaacatcgagatcaaggagatgctgctgctgaacctgaagaaggccatctctgctgctgctgagatcttccacggcaatgcccagaatgatgcccacgagttcctggcccactgcctggaccagctgaaggacaacatggagaagctgaacaccatctggaagcccaagtcagaatttggagaggacaacttccccaagcaggtgtttgctgatgatcctgacaccagcggcttcagctgccctgtgatcaccaactttgagctggagctgctgcacagcatcgcctgcaaggcctgtggccaggtgatcctgaagacagagctgaacaactacctgagcatcaacctgccccagaggatcaaggcccaccccagcagcatccagagcacctttgacctcttctttggagctgaggagctggagtacaagtgtgccaagtgtgagcacaagacctctgtgggcgtgcacagcttcagccggctgccccgcatcctgattgtgcacctgaagcgctacagcctgaatgagttctgtgccctgaagaagaatgaccaggaggtgatcatcagcaagtacctgaaggtgagcagccactgcaatgaaggcaccaggcctcccctgcccctgtctgaagatggagagatcacagacttccagctgctgaaggtgatcaggaagatgaccagcggcaacatctctgtgtcctggccagccaccaaggagagcaaggacatcctggccccccacatcggcagtgacaaggagagcgagcagaagaagggccagacagtgttcaagggggccagccggcggcagcagcagaagtacctgggcaagaacagcaagcccaatgagctggagagcgtgtacagcggggaccgggccttcatcgagaaggagcccctggcccacctgatgacctacctggaggacaccagcctgtgccagttccacaaggccggcggcaagccagccagcagccctggcacccccctgagcaaggtggacttccagacagtgcctgagaaccccaagaggaagaagtatgtgaagaccagcaagtttgtggcctttgaccgcatcatcaaccccaccaaggacctgtatgaggacaagaacatccgcatccctgagcgcttccagaaggtgtctgagcagacccagcagtgtgatggcatgaggatctgtgagcaggccccccagcaggccctgccccagagcttccccaagccaggcacccagggccacaccaagaacctgctgcggcccaccaagctgaacctgcagaagagcaacagaaacagcctgctggccctgggcagcaacaagaaccccaggaacaaggacatcctggacaagatcaagagcaaggccaaggagaccaagagaaatgatgacaagggggaccacacctaccgcctcatctctgtggtgagccacctgggcaagaccctgaagagcggccactacatctgtgatgcctatgactttgagaagcagatctggttcacctatgatgacatgagggtgctgggcatccaggaggcccagatgcaggaggaccggcgctgcaccggctacatcttcttctacatgcacaatgagatctttgaggagatgctgaagcgggaggagaatgcccagctgaacagcaaggaggtggaggagaccctgcagaaggagtag

SEQ ID NO: 175181 - DNA, 2742 bp, Artificial Sequence; identical to SEQ ID NO: 175180
  Description of Artificial Sequence: Synthetic coding sequence

SEQ ID NO: 175182 - DNA, 3234 bp, Artificial Sequence
  Description of Artificial Sequence: Synthetic coding sequence
atgacagctgagctgcagcaggatgatgctgctggagctgctgatggccacggcagcagctgccagatgctgctgaaccagctgcgggagatcaccggcatccaggaccccagcttcctgcacgaggccctgaaggccagcaatggagacatcacccaggccgtgtccctgctgacagatgagcgggtgaaggagcccagccaggacacagtggccacagagcccagcgaggtggagggcagcgctgccaacaaggaggtgctggccaaggtgattgacctgacccatgacaacaaggatgacctgcaggccgccatcgccctgagcctgctggagagccccaagatccaggctgatggccgggacctgaacaggatgcatgaggccaccagcgctgagaccaagaggagcaagaggaagagatgtgaggtgtggggcgagaaccccaaccccaatgactggaggagagtggatggctggcctgtgggcctgaagaatgtgggcaacacctgctggttctctgctgtgatccagagcctcttccagctgcctgagttccggcggctggtgctgagctacagcctgccccagaatgtgctggagaactgccgcagccacacagagaagaggaacatcatgttcatgcaggagctgcagtacctgtttgccctgatgatgggcagcaacaggaagtttgtggaccccagcgctgccctggacctgctgaagggggccttccgcagcagcgaggagcagcagcaggatgtgtctgagttcacccacaagctgctggactggctggaggatgccttccagctggccgtgaatgtgaacagccccaggaacaagtctgagaaccccatggtgcagctgttctacggcaccttcctgacagagggcgtgcgggagggcaagcccttctgcaacaatgagaccttcggccagtaccccctgcaggtgaatggctacagaaacctggatgagtgcctggagggcgccatggtggagggagatgtggagctgctgcccagcgaccacagcgtgaagtatggccaggagcgctggttcaccaagctgccccctgtgctgacctttgagctgagcagatttgagttcaaccagagcctgggccagcctgagaagatccacaacaagctggagttcccccagatcatctacatggaccgctacatgtaccgcagcaaggagctgatccggaacaagcgggagtgcatcaggaagctgaaggaggagatcaagatcctgcagcagaagctggagagatatgtgaagtatggcagcggccctgcccgcttccccctgcctgacatgctgaagtatgtgattgaatttgccagcaccaagccagccagcgagagctgccccccagagagtgacacccacatgaccctgcccctgagctctgtgcactgcagcgtgtctgaccagaccagcaaggagagcaccagcacagagagcagcagccaggatgtggagagcaccttcagcagccctgaggacagcctgcccaagagcaagcccctgaccagcagccgcagctccatggagatgcccagccagcctgcccccaggacagtgacagatgaggagatcaactttgtgaagacctgcctgcagcgctggaggagtgaaattgagcaggacatccaggacctgaagacctgcatcgccagcaccacccagaccatcgagcagatgtactgtgaccccctgctgcggcaggtgccctaccgcctgcatgctgtgctggtgcatgagggccaggccaatgccggccactactgggcctacatctacaaccagccccggcagagctggctgaagtacaatgacatctctgtgacagagagctcctgggaggaggtggagcgggacagctatggaggcctgagaaatgtgtctgcctactgcctgatgtacatcaatgacaagctgccctacttcaatgctgaggccgcccccacagaaagtgaccagatgtctgaggtggaggccctgtctgtggagctgaagcactacatccaggaggacaactggaggtttgagcaggaggtggaggagtgggaggaggagcagagctgcaagatcccccagatggagagcagcaccaacagcagcagccaggactacagcaccagccaggagcccagcgtggccagcagccatggagtgcgctgcctgagcagcgagcacgctgtgattgtgaaggagcagacagcccaggccatcgccaacacagcccgggcctatgagaagagcggcgtggaggccgccctgtctgaggtgatgctgagccctgccatgcagggcgtcatcctggccatcgccaaggcccggcagacctttgacagagatggcagcgaggccggcctcatcaaggccttccacgaggagtacagccggctgtaccagctggccaaggagacccccaccagccacagcgacccccggctgcagcacgtgctggtgtacttcttccagaatgaggcccccaagagggtggtggagaggaccctgctggagcagtttgctgacaagaacctgtcctatgatgagaggagcatcagcatcatgaaggtggcccaggccaagctgaaggagattggaccagatgacatgaacatggaggagtacaagaagtggcatgaggactacagcctcttcaggaaggtgtctgtgtacctgctgaccggcctggagctgtaccagaagggcaagtaccaggaggccctgagctacctggtgtatgcctaccagagcaatgctgccctgctgatgaagggccccaggagaggagtgaaggagagcgtgattgccctgtacagaaggaagtgcctgctggagctgaatgccaaggccgccagcctgtttgagaccaatgatgaccacagcgtgacagagggcatcaacgtgatgaatgagctgatcatcccctgcatccacctgatcatcaacaatgacatcagcaaggatgacctggatgccatcgaggtgatgaggaaccactggtgcagctacctgggccaggacattgctgagaacctgcagctgtgcctgggggagttcctgccccggctgctggaccccagcgctgagatcatcgtgctgaaggagccccccaccatccggcccaacagcccctatgacctgtgcagcagatttgctgctgtgatggagagcatccagggcgtgtccacagtgacagtgaagtag

SEQ ID NO: 175183 - DNA, 3138 bp, Artificial Sequence
  Description of Artificial Sequence: Synthetic coding sequence
atgacagctgagctgcagcaggatgatgctgctggagctgctgatggccacggcagcagctgccagatgctgctgaaccagctgcgggagatcaccggcatccaggaccccagcttcctgcacgaggccctgaaggccagcaatggagacatcacccaggccgtgtccctgctgacagatgagcgggtgaaggagcccagccaggacacagtggccacagagcccagcgaggtggagggcagcgctgccaacaaggaggtgctggccaaggtgattgacctgacccatgacaacaaggatgacctgcaggccgccatcgccctgagcctgctggagagccccaagatccaggctgatggccgggacctgaacaggatgcatgaggccaccagcgctgagaccaagaggagcaagaggaagagatgtgaggtgtggggcgagaaccccaaccccaatgactggaggagagtggatggctggcctgtgggcctgaagaatgtgggcaacacctgctggttctctgctgtgatccagagcctcttccagctgcctgagttccggcggctggtgctgagctacagcctgccccagaatgtgctggagaactgccgcagccacacagagaagaggaacatcatgttcatgcaggagctgcagtacctgtttgccctgatgatgggcagcaacaggaagtttgtggaccccagcgctgccctggacctgctgaagggggccttccgcagcagcgaggagcagcagcaggatgtgtctgagttcacccacaagctgctggactggctggaggatgccttccagctggccgtgaatgtgaacagccccaggaacaagtctgagaaccccatggtgcagctgttctacggcaccttcctgacagagggcgtgcgggagggcaagcccttctgcaacaatgagaccttcggccagtaccccctgcaggtgaatggctacagaaacctggatgagtgcctggagggcgccatggtggagggagatgtggagctgctgcccagcgaccacagcgtgaagtatggccaggagcgctggttcaccaagctgccccctgtgctgacctttgagctgagcagatttgagttcaaccagagcctgggccagcctgagaagatccacaacaagctggagttcccccagatcatctacatggaccgctacatgtaccgcagcaaggagctgatccggaacaagcgggagtgcatcaggaagctgaaggaggagatcaagatcctgcagcagaagctggagagatatgtgaagtatggcagcggccctgcccgcttccccctgcctgacatgctgaagtatgtgattgaatttgccagcaccaagccagccagcgagagctgccccccagagagtgacacccacatgaccctgcccctgagctctgtgcactgcagcgtgtctgaccagaccagcaaggagagcaccagcacagagagcagcagccaggatgtggagagcaccttcagcagccctgaggacagcctgcccaagagcaagcccctgaccagcagccgcagctccatggagatgcccagccagcctgcccccaggacagtgacagatgaggagatcaactttgtgaagacctgcctgcagcgctggaggagtgaaattgagcaggacatccaggacctgaagacctgcatcgccagcaccacccagaccatcgagcagatgtactgtgaccccctgctgcggcaggtgccctaccgcctgcatgctgtgctggtgcatgagggccaggccaatgccggccactactgggcctacatctacaaccagccccggcagagctggctgaagtacaatgacatctctgtgacagagagctcctgggaggaggtggagcgggacagctatggaggcctgagaaatgtgtctgcctactgcctgatgtacatcaatgacaagctgccctacttcaatgctgaggccgcccccacagaaagtgaccagatgtctgaggtggaggccctgtctgtggagctgaagcactacatccaggaggacaactggaggtttgagcaggaggtggaggagtgggaggaggagcagagctgcaagatcccccagatggagagcagcaccaacagcagcagccaggactacagcaccagccaggagcccagcgtggccagcagccatggagtgcgctgcctgagcagcgagcacgctgtgattgtgaaggagcagacagcccaggccatcgccaacacagcccgggcctatgagaagagcggcgtggaggccgccctgtctgaggccttccacgaggagtacagccggctgtaccagctggccaaggagacccccaccagccacagcgacccccggctgcagcacgtgctggtgtacttcttccagaatgaggcccccaagagggtggtggagaggaccctgctggagcagtttgctgacaagaacctgtcctatgatgagaggagcatcagcatcatgaaggtggcccaggccaagctgaaggagattggaccagatgacatgaacatggaggagtacaagaagtggcatgaggactacagcctcttcaggaaggtgtctgtgtacctgctgaccggcctggagctgtaccagaagggcaagtaccaggaggccctgagctacctggtgtatgcctaccagagcaatgctgccctgctgatgaagggccccaggagaggagtgaaggagagcgtgattgccctgtacagaaggaagtgcctgctggagctgaatgccaaggccgccagcctgtttgagaccaatgatgaccacagcgtgacagagggcatcaacgtgatgaatgagctgatcatcccctgcatccacctgatcatcaacaatgacatcagcaaggatgacctggatgccatcgaggtgatgaggaaccactggtgcagctacctgggccaggacattgctgagaacctgcagctgtgcctgggggagttcctgccccggctgctggaccccagcgctgagatcatcgtgctgaaggagccccccaccatccggcccaacagcccctatgacctgtgcagcagatttgctgctgtgatggagagcatccagggcgtgtccacagtgacagtgaagtag

SEQ ID NO: 175184 - DNA, 1497 bp, Artificial Sequence
  Description of Artificial Sequence: Synthetic coding sequence
atgcagagccccccccacctggccgtgtgccgcagcaacaagagcccctgggtgtgcctgacctgcagctctgtgcactgcggccgctacgtgaatggccacgccaagaagcactatgaagatgcccaggtgcccctgaccaaccacaagaagtctgagaagcaggacaaggtgcagcacacagtgtgcatggactgcagcagctacagcacctactgctaccgctgtgatgactttgtggtgaatgacaccaagctgggcctggtgcagaaggtgcgggagcacctgcagaacctggagaacagcgccttcaccgctgacagacacaagaagaggaagctgctggagaacagcaccctgaacagcaagctgctgaaggtgaatggcagcaccacagccatctgtgccaccggcctgaggaacctgggcaacacctgcttcatgaatgccatcctgcagagcctgagcaacatcgagcagttctgctgctacttcaaggagctgcctgctgtggagctgagaaatggcaagacagctggaagaaggacctaccacaccaggagccagggcgacaacaacgtgtccctggtggaggagttcaggaagaccctgtgtgccctgtggcagggcagccagacagccttcagccctgagagcctcttctacgtggtgtggaagatcatgcccaacttccggggctaccagcagcaggatgcccacgagttcatgagatacctgctggaccacctgcacctggagctgcagggcggcttcaatggagtgagccgcagcgccatcctgcaggagaacagcaccctgagcgccagcaacaagtgctgcatcaacggggccagcacagtggtgacagccatctttggaggcatcctgcagaatgaggtgaactgcctgatctgtggcacagagagcaggaagtttgaccccttcctggacctgagcctggacatccccagccagttccgcagcaagaggagcaagaaccaggagaatggacctgtgtgcagcctgcgggactgcctgcggagcttcacagacctggaggagctggatgaaacagagctgtacatgtgccacaagtgcaagaagaagcagaagagcaccaagaagttctggatccagaagctgcccaaggtgctgtgcctgcacctgaagcgcttccactggacagcctacctgaggaacaaggtggacacctacgtggagttccccctgcggggcctggacatgaagtgctacctgctggagccagaaaattctggccctgagagctgcctgtatgacctggccgctgtggtggtgcaccacggcagcggcgtgggcagcggccactacacagcctatgccacccatgagggccgctggttccacttcaatgacagcacagtgaccctgacagatgaggagaccgtggtgaaggccaaggcctacatcctcttctacgtggagcaccaggccaaggccggcagtgacaagctgtag

SEQ ID NO: 175185 - DNA, 1563 bp, Artificial Sequence
  Description of Artificial Sequence: Synthetic coding sequence
atggagtgcccccacctgagcagctctgtgtgcatcgccccagacagcgccaagttccccaacggcagccccagctcctggtgctgcagcgtgtgccgcagcaacaagagcccctgggtgtgcctgacctgcagctctgtgcactgcggccgctacgtgaatggccacgccaagaagcactatgaagatgcccaggtgcccctgaccaaccacaagaagtctgagaagcaggacaaggtgcagcacacagtgtgcatggactgcagcagctacagcacctactgctaccgctgtgatgactttgtggtgaatgacaccaagctgggcctggtgcagaaggtgcgggagcacctgcagaacctggagaacagcgccttcaccgctgacagacacaagaagaggaagctgctggagaacagcaccctgaacagcaagctgctgaaggtgaatggcagcaccacagccatctgtgccaccggcctgaggaacctgggcaacacctgcttcatgaatgccatcctgcagagcctgagcaacatcgagcagttctgctgctacttcaaggagctgcctgctgtggagctgagaaatggcaagacagctggaagaaggacctaccacaccaggagccagggcgacaacaacgtgtccctggtggaggagttcaggaagaccctgtgtgccctgtggcagggcagccagacagccttcagccctgagagcctcttctacgtggtgtggaagatcatgcccaacttccggggctaccagcagcaggatgcccacgagttcatgagatacctgctggaccacctgcacctggagctgcagggcggcttcaatggagtgagccgcagcgccatcctgcaggagaacagcaccctgagcgccagcaacaagtgctgcatcaacggggccagcacagtggtgacagccatctttggaggcatcctgcagaatgaggtgaactgcctgatctgtggcacagagagcaggaagtttgaccccttcctggacctgagcctggacatccccagccagttccgcagcaagaggagcaagaaccaggagaatggacctgtgtgcagcctgcgggactgcctgcggagcttcacagacctggaggagctggatgaaacagagctgtacatgtgccacaagtgcaagaagaagcagaagagcaccaagaagttctggatccagaagctgcccaaggtgctgtgcctgcacctgaagcgcttccactggacagcctacctgaggaacaaggtggacacctacgtggagttccccctgcggggcctggacatgaagtgctacctgctggagccagaaaattctggccctgagagctgcctgtatgacctggccgctgtggtggtgcaccacggcagcggcgtgggcagcggccactacacagcctatgccacccatgagggccgctggttccacttcaatgacagcacagtgaccctgacagatgaggagaccgtggtgaaggccaaggcctacatcctcttctacgtggagcaccaggccaaggccggcagtgacaagctgtag

SEQ ID NO: 175186 - DNA, 471 bp, Artificial Sequence
  Description of Artificial Sequence: Synthetic coding sequence
atggagtgcccccacctgagcagctctgtgtgcatcgccccagacagcgccaagttccccaacggcagccccagctcctggtgctgcagcgtgtgccgcagcaacaagagcccctgggtgtgcctgacctgcagctctgtgcactgcggccgctacgtgaatggccacgccaagaagcactatgaagatgcccaggtgcccctgaccaaccacaagaagtctgagaagcaggacaaggtgcagcacacagtgtgcatggactgcagcagctacagcacctactgctaccgctgtgatgactttgtggtgaatgacaccaagctgggcctggtgcagaaggtgcgggagcacctgcagaacctggagaacagcgccttcaccgctgacagacacaagaagaggaagctgctggagaacagcaccctgaacagcaagctgctgaaggtgaatgtgtttggccggcgggtgtag

SEQ ID NO: 175187 - DNA, 1071 bp, Artificial Sequence
  Description of Artificial Sequence: Synthetic coding sequence
atggactgcagcagctacagcacctactgctaccgctgtgatgactttgtggtgaatgacaccaagctgggcctggtgcagaaggtgcgggagcacctgcagaacctggagaacagcgccttcaccgctgacagacacaagaagaggaagctgctggagaacagcaccctgaacagcaagctgctgaaggtgaatggcagcaccacagccatctgtgccaccggcctgaggaacctgggcaacacctgcttcatgaatgccatcctgcagagcctgagcaacatcgagcagttctgctgctacttcaaggagctgcctgctgtggagctgagaaatggcaagacagctggccgccgcacctaccacaccaggagccagggcgacaacaacgtgtccctggtggaggagttcaggaagaccctgtgtgccctgtggcagggcagccagacagccttcagccctgagagcctcttctacgtggtgtggaagatcatgcccaacttccggggctaccagcagcaggatgcccacgagttcatgagatacctgctggaccacctgcacctggagctgcagggcggcttcaacggggtgagccgcagcgccatcctgcaggagaacagcaccctgagcgccagcaacaagtgctgcatcaatggagccagcacagtggtgacagccatctttggaggcatcctgcagaatgaggtgaactgcctgatctgtggcacagagagcaggaagtttgaccccttcctggacctgagcctggacatccccagccagttccgcagcaagaggagcaagaaccaggagaatggacctgtgtgcagcctgcgggactgcctgcgctccttcacagacctggaggagctggatgaaacagagctgtacatgtgccacaagtgcaagaagaagcagaagagcaccaagaagttctggatccagaagctgcccaaggtgctgtgcctgcacctgaagcgcttccactggacagcctacctgaggaacaaggtggacacctacgtggagttccccctgcggggcctggacatgaagtgctactactag

SEQ ID NO: 175188 - DNA, 816 bp, Artificial Sequence
  Description of Artificial Sequence: Synthetic coding sequence
atgcccaacttccggggctaccagcagcaggatgcccacgagttcatgagatacctgctggaccacctgcacctggagctgcagggcggcttcaacggggtgagccgcagcgccatcctgcaggagaacagcaccctgagcgccagcaacaagtgctgcatcaatggagccagcacagtggtgacagccatctttggaggcatcctgcagaatgaggtgaactgcctgatctgtggcacagagagcaggaagtttgaccccttcctggacctgagcctggacatccccagccagttccgcagcaagaggagcaagaaccaggagaatggacctgtgtgcagcctgcgggactgcctgcgctccttcacagacctggaggagctggatgaaacagagctgtacatgtgccacaagtgcaagaagaagcagaagagcaccaagaagttctggatccagaagctgcccaaggtgctgtgcctgcacctgaagcgcttccactggacagcctacctgaggaacaaggtggacacctacgtggagttccccctgcggggcctggacatgaagtgctacctgctggagcctgagaacagcggccctgagagctgcctgtatgacctggccgctgtggtggtgcaccacggcagcggcgtgggcagcggccactacacagcctatgccacccatgagggccgctggttccacttcaatgacagcacagtgaccctgacagatgaggagaccgtggtgaaggccaaggcctacatcctcttctacgtggagcaccaggccaaggccggcagtgacaagctgtag

SEQ ID NO: 175189 - DNA, 1431 bp, Artificial Sequence
  Description of Artificial Sequence: Synthetic coding sequence
atggagtgcccccacctgagcagctctgtgtgcatcgccccagacagcgccaagttccccaacggcagccccagctcctggtgctgcagcgtgtgccgcagcaacaagagcccctgggtgtgcctgacctgcagctctgtgcactgcggcagctaccgctgtgatgactttgtggtgaatgacaccaagctgggcctggtgcagaaggtgcgggagcacctgcagaacctggagaacagcgccttcaccgctgacagacacaagaagaggaagctgctggagaacagcaccctgaacagcaagctgctgaaggtgaatggcagcaccacagccatctgtgccaccggcctgaggaacctgggcaacacctgcttcatgaatgccatcctgcagagcctgagcaacatcgagcagttctgctgctacttcaaggagctgcctgctgtggagctgagaaatggcaagacagctggaagaaggacctaccacaccaggagccagggcgacaacaacgtgtccctggtggaggagttcaggaagaccctgtgtgccctgtggcagggcagccagacagccttcagccctgagagcctcttctacgtggtgtggaagatcatgcccaacttccggggctaccagcagcaggatgcccacgagttcatgagatacctgctggaccacctgcacctggagctgcagggcggcttcaatggagtgagccgcagcgccatcctgcaggagaacagcaccctgagcgccagcaacaagtgctgcatcaacggggccagcacagtggtgacagccatctttggaggcatcctgcagaatgaggtgaactgcctgatctgtggcacagagagcaggaagtttgaccccttcctggacctgagcctggacatccccagccagttccgcagcaagaggagcaagaaccaggagaatggacctgtgtgcagcctgcgggactgcctgcggagcttcacagacctggaggagctggatgaaacagagctgtacatgtgccacaagtgcaagaagaagcagaagagcaccaagaagttctggatccagaagctgcccaaggtgctgtgcctgcacctgaagcgcttccactggacagcctacctgaggaacaaggtggacacctacgtggagttccccctgcggggcctggacatgaagtgctacctgctggagccagaaaattctggccctgagagctgcctgtatgacctggccgctgtggtggtgcaccacggcagcggcgtgggcagcggccactacacagcctatgccacccatgagggccgctggttccacttcaatgacagcacagtgaccctgacagatgaggagaccgtggtgaaggccaaggcctacatcctcttctacgtggagcaccaggccaaggccggcagtgacaagctgtag

SEQ ID NO: 175190 - DNA, 168 bp, Artificial Sequence
  Description of Artificial Sequence: Synthetic coding sequence
atggagtgcccccacctgagcagctctgtgtgcatcgccccagacagcgccaagttccccaacggcagccccagctcctggtgctgcagcgtgtgccgcagcaacaagagcccctgggtgtgcctgacctgcagctctgtgcactgcggccgcatctggggcacctag

SEQ ID NO: 175191 - DNA, 1554 bp, Artificial Sequence
  Description of Artificial Sequence: Synthetic coding sequence
atgctgagcagcagagctgaggccgccatgacagctgctgaccgggccatccagcgcttcctgaggactggagctgctgtgcgctacaaggtgatgaagaactggggcgtcatcggcggcattgctgctgccctggccgccggcatctacgtgatctggggccccatcacagagaggaagaagaggaggaagggcctggtgcccggcctggtgaacctgggcaacacctgcttcatgaacagcctgctgcagggcctgagcgcctgcccagccttcatccgctggctggaggagttcaccagccagtacagccgggaccagaaggagccccccagccaccagtacctgagcctgaccctgctgcacctgctgaaggccctgagctgccaggaggtgacagatgatgaggtgctggatgccagctgcctgctggatgtgctgaggatgtaccgctggcagatcagcagctttgaggagcaggatgcccacgagctgttccacgtgatcaccagcagcctggaggatgagcgggaccggcagccccgggtgacccacctgtttgatgtgcacagcctggagcagcagagcgagatcacccccaagcagatcacctgcaggacccggggcagcccccaccccaccagcaaccactggaagagccagcaccccttccacggccgcctgaccagcaacatggtgtgcaagcactgtgagcaccagagccctgtgcgctttgacacctttgacagcctgagcctgagcatcccagctgccacctggggccaccccctgaccctggaccactgcctgcaccacttcatcagcagcgagagcgtgagagatgtggtgtgtgacaactgcaccaagattgaggccaagggcaccctgaatggagagaaggtggagcaccagaggaccacctttgtgaagcagctgaagctgggcaagctgccccagtgcctgtgcatccacctgcagaggctgtcctggagcagccacggcacccccctgaagagacatgagcacgtgcagttcaatgagttcctgatgatggacatctacaagtaccacctgctgggccacaagcccagccagcacaaccccaagctgaacaagaaccctggccccaccctggagctgcaggacggccctggggcccccacccctgtgctgaaccagcccggggcccccaagacccagatcttcatgaatggagcctgcagccccagcctgctgcccaccctgagcgcccccatgcccttccccctgcctgtggtgcctgactacagcagcagcacctacctgttccggctgatggctgtggtggtgcaccacggggacatgcacagcggccactttgtgacctacagaagaagcccccccagcgccaggaaccccctgagcaccagcaaccagtggctgtgggtgtctgatgacacagtgaggaaggccagcctgcaggaggtgctgagcagcagcgcctacctgctcttctatgagcgggtgctgagcaggatgcagcaccagagccaggagtgcaagtctgaggagtag

SEQ ID NO: 175192 - DNA, 4815 bp, Artificial Sequence
  Description of Artificial Sequence: Synthetic coding sequence
atgggcgccaaggagagccgcatcggcttcctgtcctatgaggaggccctgcggcgggtgacagatgtggagctgaagaggctgaaggatgccttcaagaggacctgtggcctgagctactacatgggccagcactgcttcatccgggaggtgctgggagatggagtgccccccaaggtggccgaggtgatctactgcagctttggaggcaccagcaagggcctgcacttcaacaacctgattgtgggcctggtgctgctgacccggggcaaggatgaggagaaggccaagtacatcttcagcctcttcagcagcgagagcggcaactacgtgatccgggaggagatggagaggatgctgcacgtggtggatggcaaggtgcctgacaccctgaggaagtgcttcagcgagggggagaaggtgaactatgagaagttcaggaactggctgttcctgaacaaggatgccttcaccttcagccgctggctgctgtctggaggagtgtatgtgaccctgacagatgacagcgacacccccaccttctaccagaccctggccggcgtgacccacctggaggagagtgacatcatcgacctggagaagcgctactggctgctgaaggcccagagcaggacaggccgctttgacctggagaccttcggccccctggtgagcccccccatccggcccagcctgtctgagggcctcttcaatgcctttgatgagaacagagacaaccacatcgacttcaaggagatcagctgtggcctgagcgcctgctgccggggccccctggccgagcggcagaagttctgcttcaaggtgtttgatgtggacagagatggagtgctgagccgggtggagctgcgggacatggtggtggccctgctggaggtgtggaaggacaacagaacagatgacatccctgagctgcacatggacctgagtgacatcgtggagggcatcctgaatgcccatgacaccaccaagatgggccacctgaccctggaggactaccagatctggagcgtgaagaatgtgctggccaatgagttcctgaacctgctcttccaggtgtgccacatcgtgctgggcctgcggcctgccaccccagaggaggagggccagatcatccggggctggctggagcgggagagccgctatggcctgcaggccggccacaactggttcatcatctccatgcagtggtggcagcagtggaaggagtatgtgaagtatgatgccaaccctgtggtgattgagcccagctctgtgctgaatggaggcaagtacagctttggaacagctgcccaccccatggagcaggtggaggacagaattggcagcagcctgtcctatgtgaacaccacagaggagaagttcagtgacaacatcagcacagccagcgaggccagcgagacagctggcagcggcttcctgtacagcgccaccccaggagcagatgtgtgctttgcccggcagcacaacaccagtgacaacaacaaccagtgcctgctgggcgccaatggaaacatcctgctgcacctgaacccccagaagccaggggccatcgacaaccagcccctggtgacccaggagcctgtgaaggccaccagcctgaccctggagggcggccgcctgaagaggaccccccagctgattcatggccgggactatgagatggtgcctgagcctgtgtggagggccctgtaccactggtacggggccaacctggccctgcccaggcctgtgatcaagaacagcaagacagacatccctgagctggagctgttcccccgctacctgctcttcctgcggcagcagcctgccaccaggacccagcagagcaacatctgggtgaacatgggaaatgtgcccagccccaatgcccccctgaagagggtgctggcctacacaggctgcttcagcaggatgcagaccatcaaggagatccacgagtacctgagccagaggctgcgcatcaaggaggaggacatgaggctgtggctgtacaacagcgagaactacctgaccctgctggatgatgaggaccacaagctggagtacctgaagatccaggatgagcagcacctggtgattgaggtgaggaacaaggacatgtcctggccagaggagatgtccttcatcgccaacagcagcaagattgacagacacaaggtgcccacagagaagggggccaccggcctgagcaacctgggcaacacctgcttcatgaacagcagcatccagtgtgtgagcaacacccagcccctgacccagtacttcatcagcggccgccacctgtatgagctgaacagaaccaaccccatcggcatgaagggccacatggccaagtgctatggagacctggtgcaggagctgtggagcggcacccagaagaatgtggcccccctgaagctgcgctggaccatcgccaagtatgccccccgcttcaacggcttccagcagcaggacagccaggagctgctggccttcctgctggatggcctgcacgaggacctgaacagagtgcatgagaagccctacgtggagctgaaggacagtgatggccgcccagactgggaggtggccgctgaggcctgggacaaccacctgcggaggaacagaagcatcgtggtggacctcttccacggccagctgcggagccaggtgaagtgcaagacctgtggccacatctctgtgcgctttgaccccttcaacttcctgagcctgcccctgcccatggacagctacatgcacctggagatcaccgtcatcaagctggatggcaccacccctgtgcgctatggcctgcggctgaacatggatgagaagtacacaggcctgaagaagcagctgagtgacctgtgtggcctgaacagcgagcagatcctgctggccgaggtgcacggcagcaacatcaagaacttcccccaggacaaccagaaggtgcggctgtctgtgtctggcttcctgtgtgcctttgagatccctgtgcctgtgagccccatcagcgccagcagccccacccagacagacttcagcagcagccccagcaccaatgagatgttcaccctgaccaccaatggagacctgccccggcccatcttcatccccaacggcatgcccaacacagtggtgccctgtggcacagagaagaacttcaccaacggcatggtgaatggccacatgcccagcctgcctgacagccccttcaccggctacatcatcgctgtgcacaggaagatgatgaggacagagctgtacttcctgagcagccagaagaaccggcccagcctgtttggcatgcccctcatcgtgccctgcaccgtgcacaccaggaagaaggacctgtatgatgctgtgtggatccaggtgtcccggctggccagccccctgcccccccaggaggccagcaaccacgcccaggactgtgatgacagcatgggctaccagtaccccttcaccctgcgggtggtgcagaaggatggcaacagctgtgcctggtgcccctggtaccgcttctgccggggctgcaagattgactgtggagaagatcgggccttcatcggaaatgcctacatcgctgtggactgggaccccacagccctgcacctgcgctaccagaccagccaggagcgggtggtggatgaacatgaatctgtggagcagagccggcgggcccaggccgagcccatcaacctggacagctgcctgcgggccttcaccagcgaggaggagctgggggagaatgagatgtactactgcagcaagtgcaagacccactgcctggccaccaagaagctggacctgtggaggctgccccccatcctgatcatccacctgaagcgcttccagtttgtgaatggccgctggatcaagagccagaagatcgtgaagttcccccgggagagctttgaccccagcgccttcctggtgccccgggaccctgccctgtgccagcacaagcccctgaccccccagggagatgagctgtctgagccccgcatcctggcccgggaggtgaagaaggtggatgcccagagcagcgctggggaggaggatgtgctgctgagcaagagccccagcagcctgagcgccaacatcatcagcagccccaagggcagccccagcagcagcaggaagagcggcaccagctgccccagcagcaagaacagcagccccaacagcagccccaggaccctgggccgcagcaagggccgcctgcggctgccccagatcggcagcaagaacaagctgagcagcagcaaagaaaacctggatgccagcaaagaaaatggagctggccagatctgtgagctggctgatgccctgagccggggccacgtgctgggcggcagccagcctgagctggtgaccccccaggaccacgaggtggccctggccaacggcttcctgtatgagcacgaggcctgtggaaatggctacagcaatggccagctgggcaaccacagcgaggaggacagcacagatgaccagcgggaggacacccgcatcaagcccatctacaacctgtatgccatcagctgccacagcggcatcctgggcggcggccactacgtgacctacgccaagaaccccaactgcaagtggtactgctacaatgacagcagctgcaaggagctgcacccagatgaaattgacacagacagcgcctacatcctcttctatgagcagcagggcattgattatgcccagttcctgcccaagacagatggcaagaagatggctgacaccagctccatggatgaagattttgaaagtgactacaagaagtactgtgtgctgcagtag

SEQ ID NO: 175193 - DNA, 1173 bp, Artificial Sequence
  Description of Artificial Sequence: Synthetic coding sequence
atgggcgccaaggagagccgcatcggcttcctgtcctatgaggaggccctgcggcgggtgacagatgtggagctgaagaggctgaaggatgccttcaagaggacctgtggcctgagctactacatgggccagcactgcttcatccgggaggtgctgggagatggagtgccccccaaggtggccgaggtgatctactgcagctttggaggcaccagcaagggcctgcacttcaacaacctgattgtgggcctggtgctgctgacccggggcaaggatgaggagaaggccaagtacatcttcagcctcttcagcagcgagagcggcaactacgtgatccgggaggagatggagaggatgctgcacgtggtggatggcaaggtgcctgacaccctgaggaagtgcttcagcgagggggagaaggtgaactatgagaagttcaggaactggctgttcctgaacaaggatgccttcaccttcagccgctggctgctgtctggaggagtgtatgtgaccctgacagatgacagcgacacccccaccttctaccagaccctggccggcgtgacccacctggaggagagtgacatcatcgacctggagaagcgctactggctgctgaaggcccagagcaggacaggccgctttgacctggagaccttcggccccctggtgagcccccccatccggcccagcctgtctgagggcctcttcaatgcctttgatgagaacagagacaaccacatcgacttcaaggagatcagctgtggcctgagcgcctgctgccggggccccctggccgagcggcagaagttctgcttcaaggtgtttgatgtggacagagatggagtgctgagccgggtggagctgcgggacatggtggtggccctgctggaggtgtggaaggacaacagaacagatgacatccctgagctgcacatggacctgagtgacatcgtggagggcatcctgaatgcccatgacaccaccaagatgggccacctgaccctggaggactaccagatctggagcgtgaagaatgtgctggccaatgagttcctgaacctgctcttccaggtgtgccacatcgtgctgggcctgcggcctgccaccccagaggaggagggccagatcatccgcaccctggagacagaccagatctacaccagaaattag

SEQ ID NO: 175194 - DNA, 3372 bp, Artificial Sequence
  Description of Artificial Sequence: Synthetic coding sequence
atgcccatcgtggacaagctgaaggaggccctgaagccaggcaggaaggacagcgcagatgatggagagctgggcaagctgctggccagcagcgccaagaaggtgctgctgcagaagattgaatttgagcccgccagcaagagcttctcctaccagctggaggccctgaagagcaaatatgtgctgctgaaccccaagacagaaggagccagccgccacaagtctggagatgatcctccagcccggcggcagggcagcgagcacacctatgagagctgtggagatggagtgcctgccccccagaaggtgctcttccccacagagcggctgagcctgcgctgggagagggtcttccgggtgggcgccggcctgcacaacctgggcaacacctgcttcctgaatgccaccatccagtgcctgacctacaccccacccctggccaactacctgctgagcaaggagcacgcccggagctgccaccagggcagcttctgcatgctgtgtgtgatgcagaaccacatcgtgcaggcctttgccaacagcggaaatgccatcaagcctgtgtccttcatccgggacctgaagaagatcgcccggcacttccgctttggaaaccaggaggatgcccacgagttcctgcgctacaccattgatgccatgcagaaggcctgcctgaatggctgtgccaagctggaccggcagacccaggccaccaccctggtgcaccagatctttggaggctacctgcggagccgggtgaagtgcagcgtgtgcaagtctgtgtctgacacctatgacccctacctggatgtggccctggagatccggcaggccgccaacatcgtgcgggccctggagctgtttgtgaaggcagatgtgctgtctggagaaaatgcctacatgtgtgccaagtgcaagaagaaggtgcctgccagcaagcgcttcaccatccacaggaccagcaatgtgctgaccctgagcctgaagagatttgccaacttcagcggcggcaagatcaccaaggatgtgggctacccagagttcctgaacatccggccctacatgagccagaacaatggagaccctgtgatgtatggcctgtatgctgtgctggtgcacagcggctacagctgccacgccggccactactactgctacgtgaaggccagcaatggccagtggtaccagatgaatgacagcctggtgcacagcagcaatgtgaaggtggtgctgaaccagcaggcctacgtgctcttctacctgcgcatccctggcagcaagaagagccctgagggcctcatcagcaggacaggcagcagcagcctgcccggccggcccagcgtcatcccagaccacagcaagaagaacattggaaatggcatcatcagcagccccctgaccgggaagaggcaggacagcggcaccatgaagaagccccacaccacagaggagattggagtgcccatcagcagaaatggcagcaccctgggcctgaagagccagaatggctgcatcccccccaagctgcccagcggcagccccagccccaagctgagccagacccccacccacatgcccaccatcctggatgaccccgggaagaaggtgaagaagccagccccaccccagcacttcagccccaggacagcccagggcctgcccggcaccagcaacagcaacagcagccgcagcggcagccagaggcagggctcctgggacagcagagatgtggtgctgagcaccagccccaagctgctggccacagccacagccaacggccacggcctgaagggaaatgatgagagcgctggcctggacagaagaggcagcagcagcagcagccctgagcacagcgccagcagtgacagcaccaaggccccccagacccccaggtctggggccgcccacctgtgtgacagccaggagaccaactgcagcacagctggccacagcaagaccccacccagcggggctgacagcaagacagtgaagctgaagagccctgtgctgagcaacaccaccacagagcccgccagcaccatgagccccccaccagccaagaagctggccctgagcgccaagaaggccagcaccctgtggagggccactggaaatgacctgcggcccccaccacccagccccagcagtgacctgacccaccccatgaagaccagccaccctgtggtggccagcacctggcctgtgcaccgggcccgggctgtgtccccagccccccagagcagcagccggctgcagccccccttcagcccccaccccaccctgctgagcagcacccccaagcccccaggcaccagcgagcccaggagctgcagcagcatcagcacagccctgccccaggtgaatgaagacctggtgtccctgccccaccagctgcctgaggccagcgagcccccccagagccccagcgagaagaggaagaagacctttgtgggggagccccagaggctgggcagcgagacccggctgccccagcacatccgggaggccacagctgcccctcatggcaagaggaagaggaagaagaagaagaggcctgaggacacagctgccagcgccctgcaggagggccagacccagaggcagcccggcagccccatgtacagaagagagggccaggcccagctgcctgctgtgcggcggcaggaggatggcacccagccccaggtgaatggccagcaggtgggctgtgtgacagatggccaccacgccagcagcaggaagagaagaagaaaaggagctgagggcctgggggaggagggcggcctgcaccaggaccccctgcggcacagctgcagccccatgggagatggagaccctgaggccatggaggagagccccaggaagaagaagaagaagaagaggaagcaggagacccagagagctgtggaggaggatggccacctgaagtgccccaggtctgccaagccccaggatgctgtggtgcctgagagcagcagctgtgcccccagcgccaacggctggtgccctggggacaggatgggcctgagccaggcccctcctgtgtcctggaatggagagcgggagagtgatgtggtgcaggagctgctgaagtacagcagtgacaaggcctacggcaggaaggtgctgacctgggatggcaagatgtctgctgtgtcccaggatgccatcgaggacagccggcaggccaggacagaaacagtggtggatgactgggatgaggagtttgaccggggcaaggagaagaagatcaagaagttcaagcgggagaagagaagaaacttcaatgccttccagaagctgcagaccaggaggaacttctggagcgtgacccacccagccaaggccgccagcctgagctacagaagatag

SEQ ID NO: 175195 - DNA, 1647 bp, Artificial Sequence
  Description of Artificial Sequence: Synthetic coding sequence
atgcccatcgtggacaagctgaaggaggccctgaagccaggcaggaaggacagcgcagatgatggagagctgggcaagctgctggccagcagcgccaagaaggtgctgctgcagaagattgaatttgagcccgccagcaagagcttctcctaccagctggaggccctgaagagcaaatatgtgctgctgaaccccaagacagaaggagccagccgccacaagtctggagatgatcctccagcccggcggcagggcagcgagcacacctatgagagctgtggagatggagtgcctgccccccagaaggtgctcttccccacagagcggctgagcctgcgctgggagagggtcttccgggtgggcgccggcctgcacaacctgggcaacacctgcttcctgaatgccaccatccagtgcctgacctacaccccacccctggccaactacctgctgagcaaggagcacgcccggagctgccaccagggcagcttctgcatgctgtgtgtgatgcagaaccacatcgtgcaggcctttgccaacagcggaaatgccatcaagcctgtgtccttcatccgggacctgaagaagatcgcccggcacttccgctttggaaaccaggaggatgcccacgagttcctgcgctacaccattgatgccatgcagaaggcctgcctgaatggctgtgccaagctggaccggcagacccaggccaccaccctggtgcaccagatctttggaggctacctgcggagccgggtgaagtgcagcgtgtgcaagtctgtgtctgacacctatgacccctacctggatgtggccctggagatccggcaggccgccaacatcgtgcgggccctggagctgtttgtgaaggcagatgtgctgtctggagaaaatgcctacatgtgtgccaagtgcaagaagaaggtgcctgccagcaagcgcttcaccatccacaggaccagcaatgtgctgaccctgagcctgaagagatttgccaacttcagcggcggcaagatcaccaaggatgtgggctacccagagttcctgaacatccggccctacatgagccagaacaatggagaccctgtgatgtatggcctgtatgctgtgctggtgcacagcggctacagctgccacgccggccactactactgctacgtgaaggccagcaatggccagtggtaccagatgaatgacagcctggtgcacagcagcaatgtgaaggtggtgctgaaccagcaggcctacgtgctcttctacctgcgcatccctggcagcaagaagagccctgagggcctcatcagcaggacaggcagcagcagcctgcccggccggcccagcgtcatcccagaccacagcaagaagaacattggaaatggcatcatcagcagccccctgaccgggaagaggcaggacagcggcaccatgaagaagccccacaccacagaggagattggagtgcccatcagcagaaatggcagcaccctgggcctgaagagccagaatggctgcatcccccccaagctgcccagcggcagccccagccccaagctgagccagacccccacccacatgcccaccatcctggatgaccccgggaagaaggtgaagaagccagccccacccctgcccaccggcatgggctag

SEQ ID NO: 175196 - DNA, 2187 bp, Artificial Sequence
  Description of Artificial Sequence: Synthetic coding sequence
atgtgtgccaagtgcaagaagaaggtgcctgccagcaagcgcttcaccatccacaggaccagcaatgtgctgaccctgagcctgaagagatttgccaacttcagcggcggcaagatcaccaaggatgtgggctacccagagttcctgaacatccggccctacatgagccagaacaatggagaccctgtgatgtatggcctgtatgctgtgctggtgcacagcggctacagctgccacgccggccactactactgctacgtgaaggccagcaatggccagtggtaccagatgaatgacagcctggtgcacagcagcaatgtgaaggtggtgctgaaccagcaggcctacgtgctcttctacctgcgcatccctggcagcaagaagagccctgagggcctcatcagcaggacaggcagcagcagcctgcccggccggcccagcgtcatcccagaccacagcaagaagaacattggaaatggcatcatcagcagccccctgaccgggaagaggcaggacagcggcaccatgaagaagccccacaccacagaggagattggagtgcccatcagcagaaatggcagcaccctgggcctgaagagccagaatggctgcatcccccccaagctgcccagcggcagccccagccccaagctgagccagacccccacccacatgcccaccatcctggatgaccccgggaagaaggtgaagaagccagccccaccccagcacttcagccccaggacagcccagggcctgcccggcaccagcaacagcaacagcagccgcagcggcagccagaggcagggctcctgggacagcagagatgtggtgctgagcaccagccccaagctgctggccacagccacagccaacggccacggcctgaagggaaatgatgagagcgctggcctggacagaagaggcagcagcagcagcagccctgagcacagcgccagcagtgacagcaccaaggccccccagacccccaggtctggggccgcccacctgtgtgacagccaggagaccaactgcagcacagctggccacagcaagaccccacccagcggggctgacagcaagacagtgaagctgaagagccctgtgctgagcaacaccaccacagagcccgccagcaccatgagccccccaccagccaagaagctggccctgagcgccaagaaggccagcaccctgtggagggccactggaaatgacctgcggcccccaccacccagccccagcagtgacctgacccaccccatgaagaccagccaccctgtggtggccagcacctggcctgtgcaccgggcccgggctgtgtccccagccccccagagcagcagccggctgcagccccccttcagcccccaccccacagctgccagcgccctgcaggagggccagacccagaggcagcccggcagccccatgtaccgccgggagggccaggcccagctgcctgctgtgcggcggcaggaggatggcacccagccccaggtgaatggccagcaggtgggctgtgtgacagatggccaccacgccagcagcaggaagagaagaagaaaaggagctgagggcctgggggaggagggcggcctgcaccaggaccccctgcggcacagctgcagccccatgggagatggagaccctgaggccatggaggagagccccaggaagaagaagaagaagaagaggaagcaggagacccagagagctgtggaggaggatggccacctgaagtgccccaggtctgccaagccccaggatgctgtggtgcctgagagcagcagctgtgcccccagcgccaacggctggtgccctggggacaggatgggcctgagccaggcccctcctgtgtcctggaatggagagcgggagagtgatgtggtgcaggagctgctgaagtacagcagtgacaaggcctacggcaggaaggtgctgacctgggatggcaagatgtctgctgtgtcccaggatgccatcgaggacagccggcaggccaggacagagaccgtggtggatgactgggatgaggagtttgaccggggcaaggagaagaagatcaagaagttcaagcgggagaagagaagaaacttcaatgccttccagaagctgcagaccaggaggaacttctggagcgtgacccacccagccaaggccgccagcctgagctacagaagatag

SEQ ID NO: 175197 - DNA, 3372 bp, Artificial Sequence; identical to SEQ ID NO: 175194
  Description of Artificial Sequence: Synthetic coding sequence

SEQ ID NO: 175198 - DNA, 1698 bp, Artificial Sequence
  Description of Artificial Sequence: Synthetic coding sequence
atgagcggccgcagcaagcgggagagccggggcagcacccggggcaagcgggagagcgagagccggggcagcagcggccgggtgaagcgggagcgggaccgggagcgggagcctgaggccgccagcagccggggcagccctgtgcgggtgaagcgggagtttgagcccgccagcgcccgggaggccccagcctctgtggtgccctttgtgcgggtgaagcgggagcgggaggtggatgaggacagcgagcctgagcgggaggtgcgggccaagaatggccgggtggacagcgaggaccggcgcagccgccactgcccctacctggacaccatcaacagatctgtgctggactttgattttgagaagctgtgcagcatcagcctgagccacatcaatgcctatgcctgcctggtgtgtgggaagtacttccagggccggggcctgaagagccacgcctacatccacagcgtgcagttcagccaccacgtgttcctgaacctgcacaccctgaagttctactgcctgcctgacaactatgagatcatcgacagcagcctggaggacatcacctacgtgctgaagcccaccttcaccaagcagcagatcgccaacctggacaagcaggccaagctgagccgggcctatgatggcaccacctacctgcccggcatcgtgggcctgaacaacatcaaggccaatgactatgccaatgctgtgctgcaggccctgagcaatgtgccccccctgaggaactacttcctggaggaggacaactacaagaacatcaagaggcctcctggggacatcatgttcctgctggtgcagagatttggagagctgatgaggaagctgtggaaccccaggaacttcaaggcccacgtgagcccccatgagatgctgcaggccgtggtgctgtgcagcaagaagaccttccagatcaccaagcagggagatggagtggacttcctgtcctggttcctgaatgccctgcacagcgccctgggcggcaccaagaagaagaagaagaccatcgtgacagatgtgttccagggctccatgaggatcttcaccaagaagctgccccacccagacctgcctgctgaggagaaggagcagctgctgcacaatgatgagtaccaggagaccatggtggagagcaccttcatgtacctgaccctggacctgcccacagcccccctgtacaaggatgagaaggagcagctgatcatcccccaggtgcccctcttcaacatcctggccaagttcaacggcatcacagagaaggagtacaagacctacaaggagaacttcctgaagcgcttccagctgaccaagctgcccccctacctgatcttctgcatcaagcgcttcaccaagaacaacttctttgtggagaagaaccccaccatcgtgaacttccccatcaccaacgtggacctgcgggagtacctgtctgaggaggtgcaggccgtgcacaagaacaccacctatgacctgattgccaacatcgtgcatgatggcaagcccagcgagggcagctaccgcatccacgtgctgcaccacggcaccgggaagtggtatgagctgcaggacctgcaggtgacagacatcctgccccagatgatcaccctgtctgaggcctacatccagatctggaagaggcgggacaatgatgagaccaaccagcagggcgcctag

SEQ ID NO: 175199 - DNA, 1698 bp, Artificial Sequence; identical to SEQ ID NO: 175198
  Description of Artificial Sequence: Synthetic coding sequence

SEQ ID NO: 175200 - DNA, 1389 bp, Artificial Sequence
  Description of Artificial Sequence: Synthetic coding sequence
atgctgacagctgtgcccagccacctgttcagcgccaagaatggccgggtggacagcgaggaccggcgcagccgccactgcccctacctggacaccatcaacagcttcagccccttccccaccggccggggcctgaagagccacgcctacatccacagcgtgcagttcagccaccacgtgttcctgaacctgcacaccctgaagttctactgcctgcctgacaactatgagatcatcgacagcagcctggaggacatcacctacgtgctgaagcccaccttcaccaagcagcagatcgccaacctggacaagcaggccaagctgagccgggcctatgatggcaccacctacctgcccggcatcgtgggcctgaacaacatcaaggccaatgactatgccaatgctgtgctgcaggccctgagcaatgtgccccccctgaggaactacttcctggaggaggacaactacaagaacatcaagaggcctcctggggacatcatgttcctgctggtgcagagatttggagagctgatgaggaagctgtggaaccccaggaacttcaaggcccacgtgagcccccatgagatgctgcaggccgtggtgctgtgcagcaagaagaccttccagatcaccaagcagggagatggagtggacttcctgtcctggttcctgaatgccctgcacagcgccctgggcggcaccaagaagaagaagaagaccatcgtgacagatgtgttccagggctccatgaggatcttcaccaagaagctgccccacccagacctgcctgctgaggagaaggagcagctgctgcacaatgatgagtaccaggagaccatggtggagagcaccttcatgtacctgaccctggacctgcccacagcccccctgtacaaggatgagaaggagcagctgatcatcccccaggtgcccctcttcaacatcctggccaagttcaacggcatcacagagaaggagtacaagacctacaaggagaacttcctgaagcgcttccagctgaccaagctgcccccctacctgatcttctgcatcaagcgcttcaccaagaacaacttctttgtggagaagaaccccaccatcgtgaacttccccatcaccaacgtggacctgcgggagtacctgtctgaggaggtgcaggccgtgcacaagaacaccacctatgacctgattgccaacatcgtgcatgatggcaagcccagcgagggcagctaccgcatccacgtgctgcaccacggcaccgggaagtggtatgagctgcaggacctgcaggtgacagacatcctgccccagatgatcaccctgtctgaggcctacatccagatctggaagagaagagacaatgatgagaccaaccagcagggcgcctag

SEQ ID NO: 175201 - DNA, 1467 bp, Artificial Sequence
  Description of Artificial Sequence: Synthetic coding sequence
atgagcggccgcagcaagcgggagagccggggcagcacccggggcaagcgggagagcgagagccggggcagcagcggccgggtgaagcgggagcgggaccgggagcgggagcctgaggccgccagcagccggggcagccctgtgcgggtgaagcgggagtttgagcccgccagcgcccgggaggccccagcctctgtggtgccctttgtgcgggtgaagcgggagcgggaggtggatgaggacagcgagcctgagcgggaggtgcgggccaagaatggccgggtggacagcgaggaccggcgcagccgccactgcccctacctggacaccatcaacagatctgtgctggactttgattttgagaagctgtgcagcatcagcctgagccacatcaatgcctatgcctgcctggtgtgtgggaagtacttccagggccggggcctgaagagccacgcctacatccacagcgtgcagttcagccaccacgtgttcctgaacctgcacaccctgaagttctactgcctgcctgacaactatgagatcatcgacagcagcctggaggacatcacctacgtgctgaagcccaccttcaccaagcagcagatcgccaacctggacaagcaggccaagctgagccgggcctatgatggcaccacctacctgcccggcatcgtgggcctgaacaacatcaaggccaatgactatgccaatgctgtgctgcaggccctgagcaatgtgccccccctgaggaactacttcctggaggaggacaactacaagaacatcaagaggcctcctggggacatcatgttcctgctggtgcagagatttggagagctgatgaggaagctgtggaaccccaggaacttcaaggcccacgtgagcccccatgagatgctgcaggccgtggtgctgtgcagcaagaagaccttccagatcaccaagcagggagatggagtggacttcctgtcctggttcctgaatgccctgcacagcgccctgggcggcaccaagaagaagaagaagaccatcgtgacagatgtgttccagggctccatgaggatcttcaccaagaagctgccccacccagacctgcctgctgaggagaaggagcagctgctgcacaatgatgagtaccaggagaccatggtggagagcaccttcatgtacctgaccctggacctgcccacagcccccctgtacaaggatgagaaggagcagctgatcatcccccaggtgcccctcttcaacatcctggccaagttcaacggcatcacagagaaggagtacaagacctacaaggagaacttcctgaagcgcttccagctgaccaagctgcccccctacctgatcttctgcatcaagcgcttcaccaagaacaacttctttgtggagaagaaccccaccatcgtgaacttccccatcaccggccaggccaacggcatgaactacaagaccagcaggtag

SEQ ID NO: 175202 - DNA, 2892 bp, Artificial Sequence
  Description of Artificial Sequence: Synthetic coding sequence
atggccgagggcggcggctgccgggagaggccagatgctgagacccagaagtctgagctgggccccctgatgaggaccaccctgcagagaggagcccagtggtacctgattgacagccgctggttcaagcagtggaagaagtatgtgggctttgacagctgggacatgtacaacgtgggggagcacaacctcttccctggccccatcgacaacagcggcctcttcagtgaccctgagagccagaccctgaaggagcacctgattgatgagctggactatgtgctggtgcccacagaggcctggaacaagctgctgaactggtacggctgtgtggagggccagcagcccatcgtgaggaaggtggtggagcacggcctgtttgtgaagcactgcaaggtggaggtgtacctgctggagctgaagctgtgtgagaacagcgaccccaccaacgtgctgagctgccacttcagcaaggctgacaccatcgccaccatcgagaaggagatgaggaagctgttcaacatcccagctgagcgggagacccggctgtggaacaagtacatgagcaacacctatgagcagctgagcaagctggacaacacagtgcaggatgctggcctgtaccagggccaggtgctggtgattgagccccagaatgaagatggcacctggccccggcagaccctgcagagcaagagcagcacagcccccagcaggaacttcaccaccagccccaagagcagcgccagcccctacagctctgtgtctgccagcctcatcgccaacggggacagcaccagcacctgtggcatgcacagcagcggcgtgtccagaggaggcagcggcttcagcgccagctacaactgccaggagccccccagcagccacatccagcccggcctgtgtggcctgggcaacctgggcaacacctgcttcatgaacagcgccctgcagtgcctgagcaacacagcccccctgacagactacttcctgaaggatgaatatgaagctgagatcaacagagacaaccccctgggcatgaagggggagattgctgaggcctatgcagagctgatcaagcagatgtggagcggcagagatgcccacgtggcccccaggatgttcaagacccaggtgggccgctttgccccccagttcagcggctaccagcagcaggacagccaggagctgctggccttcctgctggatggcctgcacgaggacctgaacagagtgaagaagaagccctacctggagctgaaggatgccaacggccgcccagatgctgtggtggccaaggaggcctgggagaaccaccggctgagaaatgattctgtgattgtggacaccttccacggcctcttcaagagcaccctggtgtgcccagaatgtgccaaggtgtctgtgacctttgaccccttctgctacctgaccctgcccctgcccctgaagaaggacagagtgatggaggtgttcctggtgcctgctgacccccactgccggcccacccagtacagagtgacagtgcccctgatgggcgctgtgtctgacctgtgtgaggccctgagccggctgagcggcattgctgctgagaacatggtggtggctgatgtgtacaaccaccgcttccacaagatcttccagatggatgagggcctgaaccacatcatgcccagagatgacatctttgtgtatgaggtgtgcagcacctctgtggatggctctgaatgtgtgaccctgcctgtgtacttccgggagaggaagagccggcccagcagcaccagcagcgccagcgccctgtatggccagcccctgctgctgtctgtgcccaagcacaagctgaccctggagagcctgtaccaggccgtgtgtgaccgcatcagccgctacgtgaagcagcccctgcctgatgaatttggcagcagccccctggagcccggggcctgcaatggcagcaggaacagctgtgaaggagaagatgaggaggagatggagcaccaggaggagggcaaggagcagctgtctgaaacagagggcagcggggaggatgagcctggaaatgaccccagcgagaccacccagaagaagatcaagggccagccctgccccaagaggctcttcaccttcagcctggtgaacagctatggaacagctgacatcaacagcctggccgcagatggcaagctgctgaagctgaacagccgcagcaccctggccatggactgggacagcgagacccggcggctgtactatgatgagcaggagagcgaggcctatgagaagcacgtgtccatgctgcagccccagaagaagaagaagaccaccgtggccctgcgggactgcatcgagctgttcaccaccatggagaccctgggggagcatgacccctggtactgccccaactgcaagaagcaccagcaggccaccaagaagtttgacctgtggagcctgcccaagatcctggtggtgcacctgaagcgcttctcctacaaccgctactggagggacaagctggacacagtggtggagttccccatccggggcctgaacatgtctgaatttgtgtgcaacctgagcgcccggccctacgtgtatgacctgattgctgtgagcaaccactacggggccatgggcgtgggccactacacagcctatgccaagaacaagctgaatggcaagtggtactactttgatgacagcaatgtgtccctggccagcgaggaccagatcgtgaccaaggccgcctacgtgctcttctaccagaggagagatgatgagttctacaagacccccagcctgagcagcagcggcagcagtgatggcggcacccggcccagcagcagccagcagggctttggagatgatgaggcctgcagcatggacaccaactag

SEQ ID NO: 175203 - DNA, 2751 bp, Artificial Sequence
  Description of Artificial Sequence: Synthetic coding sequence
atggccgagggcggcggctgccgggagaggccagatgctgagacccagaagtctgagctgggccccctgatgaggaccaccctgcagagaggagcccagtggtacctgattgacagccgctggttcaagcagtggaagaagtatgtgggctttgacagctgggacatgtacaacgtgggggagcacaacctcttccctggccccatcgacaacagcggcctcttcagtgaccctgagagccagaccctgaaggagcacctgattgatgagctggactatgtgctggtgcccacagaggcctggaacaagctgctgaactggtacggctgtgtggagggccagcagcccatcgtgaggaaggtggtggagcacggcctgtttgtgaagcactgcaaggtggaggtgtacctgctggagctgaagctgtgtgagaacagcgaccccaccaacgtgctgagctgccacttcagcaaggctgacaccatcgccaccatcgagaaggagatgaggaagctgttcaacatcccagctgagcgggagacccggctgtggaacaagtacatgagcaacacctatgagcagctgagcaagctggacaacacagtgcaggatgctggcctgtaccagggccaggtgctggtgattgagccccagaatgaagatggcacctggccccggcagaccctgcagagcaatggcagcggcttcagcgccagctacaactgccaggagccccccagcagccacatccagcccggcctgtgtggcctgggcaacctgggcaacacctgcttcatgaacagcgccctgcagtgcctgagcaacacagcccccctgacagactacttcctgaaggatgaatatgaggccgagatcaacagagacaaccccctgggcatgaagggggagattgctgaggcctatgcagagctgatcaagcagatgtggagcggcagagatgcccacgtggcccccaggatgttcaagacccaggtgggccgctttgccccccagttcagcggctaccagcagcaggacagccaggagctgctggccttcctgctggatggcctgcacgaggacctgaacagagtgaagaagaagccctacctggagctgaaggatgccaacggccgcccagatgctgtggtggccaaggaggcctgggagaaccaccggctgagaaatgacagcgtcatcgtggacaccttccacggcctcttcaagagcaccctggtgtgcccagaatgtgccaaggtgtctgtgacctttgaccccttctgctacctgaccctgcccctgcccctgaagaaggacagagtgatggaggtgttcctggtgcctgctgacccccactgccggcccacccagtacagagtgacagtgcccctgatgggcgctgtgtctgacctgtgtgaggccctgagccggctgtctggaattgctgctgagaacatggtggtggctgatgtgtacaaccaccgcttccacaagatcttccagatggatgagggcctgaaccacatcatgcccagagatgacatctttgtgtatgaggtgtgcagcacctctgtggatggctctgaatgtgtgaccctgcctgtgtacttccgggagaggaagagccggcccagcagcaccagcagcgccagcgccctgtatggccagcccctgctgctgtctgtgcccaagcacaagctgaccctggagagcctgtaccaggccgtgtgtgaccgcatcagccgctacgtgaagcagcccctgcctgatgaatttggcagcagccccctggagcccggggcctgcaatggcagcaggaacagctgtgagggggaggatgaggaggagatggagcaccaggaggagggcaaggagcagctgtctgaaacagagggcagcggagaagatgagcctggaaatgaccccagcgagaccacccagaagaagatcaagggccagccctgccccaagaggctcttcaccttcagcctggtgaacagctatggaacagctgacatcaacagcctggccgcagatggcaagctgctgaagctgaacagccgcagcaccctggccatggactgggacagcgagacccggcggctgtactatgatgagcaggagagcgaggcctatgagaagcacgtgtccatgctgcagccccagaagaagaagaagaccaccgtggccctgcgggactgcatcgagctgttcaccaccatggagaccctgggggagcatgacccctggtactgccccaactgcaagaagcaccagcaggccaccaagaagtttgacctgtggagcctgcccaagatcctggtggtgcacctgaagcgcttctcctacaaccgctactggagggacaagctggacacagtggtggagttccccatccggggcctgaacatgtctgaatttgtgtgcaacctgagcgcccggccctacgtgtatgacctgattgctgtgagcaaccactatggagccatgggcgtgggccactacacagcctatgccaagaacaagctgaatggcaagtggtactactttgatgacagcaatgtgtccctggccagcgaggaccagatcgtgaccaaggccgcctacgtgctcttctaccagaggagagatgatgagttctacaagacccccagcctgagcagcagcggcagcagtgatggcggcacccggcccagcagcagccagcagggctttggagatgatgaggcctgcagcatggacaccaactag

SEQ ID NO: 175204 - DNA, 942 bp, Artificial Sequence
  Description of Artificial Sequence: Synthetic coding sequence
atggccgagggcggcggctgccgggagaggccagatgctgagacccagaagtctgagctgggccccctgatgaggaccaccctgcagagaggagcccagtggtacctgattgacagccgctggttcaagcagtggaagaagtatgtgggctttgacagctgggacatgtacaacgtgggggagcacaacctcttccctggccccatcgacaacagcggcctcttcagtgaccctgagagccagaccctgaaggagcacctgattgatgagctggactatgtgctggtgcccacagaggcctggaacaagctgctgaactggtacggctgtgtggagggccagcagcccatcgtgaggaaggtggtggagcacggcctgtttgtgaagcactgcaaggtggaggtgtacctgctggagctgaagctgtgtgagaacagcgaccccaccaacgtgctgagctgccacttcagcaaggctgacaccatcgccaccatcgagaaggagatgaggaagctgttcaacatcccagctgagcgggagacccggctgtggaacaagtacatgagcaacacctatgagcagctgagcaagctggacaacacagtgcaggatgctggcctgtaccagggccaggtgctggtgattgagccccagaatgaagatggcacctggccccggcagaccctgcagagcaaggtgtccttcttcctgccccggctggagtgcaatggagccatcctggcccactgcaacttctgcctgcccggcagcagcaacagccctgccagcgccagccgggtggcccccagccacctggccaacttcttcttctttgagatggagagccacagcgtgaccaagctggagtgtggcggcgctgtgtctgcctacagccgggtgcaggtgatgctgctgccccagcccccagagtggctgggctag

SEQ ID NO: 175205 - DNA, 2139 bp, Artificial Sequence
  Description of Artificial Sequence: Synthetic coding sequence
atgctggccatggacacctgcaagcacgtgggccagctgcagctggcccaggaccacagcagcctgaacccccagaagtggcactgtgtggactgcaacaccacagagagcatctgggcctgcctgagctgcagccacgtggcctgtggccgctacatcgaggagcacgccctgaagcacttccaggagagcagccaccctgtggccctggaggtgaatgagatgtatgtgttctgctacctgtgtgatgattatgtgctgaatgacaacaccaccggggacctgaagctgctgcggaggaccctgagcgccatcaagagccagaactaccactgcaccaccaggagcggccgcttcctgcgctccatgggcactggagatgacagctacttcctgcatgatggagcccagagcctgctgcagagcgaggaccagctgtacacagccctgtggcacagaagacgcatcctgatgggcaagatcttccgcacctggtttgagcagagccccatcggcaggaagaagcaggaggagcccttccaggagaagatcgtggtgaagcgggaggtgaagaagaggcggcaggagctggagtaccaggtgaaggccgagctggagagcatgccacccaggaagagcctgcggctgcagggcctggcccagagcaccatcattgaaattgtgtctgtgcaggtgcctgcccagaccccagccagccctgccaaggacaaggtgctgagcaccagtgaaaatgagatcagccagaaggtgtctgacagctctgtgaagaggcggcccatcgtgaccccaggagtgacaggcctgaggaacctgggcaacacctgctacatgaacagcgtgctgcaggtgctgagccacctgctgatcttccggcagtgcttcctgaagctggacctgaaccagtggctggccatgacagccagcgagaagaccaggagctgcaagcacccccctgtgacagacacagtggtgtaccagatgaatgaatgccaggagaaggacaccggctttgtgtgcagccggcagagcagcctgagcagcggcctgtctggaggagccagcaagggcaggaagatggagctgatccagcccaaggagcccaccagccagtacatcagcctgtgccacgagctgcacaccctcttccaggtgatgtggagcggcaagtgggccctggtgagcccctttgccatgctgcacagcgtgtggaggctcatcccagccttccggggctacgcccagcaggatgcccaggagttcctgtgtgagctgctggacaagatccagcgggagctggagaccaccggcaccagcctgcctgccctgatccccaccagccagaggaagctgatcaagcaggtgctgaatgtggtgaacaacatcttccacggccagctgctgagccaggtgacctgcctggcctgtgacaacaagagcaacaccatcgagcccttctgggacctgagcctggagttccctgagcgctaccagtgcagcggcaaggacatcgccagccagccctgcctggtgacagagatgctggccaagttcacagaaacagaggccctggagggcaagatctacgtgtgtgaccagtgcaacagcaagagaagacgcttcagcagcaagcctgtggtgctgacagaggcccagaagcagctgatgatctgccacctgccccaggtgctgcggctgcacctgaagcgcttccgctggagcggcaggaacaaccgggagaagattggagtgcacgtgggctttgaggagatcctgaacatggagccctactgctgccgggagaccctgaagagcctgcggcctgagtgcttcatctatgacctgtctgctgtggtgatgcaccacggcaagggcttcggcagcggccactacacagcctactgctacaacagcgagggcggcttctgggtgcactgcaatgacagcaagctgtccatgtgcaccatggatgaggtgtgcaaggcccaggcctacatcctcttctacacccagagggtgacagaaaatggccacagcaagctgctgcccccagagctgctgctgggcagccagcaccccaatgaagatgctgacaccagcagcaatgagatcctgtcctag

SEQ ID NO: 175206 - DNA, 2139 bp, Artificial Sequence; identical to SEQ ID NO: 175205
  Description of Artificial Sequence: Synthetic coding sequence

SEQ ID NO: 175207 - DNA, 2139 bp, Artificial Sequence; identical to SEQ ID NO: 175205
  Description of Artificial Sequence: Synthetic coding sequence

SEQ ID NO: 175208 - DNA, 336 bp, Artificial Sequence
  Description of Artificial Sequence: Synthetic coding sequence
atgctggccatggacacctgcaagcacgtgggccagctgcagctggcccaggaccacagcagcctgaacccccagaagtggcactgtgtggactgcaacaccacagagagcatctgggcctgcctgagctgcagccacgtggcctgtggccgctacatcgaggagcacgccctgaagcacttccaggagagcagccaccctgtggccctggaggtgaatgagatgtatgtgttctgctacctgtgtgatgattatgtgctgaatgacaacaccaccggggacctgaagctgctgcggaggaccctgagcgccatcaagagccagaactaccactag

SEQ ID NO: 175209 - DNA, 495 bp, Artificial Sequence
  Description of Artificial Sequence: Synthetic coding sequence
atgctggccatggacacctgcaagcacgtgggccagctgcagctggcccaggaccacagcagcctgaacccccagaagtggcactgtgtggactgcaacaccacagagagcatctgggcctgcctgagctgcagccacgtggcctgtggccgctacatcgaggagcacgccctgaagcacttccaggagagcagccaccctgtggccctggaggtgaatgagatgtatgtgttctgctacctgtgtgatgattatgtgctgaatgacaacaccaccggggacctgaagctgctgcggaggaccctgagcgccatcaagagccagaactaccactgcaccaccaggagcggccgcttcctgcgctccatgggcactggagatgacagctacttcctgcatgatggagcccagagcctgctgcagagcgaggaccagctgtacacagccctgtggcacagaagacgcatcctgatgggcaagatcttccgcacctag

SEQ ID NO: 175210 - DNA, 1101 bp, Artificial Sequence
  Description of Artificial Sequence: Synthetic coding sequence
atgacagtgaggaacatcgccagcatctgcaacatgggcaccaatgccagcgccctggagaaggacatcggccctgagcagttccccatcaatgagcactacttcggcctggtgaactttggaaacacctgctactgcaacagcgtgctgcaggccctgtacttctgccggcccttcagagaaaatgtgctggcctacaaggcccagcagaagaagaaggagaacctgctgacctgcctggccgacctcttccacagcatcgccacccagaagaagaaggtgggcgtcatcccccccaagaagttcatcagccggctgaggaaagaaaatgacctgtttgacaactacatgcagcaggatgcccacgagttcctgaactacctgctgaacaccatcgctgacatcctgcaggaggagaagaagcaggagaagcagaatggcaagctgaagaatggaaacatgaatgaacctgctgagaacaacaagccagagctgacctgggtgcatgagatcttccagggcaccctgaccaatgagacccgctgcctgaactgtgaaacagtgagcagcaaggatgaggacttcctggacctgtctgtggatgtggagcagaacaccagcatcacccactgcctgcgggacttcagcaacacagagaccctgtgcagcgagcagaagtactactgtgagacctgctgcagcaagcaggaggcccagaagaggatgagggtgaagaagctgcccatgatcctggccctgcacctgaagcgcttcaagtacatggagcagctgcaccgctacaccaagctgagctacagagtggtgttccccctggagctgcggctcttcaacaccagcagtgatgctgtgaacctggacaggatgtatgacctggtggccgtggtggtgcactgcggcagcggccccaacagaggccactacatcaccatcgtgaagagccacggcttctggctgctgtttgatgatgacatcgtggagaagattgatgcccaggccatcgaggagttctacggcctgaccagtgacatcagcaagaacagcgagagcggctacatcctcttctaccagagccgggagtag

SEQ ID NO: 175211 - DNA, 1080 bp, Artificial Sequence
  Description of Artificial Sequence: Synthetic coding sequence
atgaactgcttccagggcaccaatgccagcgccctggagaaggacatcggccctgagcagttccccatcaatgagcactacttcggcctggtgaactttggaaacacctgctactgcaacagcgtgctgcaggccctgtacttctgccggcccttccgggagaatgtgctggcctacaaggcccagcagaagaagaaggagaacctgctgacctgcctggccgacctcttccacagcatcgccacccagaagaagaaggtgggcgtcatcccccccaagaagttcatcagccggctgaggaaagaaaatgacctgtttgacaactacatgcagcaggatgcccacgagttcctgaactacctgctgaacaccatcgctgacatcctgcaggaggagaagaagcaggagaagcagaatggcaagctgaagaatggaaacatgaatgaacctgctgagaacaacaagccagagctgacctgggtgcatgagatcttccagggcaccctgaccaatgagacccgctgcctgaactgtgagaccgtgagcagcaaggatgaggacttcctggacctgtctgtggatgtggagcagaacaccagcatcacccactgcctgcgggacttcagcaacacagagaccctgtgcagcgagcagaagtactactgtgagacctgctgcagcaagcaggaggcccagaagaggatgagggtgaagaagctgcccatgatcctggccctgcacctgaagcgcttcaagtacatggagcagctgcaccgctacaccaagctgagctacagagtggtgttccccctggagctgcggctcttcaacaccagcagtgatgctgtgaacctggacaggatgtatgacctggtggccgtggtggtgcactgcggcagcggccccaacagaggccactacatcaccatcgtgaagagccacggcttctggctgctgtttgatgatgacatcgtggagaagattgatgcccaggccatcgaggagttctacggcctgaccagtgacatcagcaagaacagcgagagcggctacatcctcttctaccagagccgggagtag

SEQ ID NO: 175212 - DNA, 4221 bp, Artificial Sequence
  Description of Artificial Sequence: Synthetic coding sequence
atggacatggtggagaatgctgacagcctgcaggcccaggagaggaaggacatcctgatgaagtatgacaagggccaccgggccggcctgcctgaggacaagggccctgagcctgtgggcatcaacagcagcattgaccgcttcggcatcctgcacgagacagagctgccccctgtgacagcccgggaggccaagaagatccggcgggagatgaccaggaccagcaagtggatggagatgctgggggagtgggagacctacaagcacagcagcaagctgattgacagagtgtacaagggcatccccatgaacatccggggccctgtgtggagcgtgctgctgaacatccaggagatcaagctgaagaaccctggccgctaccagatcatgaaggagcggggcaagaggagcagcgagcacatccaccacatcgacctggatgtgaggaccaccctgagaaatcatgtgttcttccgggaccgctacggggccaagcagcgggagctgttctacatcctgctggcctacagcgagtacaaccctgaggtgggctactgccgggacctgagccacatcacagccctcttcctgctgtacctgcctgaagaagatgccttctgggccctggtgcagctgctggccagcgagcggcacagcctgcccggcttccacagccccaatggaggcaccgtgcagggcctgcaggaccagcaggagcacgtggtgcccaagagccagcccaagaccatgtggcaccaggacaaggagggcctgtgtggccagtgtgccagcctgggctgcctgctgaggaacctgattgatggcatcagcctgggcctgaccctgcggctgtgggatgtgtacctggtggagggggagcaggtgctgatgcccatcaccagcatcgccctgaaggtgcagcagaagaggctgatgaagaccagccgctgtggcctgtgggcccggctgaggaaccagttctttgacacctgggccatgaatgatgacacagtgctgaagcacctgcgggccagcaccaagaagctgaccaggaagcagggcgacctgcccccaccagccaagcgggagcagggcagcctggcccccaggcctgtgcctgccagcagaggaggcaagaccctgtgcaagggctaccggcaggcccctcctggccccccagcccagttccagaggcccatctgcagcgccagccccccctgggccagccgcttcagcaccccctgccctgggggcgctgtgcgggaggacacctaccctgtgggcacccagggcgtgcccagcctggccctggcccagggcggcccccagggctcctggaggttcctggagtggaagtccatgccccggctgcccacagacctggacattggaggcccctggttcccccactatgactttgagtggagctgctgggtgcgggccatcagccaggaggaccagctggccacctgctggcaggccgagcactgtggggaggtgcacaacaaggacatgtcctggccagaggagatgtccttcaccgccaacagcagcaagattgaccggcagaaggtgcccacagagaagggggccaccggcctgagcaacctgggcaacacctgcttcatgaacagcagcatccagtgtgtgagcaacacccagcccctgacccagtacttcatcagcggccgccacctgtatgagctgaacagaaccaaccccatcggcatgaagggccacatggccaagtgctatggagacctggtgcaggagctgtggagcggcacccagaagtctgtggcccccctgaagctgcggaggaccatcgccaagtatgcccccaagtttgatggcttccagcagcaggacagccaggagctgctggccttcctgctggatggcctgcacgaggacctgaacagagtgcatgagaagccctacgtggagctgaaggacagtgatggccgcccagactgggaggtggccgctgaggcctgggacaaccacctgcggaggaacagaagcatcatcgtggacctcttccacggccagctgcggagccaggtgaagtgcaagacctgtggccacatctctgtgcgctttgaccccttcaacttcctgagcctgcccctgcccatggacagctacatggacctggagatcaccgtcatcaagctggatggcaccacccctgtgcgctatggcctgcggctgaacatggatgagaagtacacaggcctgaagaagcagctgcgggacctgtgtggcctgaacagcgagcagatcctgctggccgaggtgcatgacagcaacatcaagaacttcccccaggacaaccagaaggtgcagctgtctgtgtctggcttcctgtgtgcctttgagatccctgtgcccagcagccccatcagcgccagcagccccacccagattgacttcagcagcagccccagcaccaacggcatgttcaccctgaccaccaatggagacctgcccaagcccatcttcatccccaacggcatgcccaacacagtggtgccctgtggcacagagaagaacttcaccaacggcatggtgaatggccacatgcccagcctgcctgacagccccttcaccggctacatcatcgctgtgcacaggaagatgatgaggacagagctgtacttcctgagcccccaggagaaccggcccagcctgtttggcatgcccctcatcgtgccctgcaccgtgcacaccaggaagaaggacctgtatgatgctgtgtggatccaggtgtcctggctggcccggcccctgcccccccaggaggccagcatccacgcccaggaccgggacaactgcatgggctaccagtaccccttcaccctgcgggtggtgcagaaggatggcaacagctgtgcctggtgcccccagtaccgcttctgccggggctgcaagattgactgtggagaagatcgggccttcatcggaaatgcctacatcgctgtggactggcaccccacagccctgcacctgcgctaccagaccagccaggagcgggtggtggacaagcatgaatctgtggagcagagccggcgggcccaggccgagcccatcaacctggacagctgcctgcgggccttcaccagcgaggaggagctgggggagagcgagatgtactactgcagcaagtgcaagacccactgcctggccaccaagaagctggacctgtggaggctgccccccttcctgatcatccacctgaagcgcttccagtttgtgaatgaccagtggatcaagagccagaagatcgtgcgcttcctgcgggagagctttgaccccagcgccttcctggtgccccgggaccctgccctgtgccagcacaagcccctgaccccccagggagatgagctgagcaagccccgcatcctggcccgggaggtgaagaaggtggatgcccagagcagcgctgggaaggaggacatgctgctgagcaagagccccagcagcctgagcgccaacatcagcagcagccccaagggcagccccagcagcagcaggaagagcggcaccagctgccccagcagcaagaacagcagccccaacagcagccccaggaccctgggccgcagcaagggccgcctgcggctgccccagatcggcagcaagaacaagcccagcagcagcaagaagaacctggatgccagcaaagaaaatggagctggccagatctgtgagctggctgatgccctgagccggggccacatgaggggcggcagccagcctgagctggtgaccccccaggaccacgaggtggccctggccaacggcttcctgtatgagcacgaggcctgtggaaatggctgtggagatggctacagcaatggccagctgggcaaccacagcgaggaggacagcacagatgaccagcgggaggacacccacatcaagcccatctacaacctgtatgccatcagctgccacagcggcatcctgagcggcggccactacatcacctacgccaagaaccccaactgcaagtggtactgctacaatgacagcagctgtgaggagctgcacccagatgaaattgacacagacagcgcctacatcctcttctatgagcagcagggcattgattatgcccagttcctgcccaagattgatggcaagaagatggctgacaccagcagcacagatgaagattctgagagtgactatgagaagtacagcatgctgcagtag

SEQ ID NO: 175213 - DNA, 3270 bp, Artificial Sequence
  Description of Artificial Sequence: Synthetic coding sequence
atgccccagaggctgccccacgcccggcagcacacccccctgcccctgggcagcgctgactaccgccgggtggtgtctgtgcggccccagggcccccaccgggaccccaaggacagcagagatgctgccaagcgggagcagggcagcctggcccccaggcctgtgcctgccagccggggcggcaagaccctgtgcaagggctaccggcaggcccctcctggccccccagcccagttccagaggcccatctgcagcgccagccccccctgggccagccgcttcagcaccccctgccctggaggagctgtgcgggaggacacctaccctgtgggcacccagggcgtgcccagcctggccctggcccagggcggcccccagggctcctggaggttcctggagtggaagtccatgccccggctgcccacagacctggacatcggcggcccctggttcccccactatgactttgagtggagctgctgggtgcgggccatcagccaggaggaccagctggccacctgctggcaggccgagcactgtggggaggtgcacaacaaggacatgtcctggccagaggagatgtccttcaccgccaacagcagcaagattgaccggcagaaggtgcccacagagaagggggccaccggcctgagcaacctgggcaacacctgcttcatgaacagcagcatccagtgtgtgagcaacacccagcccctgacccagtacttcatcagcggccgccacctgtatgagctgaacagaaccaaccccatcggcatgaagggccacatggccaagtgctacggggacctggtgcaggagctgtggagcggcacccagaagtctgtggcccccctgaagctgcggaggaccatcgccaagtatgcccccaagtttgatggcttccagcagcaggacagccaggagctgctggccttcctgctggatggcctgcacgaggacctgaacagagtgcatgagaagccctacgtggagctgaaggacagtgatggccgcccagactgggaggtggccgctgaggcctgggacaaccacctgcggaggaacagaagcatcatcgtggacctcttccacggccagctgcggagccaggtgaagtgcaagacctgtggccacatctctgtgcgctttgaccccttcaacttcctgagcctgcccctgcccatggacagctacatggacctggagatcaccgtcatcaagctggatggcaccacccctgtgcgctatggcctgcggctgaacatggatgagaagtacacaggcctgaagaagcagctgcgggacctgtgtggcctgaacagcgagcagatcctgctggccgaggtgcatgacagcaacatcaagaacttcccccaggacaaccagaaggtgcagctgtctgtgtctggcttcctgtgtgcctttgagatccctgtgcccagcagccccatcagcgccagcagccccacccagattgacttcagcagcagccccagcaccaacggcatgttcaccctgaccaccaacggggacctgcccaagcccatcttcatccccaacggcatgcccaacacagtggtgccctgtggcacagagaagaacttcaccaacggcatggtgaatggccacatgcccagcctgcctgacagccccttcaccggctacatcatcgctgtgcacaggaagatgatgaggacagagctgtacttcctgagcccccaggagaaccggcccagcctgtttggcatgcccctgattgtgccctgcaccgtgcacaccaggaagaaggacctgtatgatgctgtgtggatccaggtgtcctggctggcccggcccctgcccccccaggaggccagcatccacgcccaggaccgggacaactgcatgggctaccagtaccccttcaccctgcgggtggtgcagaaggatggcaacagctgtgcctggtgcccccagtaccgcttctgccggggctgcaagattgactgtggggaggaccgggccttcatcggaaatgcctacatcgctgtggactggcaccccacagccctgcacctgcgctaccagaccagccaggagcgggtggtggacaagcatgagagcgtggagcagagcagaagagcccaggccgagcccatcaacctggacagctgcctgcgggccttcaccagcgaggaggagctgggggagagcgagatgtactactgcagcaagtgcaagacccactgcctggccaccaagaagctggacctgtggaggctgccccccttcctgatcatccacctgaagcgcttccagtttgtgaatgaccagtggatcaagagccagaagatcgtgcgcttcctgcgggagagctttgaccccagcgccttcctggtgccccgggaccctgccctgtgccagcacaagcccctgaccccccagggagatgagctgagcaagccccgcatcctggcccgggaggtgaagaaggtggatgcccagagcagcgctgggaaggaggacatgctgctgagcaagagccccagcagcctgagcgccaacatcagcagcagccccaagggcagccccagcagcagcaggaagagcggcaccagctgccccagcagcaagaacagcagccccaacagcagccccaggaccctgggccgcagcaagggccgcctgcggctgccccagatcggcagcaagaacaagcccagcagcagcaagaagaacctggatgccagcaaagaaaatggagctggccagatctgtgagctggctgatgccctgagccggggccacatgagaggaggcagccagcctgagctggtgaccccccaggaccacgaggtggccctggccaacggcttcctgtatgaacatgaggcctgtggaaatggctgtggagatggctacagcaatggccagctgggcaaccacagcgaggaggacagcacagatgaccagcgggaggacacccacatcaagcccatctacaacctgtatgccatcagctgccacagcggcatcctgagcggcggccactacatcacctacgccaagaaccccaactgcaagtggtactgctacaatgacagcagctgtgaggagctgcacccagatgaaattgacacagattctgcctacatcctcttctatgagcagcagggcatcgactatgcccagttcctgcccaagattgatggcaagaagatggctgacaccagcagcacagatgaggacagcgagagtgactatgagaagtacagcatgctgcagtag

SEQ ID NO: 175214 - DNA, 2361 bp, Artificial Sequence
  Description of Artificial Sequence: Synthetic coding sequence
atggacatggtggagaatgctgacagcctgcaggcccaggagaggaaggacatcctgatgaagtatgacaagggccaccgggccggcctgcctgaggacaagggccctgagcctgtgggcatcaacagcagcattgaccgcttcggcatcctgcacgagacagagctgccccctgtgacagcccgggaggccaagaagatccggcgggagatgaccaggaccagcaagtggatggagatgctgggggagtgggagacctacaagcacagcagcaagctgattgacagagtgtacaagggcatccccatgaacatccggggccctgtgtggagcgtgctgctgaacatccaggagatcaagctgaagaaccctggccgctaccagatcatgaaggagcggggcaagaggagcagcgagcacatccaccacatcgacctggatgtgaggaccaccctgagaaatcatgtgttcttccgggaccgctacggggccaagcagcgggagctgttctacatcctgctggcctacagcgagtacaaccctgaggtgggctactgccgggacctgagccacatcacagccctcttcctgctgtacctgcctgaagaagatgccttctgggccctggtgcagctgctggccagcgagcggcacagcctgcccggcttccacagccccaatggaggcaccgtgcagggcctgcaggaccagcaggagcacgtggtgcccaagagccagcccaagaccatgtggcaccaggacaaggagggcctgtgtggccagtgtgccagcctgggctgcctgctgaggaacctgattgatggcatcagcctgggcctgaccctgcggctgtgggatgtgtacctggtggagggggagcaggtgctgatgcccatcaccagcatcgccctgaaggtgcagcagaagaggctgatgaagaccagccgctgtggcctgtgggcccggctgaggaaccagttctttgacacctgggccatgaatgatgacacagtgctgaagcacctgcgggccagcaccaagaagctgaccaggaagcagggcgacctgcccccaccagccaagcgggagcagggcagcctggcccccaggcctgtgcctgccagcagaggaggcaagaccctgtgcaagggctaccggcaggcccctcctggccccccagcccagttccagaggcccatctgcagcgccagccccccctgggccagccgcttcagcaccccctgccctgggggcgctgtgcgggaggacacctaccctgtgggcacccagggcgtgcccagcctggccctggcccagggcggcccccagggctcctggaggttcctggagtggaagtccatgccccggctgcccacagacctggacattggaggcccctggttcccccactatgactttgagtggagctgctgggtgcgggccatcagccaggaggaccagctggccacctgctggcaggccgagcactgtggggaggtgcacaacaaggacatgtcctggccagaggagatgtccttcaccgccaacagcagcaagattgaccggcagaaggtgcccacagagaagggggccaccggcctgagcaacctgggcaacacctgcttcatgaacagcagcatccagtgtgtgagcaacacccagcccctgacccagtacttcatcagcggccgccacctgtatgagctgaacagaaccaaccccatcggcatgaagggccacatggccaagtgctatggagacctggtgcaggagctgtggagcggcacccagaagtctgtggcccccctgaagctgcggaggaccatcgccaagtatgcccccaagtttgatggcttccagcagcaggacagccaggagctgctggccttcctgctggatggcctgcacgaggacctgaacagagtgcatgagaagccctacgtggagctgaaggacagtgatggccgcccagactgggaggtggccgctgaggcctgggacaaccacctgcggaggaacagaagcatcatcgtggacctcttccacggccagctgcggagccaggtgaagtgcaagacctgtggccacatctctgtgcgctttgaccccttcaacttcctgagcctgcccctgcccatggacagctacatggacctggagatcaccgtcatcaagctggatggcaccacccctgtgcgctatggcctgcggctgaacatggatgagaagtacacaggcctgaagaagcagctgcgggacctgtgtggcctgaacagcgagcagatcctgctggccgaggtgcatgacagcaacatcaagatcagccccctgcaccacctgcagatggagtgcagcccctag

SEQ ID NO: 175215 - DNA, 84 bp, Artificial Sequence
  Description of Artificial Sequence: Synthetic coding sequence
atggacatggtggagaatgctgacagcctgcaggcccaggagaggaaggacatcctgatgaagtatgacaagggccacaggtag

SEQ ID NO: 175216 - DNA, 174 bp, Artificial Sequence
  Description of Artificial Sequence: Synthetic coding sequence
atggacatggtggagaatgctgacagcctgcaggcccaggagaggaaggacatcctgatgaagtatgacaagggccaccgggccggcctgcctgaggacaagggcagccccctggagagcacagctgccctgattgtgctggccttctgcatgaggaggagctgcctgctgtag

SEQ ID NO: 175217 - DNA, 3309 bp, Artificial Sequence
  Description of Artificial Sequence: Synthetic coding sequence
atgaaccaccagcagcagcagcagcagcagaaggccggggagcagcagctgtctgagcctgaggacatggagatggaggccggggacacagatgatcctccccgcatcacccagaaccctgtgatcaatggaaatgtggccctgagtgatggccacaacacagctgaggaggacatggaggatgacacctcctggaggtctgaggccaccttccagttcaccgtggagcgcttcagccggctgtctgagagcgtgctgagccccccctgctttgtgaggaacctgccctggaagatcatggtgatgccccgcttctacccagaccggccccaccagaagtctgtgggcttcttcctgcagtgcaatgctgagagtgacagcacctcctggagctgccacgcccaggccgtgctgaagatcatcaactacagagatgatgagaagagcttcagccgccgcatcagccacctgttcttccacaaggaaaatgactggggcttcagcaacttcatggcctggagcgaggtgacagatcctgagaagggcttcattgatgatgacaaggtgacctttgaggtgtttgtgcaggctgatgcccctcatggagtggcctgggacagcaagaagcacacaggctacgtgggcctgaagaaccagggcgccacctgctacatgaacagcctgctgcagaccctcttcttcaccaaccagctgaggaaggctgtgtacatgatgcccacagaaggagatgacagcagcaagtctgtgcccctggccctgcagagggtcttctatgagctgcagcacagcgacaagcctgtgggcaccaagaagctgaccaagagctttggctgggagaccctggacagcttcatgcagcatgatgtgcaggagctgtgccgggtgctgctggacaacgtggagaacaagatgaagggcacctgtgtggagggcaccatccccaagctgttccggggcaagatggtgtcctacatccagtgcaaggaggtggactacagaagtgacagaagagaggactactatgacatccagctgagcatcaagggcaagaagaacatctttgagagctttgtggactatgtggccgtggagcagctggatggagacaacaagtatgatgctggggagcacggcctgcaggaggccgagaagggcgtgaagttcctgaccctgccccctgtgctgcacctgcagctgatgaggttcatgtatgacccccagacagaccagaacatcaagatcaatgacagatttgagttccctgagcagctgcccctggatgagttcctgcagaagacagaccccaaggaccctgccaactacatcctgcatgctgtgctggtgcacagcggggacaaccacggcggccactacgtggtgtacctgaaccccaagggagatggcaagtggtgcaagtttgatgatgatgtggtgagccgctgcaccaaggaggaggccatcgagcacaactacggcggccatgatgatgacctgtctgtgcgccactgcaccaatgcctacatgctggtgtacatccgggagagcaagctgtctgaggtgctgcaggccgtgacagaccatgacatcccccagcagctggtggagcggctgcaggaggagaagagaattgaggcccagaagaggaaggagcggcaggaggcccacctgtacatgcaggtgcagatcgtggccgaggaccagttctgtggccaccagggcaatgacatgtatgatgaggagaaggtgaagtacaccgtcttcaaggtgctgaagaacagcagcctggccgagtttgtgcagagcctgagccagaccatgggcttcccccaggaccagatccggctgtggcccatgcaggcccggagcaatggcaccaagaggcctgccatgctggacaatgaagcagatggcaacaagaccatgattgagctgagtgacaatgaaaacccctggaccatcttcctggagaccgtggaccctgagctggccgccagcggggccaccctgcccaagtttgacaaggaccatgatgtgatgctgttcctgaagatgtatgaccccaagaccaggagcctgaactactgcggccacatctacacccccatcagctgcaagatccgggacctgctgcctgtgatgtgtgaccgggccggcttcatccaggacaccagcctcatcctgtatgaggaggtgaagcccaacctgacagagcgcatccaggactatgatgtgtccctggacaaggccctggatgagctgatggatggagacatcatcgtgttccagaaggatgatcctgaaaatgacaacagcgagctgcccacagccaaggagtacttccgggacctgtaccaccgggtggatgtgatcttctgtgacaagaccatccccaatgaccccggctttgtggtgaccctgagcaacaggatgaactacttccaggtggccaagacagtggcccagaggctgaacacagaccccatgctgctgcagttcttcaagagccagggctacagagatggccctggcaaccccctgcggcacaactatgagggcaccctgcgggacctgctgcagttcttcaagccccggcagcccaagaagctgtactaccagcagctgaagatgaagatcacagactttgaaaatagaagaagcttcaagtgcatctggctgaacagccagttccgggaggaggagatcaccctgtacccagacaagcacggctgtgtgcgggacctgctggaggagtgcaagaaggctgtggagctgggggagaaggccagcggcaagctgcggctgctggagatcgtgtcctacaagatcatcggcgtgcaccaggaggatgagctgctggagtgcctgagccctgccaccagcaggaccttccgcatcgaggagatccccctggaccaggtggacatcgacaaggaaaatgagatgctggtgacagtggcccacttccacaaggaggtgtttggcaccttcggcatccccttcctgctgcgcatccaccagggcgagcacttccgggaggtgatgaagaggatccagagcctgctggacatccaggagaaggagtttgagaagttcaagtttgccatcgtgatgatgggccgccaccagtacatcaatgaagatgaatatgaggtgaacctgaaggactttgagccccagcccggcaacatgagccacccccggccctggctgggcctggaccacttcaacaaggcccccaagaggagccgctacacctacctggagaaggccatcaagatccacaactag

SEQ ID NO: 175218 - DNA, 3333 bp, Artificial Sequence
  Description of Artificial Sequence: Synthetic coding sequence
tgcagccacagtgatgtgggggagaggaccagccccatcccccagcagaggcccctgcagagccatgctgagatggccggcaaccaccggctgggcctggaggccggggacacagatgatcctccccgcatcacccagaaccctgtgatcaatggaaatgtggccctgagtgatggccacaacacagctgaggaggacatggaggatgacacctcctggaggtctgaggccaccttccagttcaccgtggagcgcttcagccggctgtctgagagcgtgctgagccccccctgctttgtgaggaacctgccctggaagatcatggtgatgccccgcttctacccagaccggccccaccagaagtctgtgggcttcttcctgcagtgcaatgctgagagtgacagcacctcctggagctgccacgcccaggccgtgctgaagatcatcaactacagagatgatgagaagagcttcagccgccgcatcagccacctgttcttccacaaggaaaatgactggggcttcagcaacttcatggcctggagcgaggtgacagatcctgagaagggcttcattgatgatgacaaggtgacctttgaggtgtttgtgcaggctgatgcccctcatggagtggcctgggacagcaagaagcacacaggctacgtgggcctgaagaaccagggcgccacctgctacatgaacagcctgctgcagaccctcttcttcaccaaccagctgaggaaggctgtgtacatgatgcccacagaaggagatgacagcagcaagtctgtgcccctggccctgcagagggtcttctatgagctgcagcacagcgacaagcctgtgggcaccaagaagctgaccaagagctttggctgggagaccctggacagcttcatgcagcatgatgtgcaggagctgtgccgggtgctgctggacaacgtggagaacaagatgaagggcacctgtgtggagggcaccatccccaagctgttccggggcaagatggtgtcctacatccagtgcaaggaggtggactacagaagtgacagaagagaggactactatgacatccagctgagcatcaagggcaagaagaacatctttgagagctttgtggactatgtggccgtggagcagctggatggagacaacaagtatgatgctggggagcacggcctgcaggaggccgagaagggcgtgaagttcctgaccctgccccctgtgctgcacctgcagctgatgaggttcatgtatgacccccagacagaccagaacatcaagatcaatgacagatttgagttccctgagcagctgcccctggatgagttcctgcagaagacagaccccaaggaccctgccaactacatcctgcatgctgtgctggtgcacagcggggacaaccacggcggccactacgtggtgtacctgaaccccaagggagatggcaagtggtgcaagtttgatgatgatgtggtgagccgctgcaccaaggaggaggccatcgagcacaactacggcggccatgatgatgacctgtctgtgcgccactgcaccaatgcctacatgctggtgtacatccgggagagcaagctgtctgaggtgctgcaggccgtgacagaccatgacatcccccagcagctggtggagcggctgcaggaggagaagagaattgaggcccagaagaggaaggagcggcaggaggcccacctgtacatgcaggtgcagatcgtggccgaggaccagttctgtggccaccagggcaatgacatgtatgatgaggagaaggtgaagtacaccgtcttcaaggtgctgaagaacagcagcctggccgagtttgtgcagagcctgagccagaccatgggcttcccccaggaccagatccggctgtggcccatgcaggcccggagcaatggcaccaagaggcctgccatgctggacaatgaagcagatggcaacaagaccatgattgagctgagtgacaatgaaaacccctggaccatcttcctggagaccgtggaccctgagctggccgccagcggggccaccctgcccaagtttgacaaggaccatgatgtgatgctgttcctgaagatgtatgaccccaagaccaggagcctgaactactgcggccacatctacacccccatcagctgcaagatccgggacctgctgcctgtgatgtgtgaccgggccggcttcatccaggacaccagcctcatcctgtatgaggaggtgaagcccaacctgacagagcgcatccaggactatgatgtgtccctggacaaggccctggatgagctgatggatggagacatcatcgtgttccagaaggatgatcctgaaaatgacaacagcgagctgcccacagccaaggagtacttccgggacctgtaccaccgggtggatgtgatcttctgtgacaagaccatccccaatgaccccggctttgtggtgaccctgagcaacaggatgaactacttccaggtggccaagacagtggcccagaggctgaacacagaccccatgctgctgcagttcttcaagagccagggctacagagatggccctggcaaccccctgcggcacaactatgagggcaccctgcgggacctgctgcagttcttcaagccccggcagcccaagaagctgtactaccagcagctgaagatgaagatcacagactttgaaaatagaagaagcttcaagtgcatctggctgaacagccagttccgggaggaggagatcaccctgtacccagacaagcacggctgtgtgcgggacctgctggaggagtgcaagaaggctgtggagctgggggagaaggccagcggcaagctgcggctgctggagatcgtgtcctacaagatcatcggcgtgcaccaggaggatgagctgctggagtgcctgagccctgccaccagcaggaccttccgcatcgaggagatccccctggaccaggtggacatcgacaaggaaaatgagatgctggtgacagtggcccacttccacaaggaggtgtttggcaccttcggcatccccttcctgctgcgcatccaccagggcgagcacttccgggaggtgatgaagaggatccagagcctgctggacatccaggagaaggagtttgagaagttcaagtttgccatcgtgatgatgggccgccaccagtacatcaatgaagatgaatatgaggtgaacctgaaggactttgagccccagcccggcaacatgagccacccccggccctggctgggcctggaccacttcaacaaggcccccaagaggagccgctacacctacctggagaaggccatcaagatccacaactag

SEQ ID NO: 175219 - DNA, 3012 bp, Artificial Sequence
  Description of Artificial Sequence: Synthetic coding sequence
atggtgatgccccgcttctacccagaccggccccaccagaagtctgtgggcttcttcctgcagtgcaatgctgagagtgacagcacctcctggagctgccacgcccaggccgtgctgaagatcatcaactacagagatgatgagaagagcttcagccgccgcatcagccacctgttcttccacaaggaaaatgactggggcttcagcaacttcatggcctggagcgaggtgacagatcctgagaagggcttcattgatgatgacaaggtgacctttgaggtgtttgtgcaggctgatgccccccacggcgtggcctgggacagcaagaagcacacaggctacgtgggcctgaagaaccagggcgccacctgctacatgaacagcctgctgcagaccctcttcttcaccaaccagctgaggaaggctgtgtacatgatgcccacagaaggagatgacagcagcaagtctgtgcccctggccctgcagagggtcttctatgagctgcagcacagcgacaagcctgtgggcaccaagaagctgaccaagagctttggctgggagaccctggacagcttcatgcagcatgatgtgcaggagctgtgccgggtgctgctggacaacgtggagaacaagatgaagggcacctgtgtggagggcaccatccccaagctgttccggggcaagatggtgtcctacatccagtgcaaggaggtggactacagaagtgaccggcgggaggactactatgacatccagctgagcatcaagggcaagaagaacatctttgagagctttgtggactatgtggccgtggagcagctggatggagacaacaagtatgatgctggggagcacggcctgcaggaggccgagaagggcgtgaagttcctgaccctgccccctgtgctgcacctgcagctgatgaggttcatgtatgacccccagacagaccagaacatcaagatcaatgacagatttgagttccctgagcagctgcccctggatgagttcctgcagaagacagaccccaaggaccctgccaactacatcctgcatgctgtgctggtgcacagcggggacaaccacggcggccactacgtggtgtacctgaaccccaagggagatggcaagtggtgcaagtttgatgatgatgtggtgagccgctgcaccaaggaggaggccatcgagcacaactatggaggccatgatgatgacctgtctgtgcgccactgcaccaatgcctacatgctggtgtacatccgggagagcaagctgtctgaggtgctgcaggccgtgacagaccatgacatcccccagcagctggtggagcggctgcaggaggagaagagaattgaggcccagaagaggaaggagcggcaggaggcccacctgtacatgcaggtgcagatcgtggccgaggaccagttctgtggccaccagggcaatgacatgtatgatgaggagaaggtgaagtacacagtgttcaaggtgctgaagaacagcagcctggccgagtttgtgcagagcctgagccagaccatgggcttcccccaggaccagatccggctgtggcccatgcaggcccggagcaatggcaccaagaggcctgccatgctggacaatgaagcagatggcaacaagaccatgattgagctgagtgacaatgaaaacccctggaccatcttcctggagaccgtggaccctgagctggccgccagcggggccaccctgcccaagtttgacaaggaccatgatgtgatgctgttcctgaagatgtatgaccccaagaccaggagcctgaactactgcggccacatctacacccccatcagctgcaagatccgggacctgctgcctgtgatgtgtgacagagctggcttcatccaggacaccagcctcatcctgtatgaggaggtgaagcccaacctgacagagcgcatccaggactatgatgtgtccctggacaaggccctggatgagctgatggatggagacatcatcgtgttccagaaggatgatcctgaaaatgacaacagcgagctgcccacagccaaggagtacttccgggacctgtaccaccgggtggatgtgatcttctgtgacaagaccatccccaatgaccccggctttgtggtgaccctgagcaacaggatgaactacttccaggtggccaagacagtggcccagaggctgaacacagaccccatgctgctgcagttcttcaagagccagggctacagagatggccctggcaaccccctgcggcacaactatgagggcaccctgcgggacctgctgcagttcttcaagccccggcagcccaagaagctgtactaccagcagctgaagatgaagatcacagactttgagaacagaagaagcttcaagtgcatctggctgaacagccagttccgggaggaggagatcaccctgtacccagacaagcacggctgtgtgcgggacctgctggaggagtgcaagaaggctgtggagctgggggagaaggccagcggcaagctgcggctgctggagatcgtgtcctacaagatcattggagtgcaccaggaggatgagctgctggagtgcctgagccctgccaccagcaggaccttcagaattgaggagatccccctggaccaggtggacatcgacaaggaaaatgagatgctggtgacagtggcccacttccacaaggaggtgtttggcaccttcggcatccccttcctgctgcgcatccaccagggcgagcacttccgggaggtgatgaagaggatccagagcctgctggacatccaggagaaggagtttgagaagttcaagtttgccatcgtgatgatgggccgccaccagtacatcaatgaagatgaatatgaggtgaacctgaaggactttgagccccagcccggcaacatgagccacccccggccctggctgggcctggaccacttcaacaaggcccccaagaggagccgctacacctacctggagaaggccatcaagatccacaactag

SEQ ID NO: 175220 - DNA, 1530 bp, Artificial Sequence
  Description of Artificial Sequence: Synthetic coding sequence
atggaggatgacacctcctggaggtctgaggccaccttccagttcaccgtggagcgcttcagccggctgtctgagagcgtgctgagccccccctgctttgtgaggaacctgccctggaagatcatggtgatgccccgcttctacccagaccggccccaccagaagtctgtgggcttcttcctgcagtgcaatgctgagagtgacagcacctcctggagctgccacgcccaggccgtgctgaagatcatcaactacagagatgatgagaagagcttcagccgccgcatcagccacctgttcttccacaaggaaaatgactggggcttcagcaacttcatggcctggagcgaggtgacagatcctgagaagggcttcattgatgatgacaaggtgacctttgaggtgtttgtgcaggctgatgcccctcatggagtggcctgggacagcaagaagcacacaggctacgtgggcctgaagaaccagggcgccacctgctacatgaacagcctgctgcagaccctcttcttcaccaaccagctgaggaaggctgtgtacatgatgcccacagaaggagatgacagcagcaagtctgtgcccctggccctgcagagggtcttctatgagctgcagcacagcgacaagcctgtgggcaccaagaagctgaccaagagctttggctgggagaccctggacagcttcatgcagcatgatgtgcaggagctgtgccgggtgctgctggacaacgtggagaacaagatgaagggcacctgtgtggagggcaccatccccaagctgttccggggcaagatggtgtcctacatccagtgcaaggaggtggactacagaagtgacagaagagaggactactatgacatccagctgagcatcaagggcaagaagaacatctttgagagctttgtggactatgtggccgtggagcagctggatggagacaacaagtatgatgctggggagcacggcctgcaggaggccgagaagggcgtgaagttcctgaccctgccccctgtgctgcacctgcagctgatgaggttcatgtatgacccccagacagaccagaacatcaagatcaatgacagatttgagttccctgagcagctgcccctggatgagttcctgcagaagacagaccccaaggaccctgccaactacatcctgcatgctgtgctggtgcacagcggggacaaccacggcggccactacgtggtgtacctgaaccccaagggagatggcaagtggtgcaagtttgatgatgatgtggtgagccgctgcaccaaggaggaggccatcgagcacaactacggcggccatgatgatgacctgtctgtgcgccactgcaccaatgcctacatgctggtgtacatccgggagagcaagctgactgtgggcggggccatcacccggcgggagaaggaccggggcagcgaggccgagggcgctgctggcagccccagcctgtatgccagcgctgacagcagaagaggccctgtgctgtggccaccccgggagtag

SEQ ID NO: 175221 - DNA, 7713 bp, Artificial Sequence
  Description of Artificial Sequence: Synthetic coding sequence
atgacagccaccacccggggcagccctgtgggcggcaatgacaaccagggccaggccccagatggccagagccagccccccctgcagcagaaccagaccagcagcccagacagcagcaatgaaaacagccctgccaccccaccagatgagcagggccagggagatgccccaccccagctggaggatgaggagcccgccttcccccacacagacctggccaagctggatgacatgatcaaccggccccgctgggtggtgcctgtgctgcccaagggggagctggaggtgctgctggaggccgccatcgacctgagcaagaagggcctggatgtgaagtctgaggcctgccagcgcttcttcagagatggcctgaccatctccttcaccaagatcctgacagatgaggccgtgtctggctggaagtttgagatccaccgctgcatcatcaacaacacccaccggctggtggagctgtgtgtggccaagctgagccaggactggttccccctgctggagctgctggccatggccctgaacccccactgcaagttccacatctacaacggcacccggccctgtgagagcgtgagcagctctgtgcagctgcctgaagatgagctgtttgcccggagcccagaccccaggagccccaagggctggctggtggacctgctgaacaagtttggcaccctgaatggcttccagatcctgcatgaccgcttcatcaatggaagtgccctgaatgtgcagatcatcgccgccctgatcaagcccttcggccagtgctatgagttcctgaccctgcacacagtgaagaagtacttcctgcccatcatcgagatggtgccccagttcctggagaacctgacagatgaggagctgaagaaggaggccaagaatgaggccaagaatgatgccctgtccatgatcatcaagagcctgaagaacctggccagccgggtgcccggccaggaggagaccgtgaagaacctggagatcttccggctgaagatgatcctgcggctgctgcagatcagcagcttcaacgggaagatgaatgccctgaatgaggtgaacaaggtgatcagctctgtgtcctactacacccaccgccacggcaaccctgaggaggaggagtggctgacagctgagaggatggccgagtggatccagcagaacaacatcctgagcatcgtgctgcgggacagcctgcaccagccccagtatgtggagaagctggagaagatcctgcgctttgtgatcaaggagaaggccctgaccctgcaggacctggacaacatctgggccgcccaggccggcaagcatgaggccatcgtgaagaatgtgcatgacctgctggccaagctggcctgggacttcagccctgagcagctggaccacctgtttgactgcttcaaggcctcctggaccaatgccagcaagaagcagcgggagaagctgctggagctgatccggcggctggccgaggatgacaaggatggagtgatggcccacaaggtgctgaacctgctgtggaacctggcccacagtgatgatgtgcctgtggacatcatggacctggccctgagcgcccacatcaagatcctggactacagctgcagccaggaccgggacacccagaagatccagtggattgaccgcttcatcgaggagctgcggaccaatgacaagtgggtgatcccagccctgaagcagatccgggagatctgcagcctgtttggagaggccccccagaacctgagccagacccagaggagcccccacgtgttctacagacatgacctgatcaaccagctgcagcacaaccacgccctggtgaccctggtggccgagaacctggccacctacatggagagcatgaggctgtatgcccgggaccatgaagattatgacccccagacagtgcggctgggcagccgctacagccacgtgcaggaggtgcaggagcggctgaacttcctgcgcttcctgctgaaggatggccagctgtggctgtgtgccccccaggccaagcagatctggaagtgcctggccgagaatgctgtgtacctgtgtgaccgggaggcctgcttcaagtggtacagcaagctgatgggagatgagccagacctggaccctgacatcaacaaggacttctttgagagcaatgtgctgcagctggaccccagcctgctgacagaaaatggcatgaagtgctttgagcgcttcttcaaggctgtgaactgccgggagggcaagctggtggccaagaggcgggcctacatgatggatgacctggagctgattggcctggactacctgtggagggtggtgatccagagcaatgatgacatcgccagccgggccatcgacctgctgaaggagatctacaccaacctgggcccccggctgcaggtgaaccaggtggtgattcatgaggacttcatccagagctgctttgaccggctgaaggccagctatgacaccctgtgtgtgctggatggagacaaggacagcgtgaactgtgcccggcaggaggccgtgaggatggtgcgggtgctgactgtgctgcgggagtacatcaatgaatgtgacagcgactaccacgaggagaggaccatcctgcccatgagccgggccttccggggcaagcacctgagctttgtggtgcgcttccccaaccagggccggcaggtggatgacctggaggtgtggagccacaccaatgacaccatcggctctgtgcggcgctgcatcctgaaccgcatcaaggccaacgtggcccacaccaagattgagctgtttgtgggcggggagctgattgatcctgcagatgacaggaagctgattggccagctgaacctgaaggacaagagcctcatcacagccaagctgacccagatcagcagcaacatgcccagcagcccagacagcagcagtgacagcagcacaggcagccctggcaaccacggcaaccactacagtgatggccccaaccctgaggtggagagctgcctgcccggggtcatcatgagcctgcacccccgctacatctccttcctgtggcaggtggccgacctgggcagcagcctgaacatgccacccctgagagatggagcccgggtgctgatgaagctgatgcccccagacagcaccaccatcgagaagctgcgggccatctgcctggaccacgccaagctgggggagagcagcctgagccccagcctggacagcctcttcttcggccccagcgccagccaggtgctgtacctgacagaggtggtgtatgccctgctgatgcctgctggggcccccctggctgatgacagcagtgacttccagttccacttcctgaagagcggcggcctgcccctggtgctgtccatgctgaccaggaacaacttcctgcccaatgctgacatggagacccggcggggggcctacctgaatgccctgaagatcgccaagctgctgctgacagccatcggctacggccacgtgcgggctgtggccgaggcctgccagcccggggtggagggcgtgaaccccatgacccagatcaaccaggtgacccatgaccaggccgtggtgctgcagagcgccctgcagagcatccccaaccccagcagcgagtgcatgctgagaaatgtgtctgtgcggctggcccagcagatcagtgatgaggccagccgctacatgccagacatctgtgtgatccgggccatccagaagatcatctgggccagcggctgcggcagcctgcagctggtgttcagccccaatgaggagatcaccaagatctatgagaagaccaatgctggaaatgaaccagacctggaggatgagcaggtgtgctgtgaggccctggaggtgatgaccctgtgctttgccctgatccccacagccctggatgccctgagcaaggagaaggcctggcagaccttcatcatcgacctgctgctgcactgccacagcaagacagtgcggcaggtggcccaggagcagttcttcctgatgtgcacccgctgctgcatgggccaccggcccctgctcttcttcatcaccctgctcttcaccgtgctgggcagcacagcccgggagcgggccaagcacagcggggactacttcaccctgctgcggcacctgctgaactatgcctacaacagcaacatcaacgtgcccaatgctgaggtgctgctgaacaatgaaattgactggctgaagaggatcagagatgatgtgaagaggactggagagaccggcatcgaggagaccatcctggagggccacctgggcgtgaccaaggagctgctggccttccagaccagcgagaagaagttccacatcggctgtgagaagggcggggccaacctgatcaaggagctgattgatgacttcatcttccctgccagcaatgtgtacctgcagtacatgagaaatggagagctgcctgctgagcaggccatccctgtgtgtggcagcccccccaccatcaatgccggctttgagctgctggtggccctggccgtgggctgtgtgaggaacctgaagcagatcgtggacagcctgacagagatgtactacatcggcacagccatcaccacctgtgaggccctgacagagtgggagtacctgccccctgtgggcccccggccccccaagggctttgtgggcctgaagaatgctggggccacctgctacatgaacagcgtcatccagcagctgtacatgatccccagcatcagaaatggcatcctggccatcgagggcactggaagtgatgtggatgatgacatgtctggagatgagaagcaggacaatgaaagcaatgtggaccccagagatgatgtgtttggctacccccagcagtttgaggacaagccagccctgagcaagacagaggacaggaaggagtacaacattggagtgctgcggcacctgcaggtgatcttcggccacctggccgccagccggctgcagtactacgtgccccggggcttctggaagcagttccggctgtggggcgagcctgtgaacctgcgggagcagcatgatgccctggagttcttcaacagcctggtggacagcctggatgaggccctgaaggccctgggccacccagccatgctgagcaaggtgctgggcggcagctttgctgaccagaagatctgccagggctgcccccacagatatgaatgtgaggagagcttcaccaccctgaatgtggacatccggaaccaccagaacctgctggacagcctggagcagtatgtgaagggggacctgctggagggcgccaatgcctaccactgtgagaagtgcaacaagaaggtggacacagtgaagaggctgctgatcaagaagctgccccctgtgctggccatccagctgaagagatttgattatgactgggagagagaatgtgccatcaagttcaatgactactttgagttcccccgggagctggacatggagccctacacagtggccggcgtggccaagctggagggggacaacgtgaaccctgagagccagctgatccagcagagcgagcagagcgagagcgagacagctggcagcaccaagtaccgcctggtgggcgtgctggtgcacagcggccaggccagcggcggccactactacagctacatcatccagagaaatggaggagatggagagaggaaccgctggtacaagtttgatgatggagatgtgacagagtgcaagatggatgatgatgaggagatgaagaaccagtgctttggaggagagtacatgggagaggtgtttgaccacatgatgaagaggatgagctaccgccggcagaagcgctggtggaatgcctacatcctcttctatgaaagaatggacaccatcgaccaggatgatgagctgatccgctacatcagcgagctggccatcaccacccggccccaccagatcatcatgcccagcgccatcgagaggtctgtgaggaagcagaatgtgcagttcatgcacaacaggatgcagtacagcatggagtacttccagttcatgaagaagctgctgacctgcaatggagtgtacctgaaccccccacctggccaggaccacctgctgcctgaggccgaggagatcaccatgatcagcatccagctggccgcccgcttcctgttcaccaccggcttccacaccaagaaggtggtgcggggcagcgccagtgactggtatgatgccctgtgcatcctgctgcggcacagcaagaatgtgcgcttctggtttgcccacaacgtgctcttcaacgtgagcaaccgcttcagcgagtacctgctggagtgccccagcgctgaggtgcggggggcctttgccaagctgattgtgttcatcgcccacttcagcctgcaggacggcccctgccccagcccctttgccagccctggccccagcagccaggcctatgacaacctgagcctgagtgaccacctgctgcgggctgtgctgaacctgctgcggcgggaggtgtctgaacatggccgccacctgcagcagtacttcaacctgtttgtgatgtatgccaacctgggcgtggccgagaagacccagctgctgaagctgtctgtgcctgccaccttcatgctggtgtccctggatgagggccctggcccccccatcaagtaccagtatgcagagctgggcaagctgtacagcgtggtgtcccagctgatccgctgctgcaatgtgagcagcaggatgcagagcagcatcaatggaaatccacccctgcccaacccctttggagaccccaacctgagccagcccatcatgcccatccagcagaatgtggccgacatcctgtttgtgaggaccagctatgtgaagaagatcatcgaggactgcagcaacagcgaggagaccgtgaagctgctgcgcttctgctgctgggagaacccccagttcagcagcacagtgctgtctgagctgctgtggcaggtggcctacagctacacctatgagctgcggccctacctggacctgctgctgcagatcctgctgattgaagattcctggcagacccaccgcatccacaatgccctgaagggcatcccagatgacagagatggcctgtttgacaccatccagaggagcaagaaccactaccagaagagggcctaccagtgcatcaagtgcatggtggccctcttcagcaactgccctgtggcctaccagatcctgcagggcaatggagacctgaagaggaagtggacctgggccgtggagtggctgggagatgagctggagcggcggccctacacaggcaacccccagtacacctacaacaactggagcccccctgtgcagagcaatgagaccagcaatggctacttcctggagaggagccacagcgccaggatgaccctggccaaggcctgtgagctgtgcccagaggaggtgaagaaggccacctctgtgcagcagatcgagatggaggagagcaaggagccagatgaccaggatgccccagatgagcacgagagccccccaccagaagatgcccccctgtacccccacagccctggcagccagtaccagcagaacaaccacgtgcacggccagccctacacaggccctgctgcccaccacatgaacaacccccagaggacaggccagagggcccaggagaactatgagggcagcgaggaggtgagccccccccagaccaaggaccagtag

SEQ ID NO: 175222 - DNA, 7665 bp, Artificial Sequence
  Description of Artificial Sequence: Synthetic coding sequence
atgacagccaccacccggggcagccctgtgggcggcaatgacaaccagggccaggccccagatggccagagccagccccccctgcagcagaaccagaccagcagcccagacagcagcaatgaaaacagccctgccaccccaccagatgagcagggccagggagatgccccaccccagctggaggatgaggagcccgccttcccccacacagacctggccaagctggatgacatgatcaaccggccccgctgggtggtgcctgtgctgcccaagggggagctggaggtgctgctggaggccgccatcgacctgagcaagaagggcctggatgtgaagtctgaggcctgccagcgcttcttcagagatggcctgaccatctccttcaccaagatcctgacagatgaggccgtgtctggctggaagtttgagatccaccgctgcatcatcaacaacacccaccggctggtggagctgtgtgtggccaagctgagccaggactggttccccctgctggagctgctggccatggccctgaacccccactgcaagttccacatctacaacggcacccggccctgtgagagcgtgagcagctctgtgcagctgcctgaagatgagctgtttgcccggagcccagaccccaggagccccaagggctggctggtggacctgctgaacaagtttggcaccctgaatggcttccagatcctgcatgaccgcttcatcaatggaagtgccctgaatgtgcagatcatcgccgccctgatcaagcccttcggccagtgctatgagttcctgaccctgcacacagtgaagaagtacttcctgcccatcatcgagatggtgccccagttcctggagaacctgacagatgaggagctgaagaaggaggccaagaatgaggccaagaatgatgccctgtccatgatcatcaagagcctgaagaacctggccagccgggtgcccggccaggaggagaccgtgaagaacctggagatcttccggctgaagatgatcctgcggctgctgcagatcagcagcttcaacgggaagatgaatgccctgaatgaggtgaacaaggtgatcagctctgtgtcctactacacccaccgccacggcaaccctgaggaggaggagtggctgacagctgagaggatggccgagtggatccagcagaacaacatcctgagcatcgtgctgcgggacagcctgcaccagccccagtatgtggagaagctggagaagatcctgcgctttgtgatcaaggagaaggccctgaccctgcaggacctggacaacatctgggccgcccaggccggcaagcatgaggccatcgtgaagaatgtgcatgacctgctggccaagctggcctgggacttcagccctgagcagctggaccacctgtttgactgcttcaaggcctcctggaccaatgccagcaagaagcagcgggagaagctgctggagctgatccggcggctggccgaggatgacaaggatggagtgatggcccacaaggtgctgaacctgctgtggaacctggcccacagtgatgatgtgcctgtggacatcatggacctggccctgagcgcccacatcaagatcctggactacagctgcagccaggaccgggacacccagaagatccagtggattgaccgcttcatcgaggagctgcggaccaatgacaagtgggtgatcccagccctgaagcagatccgggagatctgcagcctgtttggagaggccccccagaacctgagccagacccagaggagcccccacgtgttctacagacatgacctgatcaaccagctgcagcacaaccacgccctggtgaccctggtggccgagaacctggccacctacatggagagcatgaggctgtatgcccgggaccatgaagattatgacccccagacagtgcggctgggcagccgctacagccacgtgcaggaggtgcaggagcggctgaacttcctgcgcttcctgctgaaggatggccagctgtggctgtgtgccccccaggccaagcagatctggaagtgcctggccgagaatgctgtgtacctgtgtgaccgggaggcctgcttcaagtggtacagcaagctgatgggagatgagccagacctggaccctgacatcaacaaggacttctttgagagcaatgtgctgcagctggaccccagcctgctgacagaaaatggcatgaagtgctttgagcgcttcttcaaggctgtgaactgccgggagggcaagctggtggccaagaggcgggcctacatgatggatgacctggagctgattggcctggactacctgtggagggtggtgatccagagcaatgatgacatcgccagccgggccatcgacctgctgaaggagatctacaccaacctgggcccccggctgcaggtgaaccaggtggtgattcatgaggacttcatccagagctgctttgaccggctgaaggccagctatgacaccctgtgtgtgctggatggagacaaggacagcgtgaactgtgcccggcaggaggccgtgaggatggtgcgggtgctgactgtgctgcgggagtacatcaatgaatgtgacagcgactaccacgaggagaggaccatcctgcccatgagccgggccttccggggcaagcacctgagctttgtggtgcgcttccccaaccagggccggcaggtggatgacctggaggtgtggagccacaccaatgacaccatcggctctgtgcggcgctgcatcctgaaccgcatcaaggccaacgtggcccacaccaagattgagctgtttgtgggcggggagctgattgatcctgcagatgacaggaagctgattggccagctgaacctgaaggacaagagcctcatcacagccaagctgacccagatcagcagcaacatgcccagcagcccagacagcagcagtgacagcagcacaggcagccctggcaaccacggcaaccactacagtgatggccccaaccctgaggtggagagctgcctgcccggggtcatcatgagcctgcacccccgctacatctccttcctgtggcaggtggccgacctgggcagcagcctgaacatgccacccctgagagatggagcccgggtgctgatgaagctgatgcccccagacagcaccaccatcgagaagctgcgggccatctgcctggaccacgccaagctgggggagagcagcctgagccccagcctggacagcctcttcttcggccccagcgccagccaggtgctgtacctgacagaggtggtgtatgccctgctgatgcctgctggggcccccctggctgatgacagcagtgacttccagttccacttcctgaagagcggcggcctgcccctggtgctgtccatgctgaccaggaacaacttcctgcccaatgctgacatggagacccggcggggggcctacctgaatgccctgaagatcgccaagctgctgctgacagccatcggctacggccacgtgcgggctgtggccgaggcctgccagcccggggtggagggcgtgaaccccatgacccagatcaaccaggtgacccatgaccaggccgtggtgctgcagagcgccctgcagagcatccccaaccccagcagcgagtgcatgctgagaaatgtgtctgtgcggctggcccagcagatcagtgatgaggccagccgctacatgccagacatctgtgtgatccgggccatccagaagatcatctgggccagcggctgcggcagcctgcagctggtgttcagccccaatgaggagatcaccaagatctatgagaagaccaatgctggaaatgaaccagacctggaggatgagcaggtgtgctgtgaggccctggaggtgatgaccctgtgctttgccctgatccccacagccctggatgccctgagcaaggagaaggcctggcagaccttcatcatcgacctgctgctgcactgccacagcaagacagtgcggcaggtggcccaggagcagttcttcctgatgtgcacccgctgctgcatgggccaccggcccctgctcttcttcatcaccctgctcttcaccgtgctgggcagcacagcccgggagcgggccaagcacagcggggactacttcaccctgctgcggcacctgctgaactatgcctacaacagcaacatcaacgtgcccaatgctgaggtgctgctgaacaatgaaattgactggctgaagaggatcagagatgatgtgaagaggactggagagaccggcatcgaggagaccatcctggagggccacctgggcgtgaccaaggagctgctggccttccagaccagcgagaagaagttccacatcggctgtgagaagggcggggccaacctgatcaaggagctgattgatgacttcatcttccctgccagcaatgtgtacctgcagtacatgagaaatggagagctgcctgctgagcaggccatccctgtgtgtggcagcccccccaccatcaatgccggctttgagctgctggtggccctggccgtgggctgtgtgaggaacctgaagcagatcgtggacagcctgacagagatgtactacatcggcacagccatcaccacctgtgaggccctgacagagtgggagtacctgccccctgtgggcccccggccccccaagggctttgtgggcctgaagaatgctggggccacctgctacatgaacagcgtcatccagcagctgtacatgatccccagcatcagaaatggcatcctggccatcgagggcactggaagtgatgtggatgatgacatgtctggagatgagaagcaggacaatgaaagcaatgtggaccccagagatgatgtgtttggctacccccagcagtttgaggacaagccagccctgagcaagacagaggacaggaaggagtacaacattggagtgctgcggcacctgcaggtgatcttcggccacctggccgccagccggctgcagtactacgtgccccggggcttctggaagcagttccggctgtggggcgagcctgtgaacctgcgggagcagcatgatgccctggagttcttcaacagcctggtggacagcctggatgaggccctgaaggccctgggccacccagccatgctgagcaaggtgctgggcggcagctttgctgaccagaagatctgccagggctgcccccacagatatgaatgtgaggagagcttcaccaccctgaatgtggacatccggaaccaccagaacctgctggacagcctggagcagtatgtgaagggggacctgctggagggcgccaatgcctaccactgtgagaagtgcaacaagaaggtggacacagtgaagaggctgctgatcaagaagctgccccctgtgctggccatccagctgaagagatttgattatgactgggagagagaatgtgccatcaagttcaatgactactttgagttcccccgggagctggacatggagccctacacagtggccggcgtggccaagctggagggggacaacgtgaaccctgagagccagctgatccagcagagcgagcagagcgagagcgagacagctggcagcaccaagtaccgcctggtgggcgtgctggtgcacagcggccaggccagcggcggccactactacagctacatcatccagagaaatggaggagatggagagaggaaccgctggtacaagtttgatgatggagatgtgacagagtgcaagatggatgatgatgaggagatgaagaaccagtgctttggaggagagtacatgggagaggtgtttgaccacatgatgaagaggatgagctaccgccggcagaagcgctggtggaatgcctacatcctcttctatgaaagaatggacaccatcgaccaggatgatgagctgatccgctacatcagcgagctggccatcaccacccggccccaccagatcatcatgcccagcgccatcgagaggtctgtgaggaagcagaatgtgcagttcatgcacaacaggatgcagtacagcatggagtacttccagttcatgaagaagctgctgacctgcaatggagtgtacctgaaccccccacctggccaggaccacctgctgcctgaggccgaggagatcaccatgatcagcatccagctggccgcccgcttcctgttcaccaccggcttccacaccaagaaggtggtgcggggcagcgccagtgactggtatgatgccctgtgcatcctgctgcggcacagcaagaatgtgcgcttctggtttgcccacaacgtgctcttcaacgtgagcaaccgcttcagcgagtacctgctggagtgccccagcgctgaggtgcggggggcctttgccaagctgattgtgttcatcgcccacttcagcctgcaggacggcccctgccccagcccctttgccagccctggccccagcagccaggcctatgacaacctgagcctgagtgaccacctgctgcgggctgtgctgaacctgctgcggcgggaggtgtctgaacatggccgccacctgcagcagtacttcaacctgtttgtgatgtatgccaacctgggcgtggccgagaagacccagctgctgaagctgtctgtgcctgccaccttcatgctggtgtccctggatgagggccctggcccccccatcaagtaccagtatgcagagctgggcaagctgtacagcgtggtgtcccagctgatccgctgctgcaatgtgagcagcaggatgcagagcagcatcaatggaaatccacccctgcccaacccctttggagaccccaacctgagccagcccatcatgcccatccagcagaatgtggccgacatcctgtttgtgaggaccagctatgtgaagaagatcatcgaggactgcagcaacagcgaggagaccgtgaagctgctgcgcttctgctgctgggagaacccccagttcagcagcacagtgctgtctgagctgctgtggcaggtggcctacagctacacctatgagctgcggccctacctggacctgctgctgcagatcctgctgattgaagattcctggcagacccaccgcatccacaatgccctgaagggcatcccagatgacagagatggcctgtttgacaccatccagaggagcaagaaccactaccagaagagggcctaccagtgcatcaagtgcatggtggccctcttcagcaactgccctgtggcctaccagatcctgcagggcaatggagacctgaagaggaagtggacctgggccgtggagtggctgggagatgagctggagcggcggccctacacaggcaacccccagtacacctacaacaactggagcccccctgtgcagagcaatgagaccagcaatggctacttcctggagaggagccacagcgccaggatgaccctggccaaggcctgtgagctgtgcccagaggaggagccagatgaccaggatgccccagatgagcacgagagccccccaccagaagatgcccccctgtacccccacagccctggcagccagtaccagcagaacaaccacgtgcacggccagccctacacaggccctgctgcccaccacatgaacaacccccagaggacaggccagagggcccaggagaactatgagggcagcgaggaggtgagccccccccagaccaaggaccagtag

SEQ ID NO: 175223 - DNA, 7668 bp, Artificial Sequence
  Description of Artificial Sequence: Synthetic coding sequence
atgacagccatcacccacggcagccctgtgggcggcaatgacagccagggccaggtgctggatggccagagccagcacctgttccagcagaaccagaccagcagcccagacagcagcaatgaaaattctgtggccaccccacctcctgaggagcagggccagggagatgccccaccccagcatgaagatgaggagcccgccttcccccacacagagctggccaacctggatgacatgatcaaccggccccgctgggtggtgcctgtgctgcccaagggggagctggaggtgctgctggaggccgccatcgacctgtctgtgaagggcctggatgtgaagtctgaggcctgccagcgcttcttcagagatggcctgaccatctccttcaccaagatcctgatggatgaagctgtgtctggctggaagtttgagatccaccgctgcatcatcaacaacacccaccggctggtggagctgtgtgtggccaagctgagccaggactggttccccctgctggagctgctggccatggccctgaacccccactgcaagttccacatctacaacggcacccggccctgtgagctgatcagcagcaatgcccagctgcctgaagatgagctgtttgcccggagcagtgaccccaggagccccaagggctggctggtggacctgatcaacaagtttggcaccctgaatggcttccagatcctgcatgaccgcttcttcaacggcagcgccctgaacatccagatcatcgccgccctgatcaagcccttcggccagtgctatgagttcctgagccagcacaccctgaagaagtacttcatccctgtgattgagatcgtgccccacctgctggagaacctgacagatgaggagctgaagaaggaggccaagaatgaggccaagaatgatgccctgtccatgatcatcaagagcctgaagaacctggccagccgcatcagcggccaggatgagaccatcaagaacctggagatcttccggctgaagatgatcctgcggctgctgcagatcagcagcttcaacgggaagatgaatgccctgaatgagatcaacaaggtgatcagctctgtgtcctactacacccaccgccacagcaaccctgaggaggaggagtggctgacagctgagaggatggccgagtggatccagcagaacaacatcctgagcatcgtgctgcaggacagcctgcaccagccccagtatgtggagaagctggagaagatcctgcgcttcgtcatcaaggagaaggccctgaccctgcaggacctggacaacatctgggccgcccaggccggcaagcatgaggccatcgtgaagaatgtgcatgacctgctggccaagctggcctgggacttcagccctggccagctggaccacctgtttgactgcttcaaggcctcctggaccaatgccagcaagaagcagcgggagaagctgctggagctgatccggcggctggctgaagatgacaaggatggagtgatggcccacaaggtgctgaacctgctgtggaacctggcccagagtgatgatgtgcctgtggacatcatggacctggccctgagcgcccacatcaagatcctggactacagctgcagccaggacagagatgcccagaagatccagtggattgaccacttcatcgaggagctgcggaccaatgacaagtgggtgatcccagccctgaagcagatccgggagatctgcagcctgtttggagaggccagccagaacctgagccagacccagaggagcccccacatcttctacagacatgacctgatcaaccagctgcagcagaaccacgccctggtgaccctggtggccgagaacctggccacctacatgaacagcatccggctgtatgctggggaccacgaggactatgacccccagacagtgcggctgggcagccgctacagccacgtgcaggaggtgcaggagcggctgaacttcctgcgcttcctgctgaaggatggccagctgtggctgtgtgccccccaggccaagcagatctggaagtgcctggctgaaaatgctgtgtacctgtgtgaccgggaggcctgcttcaagtggtacagcaagctgatgggagatgagccagacctggaccctgacatcaacaaggacttctttgagagcaatgtgctgcagctggaccccagcctgctgacagaaaatggcatgaagtgctttgagcgcttcttcaaggctgtgaactgccgggagaggaagctgattgccaagagaagaagctacatgatggatgacctggagctgattggcctggactacctgtggagggtggtgatccagagcagtgatgagatcgccaacagagccatcgacctgctgaaggagatctacaccaacctgggcccccggctgaaggccaaccaggtggtgattcatgaggacttcatccagagctgctttgaccggctgaaggccagctatgacaccctgtgtgtgtttgatggagacaagaacagcatcaactgtgcccggcaggaggccatccgcatggtgcgggtgctgaccgtcatcaaggagtacatcaatgaatgtgacagcgactaccacaaggagaggatgatcctgcccatgagccgggccttccggggcaagcacctgagcctcatcgtgcgcttccccaaccagggccggcaggtggatgagctggacatctggagccacaccaatgacaccatcggctctgtgcggcgctgcatcgtgaaccgcatcaaggccaacgtggcccacaagaagattgagctgtttgtgggcggggagctgattgacagtgaagatgacaggaagctgattggccagctgaacctgaaggacaagagcctcatcacagccaagctgacccagatcaacttcaacatgcccagcagcccagacagcagcagtgacagcagcacagccagccctggcaaccacaggaaccactacaatgatggccccaacctggaggtggagagctgcctgcccggggtcatcatgtctgtgcacccccgctacatctccttcctgtggcaggtggccgacctgggcagcaacctgaacatgccacccctgagagatggagcccgggtgctgatgaagctgatgcccccagacagaacagctgtggagaagctgcgggctgtgtgcctggaccacgccaagctgggggagggcaagctgagcccccccctggacagcctcttcttcggccccagcgccagccaggtgctgtacctgacagaggtggtgtatgccctgctgatgcctgctggggtgcccctgacagatggcagcagtgacttccaggtgcacttcctgaagagcggcggcctgcccctggtgctgtccatgctgatccggaacaacttcctgcccaacacagacatggagaccaggagaggagcctacctgaatgccctgaagatcgccaagctgctgctgacagccatcggctacggccacgtgcgggctgtggccgaggcctgccagcctgtggtggatggaacagaccccatcacccagatcaaccaggtgacccatgaccaggccgtggtgctgcagagcgccctgcagagcatccccaaccccagcagtgaatgtgtgctgagaaatgaaagcatcctgctggcccaggagatcagcaatgaggccagccgctacatgccagacatctgtgtgatccgggccatccagaagatcatctgggccagcgcctgtggggccctgggcctggtgttcagccccaatgaggagatcaccaagatctaccagatgaccaccaacggcagcaacaagctggaggtggaggatgagcaggtgtgctgtgaggccctggaggtgatgaccctgtgctttgccctgctgcccacagccctggatgccctgagcaaggagaaggcctggcagaccttcatcatcgacctgctgctgcactgccccagcaagacagtgcggcagctggcccaggagcagttcttcctgatgtgcacccgctgctgcatgggccaccggcccctgctcttcttcatcaccctgctcttcaccatcctgggcagcacagcccgggagaagggcaagtacagcggggactacttcaccctgctgcggcacctgctgaactatgcctacaacggcaacatcaacatccccaatgctgaggtgctgctggtgtctgaaattgactggctgaagaggatccgggacaacgtgaagaacacaggagagaccggggtggaggagcccatcctggagggccacctgggcgtgaccaaggagctgctggccttccagaccagcgagaagaagtaccacttcggctgtgagaagggcggggccaacctgatcaaggagctgattgatgacttcatcttccctgccagcaaggtgtacctgcagtacctgcggagcggggagctgcctgctgagcaggccatccctgtgtgcagcagccctgtgaccatcaatgccggctttgagctgctggtggccctggccatcggctgtgtgaggaacctgaagcagatcgtggactgcctgacagagatgtactacatgggcacagccatcaccacctgtgaggccctgacagagtgggagtacctgccccctgtgggcccccggccccccaagggctttgtgggcctgaagaatgctggggccacctgctacatgaacagcgtcatccagcagctgtacatgatccccagcatccggaacagcatcctggccatcgagggcactggaagtgacctgcatgatgacatgtttggagatgagaagcaggacagcgagagcaatgtggaccccagagatgatgtgtttggctacccccaccagtttgaggacaagccagccctgagcaagacagaggacaggaaggagtacaacattggagtgctgcggcacctgcaggtgatcttcggccacctggccgccagccagctgcagtactacgtgccccggggcttctggaagcagttccggctgtggggcgagcctgtgaacctgcgggagcagcatgatgccctggagttcttcaacagcctggtggacagcctggatgaggccctgaaggccctgggccacccagccatcctgagcaaggtgctgggcggcagctttgctgaccagaagatctgccagggctgcccccacagatatgaatgtgaggagagcttcaccaccctgaatgtggacatccggaaccaccagaacctgctggacagcctggagcagtacatcaagggggacctgctggagggcgccaatgcctaccactgtgagaagtgtgacaagaaggtggacacagtgaagaggctgctgatcaagaagctgccccgggtgctggccatccagctgaagagatttgattatgactgggagagagaatgtgccatcaagttcaatgactactttgagttcccccgggagctggacatgggcccctacacagtggccggcgtggccaacctggagcgggacaacgtgaacagtgaaaatgagctgattgagcagaaggagcagagcgacaatgaaacagctgggggcaccaagtaccgcctggtgggcgtgctggtgcacagcggccaggccagcggcggccactactacagctacatcatccagagaaatggcaaggatgaccagacagaccactggtacaagtttgatgatggagatgtgacagagtgcaagatggatgatgatgaggagatgaagaaccagtgctttggaggagagtacatgggagaggtgtttgaccacatgatgaagaggatgagctaccgccggcagaagcgctggtggaatgcctacatcctcttctatgagcagatggacatgattgatgaagatgatgagatgatccgctacatcagcgagctgaccatcgcccggccccaccagatcatcatgagccctgccatcgagaggtctgtgaggaagcagaatgtgaagttcatgcacaaccggctgcagtacagcctggagtacttccagtttgtgaagaagctgctgacctgcaatggagtgtacctgaacccagcccctggccaggactacctgctgcctgaggccgaggagatcaccatgatcagcatccagctggccgcccgcttcctgttcaccaccggcttccacaccaagaagatcgtgcggggccctgccagtgactggtatgatgccctgtgtgtgctgctgcggcacagcaagaatgtgcgcttctggttcacccacaacgtgctcttcaacgtgagcaaccgcttcagcgagtacctgctggagtgccccagcgctgaggtgcggggggcctttgccaagctgattgtgttcatcgcccacttcagcctgcaggacggcagctgccccagcccctttgccagccctggccccagcagccaggcctgtgacaacctgagcctgagtgaccacctgctgcgggccaccctgaacctgctgcggcgggaggtgtctgagcacggccaccacctgcagcagtacttcaacctgtttgtgatgtatgccaacctgggcgtggccgagaagacccagctgctgaagctgaatgtgcctgccaccttcatgctggtgtccctggatgagggccctggcccccccatcaagtaccagtatgcagagctgggcaagctgtacagcgtggtgtcccagctgatccgctgctgcaatgtgagcagcaccatgcagagcagcatcaatggaaacccccccctgcccaacccctttggagacctgaacctgagccagcccatcatgcccatccagcagaatgtgctggacatcctgtttgtgaggaccagctatgtgaagaagatcatcgaggactgcagcaacagcgaggacaccatcaagctgctgcgcttctgctcctgggagaacccccagttcagcagcacagtgctgtctgagctgctgtggcaggtggcctacagctacacctatgagctgcggccctacctggacctgctcttccagatcctgctgattgaggacagctggcagacccaccgcatccacaatgccctgaagggcatcccagatgacagagatggcctgtttgacaccatccagaggagcaagaaccactaccagaagagggcctaccagtgcatcaagtgcatggtggccctcttcagcagctgccctgtggcctaccagatcctgcagggcaatggagacctgaagaggaagtggacctgggccgtggagtggctgggagatgagctggagcggcggccctacacaggcaacccccagtacagctacaacaactggagcccccctgtgcagagcaatgaaacagccaacggctacttcctggagaggagccacagcgccaggatgaccctggccaaggcctgtgagctgtgcccagaggaggagccagatgaccaggatgccccagatgaacatgagcccagccccagtgaagatgcccccctgtacccccacagccctgccagccagtaccagcagaacaaccacgtgcacggccagccctacacaggccctgctgcccaccacctgaacaacccccagaagacaggccagaggacccaggagaactatgagggcaatgaggaggtgagcagcccccagatgaaggaccagtag

SEQ ID NO: 175224 - DNA, 714 bp, Artificial Sequence
  Description of Artificial Sequence: Synthetic coding sequence
tgactgctgaagacagctgtgacccagaggatccccagcaactactttgcctttgccctgggccgcatcctgagcagccacctgctgagcagcgccaacttcagcggccgcatccacaatgccctgaagggcatcccagatgacagagatggcctgtttgacaccatccagaggagcaagaaccactaccagaagagggcctaccagtgcatcaagtgcatggtggccctcttcagcagctgccctgtggcctaccagatcctgcagggcaatggagacctgaagaggaagtggacctgggccgtggagtggctgggagatgagctggagcggcggccctacacaggcaacccccagtacagctacaacaactggagcccccctgtgcagagcaatgaaacagccaacggctacttcctggagaggagccacagcgccaggatgaccctggccaaggcctgtgagctgtgcccagaggaggagccagatgaccaggatgccccagatgaacatgagcccagccccagtgaagatgcccccctgtacccccacagccctgccagccagtaccagcagaacaaccacgtgcacggccagccctacacaggccctgctgcccaccacctgaacaacccccagaagacaggccagaggacccaggagaactatgagggcaatgaggaggtgagcagcccccagatgaaggaccagtag

SEQ ID NO: 175225 - DNA, 3201 bp, Artificial Sequence
  Description of Artificial Sequence: Synthetic coding sequence
atgacagaccaggagaacaacaacaacatcagcagcaacccctttgctgccctgtttggcagcctggctgatgccaagcagtttgctgccatccagaaggagcagctgaagcagcagagtgatgagctgcctgccagcccagatgacagcgacaacagcgtgtctgagagcctggatgaatttgactacagcgtggccgagatcagccgctccttccgcagccagcaggagatctgtgagcagctgaacatcaaccacatgatccagaggatcttcctgatcaccctggacaacagcgaccccagcctgaagtctggaaatggcatccccagccgctgtgtgtacctggaggagatggctgtggagctggaggaccaggactggctggacatgagcaatgtggagcaggccctgtttgcccggctgctgctgcaggaccccggcaaccacctgatcaacatgaccagcagcaccaccctgaacctgtctgctgacagagatgctggggagcggcacatcttctgctacctgtacagctgcttccagagggccaaggaggagatcaccaaggtgcctgagaacctgctgccctttgctgtgcagtgcaggaacctgactgtgagcaacaccaggacagtgctgctgaccccagagatctacgtggaccagaacatccacgagcagctggtggacctgatgctggaggccatccagggcgcccactttgaagatgtgacagagttcctggaggaggtgattgaggccctgatcctggatgaggaggtgaggaccttccctgaggtgatgatccctgtgtttgacatcctgctgggccgcatcaaggacctggagctgtgccagatcctgctgtatgcctacctggacatcctgctgtacttcacccggcagaaggacatggccaaggtgtttgtggagtacatccagcccaaggaccccaccaacggccagatgtaccagaagaccctgctgggcgtcatcctgagcatcagctgcctgctgaagaccccaggagtggtggagaaccacggctacttcctgaaccccagccgcagcagcccccaggagatcaaggtgcaggaggccaacatccaccagttcatggcccagttccacgagaagatctaccagatgctgaagaacctgctgcagctgagccctgagaccaagcactgcatcctgtcctggctgggcaactgcctgcacgccaatgccggccgcaccaagatctgggccaaccagatgcctgagatcttcttccagatgtatgccagtgatgccttcttcctgaacctgggcgccgccctgctgaagctgtgccagcccttctgcaagcccaggagcagccggctgctgaccttcaaccccacctactgtgccctgaaggagctgaatgatgaggagaggaagatcaagaatgtgcacatgaggggcctggacaaggagacctgcctgatcccagctgtgcaggagcccaagttcccccagaactacaacctggtgacagagaacctggccctgacagagtacaccctgtacctgggcttccaccggctgcatgaccagatggtgaagatcaaccagaacctgcaccggctgcaggtggcctggagagatgcccagcagagcagcagccctgctgctgacaacctgcgggagcagtttgagcggctgatgaccatctacctgagcaccaagacagccatgacagagccccagatgctgcagaactgcctgaacctgcaggtgtccatggctgtgctgctggtgcagctggccatcggaaatgaaggcagccagcccatcgagctgaccttccccctgcctgatggctacagcagcctggcctacgtgcctgagttctttgctgacaacctgggggacttcctgatcttcctgcggagatttgctgatgacatcctggagaccagcgctgacagcctggagcacgtgctgcacttcatcaccatcttcaccggcagcattgaaagaatgaagaacccccacctgcgggccaagctggccgaggtgctggaggccgtgatgccccacctggaccagacccccaaccccctggtgtcctctgtgttccacaggaagagggtcttctgcaacttccagtatgccccccagctggccgaggccctgatcaaggtgtttgtggacatcgagttcaccggggacccccaccagtttgagcagaagttcaactacagaagacccatgtaccccatcctgcgctacatgtggggcacagacacctaccgggagagcatcaaggacctggccgactatgccagcaagaacctggaggccatgaaccccccactcttcctgcgcttcctgaacctgctgatgaatgatgccatcttcctgctggatgaggccatccagtacctgagcaagatcaagatccagcagatcgagaaggacagaggagagtgggacagcctgaccccagaggcccggcgggagaaggaggccggcctgcagatgtttggccagctggcccgcttccacaacatcatgagcaatgagaccatcggcaccctggccttcctgaccagcgagatcaagagcctgtttgtgcaccccttcctggccgagcgcatcatctccatgctgaactacttcctgcagcacctggtgggccccaagatgggcgccctgaaggtgaaggacttcagcgagtttgacttcaagccccagcagctggtgtctgacatctgcaccatctacctgaacctgggagatgaggagaacttctgtgccaccgtgcccaaggatggccgcagctacagccccaccctgtttgcccagacagtgcgggtgctgaagaagatcaacaagccaggcaacatgatcatggccttcagcaacctggccgagcgcatcaagagcctggccgacctgcagcagcaggaggaggagacctatgcagatgcctgtgatgagttcctggaccccatcatgagcaccctgatgtgtgaccctgtggtgctgcccagcagccgggtgacagtggacaggagcaccatcgcccggcacctgctgagtgaccagacagaccccttcaacagaagccccctgaccatggaccagatccggcccaacacagagctgaaggagaagatccagcgctggctggccgagaggaagcagcagaaggagcagctggagtag

SEQ ID NO: 175226 - DNA, 3222 bp, Artificial Sequence
  Description of Artificial Sequence: Synthetic coding sequence
atgacagaccaggagaacaacaacaacatcagcagcaacccctttgctgccctgtttggcagcctggctgatgccaagcagtttgctgccatccagaaggagcagctgaagcagcagagtgatgagctgcctgccagcccagatgacagcgacaacagcgtgtctgagagcctggatgaatttgactacagcgtggccgagatcagccgctccttccgcagccagcaggagatctgtgagcagctgaacatcaaccacatgatccagaggatcttcctgatcaccctggacaacagcgaccccagcctgaagtctggaaatggcatccccagccgctgtgtgtacctggaggagatggctgtggagctggaggaccaggactggctggacatgagcaatgtggagcaggccctgtttgcccggctgctgctgcaggaccccggcaaccacctgatcaacatgaccagcagcaccaccctgaacctgtctgctgacagagatgctggggagcggcacatcttctgctacctgtacagctgcttccagagggccaaggaggagatcaccaaggtgcctgagaacctgctgccctttgctgtgcagtgcaggaacctgactgtgagcaacaccaggacagtgctgctgaccccagagatctacgtggaccagaacatccacgagcagctggtggacctgatgctggaggccatccagggcgcccgggagtacatgaacaagatctactttgaagatgtgacagagttcctggaggaggtgattgaggccctgatcctggatgaggaggtgaggaccttccctgaggtgatgatccctgtgtttgacatcctgctgggccgcatcaaggacctggagctgtgccagatcctgctgtatgcctacctggacatcctgctgtacttcacccggcagaaggacatggccaaggtgtttgtggagtacatccagcccaaggaccccaccaacggccagatgtaccagaagaccctgctgggcgtcatcctgagcatcagctgcctgctgaagaccccaggagtggtggagaaccacggctacttcctgaaccccagccgcagcagcccccaggagatcaaggtgcaggaggccaacatccaccagttcatggcccagttccacgagaagatctaccagatgctgaagaacctgctgcagctgagccctgagaccaagcactgcatcctgtcctggctgggcaactgcctgcacgccaatgccggccgcaccaagatctgggccaaccagatgcctgagatcttcttccagatgtatgccagtgatgccttcttcctgaacctgggcgccgccctgctgaagctgtgccagcccttctgcaagcccaggagcagccggctgctgaccttcaaccccacctactgtgccctgaaggagctgaatgatgaggagaggaagatcaagaatgtgcacatgaggggcctggacaaggagacctgcctgatcccagctgtgcaggagcccaagttcccccagaactacaacctggtgacagagaacctggccctgacagagtacaccctgtacctgggcttccaccggctgcatgaccagatggtgaagatcaaccagaacctgcaccggctgcaggtggcctggagagatgcccagcagagcagcagccctgctgctgacaacctgcgggagcagtttgagcggctgatgaccatctacctgagcaccaagacagccatgacagagccccagatgctgcagaactgcctgaacctgcaggtgtccatggctgtgctgctggtgcagctggccatcggaaatgaaggcagccagcccatcgagctgaccttccccctgcctgatggctacagcagcctggcctacgtgcctgagttctttgctgacaacctgggggacttcctgatcttcctgcggagatttgctgatgacatcctggagaccagcgctgacagcctggagcacgtgctgcacttcatcaccatcttcaccggcagcattgaaagaatgaagaacccccacctgcgggccaagctggccgaggtgctggaggccgtgatgccccacctggaccagacccccaaccccctggtgagcagcgtcttccacaggaagagggtcttctgcaacttccagtatgccccccagctggccgaggccctgatcaaggtgtttgtggacatcgagttcaccggggacccccaccagtttgagcagaagttcaactaccgccggcccatgtaccccatcctgcgctacatgtggggcacagacacctaccgggagagcatcaaggacctggccgactatgccagcaagaacctggaggccatgaaccccccactcttcctgcgcttcctgaacctgctgatgaatgatgccatcttcctgctggatgaggccatccagtacctgagcaagatcaagatccagcagatcgagaaggacagaggagagtgggacagcctgaccccagaggcccggcgggagaaggaggccggcctgcagatgtttggccagctggcccgcttccacaacatcatgagcaatgagaccatcggcaccctggccttcctgaccagcgagatcaagagcctgtttgtgcaccccttcctggccgagcgcatcatctccatgctgaactacttcctgcagcacctggtgggccccaagatgggcgccctgaaggtgaaggacttcagcgagtttgacttcaagccccagcagctggtgtctgacatctgcaccatctacctgaacctgggagatgaggagaacttctgtgccaccgtgcccaaggatggccgcagctacagccccaccctgtttgcccagacagtgcgggtgctgaagaagatcaacaagccaggcaacatgatcatggccttcagcaacctggccgagcgcatcaagagcctggccgacctgcagcagcaggaggaggagacctatgcagatgcctgtgatgagttcctggaccccatcatgagcaccctgatgtgtgaccctgtggtgctgcccagcagccgggtgacagtggacaggagcaccatcgcccggcacctgctgagtgaccagacagaccccttcaacagaagccccctgaccatggaccagatccggcccaacacagagctgaaggagaagatccagcgctggctggccgagaggaagcagcagaaggagcagctggagtag

SEQ ID NO: 175227 - DNA, 1617 bp, Artificial Sequence
  Description of Artificial Sequence: Synthetic coding sequence
atggtgaagatcaaccagaacctgcaccggctgcaggtggcctggagagatgcccagcagagcagcagccctgctgctgacaacctgcgggagcagtttgagcggctgatgaccatctacctgagcaccaagacagccatgacagagccccagatgctgcagaactgcctgaacctgcaggtgtccatggctgtgctgctggtgcagctggccatcggaaatgaaggcagccagcccatcgagctgaccttccccctgcctgatggctacagcagcctggcctacgtgcctgagttctttgctgacaacctgggggacttcctgatcttcctgcggagatttgctgatgacatcctggagaccagcgctgacagcctggagcacgtgctgcacttcatcaccatcttcaccggcagcattgaaagaatgaagaacccccacctgcgggccaagctggccgaggtgctggaggccgtgatgccccacctggaccagacccccaaccccctggtgtcctctgtgttccacaggaagagggtcttctgcaacttccagtatgccccccagctggccgaggccctgatcaaggtgtttgtggacatcgagttcaccggggacccccaccagtttgagcagaagttcaactacagaagacccatgtaccccatcctgcgctacatgtggggcacagacacctaccgggagagcatcaaggacctggccgactatgccagcaagaacctggaggccatgaaccccccactcttcctgcgcttcctgaacctgctgatgaatgatgccatcttcctgctggatgaggccatccagtacctgagcaagatcaagatccagcagatcgagaaggacagaggagagtgggacagcctgaccccagaggcccggcgggagaaggaggccggcctgcagatgtttggccagctggcccgcttccacaacatcatgagcaatgagaccatcggcaccctggccttcctgaccagcgagatcaagagcctgtttgtgcaccccttcctggccgagcgcatcatctccatgctgaactacttcctgcagcacctggtgggccccaagatgggcgccctgaaggtgaaggacttcagcgagtttgacttcaagccccagcagctggtgtctgacatctgcaccatctacctgaacctgggagatgaggagaacttctgtgccaccgtgcccaaggatggccgcagctacagccccaccctgtttgcccagacagtgcgggtgctgaagaagatcaacaagccaggcaacatgatcatggccttcagcaacctggccgagcgcatcaagagcctggccgacctgcagcagcaggaggaggagacctatgcagatgcctgtgatgagttcctggaccccatcatgagcaccctgatgtgtgaccctgtggtgctgcccagcagccgggtgacagtggacaggagcaccatcgcccggcacctgctgagtgaccagacagaccccttcaacagaagccccctgaccatggaccagatccggcccaacacagagctgaaggagaagatccagcgctggctggccgagaggaagcagcagaaggagcagctggagtag

SEQ ID NO: 175228 - DNA, 3522 bp, Artificial Sequence
  Description of Artificial Sequence: Synthetic coding sequence
atggaggagctgtctgcagatgagatcagaagaagaaggctggcccggctggccggcggccagaccagccagcccaccacccccctgaccagcccccagagagaaaatcctcctggcccccccatcgccgccagcgcccctggccccagccagagcctgggcctgaatgtgcacaacatgaccccagccaccagccccatcggggccagcggcgtggcccacaggagccagagcagcgagggcgtgagcagcctgagcagcagccccagcaacagcctggagacccagagccagagcctgagccgcagccagagcatggacattgatggagtgtcctgtgagaagtccatgagccaggtggatgtggacagcggcatcgagaacatggaggtggatgaaaatgaccggcgggagaagaggagcctgagtgacaaggagcccagcagcggccctgaggtgtctgaggagcaggccctgcagctggtgtgcaagatcttccgggtgtcctggaaggaccgggacagagatgtgatcttcctgagcagcctgagcgcccagttcaagcagaaccccaaggaggtgttcagtgacttcaaggacctgattggccagatcctgatggaggtgctgatgatgagcacccagaccagagatgagaacccctttgccagcctgacagccaccagccagcccatcgctgctgctgcccggagcccagacaggaacctgctgctgaacacaggcagcaaccctggcaccagccccatgttctgcagcgtggccagctttggagccagcagcctgagcagcctgggcgccagcggcggggccagcaactgggacagctacagcgaccacttcaccatcgagacctgcaaggagacagacatgctgaactacctgattgaatgttttgacagagtgggcatcgaggagaagaaggcccccaagatgtgcagccagcctgctgtgtcccagctgctgagcaacatccgcagccagtgcatcagccacacagccctggtgctgcagggcagcctgacccagcccaggagcctgcagcagcccagcttcctggtgccctacatgctgtgcaggaacctgccctacggcttcatccaggagctggtgaggaccacccaccaggatgaggaggtgttcaagcagatcttcatccccatcctgcagggcctggccctggccgccaaggagtgcagcctggacagcgactacttcaagtaccccctgatggccctgggggagctgtgtgagaccaagtttgggaagacccaccctgtgtgcaacctggtggccagcctgcggctgtggctgcccaagagcctgagccctggctgcggccgggagctgcagaggctgagctacctgggcgccttcttctccttctctgtgtttgctgaagatgatgtgaaggtggtggagaagtacttcagcggccctgccatcaccctggagaacaccagggtggtgtcccagagcctgcagcactacctggagctgggccggcaggagctgttcaagatcctgcacagcatcctgctgaatggagagacccgggaggccgccctgagctacatggctgctgtggtgaatgccaacatgaagaaggcccagatgcagacagatgaccggctggtgtccacagatggcttcatgctgaacttcctgtgggtgctgcagcagctgagcaccaagatcaagctggagaccgtggaccccacctacatcttccacccccgctgccgcatcaccctgcccaatgatgagaccagggtgaatgccaccatggaggatgtgaatgactggctgacagagctgtatggagaccagccccccttcagcgagcccaagttccccacagagtgcttcttcctgaccctgcacgcccaccacctgagcatcctgcccagctgccgccgctacatccggcggctgcgggccatccgggagctgaacagaacagtggaggacctgaagaacaatgaaagccagtggaaggacagccccctggccaccaggcaccgggagatgctgaagcgctgcaagacccagctgaagaagctggtgcgctgcaaggcctgtgctgatgctggcctgctggatgagagcttcctgcggcgctgcctgaacttctacggcctgctgatccagctgctgctgcgcatcctggaccctgcctacccagacatcaccctgcccctgaacagtgatgtgcccaaggtgtttgctgccctgcctgagttctacgtggaggatgtggccgagttcctgttcttcatcgtgcagtacagcccccaggccctgtatgagccctgcacccaggacatcgtgatgttcctggtggtgatgctgtgcaaccagaactacatccggaacccctacctggtggccaagctggtggaggtgatgttcatgaccaacccagctgtgcagcccaggacccagaagttctttgagatgattgagaaccaccccctgagcaccaagctgctggtgcccagcctgatgaagttctacacagatgtggagcacactggagccaccagcgagttctatgacaagttcaccatccgctaccacatcagcaccatcttcaagagcctgtggcagaacatcgcccaccacggcaccttcatggaggagttcaacagcggcaagcagtttgtgcgctacatcaacatgctgatcaatgacaccaccttcctgctggatgagagcctggagagcctgaagaggatccacgaggtgcaggaggagatgaagaacaaggagcagtgggaccagctgccccgggaccagcagcaggcccggcagagccagctggcccaggatgagcgggtgagccgcagctacctggccctggccacagagaccgtggacatgttccacatcctgaccaagcaggtgcagaagcccttcctgcggcctgagctgggcccccggctggccgccatgctgaacttcaacctgcagcagctgtgtggccccaagtgccgggacctgaaggtggagaaccctgagaagtatggctttgagcccaagaagctgctggaccagctgacagacatctacctgcagctggactgtgccaggtttgccaaggccatcgcagatgaccagaggagctacagcaaggagctgtttgaggaggtgatcagcaagatgaggaaggccggcatcaagagcaccatcgccatcgagaagttcaagctgctggccgagaaggtggaggagatcgtggccaagaatgcccgggcagaaattgactacagtgatgccccagatgagttccgggaccccctgatggacaccctgatgacagatcctgtgcggctgcccagcggcaccatcatggacaggagcatcatcctgcggcacctgctgaacagccccacagaccccttcaaccggcagaccctgacagagagcatgctggagcctgtgcctgagctgaaggagcagatccaggcctggatgagggagaagcagaacagcgaccactag

SEQ ID NO: 175229 - DNA, 3909 bp, Artificial Sequence
  Description of Artificial Sequence: Synthetic coding sequence
atggaggagctgtctgcagatgagatcagaagaagaaggctggcccggctggccggcggccagaccagccagcccaccacccccctgaccagcccccagagagaaaatcctcctggcccccccatcgccgccagcgcccctggccccagccagagcctgggcctgaatgtgcacaacatgaccccagccaccagccccatcggggccagcggcgtggcccacaggagccagagcagcgagggcgtgagcagcctgagcagcagccccagcaacagcctggagacccagagccagagcctgagccgcagccagagcatggacattgatggagtgtcctgtgagaagtccatgagccaggtggatgtggacagcggcatcgagaacatggaggtggatgaaaatgaccggcgggagaagaggagcctgagtgacaaggagcccagcagcggccctgaggtgtctgaggagcaggccctgcagctggtgtgcaagatcttccgggtgtcctggaaggaccgggacagagatgtgatcttcctgagcagcctgagcgcccagttcaagcagaaccccaaggaggtgttcagtgacttcaaggacctgattggccagatcctgatggaggtgctgatgatgagcacccagaccagagatgagaacccctttgccagcctgacagccaccagccagcccatcgctgctgctgcccggagcccagacaggaacctgctgctgaacacaggcagcaaccctggcaccagccccatgttctgcagcgtggccagctttggagccagcagcctgagcagcctgtatgagagcagccctgcccccacccccagcttctggagctctgtgcctgtgatgggccccagcctggccagccccagcagagctgccagccagctggccgtgcccagcacccccctgagcccccacagcgctgccagcggcacagctgctggcagccagcccagcagcccccgctaccggccctacacagtgacccacccctgggccagcagcggcgtgtccatcctgagcagcagccccagccccccagccctggccagcagcccccaggccgtgcctgccagcagcagccggcagaggcccagcagcactggaccacccctgcccccagccagccccagcgccaccagcagaagacccagcagcctgcgcatcagccccagcctgggcgccagcggcggggccagcaactgggacagctacagcgaccacttcaccatcgagacctgcaaggagacagacatgctgaactacctgattgagtgctttgacagagtgggcatcgaggagaagaaggcccccaagatgtgcagccagcctgctgtgtcccagctgctgagcaacatccgcagccagtgcatcagccacacagccctggtgctgcagggcagcctgacccagcccaggagcctgcagcagcccagcttcctggtgccctacatgctgtgcaggaacctgccctacggcttcatccaggagctggtgaggaccacccaccaggatgaggaggtgttcaagcagatcttcatccccatcctgcagggcctggccctggccgccaaggaatgttccctggacagcgactacttcaagtaccccctgatggccctgggggagctgtgtgagaccaagtttgggaagacccaccctgtgtgcaacctggtggccagcctgcggctgtggctgcccaagagcctgagccctggctgcggccgggagctgcagaggctgagctacctgggcgccttcttctccttctctgtgtttgctgaagatgatgtgaaggtggtggagaagtacttcagcggccctgccatcaccctggagaacaccagggtggtgtcccagagcctgcagcactacctggagctgggccggcaggagctgttcaagatcctgcacagcatcctgctgaatggagagacccgggaggccgccctgagctacatggctgctgtggtgaatgccaacatgaagaaggcccagatgcagacagatgaccggctggtgtccacagatggcttcatgctgaacttcctgtgggtgctgcagcagctgagcaccaagatcaagctggagaccgtggaccccacctacatcttccacccccgctgccgcatcaccctgcccaatgatgagaccagggtgaatgccaccatggaggatgtgaatgactggctgacagagctgtatggagaccagccccccttcagcgagcccaagttccccacagagtgcttcttcctgaccctgcacgcccaccacctgagcatcctgcccagctgccgccgctacatccggcggctgcgggccatccgggagctgaacagaacagtggaggacctgaagaacaatgaaagccagtggaaggacagccccctggccaccaggcaccgggagatgctgaagcgctgcaagacccagctgaagaagctggtgcgctgcaaggcctgtgctgatgctggcctgctggatgagagcttcctgcggcgctgcctgaacttctacggcctgctgatccagctgctgctgcgcatcctggaccctgcctacccagacatcaccctgcccctgaacagtgatgtgcccaaggtgtttgctgccctgcctgagttctacgtggaggatgtggccgagttcctgttcttcatcgtgcagtacagcccccaggccctgtatgagccctgcacccaggacatcgtgatgttcctggtggtgatgctgtgcaaccagaactacatccggaacccctacctggtggccaagctggtggaggtgatgttcatgaccaacccagctgtgcagcccaggacccagaagttctttgagatgattgagaaccaccccctgagcaccaagctgctggtgcccagcctgatgaagttctacacagatgtggagcacactggagccaccagcgagttctatgacaagttcaccatccgctaccacatcagcaccatcttcaagagcctgtggcagaacatcgcccaccacggcaccttcatggaggagttcaacagcggcaagcagtttgtgcgctacatcaacatgctgatcaatgacaccaccttcctgctggatgagagcctggagagcctgaagagaattcatgaggtgcaggaggagatgaagaacaaggagcagtgggaccagctgccccgggaccagcagcaggcccggcagagccagctggcccaggatgagcgggtgagccgcagctacctggccctggccacagaaacagtggacatgttccacatcctgaccaagcaggtgcagaagcccttcctgcggcctgagctgggcccccggctggccgccatgctgaacttcaacctgcagcagctgtgtggccccaagtgccgggacctgaaggtggagaaccctgagaagtatggctttgagcccaagaagctgctggaccagctgacagacatctacctgcagctggactgtgccaggtttgccaaggccatcgcagatgaccagaggagctacagcaaggagctgtttgaggaggtgatcagcaagatgaggaaggccggcatcaagagcaccatcgccatcgagaagttcaagctgctggccgagaaggtggaggagatcgtggccaagaatgcccgggcagaaattgactacagtgatgccccagatgagttccgggaccccctgatggacaccctgatgacagatcctgtgcggctgcccagcggcaccatcatggacaggagcatcatcctgcggcacctgctgaacagccccacagaccccttcaaccggcagaccctgacagagagcatgctggagcctgtgcctgagctgaaggagcagatccaggcctggatgagggagaagcagaacagcgaccactag

SEQ ID NO: 175230 - DNA, 303 bp, Artificial Sequence
  Description of Artificial Sequence: Synthetic coding sequence
atggaggagctgtctgcagatgagatcagaagaagaaggctggcccggctggccggcggccagaccagccagcccaccacccccctgaccagcccccagagagaaaatcctcctggcccccccatcgccgccagcgcccctggccccagccagagcctgggcctgaatgtgcacaacatgaccccagccaccagccccatcggggccagcggcctgggcatcatcagtgatgacaagatgatcaagacagaatttggatctgctgacttcatgaacctggtggatggcttcaagatcaagtag

SEQ ID NO: 175231 - DNA, 3186 bp, Artificial Sequence
  Description of Artificial Sequence: Synthetic coding sequence
atgagccaggtggatgtggacagcggcatcgagaacatggaggtggatgaaaatgaccggcgggagaagaggagcctgagtgacaaggagcccagcagcggccctgaggtgtctgaggagcaggccctgcagctggtgtgcaagatcttccgggtgtcctggaaggaccgggacagagatgtgatcttcctgagcagcctgagcgcccagttcaagcagaaccccaaggaggtgttcagtgacttcaaggacctgattggccagatcctgatggaggtgctgatgatgagcacccagaccagagatgagaacccctttgccagcctgacagccaccagccagcccatcgctgctgctgcccggagcccagacaggaacctgctgctgaacacaggcagcaaccctggcaccagccccatgttctgcagcgtggccagctttggagccagcagcctgagcagcctgggcgccagcggcggggccagcaactgggacagctacagcgaccacttcaccatcgagacctgcaaggagacagacatgctgaactacctgattgaatgttttgacagagtgggcatcgaggagaagaaggcccccaagatgtgcagccagcctgctgtgtcccagctgctgagcaacatccgcagccagtgcatcagccacacagccctggtgctgcagggcagcctgacccagcccaggagcctgcagcagcccagcttcctggtgccctacatgctgtgcaggaacctgccctacggcttcatccaggagctggtgaggaccacccaccaggatgaggaggtgttcaagcagatcttcatccccatcctgcagggcctggccctggccgccaaggagtgcagcctggacagcgactacttcaagtaccccctgatggccctgggggagctgtgtgagaccaagtttgggaagacccaccctgtgtgcaacctggtggccagcctgcggctgtggctgcccaagagcctgagccctggctgcggccgggagctgcagaggctgagctacctgggcgccttcttctccttctctgtgtttgctgaagatgatgtgaaggtggtggagaagtacttcagcggccctgccatcaccctggagaacaccagggtggtgtcccagagcctgcagcactacctggagctgggccggcaggagctgttcaagatcctgcacagcatcctgctgaatggagagacccgggaggccgccctgagctacatggctgctgtggtgaatgccaacatgaagaaggcccagatgcagacagatgaccggctggtgtccacagatggcttcatgctgaacttcctgtgggtgctgcagcagctgagcaccaagatcaagctggagaccgtggaccccacctacatcttccacccccgctgccgcatcaccctgcccaatgatgagaccagggtgaatgccaccatggaggatgtgaatgactggctgacagagctgtatggagaccagccccccttcagcgagcccaagttccccacagagtgcttcttcctgaccctgcacgcccaccacctgagcatcctgcccagctgccgccgctacatccggcggctgcgggccatccgggagctgaacagaacagtggaggacctgaagaacaatgaaagccagtggaaggacagccccctggccaccaggcaccgggagatgctgaagcgctgcaagacccagctgaagaagctggtgcgctgcaaggcctgtgctgatgctggcctgctggatgagagcttcctgcggcgctgcctgaacttctacggcctgctgatccagctgctgctgcgcatcctggaccctgcctacccagacatcaccctgcccctgaacagtgatgtgcccaaggtgtttgctgccctgcctgagttctacgtggaggatgtggccgagttcctgttcttcatcgtgcagtacagcccccaggccctgtatgagccctgcacccaggacatcgtgatgttcctggtggtgatgctgtgcaaccagaactacatccggaacccctacctggtggccaagctggtggaggtgatgttcatgaccaacccagctgtgcagcccaggacccagaagttctttgagatgattgagaaccaccccctgagcaccaagctgctggtgcccagcctgatgaagttctacacagatgtggagcacactggagccaccagcgagttctatgacaagttcaccatccgctaccacatcagcaccatcttcaagagcctgtggcagaacatcgcccaccacggcaccttcatggaggagttcaacagcggcaagcagtttgtgcgctacatcaacatgctgatcaatgacaccaccttcctgctggatgagagcctggagagcctgaagaggatccacgaggtgcaggaggagatgaagaacaaggagcagtgggaccagctgccccgggaccagcagcaggcccggcagagccagctggcccaggatgagcgggtgagccgcagctacctggccctggccacagagaccgtggacatgttccacatcctgaccaagcaggtgcagaagcccttcctgcggcctgagctgggcccccggctggccgccatgctgaacttcaacctgcagcagctgtgtggccccaagtgccgggacctgaaggtggagaaccctgagaagtatggctttgagcccaagaagctgctggaccagctgacagacatctacctgcagctggactgtgccaggtttgccaaggccatcgcagatgaccagaggagctacagcaaggagctgtttgaggaggtgatcagcaagatgaggaaggccggcatcaagagcaccatcgccatcgagaagttcaagctgctggccgagaaggtggaggagatcgtggccaagaatgcccgggcagaaattgactacagtgatgccccagatgagttccggggcaagtggacccaccccctgatggacaccctgatgacagatcctgtgcggctgcccagcggcaccatcatggacaggagcatcatcctgcggcacctgctgaacagccccacagaccccttcaaccggcagaccctgacagagagcatgctggagcctgtgcctgagctgaaggagcagatccaggcctggatgagggagaagcagaacagcgaccactag

SEQ ID NO: 175232 - DNA, 513 bp, Artificial Sequence
  Description of Artificial Sequence: Synthetic coding sequence
atgcctggagaggtgcaggccagctacctgaagagccagagcaagctgagtgatgagggccgcctggagcccaggaagttccactgcaagggcgtgaaggtgcccaggaacttccggctgctggaggagctggaggagggccagaagggcgtgggagatggcaccgtgtcctggggcctggaggatgatgaggacatgaccctgacccgctggacaggcatgatcatcggcccccccaggaccatctatgagaaccgcatctacagcctgaagattgaatgtggccccaagtacccagaggcccccccatttgtgcgctttgtgaccaagatcaacatgaatggagtgaacagcagcaatggagtggtggacccccgggccatctctgtgctggccaagtggcagaacagctacagcatcaaggtggtgctgcaggagctgcggcggctgatgatgagcaaagaaaacatgaagctgccccagcccccagagggccagtgctacagcaactag

SEQ ID NO: 175233 - DNA, 312 bp, Artificial Sequence
  Description of Artificial Sequence: Synthetic coding sequence
atggagaagggcctgaacaccaagaacttcacagagcagaccatctatgaaaatcgcatctacagcctgaagattgaatgtggccccaagtacccagaggcccccccatttgtgcgctttgtgaccaagatcaacatgaatggagtgaacagcagcaatggagtggtggacccccgggccatctctgtgctggccaagtggcagaacagctacagcatcaaggtggtgctgcaggagctgcggcggctgatgatgagcaaggagaacatgaagctgccccagcccccagagggccagtgctacagcaactag

SEQ ID NO: 175234 - DNA, 444 bp, Artificial Sequence
  Description of Artificial Sequence: Synthetic coding sequence
atggccgccaccactggaagtggagtgaaggtgcccaggaacttccggctgctggaggagctggaggagggccagaagggcgtgggagatggcaccgtgtcctggggcctggaggatgatgaggacatgaccctgacccgctggacaggcatgatcatcggcccccccaggaccatctatgaaaatcgcatctacagcctgaagattgaatgtggccccaagtacccagaggcccccccatttgtgcgctttgtgaccaagatcaacatgaatggagtgaacagcagcaatggagtggtggacccccgggccatctctgtgctggccaagtggcagaacagctacagcatcaaggtggtgctgcaggagctgcggcggctgatgatgagcaaggagaacatgaagctgccccagcccccagagggccagtgctacagcaactag

SEQ ID NO: 175235 - DNA, 513 bp, Artificial Sequence; identical to SEQ ID NO: 175232
  Description of Artificial Sequence: Synthetic coding sequence

SEQ ID NO: 175236 - DNA, 312 bp, Artificial Sequence
  Description of Artificial Sequence: Synthetic coding sequence
atgaaggaggacctgaacctggagaacttcaccgccaagaccatctatgaaaatcgcatctacagcctgaagattgaatgtggccccaagtacccagaggcccccccatttgtgcgctttgtgaccaagatcaacatgaatggagtgaacagcagcaatggagtggtggacccccgggccatctctgtgctggccaagtggcagaacagctacagcatcaaggtggtgctgcaggagctgcggcggctgatgatgagcaaggagaacatgaagctgccccagcccccagagggccagtgctacagcaactag

SEQ ID NO: 175237 - DNA, 312 bp, Artificial Sequence; identical to SEQ ID NO: 175236
  Description of Artificial Sequence: Synthetic coding sequence

SEQ ID NO: 175238 - DNA, 318 bp, Artificial Sequence
  Description of Artificial Sequence: Synthetic coding sequence
atggccgccaccactggaagtggagtgaaggtgcccaggaacttccggctgctggaggagctggaggagggccagaagggcgtgggagatggcaccgtgtcctggggcctggaggatgatgaggacatgaccctgacccgctggacaggcatgatcatcggccccccccgggtggacccccgggccatctctgtgctggccaagtggcagaacagctacagcatcaaggtggtgctgcaggagctgcggcggctgatgatgagcaaggagaacatgaagctgccccagcccccagagggccagtgctacagcaactag

SEQ ID NO: 175239 - DNA, 369 bp, Artificial Sequence
  Description of Artificial Sequence: Synthetic coding sequence
atgagcaccccagcccggcggcggctgatgagggacttcaagaggctgcaggaggaccccccagctggggtgtctggggcccccagcgagaacaacatcatggtgtggaatgctgtgatctttggacctgagggcaccccatttgaagatgtgtatgcagatggcagcatctgcctggacatcctgcagaaccgctggagccccacctatgatgtgagcagcatcctgaccagcatccagagcctgctggatgagcccaaccccaacagccctgccaacagccaggccgcccagctgtaccaggagaacaagcgggagtatgagaagagggtgtctgccatcgtggagcagagctggagggactgctag

SEQ ID NO: 175240 - DNA, 459 bp, Artificial Sequence
  Description of Artificial Sequence: Synthetic coding sequence
atgagcaccccagcccggcggcggctgatgagggacttcaagaggctgcaggaggaccccccagctggggtgtctggggcccccagcgagaacaacatcatggtgtggaatgctgtgatctttggacctgagggcaccccatttgaagatggcaccttcaagctgaccatcgagttcacagaggagtaccccaacaagcccccaacagtgcgctttgtgtccaagatgttccaccccaacgtgtatgcagatggcagcatctgcctggacatcctgcagaaccgctggagccccacctatgatgtgagcagcatcctgaccagcatccagagcctgctggatgagcccaaccccaacagccctgccaacagccaggccgcccagctgtaccaggagaacaagcgggagtatgagaagagggtgtctgccatcgtggagcagagctggagggactgctag

SEQ ID NO: 175241 - DNA, 234 bp, Artificial Sequence
  Description of Artificial Sequence: Synthetic coding sequence
atgttccaccccaacgtgtatgcagatggcagcatctgcctggacatcctgcagaaccgctggagccccacctatgatgtgagcagcatcctgaccagcatccagagcctgctggatgagcccaaccccaacagccctgccaacagccaggccgcccagctgtaccaggagaacaagcgggagtatgagaagagggtgtctgccatcgtggagcagagctggagggactgctag

SEQ ID NO: 175242 - DNA, 459 bp, Artificial Sequence
  Description of Artificial Sequence: Synthetic coding sequence
atgagcaccccagcccggcggcggctgatgagggacttcaagaggctgcaggaggacccccctgtgggcgtgtctggggcccccagcgagaacaacatcatgcagtggaatgctgtgatctttggacctgagggcaccccatttgaagatggcaccttcaagctggtgattgagttcagcgaggagtaccccaacaagcccccaacagtgcgcttcctgagcaagatgttccaccccaacgtgtatgcagatggcagcatctgcctggacatcctgcagaaccgctggagccccacctatgatgtgagcagcatcctgaccagcatccagagcctgctggatgagcccaaccccaacagccctgccaacagccaggccgcccagctgtaccaggagaacaagcgggagtatgagaagagggtgtctgccatcgtggagcagagctggaatgacagctag

SEQ ID NO: 175243 - DNA, 153 bp, Artificial Sequence
  Description of Artificial Sequence: Synthetic coding sequence
atggccagccagaacagagatcctgctgccacctctgtggccgccgccaggaaaggagctgagcccagcggcggggccgcccggggccctgtgggcaagaggctgcagcaggagctgatgaccctgatgaaccccaccctcatcgtgccctag

SEQ ID NO: 175244 - DNA, 486 bp, Artificial Sequence
  Description of Artificial Sequence: Synthetic coding sequence
atggccagccagaacagagatcctgctgccacctctgtggccgccgccaggaaaggagctgagcccagcggcggggccgcccggggccctgtgggcaagaggctgcagcaggagctgatgaccctgatgatgtctggggacaagggcatcagcgccttccctgagagtgacaacctcttcaagtgggtgggcaccatccatggagctgctggaacagctgtgggcagcatccgcaccagcagcacagtgtgcctgctgagcggcccccgggagacccaggacagcagcaagcccctggtgtggggcctgggctgggacatgaggctgctgctggagctgaccctgcagctgttcctgcagatgcctgagcccaacatcgacagccccctgaacacccacgccgctgagctgtggaagaaccccacagccttcaagaagtacctgcaggagacctacagcaagcaggtgaccagccaggagccctag

SEQ ID NO: 175245 - DNA, 453 bp, Artificial Sequence
  Description of Artificial Sequence: Synthetic coding sequence
atggccagccagaacagagatcctgctgccacctctgtggccgccgccaggaaaggagctgagcccagcggcggggccgcccggggccctgtgggcaagaggctgcagcaggagctgatgaccctgatggtgtatgaggacctgcgctacaagctgagcctggagttccccagcggctacccctacaatgcccccaccgtgaagttcctgaccccctgctaccaccccaacgtggacacccagggcaacatctgcctggacatcctgaaggagaagtggagcgccctgtatgatgtgaggaccatcctgctgagcatccagagcctgctgggggagcccaacatcgacagccccctgaacacccatgctgctgagctgtggaagaaccccacagccttcaagaagtacctgcaggagacctacagcaagcaggtgaccagccaggagccctag

SEQ ID NO: 175246 - DNA, 540 bp, Artificial Sequence
  Description of Artificial Sequence: Synthetic coding sequence
atggccagccagaacagagatcctgctgccacctctgtggccgccgccaggaaaggagctgagcccagcggcggggccgcccggggccctgtgggcaagaggctgcagcaggagctgatgaccctgatgatgtctggggacaagggcatcagcgccttccctgagagtgacaacctcttcaagtgggtgggcaccatccatggagctgctggcaccgtgtatgaggacctgcgctacaagctgagcctggagttccccagcggctacccctacaatgcccccaccgtgaagttcctgaccccctgctaccaccccaacgtggacacccagggcaacatctgcctggacatcctgaaggagaagtggagcgccctgtatgatgtgaggaccatcctgctgagcatccagagcctgctgggggagcccaacatcgacagccccctgaacacccacgccgctgagctgtggaagaaccccacagccttcaagaagtacctgcaggagacctacagcaagcaggtgaccagccaggagccctag

SEQ ID NO: 175247 - DNA, 423 bp, Artificial Sequence
  Description of Artificial Sequence: Synthetic coding sequence
atgaccctgatgatgtctggggacaagggcatcagcgccttccctgagagtgacaacctcttcaagtgggtgggcaccatccacggggctgctggcaccgtgtatgaggacctgcgctacaagctgagcctggagttccccagcggctacccctacaatgcccccaccgtgaagttcctgaccccctgctaccaccccaacgtggacacccagggcaacatctgcctggacatcctgaaggagaagtggagcgccctgtatgatgtgaggaccatcctgctgagcatccagagcctgctgggggagcccaacatcgacagccccctgaacacccatgctgctgagctgtggaagaaccccacagccttcaagaagtacctgcaggagacctacagcaagcaggtgaccagccaggagccctag

SEQ ID NO: 175248 - DNA, 423 bp, Artificial Sequence; identical to SEQ ID NO: 175247
  Description of Artificial Sequence: Synthetic coding sequence

SEQ ID NO: 175249 - DNA, 114 bp, Artificial Sequence
  Description of Artificial Sequence: Synthetic coding sequence
atggccgccagcgctgctgagaccagggtcttcctggaggtgcggggccagctgcagagcgccctgctgatcctgggggacagagtgagcccctactgcccctgctggagctag

SEQ ID NO: 175250 - DNA, 1170 bp, Artificial Sequence
  Description of Artificial Sequence: Synthetic coding sequence
atggccgccagcgctgctgagaccagggtcttcctggaggtgcggggccagctgcagagcgccctgctgatcctgggggagcccaaggagggcggcatgcccatgaacatcagcatcatgcccagcagcctgcagatgaagaccccagagggctgcacagagatccagctgcctgctgaggtgcggctggtgcccagcagctgccggggcctgcagtttgtggtgggagatggcctgcacctgcggctgcagacccaggccaagctgggcaccaagctgatctccatgttcaaccagagcagccagacccaggagtgctgcaccttctactgccagagctgtggggaggtgatcatcaaggacaggaagctgctgcgggtgctgcccctgcccagcgagaactggggcgccctggtgggggagtggtgctgccacccagacccctttgccaacaagagcctgcacccccaggagaatgactgcttcatcggggacagcttcttcctggtgaacctgcggaccagcctgtggcagcagaggcctgagctgagccctgtggagatgtgctgcgtgtccagtgacaaccactgcaagctggagcccaaggccaacaccaaggtgatctgcaagcgctgcaaggtgatgctgggggagaccgtgagcagcgagaccaccaagttctacatgacagagatcatcatccagagcagcgagaggagcttccccatcatccccaggtcctggtttgtgcagagcgtcatcgcccagtgcctggtgcagctgagcagcgcccggagcaccttccgcttcaccatccagggccaggatgacaaggtgtacatcctgctgtggctgctgaacagcgacagcctggtgattgagagcctgaggaacagcaagtacatcaagaagttccccctgctggagaacaccttcaaggctgacagcagcagcgcctggagcgctgtgaaggtgctgtaccagccctgcatcaagagcagaaatgagaagctggtgtccctgtgggagagtgacatctctgtgcaccccctgaccctgcccagcgccacctgcctggagctgctgctgatcctgagcaagagcaatgccaacctgcccagcagcctgcggcgggtgaacagcttccaggtggccttcctgaagatgtag

SEQ ID NO: 175251 - DNA, 444 bp, Artificial Sequence
  Description of Artificial Sequence: Synthetic coding sequence
atggccctgaagaggatccagaaggagctgagtgacctgcagagggaccccccagcccactgcagcgctggccctgtgggagatgacctcttccactggcaggccaccatcatgggccccccagattctgcctaccagggcggcgtcttcttcctgactgtgcacttccccacagactaccccttcaagccacccaagatcgccttcaccaccaagatctaccaccccaacatcaacagcaatggcagcatctgcctggacatcctgcggagccagtggagccctgccctgactgtgtccaaggtgctgctgagcatctgcagcctgctgtgtgaccccaacccagatgaccccctggtgcctgacatcgcccagatctacaagagtgacaaggagaagtacaacagacatgcccgggagtggacccagaagtatgccatgtag

SEQ ID NO: 175252 - DNA, 606 bp, Artificial Sequence
  Description of Artificial Sequence: Synthetic coding sequence
atgagcacagaggcccagagggtggatgacagccccagcaccagcggcggcagcagtgatggagaccagcgggagagcgtgcagcaggagcctgagcgggagcaggtgcagcccaagaagaaggagggcaagatcagcagcaagacagctgccaagctgagcaccagcgccaagaggatccagaaggagctggccgagatcaccctggaccccccacccaactgcagcgctggccccaagggggacaacatctatgagtggaggagcaccatcctgggccccccaggctctgtgtatgaaggaggagtcttcttcctggacatcaccttctccccagactaccccttcaagccacccaaggtgaccttccgcacccgcatctaccactgcaacatcaacagccagggcgtcatctgcctggacatcctgaaggacaactggagccctgccctgaccatcagcaaggtgctgctgagcatctgcagcctgctgacagactgcaacccagctgaccccctggtgggcagcatcgccacccagtacatgaccaacagagctgagcatgacaggatggcccggcagtggaccaagagatatgccacctag

SEQ ID NO: 175253 - DNA, 606 bp, Artificial Sequence; identical to SEQ ID NO: 175252
  Description of Artificial Sequence: Synthetic coding sequence

SEQ ID NO: 175254 - DNA, 624 bp, Artificial Sequence
  Description of Artificial Sequence: Synthetic coding sequence
atgagcagtgaccggcagaggagtgatgatgagagccccagcaccagcagcggcagcagtgatgctgaccagagggaccctgctgcccctgagcctgaggagcaggaggagaggaagcccagcgccacccagcagaagaagaacaccaagctgagcagcaagaccacagccaagctgagcaccagcgccaagaggatccagaaggagctggccgagatcaccctggaccccccacccaactgcagcgctggccccaagggggacaacatctatgagtggaggagcaccatcctgggccccccaggctctgtgtatgaaggaggagtcttcttcctggacatcaccttcagcagtgactaccccttcaagccacccaaggtgaccttccgcacccgcatctaccactgcaacatcaacagccagggcgtcatctgcctggacatcctgaaggacaactggagccctgccctgaccatcagcaaggtgctgctgagcatctgcagcctgctgacagactgcaacccagctgaccccctggtgggcagcatcgccacccagtacctgaccaacagagctgagcatgacagaattgcccggcagtggaccaagagatatgccacctag

SEQ ID NO: 175255 - DNA, 624 bp, Artificial Sequence; identical to SEQ ID NO: 175254
  Description of Artificial Sequence: Synthetic coding sequence

SEQ ID NO: 175256 - DNA, 624 bp, Artificial Sequence; identical to SEQ ID NO: 175254
  Description of Artificial Sequence: Synthetic coding sequence

SEQ ID NO: 175257 - DNA, 624 bp, Artificial Sequence; identical to SEQ ID NO: 175254
  Description of Artificial Sequence: Synthetic coding sequence

SEQ ID NO: 175258 - DNA, 528 bp, Artificial Sequence
  Description of Artificial Sequence: Synthetic coding sequence
atgagcagtgaccggcagaggagtgatgatgagagccccagcaccagcagcggcagcagtgatgctgaccagagggaccctgctgcccctgagcctgaggagcaggaggagaggaagcccagcgccacccagcagaagaagaacaccaagctgagcagcaagaccacagccaagctgagcaccagcgccaagaggatccagaaggagctggccgagatcaccctggaccccccacccaactgcagcgctggccccaagggggacaacatctatgagtggaggagcaccatcctgggccccccaggctctgtgtatgaaggaggagtcttcttcctggacatcaccttcagcagtgactaccccttcaagccacccaaggtgaccttccgcacccgcatctaccactgcaacatcaacagccagggcgtcatctgcctggacatcctgaaggacaactggagccctgccctgaccatcagcaaggtgctgctgagcatctgcagcctgctgacagactgcaacccctag

SEQ ID NO: 175259 - DNA, 528 bp, Artificial Sequence; identical to SEQ ID NO: 175258
  Description of Artificial Sequence: Synthetic coding sequence

SEQ ID NO: 175260 - DNA, 528 bp, Artificial Sequence; identical to SEQ ID NO: 175258
  Description of Artificial Sequence: Synthetic coding sequence

SEQ ID NO: 175261 - DNA, 414 bp, Artificial Sequence
  Description of Artificial Sequence: Synthetic coding sequence
atgaatgaggagaacttctttgagtgggaggccctgatcatgggccctgaggacacctgctttgaatttggagtcttccctgccatcctgtccttccccctggactaccccctgagcccccccaagatgaggttcacctgtgagatgttccaccccaacatctacccagatggccgggtgtgcatcagcatcctgcacgcccctggagatgaccccatgggctatgagagcagcgctgagcgctggagccctgtgcagagcgtggagaagatcctgctgtctgtggtgtccatgctggccgagcccaatgatgagagcggggccaacgtggatgccagcaagatgtggagagatgaccgggagcagttctacaagatcgccaagcagatcgtgcagaagagcctgggcctgtag

SEQ ID NO: 175262 - DNA, 498 bp, Artificial Sequence
  Description of Artificial Sequence: Synthetic coding sequence
atggccggcacagccctgaagaggctgatggccgagtacaagcagctgaccctgaaccccccagagggcatcgtggccggccccatgaatgaggagaacttctttgagtgggaggccctgatcatgggccctgaggacacctgctttgaatttggagtcttccctgccatcctgtccttccccctggactaccccctgagcccccccaagatgaggttcacctgtgagatgttccaccccaacatctacccagatggccgggtgtgcatcagcatcctgcacgcccctggagatgaccccatgggctatgagagcagcgctgagcgctggagccctgtgcagagcgtggagaagatcctgctgtctgtggtgtccatgctggccgagcccaatgatgagagcggggccaacgtggatgccagcaagatgtggagagatgaccgggagcagttctacaagatcgccaagcagatcgtgcagaagagcctgggcctgtag

SEQ ID NO: 175263 - DNA, 552 bp, Artificial Sequence
  Description of Artificial Sequence: Synthetic coding sequence
atgagcagccccagccctgggaagaggaggatggacacagatgtggtgaagctgattgagagcaagcatgaggtgaccatcctgggcggcctgaatgaatttgtggtgaagttctacggcccccagggcaccccctatgagggcggcgtgtggaaggtgcgggtggacctgcctgacaagtaccccttcaagagccccagcatcggcttcatgaacaagatcttccaccccaacattgatgaggccagcggcaccgtgtgcctggatgtgatcaaccagacctggacagccctgtatgacctgaccaacatctttgagagcttcctgccccagctgctggcctaccccaaccccatcgaccccctgaatggagatgctgctgccatgtacctgcacaggcctgaggagtacaagcagaagatcaaggagtacatccagaagtatgccacagaggaggccctgaaggagcaggaggagggcactggagacagcagcagcgagagctccatgtctgacttctctgaagatgaggcccaggacatggagctgtag

SEQ ID NO: 175264 - DNA, 459 bp, Artificial Sequence
  Description of Artificial Sequence: Synthetic coding sequence
atgagcagccccagccctgggaagaggaggatggacacagatgtggtgaagctgattgagagcaagcatgaggtgaccatcctgggcggcctgaatgaatttgtggtgaagttctacggcccccagggcaccccctatgagggcggcgtgtggaaggtgcgggtggacctgcctgacaagtaccccttcaagagccccagcattgacctgaccaacatctttgagagcttcctgccccagctgctggcctaccccaaccccatcgaccccctgaatggagatgctgctgccatgtacctgcacaggcctgaggagtacaagcagaagatcaaggagtacatccagaagtatgccacagaggaggccctgaaggagcaggaggagggcaccggggacagcagcagcgagagctccatgtctgacttctctgaagatgaggcccaggacatggagctgtag

SEQ ID NO: 175265 - DNA, 477 bp, Artificial Sequence
  Description of Artificial Sequence: Synthetic coding sequence
atgagcggcatcgccctgagccggctggcccaggagaggaaggcctggaggaaggaccaccccttcggctttgtggccgtgcccaccaagaacccagatggcaccatgaacctgatgaactgggagtgtgccatccctgggaagaagggcaccccctgggagggcggcctcttcaagctgaggatgctgttcaaggatgactaccccagcagcccccccaagtgcaagtttgagcccccactcttccaccccaacgtgtaccccagcggcaccgtgtgcctgagcatcctggaggaggacaaggactggaggcctgccatcaccatcaagcagatcctgctgggcatccaggagctgctgaatgagcccaacatccaggaccctgcccaggccgaggcctacaccatctactgccagaacagagtggagtatgagaagagggtgcgggcccaggccaagaagtttgcccccagctag

SEQ ID NO: 175266 - DNA, 477 bp, Artificial Sequence; identical to SEQ ID NO: 175265
  Description of Artificial Sequence: Synthetic coding sequence

SEQ ID NO: 175267 - DNA, 477 bp, Artificial Sequence; identical to SEQ ID NO: 175265
  Description of Artificial Sequence: Synthetic coding sequence

SEQ ID NO: 175268 - DNA, 477 bp, Artificial Sequence; identical to SEQ ID NO: 175265
  Description of Artificial Sequence: Synthetic coding sequence

SEQ ID NO: 175269 - DNA, 477 bp, Artificial Sequence; identical to SEQ ID NO: 175265
  Description of Artificial Sequence: Synthetic coding sequence

SEQ ID NO: 175270 - DNA, 477 bp, Artificial Sequence; identical to SEQ ID NO: 175265
  Description of Artificial Sequence: Synthetic coding sequence

SEQ ID NO: 175271 - DNA, 465 bp, Artificial Sequence
  Description of Artificial Sequence: Synthetic coding sequence
atggccgccagccggcggctgatgaaggagctggaggagatcagaaaatgtggcatgaagaacttcaggaacatccaggtggatgaggccaacctgctgacctggcagggcctgattgtgcctgacaaccccccctatgacaagggggccttcagaattgagatcaacttccctgctgagtaccccttcaagccacccaagatcaccttcaagaccaagatctaccaccccaacattgatgagaagggccaggtgtgcctgcccgtcatctctgctgagaactggaagccagccaccaagacagaccaggtgatccagagcctgattgccctggtgaatgacccccagcctgagcaccccctgcgggctgacctggccgaggagtacagcaaggacaggaagaagttctgcaagaatgctgaggagttcaccaagaagtatggagagaagaggcctgtggactag

SEQ ID NO: 175272 - DNA, 639 bp, Artificial Sequence
  Description of Artificial Sequence: Synthetic coding sequence
atgcaggtggccgccggcaccaggggggacacccggctgcaggaggtggccctgctgccccagctgtttgacctgctggtgctgggccagaggcgggcccggctgctgcggcaggtgcccagcgccctggccggcaaggacctggcccagctgcaggccggggccaccctggccggctacagaagagcccacggccctgaggagctggaggagatcagaaaatgtggcatgaagaacttcaggaacatccaggtggatgaggccaacctgctgacctggcagggcctgattgtgcctgacaaccccccctatgacaagggggccttcagaattgagatcaacttccctgctgagtaccccttcaagccacccaagatcaccttcaagaccaagatctaccaccccaacattgatgagaagggccaggtgtgcctgcccgtcatctctgctgagaactggaagccagccaccaagacagaccaggtgatccagagcctgattgccctggtgaatgacccccagcctgagcaccccctgcgggctgacctggccgaggagtacagcaaggacaggaagaagttctgcaagaatgctgaggagttcaccaagaagtatggagagaagaggcctgtggactag

SEQ ID NO: 175273 - DNA, 369 bp, Artificial Sequence
  Description of Artificial Sequence: Synthetic coding sequence
atggccgccagccggcggctgatgaaggacaaccccccctatgacaagggggccttcagaattgagatcaacttccctgctgagtaccccttcaagccacccaagatcaccttcaagaccaagatctaccaccccaacattgatgagaagggccaggtgtgcctgcccgtcatctctgctgagaactggaagccagccaccaagacagaccaggtgatccagagcctgattgccctggtgaatgacccccagcctgagcaccccctgcgggctgacctggccgaggagtacagcaaggacaggaagaagttctgcaagaatgctgaggagttcaccaagaagtatggagagaagaggcctgtggactag

SEQ ID NO: 175274 - DNA, 462 bp, Artificial Sequence
  Description of Artificial Sequence: Synthetic coding sequence
atgatggcctccatgagggtggtgaaggagctggaggacctgcagaagaagcccccaccctacctgaggaacctgagcagtgatgatgccaacgtgctggtgtggcacgccctgctgctgcctgaccagcccccctaccacctgaaggccttcaacctgcgcatctccttccccccagagtaccccttcaagccacccatgatcaagttcaccaccaagatctaccaccccaacgtggatgaaaatggccagatctgcctgcccatcatcagcagcgagaactggaagccctgcaccaagacctgccaggtgctggaggccctgaatgtgctggtgaaccggcccaacatccgggagcccctgaggatggacctggccgacctgctgacccagaaccctgagctgttcaggaagaatgctgaggagttcaccctgcgctttggagtggaccggcccagctag

SEQ ID NO: 175275 - DNA, 264 bp, Artificial Sequence
  Description of Artificial Sequence: Synthetic coding sequence
atgatcaagttcaccaccaagatctaccaccccaacgtggatgaaaatggccagatctgcctgcccatcatcagcagcgagaactggaagccctgcaccaagacctgccaggtgctggaggccctgaatgtgctggtgaaccggcccaacatccgggagcccctgaggatggacctggccgacctgctgacccagaaccctgagctgttcaggaagaatgctgaggagttcaccctgcgctttggagtggaccggcccagctag

SEQ ID NO: 175276 - DNA, 198 bp, Artificial Sequence
  Description of Artificial Sequence: Synthetic coding sequence
atgatcaagttcaccaccaagatctaccaccccaacgtggatgaaaatggccagatctgcctgcccatcatcagcagcgagaactggaagccctgcaccaagacctgccaggtgctggaggccctgaatgtgctggtgaaccggcccaacatccgggagcccctgaggatggacctggccgacctgctgacccagtag

SEQ ID NO: 175277 - DNA, 1128 bp, Artificial Sequence
  Description of Artificial Sequence: Synthetic coding sequence
atgtctgtgtctggcctgaaggccgagctgaagttcctggccagcatctttgacaagaaccacgagcgcttccgcatcgtgtcctggaagctggatgagctgcactgccagttcctggtgccccagcagggcagcccccacagcctgcccccacccctgaccctgcactgcaacatcacagagagctaccccagcagcagccccatctggtttgtggacagcgaggaccccaacctgacctctgtgctggagcggctggaggacaccaagaacaacaacctgctgcggcagcagctgaagtggctgatctgtgagctgtgcagcctgtacaacctgcccaagcacctggatgtggagatgctggaccagcccctgcccaccggccagaatggcaccacagaggaggtgaccagcgaggaggaggaggaggaggaggagatggctgaagatattgaggacctggaccactatgagatgaaggaggaggagcccatcagcggcaagaagtcagaagatgagggcatcgagaaggagaacctggccatcctggagaagatcaggaagacccagaggcaggaccacctgaatggagctgtgtctggctctgtgcaggccagtgaccggctgatgaaggagctgcgggacatctaccgcagccagagctacaagacaggcatctacagcgtggagctgatcaatgacagcctgtatgactggcacgtgaagctgcagaaggtggaccctgacagccccctgcacagcgacctgcagatcctgaaggagaaggagggcatcgagtacatcctgctgaacttctccttcaaggacaacttcccctttgaccccccatttgtgcgggtggtgctgcctgtgctgagcggcggctacgtgctgggcggcggggccctgtgcatggagctgctgaccaagcagggctggagcagcgcctacagcattgaatctgtcatcatgcagatcaatgccaccctggtgaagggcaaggcccgggtgcagtttggagccaacaagaaccagtacaacctggcccgggcccagcagagctacaacagcatcgtgcagatccacgagaagaatggctggtacaccccacccaaggaggatggatag

SEQ ID NO: 175278 - DNA, 945 bp, Artificial Sequence
  Description of Artificial Sequence: Synthetic coding sequence
atgtctgtgtctggcctgaaggccgagctgaagttcctggccagcatctttgacaagaaccacgagcgcttccgcatcgtgtcctggaagctggatgagctgcactgccagttcctggtgccccagcagggcagcccccacagcctgcccccacccctgaccctgcactgcaacatcacagagagctaccccagcagcagccccatctggtttgtggacagcgaggaccccaacctgacctctgtgctggagcggctggaggacaccaagaacaacaacctgctgcggcagcagctgaagtggctgatctgtgagctgtgcagcctgtacaacctgcccaagcacctggatgtggagatgctggaccagcccctgcccaccggccagaatggcaccacagaggaggtgaccagcgaggaggaggaggaggaggaggagatggctgaagatattgaggacctggaccactatgagatgaaggaggaggagcccatcagcggcaagaagtcagaagatgagggcatcgagaaggagaacctggccatcctggagaagatcaggaagacccagaggcaggaccacctgaatggagctgtgtctggctctgtgcaggccagtgaccggctgatgaaggagctgcgggacatctaccgcagccagagctacaagacaggcatctacagcgtggagctgatcaatgacagcctgtatgactggcacgtgaagctgcagaaggtggaccctgacagccccctgcacagcgacctgcagatcctgaaggagaaggagggcatcgagtacatcctgctgaacttctccttcaaggacaacttcccctttgaccccccatttgtgcgggtggtgctgcctgtgctgagcggcggcctggtgcaccccagcaagggccgctggctgaatgtgctgactgtggtgtgcctggactag

SEQ ID NO: 175279 - DNA, 1080 bp, Artificial Sequence
  Description of Artificial Sequence: Synthetic coding sequence
atgaggatggacagcctgacagaggagaagctggagtgccgcctgtggtgctgcctgagtgaccccagccccccaggcctggccgcccgctgctgcgtgctggagaggagcatcgtgcccagcctgcggcaggagagctaccccagcagcagccccatctggtttgtggacagcgaggaccccaacctgacctctgtgctggagcggctggaggacaccaagaacaacaacctgctgcggcagcagctgaagtggctgatctgtgagctgtgcagcctgtacaacctgcccaagcacctggatgtggagatgctggaccagcccctgcccaccggccagaatggcaccacagaggaggtgaccagcgaggaggaggaggaggaggaggagatggctgaagatattgaggacctggaccactatgagatgaaggaggaggagcccatcagcggcaagaagtcagaagatgagggcatcgagaaggagaacctggccatcctggagaagatcaggaagacccagaggcaggaccacctgaatggagctgtgtctggctctgtgcaggccagtgaccggctgatgaaggagctgcgggacatctaccgcagccagagctacaagacaggcatctacagcgtggagctgatcaatgacagcctgtatgactggcacgtgaagctgcagaaggtggaccctgacagccccctgcacagcgacctgcagatcctgaaggagaaggagggcatcgagtacatcctgctgaacttctccttcaaggacaacttcccctttgaccccccatttgtgcgggtggtgctgcctgtgctgagcggcggctacgtgctgggcggcggggccctgtgcatggagctgctgaccaagcagggctggagcagcgcctacagcattgaatctgtcatcatgcagatcaatgccaccctggtgaagggcaaggcccgggtgcagtttggagccaacaagaaccagtacaacctggcccgggcccagcagagctacaacagcatcgtgcagatccacgagaagaatggctggtacaccccacccaaggaggatggatag

SEQ ID NO: 175280 - DNA, 1080 bp, Artificial Sequence; identical to SEQ ID NO: 175279
  Description of Artificial Sequence: Synthetic coding sequence

SEQ ID NO: 175281 - DNA, 717 bp, Artificial Sequence
  Description of Artificial Sequence: Synthetic coding sequence
atggcccagcagcagatgaccagcagccagaaggccctgatgctggagctgaagagcctgcaggaggagcctgtggagggcttccgcatcaccctggtggatgaaagtgacctgtacaactgggaggtggccatcttcggcccccccaacaccctgtatgaaggaggctacttcaaggcccacatcaagttccccatcgactacccctacagcccccccaccttccgcttcctgaccaagatgtggcaccccaacatctatgaaaatggagatgtgtgcatcagcatcctgcacccccctgtggatgacccccagagcggggagctgcccagcgagcgctggaaccccacccagaatgtgaggaccatcctgctgagcgtcatcagcctgctgaatgagcccaacaccttctccccagccaacgtggatgcctctgtgatgttcaggaagtggagggacagcaagggcaaggacaaggagtatgcagagatcatcaggaagcaggtgtctgccaccaaggccgaggccgagaaggatggagtgaaggtgcccaccaccctggccgagtactgcatcaagaccaaggtgcccagcaatgacaacagcagtgacctgctgtatgatgacctgtatgatgatgacattgatgatgaagatgaggaggaggaggatgctgactgctatgatgatgatgattctggaaatgaggagagctag

SEQ ID NO: 175282 - DNA, 669 bp, Artificial Sequence
  Description of Artificial Sequence: Synthetic coding sequence
atgaacagcaatgtggagaacctgcccccccacatcatccggctggtgtacaaggaggtgaccaccctgacagctgaccccccagatggcatcaaggtgttccccaatgaggaggacctgacagacctgcaggtgaccatcgagggccctgagggcaccccctatgctgggggcctcttcaggatgaagctgctgctgggcaaggacttccctgccagcccccccaagggctacttcctgaccaagatcttccaccccaacgtgggcgccaatggagagatctgtgtgaatgtgctgaagagggactggacagctgagctgggcatcagacatgtgctgctgaccatcaagtgcctgctgatccaccccaaccctgagagcgccctgaatgaggaggccggccgcctgctgctggagaactatgaggagtatgctgcccgggcccggctgctgacagagatccatggaggagctgggggccccagcggccgggcagaggccggccgggccctggccagcggcacagaggccagcagcacagaccccggggcccctgggggccctgggggcgctgagggccccatggccaagaagcacgccggggagcgggacaagaagctggccgccaagaagaagacagacaagaagagggccctgcggcggctgtag

SEQ ID NO: 175283 - DNA, 594 bp, Artificial Sequence
  Description of Artificial Sequence: Synthetic coding sequence
atgcagagggccagccggctgaagcgggagctgcacatgctggccacagagcccccacctggcatcacctgctggcaggacaaggaccagatggatgacctgcgggcccagatcctgggcggggccaacaccccctatgagaagggcgtcttcaagctggaggtgatcatccctgagcgctacccctttgagcccccccagatccgcttcctgacccccatctaccaccccaacattgattctgctggccgcatctgcctggatgtgctgaagctgccccccaagggggcctggaggcccagcctgaacatcgccaccgtgctgaccagcatccagctgctgatgtctgagcccaacccagatgaccccctgatggctgacatcagcagcgagttcaagtacaacaagccagccttcctgaagaatgcccggcagtggacagagaagcacgcccggcagaagcagaaggcagatgaggaggagatgctggacaacctgcctgaggccggggacagccgggtgcacaacagcacccagaagaggaaggccagccagctggtgggcatcgagaagaagttccacccagatgtgtag

SEQ ID NO: 175284 - DNA, 489 bp, Artificial Sequence
  Description of Artificial Sequence: Synthetic coding sequence
atggcctccatgcagaccactggaagaagagtggaggtgtggttccccaagaggctgcagaaggagctgctggccctgcagaatgaccccccacctggcatgaccctgaatgagaagtctgtgcagaacagcatcacccagtggatcgtggacatggagggcgcccctggcaccctgtatgaaggagagaagttccagctgctcttcaagttcagcagccgctacccctttgacagcccccaggtgatgttcaccggggagaacatccctgtgcacccccacgtgtacagcaatggccacatctgcctgagcatcctgacagaggactggagccctgccctgtctgtgcagagcgtgtgcctgagcatcatctccatgctgagcagctgcaaggagaagaggcggcccccagacaacagcttctacgtgaggacctgcaacaagaaccccaagaagaccaagtggtggtaccatgatgacacctgctag

SEQ ID NO: 175285 - DNA, 480 bp, Artificial Sequence
  Description of Artificial Sequence: Synthetic coding sequence
atggcctccatgcagaagaggctgcagaaggagctgctggccctgcagaatgaccccccacctggcatgaccctgaatgagaagtctgtgcagaacagcatcacccagtggatcgtggacatggagggcgcccctggcaccctgtatgaaggagagaagttccagctgctcttcaagttcagcagccgctacccctttgacagcccccaggtgatgttcaccggggagaacatccctgtgcacccccacgtgtacagcaatggccacatctgcctgagcatcctgacagaggactggagccctgccctgtctgtgcagagcgtgtgcctgagcatcatctccatgctgagcagctgcaaggagaagagaagacctccagacaacagcttctacgtgaggacctgcaacaagaaccccaagaagaccaagtggtggtaccacgagctgaagagcgccttcatcctgagcatcacagactag

SEQ ID NO: 175286 - DNA, 456 bp, Artificial Sequence
  Description of Artificial Sequence: Synthetic coding sequence
atggcctccatgcagaagaggctgcagaaggagctgctggccctgcagaatgaccccccacctggcatgaccctgaatgagaagtctgtgcagaacagcatcacccagtggatcgtggacatggagggcgcccctggcaccctgtatgaaggagagaagttccagctgctcttcaagttcagcagccgctacccctttgacagcccccaggtgatgttcaccggggagaacatccctgtgcacccccacgtgtacagcaatggccacatctgcctgagcatcctgacagaggactggagccctgccctgtctgtgcagagcgtgtgcctgagcatcatctccatgctgagcagctgcaaggagaagagaagacctccagacaacagcttctacgtgaggacctgcaacaagaaccccaagaagaccaagtggtggtaccatgatgacacctgctag

SEQ ID NO: 175287 - DNA, 354 bp, Artificial Sequence
  Description of Artificial Sequence: Synthetic coding sequence
atgagcagcaatgtgcctgctgacatgatcaacctgcggctcatcctggtgtctgggaagaccaaggagttcctgttcagccccaatgattctgccagtgacatcgccaagcacgtgtatgacaactggcccatggactgggaggaggagcaggtgagcagccccaacatcctgcggctcatctaccagggccgcttcctgcacggcaatgtgaccctgggcgccctgaagctgccctttgggaagaccaccgtgatgcacctggtggcccgggagaccctgcctgagcccaacagccagggccagaggaaccgggagaagacaggagagagcaactgctgcgtcatcctgtag

SEQ ID NO: 175288 - DNA, 474 bp, Artificial Sequence
  Description of Artificial Sequence: Synthetic coding sequence
atgcagctgactgtgaaggccctgcagggccgggagtgcagcctgcaggtgcctgaagatgagctggtgtccaccctgaagcagctggtgtctgagaagctgaatgtgcctgtgcggcagcagaggctgctcttcaagggcaaggccctggctgatggcaagaggctgagtgactacagcatcggccccaacagcaagctgaacctggtggtgaagcccctggagaaggtgctgctggaggagggggaggcccagaggctggccgacagccccccaccccaggtgtggcagctgatcagcaaggtgctggcccggcacttctctgctgctgatgccagccgggtgctggagcagctgcagagggactatgaaagaagcctgagccggctgaccctggatgacatcgagcggctggccagccgcttcctgcaccctgaggtgacagagaccatggagaagggcttcagcaagtag

SEQ ID NO: 175289 - DNA, 525 bp, Artificial Sequence
  Description of Artificial Sequence: Synthetic coding sequence
atgttcctgactgtgaagctgctgctgggccagcgctgcagcctgaaggtgtctggccaggagagcgtggccaccctgaagaggctggtgtcccggcggctgaaggtgcctgaggagcagcagcacctgctcttccggggccagctgctggaggatgacaagcacctgagtgactactgcatcggccccaatgccagcatcaacgtcatcatgcagcccctggagaagatggccctgaaggaggcccaccagccccagacccagcccctgtggcaccagctgggcctggtgctggccaagcactttgagccccaggatgccaaggctgtgctgcagctgctgcggcaggagcacgaggagcggctgcagaagatcagcctggagcacctggagcagctggcccagtacctgctggccgaggagccccacgtggagcctgctggggagcgggagctggaggccaaggcccggccccagagcagctgtgacatggaggagaaggaggaggccgctgctgaccagtag

SEQ ID NO: 175290 - DNA, 222 bp, Artificial Sequence
  Description of Artificial Sequence: Synthetic coding sequence
atgattgaggtggtgtgcaatgaccggctgggcaagaaggtgcgggtgaagtgcaacacagatgacaccatcggggacctgaagaagctgattgctgcccagacaggcacccgctggaacaagatcgtgctgaagaagtggtacaccatcttcaaggaccacgtgtccctgggggactatgagatccatgatggcatgaacctggagctgtactaccagtag

SEQ ID NO: 175291 - DNA, 222 bp, Artificial Sequence; identical to SEQ ID NO: 175290
  Description of Artificial Sequence: Synthetic coding sequence

SEQ ID NO: 175292 - DNA, 1143 bp, Artificial Sequence
  Description of Artificial Sequence: Synthetic coding sequence
atgagcctgagtgactggcacctggccgtgaagctggccgaccagcccctgacccccaagagcatcctgcggctgcctgagacagagctgggggagtacagcctgggcggctacagcatctccttcctgaagcagctgattgctgggaagctgcaggagagcgtgcctgaccctgagctgattgacctgatctactgcggcaggaagctgaaggatgaccagaccctggacttctacggcatccagcccggcagcacagtgcacgtgctgaggaagtcctggccagagccagaccagaagccagagcctgtggacaaggtggccgccatgagggagttccgggtgctgcacacagccctgcacagcagcagcagctaccgggaggccgtgttcaagatgctgagcaacaaggagagcctggaccagatcatcgtggccaccccaggcctgagcagtgaccccatcgccctgggcgtgctgcaggacaaggacctcttctctgtgtttgctgaccccaacatgctggacaccctggtgcctgcccacccagccctggtgaatgccatcgtgctggtgctgcacagcgtggccggcagcgcccccatgcctggaacagacagcagcagccgctccatgcccagcagcagctacagagacatgcctgggggcttcctgtttgagggcctgagtgatgatgaagatgacttccaccccaacaccaggagcacccccagcagcagcacccccagcagcaggcctgccagcctgggctacagcggggccgccggcccccggcccatcacccagagcgagctggccacagccctggccctggccagcaccccagagagcagcagccacacccccaccccaggcacccagggccacagcagcggcaccagccccatgagcagtggagtgcagagcggcacccccatcaccaatgacctcttcagccaggccctgcagcacgccctgcaggccagcggccagcccagcctgcagagccagtggcagccccagctgcagcagctgcgggacatgggcatccaggatgatgagctgagcctgcgggccctgcaggccactggaggagacatccaggccgccctggagctgatctttgctgggggcgccccctag

SEQ ID NO: 175293 - DNA, 1143 bp, Artificial Sequence; identical to SEQ ID NO: 175292
  Description of Artificial Sequence: Synthetic coding sequence

SEQ ID NO: 175294 - DNA, 957 bp, Artificial Sequence
  Description of Artificial Sequence: Synthetic coding sequence
atggccctgcccatcatcgtgaagtggggcggccaggagtacagcgtgaccaccctgtctgaagatgacacagtgctggacctgaagcagttcctgaagaccctgactggagtgctgcctgagcggcagaagctgctgggcctgaaggtgaagggcaagccagcagaaaatgatgtgaagctgggcgccctgaagctgaagcccaacaccaagatcatgatgatgggcacccgggaggagagcctggaggatgtgctgggccccccaccagacaatgatgatgtggtgaatgactttgatattgaagatgaggtggtggaggtggagaaccgggaggagaacctgctgaagatcagccggcgggtgaaggagtacaaggtggagatcctgaaccccccccgggagggcaagaagctgctggtgctggatgtggactacaccctgtttgaccacaggagctgtgccgagactggagtggagctgatgaggccctacctgcacgagttcctgaccagcgcctatgaagattatgacatcgtcatctggagcgccaccaacatgaagtggattgaggccaagatgaaggagctgggcgtgtccaccaatgccaactacaagatcaccttcatgctggacagcgctgccatgatcaccgtgcacaccccaagaagaggcctgattgatgtgaagcccctgggcgtcatctggggcaagttcagcgagttctacagcaagaagaacaccatcatgtttgatgacatcggcaggaacttcctgatgaacccccagaatggcctgaagatccggcccttcatgaaggcccacctgaacagagacaaggacaaggagctgctgaagctgacccagtacctgaaggagatcgccaagctggatgacttcctggacctgaaccacaagtactgggagcgctacctgagcaagaagcagggccagtag

SEQ ID NO: 175295 - DNA, 1923 bp, Artificial Sequence
  Description of Artificial Sequence: Synthetic coding sequence
atggccctgagccggggcctgccccgggagctggccgaggccgtggccggcggccgggtgctggtggtgggcgccggcggcatcggctgtgagctgctgaagaacctggtgctgaccggcttcagccacatcgacctgattgacctggacaccattgatgtgagcaacctgaaccggcagttcctgttccagaagaagcacgtgggccgcagcaaggcccaggtggccaaggagagcgtgctgcagttctaccccaaggccaacatcgtggcctaccatgacagcatcatgaacccagactacaacgtggagttcttccggcagttcatcctggtgatgaatgccctggacaacagagctgccaggaaccacgtgaacaggatgtgcctggccgcagatgtgcccctgattgaaagtggcacagctggctacctgggccaggtgaccaccatcaagaagggcgtgacagaatgttatgagtgccaccccaagcccacccagaggaccttccctggctgcaccatccggaacacccccagcgagcccatccactgcatcgtgtgggccaagtacctgttcaaccagctgtttggagaggaggatgctgaccaggaggtgtccccagacagagctgaccctgaggccgcctgggagcccacagaggccgaggcccgggcccgggccagcaatgaagatggagacatcaagaggatcagcaccaaggagtgggccaagagcacaggctatgaccctgtgaagctgttcaccaagctgttcaaggatgacatccgctacctgctgaccatggacaagctgtggaggaagaggaagccccctgtgcccctggactgggccgaggtgcagagccagggcgaggagaccaatgccagtgaccagcagaatgagccccagctgggcctgaaggaccagcaggtgctggatgtgaagagctatgcccggctcttcagcaagagcattgagaccctgcgggtgcacctggccgagaagggagatggagctgagctgatctgggacaaggatgaccccagcgccatggactttgtgaccagcgctgccaacctgaggatgcacatcttctccatgaacatgaagagcagatttgacatcaagtccatggccggcaacatcatcccagccatcgccaccaccaatgctgtgattgctggcctcatcgtgctggagggcctgaagatcctgagcggcaagattgaccagtgcaggaccatcttcctgaacaagcagcccaaccccaggaagaagctgctggtgccctgtgccctggacccccccaaccccaactgctacgtgtgtgccagcaagccagaggtgacagtgcggctgaatgtgcacaaggtgacagtgctgaccctgcaggacaagatcgtgaaggagaagtttgccatggtggccccagatgtgcagattgaagatggcaagggcaccatcctgatcagcagcgaggagggggagacagaggccaacaaccacaagaagctgtctgaatttggcatcagaaatggcagccggctgcaggctgatgacttcctgcaggactacaccctgctgatcaacatcctgcacagcgaggacctgggcaaggatgtggagtttgaggtggtgggagatgcccctgagaaggtgggccccaagcaggccgaggatgctgccaagagcatcaccaacggcagtgatgatggagcccagcccagcaccagcacagcccaggagcaggatgatgtgctgattgtggacagtgatgaggaggacagcagcaacaatgctgatgtgtctgaggaggagaggagcaggaagaggaagctggatgagaaggagaacctgagcgccaagaggagcagaattgagcagaaggaggagctggatgatgtgattgccctggactag

SEQ ID NO: 175296 - DNA, 1635 bp, Artificial Sequence
  Description of Artificial Sequence: Synthetic coding sequence
atgaacccagactacaacgtggagttcttccggcagttcatcctggtgatgaatgccctggacaacagagctgccaggaaccacgtgaacaggatgtgcctggccgcagatgtgcccctgattgaaagtggcacagctggctacctgggccaggtgaccaccatcaagaagggcgtgacagaatgttatgagtgccaccccaagcccacccagaggaccttccctggctgcaccatccggaacacccccagcgagcccatccactgcatcgtgtgggccaagtacctgttcaaccagctgtttggagaggaggatgctgaccaggaggtgtccccagacagagctgaccctgaggccgcctgggagcccacagaggccgaggcccgggcccgggccagcaatgaagatggagacatcaagaggatcagcaccaaggagtgggccaagagcacaggctatgaccctgtgaagctgttcaccaagctgttcaaggatgacatccgctacctgctgaccatggacaagctgtggaggaagaggaagccccctgtgcccctggactgggccgaggtgcagagccagggcgaggagaccaatgccagtgaccagcagaatgagccccagctgggcctgaaggaccagcaggtgctggatgtgaagagctatgcccggctcttcagcaagagcattgagaccctgcgggtgcacctggccgagaagggagatggagctgagctgatctgggacaaggatgaccccagcgccatggactttgtgaccagcgctgccaacctgaggatgcacatcttctccatgaacatgaagagcagatttgacatcaagtccatggccggcaacatcatcccagccatcgccaccaccaatgctgtgattgctggcctcatcgtgctggagggcctgaagatcctgagcggcaagattgaccagtgcaggaccatcttcctgaacaagcagcccaaccccaggaagaagctgctggtgccctgtgccctggacccccccaaccccaactgctacgtgtgtgccagcaagccagaggtgacagtgcggctgaatgtgcacaaggtgacagtgctgaccctgcaggacaagatcgtgaaggagaagtttgccatggtggccccagatgtgcagattgaagatggcaagggcaccatcctgatcagcagcgaggagggggagacagaggccaacaaccacaagaagctgtctgaatttggcatcagaaatggcagccggctgcaggctgatgacttcctgcaggactacaccctgctgatcaacatcctgcacagcgaggacctgggcaaggatgtggagtttgaggtggtgggagatgcccctgagaaggtgggccccaagcaggccgaggatgctgccaagagcatcaccaacggcagtgatgatggagcccagcccagcaccagcacagcccaggagcaggatgatgtgctgattgtggacagtgatgaggaggacagcagcaacaatgctgatgtgtctgaggaggagaggagcaggaagaggaagctggatgagaaggagaacctgagcgccaagaggagcagaattgagcagaaggaggagctggatgatgtgattgccctggactag

SEQ ID NO: 175297 - DNA, 879 bp, Artificial Sequence
  Description of Artificial Sequence: Synthetic coding sequence
atgtgcctggccgcagatgtgcccctcatcgagagcggcacagctggctacctgggccaggtgaccaccatcaagaagggcgtgacagagtgctatgagtgccaccccaagcccacccagaggaccttccctggctgcaccatccggaacaccccatctgagcccatccactgcatcgtgtgggccaagtacctgttcaaccagctgtttggagaagaagatgctgaccaggaggtgtccccagacagagctgaccctgaggccgcctgggagcccacagaagctgaggcccgggcccgggccagcaatgaagatggagacatcaagaggatcagcaccaaggagtgggccaagagcacaggctatgaccctgtgaagctgttcaccaagctgttcaaggatgacatccgctacctgctgaccatggacaagctgtggaggaagaggaagccccctgtgcccctggactgggccgaggtgcagagccagggcgaggagaccaatgccagtgaccagcagaatgagccccagctgggcctgaaggaccagcaggtgctggatgtgaagagctatgcccggctcttcagcaagagcattgagaccctgcgggtgcacctggccgagaagggagatggagctgagctgatctgggacaaggatgaccccagcgccatggactttgtgaccagcgctgccaacctgaggatgcacatcttctccatgaacatgaagagcagatttgacatcaagtccatggccggcaacatcatcccagccatcgccaccaccaatgctgtgattgctggcctgattgtgctggagggcctgaagatcctgagcggcaagattgaccagtgcaggacagacttctttgaatag

SEQ ID NO: 175298 - DNA, 1047 bp, Artificial Sequence
  Description of Artificial Sequence: Synthetic coding sequence
atggccctgaagaggatgggcatcgtgtctgactatgagaagatccgcacctttgctgtggccatcgtgggcgtgggcggcgtgggctctgtgacagctgagatgctgacccgctgtggcatcggcaagctgctgctgtttgattatgacaaggtggagctggccaacatgaacagactcttcttccagccccaccaggccggcctgagcaaggtgcaggccgctgagcacaccctgaggaacatcaacccagatgtgctgtttgaggtgcacaactacaacatcaccaccgtggagaacttccagcacttcatggaccgcatcagcaatggaggcctggaggagggcaagcctgtggacctggtgctgagctgtgtggacaactttgaggccaggatgaccatcaacacagcctgcaatgagctgggccagacctggatggagagcggcgtgtctgaaaatgctgtgtctggccacatccagctgatcatccctggagagagcgcctgctttgcctgtgccccacccctggtggtggccgccaacattgatgagaagaccctgaagcgggagggcgtgtgtgccgccagcctgcccaccaccatgggcgtggtggccggcatcctggtgcagaatgtgctgaagttcctgctgaactttggcaccgtgtccttctacctgggctacaatgccatgcaggacttcttccccaccatgtccatgaagcccaacccccagtgtgatgacaggaactgcaggaagcagcaggaggagtacaagaagaaggtggccgccctgcccaagcaggaggtgatccaggaggaggaggagatcatccatgaagataatgagtggggcatcgagctggtgtctgaggtgtctgaggaggagctgaagaacttcagcggccctgtgcctgacctgcctgagggcatcaccgtggcctacaccatccccaagaagcaggaggacagcgtgacagagctgactgtggaggacagcggggagagcctggaggacctgatggccaagatgaagaacatgtag

SEQ ID NO: 175299 - DNA, 1215 bp, Artificial Sequence
  Description of Artificial Sequence: Synthetic coding sequence
atggccgagagcgtggagcggctgcagcagagggtgcaggagctggagcgggagctggcccaggagaggagcctgcaggtgcccaggtctggagatggcggcggcggccgggtgcgcatcgagaagatgagcagcgaggtggtggacagcaacccctacagccggctgatggccctgaagaggatgggcatcgtgtctgactatgagaagatccgcacctttgctgtggccatcgtgggcgtgggcggcgtgggctctgtgacagctgagatgctgacccgctgtggcatcggcaagctgctgctgtttgattatgacaaggtggagctggccaacatgaacagactcttcttccagccccaccaggccggcctgagcaaggtgcaggccgctgagcacaccctgaggaacatcaacccagatgtgctgtttgaggtgcacaactacaacatcaccaccgtggagaacttccagcacttcatggaccgcatcagcaatggaggcctggaggagggcaagcctgtggacctggtgctgagctgtgtggacaactttgaggccaggatgaccatcaacacagcctgcaatgagctgggccagacctggatggagagcggcgtgtctgaaaatgctgtgtctggccacatccagctgatcatccctggagagagcgcctgctttgcctgtgccccacccctggtggtggccgccaacattgatgagaagaccctgaagcgggagggcgtgtgtgccgccagcctgcccaccaccatgggcgtggtggccggcatcctggtgcagaatgtgctgaagttcctgctgaactttggcaccgtgtccttctacctgggctacaatgccatgcaggacttcttccccaccatgtccatgaagcccaacccccagtgtgatgacaggaactgcaggaagcagcaggaggagtacaagaagaaggtggccgccctgcccaagcaggaggtgatccaggaggaggaggagatcatccatgaagataatgagtggggcatcgagctggtgtctgaggtgtctgaggaggagctgaagaacttcagcggccctgtgcctgacctgcctgagggcatcaccgtggcctacaccatccccaagaagcaggaggacagcgtgacagagctgactgtggaggacagcggggagagcctggaggacctgatggccaagatgaagaacatgtag

SEQ ID NO: 175300 - DNA, 2379 bp, Artificial Sequence
  Description of Artificial Sequence: Synthetic coding sequence
atgtggatccaggtgaggaccatggatggccggcagacccacacagtggacagcctgagccggctgaccaaggtggaggagctgcggaggaagatccaggagctgttccacgtggagcccggcctgcagaggctcttctaccggggcaagcagatggaggatggccacaccctgtttgattatgaggtgcggctgaatgacaccatccagctgctggtgcggcagagcctggtgctgccccacagcaccaaggagcgggacagcgagctgagtgacacagattctggctgctgcctgggccagagcgagagtgacaagagcagcacccacggggaggccgctgctgagacagacagcaggcctgcagatgaggacatgtgggatgaaacagagctgggcctgtacaaggtgaatgaatatgtggatgcccgggacaccaacatgggcgcctggtttgaggcccaggtggtgcgggtgaccaggaaggcccccagcagagatgagccctgcagcagcaccagcaggcctgccctggaggaggatgtgatctaccacgtgaagtatgatgactacccagaaaatggagtggtgcagatgaacagcagagatgtgcgggcccgggcccggaccatcatcaagtggcaggacctggaggtgggccaggtggtgatgctgaactacaacccagacaaccccaaggagcggggcttctggtatgatgctgagatcagcaggaagcgggagaccaggacagcccgggagctgtatgccaacgtggtgctgggagatgacagcctgaatgactgccgcatcatctttgtggatgaggtgttcaagattgaaagacctggagagggcagccccatggtggacaaccccatgaggaggaagagcggccccagctgcaagcactgcaaggatgatgtgaaccggctgtgccgggtgtgtgcctgccacctgtgtggcggccggcaggaccctgacaagcagctgatgtgtgatgaatgtgacatggccttccacatctactgcctggacccccccctgagctctgtgcccagtgaagatgagtggtactgcccagagtgcagaaatgatgccagcgaggtggtgctggccggggagcggctgcgggagagcaagaagaaggccaagatggccagcgccaccagcagcagccagagggactggggcaagggcatggcctgtgtgggccgcaccaaggaatgtaccatcgtgcccagcaaccactacggccccatccctggcatccctgtgggcaccatgtggaggttccgggtgcaggtgtctgagagcggcgtgcaccggccccacgtggccggcatccacggccgcagcaatgatggagcctacagcctggtgctggccggcggctatgaagatgatgtggaccacggcaacttcttcacctacacaggcagcggcggccgggacctgagcggcaacaagaggacagctgagcagagctgtgaccagaagctgaccaacaccaacagagccctggccctgaactgctttgcccccatcaatgaccaggagggcgctgaggccaaggactggaggtctgggaagcctgtgcgggtggtgagaaatgtgaagggcggcaagaacagcaaatatgccccagctgagggcaacagatatgatggcatctacaaggtggtgaagtactggccagagaagggcaagagcggcttcctggtgtggagatacctgctgcggagagatgatgatgagcccggcccctggaccaaggagggcaaggaccgcatcaagaagctgggcctgaccatgcagtacccagagggctacctggaggccctggccaaccgggagcgggagaaggagaacagcaagcgggaggaggaggagcagcaggagggcggctttgccagccccaggacaggcaagggcaagtggaagaggaagtctgctgggggcggccccagcagagctggccccaggaggaccagcaagaagaccaaggtggagccctacagcctgacagcccagcagagcagcctcatccgggaggacaagagcaatgccaagctgtggaatgaggtgctggccagcctgaaggacaggcctgccagcggcagccccttccagctgttcctgagcaaggtggaggagaccttccagtgcatctgctgccaggagctggtgttccggcccatcaccaccgtgtgccagcacaacgtgtgcaaggactgcctggacaggagcttccgggcccaggtgttcagctgcccagcctgccgctatgacctgggccgctcctatgccatgcaggtgaaccagcccctgcagacagtgctgaaccagctgtttcctggctatggaaatggccgctag

SEQ ID NO: 175301 - DNA, 1224 bp, Artificial Sequence
  Description of Artificial Sequence: Synthetic coding sequence
atggccagcgccaccagcagcagccagagggactggggcaagggcatggcctgtgtgggccgcaccaaggagtgcaccatcgtgcccagcaaccactacggccccatccctggcatccctgtgggcaccatgtggaggttccgggtgcaggtgtctgagagcggcgtgcaccggccccacgtggccggcatccacggccgcagcaatgatggagcctacagcctggtgctggccggcggctatgaagatgatgtggaccacggcaacttcttcacctacacaggcagcggcggccgggacctgagcggcaacaagaggacagctgagcagagctgtgaccagaagctgaccaacaccaacagagccctggccctgaactgctttgcccccatcaatgaccaggagggcgctgaggccaaggactggaggtctgggaagcctgtgcgggtggtgagaaatgtgaagggcggcaagaacagcaaatatgccccagctgagggcaacagatatgatggcatctacaaggtggtgaagtactggccagagaagggcaagagcggcttcctggtgtggagatacctgctgcggagagatgatgatgagcccggcccctggaccaaggagggcaaggaccgcatcaagaagctgggcctgaccatgcagtacccagagggctacctggaggccctggccaaccgggagcgggagaaggagaacagcaagcgggaggaggaggagcagcaggagggcggctttgccagccccaggacaggcaagggcaagtggaagaggaagtctgctgggggcggccccagccgggccggccccaggaggaccagcaagaagaccaaggtggagccctacagcctgacagcccagcagagcagcctcatccgggaggacaagagcaatgccaagctgtggaatgaggtgctggccagcctgaaggacaggcctgccagcggcagccccttccagctgttcctgagcaaggtggaggagaccttccagtgcatctgctgccaggagctggtgttccggcccatcaccaccgtgtgccagcacaacgtgtgcaaggactgcctggaccgctccttccgggcccaggtgttcagctgcccagcctgccgctatgacctgggccgctcctatgccatgcaggtgaaccagcccctgcagacagtgctgaaccagctgtttcctggctatggaaatggaagatag

SEQ ID NO: 175302 - DNA, 2418 bp, Artificial Sequence
  Description of Artificial Sequence: Synthetic coding sequence
atgggcgtgtttgctgtgccccccctgtctgctgacaccatgtggatccaggtgaggaccatggatggccggcagacccacacagtggacagcctgagccggctgaccaaggtggaggagctgcggaggaagatccaggagctgttccacgtggagcccggcctgcagaggctcttctaccggggcaagcagatggaggatggccacaccctgtttgattatgaggtgcggctgaatgacaccatccagctgctggtgcggcagagcctggtgctgccccacagcaccaaggagcgggacagcgagctgagtgacacagacagcggctgctgcctgggccagagcgagagtgacaagagcagcacccatggagaggccgctgctgagacagacagcaggcctgcagatgaggacatgtgggatgaaacagagctgggcctgtacaaggtgaatgaatatgtggatgcccgggacaccaacatgggcgcctggtttgaggcccaggtggtgcgggtgaccaggaaggcccccagcagagatgagccctgcagcagcaccagcaggcctgccctggaggaggatgtgatctaccacgtgaagtatgatgactacccagaaaatggagtggtgcagatgaacagcagagatgtgcgggcccgggcccggaccatcatcaagtggcaggacctggaggtgggccaggtggtgatgctgaactacaacccagacaaccccaaggagcggggcttctggtatgatgctgagatcagcaggaagcgggagaccaggacagcccgggagctgtatgccaacgtggtgctgggagatgacagcctgaatgactgccgcatcatctttgtggatgaggtgttcaagattgaaagacctggagagggcagccccatggtggacaaccccatgaggaggaagagcggccccagctgcaagcactgcaaggatgatgtgaaccggctgtgccgggtgtgtgcctgccacctgtgtggcggccggcaggaccctgacaagcagctgatgtgtgatgaatgtgacatggccttccacatctactgcctggacccccccctgagctctgtgcccagtgaagatgagtggtactgcccagaatgtagaaatgatgccagcgaggtggtgctggccggggagcggctgcgggagagcaagaagaaggccaagatggccagcgccaccagcagcagccagagggactggggcaagggcatggcctgtgtgggccgcaccaaggagtgcaccatcgtgcccagcaaccactacggccccatccctggcatccctgtgggcaccatgtggaggttccgggtgcaggtgtctgagagcggcgtgcaccggccccacgtggccggcatccacggccgcagcaatgatggagcctacagcctggtgctggccggcggctatgaagatgatgtggaccacggcaacttcttcacctacacaggcagcggcggccgggacctgagcggcaacaagaggacagctgagcagagctgtgaccagaagctgaccaacaccaacagagccctggccctgaactgctttgcccccatcaatgaccaggagggcgctgaggccaaggactggaggtctgggaagcctgtgcgggtggtgagaaatgtgaagggcggcaagaacagcaaatatgccccagctgagggcaacagatatgatggcatctacaaggtggtgaagtactggccagagaagggcaagagcggcttcctggtgtggagatacctgctgcggagagatgatgatgagcccggcccctggaccaaggagggcaaggaccgcatcaagaagctgggcctgaccatgcagtacccagagggctacctggaggccctggccaaccgggagcgggagaaggagaacagcaagcgggaggaggaggagcagcaggagggcggctttgccagccccaggacaggcaagggcaagtggaagaggaagtctgctgggggcggccccagccgggccggccccaggaggaccagcaagaagaccaaggtggagccctacagcctgacagcccagcagagcagcctcatccgggaggacaagagcaatgccaagctgtggaatgaggtgctggccagcctgaaggacaggcctgccagcggcagccccttccagctgttcctgagcaaggtggaggagaccttccagtgcatctgctgccaggagctggtgttccggcccatcaccaccgtgtgccagcacaacgtgtgcaaggactgcctggaccgctccttccgggcccaggtgttcagctgcccagcctgccgctatgacctgggccgctcctatgccatgcaggtgaaccagcccctgcagacagtgctgaaccagctgtttcctggctatggaaatggaagatag

SEQ ID NO: 175303 - DNA, 2379 bp, Artificial Sequence; identical to SEQ ID NO: 175300
  Description of Artificial Sequence: Synthetic coding sequence

SEQ ID NO: 175304 - DNA, 2379 bp, Artificial Sequence; identical to SEQ ID NO: 175300
  Description of Artificial Sequence: Synthetic coding sequence

SEQ ID NO: 175305 - DNA, 3240 bp, Artificial Sequence
  Description of Artificial Sequence: Synthetic coding sequence
atgaagagctgtgctgtgtccctgaccacagctgctgtggcctttggagatgaggccaagaagatggccgagggcaaggccagccgggagagcgaggaggagagcgtgtccctgactgtggaggagcgggaggccctgggcggcatggacagccggctgtttggatttgtgcggctgcatgaagatggagcccggaccaagaccctgctgggcaaggctgtgcgctgctatgagagcctcatcctgaaggccgagggcaaggtggagagtgacttcttctgccagctgggccacttcaacctgctgctggaggactacagcaaggccctgagcgcctaccagcgctactacagcctgcaggccgactactggaagaatgctgccttcctgtatggcctgggcctggtgtacttctactacaatgccttccactgggccatcaaggccttccaggatgtgctgtatgtggaccccagcttctgccgggccaaggagatccacctgcggctgggcctgatgttcaaggtgaacacagactacaagagcagcctgaagcacttccagctggccctgattgactgcaacccctgcaccctgagcaatgctgagatccagttccacatcgcccacctgtatgagacccagaggaagtaccacagcgccaaggaggcctatgagcagctgctgcagacagagaacctgcctgcccaggtgaaggccaccgtgctgcagcagctgggctggatgcaccacaacatggacctggtgggggacaaggccaccaaggagagctatgccatccagtacctgcagaagagcctggaggccgaccccaacagcggccagagctggtacttcctgggccgctgctacagcagcatcggcaaggtgcaggatgccttcatctcctaccggcagagcattgacaagtctgaggccagcgctgacacctggtgcagcattggagtgctgtaccagcagcagaaccagcccatggatgccctgcaggcctacatctgtgctgtgcagctggaccacggccatgctgctgcctggatggacctgggcaccctgtatgagagctgcaaccagccccaggatgccatcaagtgctacctgaatgctgcccggagcaagcgctgcagcaacaccagcaccctggccgcccgcatcaagttcctgcagaatggaagtgacaactggaatggaggccagagcctgagccaccaccctgtgcagcaggtgtacagcctgtgcctgaccccccagaagctgcagcacctggagcagctgcgggccaacagagacaacctgaacccagcccagaagcaccagctggagcagctggagagccagtttgtgctgatgcagcagatgaggcacaaggaggtggcccaggtgaggaccaccggcatccacaacggggccatcacagacagcagcctgcccaccaacagcgtgagcaaccggcagccccatggagccctgaccagggtgtcctctgtgtcccagcccggggtgcggcctgcctgtgtggagaagctgctgagcagcggggccttctctgctggctgcatcccctgtggcaccagcaagatcctgggcagcacagacaccatcctgctgggcagcaactgcatcgccggcagcgagagcaatggaaatgtgccctacctgcagcagaacacccacaccctgccccacaaccacacagacctgaacagcagcacagaggagccctggaggaagcagctgagcaacagcgcccagggcctgcacaagagccagagcagctgcctgagcggccccaatgaggagcagcccctcttcagcacaggcagcgcccagtaccaccaggccaccagcacaggcatcaagaaggccaatgagcacctgaccctgcccagcaacagcgtgccccagggagatgctgacagccacctgagctgccacacagccaccagcggcggccagcagggcatcatgttcaccaaggagagcaagcccagcaagaacagaagcctggtgcctgagaccagccgccacactggagacaccagcaatggctgtgctgatgtgaagggcctgagcaaccacgtgcaccagctgattgctgatgctgtgagcagccccaaccacggggacagccccaacctgctgattgctgacaacccccagctgagcgccctgctgattggcaaggccaatggaaatgtgggcaccggcacctgtgacaaggtgaacaacatccaccctgctgtgcacaccaagacagaccacagcgtggccagcagccccagcagcgccatcagcacagccacccccagccccaagagcacagagcagaggagcatcaacagcgtgaccagcctgaacagcccccacagcggcctgcacacagtgaatggagagggcctgggcaagagccagagcagcaccaaggtggacctgcccctggccagccacaggagcaccagccagatcctgcccagcatgtctgtgtccatctgccccagcagcacagaggtgctgaaggcctgcaggaaccctgggaagaatggcctgagcaacagctgcatcctgctggacaagtgccccccaccccggccccccaccagcccctacccacccctgcccaaggacaagctgaacccccccacccccagcatctacctggagaacaagagagatgccttcttcccccccctgcaccagttctgcaccaaccccaagaaccctgtgaccgtcatccggggcctggccggggccctgaagctggacctgggcctcttcagcaccaagaccctggtggaggccaacaatgagcacatggtggaggtgaggacccagctgctgcagcctgcagatgagaactgggaccccaccggcaccaagaagatctggaggtgtgagagcaacagaagccacaccaccatcgccaagtatgcccagtaccaggccagcagcttccaggagagcctgcgggccggcatgcagtggtgtgacctgagcagcctgcagcccccacctcctggcttcaagcgcttcagccacctgagcctgcccaacagctggaactaccgccacctgcccagctgccccaccaacttctgcatctttgtggagaccggcttccaccacgtgggccaggcctgcctggagctgctgaccagcggcggcctgctggccagcgccagccagagcgctggcatcaccggggtgagccaccacgccaggtag

SEQ ID NO: 175306 - DNA, 4044 bp, Artificial Sequence
  Description of Artificial Sequence: Synthetic coding sequence
atgaagagctgtgctgtgtccctgaccacagctgctgtggcctttggagatgaggccaagaagatggccgagggcaaggccagccgggagagcgaggaggagagcgtgtccctgactgtggaggagcgggaggccctgggcggcatggacagccggctgtttggatttgtgcggctgcatgaagatggagcccggaccaagaccctgctgggcaaggctgtgcgctgctatgagagcctcatcctgaaggccgagggcaaggtggagagtgacttcttctgccagctgggccacttcaacctgctgctggaggactacagcaaggccctgagcgcctaccagcgctactacagcctgcaggccgactactggaagaatgctgccttcctgtatggcctgggcctggtgtacttctactacaatgccttccactgggccatcaaggccttccaggatgtgctgtatgtggaccccagcttctgccgggccaaggagatccacctgcggctgggcctgatgttcaaggtgaacacagactacaagagcagcctgaagcacttccagctggccctgattgactgcaacccctgcaccctgagcaatgctgagatccagttccacatcgcccacctgtatgagacccagaggaagtaccacagcgccaaggaggcctatgagcagctgctgcagacagagaacctgcctgcccaggtgaaggccaccgtgctgcagcagctgggctggatgcaccacaacatggacctggtgggggacaaggccaccaaggagagctatgccatccagtacctgcagaagagcctggaggccgaccccaacagcggccagagctggtacttcctgggccgctgctacagcagcatcggcaaggtgcaggatgccttcatctcctaccggcagagcattgacaagtctgaggccagcgctgacacctggtgcagcattggagtgctgtaccagcagcagaaccagcccatggatgccctgcaggcctacatctgtgctgtgcagctggaccacggccatgctgctgcctggatggacctgggcaccctgtatgagagctgcaaccagccccaggatgccatcaagtgctacctgaatgctgcccggagcaagcgctgcagcaacaccagcaccctggccgcccgcatcaagttcctgcagaatggaagtgacaactggaatggaggccagagcctgagccaccaccctgtgcagcaggtgtacagcctgtgcctgaccccccagaagctgcagcacctggagcagctgcgggccaacagagacaacctgaacccagcccagaagcaccagctggagcagctggagagccagtttgtgctgatgcagcagatgaggcacaaggaggtggcccaggtgaggaccaccggcatccacaacggggccatcacagacagcagcctgcccaccaacagcgtgagcaaccggcagccccatggagccctgaccagggtgtcctctgtgtcccagcccggggtgcggcctgcctgtgtggagaagctgctgagcagcggggccttctctgctggctgcatcccctgtggcaccagcaagatcctgggcagcacagacaccatcctgctgggcagcaactgcatcgccggcagcgagagcaatggaaatgtgccctacctgcagcagaacacccacaccctgccccacaaccacacagacctgaacagcagcacagaggagccctggaggaagcagctgagcaacagcgcccagggcctgcacaagagccagagcagctgcctgagcggccccaatgaggagcagcccctcttcagcacaggcagcgcccagtaccaccaggccaccagcacaggcatcaagaaggccaatgagcacctgaccctgcccagcaacagcgtgccccagggagatgctgacagccacctgagctgccacacagccaccagcggcggccagcagggcatcatgttcaccaaggagagcaagcccagcaagaacagaagcctggtgcctgagaccagccgccacactggagacaccagcaatggctgtgctgatgtgaagggcctgagcaaccacgtgcaccagctgattgctgatgctgtgagcagccccaaccacggggacagccccaacctgctgattgctgacaacccccagctgagcgccctgctgattggcaaggccaatggaaatgtgggcaccggcacctgtgacaaggtgaacaacatccaccctgctgtgcacaccaagacagaccacagcgtggccagcagccccagcagcgccatcagcacagccacccccagccccaagagcacagagcagaggagcatcaacagcgtgaccagcctgaacagcccccacagcggcctgcacacagtgaatggagagggcctgggcaagagccagagcagcaccaaggtggacctgcccctggccagccacaggagcaccagccagatcctgcccagcatgtctgtgtccatctgccccagcagcacagaggtgctgaaggcctgcaggaaccctgggaagaatggcctgagcaacagctgcatcctgctggacaagtgccccccaccccggccccccaccagcccctacccacccctgcccaaggacaagctgaacccccccacccccagcatctacctggagaacaagagagatgccttcttcccccccctgcaccagttctgcaccaaccccaagaaccctgtgaccgtcatccggggcctggccggggccctgaagctggacctgggcctcttcagcaccaagaccctggtggaggccaacaatgagcacatggtggaggtgaggacccagctgctgcagcctgcagatgagaactgggaccccaccggcaccaagaagatctggaggtgtgagagcaacagaagccacaccaccatcgccaagtatgcccagtaccaggccagcagcttccaggagagcctgcgggaggagaatgagaagaggacccagcacaaggaccacagcgacaatgaaagcaccagcagcgagaacagcggcagaagaaggaagggccccttcaagaccatcaagtttggcaccaacatcgacctgagtgacaacaagaagtggaagctgcagctgcacgagctgaccaagctgcctgcctttgcccgggtggtgtctgctggcaacctgctgacccacgtgggccacaccatcctgggcatgaacacagtgcagctgtacatgaaggtgcccggcagcaggaccccaggccaccaggagaacaacaacttctgcagcgtgaacatcaacatcggccctggggactgtgagtggtttgtggtgcctgaggactactggggcgtgctgaatgacttctgtgagaagaacaacctgaacttcctgatgagctcctggtggcccaacctggaggacctgtatgaggccaacgtgcctgtgtaccgcttcatccagaggcctggggacctggtgtggatcaatgccggcaccgtgcactgggtgcaggccgtgggctggtgcaacaacatcgcctggaatgtgggccccctgacagcctgccagtacaagctggccgtggagagatatgagtggaacaagctgaagtctgtgaagagccctgtgcccatggtgcacctgtcctggaacatggccaggaacatcaaggtgtctgaccccaagctgtttgagatgatcaagtactgcctgctgaagatcctgaagcagtaccagaccctgcgggaggccctggtggccgccggcaaggaggtgatctggcacggccgcaccaatgatgagcccgcccactactgcagcatctgtgaggtggaggtgttcaacctgctgtttgtgaccaatgaaagcaacacccagaagacctacatcgtgcactgccacgactgtgccaggaagaccagcaagagcctggagaactttgtggtgctggagcagtacaagatggaggacctgatccaggtgtatgaccagttcaccctggccctgagcctgagcagcagcagctag

SEQ ID NO: 175307 - DNA, 3723 bp, Artificial Sequence
  Description of Artificial Sequence: Synthetic coding sequence
atgaagagctgtgctgtgtccctgaccacagctgctgtggcctttggagatgaggccaagaagatggccgagggcaaggccagccgggagagcgaggaggagagcgtgtccctgactgtggaggagcgggaggccctgggcggcatggacagccggctgtttggatttgtgcggctgcatgaagatggagcccggaccaagaccctgctgggcaaggctgtgcgctgctatgagagcctcatcctgaaggccgagggcaaggtggagagtgacttcttctgccagctgggccacttcaacctgctgctggaggactacagcaaggccctgagcgcctaccagcgctactacagcctgcaggccgactactggaagaatgctgccttcctgtatggcctgggcctggtgtacttctactacaatgccttccactgggccatcaaggccttccaggatgtgctgtatgtggaccccagcttctgccgggccaaggagatccacctgcggctgggcctgatgttcaaggtgaacacagactacaagagcagcctgaagcacttccagctggccctgattgactgcaacccctgcaccctgagcaatgctgagatccagttccacatcgcccacctgtatgagacccagaggaagtaccacagcgccaaggaggcctatgagcagctgctgcagacagagaacctgcctgcccaggtgaaggccaccgtgctgcagcagctgggctggatgcaccacaacatggacctggtgggggacaaggccaccaaggagagctatgccatccagtacctgcagaagagcctggaggccgaccccaacagcggccagagctggtacttcctgggccgctgctacagcagcatcggcaaggtgcaggatgccttcatctcctaccggcagagcattgacaagtctgaggccagcgctgacacctggtgcagcattggagtgctgtaccagcagcagaaccagcccatggatgccctgcaggcctacatctgtgctgtgcagctggaccacggccatgctgctgcctggatggacctgggcaccctgtatgagagctgcaaccagccccaggatgccatcaagtgctacctgaatgctgcccggagcaagcgctgcagcaacaccagcaccctggccgcccgcatcaagttcctgcagaatggaagtgacaactggaatggaggccagagcctgagccaccaccctgtgcagcaggtgtacagcctgtgcctgaccccccagaagctgcagcacctggagcagctgcgggccaacagagacaacctgaacccagcccagaagcaccagctggagcagctggagagccagtttgtgctgatgcagcagatgaggcacaaggaggtggcccaggtgaggaccaccggcatccacaacggggccatcacagacagcagcctgcccaccaacagcgtgagcaaccggcagccccatggagccctgaccagggtgtcctctgtgtcccagcccggggtgcggcctgcctgtgtggagaagctgctgagcagcggggccttctctgctggctgcatcccctgtggcaccagcaagatcctgggcagcacagacaccatcctgctgggcagcaactgcatcgccggcagcgagagcaatggaaatgtgccctacctgcagcagaacacccacaccctgccccacaaccacacagacctgaacagcagcacagaggagccctggaggaagcagctgagcaacagcgcccagggcctgcacaagagccagagcagctgcctgagcggccccaatgaggagcagcccctcttcagcacaggcagcgcccagtaccaccaggccaccagcacaggcatcaagaaggccaatgagcacctgaccctgcccagcaacagcgtgccccagggagatgctgacagccacctgagctgccacacagccaccagcggcggccagcagggcatcatgttcaccaaggagagcaagcccagcaagaacagaagcctggtgcctgagaccagccgccacactggagacaccagcaatggctgtgctgatgtgaagggcctgagcaaccacgtgcaccagctgattgctgatgctgtgagcagccccaaccacggggacagccccaacctgctgattgctgacaacccccagctgagcgccctgctgattggcaaggccaatggaaatgtgggcaccggcacctgtgacaaggtgaacaacatccaccctgctgtgcacaccaagacagaccacagcgtggccagcagccccagcagcgccatcagcacagccacccccagccccaagagcacagagcagaggagcatcaacagcgtgaccagcctgaacagcccccacagcggcctgcacacagtgaatggagagggcctgggcaagagccagagcagcaccaaggtggacctgcccctggccagccacaggagcaccagccagatcctgcccagcatgtctgtgtccatctgccccagcagcacagaggtgctgaaggcctgcaggaaccctgggaagaatggcctgagcaacagctgcatcctgctggacaagtgccccccaccccggccccccaccagcccctacccacccctgcccaaggacaagctgaacccccccacccccagcatctacctggagaacaagagagatgccttcttcccccccctgcaccagttctgcaccaaccccaagaaccctgtgaccgtcatccggggcctggccggggccctgaagctggacctgggcctcttcagcaccaagaccctggtggaggccaacaatgagcacatggtggaggtgaggacccagctgctgcagcctgcagatgagaactgggaccccaccggcaccaagaagatctggaggtgtgagagcaacagaagccacaccaccatcgccaagtatgcccagtaccaggccagcagcttccaggagagcctgcgggaggagaatgagaagaggacccagcacaaggaccacagcgacaatgaaagcaccagcagcgagaacagcggcagaagaaggaagggccccttcaagaccatcaagtttggcaccaacatcgacctgagtgacaacaagaagtggaagctgcagctgcacgagctgaccaagctgcctgcctttgcccgggtggtgtctgctggcaacctgctgacccacgtgggccacaccatcctgggcatgaacacagtgcagctgtacatgaaggtgcccggcagcaggaccccaggccaccaggagaacaacaacttctgcagcgtgaacatcaacatcggccctggggactgtgagtggtttgtggtgcctgaggactactggggcgtgctgaatgacttctgtgagaagaacaacctgaacttcctgatgagctcctggtggcccaacctggaggacctgtatgaggccaacgtgcctgtgtaccgcttcatccagaggcctggggacctggtgtggatcaatgccggcaccgtgcactgggtgcaggccgtgggctggtgcaacaacatcgcctggaatgtgggccccctgacagcctgccagtacaagctggccgtggagagatatgagtggaacaagctgaagtctgtgaagagccctgtgcccatggtgcacctgtcctggaacatggccaggaacatcaaggtgtctgaccccaagctgtttgagatgatcaagtag

SEQ ID NO: 175308 - DNA, 624 bp, Artificial Sequence
  Description of Artificial Sequence: Synthetic coding sequence
atgaagagctgtgctgtgtccctgaccacagctgctgtggcctttggagatgaggccaagaagatggccgagggcaaggccagccgggagagcgaggaggagagcgtgtccctgactgtggaggagcgggaggccctgggcggcatggacagccggctgtttggatttgtgcggctgcatgaagatggagcccggaccaagaccctgctgggcaaggctgtgcgctgctatgagagcctcatcctgaaggccgagggcaaggtggagagtgacttcttctgccagctgggccacttcaacctgctgctggaggactacagcaaggccctgagcgcctaccagcgctactacagcctgcaggccgactactggaagaatgctgccttcctgtatggcctgggcctggtgtacttctactacaatgccttccactgggccatcaaggccttccaggatgtgctgtatgtggaccccagcttctgccgggccaaggagatccacctgcggctgggcctgatgttcaaggtgaacacagactacaagagcagcctgaagcacttccagctggccctgattgactgcaacccctgcaccctgagcaatgctgagagcaagtacttctag

SEQ ID NO: 175309 - DNA, 4179 bp, Artificial Sequence
  Description of Artificial Sequence: Synthetic coding sequence
atgaagagctgtgctgtgtccctgaccacagctgctgtggcctttggagatgaggccaagaagatggccgagggcaaggccagccgggagagcgaggaggagagcgtgtccctgactgtggaggagcgggaggccctgggcggcatggacagccggctgtttggatttgtgcggctgcatgaagatggagcccggaccaagaccctgctgggcaaggctgtgcgctgctatgagagcctcatcctgaaggccgagggcaaggtggagagtgacttcttctgccagctgggccacttcaacctgctgctggaggactacagcaaggccctgagcgcctaccagcgctactacagcctgcaggccgactactggaagaatgctgccttcctgtatggcctgggcctggtgtacttctactacaatgccttccactgggccatcaaggccttccaggatgtgctgtatgtggaccccagcttctgccgggccaaggagatccacctgcggctgggcctgatgttcaaggtgaacacagactacaagagcagcctgaagcacttccagctggccctgattgactgcaacccctgcaccctgagcaatgctgagatccagttccacatcgcccacctgtatgagacccagaggaagtaccacagcgccaaggaggcctatgagcagctgctgcagacagagaacctgcctgcccaggtgaaggccaccgtgctgcagcagctgggctggatgcaccacaacatggacctggtgggggacaaggccaccaaggagagctatgccatccagtacctgcagaagagcctggaggccgaccccaacagcggccagagctggtacttcctgggccgctgctacagcagcatcggcaaggtgcaggatgccttcatctcctaccggcagagcattgacaagtctgaggccagcgctgacacctggtgcagcattggagtgctgtaccagcagcagaaccagcccatggatgccctgcaggcctacatctgtgctgtgcagctggaccacggccatgctgctgcctggatggacctgggcaccctgtatgagagctgcaaccagccccaggatgccatcaagtgctacctgaatgctgcccggagcaagcgctgcagcaacaccagcaccctggccgcccgcatcaagttcctgcaggcccagctgtgcaacctgccccagagcagcctgcagaacaagaccaagctgctgcccagcattgaggaggcctggagcctgcccatcccagctgagctgaccagccggcagggcgccatgaacacagcccagcagaatggaagtgacaactggaatggaggccagagcctgagccaccaccctgtgcagcaggtgtacagcctgtgcctgaccccccagaagctgcagcacctggagcagctgcgggccaacagagacaacctgaacccagcccagaagcaccagctggagcagctggagagccagtttgtgctgatgcagcagatgaggcacaaggaggtggcccaggtgaggaccaccggcatccacaatggagccatcacagacagcagcctgcccaccaacagcgtgagcaaccggcagccccacggggccctgaccagggtgtcctctgtgtcccagcccggggtgcggcctgcctgtgtggagaagctgctgagcagcggggccttctctgctggctgcatcccctgtggcaccagcaagatcctgggcagcacagacaccatcctgctgggcagcaactgcatcgccggcagcgagagcaatggaaatgtgccctacctgcagcagaacacccacaccctgccccacaaccacacagacctgaacagcagcacagaggagccctggaggaagcagctgagcaacagcgcccagggcctgcacaagagccagagcagctgcctgagcggccccaatgaggagcagcccctcttcagcactggaagtgcccagtaccaccaggccaccagcacaggcatcaagaaggccaatgagcacctgaccctgcccagcaacagcgtgccccagggagatgctgacagccacctgagctgccacacagccaccagcggcggccagcagggcatcatgttcaccaaggagagcaagcccagcaagaacagaagcctggtgcctgagaccagccgccacactggagacaccagcaatggctgtgctgatgtgaagggcctgagcaaccacgtgcaccagctgattgctgatgctgtgagcagccccaaccacggggacagccccaacctgctgattgctgacaacccccagctgagcgccctgctgattggcaaggccaatggaaatgtgggcaccggcacctgtgacaaggtgaacaacatccaccctgctgtgcacaccaagacagaccacagcgtggccagcagccccagcagcgccatcagcacagccacccccagccccaagagcacagagcagaggagcatcaacagcgtgaccagcctgaacagcccccacagcggcctgcacacagtgaatggagagggcctgggcaagagccagagcagcaccaaggtggacctgcccctggccagccacaggagcaccagccagatcctgcccagcatgtctgtgtccatctgccccagcagcacagaggtgctgaaggcctgcagaaatcctgggaagaatggcctgagcaacagctgcatcctgctggacaagtgccccccacccaggcctcccaccagcccctacccacccctgcccaaggacaagctgaacccccccacccccagcatctacctggagaacaagagagatgccttcttcccccccctgcaccagttctgcaccaaccccaagaaccctgtgaccgtcatccggggcctggccggggccctgaagctggacctgggcctcttcagcaccaagaccctggtggaggccaacaatgagcacatggtggaggtgaggacccagctgctgcagcctgcagatgagaactgggaccccaccggcaccaagaagatctggaggtgtgagagcaacagaagccacaccaccatcgccaagtatgcccagtaccaggccagcagcttccaggagagcctgcgggaggagaatgagaagaggacccagcacaaggaccacagcgacaatgaaagcaccagcagtgaaaattctggaagaagaaggaagggccccttcaagaccatcaagtttggcaccaacatcgacctgagtgacaacaagaagtggaagctgcagctgcacgagctgaccaagctgcctgcctttgcccgggtggtgtctgctggcaacctgctgacccacgtgggccacaccatcctgggcatgaacacagtgcagctgtacatgaaggtgcccggcagcaggaccccaggccaccaggagaacaacaacttctgcagcgtgaacatcaacatcggccctggggactgtgagtggtttgtggtgcctgaggactactggggcgtgctgaatgacttctgtgagaagaacaacctgaacttcctgatgagctcctggtggcccaacctggaggacctgtatgaggccaacgtgcctgtgtaccgcttcatccagaggcctggggacctggtgtggatcaatgccggcaccgtgcactgggtgcaggccgtgggctggtgcaacaacatcgcctggaatgtgggccccctgacagcctgccagtacaagctggccgtggagagatatgagtggaacaagctgaagtctgtgaagagccctgtgcccatggtgcacctgtcctggaacatggccaggaacatcaaggtgtctgaccccaagctgtttgagatgatcaagtactgcctgctgaagatcctgaagcagtaccagaccctgcgggaggccctggtggccgccggcaaggaggtgatctggcacggccgcaccaatgatgagcccgcccactactgcagcatctgtgaggtggaggtgttcaacctgctgtttgtgaccaatgaaagcaacacccagaagacctacatcgtgcactgccacgactgtgccaggaagaccagcaagagcctggagaactttgtggtgctggagcagtacaagatggaggacctgatccaggtgtatgaccagttcaccctggccctgagcctgagcagcagcagctag

SEQ ID NO: 175310 - DNA, 3636 bp, Artificial Sequence
  Description of Artificial Sequence: Synthetic coding sequence
atgaagagctgtgctgtgtccctgaccacagctgctgtggcctttggagatgaggccaagaagatggccgagggcaaggccagccgggagagcgaggaggagagcgtgtccctgactgtggaggagcgggaggccctgggcggcatggacagccggctgtttggatttgtgcggctgcatgaagatggagcccggaccaagaccctgctgggcaaggctgtgcgctgctatgagagcctcatcctgaaggccgagggcaaggtggagagtgacttcttctgccagctgggccacttcaacctgctgctggaggactacagcaaggccctgagcgcctaccagcgctactacagcctgcaggccgactactggaagaatgctgccttcctgtatggcctgggcctggtgtacttctactacaatgccttccactgggccatcaaggccttccaggatgtgctgtatgtggaccccagcttctgccgggccaaggagatccacctgcggctgggcctgatgttcaaggtgaacacagactacaagagcagcctgaagcacttccagctggccctgattgactgcaacccctgcaccctgagcaatgctgagatccagttccacatcgcccacctgtatgagacccagaggaagtaccacagcgccaaggaggcctatgagcagctgctgcagacagagaacctgcctgcccaggtgaaggccaccgtgctgcagcagctgggctggatgcaccacaacatggacctggtgggggacaaggccaccaaggagagctatgccatccagtacctgcagaagagcctggaggccgaccccaacagcggccagagctggtacttcctgggccgctgctacagcagcatcggcaaggtgcaggatgccttcatctcctaccggcagagcattgacaagtctgaggccagcgctgacacctggtgcagcattggagtgctgtaccagcagcagaaccagcccatggatgccctgcaggcctacatctgtgctgtgcagctggaccacggccatgctgctgcctggatggacctgggcaccctgtatgagagctgcaaccagccccaggatgccatcaagtgctacctgaatgctgcccggagcaagcgctgcagcaacaccagcaccctggccgcccgcatcaagttcctgcaggcccagctgtgcaacctgccccagagcagcctgcagaacaagaccaagctgctgcccagcattgaggaggcctggagcctgcccatcccagctgagctgaccagccggcagggcgccatgaacacagcccagcagaatggaagtgacaactggaatggaggccagagcctgagccaccaccctgtgcagcaggtgtacagcctgtgcctgaccccccagaagctgcagcacctggagcagctgcgggccaacagagacaacctgaacccagcccagaagcaccagctggagcagctggagagccagtttgtgctgatgcagcagatgaggcacaaggaggtggcccagggcctgcacaagagccagagcagctgcctgagcggccccaatgaggagcagcccctcttcagcactggaagtgcccagtaccaccaggccaccagcacaggcatcaagaaggccaatgagcacctgaccctgcccagcaacagcgtgccccagggagatgctgacagccacctgagctgccacacagccaccagcggcggccagcagggcatcatgttcaccaaggagagcaagcccagcaagaacagaagcctggtgcctgagaccagccgccacactggagacaccagcaatggctgtgctgatgtgaagggcctgagcaaccacgtgcaccagctgattgctgatgctgtgagcagccccaaccacggggacagccccaacctgctgattgctgacaacccccagctgagcgccctgctgattggcaaggccaatggaaatgtgggcaccggcacctgtgacaaggtgaacaacatccaccctgctgtgcacaccaagacagaccacagcgtggccagcagccccagcagcgccatcagcacagccacccccagccccaagagcacagagcagaggagcatcaacagcgtgaccagcctgaacagcccccacagcggcctgcacacagtgaatggagagggcctgggcaagagccagagcagcaccaaggtggacctgcccctggccagccacaggagcaccagccagatcctgcccagcatgtctgtgtccatctgccccagcagcacagaggtgctgaaggcctgcagaaatcctgggaagaatggcctgagcaacagctgcatcctgctggacaagtgccccccacccaggcctcccaccagcccctacccacccctgcccaaggacaagctgaacccccccacccccagcatctacctggagaacaagagagatgccttcttcccccccctgcaccagttctgcaccaaccccaagaaccctgtgaccgtcatccggggcctggccggggccctgaagctggacctgggcctcttcagcaccaagaccctggtggaggccaacaatgagcacatggtggaggtgaggacccagctgctgcagcctgcagatgagaactgggaccccaccggcaccaagaagatctggaggtgtgagagcaacagaagccacaccaccatcgccaagtatgcccagtaccaggccagcagcttccaggagagcctgcgggaggagaatgagaagaggacccagcacaaggaccacagcgacaatgaaagcaccagcagtgaaaattctggaagaagaaggaagggccccttcaagaccatcaagtttggcaccaacatcgacctgagtgacaacaagaagtggaagctgcagctgcacgagctgaccaagctgcctgcctttgcccgggtggtgtctgctggcaacctgctgacccacgtgggccacaccatcctgggcatgaacacagtgcagctgtacatgaaggtgcccggcagcaggaccccaggccaccaggagaacaacaacttctgcagcgtgaacatcaacatcggccctggggactgtgagtggtttgtggtgcctgaggactactggggcgtgctgaatgacttctgtgagaagaacaacctgaacttcctgatgagctcctggtggcccaacctggaggacctgtatgaggccaacgtgcctgtgtaccgcttcatccagaggcctggggacctggtgtggatcaatgccggcaccgtgcactgggtgcaggccgtgggctggtgcaacaacatcgcctggaatgtgggccccctgacagcctgccagtacaagctggccgtggagagatatgagtggaacaagctgaagtctgtgaagagccctgtgcccatggtgcacctgtcctggaacatggccaggaacatcaaggtgtctgaccccaagctgtttgagatgatcaagtactgcctgctgaagatcctgaagcagtaccagaccctgcgggaggccctggtggccgccggcaaggaggtgatctggcacggccgcaccaatgatgagcccgcccactactgcagcatctgtgaggccctgagcctgagcagcagcagctag

SEQ ID NO: 175311 - DNA, 3141 bp, Artificial Sequence
  Description of Artificial Sequence: Synthetic coding sequence
atgaagagctgtgctgtgtccctgaccacagctgctgtggcctttggagatgaggccaagaagatggccgagggcaaggccagccgggagagcgaggaggagagcgtgtccctgactgtggaggagcgggaggccctgggcggcatggacagccggctgtttggatttgtgcggctgcatgaagatggagcccggaccaagaccctgctgggcaaggctgtgcgctgctatgagagcctcatcctgaaggccgagggcaaggtggagagtgacttcttctgccagctgggccacttcaacctgctgctggaggactacagcaaggccctgagcgcctaccagcgctactacagcctgcaggccgactactggaagaatgctgccttcctgtatggcctgggcctggtgtacttctactacaatgccttccactgggccatcaaggccttccaggatgtgctgtatgtggaccccagcttctgccgggccaaggagatccacctgcggctgggcctgatgttcaaggtgaacacagactacaagagcagcctgaagcacttccagctggccctgattgactgcaacccctgcaccctgagcaatgctgagatccagttccacatcgcccacctgtatgagacccagaggaagtaccacagcgccaaggaggcctatgagcagctgctgcagacagagaacctgcctgcccaggtgaaggccaccgtgctgcagcagctgggctggatgcaccacaacatggacctggtgggggacaaggccaccaaggagagctatgccatccagtacctgcagaagagcctggaggccgaccccaacagcggccagagctggtacttcctgggctctgtgctgtaccagcagcagaaccagcccatggatgccctgcaggcctacatctgtgctgtgcagctggaccacggccacgccgccgcctggatggacctgggcaccctgtatgagagctgcaaccagccccaggatgccatcaagtgctacctgaatgctgcccggagcaagcgctgcagcaacaccagcaccctggccgcccgcatcaagttcctgcagaatggaagtgacaactggaatggaggccagagcctgagccaccaccctgtgcagcaggtgtacagcctgtgcctgaccccccagaagctgcagcacctggagcagctgcgggccaacagagacaacctgaacccagcccagaagcaccagctggagcagctggagagccagtttgtgctgatgcagcagatgaggcacaaggaggtggcccaggtgaggaccaccggcatccacaatggagccatcacagacagcagcctgcccaccaacagcgtgagcaaccggcagccccacggggccctgaccagggtgtcctctgtgtcccagcccggggtgcggcctgcctgtgtggagaagctgctgagcagcggggccttctctgctggctgcatcccctgtggcaccagcaagatcctgggcagcacagacaccatcctgctgggcagcaactgcatcgccggcagcgagagcaatggaaatgtgccctacctgcagcagaacacccacaccctgccccacaaccacacagacctgaacagcagcacagaggagccctggaggaagcagctgagcaacagcgcccagggcctgcacaagagccagagcagctgcctgagcggccccaatgaggagcagcccctcttcagcactggaagtgcccagtaccaccaggccaccagcacaggcatcaagaaggccaatgagcacctgaccctgcccagcaacagcgtgccccagggagatgctgacagccacctgagctgccacacagccaccagcggcggccagcagggcatcatgttcaccaaggagagcaagcccagcaagaacagaagcctggtgcctgagaccagccgccacactggagacaccagcaatggctgtgctgatgtgaagggcctgagcaaccacgtgcaccagctgattgctgatgctgtgagcagccccaaccacggggacagccccaacctgctgattgctgacaacccccagctgagcgccctgctgattggcaaggccaatggaaatgtgggcaccggcacctgtgacaaggtgaacaacatccaccctgctgtgcacaccaagacagaccacagcgtggccagcagccccagcagcgccatcagcacagccacccccagccccaagagcacagagcagaggagcatcaacagcgtgaccagcctgaacagcccccacagcggcctgcacacagtgaatggagagggcctgggcaagagccagagcagcaccaaggtggacctgcccctggccagccacaggagcaccagccagatcctgcccagcatgtctgtgtccatctgccccagcagcacagaggtgctgaaggcctgcagaaatcctgggaagaatggcctgagcaacagctgcatcctgctggacaagtgccccccacccaggcctcccaccagcccctacccacccctgcccaaggacaagctgaacccccccacccccagcatctacctggagaacaagagagatgccttcttcccccccctgcaccagttctgcaccaaccccaagaaccctgtgaccgtcatccggggcctggccggggccctgaagctggacctgggcctcttcagcaccaagaccctggtggaggccaacaatgagcacatggtggaggtgaggacccagctgctgcagcctgcagatgagaactgggaccccaccggcaccaagaagatctggaggtgtgagagcaacagaagccacaccaccatcgccaagtatgcccagtaccaggccagcagcttccaggagagcctgcgggccggcatgcagtggtgtgacctgagcagcctgcagcccccacctcctggcttcaagcgcttcagccacctgagcctgcccaacagctggaactaccgccacctgcccagctgccccaccaacttctgcatctttgtggagaccggcttccaccacgtgggccaggcctgcctggagctgctgaccagcggcggcctgctggccagcgccagccagagcgctggcatcactggagtgagccaccacgccaggtag

SEQ ID NO: 175312 - DNA, 3018 bp, Artificial Sequence
  Description of Artificial Sequence: Synthetic coding sequence
atgaagagctgtgctgtgtccctgaccacagctgctgtggcctttggagatgaggccaagaagatggccgagggcaaggccagccgggagagcgaggaggagagcgtgtccctgactgtggaggagcgggaggccctgggcggcatggacagccggctgtttggatttgtgcggctgcatgaagatggagcccggaccaagaccctgctgggcaaggctgtgcgctgctatgagagcctcatcctgaaggccgagggcaaggtggagagtgacttcttctgccagctgggccacttcaacctgctgctggaggactacagcaaggccctgagcgcctaccagcgctactacagcctgcaggccgactactggaagaatgctgccttcctgtatggcctgggcctggtgtacttctactacaatgccttccactgggccatcaaggccttccaggatgtgctgtatgtggaccccagcttctgccgggccaaggagatccacctgcggctgggcctgatgttcaaggtgaacacagactacaagagcagcctgaagcacttccagctggccctgattgactgcaacccctgcaccctgagcaatgctgagatccagttccacatcgcccacctgtatgagacccagaggaagtaccacagcgccaaggaggcctatgagcagctgctgcagacagagaacctgcctgcccaggtgaaggccaccgtgctgcagcagctgggctggatgcaccacaacatggacctggtgggggacaaggccaccaaggagagctatgccatccagtacctgcagaagagcctggaggccgaccccaacagcggccagagctggtacttcctgggctctgtgctgtaccagcagcagaaccagcccatggatgccctgcaggcctacatctgtgctgtgcagctggaccacggccacgccgccgcctggatggacctgggcaccctgtatgagagctgcaaccagccccaggatgccatcaagtgctacctgaatgctgcccggagcaagcgctgcagcaacaccagcaccctggccgcccgcatcaagttcctgcagcagagcctgagcctgcacatgatcaccagcagccaggtggagggcctgagcagccctgccaagaagaagaggaccagcagccccaccaagaatggaagtgacaactggaatggaggccagagcctgagccaccaccctgtgcagcaggtgtacagcctgtgcctgaccccccagaagctgcagcacctggagcagctgcgggccaacagagacaacctgaacccagcccagaagcaccagctggagcagctggagagccagtttgtgctgatgcagcagatgaggcacaaggaggtggcccaggtgaggaccaccggcatccacaatggagccatcacagacagcagcctgcccaccaacagcgtgagcaaccggcagccccacggggccctgaccagggtgtcctctgtgtcccagcccggggtgcggcctgcctgtgtggagaagctgctgagcagcggggccttctctgctggctgcatcccctgtggcaccagcaagatcctgggcagcacagacaccatcctgctgggcagcaactgcatcgccggcagcgagagcaatggaaatgtgccctacctgcagcagaacacccacaccctgccccacaaccacacagacctgaacagcagcacagaggagccctggaggaagcagctgagcaacagcgcccagggcctgcacaagagccagagcagctgcctgagcggccccaatgaggagcagcccctcttcagcactggaagtgcccagtaccaccaggccaccagcacaggcatcaagaaggccaatgagcacctgaccctgcccagcaacagcgtgccccagggagatgctgacagccacctgagctgccacacagccaccagcggcggccagcagggcatcatgttcaccaaggagagcaagcccagcaagaacagaagcctggtgcctgagaccagccgccacactggagacaccagcaatggctgtgctgatgtgaagggcctgagcaaccacgtgcaccagctgattgctgatgctgtgagcagccccaaccacggggacagccccaacctgctgattgctgacaacccccagctgagcgccctgctgattggcaaggccaatggaaatgtgggcaccggcacctgtgacaaggtgaacaacatccaccctgctgtgcacaccaagacagaccacagcgtggccagcagccccagcagcgccatcagcacagccacccccagccccaagagcacagagcagaggagcatcaacagcgtgaccagcctgaacagcccccacagcggcctgcacacagtgaatggagagggcctgggcaagagccagagcagcaccaaggtggacctgcccctggccagccacaggagcaccagccagatcctgcccagcatgtctgtgtccatctgccccagcagcacagaggtgctgaaggcctgcagaaatcctgggaagaatggcctgagcaacagctgcatcctgctggacaagtgccccccacccaggcctcccaccagcccctacccacccctgcccaaggacaagctgaacccccccacccccagcatctacctggagaacaagagagatgccttcttcccccccctgcaccagttctgcaccaaccccaagaaccctgtgaccgtcatccggggcctggccggggccctgaagctggacctgggcctcttcagcaccaagaccctggtggaggccaacaatgagcacatggtggaggtgaggacccagctgctgcagcctgcagatgagaactgggaccccaccggcaccaagaagatctggaggtgtgagagcaacagaagccacaccaccatcgccaagtatgcccagtaccaggccagcagcttccaggagagcctgcggagcctcatcctgagccaccctggctggaatgccatggtgtag

SEQ ID NO: 175313 - DNA, 3213 bp, Artificial Sequence
  Description of Artificial Sequence: Synthetic coding sequence
atgaagagctgtgctgtgtccctgaccacagctgctgtggcctttggagatgaggccaagaagatggccgagggcaaggccagccgggagagcgaggaggagagcgtgtccctgactgtggaggagcgggaggccctgggcggcatggacagccggctgtttggatttgtgcggctgcatgaagatggagcccggaccaagaccctgctgggcaaggctgtgcgctgctatgagagcctcatcctgaaggccgagggcaaggtggagagtgacttcttctgccagctgggccacttcaacctgctgctggaggactacagcaaggccctgagcgcctaccagcgctactacagcctgcaggccgactactggaagaatgctgccttcctgtatggcctgggcctggtgtacttctactacaatgccttccactgggccatcaaggccttccaggatgtgctgtatgtggaccccagcttctgccgggccaaggagatccacctgcggctgggcctgatgttcaaggtgaacacagactacaagagcagcctgaagcacttccagctggccctgattgactgcaacccctgcaccctgagcaatgctgagatccagttccacatcgcccacctgtatgagacccagaggaagtaccacagcgccaaggaggcctatgagcagctgctgcagacagagaacctgcctgcccaggtgaaggccaccgtgctgcagcagctgggctggatgcaccacaacatggacctggtgggggacaaggccaccaaggagagctatgccatccagtacctgcagaagagcctggaggccgaccccaacagcggccagagctggtacttcctgggccgctgctacagcagcatcggcaaggtgcaggatgccttcatctcctaccggcagagcattgacaagtctgaggccagcgctgacacctggtgcagcattggagtgctgtaccagcagcagaaccagcccatggatgccctgcaggcctacatctgtgctgtgcagctggaccacggccatgctgctgcctggatggacctgggcaccctgtatgagagctgcaaccagccccaggatgccatcaagtgctacctgaatgctgcccggagcaagcgctgcagcaacaccagcaccctggccgcccgcatcaagttcctgcaggcccagctgtgcaacctgccccagagcagcctgcagaacaagaccaagctgctgcccagcattgaggaggcctggagcctgcccatcccagctgagctgaccagccggcagggcgccatgaacacagcccagcagcagagcctgagcctgcacatgatcaccagcagccaggtggagggcctgagcagccctgccaagaagaagaggaccagcagccccaccaagaatggaagtgacaactggaatggaggccagagcctgagccaccaccctgtgcagcaggtgtacagcctgtgcctgaccccccagaagctgcagcacctggagcagctgcgggccaacagagacaacctgaacccagcccagaagcaccagctggagcagctggagagccagtttgtgctgatgcagcagatgaggcacaaggaggtggcccaggtgaggaccaccggcatccacaatggagccatcacagacagcagcctgcccaccaacagcgtgagcaaccggcagccccacggggccctgaccagggtgtcctctgtgtcccagcccggggtgcggcctgcctgtgtggagaagctgctgagcagcggggccttctctgctggctgcatcccctgtggcaccagcaagatcctgggcagcacagacaccatcctgctgggcagcaactgcatcgccggcagcgagagcaatggaaatgtgccctacctgcagcagaacacccacaccctgccccacaaccacacagacctgaacagcagcacagaggagccctggaggaagcagctgagcaacagcgcccagggcctgcacaagagccagagcagctgcctgagcggccccaatgaggagcagcccctcttcagcactggaagtgcccagtaccaccaggccaccagcacaggcatcaagaaggccaatgagcacctgaccctgcccagcaacagcgtgccccagggagatgctgacagccacctgagctgccacacagccaccagcggcggccagcagggcatcatgttcaccaaggagagcaagcccagcaagaacagaagcctggtgcctgagaccagccgccacactggagacaccagcaatggctgtgctgatgtgaagggcctgagcaaccacgtgcaccagctgattgctgatgctgtgagcagccccaaccacggggacagccccaacctgctgattgctgacaacccccagctgagcgccctgctgattggcaaggccaatggaaatgtgggcaccggcacctgtgacaaggtgaacaacatccaccctgctgtgcacaccaagacagaccacagcgtggccagcagccccagcagcgccatcagcacagccacccccagccccaagagcacagagcagaggagcatcaacagcgtgaccagcctgaacagcccccacagcggcctgcacacagtgaatggagagggcctgggcaagagccagagcagcaccaaggtggacctgcccctggccagccacaggagcaccagccagatcctgcccagcatgtctgtgtccatctgccccagcagcacagaggtgctgaaggcctgcagaaatcctgggaagaatggcctgagcaacagctgcatcctgctggacaagtgccccccacccaggcctcccaccagcccctacccacccctgcccaaggacaagctgaacccccccacccccagcatctacctggagaacaagagagatgccttcttcccccccctgcaccagttctgcaccaaccccaagaaccctgtgaccgtcatccggggcctggccggggccctgaagctggacctgggcctcttcagcaccaagaccctggtggaggccaacaatgagcacatggtggaggtgaggacccagctgctgcagcctgcagatgagaactgggaccccaccggcaccaagaagatctggaggtgtgagagcaacagaagccacaccaccatcgccaagtatgcccagtaccaggccagcagcttccaggagagcctgaggtag

SEQ ID NO: 175314 - DNA, 798 bp, Artificial Sequence
  Description of Artificial Sequence: Synthetic coding sequence
atgcccaacatggtgttcatcggcggcatcaactgcaagaagaggaaggacctgagccaggagtttgaggcctacatcaatgccagcggggagcacggcatcgtggtgttcagcctgggctccatggtgtctgagatccctgagaagaaggccatggccatcgcagatgccctgggcaagatcccccagacagtgctgtggagatacacaggcacccggcccagcaacctggccaacaacaccatcctggtgaagtggctgccccagaatgacctgctgggccaccccatgacccgggccttcatcacccatgctggcagccacggcgtgtatgagagcatctgcaatggagtgcccatggtgatgatgcccctgtttggagaccagatggacaatgccaagaggatggagaccaagggagctggggtgaccctgaatgtgctggagatgaccagcgaggacctggagaatgccctgaaggctgtgatcaatgacaagagctacaaggagaacatcatgaggctgagcagcctgcacaaggacaggcctgtggagcccctggacctggccgtgttctgggtggagtttgtgatgaggcacaagggggccccccacctgcggcctgctgcccatgacctgacctggtaccagtaccacagcctggatgtgattggcttcctgctggccgtggtgctgactgtggccttcatcaccttcaagtgctgtgcctacggctacaggaagtgcctgggcaagaagggccgggtgaagaaggcccacaagagcaagacccactag

SEQ ID NO: 175315 - DNA, 1605 bp, Artificial Sequence
  Description of Artificial Sequence: Synthetic coding sequence
atggccaccggcctgcaggtgcccctgccccagctggccaccggcctgctgctgctgctgtctgtgcagccctgggccgagagcggcaaggtgctggtggtgcccacagatggcagccactggctgtccatgagggaggccctgcgggacctgcacgcccggggccaccaggtggtggtgctgaccctggaggtgaacatgtacatcaaggaggagaacttcttcaccctgaccacctacgccatctcctggacccaggatgaatttgaccggctgctgctgggccacacccagagcttctttgaaacagagcacctgctgatgaagttcagcaggaggatggccatcatgaacaacatgagcctcatcatccacaggagctgtgtggagctgctgcacaatgaggccctgatccgccacctgcacgccaccagctttgatgtggtgctgacagaccccttccacctgtgtgccgctgtgctggccaagtacctgagcatcccagctgtgttcttcctgaggaacatcccctgtgacctggacttcaagggcacccagtgccccaaccccagcagctacatcccccggctgctgaccaccaacagcgaccacatgaccttcctgcagagggtgaagaacatgctgtaccccctggccctgagctacctgtgccacgctgtgtctgccccctatgccagcctggccagcgagctgttccagcgggaggtgtctgtggtggacctggtgtcccatgcctctgtgtggctgttccggggggactttgtgatggactacccccggcccatcatgcccaacatggtgttcatcggcggcatcaactgtgccaacgggaagcccctgagccaggagtttgaggcctacatcaatgccagcggggagcacggcatcgtggtgttcagcctgggctccatggtgtctgagatccctgagaagaaggccatggccatcgcagatgccctgggcaagatcccccagacagtgctgtggagatacacaggcacccggcccagcaacctggccaacaacaccatcctggtgaagtggctgccccagaatgacctgctgggccaccccatgacccgggccttcatcacccacgccggcagccatggagtgtatgagagcatctgcaatggagtgcccatggtgatgatgcccctgtttggagaccagatggacaatgccaagaggatggagaccaagggggccggcgtgaccctgaatgtgctggagatgaccagcgaggacctggagaatgccctgaaggccgtcatcaatgacaagagctacaaggagaacatcatgaggctgagcagcctgcacaaggacaggcctgtggagcccctggacctggccgtgttctgggtggagtttgtgatgaggcacaagggggccccccacctgcggcctgctgcccatgacctgacctggtaccagtaccacagcctggatgtgattggcttcctgctggccgtggtgctgactgtggccttcatcaccttcaagtgctgtgcctacggctacaggaagtgcctgggcaagaagggccgggtgaagaaggcccacaagagcaagacccactag

SEQ ID NO: 175316 - DNA, 1599 bp, Artificial Sequence
  Description of Artificial Sequence: Synthetic coding sequence
atggcctgcctgctgcgctccttccagaggatctctgctggggtcttcttcctggccctgtggggcatggtggtgggggacaagctgctggtggtgccccaggacggcagccactggctgtccatgaaggacatcgtggaggtgctgagtgaccggggccacgagatcgtggtggtggtgcctgaggtgaacctgctgctgaaggagagcaagtactacaccaggaagatctaccctgtgccctatgaccaggaggagctgaagaaccgctaccagagctttggaaacaaccactttgctgagaggagcttcctgacagccccccagacagagtacagaaacaacatgattgtgattggcctgtacttcatcaactgccagagcctgctgcaggaccgggacaccctgaacttcttcaaggagagcaagtttgatgccctcttcacagatcctgccctgccctgtggggtcatcctggccgagtacctgggcctgcccagcgtgtacctgttccggggcttcccctgcagcctggagcacaccttcagccgcagcccagaccctgtgtcctacatcccccgctgctacaccaagttcagtgaccacatgaccttcagccagagggtggccaacttcctggtgaacctgctggagccctacctgttctactgcctcttcagcaaatatgaggagctggccagcgctgtgctgaagagagatgtggacatcatcaccctgtaccagaaggtgtctgtgtggctgctgcgctatgactttgtgctggagtaccccaggcctgtgatgcccaacatggtgttcatcggcggcatcaactgcaagaagaggaaggacctgagccaggagtttgaggcctacatcaatgccagcggggagcacggcatcgtggtgttcagcctgggctccatggtgtctgagatccctgagaagaaggccatggccatcgcagatgccctgggcaagatcccccagacagtgctgtggagatacacaggcacccggcccagcaacctggccaacaacaccatcctggtgaagtggctgccccagaatgacctgctgggccaccccatgacccgggccttcatcacccacgccggcagccatggagtgtatgagagcatctgcaatggagtgcccatggtgatgatgcccctgtttggagaccagatggacaatgccaagaggatggagaccaagggggccggcgtgaccctgaatgtgctggagatgaccagcgaggacctggagaatgccctgaaggccgtcatcaatgacaagagctacaaggagaacatcatgaggctgagcagcctgcacaaggacaggcctgtggagcccctggacctggccgtgttctgggtggagtttgtgatgaggcacaagggggccccccacctgcggcctgctgcccatgacctgacctggtaccagtaccacagcctggatgtgattggcttcctgctggccgtggtgctgactgtggccttcatcaccttcaagtgctgtgcctacggctacaggaagtgcctgggcaagaagggccgggtgaagaaggcccacaagagcaagacccactag

SEQ ID NO: 175317 - DNA, 570 bp, Artificial Sequence
  Description of Artificial Sequence: Synthetic coding sequence
atggcctgcctgctgcgctccttccagaggatctctgctggggtcttcttcctggccctgtggggcatggtggtgggggacaagctgctggtggtgccccaggacggcagccactggctgtccatgaaggacatcgtggaggtgctgagtgaccggggccacgagatcgtggtggtggtgcctgaggtgaacctgctgctgaaggagagcaagtactacaccaggaagatctaccctgtgccctatgaccaggaggagctgaagaaccgctaccagagctttggaaacaaccactttgctgagaggagcttcctgacagccccccagacagagtacagaaacaacatgattgtgattggcctgtacttcatcaactgccagagcctgctgcaggaccgggacaccctgaacttcttcaaggagagcaagtttgatgccctcttcacagatcctgccctgccctgtggggtcatcctggccgagtacctgggcctgcccagcgtgtacctgttccggggcttcccctgcagcctggagcacaccttcagccgcagcccagaccctgtgtag

SEQ ID NO: 175318 - DNA, 1593 bp, Artificial Sequence
  Description of Artificial Sequence: Synthetic coding sequence
atggcccgggccggctggacaggcctgctgcccctgtatgtgtgcctgctgctgacctgtggctttgccaaggccggcaagctgctggtggtgcccatggatggcagccactggttcaccatgcagagcgtggtggagaagctgatcctgcggggccacgaggtggtggtggtgatgcctgaggtgtcctggcagctgggccgcagcctgaactgcaccgtgaagacctacagcaccagctacaccctggaggaccaggaccgggagttcatggtgtttgctgatgcccgctggacagcccccctgcggagcgccttcagcctgctgaccagcagcagcaatggcatctttgacctcttcttcagcaactgccgcagcctcttcaatgacaggaagctggtggagtacctgaaggagagctgctttgatgctgtgttcctggacccctttgatgcctgtggcctcatcgtggccaagtacttcagcctgcccagcgtggtgtttgcccggggcatcttctgccactacctggaggagggcgcccagtgcccagcccccctgtcctatgtgccccggctgctgctgggcttcagtgatgccatgaccttcaaggagcgggtgtggaaccacatcatgcacctggaggagcacctgttctgcccctacttcttcaagaatgtgctggagatcgccagcgagatcctgcagacccctgtgacagcctatgacctgtacagccacaccagcatctggctgctgaggacagactttgtgctggagtaccccaagcctgtgatgcccaacatgatcttcatcggcggcatcaactgccaccagggcaagcctgtgcccatggagtttgaggcctacatcaatgccagcggggagcacggcatcgtggtgttcagcctgggctccatggtgtctgagatccctgagaagaaggccatggccatcgcagatgccctgggcaagatcccccagacagtgctgtggagatacacaggcacccggcccagcaacctggccaacaacaccatcctggtgaagtggctgccccagaatgacctgctgggccaccccatgacccgggccttcatcacccacgccggcagccatggagtgtatgagagcatctgcaatggagtgcccatggtgatgatgcccctgtttggagaccagatggacaatgccaagaggatggagaccaagggggccggcgtgaccctgaatgtgctggagatgaccagcgaggacctggagaatgccctgaaggccgtcatcaatgacaagagctacaaggagaacatcatgaggctgagcagcctgcacaaggacaggcctgtggagcccctggacctggccgtgttctgggtggagtttgtgatgaggcacaagggggccccccacctgcggcctgctgcccatgacctgacctggtaccagtaccacagcctggatgtgattggcttcctgctggccgtggtgctgactgtggccttcatcaccttcaagtgctgtgcctacggctacaggaagtgcctgggcaagaagggccgggtgaagaaggcccacaagagcaagacccactag

SEQ ID NO: 175319 - DNA, 1593 bp, Artificial Sequence
  Description of Artificial Sequence: Synthetic coding sequence
atggccaggacaggctggaccagccccatccccctgtgtgtgtccctgctgctgacctgtggctttgctgaggccggcaagctgctggtggtgcccatggatggcagccactggttcaccatgcagagcgtggtggagaagctgatcctgcggggccacgaggtggtggtggtgatgcctgaggtgtcctggcagctgggcaagagcctgaactgcaccgtgaagacctacagcaccagctacaccctggaggacctggaccgggagttcatggactttgctgatgcccagtggaaggcccaggtgcgcagcctcttcagcctcttcctgagcagcagcaatggcttcttcaacctcttcttcagccactgccgcagcctcttcaatgacaggaagctggtggagtacctgaaggagagcagctttgatgctgtgttcctggacccctttgatgcctgtggcctcatcgtggccaagtacttcagcctgcccagcgtggtgtttgcccggggcatcgcctgccactacctggaggagggcgcccagtgcccagcccccctgtcctatgtgccccgcatcctgctgggcttcagtgatgccatgaccttcaaggagcgggtgaggaaccacatcatgcacctggaggagcacctgttctgccagtacttcagcaagaatgccctggagatcgccagcgagatcctgcagacccctgtgacagcctatgacctgtacagccacaccagcatctggctgctgaggacagactttgtgctggactaccccaagcctgtgatgcccaacatgatcttcatcggcggcatcaactgccaccagggcaagcccctgcccatggagtttgaggcctacatcaatgccagcggggagcacggcatcgtggtgttcagcctgggctccatggtgtctgagatccctgagaagaaggccatggccatcgcagatgccctgggcaagatcccccagacagtgctgtggagatacacaggcacccggcccagcaacctggccaacaacaccatcctggtgaagtggctgccccagaatgacctgctgggccaccccatgacccgggccttcatcacccacgccggcagccatggagtgtatgagagcatctgcaatggagtgcccatggtgatgatgcccctgtttggagaccagatggacaatgccaagaggatggagaccaagggggccggcgtgaccctgaatgtgctggagatgaccagcgaggacctggagaatgccctgaaggccgtcatcaatgacaagagctacaaggagaacatcatgaggctgagcagcctgcacaaggacaggcctgtggagcccctggacctggccgtgttctgggtggagtttgtgatgaggcacaagggggccccccacctgcggcctgctgcccatgacctgacctggtaccagtaccacagcctggatgtgattggcttcctgctggccgtggtgctgactgtggccttcatcaccttcaagtgctgtgcctacggctacaggaagtgcctgggcaagaagggccgggtgaagaaggcccacaagagcaagacccactag

SEQ ID NO: 175320 - DNA, 1593 bp, Artificial Sequence
  Description of Artificial Sequence: Synthetic coding sequence
atggcctgcaccggctggaccagccccctgcccctgtgtgtgtgcctgctgctgacctgtggctttgctgaggccggcaagctgctggtggtgcccatggatggcagccactggttcaccatgaggtctgtggtggagaagctgatcctgcggggccacgaggtggtggtggtgatgcctgaggtgtcctggcagctgggccgcagcctgaactgcaccgtgaagacctacagcaccagctacaccctggaggacctggaccgggagttcaaggcctttgcccacgcccagtggaaggcccaggtgcgcagcatctacagcctgctgatgggcagctacaatgacatctttgacctcttcttcagcaactgccgcagcctcttcaaggacaagaagctggtggagtacctgaaggagagcagctttgatgctgtgttcctggacccctttgacaactgtggcctcatcgtggccaagtacttcagcctgcccagcgtggtgtttgcccggggcatcctgtgccactacctggaggagggcgcccagtgcccagcccccctgtcctatgtgccccgcatcctgctgggcttcagtgatgccatgaccttcaaggagcgggtgaggaaccacatcatgcacctggaggagcacctgctgtgccaccgcttcttcaagaatgccctggagatcgccagcgagatcctgcagacccctgtgacagaatatgacctgtacagccacaccagcatctggctgctgaggacagactttgtgctggactaccccaagcctgtgatgcccaacatgatcttcatcggcggcatcaactgccaccagggcaagcccctgcccatggagtttgaggcctacatcaatgccagcggggagcacggcatcgtggtgttcagcctgggctccatggtgtctgagatccctgagaagaaggccatggccatcgcagatgccctgggcaagatcccccagacagtgctgtggagatacacaggcacccggcccagcaacctggccaacaacaccatcctggtgaagtggctgccccagaatgacctgctgggccaccccatgacccgggccttcatcacccacgccggcagccatggagtgtatgagagcatctgcaatggagtgcccatggtgatgatgcccctgtttggagaccagatggacaatgccaagaggatggagaccaagggggccggcgtgaccctgaatgtgctggagatgaccagcgaggacctggagaatgccctgaaggccgtcatcaatgacaagagctacaaggagaacatcatgaggctgagcagcctgcacaaggacaggcctgtggagcccctggacctggccgtgttctgggtggagtttgtgatgaggcacaagggggccccccacctgcggcctgctgcccatgacctgacctggtaccagtaccacagcctggatgtgattggcttcctgctggccgtggtgctgactgtggccttcatcaccttcaagtgctgtgcctacggctacaggaagtgcctgggcaagaagggccgggtgaagaaggcccacaagagcaagacccactag

SEQ ID NO: 175321 - DNA, 1584 bp, Artificial Sequence
  Description of Artificial Sequence: Synthetic coding sequence
atgctgaacaacctgctgctcttcagcctgcagatcagcctgattggcaccaccctgggcggcaatgtgctgatctggcccatggagggcagccactggctgaatgtgaagatcatcattgatgagctgatcaagaaggagcacaacgtgacagtgctggtggccagcggggccctcttcatcacccccaccagcaaccccagcctgacctttgagatctacagagtgccctttgggaaggagagaattgaaggagtcatcaaggactttgtgctgacctggctggagaaccggcccagccccagcaccatctggaggttctaccaggagatggccaaggtgatcaaggacttccacatggtgtcccaggagatctgtgatggagtgctgaagaaccagcagctgatggccaagctgaagaagagcaagtttgaggtgctggtgtctgaccctgtgttcccctgtggggacatcgtggccctgaagctgggcatccccttcatgtacagcctgcgcttctccccagccagcacagtggagaagcactgcggcaaggtgccctacccacccagctatgtgcctgctgtgctgtctgagctgacagaccagatgtccttcacagaccgcatccggaacttcatctcctaccacctgcaggactacatgtttgagaccctgtggaagtcctgggacagctactacagcaaggccctgggcggcctgctgctgtgctgccccggctggagcgctgtggccgacctgggcagcctgcagcccctgctgcccggcttcaagcgcttcagccggctgagcctgcactgctcctgggactaccgcctgcctgctggccggcccaccaccctgtgtgagaccatgggcaaggccgagatctggctgatccgcacctactgggactttgagttcccccggccctacctgcccaactttgaatttgtgggcggcctgcactgcaagccagccaagcccctgcccaaggtgctgtggagatacaagggcaagaagccagccaccctgggcaacaacacccagctgtttgactggatcccccagaatgacctgctgggccaccccaagaccaaggccttcatcacccacggcggcaccaacggcatctatgaggccatctaccacggcgtgcccatggtgggcgtgcccatgtttgctgaccagcctgacaacatcgcccacatgaaggccaagggagctgctgtggaggtgaacctgaacaccatgacctctgtggacctgctgagcgccctgaggacagtcatcaatgagcccagctacaaggaaaatgccatgaggctgagccgcatccaccacgaccagcctgtgaagcccctggacagagctgtgttctggattgaatttgtgatgaggcacaagggggccaagcacctgcgggtggccgcccatgacctgacctggttccagtaccacagcctggatgtgattggcttcctgctggtgtgtgtgaccacagccatcttcctggtgatccagtgctgcctcttcagctgccagaagtttgggaagattggcaagaagaagaagcgggagtag

SEQ ID NO: 175322 - DNA, 2082 bp, Artificial Sequence
  Description of Artificial Sequence: Synthetic coding sequence
atgctgaacaacctgctgctcttcagcctgcagatcagcctgattggcaccaccctgggcggcaatgtgctgatctggcccatggagggcagccactggctgaatgtgaagatcatcattgatgagctgatcaagaaggagcacaacgtgacagtgctggtggccagcggggccctcttcatcacccccaccagcaaccccagcctgacctttgagatctacagagtgccctttgggaaggagagaattgaaggagtcatcaaggactttgtgctgacctggctggagaaccggcccagccccagcaccatctggaggttctaccaggagatggccaaggtgatcaaggacttccacatggtgtcccaggagatctgtgatggagtgctgaagaaccagcagctgatggccaagctgaagaagagcaagtttgaggtgctggtgtctgaccctgtgttcccctgtggggacatcgtggccctgaagctgggcatccccttcatgtacagcctgcgcttctccccagccagcacagtggagaagcactgcggcaaggtgccctacccacccagctatgtgcctgctgtgctgtctgagctgacagaccagatgtccttcacagaccgcatccggaacttcatctcctaccacctgcaggactacatgtttgagaccctgtggaagtcctgggacagctactacagcaaggccctggatggcagccactggctgaacatcaagatcatcctggaggagctgatccagaggaaccacaacgtgacagtgctggccagcagcgccaccctcttcatcaacagcaacccagacagccctgtgaactttgaagtcatccctgtgtcctacaagaagagcaacatcgacagcctgattgagcacatgatcatgctgtggattgaccaccggcccacccccctgaccatctgggccttctacaaggagctgggcaagctgctggacaccttcttccagatcaacatccagctgtgtgatggagtgctgaagaaccccaagctgatggcccggctgcagaagggcggctttgatgtgctggtggccgaccctgtgaccatctgtggggacctggtggccctgaagctgggcatccccttcatgtacaccctgcgcttctccccagccagcacagtggagcggcactgcggcaagatcccagcccctgtgtcctatgtgcctgctgccctgtctgagctgacagaccagatgaccttcggggagcgcatcaagaacaccatctcctacagcctgcaggactacatcttccagagctactggggcgagtggaacagctactacagcaagatcctgggccggcccaccaccctgtgtgagaccatgggcaaggccgagatctggctgatccgcacctactgggactttgagttcccccggccctacctgcccaactttgaatttgtgggcggcctgcactgcaagccagccaagcccctgcccaaggtgctgtggagatacaagggcaagaagccagccaccctgggcaacaacacccagctgtttgactggatcccccagaatgacctgctgggccaccccaagaccaaggccttcatcacccacggcggcaccaacggcatctatgaggccatctaccacggcgtgcccatggtgggcgtgcccatgtttgctgaccagcctgacaacatcgcccacatgaaggccaagggagctgctgtggaggtgaacctgaacaccatgacctctgtggacctgctgagcgccctgaggacagtcatcaatgagcccagctacaaggaaaatgccatgaggctgagccgcatccaccacgaccagcctgtgaagcccctggacagagctgtgttctggattgaatttgtgatgaggcacaagggggccaagcacctgcgggtggccgcccatgacctgacctggttccagtaccacagcctggatgtgattggcttcctgctggtgtgtgtgaccacagccatcttcctggtgatccagtgctgcctcttcagctgccagaagtttgggaagattggcaagaagaagaagcgggagtag

SEQ ID NO: 175323 - DNA, 1611 bp, Artificial Sequence
  Description of Artificial Sequence: Synthetic coding sequence
atggtgtccatccgggacttcaccatgcccaagaagtttgtgcagatgctggtgttcaacctgaccctgacagaggtggtgctgtctggaaatgtgctgatctggcccacagatggcagccactggctgaacatcaagatcatcctggaggagctgatccagaggaaccacaacgtgacagtgctggccagcagcgccaccctcttcatcaacagcaacccagacagccctgtgaactttgaggtgattcctgtgtcctacaagaagagcaacatcgacagcctcatcgagcacatgatcatgctgtggattgaccaccggcccacccccctgaccatctgggccttctacaaggagctgggcaagctgctggacaccttcttccagatcaacatccagctgtgtgatggagtgctgaagaaccccaagctgatggcccggctgcagaagggcggctttgatgtgctggtggccgaccctgtgaccatctgtggggacctggtggccctgaagctgggcatccccttcatgtacaccctgcgcttcagccctgccagcacagtggagcggcactgtgggaagatcccagcccctgtgtcctatgtgcctgctgccctgtctgagctgacagaccagatgacctttggagagcgcatcaagaacaccatctcctacagcctgcaggactacatcttccagagctactggggcgagtggaacagctactacagcaagatcctgggccggcccaccaccctgtgtgagaccatgggcaaggccgagatctggctgatccgcacctactgggactttgagttcccccggccctacctgcccaactttgaatttgtgggcggcctgcactgcaagccagccaagcccctgcccaaggagatggaggagttcatccagagcagcggcaagaatggagtggtggtgttcagcctgggctccatggtgaagaacctgacagaggagaaggccaacctgattgccagcgccctggcccagatcccccagaaggtgctgtggagatacaagggcaagaagccagccaccctgggcaacaacacccagctgtttgactggatcccccagaatgacctgctgggccaccccaagaccaaggccttcatcacccatggaggcaccaacggcatctatgaggccatctaccatggagtgcccatggtgggcgtgcccatgtttgctgaccagcctgacaacatcgcccacatgaaggccaagggagctgctgtggaggtgaacctgaacaccatgacctctgtggacctgctgagcgccctgaggacagtcatcaatgagcccagctacaaggaaaatgccatgaggctgagccgcatccaccacgaccagcctgtgaagcccctggacagagctgtgttctggattgaatttgtgatgaggcacaagggggccaagcacctgcgggtggccgcccatgacctgacctggttccagtaccacagcctggatgtgattggcttcctgctggtgtgtgtgaccacagccatcttcctggtgatccagtgctgcctcttcagctgccagaagtttgggaagattggcaagaagaagaagcgggagtag

SEQ ID NO: 175324 - DNA, 1584 bp, Artificial Sequence
  Description of Artificial Sequence: Synthetic coding sequence
atgctgaacaacctgctgctcttcagcctgcagatcagcctgattggcaccaccctgggcggcaatgtgctgatctggcccatggagggcagccactggctgaatgtgaagatcatcattgatgagctgatcaagaaggagcacaacgtgacagtgctggtggccagcggggccctcttcatcacccccaccagcaaccccagcctgacctttgagatctacagagtgccctttgggaaggagagaattgaaggagtcatcaaggactttgtgctgacctggctggagaaccggcccagccccagcaccatctggaggttctaccaggagatggccaaggtgatcaaggacttccacatggtgtcccaggagatctgtgatggagtgctgaagaaccagcagctgatggccaagctgaagaagagcaagtttgaggtgctggtgtctgaccctgtgttcccctgtggggacatcgtggccctgaagctgggcatccccttcatgtacagcctgcgcttctccccagccagcacagtggagaagcactgcggcaaggtgccctacccacccagctatgtgcctgctgtgctgtctgagctgacagaccagatgtccttcacagaccgcatccggaacttcatctcctaccacctgcaggactacatgtttgagaccctgtggaagtcctgggacagctactacagcaaggccctgggccggcccaccaccctgtgtgagaccatgggcaaggccgagatctggctgatccgcacctactgggactttgagttcccccggccctacctgcccaactttgaatttgtgggcggcctgcactgcaagccagccaagcccctgcccaaggagatggaggagttcatccagagcagcggcaagaatggagtggtggtgttcagcctgggctccatggtgaagaacctgacagaggagaaggccaacctgattgccagcgccctggcccagatcccccagaaggtgctgtggagatacaagggcaagaagccagccaccctgggcaacaacacccagctgtttgactggatcccccagaatgacctgctgggccaccccaagaccaaggccttcatcacccacggcggcaccaacggcatctatgaggccatctaccacggcgtgcccatggtgggcgtgcccatgtttgctgaccagcctgacaacatcgcccacatgaaggccaagggagctgctgtggaggtgaacctgaacaccatgacctctgtggacctgctgagcgccctgaggacagtcatcaatgagcccagctacaaggaaaatgccatgaggctgagccgcatccaccacgaccagcctgtgaagcccctggacagagctgtgttctggattgaatttgtgatgaggcacaagggggccaagcacctgcgggtggccgcccatgacctgacctggttccagtaccacagcctggatgtgattggcttcctgctggtgtgtgtgaccacagccatcttcctggtgatccagtgctgcctcttcagctgccagaagtttgggaagattggcaagaagaagaagcgggagtag

SEQ ID NO: 175325 - DNA, 477 bp, Artificial Sequence
  Description of Artificial Sequence: Synthetic coding sequence
atgctgaacaacctgctgctcttcagcctgcagatcagcctgattggcaccaccctgggcggcaatgtgctgatctggcccatggagggcagccactggctgaatgtgaagatcatcattgatgagctgatcaagaaggagcacaacgtgacagtgctggtggccagcggggccctcttcatcacccccaccagcaaccccagcctgacctttgagatctacagagtgccctttgggaaggagagaattgaaggagtcatcaaggactttgtgctgacctggctggagaaccggcccagccccagcaccatctggaggttctaccaggagatggccaaggtgatcaaggacttccacatggtgtcccaggagatctgtgatggagtgctgaagaaccagcagctgatggccaagctgaagaagagcaagtttgaggtgctggtgtctgaccctgtgttcccctgtggggacatctag

SEQ ID NO: 175326 - DNA, 1590 bp, Artificial Sequence
  Description of Artificial Sequence: Synthetic coding sequence
atgaccctgaagtggacctctgtgctgctgctgatccacctgagctgctacttcagcagcggcagctgtgggaaggtgctggtgtgggccgctgagtacagccactggatgaacatgaagaccatcctgaaggagctggtgcagaggggccacgaggtgacagtgctggccagcagcgccagcatcctgtttgaccccaatgatgccagcaccctgaagtttgaggtgtaccccaccagcctgaccaagacagaatttgagaacatcatcatgcagcaggtgaagcgctggagcgacatcaggaaggacagcttctggctgtacttcagccaggagcaggagatcctgtgggagctgtatgacatcttcaggaacttctgcaaggatgtggtgagcaacaagaaggtgatgaagaagctgcaggagagcagatttgatattgtgtttgctgatgctgtgttcccctgtggggagctgctggccgccctgctgaacatccgctttgtgtacagcctgcgcttcaccccaggctacaccatcgagcggcacagcggcggcctcatcttcccccccagctacatccccatcgtgatgagcaagctgagtgaccagatgaccttcatggagcgggtgaagaacatgatctacgtgctgtactttgacttctggttccagatgtctgacatgaagaagtgggaccagttctacagcgaggtgctgggccggcccaccaccctgtttgagaccatgggcaaggctgacatctggctgatgagaaattcctggagcttccagttcccccaccccttcctgcccaacgtggactttgtgggcggcttccactgcaagccagccaagcccctgcccaaggagatggaggagtttgtgcagagcagtggagaaaatggagtggtggtgttcagcctgggcagcgtcatcagcaacatgacagctgagcgggccaacgtcatcgccacagccctggccaagatcccccagaaggtgctgtggaggtttgatggcaacaagccagatgccctgggcctgaacacccggctgtacaagtggatcccccagaatgacctgctgggccaccccaagacccgggccttcatcacccacggcggggccaacggcatctatgaggccatctaccacggcatccccatggtgggcatccccctcttctttgaccagcctgacaacatcgcccacatgaaggccaagggagctgctgtgcggctggacttcaacaccatgagcagcacagacctgctgaatgccctgaagacagtcatcaatgaccccctgtacaaggagaacatcatgaagctgagccgcatccagcacgaccagcctgtgaagcccctggacagagctgtgttctggattgaatttgtgatgccccacaagggggccaagcacctgcgggtggccgcccatgacctgacctggttccagtaccacagcctggatgtgattggcttcctgctggcctgtgtggccaccgtcatcttcatcatcaccaagttctgcctcttctgcttctggaagtttgccaggaagggcaagaagggcaagagggactag

SEQ ID NO: 175327 - DNA, 1593 bp, Artificial Sequence
  Description of Artificial Sequence: Synthetic coding sequence
atgagcctgaagtggacctctgtgttcctgctgatccagctgagctgctacttcagcagcggcagctgtgggaaggtgctggtgtggcccacagagtacagccactggatcaacatgaagaccatcctggaggagctggtgcagaggggccacgaggtgacagtgctgaccagcagcgccagcaccctggtgaatgccagcaagagcagcgccatcaagctggaggtgtaccccaccagcctgaccaagaactacctggaggacagcctgctgaagatcctggaccgctggatctatggagtgtccaagaacaccttctggagctacttcagccagctgcaggagctgtgctgggagtactatgactacagcaacaagctgtgcaaggatgctgtgctgaacaagaagctgatgatgaagctgcaggagagcaagtttgatgtgatcctggctgatgccctgaacccctgtggggagctgctggccgagctgttcaacatccccttcctgtacagcctgcgcttctctgtgggctacacctttgagaagaatggaggcggcttcctgtttcctccttcctatgtgcctgtggtgatgtctgagctgagtgaccagatgatcttcatggagcgcatcaagaacatgatccacatgctgtactttgacttctggttccagatctatgacctgaagaagtgggaccagttctacagcgaggtgctgggccggcccaccaccctgtttgagaccatgggcaaggccgagatgtggctgatccgcacctactgggactttgagttcccccggcccttcctgcccaacgtggactttgtgggcggcctgcactgcaagccagccaagcccctgcccaaggagatggaggagtttgtgcagagcagcggggagaatggaattgtggtgttcagcctgggctccatgatcagcaacatgtctgaggagagcgccaacatgattgccagcgccctggcccagatcccccagaaggtgctgtggaggtttgatggcaagaagcccaacaccctgggcagcaacacccggctgtacaagtggctgccccagaatgacctgctgggccaccccaagaccaaggccttcatcacccatggaggcaccaacggcatctatgaggccatctaccacggcatccccatggtgggcatccccctgtttgctgaccagcacgacaacatcgcccacatgaaggccaagggggccgccctgtctgtggacatccgcaccatgagcagccgggacctgctgaatgccctgaagagcgtcatcaatgaccctgtgtacaaggaaaatgtgatgaagctgagccgcatccaccacgaccagcccatgaagcccctggacagagctgtgttctggattgaatttgtgatgaggcacaagggggccaagcacctgcgggtggccgcccacaacctgacctggatccagtaccacagcctggatgtgattgccttcctgctggcctgtgtggccaccgtcatcttcatcatcaccaagttctgcctcttctgcttcaggaagctggccaagaagggcaagaagaagaagagggactag

SEQ ID NO: 175328 - DNA, 1593 bp, Artificial Sequence
  Description of Artificial Sequence: Synthetic coding sequence
atgagcctgaagtggatgtctgtgttcctgctgatgcagctgagctgctacttcagcagcggcagctgtgggaaggtgctggtgtggcccacagagtacagccactggatcaacatgaagaccatcctggaggagctggtgcagaggggccatgaagtcatcgtgctgaccagcagcgccagcatcctggtgaatgccagcaagagcagcgccatcaagctggaggtgtaccccaccagcctgaccaagaatgacctggaggacttcttcatgaagatgtttgaccgctggacctacagcatcagcaagaacaccttctggagctacttcagccagctgcaggagctgtgctgggagtacagcgactacaacatcaagctgtgtgaagatgctgtgctgaacaagaagctgatgaggaagctgcaggagagcaagtttgatgtgctgctggctgatgctgtgaacccctgtggggagctgctggccgagctgctgaacatccccttcctgtacagcctgcgcttctctgtgggctacacagtggagaagaatggaggcggcttcctgtttcctccttcctatgtgcctgtggtgatgtctgagctgagtgaccagatgatcttcatggagcgcatcaagaacatgatctacatgctgtactttgacttctggttccaggcctatgacctgaagaagtgggaccagttctacagcgaggtgctgggccggcccaccaccctgtttgagaccatgggcaaggccgagatgtggctgatccgcacctactgggactttgagttcccccggcccttcctgcccaacgtggactttgtgggcggcctgcactgcaagccagccaagcccctgcccaaggagatggaggagtttgtgcagagcagcggggagaatggaattgtggtgttcagcctgggctccatgatcagcaacatgtctgaggagagcgccaacatgattgccagcgccctggcccagatcccccagaaggtgctgtggaggtttgatggcaagaagcccaacaccctgggcagcaacacccggctgtacaagtggctgccccagaatgacctgctgggccaccccaagaccaaggccttcatcacccatggaggcaccaacggcatctatgaggccatctaccacggcatccccatggtgggcatccccctgtttgctgaccagcacgacaacatcgcccacatgaaggccaagggggccgccctgtctgtggacatccgcaccatgagcagccgggacctgctgaatgccctgaagagcgtcatcaatgaccccatctacaaggagaacatcatgaagctgagccgcatccaccacgaccagcctgtgaagcccctggacagagctgtgttctggattgaatttgtgatgaggcacaagggggccaagcacctgcgggtggccgcccacaacctgacctggatccagtaccacagcctggatgtgattgccttcctgctggcctgtgtggccaccatgatcttcatgatcaccaagtgctgcctcttctgcttcaggaagctggccaagacaggcaagaagaagaagagggactag

SEQ ID NO: 175329 - DNA, 1590 bp, Artificial Sequence
  Description of Artificial Sequence: Synthetic coding sequence
atggccctgaagtggacctctgtgctgctgctgatccacctgggctgctacttcagcagcggcagctgtgggaaggtgctggtgtggacaggagagtacagccactggatgaacatgaagaccatcctgaaggagctggtgcagaggggccacgaggtgacagtgctggccagcagcgccagcatcctgtttgaccccaatgatgccttcaccctgaagctggaggtgtaccccaccagcctgaccaagacagaatttgagaacatcatcatgcagcaggtgaagcgctggagcgacatccagaaggacagcttctggctgtacttcagccaggagcaggagatcctgtgggagttccatgacatcttcaggaacttctgcaaggatgtggtgagcaacaagaaggtgatgaagaagctgcaggagagcagatttgacatcatctttgctgatgccttcttcccctgtggggagctgctggccgccctgctgaacatcccctttgtgtacagcctgtgcttcaccccaggctacaccatcgagcggcacagcggcggcctcatcttcccccccagctacatccctgtggtgatgagcaagctgagtgaccagatgaccttcatggagcgggtgaagaacatgatctacgtgctgtactttgacttctggttccagatgtgtgacatgaagaagtgggaccagttctacagcgaggtgctgggccggcccaccaccctgtttgagaccatgggcaaggctgacatctggctgatgagaaattcctggagcttccagttcccccaccccttcctgcccaacatcgactttgtgggcggcctgcactgcaagccagccaagcccctgcccaaggagatggaggagtttgtgcagagcagtggagaaaatggagtggtggtgttcagcctgggcagcgtcatcagcaacatgacagctgagcgggccaacgtcatcgccacagccctggccaagatcccccagaaggtgctgtggaggtttgatggcaacaagccagatgccctgggcctgaacacccggctgtacaagtggatcccccagaatgacctgctgggcctgcccaagacccgggccttcatcacccacggcggggccaacggcatctatgaggccatctaccacggcatccccatggtgggcatccccctcttctgggaccagcctgacaacatcgcccacatgaaggccaagggagctgctgtgcggctggacttccacaccatgagcagcacagacctgctgaatgccctgaagacagtcatcaatgaccccagctacaaggaaaatgtgatgaagctgagcatcatccagcacgaccagcctgtgaagcccctgcacagagctgtgttctggattgaatttgtgatgtgccacaagggggccaagcacctgcgggtggccgcccgggacctgacctggttccagtaccacagcctggatgtgattggcttcctgctggcctgtgtggccaccgtcatctttgtggtgaccaagttctgcctcttctgcttctggaagtttgccaggaagggcaagaagggcaagagggactag

SEQ ID NO: 175330 - DNA, 1008 bp, Artificial Sequence
  Description of Artificial Sequence: Synthetic coding sequence
atggccctgaagtggacctctgtgctgctgctgatccacctgggctgctacttcagcagcggcagctgtgggaaggtgctggtgtggacaggagagtacagccactggatgaacatgaagaccatcctgaaggagctggtgcagaggggccacgaggtgacagtgctggccagcagcgccagcatcctgtttgaccccaatgatgccttcaccctgaagctggaggtgtaccccaccagcctgaccaagacagaatttgagaacatcatcatgcagcaggtgaagcgctggagcgacatccagaaggacagcttctggctgtacttcagccaggagcaggagatcctgtgggagttccatgacatcttcaggaacttctgcaaggatgtggtgagcaacaagaaggtgatgaagaagctgcaggagagcagatttgacatcatctttgctgatgccttcttcccctgtggggagctgctggccgccctgctgaacatcccctttgtgtacagcctgtgcttcaccccaggctacaccatcgagcggcacagcggcggcctcatcttcccccccagctacatccctgtggtgatgagcaagctgagtgaccagatgaccttcatggagcgggtgaagaacatgatctacgtgctgtactttgacttctggttccagatgtgtgacatgaagaagtgggaccagttctacagcgaggtgctgggccggcccaccaccctgtttgagaccatgggcaaggctgacatctggctgatgagaaattcctggagcttccagttcccccaccccttcctgcccaacatcgactttgtgggcggcctgcactgcaagccagccaagcccctgcccaaggagatggaggagtttgtgcagagcagtggagaaaatggagtggtggtgttcagcctgggcagcgtcatcagcaacatgacagctgagcgggccaacgtcatcgccacagccctggccaagatcccccagaagatctag

SEQ ID NO: 175331 - DNA, 1587 bp, Artificial Sequence
  Description of Artificial Sequence: Synthetic coding sequence
atgtccatgaagtggaccagcgccctgctgctgatccagctgagctgctacttcagcagcggcagctgtgggaaggtgctggtgtggcccacagagttcagccactggatgaacatcaagaccatcctggatgagctggtgcagaggggccacgaggtgacagtgctggccagcagcgccagcatcagctttgaccccaacagccccagcaccctgaagtttgaggtgtaccctgtgtccctgaccaagacagaatttgaggacatcatcaagcagctggtgaagcgctgggccgagctgcccaaggacaccttctggagctacttcagccaggtgcaggagatcatgtggaccttcaatgacatcctgaggaagttctgcaaggacatcgtgagcaacaagaagctgatgaagaagctgcaggagagcagatttgatgtggtgctggctgatgctgtgttcccctttggagagctgctggccgagctgctgaagatcccctttgtgtacagcctgcgcttcagccctggctacgccatcgagaagcacagcggcggcctgctcttcccccccagctatgtgcctgtggtgatgtctgagctgagtgaccagatgaccttcatcgagcgggtgaagaacatgatctacgtgctgtactttgagttctggttccagatctttgacatgaagaagtgggaccagttctacagcgaggtgctgggccggcccaccaccctgtctgagaccatggccaaggctgacatctggctgatccggaactactgggacttccagttcccccaccccctgctgcccaacgtggagtttgtgggcggcctgcactgcaagccagccaagcccctgcccaaggagatggaggagtttgtgcagagcagtggagaaaatggagtggtggtgttcagcctgggctccatggtgagcaacaccagcgaggagcgggccaacgtcatcgccagcgccctggccaagatcccccagaaggtgctgtggaggtttgatggcaacaagccagacaccctgggcctgaacacccggctgtacaagtggatcccccagaatgacctgctgggccaccccaagacccgggccttcatcacccacggcggggccaacggcatctatgaggccatctaccacggcatccccatggtgggcgtgcccctgtttgctgaccagcctgacaacatcgcccacatgaaggccaagggagctgctgtgtccctggacttccacaccatgagcagcacagacctgctgaatgccctgaagacagtcatcaatgaccccctgtacaaggaaaatgccatgaagctgagccgcatccaccacgaccagcctgtgaagcccctggacagagctgtgttctggattgaatttgtgatgaggcacaagggggccaagcacctgcgggtggccgcccatgacctgacctggttccagtaccacagcctggatgtgacaggcttcctgctggcctgtgtggccaccgtcatcttcatcatcaccaagtgcctcttctgtgtgtggaagtttgtgaggacaggcaagaagggcaagagggactag

SEQ ID NO: 175332 - DNA, 1179 bp, Artificial Sequence
  Description of Artificial Sequence: Synthetic coding sequence
atgttctttgccctgctgcacgtgagcagcaccaacggcctggatgctgtgttcccctttggagagctgctggccgagctgctgaagatcccctttgtgtacagcctgcgcttcagccctggctacgccatcgagaagcacagcggcggcctgctcttcccccccagctatgtgcctgtggtgatgtctgagctgagtgaccagatgaccttcatcgagcgggtgaagaacatgatctacgtgctgtactttgagttctggttccagatctttgacatgaagaagtgggaccagttctacagcgaggtgctgggccggcccaccaccctgtctgagaccatggccaaggctgacatctggctgatccggaactactgggacttccagttcccccaccccctgctgcccaacgtggagtttgtgggcggcctgcactgcaagccagccaagcccctgcccaaggagatggaggagtttgtgcagagcagtggagaaaatggagtggtggtgttcagcctgggctccatggtgagcaacaccagcgaggagcgggccaacgtcatcgccagcgccctggccaagatcccccagaaggtgctgtggaggtttgatggcaacaagccagacaccctgggcctgaacacccggctgtacaagtggatcccccagaatgacctgctgggccaccccaagacccgggccttcatcacccacggcggggccaacggcatctatgaggccatctaccacggcatccccatggtgggcgtgcccctgtttgctgaccagcctgacaacatcgcccacatgaaggccaagggagctgctgtgtccctggacttccacaccatgagcagcacagacctgctgaatgccctgaagacagtcatcaatgaccccctgtacaaggaaaatgccatgaagctgagccgcatccaccacgaccagcctgtgaagcccctggacagagctgtgttctggattgaatttgtgatgaggcacaagggggccaagcacctgcgggtggccgcccatgacctgacctggttccagtaccacagcctggatgtgacaggcttcctgctggcctgtgtggccaccgtcatcttcatcatcaccaagtgcctcttctgtgtgtggaagtttgtgaggacaggcaagaagggcaagagggactag

SEQ ID NO: 175333 - DNA, 165 bp, Artificial Sequence
  Description of Artificial Sequence: Synthetic coding sequence
atgtccatgaagtggaccagcgccctgctgctgatccagctgagctgctacttcagcagcggcagctgtgggaaggtgctggtgtggcccacagagttcagccactggatgaacatcaagaccatcctggatgagctggtgcagaggggccacgaggtgacctag

SEQ ID NO: 175334 - DNA, 1590 bp, Artificial Sequence
  Description of Artificial Sequence: Synthetic coding sequence
atgtctgtgaagtggaccagcgtcatcctgctgatccagctgtccttctgcttcagcagcggcaactgtgggaaggtgctggtgtgggccgctgagtacagccactggatgaacatcaagaccatcctggatgagctgatccagaggggccacgaggtgacagtgctggccagcagcgccagcatcctgtttgaccccaacaacagcagcgccctgaagattgagatctaccccaccagcctgaccaagacagagctggagaacttcatcatgcagcagatcaagcgctggagcgacctgcccaaggacaccttctggctgtacttcagccaggtgcaggagatcatgagcatctttggagacatcaccaggaagttctgcaaggatgtggtgagcaacaagaagttcatgaagaaggtgcaggagagcagatttgatgtgatctttgctgatgccatcttcccctgcagcgagctgctggccgagctgttcaacatcccctttgtgtacagcctgtccttcagccctggctacacctttgagaagcacagcggcggcttcatcttcccccccagctatgtgcctgtggtgatgtctgagctgacagaccagatgaccttcatggagcgggtgaagaacatgatctacgtgctgtactttgacttctggtttgagatctttgacatgaagaagtgggaccagttctacagcgaggtgctgggccggcccaccaccctgtctgagaccatgggcaaggcagatgtgtggctgatcagaaattcctggaacttccagttcccctaccccctgctgcccaacgtggactttgtgggcggcctgcactgcaagccagccaagcccctgcccaaggagatggaggactttgtgcagagcagtggagaaaatggagtggtggtgttcagcctgggctccatggtgagcaacatgacagaggagcgggccaacgtcatcgccagcgccctggcccagatcccccagaaggtgctgtggaggtttgatggcaacaagccagacaccctgggcctgaacacccggctgtacaagtggatcccccagaatgacctgctgggccaccccaagacccgggccttcatcacccacggcggggccaacggcatctatgaggccatctaccacggcatccccatggtgggcatccccctgtttgctgaccagcctgacaacatcgcccacatgaaggcccggggagctgctgtgcgggtggacttcaacaccatgagcagcacagacctgctgaatgccctgaagagggtcatcaatgaccccagctacaaggaaaatgtgatgaagctgagccgcatccagcacgaccagcctgtgaagcccctggacagagctgtgttctggattgaatttgtgatgaggcacaagggggccaagcacctgcgggtggccgcccatgacctgacctggttccagtaccacagcctggatgtgattggcttcctgctggtgtgtgtggccaccgtcatcttcatcgtgaccaagtgctgcctcttctgcttctggaagtttgccaggaaggccaagaagggcaagaatgactag

SEQ ID NO: 175335 - DNA, 1269 bp, Artificial Sequence
  Description of Artificial Sequence: Synthetic coding sequence
atgctgcagtggaggcggcggcactgctgctttgccaagatgacctggaatgccaagaggagcctcttccgcacccacctgattggagtgctgagcctggtgttcctgtttgccatgttcctgttcttcaaccaccacgactggctgcccggccgggccggcttcaaggaaaatcctgtgacctacaccttccggggcttccgcagcaccaagtctgagaccaaccacagcagcctgaggaacatctggaaggagaccgtgccccagaccctgcggccccagacagccaccaacagcaacaacacagacctgagcccccagggcgtgacaggcctggagaacaccctgagcgccaacggcagcatctacaatgagaagggcaccggccaccccaacagctaccacttcaagtacatcatcaatgaacctgagaagtgccaggagaagagccccttcctgatcctgctgattgctgctgagcccggccagatcgaggcccggcgggccatccggcagacctggggcaatgaaagcctggcccctggcatccagatcacccgcatcttcctgctgggcctgagcatcaagctgaatggctacctgcagagggccatcctggaggagagccggcagtaccatgacatcatccagcaggagtacctggacacctactacaacctgaccatcaagaccctgatgggcatgaactgggtggccacctactgcccccacatcccctacgtgatgaagacagacagcgacatgtttgtgaacacagagtacctgatcaacaagctgctgaagccagacctgccccccaggcacaactacttcaccggctacctgatgaggggctacgcccccaacagaaacaaggacagcaagtggtacatgcccccagacctgtaccccagcgagcgctaccctgtgttctgcagcggcaccggctacgtgttcagcggggacctggccgagaagatcttcaaggtgtccctgggcatccggcggctgcacctggaggatgtgtatgtgggcatctgcctggccaagctgagaattgatcctgtgcccccaccaaatgaatttgtgttcaaccactggagggtgtcctacagcagctgcaagtacagccacctgatcaccagccaccagttccagcccagcgagctgatcaagtactggaaccacctgcagcagaacaagcacaatgcctgtgccaatgctgccaaggagaaggccggccgctaccgccacaggaagctgcactag

SEQ ID NO: 175336 - DNA, 1137 bp, Artificial Sequence
  Description of Artificial Sequence: Synthetic coding sequence
atgcagctgcggctcttccggcggctgctgctggccgccctgctgctggtgattgtgtggaccctgtttggccccagcggcctgggggaggagctgctgagcctgagcctggccagcctgctgcctgccccagccagccctggcccccccctggccctgccccggctgctgatccccaaccaggaggcctgcagcggccctggggccccacccttcctgctgatcctggtgtgcacagcccctgagaacctgaaccagagaaatgccatccgggcctcctggggcggcctgcgggaggcccggggcctgcgggtgcagaccctcttcctgctgggggagcccaatgcccagcaccctgtgtggggcagccagggcagtgacctggccagcgagagcgctgcccagggcgacatcctgcaggccgccttccaggacagctacagaaacctgaccctgaagaccctgagcggcctgaactgggccgagaagcactgccccatggcccgctacgtgctgaagacagatgatgatgtgtatgtgaatgtgcctgagctggtgtctgagctggtgctgcggggcggccgctggggccagtgggagaggagcacagagccccagcgggaggccgagcaggagggcggccaggtgctgcacagcgaggaggtgcccctgctgtacctgggccgggtgcactggagggtgaaccccagcaggacccctgggggccgccaccgggtgtctgaggagcagtggccccacacctggggccccttccccccctatgccagcggcaccggctacgtgctgagcgccagcgctgtgcagctgatcctgaaggtggccagccgggcccccctgctgcccctggaggatgtgtttgtgggcgtgtctgccaggagaggaggcctggcccccacccagtgtgtgaagctggccggggccacccactaccccctggaccgctgctgctacggcaagttcctgctgaccagccaccggctggacccctggaagatgcaggaggcctggaagctggtgggcggcagtgatggagagaggacagcccccttctgctcctggttccagggcgtgctgggcatcctgcgctgccgggccatcgcctggctgcagagctag

SEQ ID NO: 175337 - DNA, 1137 bp, Artificial Sequence; identical to SEQ ID NO: 175336
  Description of Artificial Sequence: Synthetic coding sequence

SEQ ID NO: 175338 - DNA, 1137 bp, Artificial Sequence; identical to SEQ ID NO: 175336
  Description of Artificial Sequence: Synthetic coding sequence

SEQ ID NO: 175339 - DNA, 1137 bp, Artificial Sequence; identical to SEQ ID NO: 175336
  Description of Artificial Sequence: Synthetic coding sequence

SEQ ID NO: 175340 - DNA, 1137 bp, Artificial Sequence; identical to SEQ ID NO: 175336
  Description of Artificial Sequence: Synthetic coding sequence

SEQ ID NO: 175341 - DNA, 933 bp, Artificial Sequence
  Description of Artificial Sequence: Synthetic coding sequence
atggccttccccaagatgaggctgatgtacatctgcctgctggtgctgggcgccctgtgcctgtacttctccatgtacagcctgaaccccttcaaggagcagagctttgtgtacaagaaggatggcaacttcctgaagctgcctgacacagactgccggcagaccccacccttcctggtgctgctggtgaccagcagccacaagcagctggccgagaggatggccatccggcagacctggggcaaggagaggatggtgaagggcaagcagctgaagaccttcttcctgctgggcaccaccagcagcgctgctgagaccaaggaggtggaccaggagagccagagacatggagacatcatccagaaggacttcctggatgtgtactacaacctgaccctgaagaccatgatgggcatcgagtgggtgcaccgcttctgcccccaggccgcctttgtgatgaagacagacagcgacatgttcatcaacgtggactacctgacagagctgctgctgaagaagaacagaaccacccgcttcttcaccggcttcctgaagctgaatgagttccccatccggcagcccttcagcaagtggtttgtgtccaagtctgagtacccctgggaccgctacccacccttctgcagcggcaccggctacgtgttttctggagatgtggccagccaggtgtacaacgtgtccaagtctgtgccctacatcaagctggaggatgtgtttgtgggcctgtgcctggagcggctgaacatccggctggaggagctgcacagccagcccaccttcttccctgggggcctgcgcttctctgtgtgcctcttcagaagaattgtggcctgccacttcatcaagcccaggaccctgctggactactggcaggccctggagaacagcagaggagaggactgcccccctgtgtag

SEQ ID NO: 175342 - DNA, 933 bp, Artificial Sequence; identical to SEQ ID NO: 175341
  Description of Artificial Sequence: Synthetic coding sequence

SEQ ID NO: 175343 - DNA, 933 bp, Artificial Sequence; identical to SEQ ID NO: 175341
  Description of Artificial Sequence: Synthetic coding sequence

SEQ ID NO: 175344 - DNA, 933 bp, Artificial Sequence; identical to SEQ ID NO: 175341
  Description of Artificial Sequence: Synthetic coding sequence

SEQ ID NO: 175345 - DNA, 1197 bp, Artificial Sequence
  Description of Artificial Sequence: Synthetic coding sequence
atgaggctgcgggagcccctgctgagcggcagcgctgccatgcctggggccagcctgcagagggcctgccgcctgctggtggccgtgtgtgccctgcacctgggcgtgaccctggtgtactacctggccggccgggacctgagccggctgccccagctggtgggcgtgtccacccccctgcagggcggcagcaacagcgctgctgccatcggccagagcagcggggagctgaggactggaggagcccggcccccaccacccctgggcgccagcagccagcccaggcctggaggagacagcagccctgtggtggacagcggccctggccctgccagcaacctgacctctgtgcctgtgccccacaccacagccctgagcctgcctgcctgcccagaggagagccccctgctggtgggccccatgctgattgagttcaacatgcctgtggacctggagctggtggccaagcagaaccccaacgtgaagatgggcggccgctatgccccccgggactgtgtgagcccccacaaggtggccatcatcatccccttcaggaaccggcaggagcacctgaagtactggctgtactacctgcaccctgtgctgcagaggcagcagctggactatggcatctacgtgatcaaccaggccggggacaccatcttcaacagagccaagctgctgaatgtgggcttccaggaggccctgaaggactatgactacacctgctttgtgttcagtgatgtggacctgatccccatgaatgaccacaatgcctaccgctgcttcagccagcccaggcacatctctgtggccatggacaagtttggcttcagcctgccctacgtgcagtactttggaggagtgtctgccctgagcaagcagcagttcctgaccatcaatggcttccccaacaactactggggctggggcggagaagatgatgacatcttcaaccggctggtgttccggggcatgagcatcagccggcccaatgctgtggtgggccgctgcaggatgatccgccacagccgggacaagaagaatgagcccaacccccagagatttgacagaattgcccacaccaaggagaccatgctgagtgatggcctgaacagcctgacctaccaggtgctggatgtgcagcgctaccccctgtacacccagatcaccgtggacatcggcacccccagctag

SEQ ID NO: 175346 - DNA, 678 bp, Artificial Sequence
  Description of Artificial Sequence: Synthetic coding sequence
atgaggctgcgggagcccctgctgagcggcagcgctgccatgcctggggccagcctgcagagggcctgccgcctgctggtggccgtgtgtgccctgcacctgggcgtgaccctggtgtactacctggccggccgggacctgagccggctgccccagctggtgggcgtgtccacccccctgcagggcggcagcaacagcgctgctgccatcggccagagcagcggggagctgaggactggaggagcccggcccccaccacccctgggcgccagcagccagcccaggcctggaggagacagcagccctgtggtggacagcggccctggccctgccagcaacctgacctctgtgcctgtgccccacaccacagccctgagcctgcctgcctgcccagaggagagccccctgctggtgggccccatgctgattgagttcaacatgcctgtggacctggagctggtggccaagcagaaccccaacgtgaagatgggcggccgctatgccccccgggactgtgtgagcccccacaaggtggccatcatcatccccttcaggaaccggcaggagcacctgaagtactggctgtactacctgcaccctgtgctgcagaggcagcagctggactatggcatctacgtgatcaaccagtatgagaagatccggcggctgctgtggtag

SEQ ID NO: 175347 - DNA, 1068 bp, Artificial Sequence
  Description of Artificial Sequence: Synthetic coding sequence
atgaggctgcgggagcccctgctgagcggcagcgctgccatgcctggggccagcctgcagagggcctgccgcctgctggtggccgtgtgtgccctgcacctgggcgtgaccctggtgtactacctggccggccgggacctgagccggctgccccagctggtgggcgtgtccacccctgtggtggacagcggccctggccctgccagcaacctgacctctgtgcctgtgccccacaccacagccctgagcctgcctgcctgcccagaggagagccccctgctggtgggccccatgctgattgagttcaacatgcctgtggacctggagctggtggccaagcagaaccccaacgtgaagatgggcggccgctatgccccccgggactgtgtgagcccccacaaggtggccatcatcatccccttcaggaaccggcaggagcacctgaagtactggctgtactacctgcaccctgtgctgcagaggcagcagctggactatggcatctacgtgatcaaccaggccggggacaccatcttcaacagagccaagctgctgaatgtgggcttccaggaggccctgaaggactatgactacacctgctttgtgttcagtgatgtggacctgatccccatgaatgaccacaatgcctaccgctgcttcagccagcccaggcacatctctgtggccatggacaagtttggcttcagcctgccctacgtgcagtactttggaggagtgtctgccctgagcaagcagcagttcctgaccatcaatggcttccccaacaactactggggctggggcggggaggatgatgacatcttcaaccggctggtgttccggggcatgagcatcagccggcccaatgctgtggtgggccgctgcaggatgatccgccacagccgggacaagaagaatgagcccaacccccagagatttgaccgcatcgcccacaccaaggagaccatgctgagtgatggcctgaacagcctgacctaccaggtgctggatgtgcagcgctaccccctgtacacccagatcaccgtggacatcggcacccccagctag

SEQ ID NO: 175348 - DNA, 438 bp, Artificial Sequence
  Description of Artificial Sequence: Synthetic coding sequence
atgaatgaccacaatgcctaccgctgcttcagccagcccaggcacatctctgtggccatggacaagtttggcttcagcctgccctacgtgcagtactttggaggagtgtctgccctgagcaagcagcagttcctgaccatcaatggcttccccaacaactactggggctggggcggggaggatgatgacatcttcaaccggctggtgttccggggcatgagcatcagccggcccaatgctgtggtgggccgctgcaggatgatccgccacagccgggacaagaagaatgagcccaacccccagagatttgaccgcatcgcccacaccaaggagaccatgctgagtgatggcctgaacagcctgacctaccaggtgctggatgtgcagcgctaccccctgtacacccagatcaccgtggacatcggcacccccagctag

SEQ ID NO: 175349 - DNA, 1206 bp, Artificial Sequence
  Description of Artificial Sequence: Synthetic coding sequence
atggctgtggaggtgcaggagcagtggccctgcctgcctgctgctggctgccccggccccctgggcggccctgtggccgcctgtggcatgagccggctgctgggcggcaccctggagcgggtgtgcaaggctgtgctgctgctgtgcctgctgcacttcctggtggccgtcatcctgtactttgatgtgtatgcccagcacctggccttcttcagccgcttcagcgcccggggccctgcccacgccctgcaccctgctgccagcagcagcagcagcagcagcaactgcagccggcccaatgccacagccagcagcagcggcctgcctgaggtgcccagcgccctgcccggccccacagcccccaccctgcccccctgcccagacagccccccaggcctggtgggccgcctgctgattgagttcaccagccccatgcccctggagcgggtgcagagagaaaatcctggggtgctgatgggcggccgctacaccccaccagactgcaccccagcccagacagtggccgtcatcatccccttccgccaccgggagcaccacctgcgctactggctgcactacctgcaccccatcctgcggcggcagaggctgcgctatggagtgtatgtgatcaaccagcacggggaggacaccttcaacagagccaagctgctgaatgtgggcttcctggaggccctgaaggaggatgctgcctatgactgcttcatcttcagtgatgtggacctggtgcccatggatgacaggaacctgtaccgctgtggggaccagcccaggcactttgccatcgccatggacaagtttggcttccggctgccctatgccggctactttggaggagtgtctggcctgagcaaggcccagttcctgcgcatcaatggcttccccaatgagtactggggctggggcggggaggatgatgacatcttcaaccgcatcagcctgaccggcatgaagatcagcaggccagacatccgcatcggccgctacaggatgatcaagcatgaccgggacaagcacaatgagcccaacccccagcgcttcaccaagatccagaacaccaagctgaccatgaagagagatggcatcggctctgtgcgctaccaggtgctggaggtgtcccggcagcccctcttcaccaacatcaccgtggacatcggccggccccccagctggccaccccggggctag

SEQ ID NO: 175350 - DNA, 1119 bp, Artificial Sequence
  Description of Artificial Sequence: Synthetic coding sequence
atgagccggctgctgggcggcaccctggagcgggtgtgcaaggctgtgctgctgctgtgcctgctgcacttcctggtggccgtcatcctgtactttgatgtgtatgcccagcacctggccttcttcagccgcttcagcgcccggggccctgcccacgccctgcaccctgctgccagcagcagcagcagcagcagcaactgcagccggcccaatgccacagccagcagcagcggcctgcctgaggtgcccagcgccctgcccggccccacagcccccaccctgcccccctgcccagacagccccccaggcctggtgggccgcctgctgattgagttcaccagccccatgcccctggagcgggtgcagcgggagaaccctggggtgctgatgggcggccgctacaccccaccagactgcaccccagcccagacagtggccgtcatcatccccttccgccaccgggagcaccacctgcgctactggctgcactacctgcaccccatcctgcggcggcagaggctgcgctatggagtgtatgtgatcaaccagcacggggaggacaccttcaacagagccaagctgctgaatgtgggcttcctggaggccctgaaggaggatgctgcctatgactgcttcatcttcagtgatgtggacctggtgcccatggatgacaggaacctgtaccgctgtggggaccagcccaggcactttgccatcgccatggacaagtttggcttccggctgccctatgccggctactttggaggagtgtctggcctgagcaaggcccagttcctgcgcatcaatggcttccccaatgagtactggggctggggcggagaagatgatgacatcttcaaccgcatcagcctgaccggcatgaagatcagcaggccagacatcagaattggccgctacaggatgatcaagcatgaccgggacaagcacaatgagcccaacccccagcgcttcaccaagatccagaacaccaagctgaccatgaagagagatggcatcggctctgtgcgctaccaggtgctggaggtgtcccggcagcccctcttcaccaacatcaccgtggacatcggccggcccccatcctggccaccccggggctag

SEQ ID NO: 175351 - DNA, 1119 bp, Artificial Sequence; identical to SEQ ID NO: 175350
  Description of Artificial Sequence: Synthetic coding sequence

SEQ ID NO: 175352 - DNA, 921 bp, Artificial Sequence
  Description of Artificial Sequence: Synthetic coding sequence
atgcccagcacccagctgctggccgctgctgctgctgctgccacagcccctggccccaccccaccacccctggcccctggcagcctgcggagccctgtgccctgccctgtgccccggctgccccgctgccaccctgtgctgaccaggcacctggtgctgcgggtgcagcgggagaaccctggggtgctgatgggcggccgctacaccccaccagactgcaccccagcccagacagtggccgtcatcatccccttccgccaccgggagcaccacctgcgctactggctgcactacctgcaccccatcctgcggcggcagaggctgcgctatggagtgtatgtgatcaaccagcacggggaggacaccttcaacagagccaagctgctgaatgtgggcttcctggaggccctgaaggaggatgctgcctatgactgcttcatcttcagtgatgtggacctggtgcccatggatgacaggaacctgtaccgctgtggggaccagcccaggcactttgccatcgccatggacaagtttggcttccggctgccctatgccggctactttggaggagtgtctggcctgagcaaggcccagttcctgcgcatcaatggcttccccaatgagtactggggctggggcggagaagatgatgacatcttcaaccgcatcagcctgaccggcatgaagatcagcaggccagacatcagaattggccgctacaggatgatcaagcatgaccgggacaagcacaatgagcccaacccccagcgcttcaccaagatccagaacaccaagctgaccatgaagagagatggcatcggctctgtgcgctaccaggtgctggaggtgtcccggcagcccctcttcaccaacatcaccgtggacatcggccggcccccatcctggccaccccggggctag

SEQ ID NO: 175353 - DNA, 441 bp, Artificial Sequence
  Description of Artificial Sequence: Synthetic coding sequence
atgctgcggcggctgctggagcggccctgcaccctggccctgctggtgggcagccagctggccgtgatgatgtacctgagcctgggcggcttccgcagcctgagcgccctgtttggccgggaccagggccccacctttgactacagccaccccagagatgtgtacagcaacctgagccacctgcccggggcccctgggggccccccagccccccagggcctgccctactgcccagagaggagccccctgctggtgggccctgtgtctgtgtccttcagccctgtgcccagcctggccgagatcgtggagaggaacccccgggtggagcccggcggccgctaccggcccccagctgccctgcccccagcccccctgctggccgccccagctgcctgcctgtggcacctgtgccaccccccaggctggaagtggaacatctag

SEQ ID NO: 175354 - DNA, 1182 bp, Artificial Sequence
  Description of Artificial Sequence: Synthetic coding sequence
atgctgcggcggctgctggagcggccctgcaccctggccctgctggtgggcagccagctggccgtgatgatgtacctgagcctgggcggcttccgcagcctgagcgccctgtttggccgggaccagggccccacctttgactacagccaccccagagatgtgtacagcaacctgagccacctgcccggggcccctgggggccccccagccccccagggcctgccctactgcccagagaggagccccctgctggtgggccctgtgtctgtgtccttcagccctgtgcccagcctggccgagatcgtggagaggaacccccgggtggagcccggcggccgctacagacctgctggctgtgagcccaggagcaggacagccatcatcgtgccccaccgggcccgggagcaccacctgcggctgctgctgtaccacctgcaccccttcctgcagaggcagcagctggcctacggcatctacgtgatccaccaggccggaaatggcaccttcaacagagccaagctgctgaatgtgggcgtgcgggaggccctgagagatgaggagtgggactgcctcttcctgcatgatgtggacctgctgcctgaaaatgaccacaacctgtatgtgtgtgacccccggggccccaggcatgtggccgtggccatgaacaagtttggctacagcctgccctacccccagtactttggaggagtgtctgccctgaccccagaccagtacctgaagatgaatggcttccccaatgagtactggggctggggcggagaagatgatgacatcgccaccagggtgcggctggccggcatgaagatcagcaggcctcccacctctgtgggccactacaagatggtgaagcacagaggagacaagggaaatgaggagaacccccacagatttgacctgctggtgaggacccagaacagctggacccaggacggcatgaacagcctgacctaccagctgctggcccgggagctgggccccctgtacaccaacatcacagctgacatcggcacagacccccggggcccccgggcccccagcggcccccgctacccacctggcagcagccaggccttccggcaggagatgctgcagaggcggcccccagcccggcccggccccctgagcacagccaaccacacagccctgcggggcagccactag

SEQ ID NO: 175355 - DNA, 1182 bp, Artificial Sequence
  Description of Artificial Sequence: Synthetic coding sequence
atgctgcggcggctgctggagcggccctgcaccctggccctgctggtgggcagccagctggccgtgatgatgtacctgagcctgggcggcttccgcagcctgagcgccctgtttggccgggaccagggccccacctttgactacagccaccccagagatgtgtacagcaacctgagccacctgcccggggcccctgggggccccccagccccccagggcctgccctactgcccagagaggagccccctgctggtgggccctgtgtctgtgtccttcagccctgtgcccagcctggccgagatcgtggagaggaacccccgggtggagcccggcggccgctacagacctgctggctgtgagcccaggagcaggacagccatcatcgtgccccaccgggcccgggagcaccacctgcggctgctgctgtaccacctgcaccccttcctgcagaggcagcagctggcctacggcatctacgtgatccaccaggccggaaatggcaccttcaacagagccaagctgctgaatgtgggcgtgcgggaggccctgagagatgaggagtgggactgcctcttcctgcatgatgtggacctgctgcctgaaaatgaccacaacctgtatgtgtgtgacccccggggccccaggcatgtggccgtggccatgaacaagtttggctacagcctgccctacccccagtactttggaggagtgtctgccctgaccccagaccagtacctgaagatgaatggcttccccaatgagtactggggctggggcggagaagatgatgacatcgccaccagggtgcggctggccggcatgaagatcagcaggcctcccacctctgtgggccactacaagatggtgaagcacagaggagacaagggaaatgaggagaacccccacagatttgacctgctggtgaggacccagaacagctggacccaggacggcatgaacagcctgacctaccagctgctggcccgggagctgggccccctgtacaccaacatcacagctgacatcggcacagacccccggggcccccgggcccccagcggcccccgctacccacctggcagcagccaggccttccggcaggagatgctgcagaggcggcccccagcccggcccggccccctgagcacagccaaccacaccccatctgaggtgcacacctag

SEQ ID NO: 175356 - DNA, 1182 bp, Artificial Sequence; identical to SEQ ID NO: 175354
  Description of Artificial Sequence: Synthetic coding sequence

SEQ ID NO: 175357 - DNA, 1113 bp, Artificial Sequence
  Description of Artificial Sequence: Synthetic coding sequence
atgctgcggcggctgctggagcggccctgcaccctggccctgtttggccgggaccagggccccacctttgactacagccaccccagagatgtgtacagcaacctgagccacctgcccggggcccctgggggccccccagccccccagggcctgccctactgcccagagaggagccccctgctggtgggccctgtgtctgtgtccttcagccctgtgcccagcctggccgagatcgtggagaggaacccccgggtggagcccggcggccgctacagacctgctggctgtgagcccaggagcaggacagccatcatcgtgccccaccgggcccgggagcaccacctgcggctgctgctgtaccacctgcaccccttcctgcagaggcagcagctggcctacggcatctacgtgatccaccaggccggaaatggcaccttcaacagagccaagctgctgaatgtgggcgtgcgggaggccctgagagatgaggagtgggactgcctcttcctgcatgatgtggacctgctgcctgaaaatgaccacaacctgtatgtgtgtgacccccggggccccaggcatgtggccgtggccatgaacaagtttggctacagcctgccctacccccagtactttggaggagtgtctgccctgaccccagaccagtacctgaagatgaatggcttccccaatgagtactggggctggggcggggaggatgatgacatcgccaccagggtgcggctggccggcatgaagatcagccggccccccacctctgtgggccactacaagatggtgaagcacagaggagacaagggaaatgaggagaacccccacagatttgacctgctggtgaggacccagaacagctggacccaggacggcatgaacagcctgacctaccagctgctggcccgggagctgggccccctgtacaccaacatcacagctgacattggaacagacccccggggcccccgggcccccagcggcccccgctacccacctggcagcagccaggccttccggcaggagatgctgcagaggcggcccccagcccggcccggccccctgagcacagccaaccacacagccctgcggggcagccactag

SEQ ID NO: 175358 - DNA, 684 bp, Artificial Sequence
  Description of Artificial Sequence: Synthetic coding sequence
atgctgcggcggctgctggagcggccctgcaccctggccctgctggtgggcagccagctggccgtgatgatgtacctgagcctgggcggcttccgcagcctgagcgccctgtttggccgggaccagggccccacctttgactacagccaccccagagatgtgtacagcaacctgagccacctgcccggggcccctgggggccccccagccccccagggcctgccctactgcccagagaggagccccctgctggtgggccctgtgtctgtgtccttcagccctgtgcccagcctggccgagatcgtggagaggaacccccgggtggagcccggcggccgctacagacctgctggctgtgagcccaggagcaggacagccatcatcgtgccccaccgggcccgggagcaccacctgcggctgctgctgtaccacctgcaccccttcctgcagaggcagcagctggcctacggcatctacgtgatccaccaggccggaaatggcaccttcaacagagccaagctgctgaatgtgggcgtgcgggaggccctgagagatgaggagtgggactgcctcttcctgcatgatgtggacctgctgcctgaaaatgaccacaacctgtatgtgtgtgacccccggggccccaggcatgtggccgtggccatgaacaagtttggctacagatag

SEQ ID NO: 175359 - DNA, 1035 bp, Artificial Sequence
  Description of Artificial Sequence: Synthetic coding sequence
atgggcttcaacctgaccttccacctgagctacaagttccggctgctgctgctgctgaccctgtgcctgactgtggtgggctgggccaccagcaactactttgtgggcgccatccaggagatccccaaggccaaggagttcatggccaacttccacaagaccctcatcctgggcaagggcaagaccctgaccaatgaggccagcaccaagaaggtggagctggacaactgccccagcgtgagcccctacctgcggggccagagcaagctgatcttcaagccagacctgaccctggaggaggtgcaggccgagaaccccaaggtgtcccggggccgctaccggccccaggagtgcaaggccctgcagagggtggccatcctggtgccccacaggaaccgggagaagcacctgatgtacctgctggagcacctgcaccccttcctgcagaggcagcagctggactatggcatctacgtgatccaccaggccgagggcaagaagttcaacagagccaagctgctgaatgtgggctacctggaggccctgaaggaggagaactgggactgcttcatcttccatgatgtggacctggtgcctgaaaatgacttcaacctgtacaagtgtgaggagcaccccaagcacctggtggtgggcaggaacagcacaggctaccgcctgcgctacagcggctactttggaggagtgacagccctgagccgggagcagttcttcaaggtgaatggcttcagcaacaactactggggctggggcggagaagatgatgacctgcggctgcgggtggagctgcagaggatgaagatcagccggcccctgcctgaggtgggcaagtacaccatggtgttccacacccgggacaagggaaatgaggtgaatgctgagaggatgaagctgctgcaccaggtgtcccgggtgtggaggacagatggcctgagcagctgcagctacaagctggtgtctgtggagcacaaccccctgtacatcaacatcaccgtggacttctggtttggagcctag

SEQ ID NO: 175360 - DNA, 1035 bp, Artificial Sequence; identical to SEQ ID NO: 175359
  Description of Artificial Sequence: Synthetic coding sequence

SEQ ID NO: 175361 - DNA, 21 bp, Artificial Sequence
  Description of Artificial Sequence: Synthetic coding sequence
atgggcttcaacctgacctag

SEQ ID NO: 175362 - DNA, 9 bp, Artificial Sequence
  Description of Artificial Sequence: Synthetic coding sequence
atgggctag

SEQ ID NO: 175363 - DNA, 168 bp, Artificial Sequence
  Description of Artificial Sequence: Synthetic coding sequence
atgggcttcaacctgaccttccacctgagctacaagttccggctgctgctgctgctgaccctgtgcctgactgtggtgggctgggccaccagcaactactttgtgggcgccatccaggagatccccaaggccaaggagttcatggccaacttccacaagaccctgtag

SEQ ID NO: 175364 - DNA, 66 bp, Artificial Sequence
  Description of Artificial Sequence: Synthetic coding sequence
atgggcttcaacctgaccttccacctgagctacaagttccggctgctgctgctgctgaccctgtag

SEQ ID NO: 175365 - DNA, 411 bp, Artificial Sequence
  Description of Artificial Sequence: Synthetic coding sequence
atgggcttcaacctgaccttccacctgagctacaagttccggctgctgctgctgctgaccctgtgcctgactgtggtgggctgggccaccagcaactactttgtgggcgccatccaggagatccccaaggccaaggagttcatggccaacttccacaagaccctcatcctgggcaagggcaagaccctgaccaatgaggccagcaccaagaaggtggagctggacaactgccccagcgtgagcccctacctgcggggccagagcaagctgatcttcaagccagacctgaccctggaggaggtgcaggccgagaaccccaaggtgtcccggggccgctaccggccccaggagtgcaaggccctgcagagggtggccatcctggtgccccacaggaaccgggagaagcactag

SEQ ID NO: 175366 - DNA, 357 bp, Artificial Sequence
  Description of Artificial Sequence: Synthetic coding sequence
atgggcttcaacctgaccttccacctgagctacaagttccggctgctgctgctgctgaccctgtgcctgactgtggtgggctgggccaccagcaactactttgtgggcgccatccaggagatccccaaggccaaggagttcatggccaacttccacaagaccctcatcctgggcaagggcaagaccctgaccaatgaggccagcaccaagaaggtggagctggacaactgccccagcgtgagcccctacctgcggggccagagcaagctgatcttcaagccagacctgaccctggaggaggtgcaggccgagaaccccaaggtgtcccggggccgctaccggccccaggagtgctag

SEQ ID NO: 175367 - DNA, 1035 bp, Artificial Sequence; identical to SEQ ID NO: 175359
  Description of Artificial Sequence: Synthetic coding sequence

SEQ ID NO: 175368 - DNA, 129 bp, Artificial Sequence
  Description of Artificial Sequence: Synthetic coding sequence
atgggcttcaacctgaccttccacctgagctacaagttccggctgctgctgctgctgaccctgtgcctgactgtggtgggctgggccaccagcaactactttgtgggcgccatccaggagatcccctag

SEQ ID NO: 175369 - DNA, 1167 bp, Artificial Sequence
  Description of Artificial Sequence: Synthetic coding sequence
atgagggcccggcggggcctgctgcggctgccccggcgcagcctgctggccgccctcttcttcttcagcctgagcagcagcctgctgtactttgtgtatgtggcccctggcatcgtgaacacctacctgttcatgatgcaggcccagggcatcctgatccgggacaacgtgaggaccatcggggcccaggtgtatgagcaggtgctgcggagcgcctatgccaagaggaacagctctgtgaatgacagcgactaccccctggacctgaaccacagcgagaccttcctgcagaccaccaccttcctgcctgaggacttcacctactttgccaaccacacctgcccagagcggctgcccagcatgaagggccccatcgacatcaacatgtctgagatcggcatggactacatccacgagctgttcagcaaggaccccaccatcaagctgggcggccactggaagcccagcgactgcatgccccgctggaaggtggccatcctgatccccttcaggaacagacatgagcacctgcctgtgctcttccgccacctgctgcccatgctgcagaggcagaggctgcagtttgccttctacgtggtggagcaggtgggcacccagcccttcaacagagccatgctgttcaacgtgggcttccaggaggccatgaaggacctggactgggactgcctgatcttccatgatgtggaccacatccctgagagtgacaggaactactacggctgcggccagatgcccaggcactttgccaccaagctggacaagtacatgtacctgctgccctacacagagttcttcggcggcgtgtctggcctgactgtggagcagttcaggaagatcaatggcttccccaatgccttctggggctggggcggagaagatgatgacctgtggaacagagtgcagaatgccggctacagcgtgtccaggcctgagggggacaccgggaagtacaagagcatcccccaccaccacagaggagaggtgcagttcctgggccgctatgccctgctgaggaagagcaaggagcggcagggcctggatggcctgaacaacctgaactactttgccaacatcacctatgatgccctgtacaagaacatcaccgtgaacctgaccccagagctggcccaggtgaatgagtactag

SEQ ID NO: 175370 - DNA, 1032 bp, Artificial Sequence
  Description of Artificial Sequence: Synthetic coding sequence
atgtctgtgctgcggaggatgatgagggtgagcaacagaagcctgctggccttcatcttcttcttcagcctgagcagcagctgcctgtacttcatctacgtggcccctggcatcgactacccagagggcaacaacagcagtgactacctggtgcagaccaccacctacctgcctgagaacttcacctacagcccctacctgccctgcccagagaagctgccctacatgaggggcttcctgaatgtgaatgtgtctgaggtgtcctttgatgagatccaccagctgttcagcaaggacctggacatcgagcccggcggccactggaggcccaaggactgcaagccccgctggaaggtggccgtgctgatccccttcaggaacagacatgagcacctgcccatcttcttcctgcacctgatccccatgctgcagaagcagaggctggagtttgccttctacgtgattgagcagacaggcacccagcccttcaacagagccatgctgttcaacgtgggcttcaaggaggccatgaaggacagcgtgtgggactgtgtgatcttccatgatgtggaccacctgcctgaaaatgacaggaactactacggctgtggggagatgcccaggcactttgctgccaagctggacaagtacatgtacatcctgccctacaaggagttctttggaggagtgtctggcctgactgtggagcagttcaggaagatcaatggcttccccaatgccttctggggctggggcggggaggatgatgacctgtggaacagagtgcactacgccggctacaacgtgaccaggcctgagggggacctgggcaagtacaagagcatcccccaccaccacagaggagaggtgcagttcctgggccgctacaagctgctgcgctacagcaaggagcggcagtacattgatggcctgaacaacctgatctaccggcccaagatcctggtggaccggctgtacaccaacatctctgtgaacctgatgcctgagctggcccccatcgaggactactag

SEQ ID NO: 175371 - DNA, 1149 bp, Artificial Sequence
  Description of Artificial Sequence: Synthetic coding sequence
atgtctgtgctgcggaggatgatgagggtgagcaacagaagcctgctggccttcatcttcttcttcagcctgagcagcagctgcctgtacttcatctacgtggcccctggcatcgccaacacctacctgttcatggtgcaggcccggggcatcatgctgagagaaaatgtgaagaccatcggccacatgatccggctgtacaccaacaagaacagcaccctgaatggaacagactacccagagggcaacaacagcagtgactacctggtgcagaccaccacctacctgcctgagaacttcacctacagcccctacctgccctgcccagagaagctgccctacatgaggggcttcctgaatgtgaatgtgtctgaggtgtcctttgatgagatccaccagctgttcagcaaggacctggacatcgagcccggcggccactggaggcccaaggactgcaagccccgctggaaggtggccgtgctgatccccttcaggaacagacatgagcacctgcccatcttcttcctgcacctgatccccatgctgcagaagcagaggctggagtttgccttctacgtgattgagcagacaggcacccagcccttcaacagagccatgctgttcaacgtgggcttcaaggaggccatgaaggacagcgtgtgggactgtgtgatcttccatgatgtggaccacctgcctgaaaatgacaggaactactacggctgtggggagatgcccaggcactttgctgccaagctggacaagtacatgtacatcctgccctacaaggagttcttcggcggcgtgtctggcctgactgtggagcagttcaggaagatcaatggcttccccaatgccttctggggctggggcggagaagatgatgacctgtggaacagagtgcactacgccggctacaacgtgaccaggcctgagggggacctgggcaagtacaagagcatcccccaccaccacagaggagaggtgcagttcctgggccgctacaagctgctgcgctacagcaaggagcggcagtacattgatggcctgaacaacctgatctaccggcccaagatcctggtggaccggctgtacaccaacatctctgtgaacctgatgcctgagctggcccccatcgaggactactag

SEQ ID NO: 175372 - DNA, 1032 bp, Artificial Sequence
  Description of Artificial Sequence: Synthetic coding sequence
atgtctgtgctgcggaggatgatgagggtgagcaacagaagcctgctggccttcatcttcttcttcagcctgagcagcagctgcctgtacttcatctacgtggcccctggcatcgccaacacctacctgttcatggtgcaggcccggggcatcatgctgagagaaaatgtgaagaccatcggccacatgatccggctgtacaccaacaagaacagcaccctgaatggaacagactacccagagggcaacaacagcagtgactacctggtgcagaccaccacctacctgcctgagaacttcacctacagcccctacctgccctgcccagagaagctgccctacatgaggggcttcctgaatgtgaatgtgtctgaggtgtcctttgatgagatccaccagctgttcagcaaggacctggacatcgagcccggcggccactggaggcccaaggactgcaagccccgctggaagacaggcacccagcccttcaacagagccatgctgttcaacgtgggcttcaaggaggccatgaaggacagcgtgtgggactgtgtgatcttccatgatgtggaccacctgcctgaaaatgacaggaactactacggctgtggggagatgcccaggcactttgctgccaagctggacaagtacatgtacatcctgccctacaaggagttctttggaggagtgtctggcctgactgtggagcagttcaggaagatcaatggcttccccaatgccttctggggctggggcggggaggatgatgacctgtggaacagagtgcactacgccggctacaacgtgaccaggcctgagggggacctgggcaagtacaagagcatcccccaccaccacagaggagaggtgcagttcctgggccgctacaagctgctgcgctacagcaaggagcggcagtacattgatggcctgaacaacctgatctaccggcccaagatcctggtggaccggctgtacaccaacatctctgtgaacctgatgcctgagctggcccccatcgaggactactag

SEQ ID NO: 175373 - DNA, 1047 bp, Artificial Sequence
  Description of Artificial Sequence: Synthetic coding sequence
atggccgagaaggtgctggtgactggaggagctggctacatcggcagccacacagtgctggagctgctggaggccggctacctgcctgtggtgattgacaacttccacaatgccttccggggcggcggcagcctgcctgagagcctgcggcgggtgcaggagctgaccggccgctctgtggagtttgaggagatggacatcctggaccagggcgccctgcagaggctcttcaagaagtacagcttcatggccgtcatccactttgctggcctgaaggctgtgggggagagcgtgcagaagcccctggactactacagagtgaacctgaccggcaccatccagctgctggagatcatgaaggcccacggcgtgaagaacctggtgttcagcagcagcgccaccgtgtatggcaacccccagtacctgcccctggatgaggcccaccccaccggcggctgcaccaacccctacggcaagagcaagttcttcatcgaggagatgatccgggacctgtgccaggccgacaagacctggaatgctgtgctgctgcgctacttcaaccccactggagcccacgccagcggctgcattggagaggacccccagggcatccccaacaacctgatgccctacgtgtcccaggtggccatcggcagaagagaggccctgaatgtgtttggaaatgactatgacacagaagatggcaccggggtgcgggactacatccacgtggtggacctggccaagggccacatcgccgccctgaggaagctgaaggagcagtgtggctgccgcatctacaacctgggcactggaacaggctacagcgtgctgcagatggtgcaggccatggagaaggccagcggcaagaagatcccctacaaggtggtggcccggcgggagggagatgtggccgcctgctacgccaaccccagcctggcccaggaggagctgggctggacagctgccctgggcctggacaggatgtgtgaggacctgtggcgctggcagaagcagaaccccagcggcttcggcacccaggcctag

SEQ ID NO: 175374 - DNA, 777 bp, Artificial Sequence
  Description of Artificial Sequence: Synthetic coding sequence
atggacatcctggaccagggcgccctgcagaggctcttcaagaagtacagcttcatggccgtcatccactttgctggcctgaaggctgtgggggagagcgtgcagaagcccctggactactacagagtgaacctgaccggcaccatccagctgctggagatcatgaaggcccacggcgtgaagaacctggtgttcagcagcagcgccaccgtgtatggcaacccccagtacctgcccctggatgaggcccaccccaccggcggctgcaccaacccctacggcaagagcaagttcttcatcgaggagatgatccgggacctgtgccaggccgacaagacctggaatgctgtgctgctgcgctacttcaaccccactggagcccacgccagcggctgcattggagaggacccccagggcatccccaacaacctgatgccctacgtgtcccaggtggccatcggcagaagagaggccctgaatgtgtttggaaatgactatgacacagaagatggcaccggggtgcgggactacatccacgtggtggacctggccaagggccacatcgccgccctgaggaagctgaaggagcagtgtggctgccgcatcccctacaaggtggtggcccggcgggagggagatgtggccgcctgctacgccaaccccagcctggcccaggaggagctgggctggacagctgccctgggcctggacaggatgtgtgaggacctgtggcgctggcagaagcagaaccccagcggcttcggcacccaggcctag

SEQ ID NO: 175375 - DNA, 684 bp, Artificial Sequence
  Description of Artificial Sequence: Synthetic coding sequence
atggacatcctggaccagggcgccctgcagaggctcttcaagaagtacagcttcatggccgtcatccactttgctggcctgaaggctgtgggggagagcgtgcagaagcccctggactactacagagtgaacctgaccggcaccatccagctgctggagatcatgaaggcccacggcgtgaagaacctggtgttcagcagcagcgccaccgtgtatggcaacccccagtacctgcccctggatgaggcccaccccaccggcggctgcaccaacccctacggcaagagcaagttcttcatcgaggagatgatccgggacctgtgccaggccgacaagacctggaatgctgtgctgctgcgctacttcaaccccactggagcccacgccagcggctgcattggagaggacccccagggcatccccaacaacctgatgccctacgtgtcccaggtggccatcggcagaagagaggccctgaatgtgtttggaaatgactatgacacagaagatggcaccggggtgcgggactacatccacgtggtggacctggccaagggccacatcgccgccctgaggaagctgaaggagcagtgtggctgccgcatctacaacctgggcactggaacaggctacagcgtgctgcagatggtgcaggccatggagaaggccagcggcaagaagtag

SEQ ID NO: 175376 - DNA, 588 bp, Artificial Sequence
  Description of Artificial Sequence: Synthetic coding sequence
atggccgagaaggtgctggtgactggaggagctggctacatcggcagccacacagtgctggagctgctggaggccggctacctgcctgtggtgattgacaacttccacaatgccttccggggcggcggcagcctgcctgagagcctgcggcgggtgcaggagctgaccggccgctctgtggagtttgaggagatggacatcctggaccagggcgccctgcagaggctcttcaagaagtacagcttcatggccgtcatccactttgctggcctgaaggctgtgggggagagcgtgcagaagcccctggactactacagagtgaacctgaccggcaccatccagctgctggagatcatgaaggcccacggcgtgaagaacctggtgttcagcagcagcgccaccgtgtatggcaacccccagtacctgcccctggatgaggcccaccccaccggcggctgcaccaacccctacggcaagagcaagttcttcatcgaggagatgatccgggacctgtgccaggccgacaagacctggaatgctgtgctgctgcgctacttcaaccccactggagcccacgccagcggctag

SEQ ID NO: 175377 - DNA, 720 bp, Artificial Sequence
  Description of Artificial Sequence: Synthetic coding sequence
atggacatcctggaccagggcgccctgcagaggctcttcaagaagtacagcttcatggccgtcatccactttgctggcctgaaggctgtgggggagagcgtgcagaagcccctggactactacagagtgaacctgaccggcaccatccagctgctggagatcatgaaggcccacggcgtgaagaacctggtgttcagcagcagcgccaccgtgtatggcaacccccagtacctgcccctggatgaggcccaccccaccggcggctgcaccaacccctacggcaagagcaagttcttcatcgaggagatgatccgggacctgtgccaggccgacaagacctggaatgctgtgctgctgcgctacttcaaccccactggagcccacgccagcggctgcattggagaggacccccagggcatccccaacaacctgatgccctacgtgtcccaggtggccatcggcagaagagaggccctgaatgtgtttggaaatgactatgacacagaagatggcaccggggtgcgggactacatccacgtggtggacctggccaagggccacatcgccgccctgaggaagctgaaggagcagtgtggctgccgcatcccctacaaggtggtggcccggcgggagggagatgtggccgcctgctacgccaaccccagcctggcccaggaggagctgggctggacagctgccctgggcctggacaggatgtag

SEQ ID NO: 175378 - DNA, 585 bp, Artificial Sequence
  Description of Artificial Sequence: Synthetic coding sequence
atggccgagaaggtgctggtgactggaggagctggctacatcggcagccacacagtgctggagctgctggaggccggctacctgcctgtggtgattgacaacttccacaatgccttccggggcggcggcagcctgcctgagagcctgcggcgggtgcaggagctgaccggccgctctgtggagtttgaggagatggacatcctggaccagggcgccctgcagaggctcttcaagaagtacagcttcatggccgtcatccactttgctggcctgaaggctgtgggggagagcgtgcagaagcccctggactactacagagtgaacctgaccggcaccatccagctgctggagatcatgaaggcccacggcgtgaagaacctggtgttcagcagcagcgccaccgtgtatggcaacccccagtacctgcccctggatgaggcccaccccaccggcggctgcaccaacccctacggcaagagcaagttcttcatcgaggagatgatccgggacctgtgccaggccgacaagacctggaatgctgtgctgctgcgctacttcaaccccactggagcccacgccagctag

SEQ ID NO: 175379 - DNA, 327 bp, Artificial Sequence
  Description of Artificial Sequence: Synthetic coding sequence
gtggccatcggcagaagagaggccctgaatgtgtttggaaatgactatgacacagaagatggcaccggggtgcgggactacatccacgtggtggacctggccaagggccacatcgccgccctgaggaagctgaaggagcagtgtggctgccgcatcccctacaaggtggtggcccggcgggagggagatgtggccgcctgctacgccaaccccagcctggcccaggaggagctgggctggacagctgccctgggcctggacaggatgtgtgaggacctgtggcgctggcagaagcagaaccccagcggcttcggcacccaggcctag

SEQ ID NO: 175380 - DNA, 1119 bp, Artificial Sequence
  Description of Artificial Sequence: Synthetic coding sequence
atgaagtacctgcggcacagaagaccaaatgccaccctcatcctggccatcggggccttcaccctgctgctcttcagcctgctggtgtccccacccacctgcaaggtgcaggagcagcccccagccatccctgaggccctggcctggcccaccccacccaccaggcctgccccagccccctgccacgccaacacctccatggtgacccacccagactttgccacccagccccagcacgtgcagaacttcctgctgtaccgccactgccgccacttccccctgctgcaggatgtgccccccagcaaatgtgcccagcccgtcttcctgctgctggtgatcaagagcagccccagcaactacgtgcggcgggagctgctgcggaggacctggggccgggagaggaaggtgcggggcctgcagctgcggctgctcttcctggtgggcacagccagcaacccccatgaggccaggaaggtgaaccggctgctggagctggaggcccagacccacggggacatcctgcagtgggacttccatgacagcttcttcaacctgaccctgaagcaggtgctcttcctgcagtggcaggagacccgctgtgccaatgccagctttgtgctgaatggagatgatgatgtgtttgcccacacagacaacatggtgttctacctgcaggaccatgaccccggccgccacctgtttgtgggccagctgatccagaatgtgggccccatccgggccttctggagcaagtactacgtgcctgaggtggtgacccagaatgaaagatacccaccctactgcggcggcggcggcttcctgctgagccgcttcaccgctgctgccctgcggcgggccgcccacgtgctggacatcttccccattgatgatgtgttcctgggcatgtgcctggagctggagggcctgaagccagccagccacagcggcatccgcaccagcggcgtgcgggcccccagccagaggctgagcagctttgacccctgcttctacagagacctgctgctggtgcaccgcttcctgccctatgagatgctgctgatgtgggatgccctgaaccagcccaacctgacctgtggcaaccagacccagatctactag

SEQ ID NO: 175381 - DNA, 1137 bp, Artificial Sequence
  Description of Artificial Sequence: Synthetic coding sequence
atgctgcccccccagcccagcgctgcccaccagggccggggcggccgcagcggcctgctgcccaagggccctgccatgctgtgccgcctgtgctggctggtgtcctacagcctggccgtgctgctgctgggctgcctgctcttcctgaggaaggccgccaagccagctggggaccccacagcccaccagcccttctgggccccacccacccccaggcacagccgctgcccccccaaccacacagtgagcagcgccagcctgagcctgcccagccgccacaggctcttcctgacctaccgccactgcaggaacttcagcatcctgctggagcccagcggctgcagcaaggacaccttcctgctgctggccatcaagagccagcccggccacgtggagaggagagctgccatccgcagcacctggggccgggtgggcggctgggcccggggccggcagctgaagctggtgttcctgctgggcgtggccggcagcgcccccccagcccagctgctggcctatgagagccgggagtttgatgacatcctgcagtgggacttcacagaggacttcttcaacctgaccctgaaggagctgcacctgcagcgctgggtggtggccgcctgcccccaggcccacttcatgctgaagggagatgatgatgtgtttgtgcacgtgcccaacgtgctggagttcctggatggctgggaccctgcccaggacctgctggtgggagatgtgatccggcaggccctgcccaacagaaacaccaaggtgaagtacttcatccccccatccatgtaccgggccacccactacccaccctatgctgggggcggcggctacgtgatgagccgggccaccgtgcggcggctgcaggccatcatggaggatgctgagctgttccccattgatgatgtgtttgtgggcatgtgcctgcggcggctgggcctgagccccatgcaccacgccggcttcaagaccttcggcatcagaagacccctggaccccctggacccctgcctgtaccggggcctgctgctggtgcaccggctgagccccctggagatgtggaccatgtgggccctggtgacagatgagggcctgaagtgtgccgccggccccatcccccagaggtag

SEQ ID NO: 175382 - DNA, 1062 bp, Artificial Sequence
  Description of Artificial Sequence: Synthetic coding sequence
atgctgtgccgcctgtgctggctggtgtcctacagcctggccgtgctgctgctgggctgcctgctcttcctgaggaaggccgccaagccagctggggaccccacagcccaccagcccttctgggccccacccacccccaggcacagccgctgcccccccaaccacacagtgtcctctgccagcctgagcctgcccagccgccacaggctcttcctgacctaccgccactgcaggaacttcagcatcctgctggagcccagcggctgcagcaaggacaccttcctgctgctggccatcaagagccagcccggccacgtggagcggcgggccgccatccgcagcacctggggccgggtgggcggctgggcccggggccggcagctgaagctggtgttcctgctgggcgtggccggcagcgcccccccagcccagctgctggcctatgagagccgggagtttgatgacatcctgcagtgggacttcacagaggacttcttcaacctgaccctgaaggagctgcacctgcagcgctgggtggtggccgcctgcccccaggcccacttcatgctgaagggagatgatgatgtgtttgtgcacgtgcccaacgtgctggagttcctggatggctgggaccctgcccaggacctgctggtgggagatgtgatccggcaggccctgcccaacagaaacaccaaggtgaagtacttcatcccccccagcatgtaccgggccacccactacccaccctatgccggcggcggcggctacgtgatgagccgggccaccgtgcggcggctgcaggccatcatggaggatgctgagctgttccccattgatgatgtgtttgtgggcatgtgcctgcggcggctgggcctgagccccatgcaccacgccggcttcaagaccttcggcatccggcggcccctggaccccctggacccctgcctgtaccggggcctgctgctggtgcaccggctgagccccctggagatgtggaccatgtgggccctggtgacagatgagggcctgaagtgtgccgccggccccatcccccagaggtag

SEQ ID NO: 175383 - DNA, 1062 bp, Artificial Sequence; identical to SEQ ID NO: 175382
  Description of Artificial Sequence: Synthetic coding sequence

SEQ ID NO: 175384 - DNA, 1485 bp, Artificial Sequence
  Description of Artificial Sequence: Synthetic coding sequence
atgtttgagatcaagaagatctgctgcatcggggccggctacgtgggcggccccacctgcagcgtgattgcccacatgtgcccagagatccgggtgacagtggtggatgtgaatgaaagccgcatcaatgcctggaacagccccaccctgcccatctatgagcccggcctgaaggaggtggtggagagctgccggggcaagaacctcttcttcagcaccaacattgatgatgccatcaaggaggccgacctggtgttcatctctgtgaacacccccaccaagacctacggcatgggcaagggccgggctgctgacctgaagtacatcgaggcctgtgcccggcgcatcgtgcagaacagcaatggctacaagatcgtgacagagaagagcacagtgcctgtgcgggctgctgagagcatccgccgcatctttgatgccaacaccaagcccaacctgaacctgcaggtgctgagcaaccctgagttcctggccgagggcacagccatcaaggacctgaagaacccagacagagtgctgattggaggagatgagaccccagagggccagagagctgtgcaggccctgtgtgctgtgtatgagcactgggtgccccgggagaagatcctgaccaccaacacctggagcagcgagctgagcaagctggccgccaatgccttcctggcccagaggatcagcagcatcaacagcatcagcgccctgtgtgaggccaccggggctgatgtggaggaggtggccacagccatcggcatggaccagagaattggcaacaagttcctgaaggcctctgtgggctttggaggcagctgcttccagaaggatgtgctgaacctggtgtacctgtgtgaggccctgaacctgcctgaggtggcccgctactggcagcaggtgattgacatgaatgactaccagaggagaagatttgccagccgcatcatcgacagcctcttcaacacagtgacagacaagaagatcgccatcctgggctttgccttcaagaaggacaccggggacacccgggagagcagcagcatctacatcagcaagtacctgatggatgaaggagcccacctgcacatctatgaccccaaggtgccccgggagcagatcgtggtggacctgagccaccctggggtgtctgaagatgaccaggtgtcccggctggtgaccatcagcaaggacccctatgaggcctgtgatggagcccatgctgtggtgatctgcacagagtgggacatgttcaaggagctggactatgagcgcatccacaagaagatgctgaagccagccttcatctttgatggccggcgggtgctggatggcctgcacaatgagctgcagaccatcggcttccagatcgagaccatcggcaagaaggtgagcagcaagaggatcccctatgcccccagcggggagatccccaagttcagcctgcaggacccccccaacaagaagcccaaggtgtag

SEQ ID NO: 175385 - DNA, 1284 bp, Artificial Sequence
  Description of Artificial Sequence: Synthetic coding sequence
atgtttgagatcaagaagatctgctgcatcggggccggctacgtgggcggccccacctgcagcgtgattgcccacatgtgcccagagatccgggtgacagtggtggatgtgaatgaaagccgcatcaatgcctggaacagccccaccctgcccatctatgagcccggcctgaaggaggtggtggagagctgccggggcaagaacctcttcttcagcaccaacattgatgatgccatcaaggaggccgacctggtgttcatctctgtgctgagcaaccctgagttcctggccgagggcacagccatcaaggacctgaagaacccagacagagtgctgattggaggagatgagaccccagagggccagagagctgtgcaggccctgtgtgctgtgtatgagcactgggtgccccgggagaagatcctgaccaccaacacctggagcagcgagctgagcaagctggccgccaatgccttcctggcccagaggatcagcagcatcaacagcatcagcgccctgtgtgaggccactggagcagatgtggaggaggtggccacagccatcggcatggaccagagaattggcaacaagttcctgaaggcctctgtgggctttggaggcagctgcttccagaaggatgtgctgaacctggtgtacctgtgtgaggccctgaacctgcctgaggtggcccgctactggcagcaggtgattgacatgaatgactaccagaggagaagatttgccagccgcatcatcgacagcctcttcaacacagtgacagacaagaagatcgccatcctgggctttgccttcaagaaggacacaggagacacccgggagagcagcagcatctacatcagcaagtacctgatggatgagggcgcccacctgcacatctatgaccccaaggtgccccgggagcagatcgtggtggacctgagccaccctggggtgtctgaagatgaccaggtgtcccggctggtgaccatcagcaaggacccctatgaggcctgtgatggagcccatgctgtggtgatctgcacagagtgggacatgttcaaggagctggactatgaaagaatccacaagaagatgctgaagccagccttcatctttgatggaagaagagtgctggatggcctgcacaatgagctgcagaccatcggcttccagatcgagaccatcggcaagaaggtgagcagcaagaggatcccctatgcccccagcggggagatccccaagttcagcctgcaggacccccccaacaagaagcccaaggtgtag

SEQ ID NO: 175386 - DNA, 168 bp, Artificial Sequence
  Description of Artificial Sequence: Synthetic coding sequence
atgtttgagatcaagaagatctgctgcatcggggccggctacgtgggcggccccacctgcagcgtgattgcccacatgtgcccagagatccgggtgacagtggtggatgtgaatgaaagccgcatcaatgcctggaacagccccaccctgcccatctatgaggactag

SEQ ID NO: 175387 - DNA, 258 bp, Artificial Sequence
  Description of Artificial Sequence: Synthetic coding sequence
atgtttgagatcaagaagatctgctgcatcggggccggctacgtgggcggccccacctgcagcgtgattgcccacatgtgcccagagatccgggtgacagtggtggatgtgaatgaaagccgcatcaatgcctggaacagccccaccctgcccatctatgagcccggcctgaaggaggtggtggagagctgccggggcaagaacctcttcttcagcaccaacattgatgatgccatcaaggaggccgacctggtgtag

SEQ ID NO: 175388 - DNA, 1485 bp, Artificial Sequence; identical to SEQ ID NO: 175384
  Description of Artificial Sequence: Synthetic coding sequence

SEQ ID NO: 175389 - DNA, 1194 bp, Artificial Sequence
  Description of Artificial Sequence: Synthetic coding sequence
atgggcaagggccgggctgctgacctgaagtacatcgaggcctgtgccaggagaattgtgcagaacagcaatggctacaagatcgtgacagagaagagcacagtgcctgtgcgggctgctgagagcatccgccgcatctttgatgccaacaccaagcccaacctgaacctgcaggtgctgagcaaccctgagttcctggccgagggcacagccatcaaggacctgaagaacccagacagagtgctgattggaggagatgagaccccagagggccagagagctgtgcaggccctgtgtgctgtgtatgagcactgggtgccccgggagaagatcctgaccaccaacacctggagcagcgagctgagcaagctggccgccaatgccttcctggcccagaggatcagcagcatcaacagcatcagcgccctgtgtgaggccactggagcagatgtggaggaggtggccacagccatcggcatggaccagagaattggcaacaagttcctgaaggcctctgtgggctttggaggcagctgcttccagaaggatgtgctgaacctggtgtacctgtgtgaggccctgaacctgcctgaggtggcccgctactggcagcaggtgattgacatgaatgactaccagaggagaagatttgccagccgcatcatcgacagcctcttcaacacagtgacagacaagaagatcgccatcctgggctttgccttcaagaaggacacaggagacacccgggagagcagcagcatctacatcagcaagtacctgatggatgagggcgcccacctgcacatctatgaccccaaggtgccccgggagcagatcgtggtggacctgagccaccctggggtgtctgaagatgaccaggtgtcccggctggtgaccatcagcaaggacccctatgaggcctgtgatggagcccatgctgtggtgatctgcacagagtgggacatgttcaaggagctggactatgaaagaatccacaagaagatgctgaagccagccttcatctttgatggaagaagagtgctggatggcctgcacaatgagctgcagaccatcggcttccagatcgagaccatcggcaagaaggtgagcagcaagaggatcccctatgcccccagcggggagatccccaagttcagcctgcaggacccccccaacaagaagcccaaggtgtag

SEQ ID NO: 175390 - DNA, 393 bp, Artificial Sequence
  Description of Artificial Sequence: Synthetic coding sequence
atgtttgagatcaagaagatctgctgcatcggggccggctacgtgggcggccccacctgcagcgtgattgcccacatgtgcccagagatccgggtgacagtggtggatgtgaatgaaagccgcatcaatgcctggaacagccccaccctgcccatctatgagcccggcctgaaggaggtggtggagagctgccggggcaagaacctcttcttcagcaccaacattgatgatgccatcaaggaggccgacctggtgttcatctctgtgaacacccccaccaagacctacggcatgggcaagggccgggctgctgacctgaagtacatcgaggcctgtgcccggcgcatcgtgcagaacagcaatggctacaagatcgtgacagagaagagctag

SEQ ID NO: 175391 - DNA, 162 bp, Artificial Sequence
  Description of Artificial Sequence: Synthetic coding sequence
atgtttgagatcaagaagatctgctgcatcggggccggctacgtgggcggccccacctgcagcgtgattgcccacatgtgcccagagatccgggtgacagtggtggatgtgaatgaaagccgcatcaatgcctggaacagccccaccctgcccatctactag

SEQ ID NO: 175392 - DNA, 168 bp, Artificial Sequence; identical to SEQ ID NO: 175386
  Description of Artificial Sequence: Synthetic coding sequence

SEQ ID NO: 175393 - DNA, 462 bp, Artificial Sequence
  Description of Artificial Sequence: Synthetic coding sequence
atgtttgagatcaagaagatctgctgcatcggggccggctacgtgggcggccccacctgcagcgtgattgcccacatgtgcccagagatccgggtgacagtggtggatgtgaatgaaagccgcatcaatgcctggaacagccccaccctgcccatctatgagcccggcctgaaggaggtggtggagagctgccggggcaagaacctcttcttcagcaccaacattgatgatgccatcaaggaggccgacctggtgttcatctctgtgaacacccccaccaagacctacggcatgggcaagggccgggctgctgacctgaagtacatcgaggcctgtgcccggcgcatcgtgcagaacagcaatggctacaagatcgtgacagagaagagcacagtgcctgtgcgggctgctgagagcatccgccgcatctttgatgccaacaccaagcccaacctgaactag

SEQ ID NO: 175394 - DNA, 546 bp, Artificial Sequence
  Description of Artificial Sequence: Synthetic coding sequence
atgtggagcagcggcctgctgatccaggacagcaccatcatgtttgagatcaagaagatctgctgcattggagctggctacgtgggcggccccacctgcagcgtcatcgcccacatgtgcccagagatccgggtgacagtggtggatgtgaatgaaagccgcatcaatgcctggaacagccccaccctgcccatctatgagcccggcctgaaggaggtggtggagagctgccggggcaagaacctcttcttcagcaccaacattgatgatgccatcaaggaggccgacctggtgttcatctctgtgaacacccccaccaagacctacggcatgggcaagggccgggctgctgacctgaagtacatcgaggcctgtgccaggagaattgtgcagaacagcaatggctacaagatcgtgacagagaagagcacagtgcctgtgcgggctgctgagagcatccgccgcatctttgatgccaacaccaagcccaacctgaacctgcaggtgctgagcaaccctgagttcctggccgagggcacagcctag

SEQ ID NO: 175395 - DNA, 1185 bp, Artificial Sequence
  Description of Artificial Sequence: Synthetic coding sequence
atggccctgctggacctggccctggagggcatggctgtgtttggatttgtgctcttcctggtgctgtggctgatgcacttcatggccatcatctacacccggctgcacctgaacaagaaggccacagacaagcagccctacagcaagctgcccggggtgtccctgctgaagcccctgaagggcgtggaccccaacctgatcaacaacctggagaccttctttgagctggactaccccaagtatgaggtgctgctgtgtgtgcaggaccatgatgatcctgccattgatgtgtgcaagaagctgctgggcaagtacccaaatgtggatgcccggctcttcatcggcggcaagaaggtgggcatcaaccccaagatcaacaacctgatgcctggctatgaggtggccaagtatgacctgatctggatctgtgacagcggcatccgggtcatcccagacaccctgacagacatggtgaaccagatgacagagaaggtgggcctggtgcacggcctgccctacgtggccgaccggcagggctttgctgccaccctggagcaggtgtacttcggcaccagccacccccgctactacatcagcgccaacgtgacaggcttcaagtgtgtgacaggcatgagctgcctgatgaggaaggatgtgctggaccaggccggcggcctgattgcctttgcccagtacatcgccgaggactacttcatggccaaggccatcgctgaccggggctggaggtttgccatgagcacccaggtggccatgcagaacagcggcagctacagcatcagccagttccagagcaggatgatccgctggaccaagctgcgcatcaacatgctgcctgccaccatcatctgtgagcccatcagtgaatgttttgtggccagcctcatcatcggctgggccgcccaccacgtgttccgctgggacatcatggtgttcttcatgtgccactgcctggcctggttcatctttgactacatccagctgcggggcgtgcagggcggcaccctgtgcttcagcaagctggactatgctgtggcctggttcatccgggagagcatgaccatctacatcttcctgagcgccctgtgggaccccaccatctcctggaggacaggccgctaccgcctgcgctgtggcggcacagctgaggagatcctggatgtgtag

SEQ ID NO: 175396 - DNA, 4668 bp, Artificial Sequence
  Description of Artificial Sequence: Synthetic coding sequence
atgggctgcaagggagatgccagcggggcctgtgccgccggggccctgcctgtgactggagtgtgctacaagatgggcgtgctggtggtgctgactgtgctgtggctgttcagctctgtgaaggctgacagcaaggccatcaccaccagcctgaccaccaagtggttcagcacccccctgctgctggaggccagcgagttcctggccgaggacagccaggagaagttctggaactttgtggaggccagccagaacatcggcagcagtgaccatgatggaacagactacagctactaccacgccatcctggaggccgccttccagttcctgagccccctgcagcagaacctcttcaagttctgcctgagcctgcggagctacagcgccaccatccaggccttccagcagattgctgctgatgagcccccacctgagggctgcaacagcttcttctctgtgcacggcaagaagacctgtgagagtgacaccctggaggccctgctgctgacagccagcgagcggcccaagcccctgctcttcaagggggaccaccgctaccccagcagcaaccctgagagccctgtggtgatcttctacagcgagatcggcagcgaggagttcagcaacttccaccggcagctgatcagcaagagcaatgctgggaagatcaactacgtgttccgccactacatcttcaaccccaggaaggagcctgtgtacctgagcggctacggcgtggagctggccatcaagagcacagagtacaaggccaaggatgacacccaggtgaagggcacagaggtgaacaccaccgtgattggagaaaatgaccccattgatgaggtgcagggcttcctgtttgggaagctgcgggacctgcacccagacctggagggccagctgaaggagctgaggaagcacctggtggagagcaccaatgagatggcccccctgaaggtgtggcagctgcaggacctgtccttccagacagctgcccgcatcctggccagccctgtggagctggccctggtggtgatgaaggacctgagccagaacttccccaccaaggcccgggccatcaccaagacagctgtgtcctctgagctgaggacagaggtggaggagaaccagaagtacttcaagggcaccctgggcctgcagcccggggacagcgccctcttcatcaatggcctgcacatggacctggacacccaggacatcttcagcctgtttgatgtgctgagaaatgaggcccgggtgatggagggcctgcaccggctgggcatcgagggcctgagcctgcacaacgtgctgaagctgaacatccagcccagcgaggccgactatgctgtggacatccgcagccctgccatctcctgggtgaacaacctggaggtggacagccgctacaacagctggcccagcagcctgcaggagctgctgcggcccaccttccctggggtcatccggcagatcaggaagaacctgcacaacatggtgttcatcgtggaccctgcccacgagaccacagctgagctgatgaacacagctgagatgttcctgagcaaccacatccccctgagaattggcttcatctttgtggtgaatgacagtgaagatgtggatggcatgcaggatgctggggtggccgtgctgcgggcctacaactacgtggcccaggaggtggatgactaccacgccttccagaccctgacccacatctacaacaaggtgaggactggagagaaggtgaaggtggagcacgtggtgtctgtgctggagaagaagtacccctacgtggaggtgaacagcatcctgggcatcgacagcgcctatgacaggaacaggaaggaggcccggggctactatgagcagacaggagtgggccccctgcctgtggtgctcttcaacggcatgccctttgagcgggagcagctggaccctgatgagctggagaccatcaccatgcacaagatcctggagaccaccaccttcttccagagagctgtgtacctgggggagctgccccatgaccaggatgtggtggagtacatcatgaaccagcccaacgtggtgccccgcatcaacagccgcatcctgacagctgagcgggactacctggacctgacagccagcaacaacttctttgtggatgattatgcccgcttcaccatcctggacagccagggcaagacagctgctgtggccaacagcatgaactacctgaccaagaagggcatgagcagcaaggagatctatgatgacagcttcatccggcctgtgaccttctggatcgtgggggactttgacagccccagcggccggcagctgctgtatgatgccatcaagcaccagaagagcagcaacaacgtgcgcatctccatgatcaacaacccagccaaggagatctcctatgagaacacccagatcagccgggccatctgggccgccctgcagacccagaccagcaatgctgccaagaacttcatcaccaagatggccaaggagggcgctgctgaggccctggccgccggggctgacattgctgagttctctgtgggcggcatggacttcagcctcttcaaggaggtgtttgagagcagcaagatggacttcatcctgagccatgctgtgtactgcagagatgtgctgaagctgaagaagggccagagagctgtgatcagcaatggccgcatcatcggccccctggaggacagcgagctgttcaaccaggatgacttccacctgctggagaacatcatcctgaagaccagcggccagaagatcaagagccacatccagcagctgcgggtggaggaggatgtggccagtgacctggtgatgaaggtggatgccctgctgagcgcccagcccaagggggacccccgcatcgagtaccagttctttgaggacagacacagcgccatcaagctgcggcccaaggagggggagacctactttgatgtggtggccgtggtggaccctgtgacccgggaggcccagaggctggcccccctgctgctggtgctggcccagctgatcaacatgaacctgcgggtcttcatgaactgccagagcaagctgagtgacatgcccctgaagagcttctaccgctacgtgctggagcctgagatctccttcaccagtgacaacagctttgccaagggccccatcgccaagttcctggacatgccccagagccccctcttcaccctgaacctgaacaccccagagagctggatggtggagagcgtgaggaccccctatgacctggacaacatctacctggaggaggtggacagcgtggtggccgcagaatatgagctggagtacctgctgctggagggccactgctatgacatcaccaccggccagcccccccggggcctgcagttcaccctgggcaccagcgccaaccctgtgattgtggacaccatcgtgatggccaacctgggctacttccagctgaaggccaaccctggggcctggatcctgcggctgaggaagggccgctctgaggacatctaccgcatctacagccatgatggaacagacagccccccagatgctgatgaggtggtgattgtgctgaacaacttcaagagcaagatcatcaaggtgaaggtgcagaagaaggctgacatggtgaatgaagacctgctgagtgatggcaccagtgaaaatgaaagtggcttctgggacagcttcaagtggggcttcaccggccagaagacagaggaggtgaagcaggacaaggatgacatcatcaacatcttctctgtggccagcggccacctgtatgagcgcttcctgcgcatcatgatgctgtctgtgctgaagaacaccaagacccctgtgaagttctggttcctgaagaactacctgagccccaccttcaaggagttcatcccctacatggccaatgagtacaacttccagtatgagctggtgcagtacaagtggccccgctggctgcaccagcagacagagaagcagaggatcatctggggctacaagatcctcttcctggatgtgctcttccccctggtggtggacaagttcctgtttgtggatgctgaccagatcgtgaggacagacctgaaggagctgcgggacttcaacctggatggagccccctacggctacacccccttctgtgacagcagaagagagatggatggctaccgcttctggaagagcggctactgggccagccacctggccggcaggaagtaccacatcagcgccctgtatgtggtggacctgaagaagttcaggaagattgctgctggggaccggctgcggggccagtaccagggcctgagccaggaccccaacagcctgagcaacctggaccaggacctgcccaacaacatgatccaccaggtgcccatcaagagcctgccccaggagtggctgtggtgtgagacctggtgtgatgatgccagcaagaagagggccaagaccatcgacctgtgcaacaaccccatgaccaaggagcccaagctggaggccgctgtgagaattgtgcctgagtggcaggactatgaccaggagatcaagcagctgcagatccgcttccagaaggagaaggagactggagccctgtacaaggagaagaccaaggagcccagccgggagggcccccagaagcgggaggagctgtag

SEQ ID NO: 175397 - DNA, 4596 bp, Artificial Sequence
  Description of Artificial Sequence: Synthetic coding sequence
atgggcgtgctggtggtgctgactgtgctgtggctgttcagctctgtgaaggctgacagcaaggccatcaccaccagcctgaccaccaagtggttcagcacccccctgctgctggaggccagcgagttcctggccgaggacagccaggagaagttctggaactttgtggaggccagccagaacatcggcagcagtgaccatgatggaacagactacagctactaccacgccatcctggaggccgccttccagttcctgagccccctgcagcagaacctcttcaagttctgcctgagcctgcggagctacagcgccaccatccaggccttccagcagattgctgctgatgagcccccacctgagggctgcaacagcttcttctctgtgcacggcaagaagacctgtgagagtgacaccctggaggccctgctgctgacagccagcgagcggcccaagcccctgctcttcaagggggaccaccgctaccccagcagcaaccctgagagccctgtggtgatcttctacagcgagatcggcagcgaggagttcagcaacttccaccggcagctgatcagcaagagcaatgctgggaagatcaactacgtgttccgccactacatcttcaaccccaggaaggagcctgtgtacctgagcggctacggcgtggagctggccatcaagagcacagagtacaaggccaaggatgacacccaggtgaagggcacagaggtgaacaccaccgtgattggagaaaatgaccccattgatgaggtgcagggcttcctgtttgggaagctgcgggacctgcacccagacctggagggccagctgaaggagctgaggaagcacctggtggagagcaccaatgagatggcccccctgaaggtgtggcagctgcaggacctgtccttccagacagctgcccgcatcctggccagccctgtggagctggccctggtggtgatgaaggacctgagccagaacttccccaccaaggcccgggccatcaccaagacagctgtgtcctctgagctgaggacagaggtggaggagaaccagaagtacttcaagggcaccctgggcctgcagcccggggacagcgccctcttcatcaatggcctgcacatggacctggacacccaggacatcttcagcctgtttgatgtgctgagaaatgaggcccgggtgatggagggcctgcaccggctgggcatcgagggcctgagcctgcacaacgtgctgaagctgaacatccagcccagcgaggccgactatgctgtggacatccgcagccctgccatctcctgggtgaacaacctggaggtggacagccgctacaacagctggcccagcagcctgcaggagctgctgcggcccaccttccctggggtcatccggcagatcaggaagaacctgcacaacatggtgttcatcgtggaccctgcccacgagaccacagctgagctgatgaacacagctgagatgttcctgagcaaccacatccccctgagaattggcttcatctttgtggtgaatgacagtgaagatgtggatggcatgcaggatgctggggtggccgtgctgcgggcctacaactacgtggcccaggaggtggatgactaccacgccttccagaccctgacccacatctacaacaaggtgaggactggagagaaggtgaaggtggagcacgtggtgtctgtgctggagaagaagtacccctacgtggaggtgaacagcatcctgggcatcgacagcgcctatgacaggaacaggaaggaggcccggggctactatgagcagacaggagtgggccccctgcctgtggtgctcttcaacggcatgccctttgagcgggagcagctggaccctgatgagctggagaccatcaccatgcacaagatcctggagaccaccaccttcttccagagagctgtgtacctgggggagctgccccatgaccaggatgtggtggagtacatcatgaaccagcccaacgtggtgccccgcatcaacagccgcatcctgacagctgagcgggactacctggacctgacagccagcaacaacttctttgtggatgattatgcccgcttcaccatcctggacagccagggcaagacagctgctgtggccaacagcatgaactacctgaccaagaagggcatgagcagcaaggagatctatgatgacagcttcatccggcctgtgaccttctggatcgtgggggactttgacagccccagcggccggcagctgctgtatgatgccatcaagcaccagaagagcagcaacaacgtgcgcatctccatgatcaacaacccagccaaggagatctcctatgagaacacccagatcagccgggccatctgggccgccctgcagacccagaccagcaatgctgccaagaacttcatcaccaagatggccaaggagggcgctgctgaggccctggccgccggggctgacattgctgagttctctgtgggcggcatggacttcagcctcttcaaggaggtgtttgagagcagcaagatggacttcatcctgagccatgctgtgtactgcagagatgtgctgaagctgaagaagggccagagagctgtgatcagcaatggccgcatcatcggccccctggaggacagcgagctgttcaaccaggatgacttccacctgctggagaacatcatcctgaagaccagcggccagaagatcaagagccacatccagcagctgcgggtggaggaggatgtggccagtgacctggtgatgaaggtggatgccctgctgagcgcccagcccaagggggacccccgcatcgagtaccagttctttgaggacagacacagcgccatcaagctgcggcccaaggagggggagacctactttgatgtggtggccgtggtggaccctgtgacccgggaggcccagaggctggcccccctgctgctggtgctggcccagctgatcaacatgaacctgcgggtcttcatgaactgccagagcaagctgagtgacatgcccctgaagagcttctaccgctacgtgctggagcctgagatctccttcaccagtgacaacagctttgccaagggccccatcgccaagttcctggacatgccccagagccccctcttcaccctgaacctgaacaccccagagagctggatggtggagagcgtgaggaccccctatgacctggacaacatctacctggaggaggtggacagcgtggtggccgcagaatatgagctggagtacctgctgctggagggccactgctatgacatcaccaccggccagcccccccggggcctgcagttcaccctgggcaccagcgccaaccctgtgattgtggacaccatcgtgatggccaacctgggctacttccagctgaaggccaaccctggggcctggatcctgcggctgaggaagggccgctctgaggacatctaccgcatctacagccatgatggaacagacagccccccagatgctgatgaggtggtgattgtgctgaacaacttcaagagcaagatcatcaaggtgaaggtgcagaagaaggctgacatggtgaatgaagacctgctgagtgatggcaccagtgaaaatgaaagtggcttctgggacagcttcaagtggggcttcaccggccagaagacagaggaggtgaagcaggacaaggatgacatcatcaacatcttctctgtggccagcggccacctgtatgagcgcttcctgcgcatcatgatgctgtctgtgctgaagaacaccaagacccctgtgaagttctggttcctgaagaactacctgagccccaccttcaaggagttcatcccctacatggccaatgagtacaacttccagtatgagctggtgcagtacaagtggccccgctggctgcaccagcagacagagaagcagaggatcatctggggctacaagatcctcttcctggatgtgctcttccccctggtggtggacaagttcctgtttgtggatgctgaccagatcgtgaggacagacctgaaggagctgcgggacttcaacctggatggagccccctacggctacacccccttctgtgacagcagaagagagatggatggctaccgcttctggaagagcggctactgggccagccacctggccggcaggaagtaccacatcagcgccctgtatgtggtggacctgaagaagttcaggaagattgctgctggggaccggctgcggggccagtaccagggcctgagccaggaccccaacagcctgagcaacctggaccaggacctgcccaacaacatgatccaccaggtgcccatcaagagcctgccccaggagtggctgtggtgtgagacctggtgtgatgatgccagcaagaagagggccaagaccatcgacctgtgcaacaaccccatgaccaaggagcccaagctggaggccgctgtgagaattgtgcctgagtggcaggactatgaccaggagatcaagcagctgcagatccgcttccagaaggagaaggagactggagccctgtacaaggagaagaccaaggagcccagccgggagggcccccagaagcgggaggagctgtag

SEQ ID NO: 175398 - DNA, 843 bp, Artificial Sequence
  Description of Artificial Sequence: Synthetic coding sequence
atggccccagccaaggccaccaacgtggtgcggctgctgctgggcagcacagccctgtggctgagccagctgggcagcggcaccgtggccgccagcaagtctgtgacagcccacctggccgccaagtggccagagacccccctgctgctggaggccagcgagttcatggccgaggagagcaatgagaagttctggcagttcctggagaccgtgcaggagctggccatctacaagcagacagaaagtgactacagctactacaacctgatcctgaagaaggccggccagttcctggacaacctgcacatcaacctgctgaagtttgccttcagcatccgggcctacagccctgccatccagatgttccagcagattgctgctgatgagcccccaccagatggctgcaatgcctttgtggtgatccacaagaagcacacctgcaagatcaatgagatcaagaagctgctgaagaaggccgccagcaggacccggccctacctgttcaagggggaccacaagttccccaccaacaaggagaacctgcctgtggtgatcctgtatgcagagatgggcaccaggaccttcagcgccttccacaaggtgctgtctgagaaggcccagaatgaggagatcctgtatgtgctgcggcactacatccagaagcccagcagcaggaagatgtacctgagcggctacggcgtggagctggccatcaagagcacagagtacaaggccctggatgacacccaggtgaagacagtgaccaacaccaccgtggaggatgaaacagagaccaatgaggtgcagggcttcctgtttgggaagctgaagctggtgtactag

SEQ ID NO: 175399 - DNA, 837 bp, Artificial Sequence
  Description of Artificial Sequence: Synthetic coding sequence
atggccccagccaaggccaccaacgtggtgcggctgctgctgggcagcacagccctgtggctgagccagctgggcagcggcaccgtggccgccagcaagtctgtgacagcccacctggccgccaagtggccagagacccccctgctgctggaggccagcgagttcatggccgaggagagcaatgagaagttctggcagttcctggagaccgtgcaggagctggccatctacaagcagacagaaagtgactacagctactacaacctgatcctgaagaaggccggccagttcctggacaacctgcacatcaacctgctgaagtttgccttcagcatccgggcctacagccctgccatccagatgttccagcagattgctgctgatgagcccccaccagatggctgcaatgcctttgtggtgatccacaagaagcacacctgcaagatcaatgagatcaagaagctgctgaagaaggccgccagcaggacccggccctacctgttcaagggggaccacaagttccccaccaacaaggagaacctgcctgtggtgatcctgtatgcagagatgggcaccaggaccttcagcgccttccacaaggtgctgtctgagaaggcccagaatgaggagatcctgtatgtgctgcggcactacatccagaagcccagcagcaggaagatgtacctgagcggctacggcgtggagctggccatcaagagcacagagtacaaggccctggatgacacccaggtgaagacagtgaccaacaccaccgtggaggatgaaacagagaccaatgaggtgcagggcttcctgtttgggaagctgaagagctag

SEQ ID NO: 175400 - DNA, 786 bp, Artificial Sequence
  Description of Artificial Sequence: Synthetic coding sequence
atggccccagccaaggccaccaacgtggtgcggctgctgctgggcagcacagccctgtggctgagccagctgggcagcggcaccgtggccgccagcaagtctgtgacagcccacctggccgccaagtggccagagacccccctgctgctggaggccagcgagttcatggccgaggagagcaatgagaagttctggcagttcctggagaccgtgcaggagctggccatctacaagcagacagaaagtgactacagctactacaacctgatcctgaagaaggccggccagttcctggacaacctgcacatcaacctgctgaagtttgccttcagcatccgggcctacagccctgccatccagatgttccagcagattgctgctgatgagcccccaccagatggctgcaatgcctttgtggtgatccacaagaagcacacctgcaagatcaatgagatcaagaagctgctgaagaaggccgccagcaggacccggccctacctgttcaagggggaccacaagttccccaccaacaaggagaacctgcctgtggtgatcctgtatgcagagatgggcaccaggaccttcagcgccttccacaaggtgctgtctgagaaggcccagaatgaggagatcctgtatgtgctgcggcactacatccagaagcccagcagcaggaagatgtacctgagcggctacggcgtggagctggccatcaagagcacagagtacaaggccctggatgacacccaggtgaaggtgttccaggaccctgaggccttcttctag

SEQ ID NO: 175401 - DNA, 4551 bp, Artificial Sequence
  Description of Artificial Sequence: Synthetic coding sequence
atggccccagccaaggccaccaacgtggtgcggctgctgctgggcagcacagccctgtggctgagccagctgggcagcggcaccgtggccgccagcaagtctgtgacagcccacctggccgccaagtggccagagacccccctgctgctggaggccagcgagttcatggccgaggagagcaatgagaagttctggcagttcctggagaccgtgcaggagctggccatctacaagcagacagaaagtgactacagctactacaacctgatcctgaagaaggccggccagttcctggacaacctgcacatcaacctgctgaagtttgccttcagcatccgggcctacagccctgccatccagatgttccagcagattgctgctgatgagcccccaccagatggctgcaatgcctttgtggtgatccacaagaagcacacctgcaagatcaatgagatcaagaagctgctgaagaaggccgccagcaggacccggccctacctgttcaagggggaccacaagttccccaccaacaaggagaacctgcctgtggtgatcctgtatgcagagatgggcaccaggaccttcagcgccttccacaaggtgctgtctgagaaggcccagaatgaggagatcctgtatgtgctgcggcactacatccagaagcccagcagcaggaagatgtacctgagcggctacggcgtggagctggccatcaagagcacagagtacaaggccctggatgacacccaggtgaagacagtgaccaacaccaccgtggaggatgaaacagagaccaatgaggtgcagggcttcctgtttgggaagctgaaggagatctacagcgacctgcgggacaacctgacagccttccagaagtacctgattgagagcaacaagcagatgatgcccctgaaggtgtgggagctgcaggacctgtccttccaggccgccagccagatcatgtctgcccctgtgtatgacagcatcaagctgatgaaggacatcagccagaacttccccatcaaggcccggagcctgaccagaattgctgtgaaccagcacatgagggaggagatcaaggagaaccagaaggacctgcaggtgcgcttcaagatccagcctggagatgcccggctcttcatcaatggcctgcgggtggacatggatgtgtatgatgccttcagcatcctggacatgctgaagctggagggcaagatgatgaatggcctgaggaacctgggcatcaacggggaggacatgagcaagttcctgaagctgaacagccacatctgggagtacacctacgtgctggacatccgccacagcagcatcatgtggatcaatgacctggagaatgatgacctgtacatcacctggcccaccagctgccagaagctgctgaagcctgtgtttcctggctctgtgcccagcatcagaagaaacttccacaacctggtgctcttcattgatcctgcccaggagtacaccctggacttcatcaagctggctgatgtgttctacagccatgaggtgcccctgagaattggatttgtgttcatcctgaacacagatgatgaggtggatggagccaatgatgctggggtggccctgtggagggccttcaactacatcgccgaggagtttgacatcagcgaggccttcatcagcatcgtgcacatgtaccagaaggtgaagaaggaccagaacatcctgactgtggacaacgtgaagtctgtgctgcagaacaccttcccccacgccaacatctgggacatcctgggcatccacagcaaatatgatgaggagaggaaggccggggccagcttctacaagatgacaggcctgggccccctgccccaggccctgtacaacggggagcccttcaagcatgaggagatgaacatcaaggagctgaagatggctgtgctgcagaggatgatggatgcctctgtgtacctgcagcgggaggtgttcctgggcaccctgaatgacaggaccaatgccatcgacttcctgatggacagaaataatgtggtgccccgcatcaacaccctcatcctgcggaccaaccagcagtacctgaacctgatcagcacctctgtgacagcagatgtggaggacttcagcaccttcttcttcctggacagccaggacaagtctgctgtgattgccaagaacatgtactacctgacccaggatgatgagagcatcatctctgctgtgaccctgtggatcatcgctgactttgacaagcccagcggcaggaagctgctcttcaatgccctgaagcacatgaagacctctgtgcacagccggctgggcatcatctacaaccccaccagcaagatcaatgaggagaacacagccatcagccggggcatcctggccgccttcctgacccagaagaacatgttcctgcggagcttcctgggccagctggccaaggaggagatcgccacagccatctacagcggggacaagatcaagaccttcctgattgagggcatggacaagaatgcctttgagaagaagtacaacacagtgggcgtgaacatcttccgcacccaccagctgttctgccaggatgtgctgaagctgcggcctggagagatgggcatcgtgtccaatggccgcttcctgggccccctggatgaggacttctatgcagaggacttctacctgctggagaagatcaccttcagcaacctgggggagaagatcaagggcatcgtggagaacatgggcatcaatgccaacaacatgtctgacttcatcatgaaggtggatgccctgatgagctctgtgcccaagagggccagccgctatgatgtgaccttcctgcgggagaaccacagcgtcatcaagaccaacccccaggagaatgacatgttcttcaacgtcatcgccatcgtggaccccctgacccgggaggcccagaagatggcccagctgctggtggtgctgggcaagatcatcaacatgaagatcaagctgttcatgaactgccggggccgcctgtctgaggcccccctggagagcttctacagatttgtgctggagcctgagctgatgtctggggccaatgatgtgagcagcctgggccctgtggccaagttcctggacatccctgagagccccctgctgatcctgaacatgatcaccccagagggctggctggtggagaccgtgcacagcaactgtgacctggacaacatccacctgaaggacacagagaagacagtgacagcagaatatgagctggagtacctgctgctggagggccagtgctttgacaaggtgacagagcagcccccccggggcctgcagttcaccctgggcaccaagaacaagccagctgtggtggacaccatcgtgatggcccaccacggctacttccagctgaaggccaaccctggggcctggatcctgcggctgcaccagggcaagtctgaggacatctaccagatcgtgggccacgagggcacagacagccaggccgacctggaggacatcatcgtggtgctgaacagcttcaagagcaagatcctgaaggtgaaggtgaagaaggagacagacaagatcaaggaggacatcctgacagatgaagatgagaagaccaagggcctgtgggacagcatcaagagcttcaccgtgtccctgcacaaggagaacaagaaggagaaggatgtgctgaacatcttctctgtggccagcggccacctgtatgagcgcttcctgcgcatcatgatgctgtctgtgctgaggaacaccaagacccctgtgaagttctggctgctgaagaactacctgagccccaccttcaaggaggtgatcccccacatggccaaggagtatggcttccgctatgagctggtgcagtaccgctggccccgctggctgcggcagcagacagagcggcagaggatcatctggggctacaagatcctcttcctggatgtgctcttccccctggccgtggacaagatcatctttgtggatgctgaccagatcgtgagacatgacctgaaggagctgcgggactttgacctggatggagccccctacggctacacccccttctgtgacagccggcgggagatggatggctaccgcttctggaagacaggctactgggccagccacctgctgcggaggaagtaccacatcagcgccctgtatgtggtggacctgaagaagttcagaagaattggagctggggaccggctgcggagccagtaccaggccctgagccaggaccccaacagcctgagcaacctggaccaggacctgcccaacaacatgatctaccaggtggccatcaagagcctgccccaggactggctgtggtgtgagacctggtgtgatgatgagagcaagcagagggccaagaccatcgacctgtgcaacaaccccaagaccaaggagagcaagctgaaggctgctgcccgcatcgtgcctgagtgggtggagtatgatgctgagatccggcagctgctggaccacctggagaacaagaagcaggacaccatcctgacccatgatgagctgtag

SEQ ID NO: 175402 - DNA, 1119 bp, Artificial Sequence
  Description of Artificial Sequence: Synthetic coding sequence
atggccccagccaaggccaccaacgtggtgcggctgctgctgggcagcacagccctgtggctgagccagctgggcagcggcaccgtggccgccagcaagtctgtgacagcccacctggccgccaagtggccagagacccccctgctgctggaggccagcgagttcatggccgaggagagcaatgagaagttctggcagttcctggagaccgtgcaggagctggccatctacaagcagacagaaagtgactacagctactacaacctgatcctgaagaaggccggccagttcctggacaacctgcacatcaacctgctgaagtttgccttcagcatccgggcctacagccctgccatccagatgttccagcagattgctgctgatgagcccccaccagatggctgcaatgcctttgtggtgatccacaagaagcacacctgcaagatcaatgagatcaagaagctgctgaagaaggccgccagcaggacccggccctacctgttcaagggggaccacaagttccccaccaacaaggagaacctgcctgtggtgatcctgtatgcagagatgggcaccaggaccttcagcgccttccacaaggtgctgtctgagaaggcccagaatgaggagatcctgtatgtgctgcggcactacatccagaagcccagcagcaggaagatgtacctgagcggctacggcgtggagctggccatcaagagcacagagtacaaggccctggatgacacccaggtgaagacagtgaccaacaccaccgtggaggatgaaacagagaccaatgaggtgcagggcttcctgtttgggaagctgaaggagatctacagcgacctgcgggacaacctgacagccttccagaagtacctgattgagagcaacaagcagatgatgcccctgaaggtgtgggagctgcaggacctgtccttccaggccgccagccagatcatgtctgcccctgtgtatgacagcatcaagctgatgaaggacatcagccagaacttccccatcaaggcccggctgaggatgaacatcctgatctgcctcttccagagcaccctgaatgtgaagaacctgcggagccgccacctgtacaacaagacctag

SEQ ID NO: 175403 - DNA, 1527 bp, Artificial Sequence
  Description of Artificial Sequence: Synthetic coding sequence
atgagcagatttgtgcaggacctgagcaaggccatgagccaggatggagccagccagttccaggaggtgatccggcaggagctggagctgtctgtgaagaaggagctggagaagatcctgaccacagccagcagccatgaatttgagcacaccaagaaggacctggatggcttcaggaagctgttccaccgcttcctgcaggagaagggccccagcgtggactggggcaagatccagaggcccccagaagattccatccagccctatgagaagatcaaggcccggggcctgcctgacaacatcagctctgtgctgaacaagctggtggtggtgaagctgaatggaggcctgggcacctccatgggctgcaagggccccaagagcctcatcggcgtgagaaatgaaaacaccttcctggacctgactgtgcagcagatcgagcacctgaacaagacctacaacacagatgtgcccctggtgctgatgaacagcttcaacacagatgaggacaccaagaagatcctgcagaagtacaaccactgccgggtgaagatctacaccttcaaccagagccgctacccccgcatcaacaaggagagcctgctgcctgtggccaaggatgtgtcctacagcggagaaaatacagaggcctggtacccacctggccatggagacatctatgccagcttctacaacagcggcctgctggacaccttcatcggggagggcaaggagtacatctttgtgagcaacatcgacaacctgggcgccaccgtggacctgtacatcctgaaccacctgatgaacccccccaacgggaagagatgtgaatttgtgatggaggtgaccaacaagaccagggcagatgtgaagggcggcaccctgacccagtatgagggcaagctgcggctggtggagatcgcccaggtgcccaaggcccacgtggatgagttcaagtctgtgtccaagttcaagatcttcaacaccaacaacctgtggatcagcctggccgctgtgaagaggctgcaggagcagaatgccatcgacatggagatcatcgtgaatgccaagaccctggatggcggcctgaatgtcatccagctggagacagctgtgggcgccgccatcaagagctttgagaacagcctgggcatcaacgtgcccaggagccgcttcctgcctgtgaagaccaccagtgacctgctgctggtgatgagcaacctgtacagcctgaatgccggcagcctgaccatgtctgagaagcgggagttccccaccgtgcccctggtgaagctgggcagcagcttcaccaaggtgcaggactacctgcggagatttgagagcatcccagacatgctggagctggaccacctgactgtgtctggagatgtgaccttcggcaagaatgtgtccctgaagggcaccgtcatcatcatcgccaaccacggggacagaattgacatccccccaggagctgtgctggagaacaagatcgtgtctggcaacctgcgcatcctggaccactag

SEQ ID NO: 175404 - DNA, 1494 bp, Artificial Sequence
  Description of Artificial Sequence: Synthetic coding sequence
atgagccaggatggagccagccagttccaggaggtgatccggcaggagctggagctgtctgtgaagaaggagctggagaagatcctgaccacagccagcagccatgaatttgagcacaccaagaaggacctggatggcttcaggaagctgttccaccgcttcctgcaggagaagggccccagcgtggactggggcaagatccagaggcctcctgaggacagcatccagccctatgagaagatcaaggcccggggcctgcctgacaacatcagctctgtgctgaacaagctggtggtggtgaagctgaatggaggcctgggcacctccatgggctgcaagggccccaagagcctgattggagtgagaaatgaaaacaccttcctggacctgactgtgcagcagatcgagcacctgaacaagacctacaacacagatgtgcccctggtgctgatgaacagcttcaacacagatgaggacaccaagaagatcctgcagaagtacaaccactgccgggtgaagatctacaccttcaaccagagccgctacccccgcatcaacaaggagagcctgctgcctgtggccaaggatgtgtcctacagcggggagaacacagaggcctggtacccacctggccacggggacatctatgccagcttctacaacagcggcctgctggacaccttcatcggggagggcaaggagtacatctttgtgagcaacatcgacaacctgggcgccaccgtggacctgtacatcctgaaccacctgatgaaccccccaaatggcaagagatgtgaatttgtgatggaggtgaccaacaagaccagggcagatgtgaagggcggcaccctgacccagtatgagggcaagctgcggctggtggagatcgcccaggtgcccaaggcccacgtggatgagttcaagtctgtgtccaagttcaagatcttcaacaccaacaacctgtggatcagcctggccgctgtgaagaggctgcaggagcagaatgccatcgacatggagatcatcgtgaatgccaagaccctggatggcggcctgaatgtcatccagctggagacagctgtgggcgccgccatcaagagctttgagaacagcctgggcatcaacgtgcccaggagccgcttcctgcctgtgaagaccaccagtgacctgctgctggtgatgagcaacctgtacagcctgaatgccggcagcctgaccatgtctgagaagcgggagttccccaccgtgcccctggtgaagctgggcagcagcttcaccaaggtgcaggactacctgcggagatttgagagcatcccagacatgctggagctggaccacctgactgtgtctggagatgtgaccttcggcaagaatgtgtccctgaagggcaccgtcatcatcatcgccaaccacggggacagaattgacatccccccaggagctgtgctggagaacaagatcgtgtctggcaacctgcgcatcctggaccactag

SEQ ID NO: 175405 - DNA, 1554 bp, Artificial Sequence
  Description of Artificial Sequence: Synthetic coding sequence
atgctgctgtacccagctggcttctcctttgccagcctgaagagtgacctgagcaaggccatgagccaggatggagccagccagttccaggaggtgatccggcaggagctggagctgtctgtgaagaaggagctggagaagatcctgaccacagccagcagccatgaatttgagcacaccaagaaggacctggatggcttcaggaagctgttccaccgcttcctgcaggagaagggccccagcgtggactggggcaagatccagaggcctcctgaggacagcatccagccctatgagaagatcaaggcccggggcctgcctgacaacatcagctctgtgctgaacaagctggtggtggtgaagctgaatggaggcctgggcacctccatgggctgcaagggccccaagagcctgattggagtgagaaatgaaaacaccttcctggacctgactgtgcagcagatcgagcacctgaacaagacctacaacacagatgtgcccctggtgctgatgaacagcttcaacacagatgaggacaccaagaagatcctgcagaagtacaaccactgccgggtgaagatctacaccttcaaccagagccgctacccccgcatcaacaaggagagcctgctgcctgtggccaaggatgtgtcctacagcggggagaacacagaggcctggtacccacctggccacggggacatctatgccagcttctacaacagcggcctgctggacaccttcatcggggagggcaaggagtacatctttgtgagcaacatcgacaacctgggcgccaccgtggacctgtacatcctgaaccacctgatgaaccccccaaatggcaagagatgtgaatttgtgatggaggtgaccaacaagaccagggcagatgtgaagggcggcaccctgacccagtatgagggcaagctgcggctggtggagatcgcccaggtgcccaaggcccacgtggatgagttcaagtctgtgtccaagttcaagatcttcaacaccaacaacctgtggatcagcctggccgctgtgaagaggctgcaggagcagaatgccatcgacatggagatcatcgtgaatgccaagaccctggatggcggcctgaatgtcatccagctggagacagctgtgggcgccgccatcaagagctttgagaacagcctgggcatcaacgtgcccaggagccgcttcctgcctgtgaagaccaccagtgacctgctgctggtgatgagcaacctgtacagcctgaatgccggcagcctgaccatgtctgagaagcgggagttccccaccgtgcccctggtgaagctgggcagcagcttcaccaaggtgcaggactacctgcggagatttgagagcatcccagacatgctggagctggaccacctgactgtgtctggagatgtgaccttcggcaagaatgtgtccctgaagggcaccgtcatcatcatcgccaaccacggggacagaattgacatccccccaggagctgtgctggagaacaagatcgtgtctggcaacctgcgcatcctggaccactag

SEQ ID NO: 175406 - DNA, 1494 bp, Artificial Sequence; identical to SEQ ID NO: 175404
  Description of Artificial Sequence: Synthetic coding sequence

SEQ ID NO: 175407 - DNA, 453 bp, Artificial Sequence
  Description of Artificial Sequence: Synthetic coding sequence
atgagccaggatggagccagccagttccaggaggtgatccggcaggagctggagctgtctgtgaagaaggagctggagaagatcctgaccacagccagcagccatgaatttgagcacaccaagaaggacctggatggcttcaggaagctgttccaccgcttcctgcaggagaagggccccagcgtggactggggcaagatccagaggcctcctgaggacagcatccagccctatgagaagatcaaggcccggggcctgcctgacaacatcagctctgtgctgaacaagctggtggtggtgaagctgaatggaggcctgggcacctccatgggctgcaagggccccaagagcctgattggagtgagaaatgaaaacaccttcctggacctgactgtgcagcagatcgagcacctgaacaagacctacaacacagatgtgcccctggtgctgtag

SEQ ID NO: 175408 - DNA, 516 bp, Artificial Sequence
  Description of Artificial Sequence: Synthetic coding sequence
atgagccaggatggagccagccagttccaggaggtgatccggcaggagctggagctgtctgtgaagaaggagctggagaagatcctgaccacagccagcagccatgaatttgagcacaccaagaaggacctggatggcttcaggaagctgttccaccgcttcctgcaggagaagggccccagcgtggactggggcaagatccagaggcctcctgaggacagcatccagccctatgagaagatcaaggcccggggcctgcctgacaacatcagctctgtgctgaacaagctggtggtggtgaagctgaatggaggcctgggcacctccatgggctgcaagggccccaagagcctgattggagtgagaaatgaaaacaccttcctggacctgactgtgcagcagatcgagcacctgaacaagacctacaacacagatgtgcccctggtgctgatgaacagcttcaacacagatgaggacaccaagaagatcctgcagaagtacaaccactgcaggtag

SEQ ID NO: 175409 - DNA, 117 bp, Artificial Sequence
  Description of Artificial Sequence: Synthetic coding sequence
atgagccaggatggagccagccagttccaggaggtgatccggcaggagctggagctgtctgtgaagaaggagctggagaagatcctgaccacagccagcagccatgaatttgaatag

SEQ ID NO: 175410 - DNA, 318 bp, Artificial Sequence
  Description of Artificial Sequence: Synthetic coding sequence
atgagccaggatggagccagccagttccaggaggtgatccggcaggagctggagctgtctgtgaagaaggagctggagaagatcctgaccacagccagcagccatgaatttgagcacaccaagaaggacctggatggcttcaggaagctgttccaccgcttcctgcaggagaagggccccagcgtggactggggcaagatccagaggcctcctgaggacagcatccagccctatgagaagatcaaggcccggggcctgcctgacaacatcagctctgtgctgaacaagctggtggtggtgaagctgaatggaggatag

SEQ ID NO: 175411 - DNA, 150 bp, Artificial Sequence
  Description of Artificial Sequence: Synthetic coding sequence
atgagcagatttgtgcaggacctgagcaaggccatgagccaggatggagccagccagttccaggaggtgatccggcaggagctggagctgtctgtgaagaaggagctggagaagatcctgaccacagccagcagccatgaatttgaatag

SEQ ID NO: 175412 - DNA, 408 bp, Artificial Sequence
  Description of Artificial Sequence: Synthetic coding sequence
atgagccaggatggagccagccagttccaggaggtgatccggcaggagctggagctgtctgtgaagaaggagctggagaagatcctgaccacagccagcagccatgaatttgagcacaccaagaaggacctggatggcttcaggaagctgttccaccgcttcctgcaggagaagggccccagcgtggactggggcaagatccagaggcctcctgaggacagcatccagccctatgagaagatcaaggcccggggcctgcctgacaacatcagctctgtgctgaacaagctggtggtggtgaagctgaatggaggcctgggcacctccatgggctgcaagggccccaagagcctgattggagtgagaaatgaaaacaccttcctggacctgactgtgcagcagatctag

SEQ ID NO: 175413 - DNA, 642 bp, Artificial Sequence
  Description of Artificial Sequence: Synthetic coding sequence
atgagccaggatggagccagccagttccaggaggtgatccggcaggagctggagctgtctgtgaagaaggagctggagaagatcctgaccacagccagcagccatgaatttgagcacaccaagaaggacctggatggcttcaggaagctgttccaccgcttcctgcaggagaagggccccagcgtggactggggcaagatccagaggcctcctgaggacagcatccagccctatgagaagatcaaggcccggggcctgcctgacaacatcagctctgtgctgaacaagctggtggtggtgaagctgaatggaggcctgggcacctccatgggctgcaagggccccaagagcctgattggagtgagaaatgaaaacaccttcctggacctgactgtgcagcagatcgagcacctgaacaagacctacaacacagatgtgcccctggtgctgatgaacagcttcaacacagatgaggacaccaagaagatcctgcagaagtacaaccactgccgggtgaagatctacaccttcaaccagagccgctacccccgcatcaacaaggagagcctgctgcctgtggccaaggatgtgtcctacagcggggagaacacagaggcctggtacccacctggccacggctag

SEQ ID NO: 175414 - DNA, 1278 bp, Artificial Sequence
  Description of Artificial Sequence: Synthetic coding sequence
atggtgtccaaggccctgctgcggctggtgtctgctgtgaacagaagaaggatgaagctgctgctgggcatcgccctgctggcctacgtggcctctgtgtggggcaactttgtgaacatgtccttcctgctgaacagaagcatccaggagaatggagagctgaagattgagagcaagattgaggagatggtggagcccctgcgggagaagatccgggacctggagaagagcttcacccagaagtacccacctgtgaagttcctgtctgagaaggacaggaagaggatcctgatcactggaggagctggctttgtgggcagccacctgacagacaagctgatgatggatggccacgaggtgacagtggtggacaacttcttcaccggcaggaagagaaatgtggagcactggattggacatgaaaattttgagctgatcaaccatgatgtggtggagcccctgtacatcgaggtggaccagatctaccacctggccagccctgccagcccccccaactacatgtacaaccccatcaagaccctgaagaccaacaccatcggcaccctgaacatgctgggcctggccaagagggtgggcgcccggctgctgctggccagcaccagcgaggtgtatggagaccctgaggtgcacccccagagcgaggactactggggccacgtgaaccccatcggcccccgggcctgctatgatgagggcaagagggtggccgagaccatgtgctacgcctacatgaagcaggagggcgtggaggtgcgggtggcccgcatcttcaacaccttcggccccaggatgcacatgaatgatggccgggtggtgagcaacttcatcctgcaggccctgcagggcgagcccctgactgtgtatggcagcggcagccagacccgggccttccagtatgtgtctgacctggtgaatggcctggtggccctgatgaacagcaatgtgagcagccctgtgaacctgggcaaccctgaggagcacaccatcctggagtttgcccagctgatcaagaacctggtgggcagcggcagcgagatccagttcctgtctgaggcccaggatgacccccagaagaggaagccagacatcaagaaggccaagctgatgctgggctgggagcctgtggtgcccctggaggagggcctgaacaaggccatccactacttcaggaaggagctggagtaccaggccaacaaccagtacatccccaagcccaagccagcccgcatcaagaagggccgcaccaggcacagctag

SEQ ID NO: 175415 - DNA, 759 bp, Artificial Sequence
  Description of Artificial Sequence: Synthetic coding sequence
atgtacaaccccatcaagaccctgaagaccaacaccatcggcaccctgaacatgctgggcctggccaagagggtgggcgcccggctgctgctggccagcaccagcgaggtgtatggagaccctgaggtgcacccccagagcgaggactactggggccacgtgaaccccatcggcccccgggcctgctatgatgagggcaagagggtggccgagaccatgtgctacgcctacatgaagcaggagggcgtggaggtgcgggtggcccgcatcttcaacaccttcggccccaggatgcacatgaatgatggccgggtggtgagcaacttcatcctgcaggccctgcagggcgagcccctgactgtgtatggcagcggcagccagacccgggccttccagtatgtgtctgacctggtgaatggcctggtggccctgatgaacagcaatgtgagcagccctgtgaacctgggcaaccctgaggagcacaccatcctggagtttgcccagctgatcaagaacctggtgggcagcggcagcgagatccagttcctgtctgaggcccaggatgacccccagaagaggaagccagacatcaagaaggccaagctgatgctgggctgggagcctgtggtgcccctggaggagggcctgaacaaggccatccactacttcaggaaggagctggagtaccaggccaacaaccagtacatccccaagcccaagccagcccgcatcaagaagggccgcaccaggcacagctag

SEQ ID NO: 175416 - DNA, 1263 bp, Artificial Sequence
  Description of Artificial Sequence: Synthetic coding sequence
atggtgtccaaggccctgctgcggctggtgtctgctgtgaacagaagaaggatgaagctgctgctgggcatcgccctgctggcctacgtggcctctgtgtggggcaactttgtgaacatgaggagcatccaggagaatggagagctgaagattgagagcaagattgaggagatggtggagcccctgcgggagaagatccgggacctggagaagagcttcacccagaagtacccacctgtgaagttcctgtctgagaaggacaggaagaggatcctgatcaccggcggggccggctttgtgggcagccacctgacagacaagctgatgatggatggccacgaggtgacagtggtggacaacttcttcaccggcaggaagagaaatgtggagcactggattggacatgagaactttgagctgatcaaccatgatgtggtggagcccctgtacatcgaggtggaccagatctaccacctggccagccctgccagcccccccaactacatgtacaaccccatcaagaccctgaagaccaacaccatcggcaccctgaacatgctgggcctggccaagagggtgggcgcccggctgctgctggccagcaccagcgaggtgtatggagaccctgaggtgcacccccagagcgaggactactggggccacgtgaaccccatcggcccccgggcctgctatgatgagggcaagagggtggccgagaccatgtgctacgcctacatgaagcaggagggcgtggaggtgcgggtggcccgcatcttcaacaccttcggccccaggatgcacatgaatgatggccgggtggtgagcaacttcatcctgcaggccctgcagggcgagcccctgactgtgtatggcagcggcagccagacccgggccttccagtatgtgtctgacctggtgaatggcctggtggccctgatgaacagcaatgtgagcagccctgtgaacctgggcaaccctgaggagcacaccatcctggagtttgcccagctgatcaagaacctggtgggcagcggcagcgagatccagttcctgtctgaggcccaggatgacccccagaagaggaagccagacatcaagaaggccaagctgatgctgggctgggagcctgtggtgcccctggaggagggcctgaacaaggccatccactacttcaggaaggagctggagtaccaggccaacaaccagtacatccccaagcccaagccagcccgcatcaagaagggccgcaccaggcacagctag

SEQ ID NO: 175417 - DNA, 405 bp, Artificial Sequence
  Description of Artificial Sequence: Synthetic coding sequence
atgtacaaccccatcaagaccctgaagaccaacaccatcggcaccctgaacatgctgggcctggccaagagggtgggcgcccggctgctgctggccagcaccagcgaggtgtatggagaccctgaggtgcacccccagagcgaggactactggggccacgtgaaccccatcggcccccgggcctgctatgatgagggcaagagggtggccgagaccatgtgctacgcctacatgaagcaggagggcgtggaggtgcgggtggcccgcatcttcaacaccttcggccccaggatgcacatgaatgatggccgggtggtgagcaacttcatcctgcaggccctgcagggcgagcccctgactgtgtatggcagcggcagccagacccgggccttccagtatgtgtag

SEQ ID NO: 175418 - DNA, 558 bp, Artificial Sequence
  Description of Artificial Sequence: Synthetic coding sequence
atggtgtccaaggccctgctgcggctggtgtctgctgtgaacagaagaaggatgaagctgctgctgggcatcgccctgctggcctacgtggcctggctggccaagagggtgggcgcccggctgctgctggccagcaccagcgaggtgtatggagaccctgaggtgcacccccagagcgaggactactggggccacgtgaaccccatcggcccccgggcctgctatgatgagggcaagagggtggccgagaccatgtgctacgcctacatgaagcaggagggcgtggaggtgcgggtggcccgcatcttcaacaccttcggccccaggatgcacatgaatgatggccgggtggtgagcaacttcatcctgcaggccctgcagggcgagcccctgactgtgtatggcagcggcagccagacccgggccttccagtatgtgtctgacctggtgaatggcctggtggccctgatgaacagcaatgtgagcagccctgtgaacctggtgtctgcccccctgccccccctgtgcaggacagcccagacctttgtgcacctgtag

SEQ ID NO: 175419 - DNA, 159 bp, Artificial Sequence
  Description of Artificial Sequence: Synthetic coding sequence
atgtacaaccccatcaagaccctgaagaccaacaccatcggcaccctgaacatgctgggcctggccaagagggtgggcgcccggctgctgctggccagcaccagcgaggtgtatggagaccctgaggtgcacccccagagcgaggactactggggctag

SEQ ID NO: 175420 - DNA, 366 bp, Artificial Sequence
  Description of Artificial Sequence: Synthetic coding sequence
atgtacaaccccatcaagaccctgaagaccaacaccatcggcaccctgaacatgctgggcctggccaagagggtgggcgcccggctgctgctggccagcaccagcgaggtgtatggagaccctgaggtgcacccccagagcgaggactactggggccacgtgaaccccatcggcccccgggcctgctatgatgagggcaagagggtggccgagaccatgtgctacgcctacatgaagcaggagggcgtggaggtgcgggtggcccgcatcttcaacaccttcggccccaggatgcacatgaatgatggccgggtggtgagcaacttcatcctgcaggccctgcagggcgagcccctgactgtgtag

SEQ ID NO: 175421 - DNA, 1092 bp, Artificial Sequence
  Description of Artificial Sequence: Synthetic coding sequence
atggtggagcccctgcgggagaagatccgggacctggagaagagcttcacccagaagtacccacctgtgaagttcctgtctgagaaggacaggaagaggatcctgatcactggaggagctggctttgtgggcagccacctgacagacaagctgatgatggatggccacgaggtgacagtggtggacaacttcttcaccggcaggaagagaaatgtggagcactggattggacatgaaaattttgagctgatcaaccatgatgtggtggagcccctgtacatcgaggtggaccagatctaccacctggccagccctgccagcccccccaactacatgtacaaccccatcaagaccctgaagaccaacaccatcggcaccctgaacatgctgggcctggccaagagggtgggcgcccggctgctgctggccagcaccagcgaggtgtatggagaccctgaggtgcacccccagagcgaggactactggggccacgtgaaccccatcggcccccgggcctgctatgatgagggcaagagggtggccgagaccatgtgctacgcctacatgaagcaggagggcgtggaggtgcgggtggcccgcatcttcaacaccttcggccccaggatgcacatgaatgatggccgggtggtgagcaacttcatcctgcaggccctgcagggcgagcccctgactgtgtatggcagcggcagccagacccgggccttccagtatgtgtctgacctggtgaatggcctggtggccctgatgaacagcaatgtgagcagccctgtgaacctgggcaaccctgaggagcacaccatcctggagtttgcccagctgatcaagaacctggtgggcagcggcagcgagatccagttcctgtctgaggcccaggatgacccccagaagaggaagccagacatcaagaaggccaagctgatgctgggctgggagcctgtggtgcccctggaggagggcctgaacaaggccatccactacttcaggaaggagctggagtaccaggccaacaaccagtacatccccaagcccaagccagcccgcatcaagaagggccgcaccaggcacagctag

SEQ ID NO: 175422 - DNA, 1680 bp, Artificial Sequence
  Description of Artificial Sequence: Synthetic coding sequence
atgaggaagtttgcctactgcaaggtggtgctggccaccagcctcatctgggtgctgctggacatgttcctgctgctgtacttcagcgagtgcaacaagtgtgatgagaagaaggagcggggcctgcctgctggagatgtgctggagcctgtgcagaagccccatgagggccctggagagatgggcaagcctgtggtgatccccaaggaggaccaggagaagatgaaggagatgttcaagatcaaccagttcaacctgatggccagcgagatgattgccctgaacagaagcctgcctgatgtgcggctggagggctgcaagaccaaggtgtacccagacaacctgcccaccacctctgtggtgattgtgttccacaatgaggcctggagcaccctgctgaggacagtgcacagcgtcatcaacagaagccccaggcacatgattgaggagatcgtgctggtggatgatgccagcgagcgggacttcctgaagaggcccctggagagctatgtgaagaagctgaaggtgcctgtgcacgtgatccgcatggagcagaggagcggcctcatccgggcccggctgaagggagctgctgtgtccaagggccaggtgatcaccttcctggatgcccactgtgaatgtactgtgggctggctggagcccctgctggcccgcatcaagcatgacagaagaacagtggtgtgccccatcattgatgtgatcagtgatgacacctttgagtacatggccggcagtgacatgacctacggcggcttcaactggaagctgaacttccgctggtaccctgtgccccagcgggagatggacagaagaaaaggagacaggaccctgcctgtgaggacccccaccatggccggcggcctcttcagcattgaccgggactacttccaggagatcggcacctatgatgctggcatggacatctggggcggggagaacctggagatctccttccgcatctggcagtgtggcggcaccctggagatcgtgacctgcagccacgtgggccacgtgttcaggaaggccaccccctacaccttccctgggggcaccggccagatcatcaacaagaacaacagaaggctggccgaggtgtggatggatgagttcaagaacttcttctacatcatcagccctggggtgaccaaggtggactatggagacatcagcagccgggtgggcctgcggcacaagctgcagtgcaagcccttctcctggtacctggagaacatctacccagacagccagatccccaggcactacttcagcctgggggagatcagaaatgtggagaccaaccagtgcctggacaacatggccaggaaagaaaatgagaaggtgggcatcttcaactgccacggcatgggcggcaaccaggtgttctcctacacagccaacaaggagatcagaacagatgacctgtgcctggatgtgtccaagctgaatggacctgtgaccatgctgaagtgccaccacctgaagggcaaccagctgtgggagtatgaccctgtgaagctgaccctgcagcacgtgaacagcaaccagtgcctggacaaggccacagaggaggacagccaggtgcccagcatccgggactgcaatggcagccgcagccagcagtggctgctgagaaatgtgaccctgcctgagatcttctag

SEQ ID NO: 175423 - DNA, 1500 bp, Artificial Sequence
  Description of Artificial Sequence: Synthetic coding sequence
atgggcaagcctgtggtgatccccaaggaggaccaggagaagatgaaggagatgttcaagatcaaccagttcaacctgatggccagcgagatgattgccctgaacagaagcctgcctgatgtgcggctggagggctgcaagaccaaggtgtacccagacaacctgcccaccacctctgtggtgattgtgttccacaatgaggcctggagcaccctgctgaggacagtgcacagcgtcatcaacagaagccccaggcacatgattgaggagatcgtgctggtggatgatgccagcgagcgggacttcctgaagaggcccctggagagctatgtgaagaagctgaaggtgcctgtgcacgtgatccgcatggagcagaggagcggcctcatccgggcccggctgaagggagctgctgtgtccaagggccaggtgatcaccttcctggatgcccactgtgaatgtactgtgggctggctggagcccctgctggcccgcatcaagcatgacagaagaacagtggtgtgccccatcattgatgtgatcagtgatgacacctttgagtacatggccggcagtgacatgacctacggcggcttcaactggaagctgaacttccgctggtaccctgtgccccagcgggagatggacagaagaaaaggagacaggaccctgcctgtgaggacccccaccatggccggcggcctcttcagcattgaccgggactacttccaggagatcggcacctatgatgctggcatggacatctggggcggggagaacctggagatctccttccgcatctggcagtgtggcggcaccctggagatcgtgacctgcagccacgtgggccacgtgttcaggaaggccaccccctacaccttccctgggggcaccggccagatcatcaacaagaacaacagaaggctggccgaggtgtggatggatgagttcaagaacttcttctacatcatcagccctggggtgaccaaggtggactatggagacatcagcagccgggtgggcctgcggcacaagctgcagtgcaagcccttctcctggtacctggagaacatctacccagacagccagatccccaggcactacttcagcctgggggagatcagaaatgtggagaccaaccagtgcctggacaacatggccaggaaagaaaatgagaaggtgggcatcttcaactgccacggcatgggcggcaaccaggtgttctcctacacagccaacaaggagatcagaacagatgacctgtgcctggatgtgtccaagctgaatggacctgtgaccatgctgaagtgccaccacctgaagggcaaccagctgtgggagtatgaccctgtgaagctgaccctgcagcacgtgaacagcaaccagtgcctggacaaggccacagaggaggacagccaggtgcccagcatccgggactgcaatggcagccgcagccagcagtggctgctgagaaatgtgaccctgcctgagatcttctag

SEQ ID NO: 175424 - DNA, 1680 bp, Artificial Sequence; identical to SEQ ID NO: 175422
  Description of Artificial Sequence: Synthetic coding sequence

SEQ ID NO: 175425 - DNA, 1812 bp, Artificial Sequence
  Description of Artificial Sequence: Synthetic coding sequence
atgaggaggaaggagaagaggctgctgcaggccgtggccctggtgctggccgccctggtgctgctgcccaacgtgggcctgtgggccctgtaccgggagcggcagccagatggcacccctgggggcagcggggctgctgtggccccagctgctggccagggcagccacagccggcagaagaagaccttcttcctgggagatggccagaagctgaaggactggcatgacaaggaggccatcagaagagatgcccagagggtgggcaatggagagcagggccggccctaccccatgacagatgctgagcgggtggaccaggcctaccgggagaatggcttcaacatctacgtgtctgacaagatcagcctgaacagaagcctgcctgacatccgccaccccaactgcaacagcaagcgctacctggagaccctgcccaacaccagcatcatcatccccttccacaatgaaggctggagcagcctgctgaggacagtgcacagcgtgctgaacagaagccccccagagctggtggccgagatcgtgctggtggatgacttcagtgaccgggagcacctgaagaagcccctggaggactacatggccctcttccccagcgtgcgcatcctgcggaccaagaagcgggagggcctcatccgcaccaggatgctgggcgcctctgtggccactggagatgtgatcaccttcctggacagccactgtgaggccaacgtgaactggctgccccccctgctggaccgcatcgccaggaacaggaagaccatcgtgtgccccatgattgatgtgattgaccatgatgacttccgctatgagacccaggccggagatgccatgagaggagcctttgactgggagatgtactacaagaggatccccatccccccagagctgcagaaggctgaccccagcgacccctttgagagccctgtgatggccggcggcctgtttgctgtggacaggaagtggttctgggagctgggcggctatgaccccggcctggagatctggggcggggagcagtatgagatctccttcaaggtgtggatgtgtggcggccgcatggaggacatcccctgcagccgggtgggccacatctacagaaaatatgtgccctacaaggtgcctgctggggtgtccctggccaggaacctgaagagggtggccgaggtgtggatggatgaatatgcagagtacatctaccagaggaggcctgagtaccgccacctgtctgctggagatgtggccgtgcagaagaagctgcggagcagcctgaactgcaagagcttcaagtggttcatgaccaagatcgcctgggacctgcccaagttctacccacctgtggagcccccagctgctgcctggggcgagatcagaaatgtgggcaccggcctgtgtgccgacaccaagcacggggccctgggcagccccctgcggctggagggctgtgtgcggggccgcggggaggccgcctggaacaacatgcaggtgttcaccttcacctggagggaggacatccggcctggggacccccagcacaccaagaagttctgctttgatgccatcagccacaccagccctgtgaccctgtatgactgccacagcatgaagggcaaccagctgtggaagtacaggaaggacaagaccctgtaccaccctgtgtctggcagctgcatggactgcagcgagagtgaccaccgcatcttcatgaacacctgcaaccccagcagcctgacccagcagtggctgtttgagcacaccaacagcacagtgctggagaagttcaacagaaattag

SEQ ID NO: 175426 - DNA, 831 bp, Artificial Sequence
  Description of Artificial Sequence: Synthetic coding sequence
atgctggcctggagagatggagagctggaggccgagaccagcagcagcctcttcctgctggccatgcaggtgtggatgtgtggcggccgcatggaggacatcccctgcagccgggtgggccacatctacagaaaatatgtgccctacaaggtgcctgctggggtgtccctggcccgggtgaggaacctgaagagggtggccgaggtgtggatggatgaatatgcagagtacatctaccagaggaggcctgagtaccgccacctgtctgctggagatgtggccgtgcagaagaagctgcggagcagcctgaactgcaagagcttcaagtggttcatgaccaagatcgcctgggacctgcccaagttctacccacctgtggagcccccagctgctgcctggggcgagatcagaaatgtgggcaccggcctgtgtgccgacaccaagcatggagccctgggcagccccctgcggctggagggctgtgtgcggggccgcggggaggccgcctggaacaacatgcaggtgttcaccttcacctggagggaggacatccggcctggggacccccagcacaccaagaagttctgctttgatgccatcagccacaccagccctgtgaccctgtatgactgccacagcatgaagggcaaccagctgtggaagtacaggaaggacaagaccctgtaccaccctgtgtctggcagctgcatggactgcagcgagagtgaccaccgcatcttcatgaacacctgcaaccccagcagcctgacccagcagtggctgtttgagcacaccaacagcacagtgctggagaagttcaacagaaattag

SEQ ID NO: 175427 - DNA, 1626 bp, Artificial Sequence
  Description of Artificial Sequence: Synthetic coding sequence
atgaggaggaaggagaagaggctgctgcaggccgtggccctggtgctggccgccctggtgctgctgcccaacgtgggcctgtgggccctgtaccgggagcggcagccagatggcacccctgggggcagcggggctgctgtggccccagctgctggccagggcagccacagccggcagaagaagaccttcttcctgggagatggccagaagctgaaggactggcatgacaaggaggccatcagaagagatgcccagagggtgggcaatggagagcagggccggccctaccccatgacagatgctgagcgggtggaccaggcctaccgggagaatggcttcaacatctacgtgtctgacaagatcagcctgaacagaagcctgcctgacatccgccaccccaactgcaacagcaagcgctacctggagaccctgcccaacaccagcatcatcatccccttccacaatgaaggctggagcagcctgctgaggacagtgcacagcgtgctgaacagaagccccccagagctggtggccgagatcgtgctggtggatgacttcagtgaccgggaccgcatcgccaggaacaggaagaccatcgtgtgccccatgattgatgtgattgaccatgatgacttccgctatgagacccaggccggagatgccatgagaggagcctttgactgggagatgtactacaagaggatccccatccccccagagctgcagaaggctgaccccagcgacccctttgagagccctgtgatggccggcggcctgtttgctgtggacaggaagtggttctgggagctgggcggctatgaccccggcctggagatctggggcggggagcagtatgagatctccttcaaggtgtggatgtgtggcggccgcatggaggacatcccctgcagccgggtgggccacatctacagaaaatatgtgccctacaaggtgcctgctggggtgtccctggccaggaacctgaagagggtggccgaggtgtggatggatgaatatgcagagtacatctaccagaggaggcctgagtaccgccacctgtctgctggagatgtggccgtgcagaagaagctgcggagcagcctgaactgcaagagcttcaagtggttcatgaccaagatcgcctgggacctgcccaagttctacccacctgtggagcccccagctgctgcctggggcgagatcagaaatgtgggcaccggcctgtgtgccgacaccaagcacggggccctgggcagccccctgcggctggagggctgtgtgcggggccgcggggaggccgcctggaacaacatgcaggtgttcaccttcacctggagggaggacatccggcctggggacccccagcacaccaagaagttctgctttgatgccatcagccacaccagccctgtgaccctgtatgactgccacagcatgaagggcaaccagctgtggaagtacaggaaggacaagaccctgtaccaccctgtgtctggcagctgcatggactgcagcgagagtgaccaccgcatcttcatgaacacctgcaaccccagcagcctgacccagcagtggctgtttgagcacaccaacagcacagtgctggagaagttcaacagaaattag

SEQ ID NO: 175428 - DNA, 1101 bp, Artificial Sequence
  Description of Artificial Sequence: Synthetic coding sequence
atgaggaggaaggagaagaggctgctgcaggccgtggccctggtgctggccgccctggtgctgctgcccaacgtgggcctgtgggccctgtaccgggagcggcagccagatggcacccctgggggcagcggggctgctgtggccccagctgctggccagggcagccacagccggcagaagaagaccttcttcctgggagatggccagaagctgaaggactggcatgacaaggaggccatcagaagagatgcccagagggtgggcaatggagagcagggccggccctaccccatgacagatgctgagcgggtggaccaggcctaccgggagaatggcttcaacatctacgtgtctgacaagatcagcctgaacagaagcctgcctgacatccgccaccccaactgcaacagcaagcgctacctggagaccctgcccaacaccagcatcatcatccccttccacaatgaaggctggagcagcctgctgaggacagtgcacagcgtgctgaacagaagccccccagagctggtggccgagatcgtgctggtggatgacttcagtgaccgggagcacctgaagaagcccctggaggactacatggccctcttccccagcgtgcgcatcctgcggaccaagaagcgggagggcctcatccgcaccaggatgctgggcgcctctgtggccactggagatgtgatcaccttcctggacagccactgtgaggccaacgtgaactggctgccccccctgctggaccgcatcgccaggaacaggaagaccatcgtgtgccccatgattgatgtgattgaccatgatgacttccgctatgagacccaggccggagatgccatgagaggagcctttgactgggagatgtactacaagaggatccccatccccccagagctgcagaaggctgaccccagcgacccctttgagagccctgtgatggccggcggcctgtttgctgtggacaggaagtggttctgggagctgggcggctatgaccccggcctggagatctggggcggggagcagtatgagatctccttcaaggtgtcccagctgagccggcggcctgtgctgggcacagccagctag

SEQ ID NO: 175429 - DNA, 1746 bp, Artificial Sequence
  Description of Artificial Sequence: Synthetic coding sequence
atgtggggccgcacagcccggcggcgctgcccccgggagctgcggcggggccgggaggccctgctggtgctgctggccctgctggccctggccggcctgggctctgtgctgcgggcccagagaggagctggagctggagctgctgagcccggcccccccaggaccccccggcccggccggcgggagcctgtgatgccccggccccctgtgcctgccaatgccctgggcgcccggggggaggccgtgcggctgcagctgcagggcgaggagctgcggctgcaggaggagagcgtgcggctgcaccagatcaacatctacctgagtgaccgcatcagcctgcaccggcggctgcctgagcgctggaaccccctgtgcaaggagaagaagtatgactatgacaacctgcccaggaccagcgtcatcatcgccttctacaatgaggcctggagcaccctgctgaggacagtgtacagcgtgctggagaccagcccagacatcctgctggaggaggtgatcctggtggatgactacagcgaccgggagcacctgaaggagcggctggccaatgagctgagcggcctgcccaaggtgcggctcatccgggccaacaagcgggagggcctggtgcgggcccggctgctgggcgccagcgctgcccggggagatgtgctgaccttcctggactgccactgtgagtgccacgagggctggctggagcccctgctgcagaggatccacgaggaggagagcgctgtggtgtgccctgtgattgatgtgattgactggaacacctttgagtacctgggcaacagcggggagccccagatcggcggctttgactggaggctggtgttcacctggcacacagtgcctgagcgggagcgcatccgcatgcagagccctgtggatgtgatccgcagccccaccatggccggcggcctgtttgctgtgtccaagaagtactttgagtacctgggcagctatgacaccggcatggaggtgtggggcggggagaacctggagttctccttccgcatctggcagtgtggcggcgtgctggagacccacccctgcagccacgtgggccacgtgttccccaagcaggccccctacagcaggaacaaggccctggccaacagcgtgcgggctgctgaggtgtggatggatgagttcaaggagctgtactaccacaggaacccccgggcccggctggagccctttggagatgtgacagagaggaagcagctgcgggacaagctgcagtgcaaggacttcaagtggttcctggagaccgtgtacccagagctgcacgtgcctgaggacaggcctggcttcttcggcatgctgcagaacaagggcctgacagactactgctttgactacaaccccccagatgagaaccagatcgtgggccaccaggtgatcctgtacctgtgccacggcatgggccagaaccagttctttgagtacaccagccagaaggagatccgctacaacacccaccagcctgagggctgcatcgctgtggaggccggcatggacaccctcatcatgcacctgtgtgaggagacagcccctgagaaccagaagttcatcctgcaggaggatggcagcctcttccacgagcagagcaagaagtgtgtgcaggccgccaggaaggagagcagtgacagctttgtgcccctgctgcgggactgcaccaacagcgaccaccagaagtggttcttcaaggagaggatgctgtag

SEQ ID NO: 175430 - DNA, 1671 bp, Artificial Sequence
  Description of Artificial Sequence: Synthetic coding sequence
atgagaagatttgtgtactgcaaggtggtgctggccaccagcctgatgtgggtgctggtggatgtgttcctgctgctgtacttcagcgagtgcaacaagtgtgatgacaagaaggagaggagcctgctgcctgccctgcgggccgtcatcagcaggaaccaggagggccctggagagatgggcaaggctgtgctgatccccaaggatgaccaggagaagatgaaggagctgttcaagatcaaccagttcaacctgatggccagtgacctgattgccctgaacagaagcctgcctgatgtgcggctggagggctgcaagaccaaggtgtacccagatgagctgcccaacacctctgtggtgattgtgttccacaatgaggcctggagcaccctgctgaggacagtgtacagcgtcatcaacagaagcccccactacctgctgtctgaggtgatcctggtggatgatgccagcgagcgggacttcctgaagctgaccctggagaactacgtgaagaacctggaggtgcctgtgaagatcatccgcatggaggagaggagcggcctcatccgggcccggctgcggggagctgctgccagcaagggccaggtgatcaccttcctggatgcccactgtgagtgcaccctgggctggctggagcccctgctggcccgcatcaaggaggacaggaagacagtggtgtgccccatcattgatgtgatcagtgatgacacctttgagtacatggccggcagtgacatgacctatggaggcttcaactggaagctgaacttccgctggtaccctgtgccccagcgggagatggacaggaggaagggggacaggaccctgcctgtgaggacccccaccatggccggcggcctcttcagcattgacaggaactactttgaggagatcggcacctatgatgctggcatggacatctggggcggggagaacctggagatgtccttccgcatctggcagtgtggcggcagcctggagatcgtgacctgcagccacgtgggccacgtgttcaggaaggccaccccctacaccttccctgggggcactggacatgtgatcaacaagaacaacagaaggctggccgaggtgtggatggatgagttcaaggacttcttctacatcatcagccctggggtggtgaaggtggactatggagatgtgtctgtgaggaagaccctgcgggagaacctgaagtgcaagcccttctcctggtacctggagaacatctacccagacagccagatcccccggcgctactacagcctgggggagatcagaaatgtggagaccaaccagtgcctggacaacatgggcaggaaagaaaatgagaaggtgggcatcttcaactgccacggcatgggcggcaaccaggtgttctcctacacagctgacaaggagatcagaacagatgacctgtgcctggatgtgtcccggctgaatggacctgtgatcatgctgaagtgccaccacatgaggggcaaccagctgtgggagtatgatgctgagcggctgaccctgcggcacgtgaacagcaaccagtgcctggatgagcccagcgaggaggacaagatggtgcccaccatgcaggactgcagcggcagccgcagccagcagtggctgctgaggaacatgaccctgggcacctag

SEQ ID NO: 175431 - DNA, 1686 bp, Artificial Sequence
  Description of Artificial Sequence: Synthetic coding sequence
atgagaagatttgtgtactgcaaggtggtgctggccaccagcctgatgtgggtgctggtggatgtgttcctgctgctgtacttcagcgagtgcaacaagtgtgatgacaagaaggagaggagcctgctgcctgccctgcgggccgtcatcagcaggaaccaggagggccctggagagatgggcaaggctgtgctgatccccaaggatgaccaggagaagatgaaggagctgttcaagatcaaccagttcaacctgatggccagtgacctgattgccctgaacagaagcctgcctgatgtgcggctggagggctgcaagaccaaggtgtacccagatgagctgcccaacacctctgtggtgattgtgttccacaatgaggcctggagcaccctgctgaggacagtgtacagcgtcatcaacagaagcccccactacctgctgtctgaggtgatcctggtggatgatgccagcgagcgggacttcctgaagctgaccctggagaactacgtgaagaacctggaggtgcctgtgaagatcatccgcatggaggagaggagcggcctcatccgggcccggctgcggggagctgctgccagcaagggccaggtgatcaccttcctggatgcccactgtgagtgcaccctgggctggctggagcccctgctggcccgcatcaaggaggacaggaagacagtggtgtgccccatcattgatgtgatcagtgatgacacctttgagtacatggccggcagtgacatgacctatggaggcttcaactggaagctgaacttccgctggtaccctgtgccccagcgggagatggacaggaggaagggggacaggaccctgcctgtgaggacccccaccatggccggcggcctcttcagcattgacaggaactactttgaggagatcggcacctatgatgctggcatggacatctggggcggggagaacctggagatgtccttccgcatctggcagtgtggcggcagcctggagatcgtgacctgcagccacgtgggccacgtgttcaggaaggccaccccctacaccttccctgggggcactggacatgtgatcaacaagaacaacagaaggctggccgaggtgtggatggatgagttcaaggacttcttctacatcatcagccctggggtggtgaaggtggactatggagatgtgtctgtgaggaagaccctgcgggagaacctgaagtgcaagcccttctcctggtacctggagaacatctacccagacagccagatcccccggcgctactacagcctgggggagatcagaaatgtggagaccaaccagtgcctggacaacatgggcaggaaagaaaatgagaaggtgggcatcttcaactgccacggcatgggcggcaaccaggtgttctcctacacagctgacaaggagatcagaacagatgacctgtgcctggatgtgtcccggctgaatggacctgtgatcatgctgaagtgccaccacatgaggggcaaccagctgtgggagtatgatgctgagagctgcctgtctgtgaacaaggtggctgatggcagccagcaccccaccgtggagacctgcaatgacagcaccctgcagaagtggctgctgaggaactacaccaggatggagatcttcaggaacatctttggaaacagcacagactacatcctgtag

SEQ ID NO: 175432 - DNA, 60 bp, Artificial Sequence
  Description of Artificial Sequence: Synthetic coding sequence
atgagaagatttgtgtactgcaaggtggtgctggccaccagcctgatgtgggtgctgtag

SEQ ID NO: 175433 - DNA, 1659 bp, Artificial Sequence
  Description of Artificial Sequence: Synthetic coding sequence
atgaggcggctgacccggcggctggtgctgcctgtgtttggagtgctgtggatcaccgtgctgctcttcttctgggtgaccaagaggaagctggaggtgcccactggacctgaggtgcagacccccaagcccagtgatgctgactgggatgacctgtgggaccagtttgatgaaagacgctacctgaatgccaagaagtggagggtgggagatgacccctacaagctgtatgccttcaaccagcgggagagcgagcgcatcagcagcaacagagccatcccagacaccaggcacctgcgctgcaccctgctggtgtactgcacagacctgccccccaccagcatcatcatcaccttccacaatgaggcccggagcaccctgctgcggaccatccgctctgtgctgaacagaacacccacccacctgatccgggagatcatcctggtggatgacttcagcaatgaccctgatgactgcaagcagctgatcaagctgcccaaggtgaagtgcctgaggaacaatgaaaggcagggcctggtgcgcagccgcatcagaggagctgacatcgcccagggcaccaccctgaccttcctggacagccactgtgaggtgaacagagactggctgcagcccctgctgcaccgggtgaaggaggactacaccagggtggtgtgccctgtgattgacatcatcaacctggacaccttcacctacattgaaagtgccagcgagctgcggggcggctttgactggagcctgcacttccagtgggagcagctgagccctgagcagaaggcccggcggctggaccccacagagcccatccgcacccccatcatcgccggcggcctgtttgtgattgacaaggcctggtttgactacctgggcaagtatgacatggacatggacatctggggcggggagaactttgagatctccttccgggtgtggatgtgtggcggcagcctggagatcgtgccctgcagccgggtgggccacgtgttcaggaagaagcacccctacgtgtttcctgatggaaatgccaacacctacatcaagaacaccaagaggacagctgaggtgtggatggatgagtacaagcagtactactatgctgcccggccctttgccctggagcggccctttggaaatgtggagagccggctggacctgaggaagaacctgcgctgccagagcttcaagtggtacctggagaacatctacccagagctgagcatccccaaggagagcagcatccagaagggcaacatccggcagaggcagaagtgcctggagagccagaggcagaacaaccaggagacccccaacctgaagctgagcccctgtgccaaggtgaagggagaagatgccaagagccaggtgtgggccttcacctacacccagcagatcctgcaggaggagctgtgcctgagcgtcatcaccctcttccctggggcccctgtggtgctggtgctgtgcaagaatggagatgaccggcagcagtggaccaagacaggcagccacatcgagcacatcgccagccacctgtgcctggacacagacatgtttggagatggaacagaaaatggcaaggagatcgtggtgaacccctgtgagagcagcctgatgagccagcactgggacatggtgagcagctag

SEQ ID NO: 175434 - DNA, 1560 bp, Artificial Sequence
  Description of Artificial Sequence: Synthetic coding sequence
atgaggcggctgacccggcggctggtgctgcctgtgtttggagtgctgtggatcaccgtgctgctcttcttctgggtgaccaagaggaagctggaggtgcccactggacctgaggtgcagacccccaagcccagtgatgctgactgggatgacctgtgggaccagtttgatgaaagacgctacctgaatgccaagaagtggagggtgggagatgacccctacaagctgtatgccttcaaccagcgggagagcgagcgcatcagcagcaacagagccatcccagacaccaggcacctgtctgtgctgaacagaacacccacccacctgatccgggagatcatcctggtggatgacttcagcaatgaccctgatgactgcaagcagctgatcaagctgcccaaggtgaagtgcctgagaaataatgaaaggcagggcctggtgcgcagccgcatcagaggagctgacatcgcccagggcaccaccctgaccttcctggacagccactgtgaggtgaacagagactggctgcagcccctgctgcaccgggtgaaggaggactacaccagggtggtgtgccctgtgattgacatcatcaacctggacaccttcacctacatcgagagcgccagcgagctgcggggcggctttgactggagcctgcacttccagtgggagcagctgagccctgagcagaaggcccggcggctggaccccacagagcccatccgcacccccatcatcgccggcggcctcttcgtcatcgacaaggcctggtttgactacctgggcaagtatgacatggacatggacatctggggcggagaaaattttgagatctccttccgggtgtggatgtgtggcggcagcctggagatcgtgccctgcagccgggtgggccacgtgttcaggaagaagcacccctacgtgtttcctgatggaaatgccaacacctacatcaagaacaccaagaggacagctgaggtgtggatggatgagtacaagcagtactactatgctgcccggccctttgccctggagcggccctttggaaatgtggagagccggctggacctgaggaagaacctgcgctgccagagcttcaagtggtacctggagaacatctacccagagctgagcatccccaaggagagcagcatccagaagggcaacatccggcagaggcagaagtgcctggagagccagaggcagaacaaccaggagacccccaacctgaagctgagcccctgtgccaaggtgaagggggaggatgccaagagccaggtgtgggccttcacctacacccagcagatcctgcaggaggagctgtgcctgagcgtcatcaccctcttccctggggcccctgtggtgctggtgctgtgcaagaatggagatgaccggcagcagtggaccaagacaggcagccacatcgagcacatcgccagccacctgtgcctggacacagacatgtttggagatggaacagaaaatggcaaggagatcgtggtgaacccctgtgagagcagcctgatgagccagcactgggacatggtgagcagctag

SEQ ID NO: 175435 - DNA, 1599 bp, Artificial Sequence
  Description of Artificial Sequence: Synthetic coding sequence
atgtccttccccatgagcctggcccggagctctgtgccctttgctgacagcggcctgagcagcagccagcccagtgatgctgactgggatgacctgtgggaccagtttgatgaaagacgctacctgaatgccaagaagtggagggtgggagatgacccctacaagctgtatgccttcaaccagcgggagagcgagcgcatcagcagcaacagagccatcccagacaccaggcacctgcgctgcaccctgctggtgtactgcacagacctgccccccaccagcatcatcatcaccttccacaatgaggcccggagcaccctgctgcggaccatccgctctgtgctgaacagaacacccacccacctgatccgggagatcatcctggtggatgacttcagcaatgaccctgatgactgcaagcagctgatcaagctgcccaaggtgaagtgcctgaggaacaatgaaaggcagggcctggtgcgcagccgcatcagaggagctgacatcgcccagggcaccaccctgaccttcctggacagccactgtgaggtgaacagagactggctgcagcccctgctgcaccgggtgaaggaggactacaccagggtggtgtgccctgtgattgacatcatcaacctggacaccttcacctacattgaaagtgccagcgagctgcggggcggctttgactggagcctgcacttccagtgggagcagctgagccctgagcagaaggcccggcggctggaccccacagagcccatccgcacccccatcatcgccggcggcctgtttgtgattgacaaggcctggtttgactacctgggcaagtatgacatggacatggacatctggggcggggagaactttgagatctccttccgggtgtggatgtgtggcggcagcctggagatcgtgccctgcagccgggtgggccacgtgttcaggaagaagcacccctacgtgtttcctgatggaaatgccaacacctacatcaagaacaccaagaggacagctgaggtgtggatggatgagtacaagcagtactactatgctgcccggccctttgccctggagcggccctttggaaatgtggagagccggctggacctgaggaagaacctgcgctgccagagcttcaagtggtacctggagaacatctacccagagctgagcatccccaaggagagcagcatccagaagggcaacatccggcagaggcagaagtgcctggagagccagaggcagaacaaccaggagacccccaacctgaagctgagcccctgtgccaaggtgaagggagaagatgccaagagccaggtgtgggccttcacctacacccagcagatcctgcaggaggagctgtgcctgagcgtcatcaccctcttccctggggcccctgtggtgctggtgctgtgcaagaatggagatgaccggcagcagtggaccaagacaggcagccacatcgagcacatcgccagccacctgtgcctggacacagacatgtttggagatggaacagaaaatggcaaggagatcgtggtgaacccctgtgagagcagcctgatgagccagcactgggacatggtgagcagctag

SEQ ID NO: 175436 - DNA, 1554 bp, Artificial Sequence
  Description of Artificial Sequence: Synthetic coding sequence
atggcccaggatgagagctgccccccatctgatgctgactgggatgacctgtgggaccagtttgatgagcggcgctacctgaatgccaagaagtggagggtgggagatgacccctacaagctgtatgccttcaaccagcgggagagcgagcgcatcagcagcaacagagccatcccagacaccaggcacctgcgctgcaccctgctggtgtactgcacagacctgccccccaccagcatcatcatcaccttccacaatgaggcccggagcaccctgctgcggaccatccgctctgtgctgaacagaacacccacccacctgatccgggagatcatcctggtggatgacttcagcaatgaccctgatgactgcaagcagctgatcaagctgcccaaggtgaagtgcctgagaaataatgaaaggcagggcctggtgcgcagccgcatcagaggagctgacatcgcccagggcaccaccctgaccttcctggacagccactgtgaggtgaacagagactggctgcagcccctgctgcaccgggtgaaggaggactacaccagggtggtgtgccctgtgattgacatcatcaacctggacaccttcacctacatcgagagcgccagcgagctgcggggcggctttgactggagcctgcacttccagtgggagcagctgagccctgagcagaaggcccggcggctggaccccacagagcccatccgcacccccatcatcgccggcggcctcttcgtcatcgacaaggcctggtttgactacctgggcaagtatgacatggacatggacatctggggcggagaaaattttgagatctccttccgggtgtggatgtgtggcggcagcctggagatcgtgccctgcagccgggtgggccacgtgttcaggaagaagcacccctacgtgtttcctgatggaaatgccaacacctacatcaagaacaccaagaggacagctgaggtgtggatggatgagtacaagcagtactactatgctgcccggccctttgccctggagcggccctttggaaatgtggagagccggctggacctgaggaagaacctgcgctgccagagcttcaagtggtacctggagaacatctacccagagctgagcatccccaaggagagcagcatccagaagggcaacatccggcagaggcagaagtgcctggagagccagaggcagaacaaccaggagacccccaacctgaagctgagcccctgtgccaaggtgaagggggaggatgccaagagccaggtgtgggccttcacctacacccagcagatcctgcaggaggagctgtgcctgagcgtcatcaccctcttccctggggcccctgtggtgctggtgctgtgcaagaatggagatgaccggcagcagtggaccaagacaggcagccacatcgagcacatcgccagccacctgtgcctggacacagacatgtttggagatggaacagaaaatggcaaggagatcgtggtgaacccctgtgagagcagcctgatgagccagcactgggacatggtgagcagctag

SEQ ID NO: 175437 - DNA, 1674 bp, Artificial Sequence
  Description of Artificial Sequence: Synthetic coding sequence
atgaggcggctgacccggcggctggtgctgcctgtgtttggagtgctgtggatcaccgtgctgctcttcttctgggtgaccaagaggaagctggaggtgcccactggacctgaggtgcagacccccaaggtgtggagcctcttcttcaaggtggccggcatgagcccctgggccccccaggtgcctgtgagccccaccccaccctaccagaggggccacctgcccaccggcggccacctggccgtgtgccacttcccctgcctgctgcaggaggcccagttccacctgcagacccaggtgttcctgcaggtgcgctgcaccctgctggtgtactgcacagacctgccccccaccagcatcatcatcaccttccacaatgaggcccggagcaccctgctgcggaccatccgctctgtgctgaacagaacacccacccacctgatccgggagatcatcctggtggatgacttcagcaatgaccctgatgactgcaagcagctgatcaagctgcccaaggtgaagtgcctgagaaataatgaaaggcagggcctggtgcgcagccgcatcagaggagctgacatcgcccagggcaccaccctgaccttcctggacagccactgtgaggtgaacagagactggctgcagcccctgctgcaccgggtgaaggaggactacaccagggtggtgtgccctgtgattgacatcatcaacctggacaccttcacctacatcgagagcgccagcgagctgcggggcggctttgactggagcctgcacttccagtgggagcagctgagccctgagcagaaggcccggcggctggaccccacagagcccatccgcacccccatcatcgccggcggcctcttcgtcatcgacaaggcctggtttgactacctgggcaagtatgacatggacatggacatctggggcggagaaaattttgagatctccttccgggtgtggatgtgtggcggcagcctggagatcgtgccctgcagccgggtgggccacgtgttcaggaagaagcacccctacgtgtttcctgatggaaatgccaacacctacatcaagaacaccaagaggacagctgaggtgtggatggatgagtacaagcagtactactatgctgcccggccctttgccctggagcggccctttggaaatgtggagagccggctggacctgaggaagaacctgcgctgccagagcttcaagtggtacctggagaacatctacccagagctgagcatccccaaggagagcagcatccagaagggcaacatccggcagaggcagaagtgcctggagagccagaggcagaacaaccaggagacccccaacctgaagctgagcccctgtgccaaggtgaagggggaggatgccaagagccaggtgtgggccttcacctacacccagcagatcctgcaggaggagctgtgcctgagcgtcatcaccctcttccctggggcccctgtggtgctggtgctgtgcaagaatggagatgaccggcagcagtggaccaagacaggcagccacatcgagcacatcgccagccacctgtgcctggacacagacatgtttggagatggaacagaaaatggcaaggagatcgtggtgaacccctgtgagagcagcctgatgagccagcactgggacatggtgagcagctag

SEQ ID NO: 175438 - DNA, 1716 bp, Artificial Sequence
  Description of Artificial Sequence: Synthetic coding sequence
atgagaagaagaagcaggatgctgctgtgctttgccttcctgtgggtgctgggcatcgcctactacatgtacagcggcggcggcagcgccctggccggcggggccggcggcggggccggcaggaaagaagactggaatgaaattgaccccatcaagaagaaggacctgcaccacagcaatggagaggagaaggcccagagcatggagaccctgcccccaggcaaggtgcgctggccagacttcaaccaggaggcctacgtgggcggcaccatggtgcgcagcggccaggacccctatgccaggaacaagttcaaccaggtggagagtgacaagctgaggatggaccgggccatcccagacaccaggcatgaccagtgccagaggaagcagtggagggtggacctgcctgccacctctgtggtgatcaccttccacaatgaggcccggagcgccctgctgaggacagtggtgtctgtgctgaagaagagccccccccacctgatcaaggagatcatcctggtggatgactacagcaatgaccctgaagatggagccctgctgggcaagattgagaaggtgcgggtgctgagaaatgaccggcgggagggcctgatgaggagccgggtgagaggagcagatgctgcccaggccaaggtgctgaccttcctggacagccactgtgagtgcaatgagcactggctggagcccctgctggagcgggtggccgaggacaggaccagggtggtgagccccatcattgatgtgatcaacatggacaacttccagtatgtgggcgccagcgctgacctgaagggcggctttgactggaacctggtgttcaagtgggactacatgaccccagagcagaggaggagccggcagggcaaccctgtggcccccatcaagacccccatgattgctgggggcctgtttgtgatggacaagttctactttgaggagctgggcaagtatgacatgatgatggatgtgtggggcggggagaacctggagatctccttccgggtgtggcagtgtggcggcagcctggagatcatcccctgcagccgggtgggccacgtgttcaggaagcagcacccctacaccttccctgggggcagcggcaccgtgtttgccaggaacacccggcgggctgctgaggtgtggatggatgagtacaagaacttctactatgctgctgtgcccagcgccagaaatgtgccctacggcaacatccagagccggctggagctgaggaagaagctgagctgcaagcccttcaagtggtacctggagaatgtgtacccagagctgcgggtgcctgaccaccaggacatcgcctttggagccctgcagcagggcaccaactgcctggacaccctgggccactttgctgatggagtggtgggcgtgtatgagtgccacaatgctgggggcaaccaggagtgggccctgaccaaggagaagtctgtgaagcacatggacctgtgcctgactgtggtggaccgggcccctggcagcctcatcaagctgcagggctgcagagaaaatgacagccggcagaagtgggagcagatcgagggcaacagcaagctgcggcacgtgggcagcaacctgtgcctggacagcaggacagccaagagcggcggcctgtctgtggaggtgtgtggccctgccctgagccagcagtggaagttcaccctgaacctgcagcagtag

SEQ ID NO: 175439 - DNA, 798 bp, Artificial Sequence
  Description of Artificial Sequence: Synthetic coding sequence
atggtgcgcagcggccaggacccctatgccaggaacaagttcaaccaggtggagagtgacaagctgaggatggaccgggccatcccagacaccaggcatgaccagtgccagaggaagcagtggagggtggacctgcctgccacctctgtggtgatcaccttccacaatgaggcccggagcgccctgctgaggacagtggtgtctgtgctgaagaagagccccccccacctgatcaaggagatcatcctggtggatgactacagcaatgaccctgaagatggagccctgctgggcaagattgagaaggtgcgggtgctgagaaatgaccggcgggagggcctgatgaggagccgggtgagaggagcagatgctgcccaggccaaggtgctgaccttcctggacagccactgtgagtgcaatgagcactggctggagcccctgctggagcgggtggccgaggacaggaccagggtggtgagccccatcattgatgtgatcaacatggacaacttccagtatgtgggcgccagcgctgacctgaagggcggctttgactggaacctggtgttcaagtgggactacatgaccccagagcagaggaggagccggcagggcaaccctgtggcccccatcaaggacctggtgccccgggtggccgtgtggtggcagcccggggaccaccctgtgcagccctgtggcaccagggtgcctgaggccgcccccctgcacgtgcccggctggcagtggcactgcctgtgccccaagcaccccccaggcagccggggcctggatggatag

SEQ ID NO: 175440 - DNA, 1086 bp, Artificial Sequence
  Description of Artificial Sequence: Synthetic coding sequence
atgagaagaagaagcaggatgctgctgtgctttgccttcctgtgggtgctgggcatcgcctactacatgtacagcggcggcggcagcgccctggccggcggggccggcggcggggccggcaggaaagaagactggaatgaaattgaccccatcaagaagaaggacctgcaccacagcaatggagcagaagatggagccctgctgggcaagattgagaaggtgcgggtgctgagaaatgacagaagagagggcctgatgaggagccgggtgagaggagcagatgctgcccaggccaaggtgctgaccttcctggacagccactgtgaatgtaatgagcactggctggagcccctgctggagcgggtggccgaggacaggaccagggtggtgagccccatcattgatgtgatcaacatggacaacttccagtatgtgggcgccagcgctgacctgaagggcggctttgactggaacctggtgttcaagtgggactacatgaccccagagcagaggaggagccggcagggcaaccctgtggcccccatcaagacccccatgattgctgggggcctgtttgtgatggacaagttctactttgaggagctgggcaagtatgacatgatgatggatgtgtggggcggggagaacctggagatctccttccgggtgtggcagtgtggcggcagcctggagatcatcccctgcagccgggtgggccacgtgttcaggaagcagcacccctacaccttccctgggggcagcggcaccgtgtttgccaggaacaccaggagagctgctgaggtgtggatggatgagtacaagaacttctactatgctgctgtgcccagcgccagaaatgtgccctacggcaacatccagagccggctggagctgaggaagaagctgagctgcaagcccttcaagtggtacctggagaatgtgtacccagagctgcgggtgcctgaccaccaggacatcgccttcggggccctgcagcagggcaccaactgcctggacaccctgggccactttgctgatggagtggtgggcgtgtatgaatgtcatgtggccggcctgcggcagtag

SEQ ID NO: 175441 - DNA, 1602 bp, Artificial Sequence
  Description of Artificial Sequence: Synthetic coding sequence
atggctgaccgggaggactggaatgaaattgaccccatcaagaagaaggacctgcaccacagcaatggagaggagaaggcccagagcatggagaccctgcccccaggcaaggtgcgctggccagacttcaaccaggaggcctacgtgggcggcaccatggtgcgcagcggccaggacccctatgccaggaacaagttcaaccaggtggagagtgacaagctgaggatggaccgggccatcccagacaccaggcatgaccagtgccagaggaagcagtggagggtggacctgcctgccacctctgtggtgatcaccttccacaatgaggcccggagcgccctgctgaggacagtggtgtctgtgctgaagaagagccccccccacctgatcaaggagatcatcctggtggatgactacagcaatgaccctgaagatggagccctgctgggcaagattgagaaggtgcgggtgctgagaaatgaccggcgggagggcctgatgaggagccgggtgagaggagcagatgctgcccaggccaaggtgctgaccttcctggacagccactgtgagtgcaatgagcactggctggagcccctgctggagcgggtggccgaggacaggaccagggtggtgagccccatcattgatgtgatcaacatggacaacttccagtatgtgggcgccagcgctgacctgaagggcggctttgactggaacctggtgttcaagtgggactacatgaccccagagcagaggaggagccggcagggcaaccctgtggcccccatcaagacccccatgattgctgggggcctgtttgtgatggacaagttctactttgaggagctgggcaagtatgacatgatgatggatgtgtggggcggggagaacctggagatctccttccgggtgtggcagtgtggcggcagcctggagatcatcccctgcagccgggtgggccacgtgttcaggaagcagcacccctacaccttccctgggggcagcggcaccgtgtttgccaggaacacccggcgggctgctgaggtgtggatggatgagtacaagaacttctactatgctgctgtgcccagcgccagaaatgtgccctacggcaacatccagagccggctggagctgaggaagaagctgagctgcaagcccttcaagtggtacctggagaatgtgtacccagagctgcgggtgcctgaccaccaggacatcgcctttggagccctgcagcagggcaccaactgcctggacaccctgggccactttgctgatggagtggtgggcgtgtatgagtgccacaatgctgggggcaaccaggagtgggccctgaccaaggagaagtctgtgaagcacatggacctgtgcctgactgtggtggaccgggcccctggcagcctcatcaagctgcagggctgcagagaaaatgacagccggcagaagtgggagcagatcgagggcaacagcaagctgcggcacgtgggcagcaacctgtgcctggacagcaggacagccaagagcggcggcctgtctgtggaggtgtgtggccctgccctgagccagcagtggaagttcaccctgaacctgcagcagtag

SEQ ID NO: 175442 - DNA, 1902 bp, Artificial Sequence
  Description of Artificial Sequence: Synthetic coding sequence
atggcccacctgaagaggctggtgaagctgcacatcaagaggcactaccacaagaagttctggaagctgggcgctgtgatcttcttcttcatcatcgtgctggtgctgatgcagcgggaggtgtctgtgcagtacagcaaggaggagagcaggatggagaggaacatgaagaacaagaacaagatgctggacctgatgctggaggccgtgaacaacatcaaggatgccatgcccaagatgcagatcggggcccctgtgcggcagaacattgatgctggggagcggccctgcctgcagggctactacacagctgctgagctgaagcctgtgctggaccggcccccccaggacagcaatgcccctggggccagcggcaaggccttcaagaccaccaacctgtctgtggaggagcagaaggagaaggagcggggggaggccaagcactgcttcaatgcctttgccagtgaccgcatcagcctgcaccgggacctgggccctgacacccggcccccagagtgcatcgagcagaagttcaagcgctgcccccccctgcccaccaccagcgtcatcatcgtgttccacaatgaggcctggagcaccctgctgaggacagtgcacagcgtgctgtacagcagccctgccatcctgctgaaggagatcatcctggtggatgatgcctctgtggatgagtacctgcatgacaagctggatgaatatgtgaagcagttcagcatcgtgaagatcgtgcggcagcgggagaggaagggcctcatcacagcccggctgctgggcgccaccgtggccacagctgagaccctgaccttcctggatgcccactgtgagtgcttctacggctggctggagcccctgctggccagaattgctgagaactacacagctgtggtgtccccagacatcgccagcattgacctgaacacctttgagttcaacaagcccagcccctacggcagcaaccacaacagaggcaactttgactggagcctgagctttggctgggagagcctgcctgaccacgagaagcagaggaggaaggatgagacctaccccatcaagacccccacctttgctgggggcctcttcagcatcagcaaggagtactttgagtacatcggcagctatgatgaggagatggagatctggggcggggagaacatcgagatgtccttccgggtgtggcagtgtggcggccagctggagatcatgccctgcagcgtggtgggccacgtgttccgcagcaagagcccccacagcttccccaagggcacccaggtgattgccaggaaccaggtgcggctggccgaggtgtggatggatgagtacaaggagatcttctacagaagaaacacagatgctgccaagatcgtgaagcagaaggcctttggagacctgagcaagagatttgagatcaagcaccggctgcagtgcaagaacttcacctggtacctgaacaacatctacccagaggtgtatgtgcctgacctgaaccctgtgatcagcggctacatcaagtctgtgggccagcccctgtgcctggatgtgggggagaacaaccagggcggcaagcccctcatcatgtacacctgccacggcctgggcggcaaccagtactttgagtacagcgcccagcacgagatccgccacaacatccagaaggagctgtgcctgcacgccgcccagggcctggtgcagctgaaggcctgcacctacaagggccacaagacagtggtgactggagagcagatctgggagatccagaaggaccagctgctgtacaaccccttcctgaagatgtgcctgagcgccaatggagagcaccccagcctggtgtcctgcaaccccagcgaccccctgcagaagtggatcctgagccagaatgactag

SEQ ID NO: 175443 - DNA, 1395 bp, Artificial Sequence
  Description of Artificial Sequence: Synthetic coding sequence
atggcccacctgaagaggctggtgaagctgcacatcaagaggcactaccacaagaagttctggaagctgggcgctgtgatcttcttcttcatcatcgtgctggtgctgatgcagcgggaggtgtctgtgcagtacagcaaggaggagagcaggatggagaggaacatgaagaacaagaacaagatgctggacctgatgctggaggccgtgaacaacatcaaggatgccatgcccaagatgcagatcggggcccctgtgcggcagaacattgatgctggggagcggccctgcctgcagggctactacacagctgctgagctgaagcctgtgctggaccggcccccccaggacagcaatgcccctggggccagcggcaaggccttcaagaccaccaacctgtctgtggaggagcagaaggagaaggagcggggggaggccaagcactgcttcaatgcctttgccagtgaccgcatcagcctgcaccgggacctgggccctgacacccggcccccagagtgcatcgagcagaagttcaagcgctgcccccccctgcccaccaccagcgtcatcatcgtgttccacaatgaggcctggagcaccctgctgaggacagtgcacagcgtgctgtacagcagccctgccatcctgctgaaggagatcatcctggtggatgatgcctctgtggatgagtacctgcatgacaagctggatgaatatgtgaagcagttcagcatcgtgaagatcgtgcggcagcgggagaggaagggcctcatcacagcccggctgctgggcgccaccgtggccacagctgagaccctgaccttcctggatgcccactgtgagtgcttctacggctggctggagcccctgctggccagaattgctgagaactacacagctgtggtgtccccagacatcgccagcattgacctgaacacctttgagttcaacaagcccagcccctacggcagcaaccacaacagaggcaactttgactggagcctgagctttggctgggagagcctgcctgaccacgagaagcagaggaggaaggatgagacctaccccatcaagacccccacctttgctgggggcctcttcagcatcagcaaggagtactttgagtacatcggcagctatgatgaggagatggagatctggggcggggagaacatcgagatgtccttccgggtgtggcagtgtggcggccagctggagatcatgccctgcagcgtggtgggccacgtgttccgcagcaagagcccccacagcttccccaagggcacccaggtgattgccaggaaccaggtgcggctggccgaggtgtggatggatgagtacaaggagatcttctacagaagaaacacagatgctgccaagatcgtgaagcagtag

SEQ ID NO: 175444 - DNA, 174 bp, Artificial Sequence
  Description of Artificial Sequence: Synthetic coding sequence
atggcccacctgaagaggctggtgaagctgcacatcaagaggcactaccacaagaagttctggaagctgggcgctgtgatcttcttcttcatcatcgtgctggtgctgatgcagcgggaggtgtctgtgcagtacagcaaggaggagagcaggatggagaggaacatgaagtag

SEQ ID NO: 175445 - DNA, 78 bp, Artificial Sequence
  Description of Artificial Sequence: Synthetic coding sequence
atggcccacctgaagaggctggtgaagctgcacatcaagaggcactaccacaagaagttctggaagctgggcgcctag

SEQ ID NO: 175446 - DNA, 273 bp, Artificial Sequence
  Description of Artificial Sequence: Synthetic coding sequence
atggcccacctgaagaggctggtgaagctgcacatcaagaggcactaccacaagaagttctggaagctgggcgctgtgatcttcttcttcatcatcgtgctggtgctgatgcagcgggaggtgtctgtgcagtacagcaaggaggagagcaggatggagaggaacatgaagaacaagaacaagatgctggacctgatgctggaggccgtgaacaacatcaaggatgccatgcccaagatgcagatcggggcccctgtgcggcagaacatctag

SEQ ID NO: 175447 - DNA, 36 bp, Artificial Sequence
  Description of Artificial Sequence: Synthetic coding sequence
atggcccacctgaagaggctggtgaagctgcactag

SEQ ID NO: 175448 - DNA, 1737 bp, Artificial Sequence
  Description of Artificial Sequence: Synthetic coding sequence
atggctgtgcgctggacctgggccggcaagagctgcctgctgctggccttcctgactgtggcctacatctttgtggagctgctggtgtccaccttccacgccagcgctggggccggccgggcccgggagctgggcagccggcggctgagtgacctgcagaagaacacagaggacctgagccggcccctgtacaagaagcccccagctgacagccgggccctgggggagtggggcaaggccagcaagctgcagctgaatgaagatgagctgaagcagcaggaggagctgattgaaagatatgccatcaacatctacctgagtgaccgcatcagcctgcaccgccacatcgaggacaagaggatgtatgagtgcaagagccagaagttcaactaccgcaccctgcccaccaccagcgtcatcatcgccttctacaatgaggcctggagcaccctgctgcggaccatccacagcgtgctggagaccagccctgctgtgctgctgaaggagatcatcctggtggatgacctgagtgacagagtgtacctgaagacccagctggagacctacatcagcaacctggacagagtgcggctcatccgcaccaacaagcgggagggcctggtgcgggcccggctgattggagccacctttgccactggagatgtgctgaccttcctggactgccactgtgagtgcaacagcggctggctggagcccctgctggagcgcatcggcagagatgaaacagctgtggtgtgccctgtgattgacaccatcgactggaacacctttgagttctacatgcagatcggggagcccatgattggaggctttgactggaggctgaccttccagtggcacagcgtgcccaagcaggagcgggaccggcgcatcagcagaattgaccccatccgcagccccaccatggccggcggcctgtttgctgtgtccaagaagtacttccagtacctgggcacctatgacaccggcatggaggtgtggggcggggagaacctggagctgtccttccgggtgtggcagtgtggcggcaagctggagatccacccctgcagccacgtgggccacgtgttccccaagagggccccctatgcccggcccaacttcctgcagaacacagcccgggctgctgaggtgtggatggatgagtacaaggagcacttctacaacagaaatcctccagccaggaaggaggcctacggggacatcagcgagaggaagctgctgcgggagcggctgcgctgcaagagctttgactggtacctgaagaatgtgttccccaacctgcacgtgcctgaagatcggcccggctggcatggagccatccgcagccggggcatcagcagcgagtgcctggactacaacagcccagacaacaaccccaccggggccaacctgagcctgtttggctgccacggccagggcggcaaccagttctttgagtacaccagcaacaaggagatccgcttcaacagcgtgacagagctgtgtgccgaggtgcctgagcagaagaactacgtgggcatgcagaactgccccaaggatggcttccctgtgcctgccaacatcatctggcacttcaaggaggatggcaccatcttccacccccacagcggcctgtgcctgagcgcctaccgcaccccagagggccgcccagatgtgcagatgaggacctgtgatgccctggacaagaaccagatctggagctttgagaagtag

SEQ ID NO: 175449 - DNA, 1869 bp, Artificial Sequence
  Description of Artificial Sequence: Synthetic coding sequence
atgaggctgctgcggcggcggcacatgcccctgcggctggccatggtgggctgtgcctttgtgctcttcctgttcctgctgcacagagatgtgagcagccgggaggaggccacagagaagccctggctgaagagcctggtgtccaggaaggaccacgtgctggacctgatgctggaggccatgaacaacctgcgggacagcatgcccaagctgcagatccgggcccctgaggcccagcagaccctcttcagcatcaaccagagctgcctgcccggcttctacaccccagctgagctgaagcccttctgggagcggcccccccaggaccccaatgcccctggagcagatggcaaggccttccagaagagcaagtggacccccctggagacccaggagaaggaggagggctacaagaagcactgcttcaatgcctttgccagtgaccgcatcagcctgcagaggagcctgggccctgacacccggcccccagaatgtgtggaccagaagttccgccgctgcccccccctggccaccaccagcgtcatcatcgtgttccacaatgaggcctggagcaccctgctgaggacagtgtacagcgtgctgcacaccaccccagccatcctgctgaaggagatcatcctggtggatgatgccagcacagaggagcacctgaaggagaagctggagcagtatgtgaagcagctgcaggtggtgcgggtggtgcggcaggaggagaggaagggcctcatcacagcccggctgctgggcgcctctgtggcccaggccgaggtgctgaccttcctggatgcccactgtgagtgcttccacggctggctggagcccctgctggccagaattgctgaggacaagacagtggtggtgtccccagacatcgtgaccatcgacctgaacacctttgaatttgccaagcctgtgcagaggggccgggtgcacagccggggcaactttgactggagcctgaccttcggctgggagaccctgccccctcatgagaagcagaggaggaaggatgagacctaccccatcaagagccccacctttgctgggggcctcttcagcatcagcaagagctactttgagcacatcggcacctatgacaaccagatggagatctggggcggggagaatgtggagatgtccttccgggtgtggcagtgtggcggccagctggagatcatcccctgcagcgtggtgggccacgtgttccgcaccaagagcccccacaccttccccaagggcaccagcgtcatcgccaggaaccaggtgcggctggccgaggtgtggatggacagctacaagaagatcttctacagaagaaacctgcaggccgccaagatggcccaggagaagagctttggagacatcagcgagcggctgcagctgcgggagcagctgcactgccacaacttctcctggtacctgcacaacgtgtacccagagatgtttgtgcctgacctgacccccaccttctacggggccatcaagaacctgggcaccaaccagtgcctggatgtgggggagaacaacagaggaggcaagcccctcatcatgtacagctgccacggcctgggcggcaaccagtactttgagtacaccacccagagggacctgcggcacaacatcgccaagcagctgtgcctgcacgtgtccaagggggccctgggcctgggcagctgccacttcaccgggaagaacagccaggtgcccaaggatgaggagtgggagctggcccaggaccagctgatccggaacagcggcagcggcacctgcctgaccagccaggacaagaagccagccatggccccctgcaaccccagcgacccccaccagctgtggctgtttgtgtag

SEQ ID NO: 175450 - DNA, 1869 bp, Artificial Sequence; identical to SEQ ID NO: 175449
  Description of Artificial Sequence: Synthetic coding sequence

SEQ ID NO: 175451 - DNA, 1812 bp, Artificial Sequence
  Description of Artificial Sequence: Synthetic coding sequence
atgaggctgctgcggcggcggcacatgcccctgcggctggccatggtgggctgtgcctttgtgctcttcctgttcctgctggtgtccaggaaggaccacgtgctggacctgatgctggaggccatgaacaacctgcgggacagcatgcccaagctgcagatccgggcccctgaggcccagcagaccctcttcagcatcaaccagagctgcctgcccggcttctacaccccagctgagctgaagcccttctgggagaggcctccccaggaccccaatgcccctggagcagatggcaaggccttccagaagagcaagtggacccccctggagacccaggagaaggaggagggctacaagaagcactgcttcaatgcctttgccagtgaccgcatcagcctgcagaggagcctgggccctgacacccggcccccagaatgtgtggaccagaagttccgccgctgcccccccctggccaccaccagcgtcatcatcgtgttccacaatgaggcctggagcaccctgctgaggacagtgtacagcgtgctgcacaccaccccagccatcctgctgaaggagatcatcctggtggatgatgccagcacagaggagcacctgaaggagaagctggagcagtatgtgaagcagctgcaggtggtgcgggtggtgcggcaggaggagaggaagggcctcatcacagcccggctgctgggcgcctctgtggcccaggccgaggtgctgaccttcctggatgcccactgtgagtgcttccacggctggctggagcccctgctggccagaattgctgaggacaagacagtggtggtgtccccagacatcgtgaccatcgacctgaacacctttgaatttgccaagcctgtgcagaggggccgggtgcacagccggggcaactttgactggagcctgaccttcggctgggagaccctgccccctcatgagaagcagaggaggaaggatgagacctaccccatcaagagccccacctttgctgggggcctcttcagcatcagcaagagctactttgagcacatcggcacctatgacaaccagatggagatctggggcggagaaaatgtggagatgtccttccgggtgtggcagtgtggcggccagctggagatcatcccctgcagcgtggtgggccacgtgttccgcaccaagagcccccacaccttccccaagggcacctctgtgattgccaggaaccaggtgcggctggccgaggtgtggatggacagctacaagaagatcttctacagaagaaacctgcaggccgccaagatggcccaggagaagagctttggagacatcagcgagcggctgcagctgcgggagcagctgcactgccacaacttctcctggtacctgcacaacgtgtacccagagatgtttgtgcctgacctgacccccaccttctatggagccatcaagaacctgggcaccaaccagtgcctggatgtgggggagaacaacagaggaggcaagcccctcatcatgtacagctgccacggcctgggcggcaaccagtactttgagtacaccacccagagggacctgcggcacaacatcgccaagcagctgtgcctgcacgtgtccaaaggagccctgggcctgggcagctgccacttcaccgggaagaacagccaggtgcccaaggatgaggagtgggagctggcccaggaccagctgatcagaaattctggcagcggcacctgcctgaccagccaggacaagaagccagccatggccccctgcaaccccagcgacccccaccagctgtggctgtttgtgtag

SEQ ID NO: 175452 - DNA, 1974 bp, Artificial Sequence
  Description of Artificial Sequence: Synthetic coding sequence
atgaggctgaagattggcttcatcctgcggagcctgctggtggtgggcagcttcctgggcctggtggtgctgtggagcagcctgacccccaggccagatgaccccagccccctgagcaggatgagagaagatagagatgtgaatgaccccatgcccaacagaggaggaaatggcctggcccctggagaagatcgcttcaagcctgtggtgccctggccccacgtggagggcgtggaggtggacctggagagcatccgccgcatcaacaaggccaagaatgagcaggagcaccacgccggcggggacagccagaaggacatcatgcagaggcagtacctgaccttcaagccccagaccttcacctaccatgaccctgtgctgcggcccggcatcctgggcaactttgagcccaaggagcctgagcccccaggagtggtgggcggccctggagagaaggccaagcccctggtgctgggccctgagttcaagcaggccatccaggccagcatcaaggagtttggcttcaacatggtggccagtgacatgatcagcctggacagatctgtgaatgacctgcggcaggaggagtgcaagtactggcactatgatgagaacctgctgaccagctctgtggtgattgtgttccacaatgaaggctggagcaccctgatgaggacagtgcacagcgtcatcaagaggacccccaggaagtacctggccgagatcgtgctgattgatgacttcagcaacaaggagcacctgaaggagaagctggatgagtacatcaagctgtggaatggcctggtgaaggtgttcagaaatgaaagaagagagggcctcatccaggcccggagcatcggggcccagaaggccaagctgggccaggtgctgatctacctggatgcccactgtgaggtggccgtgaactggtacgcccccctggtggcccccatcagcaaggacaggaccatctgcaccgtgcccctgattgatgtgatcaatggaaacacctatgagatcatcccccagggcggcggagatgaagatggctacgcccggggggcctgggactggagcatgctgtggaagagggtgcccctgaccccccaggagaagaggctgaggaagaccaagacagagccctaccgcagccctgccatggccggcggcctgtttgccatcgagcgggagttcttctttgagctgggcctgtatgaccccggcctgcagatctggggcggagaaaattttgagatctcctacaagatctggcagtgtggcggcaagctgctgtttgtgccctgcagccgggtgggccacatctaccgcctggagggctggcagggcaaccccccacccatctacgtgggcagcagccccaccctgaagaactacgtgcgggtggtggaggtgtggtgggatgagtacaaggactacttctacgccagcaggcctgagagccaggccctgccctacggggacatcagcgagctgaagaagttccgggaggaccacaactgcaagagcttcaagtggttcatggaggagatcgcctatgacatcaccagccactaccccctgccccccaagaatgtggactggggcgagatccggggctttgaaacagcctactgcatcgacagcatgggcaagaccaatggaggctttgtggagctgggcccctgccacaggatgggcggcaaccagctgttccgcatcaatgaggccaaccagctgatgcagtatgaccagtgcctgaccaagggagcagatggcagcaaggtgatgatcacccactgcaacctgaatgagttcaaggagtggcagtacttcaagaacctgcaccgcttcacccacatccccagcggcaagtgcctggacagaagtgaggtgctgcaccaggtgttcatcagcaactgtgacagcagcaagaccacccagaagtgggagatgaacaacatccacagcgtgtag

SEQ ID NO: 175453 - DNA, 717 bp, Artificial Sequence
  Description of Artificial Sequence: Synthetic coding sequence
atgaggacagtgcacagcgtcatcaagaggacccccaggaagtacctggccgagatcgtgctgattgatgacttcagcaacaaggagcacctgaaggagaagctggatgagtacatcaagctgtggaatggcctggtgaaggtgttcagaaatgaaagaagagagggcctcatccaggcccggagcattggagcccagaaggccaagctgggccaggtgctgatctacctggatgcccactgtgaggtggccgtgaactggtacgcccccctggtggcccccatcagcaaggacaggaccacctgcaccgtgcccctgattgactacattgatggaaatgactacagcattgagccccagcagggcggagatgaagatggctttgcccggggggcctgggactggagcctgctgtggaagaggatccccctgagccacaaggagaaggccaagaggaagcacaagacagagccctaccgcagccctgccatggccggcggcctgtttgccatcgagcgggagttcttctttgagctgggcctgtatgaccccggcctgcagatctggggcggcaagaccctgcggagccacaccaggtatggctctgtggtggccaactactacctgttcctggtgctggtgctggacatcagcacagtgctgcgggccggcaaggagatcctgcggcccttcatgctgggcctgctgcagctgtag

SEQ ID NO: 175454 - DNA, 1914 bp, Artificial Sequence
  Description of Artificial Sequence: Synthetic coding sequence
atgatgttctggaggaagctgcccaaggccctcttcatcggcctgaccctggccatcgctgtgaacctgctgctggtgttcagcagcaagggcaccctgcagaacctcttcaccggcggcctgcaccgggagctgcccctgcacctgaacaagagatatggagctgtgatcaagaggctgagccacctggaggtggagctgcaggacctgaaggagagcatgaagctggccctgcggcagcaggagaatgtgaacagcaccctgaagagggccaaggatgaggtgcggcccctgctgaaggccatggagaccaaggtgaatgagaccaagaagcacaagacccagatgaagctgttcccccacagccagctgttccggcagtggggcgaggacctgtctgaggcccagcagaaggccgcccaggacctcttcaggaagtttggctacaatgcctacctgagcaaccagctgcccctgaacagaaccatcccagacacccgggactaccgctgcctgaggaagacctaccccagccagctgcccagcctgagcgtcatcctgatctttgtgaatgaggccctgagcatcatccagagggccatcaccagcatcatcaacagaacacccagccggctgctgaaggagatcatcctggtggatgacttcagcagcaatggagagctgaaggtgcacctggatgagaagatcaagctgtacaaccagaagtacccaggcctgctgaagatcatccgccaccctgagaggaagggcctggcccaggccaggaacacaggctgggaggccgccacagcagatgtggtggccatcctggatgcccacatcgaggtgaatgtgggctgggccgagcccatcctggcccgcatccaggaggacagaactgtcatcgtgtcccctgtgtttgacaacatccgctttgacaccttcaagctggacaagtatgagctggccgtggatggcttcaactgggagctgtggtgccgctatgatgccctgccccaggcctggattgacctgcatgatgtgacagcccctgtgaagagccccagcatcatgggcatcctggccgccaacagacacttcctgggggagatcggcagcctggatggcggcatgctgatctatggaggagaaaatgtggagctgagcctgcgggtgtggcagtgtggcggcaaggtggagatcctgccctgcagcagaattgcccacctggagcggcaccacaagccctatgccctggacctgacagctgccctgaagagaaatgccctgcgggtggccgagatctggatggatgagcacaagcacatggtgtacctggcctggaacatccccctgcagaacagcggcatcgactttggagatgtgagcagcaggatggccctgcgggagaagctgaagtgcaagacctttgactggtacctgaagaatgtgtaccccctgctgaagcccctgcacaccatcgtgggctacggccgcatgaagaacctgctggatgaaaatgtgtgcctggaccagggccctgtgcccggcaacacccccatcatgtactactgccacgagttcagcagccagaatgtgtactaccacctgaccggggagctgtatgtgggccagctgattgctgaggccagcgccagtgaccgctgcctgacagaccccgggaaggccgagaagcccaccctggagccctgcagcaaggccgccaagaaccggctgcacatctactgggacttcaagccaggaggagctgtgatcaacagagacaccaagcgctgcctggagatgaagaaggacctgctgggcagccacgtgctggtgctgcagacctgcagcacccaggtgtgggagatccagcacacagtgcgggactggggccagaccaacagccagtag

SEQ ID NO: 175455 - DNA, 648 bp, Artificial Sequence
  Description of Artificial Sequence: Synthetic coding sequence
atggagtttgactgtgagggcctgcggcggctgctgggcaagtacaagttccgggacctgactgtggaggagctgagaaatgtgaatgtgttcttcccccacttcaagtacagcatggacacctacgtgttcaaggacagcagccagaaggacctgctgaacttcaccggcaccatccctgtgatgtaccagggcaacacctacaacatccccatccgcttctggatcctggacagccacccctttgccccacccatctgcttcctgaagcccacagccaacatgggcatcctggtgggcaagcacgtggatgcccagggccgcatctacctgccctacctgcagaactggagccaccccaagagcgtcatcgtgggcctcatcaaggagatgattgccaagttccaggaggagctgcccatgtacagcctgagcagcagtgatgaggcccggcaggtggacctgctggcctacatcgccaagatcacagaaggagtgtctgacaccaacagcaagtcctgggccaaccacgagaacaagacagtgaacaagatcaccgtggtgggcggcggggagctgggcatcgcctgcaccctggccatcagcgccaaggtggagagccgctctgtgacccaggccggcgtgtag

SEQ ID NO: 175456 - DNA, 1416 bp, Artificial Sequence
  Description of Artificial Sequence: Synthetic coding sequence
atggagtttgactgtgagggcctgcggcggctgctgggcaagtacaagttccgggacctgactgtggaggagctgagaaatgtgaatgtgttcttcccccacttcaagtacagcatggacacctacgtgttcaaggacagcagccagaaggacctgctgaacttcaccggcaccatccctgtgatgtaccagggcaacacctacaacatccccatccgcttctggatcctggacagccacccctttgccccacccatctgcttcctgaagcccacagccaacatgggcatcctggtgggcaagcacgtggatgcccagggccgcatctacctgccctacctgcagaactggagccaccccaagagcgtcatcgtgggcctcatcaaggagatgattgccaagttccaggaggagctgcccatgtacagcctgagcagcagtgatgaggcccggcaggtggacctgctggcctacatcgccaagatcacagaaggagtgtctgacaccaacagcaagtcctgggccaaccacgagaacaagacagtgaacaagatcaccgtggtgggcggcggggagctgggcatcgcctgcaccctggccatcagcgccaagggcattgctgaccggctggtgctgctggacctgtctgagggcaccaagggggccaccatggacctggagatcttcaacctgcccaacgtggagatcagcaaggacctgagcgccagcgcccacagcaaggtggtgatcttcaccgtgaacagcctgggcagcagccagagctacctggatgtggtgcagagcaatgtggacatgttccgggccctggtgcctgccctgggccactacagccagcacagcgtgctgctggtggccagccagcctgtggagatcatgacctacgtgacctggaagctgagcaccttccctgccaacagagtgattggaattggctgcaacctggacagccagaggctgcagtacatcatcaccaacgtgctgaaggcccagaccagcggcaaggaggtgtgggtgattggagagcagggcgaggacaaggtgctgacctggagcggccaggaggaggtggtgagccacaccagccaggtgcagctgagcaacagagccatggagctgctgcgggtgaagggccagaggtcctggagcgtgggcctgtctgtggccgacatggtggacagcatcgtgaacaacaagaagaaggtgcacagcgtgtctgccctggccaagggctactatgacatcaacagcgaggtgttcctgagcctgccctgcatcctgggcaccaacggggtgtctgaggtgatcaagaccaccctgaaggaggacacagtgacagagaagctgcagagcagcgccagcagcatccacagcctgcagcagcagctgaagctgtag

SEQ ID NO: 175457 - DNA, 747 bp, Artificial Sequence
  Description of Artificial Sequence: Synthetic coding sequence
atggacctggagatcttcaacctgcccaacgtggagatcagcaaggacctgagcgccagcgcccacagcaaggtggtgatcttcaccgtgaacagcctgggcagcagccagagctacctggatgtggtgcagagcaatgtggacatgttccgggccctggtgcctgccctgggccactacagccagcacagcgtgctgctggtggccagccagcctgtggagatcatgacctacgtgacctggaagctgagcaccttccctgccaacagagtcatcggcatcggctgcaacctggacagccagaggctgcagtacatcatcaccaacgtgctgaaggcccagaccagcggcaaggaggtgtgggtgattggagagcagggcgaggacaaggtgctgacctggagcggccaggaggaggtggtgagccacaccagccaggtgcagctgagcaacagagccatggagctgctgcgggtgaagggccagaggtcctggagcgtgggcctgtctgtggccgacatggtggacagcatcgtgaacaacaagaagaaggtgcacagcgtgtctgccctggccaagggctactatgacatcaacagcgaggtgttcctgagcctgccctgcatcctgggcaccaatggagtgtctgaggtgatcaagaccaccctgaaggaggacacagtgacagagaagctgcagagcagcgccagcagcatccacagcctgcagcagcagctgaagctgtag

SEQ ID NO: 175458 - DNA, 1140 bp, Artificial Sequence
  Description of Artificial Sequence: Synthetic coding sequence
atggagtttgactgtgagggcctgcggcggctgctgggcaagtacaagttccgggacctgactgtggaggagctgagaaatgtgaatgtgttcttcccccacttcaagtacagcatggacacctacgtgttcaaggacagcagccagaaggacctgctgaacttcaccggcaccatccctgtgatgtaccagggcaacacctacaacatccccatccgcttctggatcctggacagccacccctttgccccacccatctgcttcctgaagcccacagccaacatgggcatcctggtgggcaagcacgtggatgcccagggccgcatctacctgccctacctgcagaactggagccaccccaagagcgtcatcgtgggcctcatcaaggagatgattgccaagttccaggaggagctgcccatgtacagcctgagcagcagtgatgaggcccggcaggtggacctgctggcctacatcgccaagatcacagaaggagtgtctgacaccaacagcaagtcctgggccaaccacgagaacaagacagtgaacaagatcaccgtggtgggcggcggggagctgggcatcgcctgcaccctggccatcagcgccaagggcattgctgaccggctggtgctgctggacctgtctgagggcaccaagggggccaccatggacctggagatcttcaacctgcccaacgtggagatcagcaaggacctgagcgccagcgcccacagcaaggtggtgatcttcaccgtgaacagcctgggcagcagccagagctacctggatgtggtgcagagcaatgtggacatgttccgggccctggtgcctgccctgggccactacagccagcacagcgtgctgctggtggccagccagcctgtggagatcatgacctacgtgacctggaagctgagcaccttccctgccaacagagtgattggaattggctgcaacctggacagccagaggctgcagtacatcatcaccaacgtgctgaaggcccagaccagcggcaaggaggtgtgggtgattggagagcagggcgaggacaaggtgctgacctggagcggccaggaggaggtggtgagccacaccagccaggtgcagctgagcaacagagacatcatgatctag

SEQ ID NO: 175459 - DNA, 1350 bp, Artificial Sequence
  Description of Artificial Sequence: Synthetic coding sequence
atggagtttgactgtgagggcctgcggcggctgctgggcaagtacaagttccgggacctgactgtggaggagctgagaaatgtgaatgtgttcttcccccacttcaagtacagcatggacacctacggcaacacctacaacatccccatccgcttctggatcctggacagccacccctttgccccacccatctgcttcctgaagcccacagccaacatgggcatcctggtgggcaagcacgtggatgcccagggccgcatctacctgccctacctgcagaactggagccaccccaagagcgtcatcgtgggcctcatcaaggagatgattgccaagttccaggaggagctgcccatgtacagcctgagcagcagtgatgaggcccggcaggtggacctgctggcctacatcgccaagatcacagaaggagtgtctgacaccaacagcaagtcctgggccaaccacgagaacaagacagtgaacaagatcaccgtggtgggcggcggggagctgggcatcgcctgcaccctggccatcagcgccaagggcattgctgaccggctggtgctgctggacctgtctgagggcaccaagggggccaccatggacctggagatcttcaacctgcccaacgtggagatcagcaaggacctgagcgccagcgcccacagcaaggtggtgatcttcaccgtgaacagcctgggcagcagccagagctacctggatgtggtgcagagcaatgtggacatgttccgggccctggtgcctgccctgggccactacagccagcacagcgtgctgctggtggccagccagcctgtggagatcatgacctacgtgacctggaagctgagcaccttccctgccaacagagtgattggaattggctgcaacctggacagccagaggctgcagtacatcatcaccaacgtgctgaaggcccagaccagcggcaaggaggtgtgggtgattggagagcagggcgaggacaaggtgctgacctggagcggccaggaggaggtggtgagccacaccagccaggtgcagctgagcaacagagccatggagctgctgcgggtgaagggccagaggtcctggagcgtgggcctgtctgtggccgacatggtggacagcatcgtgaacaacaagaagaaggtgcacagcgtgtctgccctggccaagggctactatgacatcaacagcgaggtgttcctgagcctgccctgcatcctgggcaccaacggggtgtctgaggtgatcaagaccaccctgaaggaggacacagtgacagagaagctgcagagcagcgccagcagcatccacagcctgcagcagcagctgaagctgtag

SEQ ID NO: 175460 - DNA, 429 bp, Artificial Sequence
  Description of Artificial Sequence: Synthetic coding sequence
atgggagacaagcccccaggcttccggggcagccgggactggattggctgtgtggaggccagcctgtgcctggcccactttggaggcccccagggccgcctgtgccacgtgccccggggcgtgggcctgcacggggagctggagcggctgtacagccactttgctgggggcggcggccctgtgatggtgggcggagatgctgatgcccggagcaaggccctgctgggcgtgtgtgtgggcagcggcacagaggcctacgtgctggtgctggacccccactactggggcacccccaagagccccagcgagctgcaggccgccggctgggtgggctggcaggaggtgtctgctgcctttgaccccaacagcttctacaacctgtgcctgaccagcctgagcagccagcagcagcagaggaccctggactag

SEQ ID NO: 175461 - DNA, 1410 bp, Artificial Sequence
  Description of Artificial Sequence: Synthetic coding sequence
atggtgatcagcgagagcatggacatcctcttccgcatccggggcggcctggacctggccttccagctggccaccccaaatgagatcttcctgaagaaggccctgaagcacgtgctgagtgacctgagcaccaagctgagcagcaatgccctggtgttccgcatctgccacagctctgtgtacatctggcccagcagtgacatcaacaccatccctggagagctgacagatgccagcgcctgcaagaacatcctgcgcttcatccagtttgagcctgaggaggacatcaagaggaagttcatgaggaagaaggacaagaagctgagtgacatgcaccagatcgtgaacatcgacctgatgctggagatgagcaccagcctggccgctgtgacccccatcatcgagcgggagagcggcggccaccactacgtgaacatgaccctgcctgtggatgctgtgatctctgtggcccctgaggagacctggggcaaggtgaggaagctgctggtggatgccatccacaaccagctgacagacatggagaagtgcatcctgaagtacatgaagggcaccagcatcgtggtgcctgagcccctgcacttcctgctgcccgggaagaagaacctggtgaccatctcctaccccagcggcatcccagatggccagctgcaggcctacaggaaggagctgcatgacctcttcaacctgccccatgaccggccctacttcaagaggagcaatgcctaccacttcccagatgagccctacaaggatggctacatccggaacccccacacctacctgaacccccccaacatggagaccggcatgatctacgtggtgcagggcatctacggctaccaccactacatgcaggacagaattgatgacaatggctggggctgtgcctaccgcagcctgcagaccatctgctcctggttcaagcaccagggctacacagagaggagcatccccacccaccgggagatccagcaggccctggtggatgctggggacaagccagccacctttgtgggcagccggcagtggattggcagcattgaggtgcagctggtgctgaaccagctgattggcatcaccagcaagatcctgtttgtgtcccagggcagcgagatcgccagccagggccgggagctggccaaccacttccagagcgagggcacccctgtgatgattggaggcggcgtgctggcccacaccatcctgggcgtggcctggaatgagatcaccggccagatcaagttcctgatcctggacccccactacaccggggctgaggacctgcaggtgatcctggagaagggctggtgtggctggaagggccctgacttctggaacaaggatgcctactacaacctgtgcctgccccagaggcccaacatgatctag

SEQ ID NO: 175462 - DNA, 2484 bp, Artificial Sequence
  Description of Artificial Sequence: Synthetic coding sequence
atggtggtgcagaagccccacggcaccatggagtacacagctggcaaccaggacaccctgaacagcatcgccctgaagttcaacatcacccccaacaagctggtggagctgaacaagctgttcacccacaccatcgtgcccggccaggtgctgtttgtgcctgatgccaacagccccagcagcaccctgcggctgagcagcagcagccctggggccaccgtgagccccagcagcagtgatgctgaatatgacaagctgcctgatgctgacctggccaggaaggccctgaagcccatcgagcgggtgctgagcagcaccagtgaagaagatgagcccggggtggtgaagttcctgaagatgaactgccgctacttcacagatggaaaaggagtggtgggcggcgtgatgattgtgacccccaacaacatcatgtttgacccccacaagagtgaccccctggtgattgaaaatggctgtgaggagtatggcctcatctgccccatggaggaggtggtgtccatcgccctgtacaatgacatcagccacatgaagatcaaggatgccctgcccagccctggagagtgggaggacctggccagcgagaaggacatcaaccccttcagcaagttcaagagcatcaacaaggagaagaggcagcagaatggagagaagatcatgaccagtgacagccggcccatcgtgcccctggagaagagcacaggccacacccccaccaagcccagcggcagctctgtgtctgagaagctgaagaagctggacagcagccgggagaccagccacggcagccccaccgtgaccaagctgagcaaggagcccagcgacaccagcagcgcctttgagagcacagccaaggagaacttcctgggagaagatgatgactttgtggacctggaggagctgagcagccagacaggaggcggcatgcacaagaaggacaccctgaaggaatgtctgagcctggaccctgaggagaggaagaaggccgagagccagatcaacaacagcgctgtggagatgcaggtgcagagcgccctggccttcctgggcacagaaaatgatgtggagctgaagggggccctggacctggagacctgtgagaagcaggacatcatgcctgaggtggacaagcagagcggcagccctgagagccgggtggagaacaccctgaacatccacgaggacctggacaaggtgaagctgattgagtactacctgaccaagaacaaggagggcccccaggtgtctgagaacctgcagaagacagagctgagtgatggcaagagcattgagcccggcggcatcgacatcaccctgagcagcagcctgagccaggccggggaccccatcacagagggcaacaaggagccagacaagacctgggtgaagaagggggagcccctgcctgtgaagctgaacagcagcacagaggccaacgtcatcaaggaggccctggacagcagcctggagagcaccctggacaacagctgccagggcgcccagatggacaacaagtctgaggtgcagctgtggctgctgaagaggatccaggtgcccatcgaggacatcctgcccagcaaggaggagaagagcaagaccccacccatgttcctgtgcatcaaggtgggcaagcccatgaggaagagctttgccacccacacagctgccatggtgcagcagtatggcaagaggaggaagcagcctgagtactggtttgctgtgccccgggagcgggtggaccacctgtacaccttctttgtgcagtggagcccagatgtgtatggcaaggatgccaaggagcagggctttgtggtggtggagaaggaggagctgaacatgattgacaacttcttcagcgagcccaccaccaagtcctgggagatcatcaccgtggaggaggccaagaggaggaagagcacctgcagctactatgaagatgaagatgaggaggtgctgcctgtgctgcggccccacagcgccctgctggagaacatgcacatcgagcagctggcccggcggctgcctgcccgggtgcagggctacccctggaggctggcctacagcaccctggagcacggcaccagcctgaagaccctgtacaggaagagcgccagcctggacagccctgtgctgctggtgatcaaggacatggacaaccagatctttggagcctatgccacccaccccttcaagttcagtgaccactactatggaactggagagaccttcctgtacaccttcagcccccacttcaaggtgttcaagtggagcggagaaaattcctacttcatcaatggagacatcagcagcctggagctgggcggcggcggcggccgcttcggcctgtggctggatgctgacctgtaccacggccgcagcaacagctgcagcaccttcaacaatgacatcctgagcaagaaggaggacttcatcgtgcaggacctggaggtgtgggcctttgattag

SEQ ID NO: 175463 - DNA, 735 bp, Artificial Sequence; identical to SEQ ID NO: 169712
  Description of Artificial Sequence: Synthetic coding sequence

SEQ ID NO: 175464 - DNA, 741 bp, Artificial Sequence
  Description of Artificial Sequence: Synthetic coding sequence
atggctgctgctgctgccaccaagatcctgctgtgcctgcccctgctgctgctgctgagcggctggagcagagctggccgggctgacccccacagcctgtgctatgacatcaccgtcatccccaagttccggcccggcccccgctggtgtgctgtgcagggccaggtggatgagaagaccttcctgcactatgactgtggcaacaagacagtgacccctgtgagccccctgggcaagaagctgaatgtgaccacagcctggaaggcccagaaccctgtgctgcgggaggtggtggacatcctgacagagcagctgcgggacatccagctggagaactacacccccaaggagcccctgaccctgcaggccaggatgagctgtgagcagaaggccgagggccacagcagcggctcctggcagttctcctttgatggccagatcttcctgctgtttgattctgagaagaggatgtggaccaccgtgcaccctggggccaggaagatgaaggagaagtgggagaatgacaaggtggtggccatgtccttccactacttctccatgggagactgcatcggctggctggaggacttcctgatgggcatggacagcaccctggagcccagcgctggggcccccctggccatgagcagcggcaccacccagctgcgggccacagccaccaccctcatcctgtgctgcctgctgatcatcctgccctgcttcatcctgcccggcatctag

SEQ ID NO: 175465 - DNA, 510 bp, Artificial Sequence
  Description of Artificial Sequence: Synthetic coding sequence
atggctgctgctgccagccctgccatcctgccccggctggccatcctgccctacctgctgtttgactggagcggcaccggccgggcagatgcccacagcctgtggtacaacttcaccatcatccacctgcccaggcatggccagcagtggtgtgaggtgcagagccaggtggaccagaagaacttcctgtcctatgactgtggcagtgacaaggtgctgtccatgggccacctggaggagcagctgtatgccacagatgcctggggcaagcagctggagatgctgcgggaggtgggccagaggctgcggctggagctggccgacacagagctggaggacttcaccccatctggccccctgaccctgcaggtgaggatgagctgtgaatgtgaggctgatggctacatccggggctcctggcagttctcctttgatggcaggaagttcctgctgtttgacagcaacaacaggaagtggacagtggtgcacgccggcctgggcaccagctag

SEQ ID NO: 175466 - DNA, 735 bp, Artificial Sequence
  Description of Artificial Sequence: Synthetic coding sequence
atggctgctgctgccagccctgccatcctgccccggctggccatcctgccctacctgctgtttgactggagcggcaccggccgggcagatgcccacagcctgtggtacaacttcaccatcatccacctgcccaggcatggccagcagtggtgtgaggtgcagagccaggtggaccagaagaacttcctgtcctatgactgtggcagtgacaaggtgctgtccatgggccacctggaggagcagctgtatgccacagatgcctggggcaagcagctggagatgctgcgggaggtgggccagaggctgcggctggagctggccgacacagagctggaggacttcaccccatctggccccctgaccctgcaggtgaggatgagctgtgaatgtgaggctgatggctacatccggggctcctggcagttctcctttgatggcaggaagttcctgctgtttgacagcaacaacaggaagtggacagtggtgcacgccggggcccggaggatgaaggagaagtgggagaaggacagcggcctgaccaccttcttcaagatggtgtccatgagggactgcaagtcctggctgcgggacttcctgatgcacaggaagaagaggctggagcccacagccccacccaccatggcccctggcctggcccagcccaaggccatcgccaccaccctgagcccctggagcttcctgatcatcctgtgcttcatcctgcccggcatctag

SEQ ID NO: 175467 - DNA, 393 bp, Artificial Sequence
  Description of Artificial Sequence: Synthetic coding sequence
atggctgctgctgccagccctgccatcctgccccggctggccatcctgccctacctgctgtttgactggagcggcaccggccgggcagaggagcagctgtatgccacagatgcctggggcaagcagctggagatgctgcgggaggtgggccagaggctgcggctggagctggccgacacagagctggaggacttcacccccagcggccccctgaccctgcaggtgaggatgagctgtgaatgtgaggctgatggctacatccggggctcctggcagttctcctttgatggcaggaagttcctgctgtttgacagcaacaacaggaagtggacagtggtgcatgctggggcccggaggatgaaggagaagtgggagaagagccacctggagtag

SEQ ID NO: 175468 - DNA, 735 bp, Artificial Sequence; identical to SEQ ID NO: 175466
  Description of Artificial Sequence: Synthetic coding sequence

SEQ ID NO: 175469 - DNA, 663 bp, Artificial Sequence
  Description of Artificial Sequence: Synthetic coding sequence
atgaaggtgaagaagggcggcggcggggccggcacagccacagagagcgcccctggccccagcggccagagcgtggcccccatcccccagcccccagctgagagcgagagcggcagcgagagcgagccagatgctggccctggccccaggcctggccccctgcagaggaagcagcccatcggcccagaagatgtgctgggcctgcagaggatcaccggggactacctgtgcagccctgaggagaacatctacaagattgactttgtgcgcttcaagatccgggacatggacagcggcaccgtgctgtttgagatcaagaagccccctgtgtctgagcggctgcccatcaacagaagagacctggaccccaatgccggccgctttgtgcgctaccagttcaccccagccttcctgcggctgcggcaggtgggcgccaccgtggagttcaccgtgggggacaagcctgtgaacaacttcaggatgattgaaagacactacttcaggaaccagctgctgaagagctttgacttccacttcggcttctgcatccccagcagcaagaacacctgtgagcacatctatgacttcccccccctgtctgaggagctgagcgcccgggccggcagcagcggcagcggggaggtgggcgccagccgggactag

SEQ ID NO: 175470 - DNA, 723 bp, Artificial Sequence
  Description of Artificial Sequence: Synthetic coding sequence
atgaaggtgaagaagggcggcggcggggccggcacagccacagagagcgcccctggccccagcggccagagcgtggcccccatcccccagcccccagctgagagcgagagcggcagcgagagcgagccagatgctggccctggccccaggcctggccccctgcagaggaagcagcccatcggcccagaagatgtgctgggcctgcagaggatcaccggggactacctgtgcagccctgaggagaacatctacaagattgactttgtgcgcttcaagatccgggacatggacagcggcaccgtgctgtttgagatcaagaagccccctgtgtctgagcggctgcccatcaacagaagagacctggaccccaatgccggccgctttgtgcgctaccagttcaccccagccttcctgcggctgcggcaggtgggcgccaccgtggagttcaccgtgggggacaagcctgtgaacaacttcaggatgattgaaagacactacttcaggaaccagctgctgaagagctttgacttccacttcggcttctgcatccccagcagcaagaacacctgtgagcacatctatgacttcccccccctgtctgaggagctgatcagcgagatgatccgccacccctatgagacccagagcgacagcttctactttgtggatgaccggctggtgatgcacaacaaggctgactacagctacagcggcaccccctag

SEQ ID NO: 175471 - DNA, 627 bp, Artificial Sequence
  Description of Artificial Sequence: Synthetic coding sequence
atgaaggtgaagaagggcggcggcggggccggcacagccacagagagcgcccctggccccagcggccagagcgtggcccccatcccccagcccccagctgagagcgagagcggcagcgagagcgagccagatgctggccctggccccaggcctggccccctgcagaggaagcagcccatcggcccagaagatgtgctgggcctgcagaggatcaccggcggggcccggcccctcttccctgcctggaggttcaagatccgggacatggattctggaacagtgctgtttgagatcaagaagccccctgtgtctgagcggctgcccatcaacagaagagacctggaccccaatgccggccgctttgtgcgctaccagttcaccccagccttcctgcggctgcggcaggtgggcgccaccgtggagttcaccgtgggggacaagcctgtgaacaacttcaggatgattgagcggcactacttcaggaaccagctgctgaagagctttgacttccacttcggcttctgcatccccagcagcaagaacacctgtgagcacatctatgacttcccccccctgtctgaggagctgagcgcccgggccggcagcagcggcagcggggaggtgtag

SEQ ID NO: 175472 - DNA, 5112 bp, Artificial Sequence
  Description of Artificial Sequence: Synthetic coding sequence
ctgagcctgctgtgtgtgtccctgaagaaggccaagtttgatggagcccaggagaagttcaacacctacgtgaccctgaaggtgcagaatgtgaagagcaccaccatcgctgtgcggggcagccagcccagctgggagcaggacttcatgtttgagatcaaccggctggacctgggcctgactgtggaggtgtggaacaagggcctcatctgggacaccatggtgggcaccgtgtggatccccctgcggaccatccggcagagcaatgaggagggccctggagagtggctgaccctggacagccaggtgatcatggctgacagcgagatctgtggcaccaaggaccccaccttccaccgcatcctgctggacaccaggtttgagctgcccctggacatccctgaggaggaggcccgctactgggccaagaagctggagcagctgaatgccatgagggaccaggatgagtacagcttccaggatgagcaggacaagcccctgcctgtgcccagcaaccagtgctgcaactggaactacttcggctggggcgagcagcacaatgatgatcctgacagcgctgtggatgaccgggacagcgactacagaagtgagaccagcaacagcatccccccaccctactacaccaccagccagcccaatgcctctgtgcaccagtacagcgtgcggcccccacccctgggcagccgggagagctacagcgacagcatgcacagctatgaggagttcagcgagccccaggccctgagccccaccggcagcagccgctatgccagcagcggggagctgagccagggcagcagccagctgtctgaggactttgatcctgatgagcacagcctgcagggcagtgacatggaggatgagcgggaccgggacagctaccacagctgccacagctctgtgtcctaccacaaggacagcccccgctgggaccaggatgaggaggagctggaggaggacctggaggacttcctggaggaggaggagctgcctgaagatgaggaggagctggaggaggaggaggaggaggtgcctgatgacctgggcagctatgcccagcgggaggatgtggccgtggccgagcccaaggacttcaagaggatcagcctgcccccagctgcccctgggaaggaggacaaggcccctgtggcccccacagaggccccagacatggccaaggtggcccccaagccagccaccccagacaaggtgcctgctgctgagcagatccctgaggccgagccccccaaggatgaggagagcttccggcccagagaagatgaggagggccaggagggccaggacagcatgagccgggccaaggccaactggctgcgggccttcaacaaggtgaggatgcagctgcaggaggcccggggggagggggagatgagcaagagcctgtggttcaagggcggccctgggggcggcctcatcatcatcgacagcatgccagacatcaggaagaggaagcccatccccctggtgtctgacctggccatgagcctggtgcagagcaggaaggccggcatcaccagcgccctggccagcagcaccctgaacaatgaggagctgaagaaccacgtgtacaagaagaccctgcaggccctgatctaccccatcagctgcaccaccccccacaactttgaggtgtggacagccaccacccccacctactgctatgaatgtgagggcctgctgtggggcatcgcccggcagggcatgcgctgcacagaatgtggggtgaagtgccacgagaagtgccaggacctgctgaatgctgactgcctgcagagagctgctgagaagagcagcaagcacggggctgaggacaggacccagaacatcatcatggtgctgaaggacaggatgaagatccgggagaggaacaagccagagatctttgagctgatccaggagatctttgctgtgaccaagacagcccacacccagcagatgaaggctgtgaagcagagcgtgctggatggcaccagcaagtggagcgccaagatcagcatcaccgtggtgtgtgcccagggcctgcaggccaaggacaagacaggcagcagtgacccctacgtgacagtgcaggtgggcaagaccaagaagaggaccaagaccatctacggcaacctgaaccctgtgtgggaggagaacttccactttgagtgccacaacagcagtgaccgcatcaaggtgcgggtgtgggatgaagatgatgacatcaagagccgggtgaagcagcgcttcaagcgggagagtgatgacttcctgggccagaccatcatcgaggtgaggaccctgagcggggagatggatgtgtggtacaacctggacaagaggacagacaagtctgctgtgtctggggccatccggctgcacatctctgtggagatcaagggggaggagaaggtggccccctaccacgtgcagtacacctgcctgcacgagaacctcttccactttgtgacagatgtgcagaacaacggggtggtgaagatcccagatgccaagggagatgatgcctggaaggtgtactatgatgaaacagcccaggagatcgtggatgaatttgccatgagatatggagtggagagcatctaccaggccatgacccactttgcctgcctgagcagcaagtacatgtgccctggggtgcctgctgtgatgagcaccctgctggccaacatcaatgcctactatgcccacaccacagccagcaccaacgtgtctgccagtgacagatttgctgccagcaactttgggaaggagagatttgtgaagctgctggaccagctgcacaacagcctgagaattgacctgtccatgtacagaaacaacttccctgccagcagccctgagcggctgcaggacctgaagagcacagtggacctgctgaccagcatcaccttcttcaggatgaaggtgcaggagctgcagagccccccccgggccagccaggtggtgaaggactgtgtgaaggcctgcctgaacagcacctatgagtacatcttcaacaactgccacgagctgtacagccgggagtaccagacagatcctgccaagaagggggaggtgctgcctgaggagcagggccccagcatcaagaacctggacttctggagcaagctgatcaccctgattgtgtccatcatcgaggaggacaagaacagctacaccccctgcctgaaccagttcccccaggagctgaatgtgggcaagatctctgctgaggtgatgtggaacctgtttgcccaggacatgaagtatgccatggaggagcatgacaagcaccggctgtgcaagtctgctgactacatgaacctgcacttcaaggtgaagtggctgtacaatgaatatgtgacagagctgcctgccttcaaggacagagtgcctgagtacccagcctggtttgagcccttcgtcatccagtggctggatgaaaatgaggaggtgtcccgggacttcctgcatggagccctggagcgggacaagaaggatggcttccagcagaccagcgagcacgccctcttcagctgcagcgtggtggatgtgttcagccagctgaaccagagctttgagatcatcaagaagctggagtgcccagacccccagatcgtgggccactacatgagaagatttgccaagaccatcagcaatgtgctgctgcagtatgctgacatcatcagcaaggactttgccagctactgcagcaaggagaaggagaaggtgccctgcatcctgatgaacaacacccagcagctgcgggtgcagctggagaagatgtttgaggccatgggcggcaaggagctggatgctgaggccagtgacatcctgaaggagctgcaggtgaagctgaacaacgtgctggatgagctgagccgggtgtttgccaccagcttccagccccacatcgaggagtgtgtgaagcagatgggagacatcctgagccaggtgaagggcactggaaatgtgcctgccagcgcctgcagctctgtggcccaggatgctgacaacgtgctgcagcccatcatggacctgctggacagcaacctgaccctgtttgccaagatctgtgagaagacagtgctgaagagggtgctgaaggagctgtggaagctggtgatgaacaccatggagaagaccatcgtgctgccccccctgacagaccagaccctgcagggcaacctgctgaggaagcacggcaagggcctggagaagggccgggtgaagctgcccagccacagtgatggcacccagatgatcttcaatgctgccaaggagctgggccagctgagcaagctgaaggaccacatggtgcgggaggaggccaagagcctgacccccaagcagtgtgctgtggtggagctggccctggacaccatcaagcagtacttccacgccggcggcgtgggcctgaagaagaccttcctggagaagagcccagacctgcagagcctgcgctatgccctgagcctgtacacccaggccacagacctgctgatcaagacctttgtgcagacccagagcgcccagggcctgggcgtggaggaccctgtgggggaggtgtctgtgcacgtggagctgttcacccaccctggcaccggggagcacaaggtgacagtgaaggtggtggccgccaatgacctgaagtggcagaccagcggcatcttccggcccttcatcgaggtgaacatcatcggcccccagctgagtgacaagaagaggaagtttgccaccaagagcaagaacaacagctgggcccccaagtacaatgaaagcttccagttcaccctgtctgcagatgctggcccagaatgttatgagctgcaggtgtgtgtgaaggactactgctttgcccgggaggacagaacagtgggcctggccgtgctgcagctgcgggagctggcccagaggggcagcgctgcctgctggctgcccctgggccgccgcatccacatggatgacaccggcctgactgtgctgcgcatcctgagccagaggagcaatgatgaggtggccaaggagtttgtgaagctgaagagtgacaccaggtctgctgaggagggcggggccgccccagccccctag

SEQ ID NO: 175473 - DNA, 5376 bp, Artificial Sequence
  Description of Artificial Sequence: Synthetic coding sequence
atgggcggcggcggcacctgcaccatctctgtgcaggtgcgggtgtgcacaggaggcaacctgctgggcggcagaagaagacccctgagcccctgcaatgaggaggtgtggggcgaggcccccctgcccggggcccggcccttcaatgcccccccagcccggagcgccccagcccccagcggcgtgcccggcctgcggctgcctgccccccaccagaggcacagcaggcctggccgcctgcggcccacctgtgagctgggggacatgagcctgctgtgtgtgggcgtgaagaaggccaagtttgatggagcccaggagaagttcaacacctacgtgaccctgaaggtgcagaatgtgaagagcaccaccatcgctgtgcggggcagccagcccagctgggagcaggacttcatgtttgagatcaaccggctggacctgggcctgactgtggaggtgtggaacaagggcctcatctgggacaccatggtgggcaccgtgtggatccccctgcggaccatccggcagagcaatgaggagggccctggagagtggctgaccctggacagccaggtgatcatggctgacagcgagatctgtggcaccaaggaccccaccttccaccgcatcctgctggacaccaggtttgagctgcccctggacatccctgaggaggaggcccgctactgggccaagaagctggagcagctgaatgccatgagggaccaggatgagtacagcttccaggatgagcaggacaagcccctgcctgtgcccagcaaccagtgctgcaactggaactacttcggctggggcgagcagcacaatgatgatcctgacagcgctgtggatgaccgggacagcgactacagaagtgagaccagcaacagcatccccccaccctactacaccaccagccagcccaatgcctctgtgcaccagtacagcgtgcggcccccacccctgggcagccgggagagctacagcgacagcatgcacagctatgaggagttcagcgagccccaggccctgagccccaccggcagcagccgctatgccagcagcggggagctgagccagggcagcagccagctgtctgaggactttgatcctgatgagcacagcctgcagggcagtgacatggaggatgagcgggaccgggacagctaccacagctgccacagctctgtgtcctaccacaaggacagcccccgctgggaccaggatgaggaggagctggaggaggacctggaggacttcctggaggaggaggagctgcctgaagatgaggaggagctggaggaggaggaggaggaggtgcctgatgacctgggcagctatgcccagcgggaggatgtggccgtggccgagcccaaggacttcaagaggatcagcctgcccccagctgcccctgggaaggaggacaaggcccctgtggcccccacagaggccccagacatggccaaggtggcccccaagccagccaccccagacaaggtgcctgctgctgagcagatccctgaggccgagccccccaaggatgaggagagcttccggcccagagaagatgaggagggccaggagggccaggacagcatgagccgggccaaggccaactggctgcgggccttcaacaaggtgaggatgcagctgcaggaggcccggggggagggggagatgagcaagagcctgtggttcaagggcggccctgggggcggcctcatcatcatcgacagcatgccagacatcaggaagaggaagcccatccccctggtgtctgacctggccatgagcctggtgcagagcaggaaggccggcatcaccagcgccctggccagcagcaccctgaacaatgaggagctgaagaaccacgtgtacaagaagaccctgcaggccctgatctaccccatcagctgcaccaccccccacaactttgaggtgtggacagccaccacccccacctactgctatgaatgtgagggcctgctgtggggcatcgcccggcagggcatgcgctgcacagaatgtggggtgaagtgccacgagaagtgccaggacctgctgaatgctgactgcctgcagagagctgctgagaagagcagcaagcacggggctgaggacaggacccagaacatcatcatggtgctgaaggacaggatgaagatccgggagaggaacaagccagagatctttgagctgatccaggagatctttgctgtgaccaagacagcccacacccagcagatgaaggctgtgaagcagagcgtgctggatggcaccagcaagtggagcgccaagatcagcatcaccgtggtgtgtgcccagggcctgcaggccaaggacaagacaggcagcagtgacccctacgtgacagtgcaggtgggcaagaccaagaagaggaccaagaccatctacggcaacctgaaccctgtgtgggaggagaacttccactttgagtgccacaacagcagtgaccgcatcaaggtgcgggtgtgggatgaagatgatgacatcaagagccgggtgaagcagcgcttcaagcgggagagtgatgacttcctgggccagaccatcatcgaggtgaggaccctgagcggggagatggatgtgtggtacaacctggacaagaggacagacaagtctgctgtgtctggggccatccggctgcacatctctgtggagatcaagggggaggagaaggtggccccctaccacgtgcagtacacctgcctgcacgagaacctcttccactttgtgacagatgtgcagaacaacggggtggtgaagatcccagatgccaagggagatgatgcctggaaggtgtactatgatgaaacagcccaggagatcgtggatgaatttgccatgagatatggagtggagagcatctaccaggccatgacccactttgcctgcctgagcagcaagtacatgtgccctggggtgcctgctgtgatgagcaccctgctggccaacatcaatgcctactatgcccacaccacagccagcaccaacgtgtctgccagtgacagatttgctgccagcaactttgggaaggagagatttgtgaagctgctggaccagctgcacaacagcctgagaattgacctgtccatgtacagaaacaacttccctgccagcagccctgagcggctgcaggacctgaagagcacagtggacctgctgaccagcatcaccttcttcaggatgaaggtgcaggagctgcagagccccccccgggccagccaggtggtgaaggactgtgtgaaggcctgcctgaacagcacctatgagtacatcttcaacaactgccacgagctgtacagccgggagtaccagacagatcctgccaagaagggggaggtgctgcctgaggagcagggccccagcatcaagaacctggacttctggagcaagctgatcaccctgattgtgtccatcatcgaggaggacaagaacagctacaccccctgcctgaaccagttcccccaggagctgaatgtgggcaagatctctgctgaggtgatgtggaacctgtttgcccaggacatgaagtatgccatggaggagcatgacaagcaccggctgtgcaagtctgctgactacatgaacctgcacttcaaggtgaagtggctgtacaatgaatatgtgacagagctgcctgccttcaaggacagagtgcctgagtacccagcctggtttgagcccttcgtcatccagtggctggatgaaaatgaggaggtgtcccgggacttcctgcatggagccctggagcgggacaagaaggatggcttccagcagaccagcgagcacgccctcttcagctgcagcgtggtggatgtgttcagccagctgaaccagagctttgagatcatcaagaagctggagtgcccagacccccagatcgtgggccactacatgagaagatttgccaagaccatcagcaatgtgctgctgcagtatgctgacatcatcagcaaggactttgccagctactgcagcaaggagaaggagaaggtgccctgcatcctgatgaacaacacccagcagctgcgggtgcagctggagaagatgtttgaggccatgggcggcaaggagctggatgctgaggccagtgacatcctgaaggagctgcaggtgaagctgaacaacgtgctggatgagctgagccgggtgtttgccaccagcttccagccccacatcgaggagtgtgtgaagcagatgggagacatcctgagccaggtgaagggcactggaaatgtgcctgccagcgcctgcagctctgtggcccaggatgctgacaacgtgctgcagcccatcatggacctgctggacagcaacctgaccctgtttgccaagatctgtgagaagacagtgctgaagagggtgctgaaggagctgtggaagctggtgatgaacaccatggagaagaccatcgtgctgccccccctgacagaccagaccatgattggcaacctgctgaggaagcacggcaagggcctggagaagggccgggtgaagctgcccagccacagtgatggcacccagatgatcttcaatgctgccaaggagctgggccagctgagcaagctgaaggaccacatggtgcgggaggaggccaagagcctgacccccaagcagtgtgctgtggtggagctggccctggacaccatcaagcagtacttccacgccggcggcgtgggcctgaagaagaccttcctggagaagagcccagacctgcagagcctgcgctatgccctgagcctgtacacccaggccacagacctgctgatcaagacctttgtgcagacccagagcgcccagggcctgggcgtggaggaccctgtgggggaggtgtctgtgcacgtggagctgttcacccaccctggcaccggggagcacaaggtgacagtgaaggtggtggccgccaatgacctgaagtggcagaccagcggcatcttccggcccttcatcgaggtgaacatcatcggcccccagctgagtgacaagaagaggaagtttgccaccaagagcaagaacaacagctgggcccccaagtacaatgaaagcttccagttcaccctgtctgcagatgctggcccagaatgttatgagctgcaggtgtgtgtgaaggactactgctttgcccgggaggacagaacagtgggcctggccgtgctgcagctgcgggagctggcccagaggggcagcgctgcctgctggctgcccctgggccgccgcatccacatggatgacaccggcctgactgtgctgcgcatcctgagccagaggagcaatgatgaggtggccaaggagtttgtgaagctgaagagtgacaccaggtctgctgaggagggcggggccgccccagccccctag

SEQ ID NO: 175474 - DNA, 5112 bp, Artificial Sequence
  Description of Artificial Sequence: Synthetic coding sequence
atgagcctgctgtgtgtgggcgtgaagaaggccaagtttgatggagcccaggagaagttcaacacctacgtgaccctgaaggtgcagaatgtgaagagcaccaccatcgctgtgcggggcagccagcccagctgggagcaggacttcatgtttgagatcaaccggctggacctgggcctgactgtggaggtgtggaacaagggcctcatctgggacaccatggtgggcaccgtgtggatccccctgcggaccatccggcagagcaatgaggagggccctggagagtggctgaccctggacagccaggtgatcatggctgacagcgagatctgtggcaccaaggaccccaccttccaccgcatcctgctggacaccaggtttgagctgcccctggacatccctgaggaggaggcccgctactgggccaagaagctggagcagctgaatgccatgagggaccaggatgagtacagcttccaggatgagcaggacaagcccctgcctgtgcccagcaaccagtgctgcaactggaactacttcggctggggcgagcagcacaatgatgatcctgacagcgctgtggatgaccgggacagcgactacagaagtgagaccagcaacagcatccccccaccctactacaccaccagccagcccaatgcctctgtgcaccagtacagcgtgcggcccccacccctgggcagccgggagagctacagcgacagcatgcacagctatgaggagttcagcgagccccaggccctgagccccaccggcagcagccgctatgccagcagcggggagctgagccagggcagcagccagctgtctgaggactttgatcctgatgagcacagcctgcagggcagtgacatggaggatgagcgggaccgggacagctaccacagctgccacagctctgtgtcctaccacaaggacagcccccgctgggaccaggatgaggaggagctggaggaggacctggaggacttcctggaggaggaggagctgcctgaagatgaggaggagctggaggaggaggaggaggaggtgcctgatgacctgggcagctatgcccagcgggaggatgtggccgtggccgagcccaaggacttcaagaggatcagcctgcccccagctgcccctgggaaggaggacaaggcccctgtggcccccacagaggccccagacatggccaaggtggcccccaagccagccaccccagacaaggtgcctgctgctgagcagatccctgaggccgagccccccaaggatgaggagagcttccggcccagagaagatgaggagggccaggagggccaggacagcatgagccgggccaaggccaactggctgcgggccttcaacaaggtgaggatgcagctgcaggaggcccggggggagggggagatgagcaagagcctgtggttcaagggcggccctgggggcggcctcatcatcatcgacagcatgccagacatcaggaagaggaagcccatccccctggtgtctgacctggccatgagcctggtgcagagcaggaaggccggcatcaccagcgccctggccagcagcaccctgaacaatgaggagctgaagaaccacgtgtacaagaagaccctgcaggccctgatctaccccatcagctgcaccaccccccacaactttgaggtgtggacagccaccacccccacctactgctatgaatgtgagggcctgctgtggggcatcgcccggcagggcatgcgctgcacagaatgtggggtgaagtgccacgagaagtgccaggacctgctgaatgctgactgcctgcagagagctgctgagaagagcagcaagcacggggctgaggacaggacccagaacatcatcatggtgctgaaggacaggatgaagatccgggagaggaacaagccagagatctttgagctgatccaggagatctttgctgtgaccaagacagcccacacccagcagatgaaggctgtgaagcagagcgtgctggatggcaccagcaagtggagcgccaagatcagcatcaccgtggtgtgtgcccagggcctgcaggccaaggacaagacaggcagcagtgacccctacgtgacagtgcaggtgggcaagaccaagaagaggaccaagaccatctacggcaacctgaaccctgtgtgggaggagaacttccactttgagtgccacaacagcagtgaccgcatcaaggtgcgggtgtgggatgaagatgatgacatcaagagccgggtgaagcagcgcttcaagcgggagagtgatgacttcctgggccagaccatcatcgaggtgaggaccctgagcggggagatggatgtgtggtacaacctggacaagaggacagacaagtctgctgtgtctggggccatccggctgcacatctctgtggagatcaagggggaggagaaggtggccccctaccacgtgcagtacacctgcctgcacgagaacctcttccactttgtgacagatgtgcagaacaacggggtggtgaagatcccagatgccaagggagatgatgcctggaaggtgtactatgatgaaacagcccaggagatcgtggatgaatttgccatgagatatggagtggagagcatctaccaggccatgacccactttgcctgcctgagcagcaagtacatgtgccctggggtgcctgctgtgatgagcaccctgctggccaacatcaatgcctactatgcccacaccacagccagcaccaacgtgtctgccagtgacagatttgctgccagcaactttgggaaggagagatttgtgaagctgctggaccagctgcacaacagcctgagaattgacctgtccatgtacagaaacaacttccctgccagcagccctgagcggctgcaggacctgaagagcacagtggacctgctgaccagcatcaccttcttcaggatgaaggtgcaggagctgcagagccccccccgggccagccaggtggtgaaggactgtgtgaaggcctgcctgaacagcacctatgagtacatcttcaacaactgccacgagctgtacagccgggagtaccagacagatcctgccaagaagggggaggtgctgcctgaggagcagggccccagcatcaagaacctggacttctggagcaagctgatcaccctgattgtgtccatcatcgaggaggacaagaacagctacaccccctgcctgaaccagttcccccaggagctgaatgtgggcaagatctctgctgaggtgatgtggaacctgtttgcccaggacatgaagtatgccatggaggagcatgacaagcaccggctgtgcaagtctgctgactacatgaacctgcacttcaaggtgaagtggctgtacaatgaatatgtgacagagctgcctgccttcaaggacagagtgcctgagtacccagcctggtttgagcccttcgtcatccagtggctggatgaaaatgaggaggtgtcccgggacttcctgcatggagccctggagcgggacaagaaggatggcttccagcagaccagcgagcacgccctcttcagctgcagcgtggtggatgtgttcagccagctgaaccagagctttgagatcatcaagaagctggagtgcccagacccccagatcgtgggccactacatgagaagatttgccaagaccatcagcaatgtgctgctgcagtatgctgacatcatcagcaaggactttgccagctactgcagcaaggagaaggagaaggtgccctgcatcctgatgaacaacacccagcagctgcgggtgcagctggagaagatgtttgaggccatgggcggcaaggagctggatgctgaggccagtgacatcctgaaggagctgcaggtgaagctgaacaacgtgctggatgagctgagccgggtgtttgccaccagcttccagccccacatcgaggagtgtgtgaagcagatgggagacatcctgagccaggtgaagggcactggaaatgtgcctgccagcgcctgcagctctgtggcccaggatgctgacaacgtgctgcagcccatcatggacctgctggacagcaacctgaccctgtttgccaagatctgtgagaagacagtgctgaagagggtgctgaaggagctgtggaagctggtgatgaacaccatggagaagaccatcgtgctgccccccctgacagaccagaccatgattggcaacctgctgaggaagcacggcaagggcctggagaagggccgggtgaagctgcccagccacagtgatggcacccagatgatcttcaatgctgccaaggagctgggccagctgagcaagctgaaggaccacatggtgcgggaggaggccaagagcctgacccccaagcagtgtgctgtggtggagctggccctggacaccatcaagcagtacttccacgccggcggcgtgggcctgaagaagaccttcctggagaagagcccagacctgcagagcctgcgctatgccctgagcctgtacacccaggccacagacctgctgatcaagacctttgtgcagacccagagcgcccagggcctgggcgtggaggaccctgtgggggaggtgtctgtgcacgtggagctgttcacccaccctggcaccggggagcacaaggtgacagtgaaggtggtggccgccaatgacctgaagtggcagaccagcggcatcttccggcccttcatcgaggtgaacatcatcggcccccagctgagtgacaagaagaggaagtttgccaccaagagcaagaacaacagctgggcccccaagtacaatgaaagcttccagttcaccctgtctgcagatgctggcccagaatgttatgagctgcaggtgtgtgtgaaggactactgctttgcccgggaggacagaacagtgggcctggccgtgctgcagctgcgggagctggcccagaggggcagcgctgcctgctggctgcccctgggccgccgcatccacatggatgacaccggcctgactgtgctgcgcatcctgagccagaggagcaatgatgaggtggccaaggagtttgtgaagctgaagagtgacaccaggtctgctgaggagggcggggccgccccagccccctag

SEQ ID NO: 175475 - DNA, 1293 bp, Artificial Sequence
  Description of Artificial Sequence: Synthetic coding sequence
atggccaccctgtctgtgaagcccagccgccgcttccagctgcctgactggcacaccaacagctacctgctgagcaccaatgcccagctgcagagagatgccagccaccagatccggcaggaggcccgggtgctgagaaatgagaccaacaaccagaccatctgggatgaacatgacaacagaacccggctggtggagagaattgacacagtgaaccgctggaaggagatgctggacaagtgcctgacagacctggatgctgagattgatgccctgacccagatgaaggagagcgctgagcagaacctgcaggccaagaacctgcccctggatgtggccattgaatgtctgaccctgcgggagagcagaagagacattgatgtggtgaaggaccctgtggaggatgagctgcacaaggaggtggaggtgattgaggccaccaagaaggccctgcagcagaaggtgtcccaggcctttgagcagctgtgcctgctgcaggaggtgcagcagcagctgaacagcgaccaccggggcaagatggagaccctggagattgaccggggctgcctgagcctgaacctgcggagccccaacatcagcctgaaggtggaccccaccagggtgcctgatggcagcaccaccctgcagcagtgggatgacttcagccgcttcaacaaggacagagctgaggccgagatgaaggccgccacagagctgcgggaggccacagccctgaccatcgccgagaccaacaatgagctggaggcccagagggtggccacagaatttgccttcaggaagaggctgcgggagatggagaaggtgtacagcgagctgaagtggcaggagaagaacaccctggaggagattgctgagctgcaggaggacatccgccacctggaggaggacctgcggaccaagctgctgagcctgaagctgagccacacccggctggaggcccggacctaccggcccaacgtggagctgtgccgggaccaggcccagtatggcctgacagatgaggtgcaccagctggaggccaccatcgccgccctgaagcagaagctggcccaggcccaggatgccctggatgccctgtgcaagcacctggcccggctgcaggccgacatcgcctgcaaggccaacagcatgctgctggacaccaagtgcatggacaccaggaggaagctgactgtgcctgctgagagatttgtgcctgaggtggacaccttcaccaggaccaccaacagcaccctgagccccctgaagagctgccagctggagctggcctag

SEQ ID NO: 175476 - DNA, 3429 bp, Artificial Sequence
  Description of Artificial Sequence: Synthetic coding sequence
atggccaccctgctgagccacccccagcagaggcctcccttcctgcggcaggccatcaagatcagaagaagaagagtgcgggacctgcaggaccccccaccccagatggcccctgagatccagccccccagccaccacttcagccctgagcagagggccctgctgtatgaagatgccctgtacacagtgctgcaccggctgggccaccctgagcccaaccacgtgacagaggccagcgagctgctgcgctacctgcaggaggccttccacgtggagcctgaggagcaccagcagaccctgcagagggtgcgggagctggagaagcccatcttctgcctgaaggccaccgtgaagcaggccaagggcatcctgggcaaggatgtgtctggcttcagtgacccctactgcctgctgggcatcgagcagggcgtgggcgtgcctgggggcagccctggcagccgccaccggcagaaggctgtggtgcgccacaccatccctgaggaggagacccacaggacccaggtgatcacccagaccctgaaccctgtgtgggatgagaccttcatcctggagtttgaggacatcaccaatgccagcttccacctggacatgtgggacctggacacagtggagagcgtgcggcagaagctgggggagctgacagacctgcacggcctgcggcgcatcttcaaggaggccaggaaggacaagggccaggatgacttcctgggcaatgtggtgctgcggctgcaggacctgcgctgccgggaggaccagtggtaccccctggagcccaggacagagacctacccagaccggggccagtgccacctgcagttccagctgatccacaagaggcgggccaccagcgccagccgcagccagcccagctacacagtgcacctgcacctgctgcagcagctggtgtcccatgaggtgacccagcacgaggccggcagcacctcctgggatggcagcctgagcccccaggccgccaccgtgctcttcctgcacgccacccagaaggacctgagtgacttccaccagagcatggcccagtggctggcctacagccggctgtaccagagcctggagttccccagcagctgcctgctgcaccccatcaccagcattgagtaccagtggatccagggccgcctgaaggccgagcagcaggaggagctggccgccagcttcagcagcctgctgacctacggcctgagcctcatccgccgcttccgctctgtgttccccctgtctgtgtctgacagccctgcccggctgcagagcctgctgcgggtgctggtgcagatgtgcaagatgaaggccttcggggagctgtgccccaacacagcccccctgccccagctggtgacagaggccctgcagacaggcaccacagagtggttccacctgaagcagcagcaccaccagcccatggtgcagggcatccctgaggccggcaaggccctgctgggcctggtgcaggatgtgattggagacctgcaccagtgccagaggacctgggacaagatcttccacaacaccctgaagatccacctgttctccatggccttccgggagctgcagtggctggtggccaagagggtgcaggaccacaccaccgtggtgggagatgtggtgtccccagagatgggagagagcctcttccagctgtacatcagcctgaaggagctgtgccagctgaggatgagcagcagcgagagagatggagtgctggccctggacaacttccaccgctggttccagcctgccatccccagctggctgcagaagacctacaatgaggccctggcccgggtgcagagagctgtgcagatggatgagctggtgcccctgggggagctgaccaagcacagcaccagcgctgtggacctgagcacctgctttgcccagatcagccacacagcccggcagctggactggccagaccctgaggaggccttcatgatcaccgtgaagtttgtggaggacacctgccgcctggccctggtgtactgcagcctcatcaaggcccgggcccgggagctgagcagcggccagaaggaccagggccaggccgccaacatgctgtgtgtggtggtgaatgacatggagcagctgcggctggtgattggcaagctgcctgcccagctggcctgggaggccctggagcagagggtgggcgctgtgctggagcagggccagctgcagaacaccctgcacgcccagctgcagagcgccctggccggcctgggccacgagatcagaactggagtgaggaccctggccgagcagctggaggtgggcatcgccaagcacatccagaagctggtgggcgtgcgggagagcgtgctgcctgaagatgccatcctgcccctgatgaagttcctggaggtggagctgtgctacatgaacaccaacctggtgcaggagaacttcagcagcctgctgaccctgctgtggacccacaccctgactgtgctggtggaggccgccgccagccagaggagcagcagcctggccagcaaccggctgaagatcgccctgcagaacctggagatctgcttccacgccgagggctgcggcctgccccccaaggccctgcacacagccaccttccaggccctgcagagggacctggagctgcaggccgccagcagccgggagctgatcaggaagtacttctgcagccgcatccagcagcaggccgagaccaccagcgaggagctgggcgctgtgacagtgaaggccagctaccgggccagcgagcagaagctgcgggtggagctgctgagcgccagcagcctgctgcccctggacagcaatggcagcagtgacccctttgtgcagctgaccctggagcccaggcatgagttccctgagctggccgcccgggagacccagaagcacaagaaggacctgcaccccctgtttgatgagacctttgagttcctggtgcctgctgagccctgcaggaaggccggggcctgcctgctgctgactgtgctggactatgacaccctgggcgcagatgacctggagggggaggccttcctgcccctgcgggaggtgcccggcctgagcggcagcgaggagcccggggaggtgccccagacccggctgcccctgacctacccagcccccaacggggaccccatcctgcagctgctggagggcaggaagggggaccgggaggcccaggtgtttgtgcggctgcggcggcaccgggccaagcagggcatcggccccagcgtgtcctggccctggcccatctgcctgctggccttcctgttccagcccctgggctggggccctggcagcctgggccctggcctgcaggcccagagcctgctggagaagggggagggcaccctgcccaagatgaggctgcagctgccctggggcgagggcggcggccactactag

SEQ ID NO: 175477 - DNA, 2835 bp, Artificial Sequence
  Description of Artificial Sequence: Synthetic coding sequence
atggccaccctgctgagccacccccagcagaggcctcccttcctgcggcaggccatcaagatcagaagaagaagagtgcgggacctgcaggaccccccaccccagatggcccctgagatccagccccccagccaccacttcagccctgagcagagggccctgctgtatgaagatgccctgtacacagtgctgcaccggctgggccaccctgagcccaaccacgtgacagaggccagcgagctgctgcgctacctgcaggaggccttccacgtggagcctgaggagcaccagcagaccctgcagagggtgcgggagctggagaagcccatcttctgcctgaaggccaccgtgaagcaggccaagggcatcctgggcaaggatgtgtctggcttcagtgacccctactgcctgctgggcatcgagcagggcgtgggcgtgcctgggggcagccctggcagccgccaccggcagaaggctgtggtgcgccacaccatccctgaggaggagacccacaggacccaggtgatcacccagaccctgaaccctgtgtgggatgagaccttcatcctggagtttgaggacatcaccaatgccagcttccacctggacatgtgggacctggacacagtggagagcgtgcggcagaagctgggggagctgacagacctgcacggcctgcggcgcatcttcaaggaggccaggaaggacaagggccaggatgacttcctgggcaatgtggtgctgcggctgcaggacctgcgctgccgggaggaccagtggtaccccctggagcccaggacagagacctacccagaccggggccagtgccacctgcagttccagctgatccacaagaggcgggccaccagcgccagccgcagccagcccagctacacagtgcacctgcacctgctgcagcagctggtgtcccatgaggtgacccagcacgaggccggcagcacctcctgggatggcagcctgagcccccaggccgccaccgtgctcttcctgcacgccacccagaaggacctgagtgacttccaccagagcatggcccagtggctggcctacagccggctgtaccagagcctggagttccccagcagctgcctgctgcaccccatcaccagcattgagtaccagtggatccagggccgcctgaaggccgagcagcaggaggagctggccgccagcttcagcagcctgctgacctacggcctgagcctcatccgccgcttccgctctgtgttccccctgtctgtgtctgacagccctgcccggctgcagagcctgctgcgggtgctggtgcagatgtgcaagatgaaggccttcggggagctgtgccccaacacagcccccctgccccagctggtgacagaggccctgcagacaggcaccacagagtggttccacctgaagcagcagcaccaccagcccatggtgcagggcatccctgaggccggcaaggccctgctgggcctggtgcaggatgtgattggagacctgcaccagtgccagaggacctgggacaagatcttccacaacaccctgaagatccacctgttctccatggccttccgggagctgcagtggctggtggccaagagggtgcaggaccacaccaccgtggtgggagatgtggtgtccccagagatgggagagagcctcttccagctgtacatcagcctgaaggagctgtgccagctgaggatgagcagcagcgagagagatggagtgctggccctggacaacttccaccgctggttccagcctgccatccccagctggctgcagaagacctacaatgaggccctggcccgggtgcagagagctgtgcagatggatgagctggtgcccctgggggagctgaccaagcacagcaccagcgctgtggacctgagcacctgctttgcccagatcagccacacagcccggcagctggactggccagaccctgaggaggccttcatgatcaccgtgaagtttgtggaggacacctgccgcctggccctggtgtactgcagcctcatcaaggcccgggcccgggagctgagcagcggccagaaggaccagggccaggccgccaacatgctgtgtgtggtggtgaatgacatggagcagctgcggctggtgattggcaagctgcctgcccagctggcctgggaggccctggagcagagggtgggcgctgtgctggagcagggccagctgcagaacaccctgcacgcccagctgcagagcgccctggccggcctgggccacgagatcagaactggagtgaggaccctggccgagcagctggaggtgggcatcgccaagcacatccagaagctggtgggcgtgcgggagagcgtgctgcctgaagatgccatcctgcccctgatgaagttcctggaggtggagctgtgctacatgaacaccaacctggtgcaggagaacttcagcagcctgctgaccctgctgtggacccacaccctgactgtgctggtggaggccgccgccagccagaggagcagcagcctggccagcaaccggctgaagatcgccctgcagaacctggagatctgcttccacgccgagggctgcggcctgccccccaagaccctgcccctgcctgccagccagaagagctgctgcggcggccagggcatcggccccagcgtgtcctggccctggcccatctgcctgctggccttcctgttccagcccctgggctggggccctggcagcctgggccctggcctgcaggcccagagcctgctggagaagggggagggcaccctgcccaagatgaggctgcagctgccctggggcgagggcggcggccactactag

SEQ ID NO: 175478 - DNA, 2790 bp, Artificial Sequence
  Description of Artificial Sequence: Synthetic coding sequence
atgacagccagctctgtggagcagctgaggaaggagggcaatgagctgttcaagtgtggggactatggaggagccctggccgcctacacccaggccctgggcctggatgccaccccccaggaccaggccgtgctgcacaggaacagagctgcctgccacctgaagctggaggactatgacaaggccgagacagaggccagcaaggccatcgagaaggatggaggagatgtgaaggccctgtaccgccgcagccaggccctggagaagctgggccgcctggaccaggccgtgctggacctgcagagatgtgtgtccctggagcccaagaacaaggtgttccaggaggccctgaggaacatcggcggccagatccaggagaaggtgcgctacatgagcagcacagatgccaaggtggagcagatgttccagatcctgctggaccctgaggagaagggcacagagaagaagcagaaggccagccagaacctggtggtgctggccagagaagatgctggagctgagaagatcttccgcagcaatggagtgcagctgctgcagaggctgctggacatgggagaaacagacctgatgctggccgccctgcggaccctggtgggcatctgcagcgagcaccagagcaggacagtggccaccctgagcatcctgggcaccaggagagtggtgtccatcctgggcgtggagagccaggccgtgtccctggccgcctgccacctgctgcaggtgatgtttgatgccctgaaggagggcgtgaagaagggcttccggggcaaggagggcgccatcatcgtggaccctgcccgggagctgaaggtgctgatcagcaacctgctggacctgctgacagaggtgggcgtgtctggccagggccgggacaatgccctgaccctgctgatcaaggctgtgcccaggaagagcctgaaggaccccaacaacagcctgaccctgtgggtgattgaccagggcctgaagaagatcctggaggtgggcggcagcctgcaggaccccccaggagagctggccgtgacagccaacagcaggatgtctgccagcatcctgctgagcaagctgtttgatgacctgaagtgtgatgctgagcgggagaacttccaccggctgtgtgagaactacatcaagtcctggtttgagggccagggcctggccggcaagctgcgggccatccagacagtgtcctgcctgctgcagggcccctgtgatgctggcaacagagccctggagctgtctggagtgatggagagcgtcatcgccctgtgtgccagcgagcaggaggaggagcagctggtggccgtggaggccctgattcatgctgctgggaaggccaagagggccagcttcatcacagccaacggggtgtccctgctgaaggacctgtacaagtgcagcgagaaggacagcatccgcatccgggccctggtgggcctgtgcaagctgggcagcgctgggggcacagacttctccatgaagcagtttgctgagggcagcaccctgaagctggccaagcagtgcaggaagtggctgtgcaatgaccagattgatgctggcacccggcgctgggccgtggagggcctggcctacctgacctttgatgctgatgtgaaggaggagtttgtggaggatgctgctgccctgaaggccctcttccagctgagccggctggaggagaggtctgtgctgtttgctgtggccagcgccctggtgaactgcaccaacagctatgactatgaggagccagaccccaagatggtggagctggccaagtatgccaagcagcacgtgcctgagcagcaccccaaggacaagcccagctttgtgcgggcccgggtgaagaagctgctggccgccggcgtggtgtctgccatggtgtgcatggtgaagacagagagccctgtgctgaccagcagctgccgggagctgctgagcagggtcttcctggccctggtggaggaggtggaggaccggggcaccgtggtggcccagggcggcggccgggccctgatccccctggccctggagggcacagatgtgggccagaccaaggccgcccaggccctggccaagctgaccatcaccagcaaccctgagatgaccttccctggagagcgcatctatgaggtggtgcggcccctggtgtccctgctgcacctgaactgcagcggcctgcagaactttgaggccctgatggccctgaccaacctggccggcatcagcgagcggctgcggcagaagatcctgaaggagaaggctgtgcccatgattgagggctacatgtttgaggagcacgagatgatcagaagagctgccacagagtgcatgtgcaacctggccatgagcaaggaggtgcaggacctgtttgaggcccagggcaatgaccggctgaagctgctggtgctgtacagcggggaggatgatgagctgctgcagagagctgctgctgggggcctggccatgctgacctccatgaggcccaccctgtgcagccgcatcccccaggtgaccacccactggctggagatcctgcaggccctgctgctgagcagcaaccaggagctgcagcacagaggagctgtggtggtgctgaacatggtggaggccagccgggagatcgccagcaccctgatggagagcgagatgatggagatcctgtctgtgctggccaagggggaccacagccctgtgaccagggctgctgctgcctgcctggacaaggctgtggagtatggcctcatccagcccaaccaggatggagagtag

SEQ ID NO: 175479 - DNA, 2835 bp, Artificial Sequence
  Description of Artificial Sequence: Synthetic coding sequence
atgacagtgtctggccctggcaccccagagcccaggcctgccacccctggggccagctctgtggagcagctgaggaaggagggcaatgaactcttcaagtgtggggactatggaggagccctggccgcctacacccaggccctgggcctggatgccaccccccaggaccaggccgtgctgcacaggaacagagctgcctgccacctgaagctggaggactatgacaaggccgagacagaggccagcaaggccatcgagaaggatggaggagatgtgaaggccctgtacagaagaagccaggccctggagaagctgggccgcctggaccaggccgtgctggacctgcagagatgtgtgtccctggagcccaagaacaaggtgttccaggaggccctgagaaatattggaggccagatccaggagaaggtgcgctacatgagcagcacagatgccaaggtggagcagatgttccagatcctgctggaccctgaggagaagggcacagagaagaagcagaaggccagccagaacctggtggtgctggcccgggaggatgctggagctgagaagatcttccgcagcaatggagtgcagctgctgcagaggctgctggacatgggagaaacagacctgatgctggccgccctgcggaccctggtgggcatctgcagcgagcaccagagcaggacagtggccaccctgagcatcctgggcacccggcgggtggtgtccatcctgggcgtggagagccaggccgtgtccctggccgcctgccacctgctgcaggtgatgtttgatgccctgaaggagggcgtgaagaagggcttccggggcaaggagggcgccatcatcgtggaccctgcccgggagctgaaggtgctgatcagcaacctgctggacctgctgacagaggtgggcgtgtctggccagggccgggacaatgccctgaccctgctgatcaaggctgtgcccaggaagagcctgaaggaccccaacaacagcctgaccctgtgggtgattgaccagggcctgaagaagatcctggaggtgggcggcagcctgcaggaccccccaggagagctggccgtgacagccaacagcaggatgtctgccagcatcctgctgagcaagctgtttgatgacctgaagtgtgatgctgagcgggagaacttccaccggctgtgtgagaactacatcaagtcctggtttgagggccagggcctggccggcaagctgcgggccatccagacagtgtcctgcctgctgcagggcccctgtgatgctggcaacagagccctggagctgagcggcgtgatggagagcgtgattgccctgtgtgccagcgagcaggaggaggagcagctggtggccgtggaggccctgattcatgctgctgggaaggccaagagggccagcttcatcacagccaatggagtgtccctgctgaaggacctgtacaagtgcagcgagaaggacagcatccgcatccgggccctggtgggcctgtgcaagctgggcagcgctgggggcacagacttctccatgaagcagtttgctgagggcagcaccctgaagctggccaagcagtgcaggaagtggctgtgcaatgaccagattgatgctggcacccggcgctgggccgtggagggcctggcctacctgacctttgatgctgatgtgaaggaggagtttgtggaggatgctgctgccctgaaggccctcttccagctgagccggctggaggagaggtctgtgctgtttgctgtggccagcgccctggtgaactgcaccaacagctatgactatgaggagccagaccccaagatggtggagctggccaagtatgccaagcagcacgtgcctgagcagcaccccaaggacaagcccagctttgtgcgggcccgggtgaagaagctgctggccgccggcgtggtgtctgccatggtgtgcatggtgaagacagagagccctgtgctgaccagcagctgccgggagctgctgagcagggtcttcctggccctggtggaggaggtggaggaccggggcaccgtggtggcccagggcggcggccgggccctgatccccctggccctggagggcacagatgtgggccagaccaaggccgcccaggccctggccaagctgaccatcaccagcaaccctgagatgaccttccctggagagcgcatctatgaggtggtgcggcccctggtgtccctgctgcacctgaactgcagcggcctgcagaactttgaggccctgatggccctgaccaacctggccggcatcagcgagcggctgcggcagaagatcctgaaggagaaggctgtgcccatgattgagggctacatgtttgaggagcacgagatgatccggcgggccgccacagagtgcatgtgcaacctggccatgagcaaggaggtgcaggacctgtttgaggcccagggcaatgaccggctgaagctgctggtgctgtacagcggagaagatgatgagctgctgcagagagctgctgctgggggcctggccatgctgacctccatgaggcccaccctgtgcagccgcatcccccaggtgaccacccactggctggagatcctgcaggccctgctgctgagcagcaaccaggagctgcagcacagaggagctgtggtggtgctgaacatggtggaggccagccgggagatcgccagcaccctgatggagagcgagatgatggagatcctgtctgtgctggccaagggggaccacagccctgtgaccagggctgctgctgcctgcctggacaaggctgtggagtatggcctcatccagcccaaccaggatggagagtag

SEQ ID NO: 175480 - DNA, 2409 bp, Artificial Sequence
  Description of Artificial Sequence: Synthetic coding sequence
atggccggcaccagcgagaggagcctcatcagcagcatcagccagcccaaggccatcgagtgctttgaggtgaagaagaaggccttcctgacccacggccgctaccacggcagcggggccaccccacccaagaccaaggaccccaagccagagaccttctgtggccagacaggcctgcccaccatggaggtgcgcatcaacgtgtcccggcagcaggtggagaaggtgtttggcctggaggagtactggtgccagtgtgtggcctggagcagcagcggcaccaccaagagccagaaggcctacatccgcatcgcctacctgaggaagaactttgagcaggagcccctggccaaggaggtgtccctggagcagggcatcgtgctgccctgccggcccccagagggcatccccccagctgaggtggagtggctgagaaatgaagacctggtggaccccagcctggaccccaacgtgtacatcacccgggagcacagcctggtggtgcggcaggcccggctggccgacacagccaactacacctgtgtggccaagaacatcgtggcccggcggcgcagcgccagcgctgctgtgattgtgtatgtggatggctcctggagcccctggagcaagtggagcgcctgtggcctggactgcacccactggaggagcagagaatgtagtgaccctgcccccagaaatggaggagaggagtgccagggcacagacctggacaccaggaactgcaccagtgacctgtgtgtgcacacagccagcggcccagaagatgtggccctgtatgtgggcctgattgctgtggccgtgtgcctggtgctgctgctgctggtgctgatcctggtgtactgcaggaagaaggagggcctggacagtgatgtggccgacagcagcatcctgaccagcggcttccagcctgtgtccatcaagcccagcaaggctgacaacccccacctgctgaccatccagcctgacctgagcaccaccaccaccacctaccagggcagcctgtgcccccggcaggacggccccagccccaagttccagctgaccaacggccacctgctgagccccctgggcggcggccgccacaccctgcaccacagcagccccaccagcgaggccgaggagtttgtgtcccggctgagcacccagaactacttccgcagcctgccccggggcaccagcaacatgacctacggcaccttcaacttcctgggcggccgcctgatgatccccaacacaggcatcagcctgctgatccccccagatgccatcccccggggcaagatctatgagatctacctgaccctgcacaagccagaagatgtgcggctgcccctggccggctgccagaccctgctgagccccatcgtgtcctgtggccccccaggagtgctgctgaccaggcctgtgatcctggccatggaccactgtggggagcccagcccagacagctggagcctgcggctgaagaagcagagctgtgagggctcctgggaggatgtgctgcacctgggggaggaggcccccagccacctgtactactgccagctggaggccagcgcctgctacgtgttcacagagcagctgggccgctttgccctggtgggggaggccctgtctgtggccgccgccaagaggctgaagctgctgctgtttgcccctgtggcctgcaccagcctggagtacaacatccgggtgtactgcctgcatgacacccatgatgccctgaaggaggtggtgcagctggagaagcagctgggcggccagctgatccaggagccccgggtgctgcacttcaaggacagctaccacaacctgcggctgagcatccatgatgtgcccagcagcctgtggaagagcaagctgctggtgtcctaccaggagatccccttctaccacatctggaatggcacccagcgctacctgcactgcaccttcaccctggagcgggtgagccccagcaccagtgacctggcctgcaagctgtgggtgtggcaggtggagggagatggccagagcttcagcatcaacttcaacatcaccaaggacaccaggtttgctgagctgctggccctggagagcgaggccggcgtgcctgccctggtgggccccagcgccttcaagatccccttcctgatccggcagaagatcatcagcagcctggaccccccctgcagaagaggagctgactggaggaccctggcccagaagctgcacctggacagccacctgtccttctttgccagcaagcccagccccacagccatgatcctgaacctgtgggaggcccggcacttccccaacggcaacctgagccagctggccgctgctgtggccggcctgggccagccagatgctggcctcttcaccgtgtctgaggctgaatgttag

SEQ ID NO: 175481 - DNA, 2529 bp, Artificial Sequence
  Description of Artificial Sequence: Synthetic coding sequence
atggctgtgcggcccggcctgtggccagccctgctgggcatcgtgctggccgcctggctgcggggcagcggggcccagcagagcgccaccgtggccaaccctgtgcctggggccaacccagacctgctgccccacttcctggtggagccagaagatgtgtacatcgtgaagaacaagcctgtgctgctggtgtgcaaggctgtgcctgccacccagatcttcttcaagtgcaatggagagtgggtgcggcaggtggaccacgtgattgaaagaagcacagatggcagcagcggcctgcccaccatggaggtgcgcatcaacgtgtcccggcagcaggtggagaaggtgtttggcctggaggagtactggtgccagtgtgtggcctggagcagcagcggcaccaccaagagccagaaggcctacatccgcatcgcctacctgaggaagaactttgagcaggagcccctggccaaggaggtgtccctggagcagggcatcgtgctgccctgccggcccccagagggcatccccccagctgaggtggagtggctgagaaatgaagacctggtggaccccagcctggaccccaacgtgtacatcacccgggagcacagcctggtggtgcggcaggcccggctggccgacacagccaactacacctgtgtggccaagaacatcgtggcccggcggcgcagcgccagcgctgctgtgattgtgtatgtggatggctcctggagcccctggagcaagtggagcgcctgtggcctggactgcacccactggaggagcagagaatgtagtgaccctgcccccagaaatggaggagaggagtgccagggcacagacctggacaccaggaactgcaccagtgacctgtgtgtgcacacagccagcggcccagaagatgtggccctgtatgtgggcctgattgctgtggccgtgtgcctggtgctgctgctgctggtgctgatcctggtgtactgcaggaagaaggagggcctggacagtgatgtggccgacagcagcatcctgaccagcggcttccagcctgtgtccatcaagcccagcaaggctgacaacccccacctgctgaccatccagcctgacctgagcaccaccaccaccacctaccagggcagcctgtgcccccggcaggacggccccagccccaagttccagctgaccaacggccacctgctgagccccctgggcggcggccgccacaccctgcaccacagcagccccaccagcgaggccgaggagtttgtgtcccggctgagcacccagaactacttccgcagcctgccccggggcaccagcaacatgacctacggcaccttcaacttcctgggcggccgcctgatgatccccaacacaggcatcagcctgctgatccccccagatgccatcccccggggcaagatctatgagatctacctgaccctgcacaagccagaagatgtgcggctgcccctggccggctgccagaccctgctgagccccatcgtgtcctgtggccccccaggagtgctgctgaccaggcctgtgatcctggccatggaccactgtggggagcccagcccagacagctggagcctgcggctgaagaagcagagctgtgagggctcctgggaggatgtgctgcacctgggggaggaggcccccagccacctgtactactgccagctggaggccagcgcctgctacgtgttcacagagcagctgggccgctttgccctggtgggggaggccctgtctgtggccgccgccaagaggctgaagctgctgctgtttgcccctgtggcctgcaccagcctggagtacaacatccgggtgtactgcctgcatgacacccatgatgccctgaaggaggtggtgcagctggagaagcagctgggcggccagctgatccaggagccccgggtgctgcacttcaaggacagctaccacaacctgcggctgagcatccatgatgtgcccagcagcctgtggaagagcaagctgctggtgtcctaccaggagatccccttctaccacatctggaatggcacccagcgctacctgcactgcaccttcaccctggagcgggtgagccccagcaccagtgacctggcctgcaagctgtgggtgtggcaggtggagggagatggccagagcttcagcatcaacttcaacatcaccaaggacaccaggtttgctgagctgctggccctggagagcgaggccggcgtgcctgccctggtgggccccagcgccttcaagatccccttcctgatccggcagaagatcatcagcagcctggaccccccctgcagaagaggagctgactggaggaccctggcccagaagctgcacctggacagccacctgtccttctttgccagcaagcccagccccacagccatgatcctgaacctgtgggaggcccggcacttccccaacggcaacctgagccagctggccgctgctgtggccggcctgggccagccagatgctggcctcttcaccgtgtctgaggctgaatgttag

SEQ ID NO: 175482 - DNA, 2838 bp, Artificial Sequence
  Description of Artificial Sequence: Synthetic coding sequence
atgggcgcccggagcggggcccggggggccctgctgctggccctgctgctgtgctgggacccccggctgagccaggccggcacagacagcggcagcgaggtgctgcctgacagcttccccagcgccccagctgagcccctgccctacttcctgcaggagccccaggatgcctacatcgtgaagaacaagcctgtggagctgcgctgccgggccttccctgccacccagatctacttcaagtgcaatggagagtgggtgtcccagaatgaccacgtgacccaggagggcctggatgaggccaccggcctgcgggtgcgggaggtgcagatcgaggtgtcccggcagcaggtggaggagctgtttggcctggaggactactggtgccagtgtgtggcctggagcagcgctggcaccaccaagagccggcgggcctacgtgcgcatcgcctacctgaggaagaactttgaccaggagcccctgggcaaggaggtgcccctggaccacgaggtgctgctgcagtgccggcccccagagggcgtgcctgtggccgaggtggagtggctgaagaatgaagatgtgattgaccccacccaggacaccaacttcctgctgaccatcgaccacaacctgatcatccggcaggcccggctgagtgacacagccaactacacctgtgtggccaagaacatcgtggccaagaggaggagcaccacagccaccgtcatcgtgtatgtgaatggaggctggagctcctgggccgagtggagcccctgcagcaacagatgtggccggggctggcagaagaggaccaggacctgcaccaacccagcccccctgaatggaggagccttctgtgagggccaggccttccagaagacagcctgcaccaccatctgccctgtggatggagcctggacagagtggagcaagtggagcgcctgcagcacagaatgtgcccactggaggagccgggagtgcatggcccccccaccccagaatggaggccgggactgcagcggcaccctgctggacagcaagaactgcacagatggcctgtgcatgcagaacaagaagaccctgagtgaccccaacagccacctgctggaggccagcggagatgctgccctgtatgccggcctggtggtggccatctttgtggtggtggccatcctgatggctgtgggcgtggtggtgtacagaagaaactgccgggactttgacacagacatcacagacagcagcgctgccctgaccggcggcttccaccctgtgaacttcaagacagcccggcccagcaacccccagctgctgcaccccagcgtgcccccagacctgacagccagcgctggcatctaccggggccctgtgtatgccctgcaggacagcacagacaagatccccatgaccaacagccccctgctggaccccctgcccagcctgaaggtgaaggtgtacagcagcagcaccaccggcagcggccctggcctggctgatggagctgacctgctgggcgtgctgcccccaggcacctaccccagcgactttgcccgggacacccacttcctgcacctgcggagcgccagcctgggcagccagcagctgctgggcctgccccgggaccccggcagctctgtgtctggcaccttcggctgcctgggcggccgcctgagcatccctggcactggagtgtccctgctggtgcccaatggagccatcccccagggcaagttctatgagatgtacctgctgatcaacaaggccgagagcaccctgcccctgtctgagggcacccagacagtgctgagccccagcgtgacctgtggccccaccggcctgctgctgtgcaggcctgtgatcctgaccatgccccactgtgccgaggtgtctgcccgggactggatcttccagctgaagacccaggcccaccagggccactgggaggaggtggtgaccctggatgaggagaccctgaacaccccctgctactgccagctggagccccgggcctgccacatcctgctggaccagctgggcacctacgtgttcaccggggagagctacagccgctctgctgtgaagaggctgcagctggccgtgtttgccccagccctgtgcaccagcctggagtacagcctgcgggtgtactgcctggaggacacccctgtggccctgaaggaggtgctggagctggagaggaccctgggcggctacctggtggaggagcccaagcccctgatgttcaaggacagctaccacaacctgcggctgagcctgcatgacctgccccacgcccactggaggagcaagctgctggccaagtaccaggagatccccttctaccacatctggagcggcagccagaaggccctgcactgcaccttcaccctggagcggcacagcctggccagcacagagctgacctgcaagatctgtgtgcggcaggtggagggggagggccagatcttccagctgcacaccaccctggccgagaccccagctggcagcctggacaccctgtgcagcgcccctggcagcacagtgaccacccagctgggcccctatgccttcaagatccccctgagcatccggcagaagatctgcaacagcctggatgcccccaacagcagaggaaatgactggaggatgctggcccagaagctgtccatggaccgctacctgaactactttgccaccaaggccagccccactggagtcatcctggacctgtgggaggccctgcagcaggatgatggagacctgaacagcctggccagcgccctggaggagatgggcaagtctgagatgctggtggccgtggccacagatggagactgctag

SEQ ID NO: 175483 - DNA, 2805 bp, Artificial Sequence
  Description of Artificial Sequence: Synthetic coding sequence
atgggcgcccggagcggggcccggggggccctgctgctggccctgctgctgtgctgggacccccggctgagccaggccggcacagacagcggcagcgaggtgctgcctgacagcttccccagcgccccagctgagcccctgccctacttcctgcaggagccccaggatgcctacatcgtgaagaacaagcctgtggagctgcgctgccgggccttccctgccacccagatctacttcaagtgcaatggagagtgggtgtcccagaatgaccacgtgacccaggagggcctggatgaggccaccggcctgcgggtgcgggaggtgcagatcgaggtgtcccggcagcaggtggaggagctgtttggcctggaggactactggtgccagtgtgtggcctggagcagcgctggcaccaccaagagccggcgggcctacgtgcgcatcgcctacctgaggaagaactttgaccaggagcccctgggcaaggaggtgcccctggaccacgaggtgctgctgcagtgccggcccccagagggcgtgcctgtggccgaggtggagtggctgaagaatgaagatgtgattgaccccacccaggacaccaacttcctgctgaccatcgaccacaacctgatcatccggcaggcccggctgagtgacacagccaactacacctgtgtggccaagaacatcgtggccaagaggaggagcaccacagccaccgtcatcgtgtatgtgaatggaggctggagctcctgggccgagtggagcccctgcagcaacagatgtggccggggctggcagaagaggaccaggacctgcaccaacccagcccccctgaatggaggagccttctgtgagggccaggccttccagaagacagcctgcaccaccatctgccctgtggatggagcctggacagagtggagcaagtggagcgcctgcagcacagaatgtgcccactggaggagccgggagtgcatggcccccccaccccagaatggaggccgggactgcagcggcaccctgctggacagcaagaactgcacagatggcctgtgcatgcagatgctggaggccagcggagatgctgccctgtatgccggcctggtggtggccatctttgtggtggtggccatcctgatggctgtgggcgtggtggtgtacagaagaaactgccgggactttgacacagacatcacagacagcagcgctgccctgactggaggcttccaccctgtgaacttcaagacagcccggcccagcaacccccagctgctgcaccccagcgtgcccccagacctgacagccagcgctggcatctaccggggccctgtgtatgccctgcaggacagcacagacaagatccccatgaccaacagccccctgctggaccccctgcccagcctgaaggtgaaggtgtacagcagcagcaccactggaagtggccctggcctggctgatggagctgacctgctgggcgtgctgcccccaggcacctaccccagcgactttgcccgggacacccacttcctgcacctgcggagcgccagcctgggcagccagcagctgctgggcctgccccgggaccccggcagctctgtgtctggcaccttcggctgcctgggcggccgcctgagcatccctggcaccggggtgtccctgctggtgcccaacggggccatcccccagggcaagttctatgagatgtacctgctgatcaacaaggccgagagcaccctgcccctgtctgagggcacccagacagtgctgagccccagcgtgacctgtggccccaccggcctgctgctgtgcaggcctgtgatcctgaccatgccccactgtgccgaggtgtctgcccgggactggatcttccagctgaagacccaggcccaccagggccactgggaggaggtggtgaccctggatgaggagaccctgaacaccccctgctactgccagctggagccccgggcctgccacatcctgctggaccagctgggcacctacgtgttcaccggggagagctacagccgctctgctgtgaagaggctgcagctggccgtgtttgccccagccctgtgcaccagcctggagtacagcctgcgggtgtactgcctggaggacacccctgtggccctgaaggaggtgctggagctggagaggaccctgggcggctacctggtggaggagcccaagcccctgatgttcaaggacagctaccacaacctgcggctgagcctgcatgacctgccccacgcccactggaggagcaagctgctggccaagtaccaggagatccccttctaccacatctggagcggcagccagaaggccctgcactgcaccttcaccctggagcggcacagcctggccagcacagagctgacctgcaagatctgtgtgcggcaggtggagggggagggccagatcttccagctgcacaccaccctggccgagaccccagctggcagcctggacaccctgtgcagcgcccctggcagcacagtgaccacccagctgggcccctatgccttcaagatccccctgagcatccggcagaagatctgcaacagcctggatgcccccaacagcagaggaaatgactggaggatgctggcccagaagctgtccatggaccgctacctgaactactttgccaccaaggccagccccaccggggtcatcctggacctgtgggaggccctgcagcaggatgatggagacctgaacagcctggccagcgccctggaggagatgggcaagtctgagatgctggtggccgtggccacagatggagactgctag

SEQ ID NO: 175484 - DNA, 2673 bp, Artificial Sequence
  Description of Artificial Sequence: Synthetic coding sequence
gatgatgacttcttccacgagctgcctgagaccttccccagcgaccccccagagcccctgccccacttcctgattgagcctgaggaggcctacatcgtgaagaacaagcctgtgaacctgtactgcaaggccagccctgccacccagatctacttcaagtgcaacagcgagtgggtgcaccagaaggaccacatcgtggatgagcgggtggatgagaccagcggcctgattgtgcgggaggtgtccattgagatcagccggcagcaggtggaggagctgtttggacctgaggactactggtgccagtgtgtggcctggagcagcgctggcaccaccaagagcaggaaggcctacgtgagaattgcctacctgaggaagacctttgagcaggagcccctgggcaaggaggtgtccctggagcaggaggtgctgctgcagtgcaggcctcctgagggcatccctgtggccgaggtggagtggctgaagaatgaagacatcattgatcctgtggaggacaggaacttctacatcaccatcgaccacaacctgatcatcaagcaggcccggctgagtgacacagccaactacacctgtgtggccaagaacatcgtggccaagaggaagagcaccacagccaccgtgattgtgtatgtgaatggaggctggagcacctggacagagtggagcgtgtgcaacagccgctgtggccggggctaccagaagaggaccaggacctgcaccaacccagcccccctgaatggaggagccttctgtgagggccagagcgtgcagaagatcgcctgcaccaccctgtgccctgtggatggccgctggaccccctggagcaagtggagcacctgtggcacagagtgcacccactggaggcggcgggagtgcacagccccagcccccaagaatggaggcaaggactgtgatggcctggtgctgcagagcaagaactgcacagatggcctgtgcatgcagacagccccagacagtgatgatgtggccctgtatgtgggcatcgtgattgctgtgattgtgtgcctggccatctctgtggtggtggccctgtttgtgtacaggaagaaccaccgggactttgaaagtgacatcatcgacagcagcgccctgaatggaggcttccagcctgtgaacatcaaggccgcccggcaggacctgctggccgtgcccccagacctgaccagcgctgctgccatgtaccggggccctgtgtatgccctgcatgatgtgtctgacaagatccccatgaccaacagccccatcctggaccccctgcccaacctgaagatcaaggtgtacaacaccagcggggctgtgaccccccaggatgacctgtctgagttcaccagcaagctgagcccccagatgacccagagcctgctggagaatgaggccctgagcctgaagaaccagagcctggcccggcagacagaccccagctgcacagccttcggcagcttcaacagcctgggcggccacctgattgtgcccaacagcggcgtgtccctgctgatcccagctggggccatcccccagggccgggtgtatgagatgtatgtgacagtgcacaggaaggagaccatgaggcctcccatggatgacagccagaccctgctgacccctgtggtgtcctgtggccccccaggggccctgctgaccaggcctgtggtgctgaccatgcaccactgtgccgaccccaacacagaggactggaagatcctgctgaagaaccaggccgcccagggccagtgggaggatgtggtggtggtgggggaggagaacttcaccaccccctgctacatccagctggatgctgaggcctgccacatcctgacagagaacctgagcacctacgccctggtgggccacagcaccaccaaggctgctgccaagaggctgaagctggccatcttcggccccctgtgctgcagcagcctggagtacagcatccgggtgtactgcctggatgacacccaggatgccctgaaggagatcctgcacctggagcggcagatgggcggccagctgctggaggagcccaaggccctgcacttcaagggcagcacccacaacctgcggctgagcatccatgacatcgcccacagcctgtggaagagcaagctgctggccaagtaccaggagatccccttctaccacgtgtggagcggcagccagaggaacctgcactgcaccttcaccctggagcgcttcagcctgaacacagtggagctggtgtgcaagctgtgtgtgcggcaggtggagggggagggccagatcttccagctgaactgcaccgtgtctgaggagcccactggaattgacctgcccctgctggaccctgccaacaccatcaccaccgtgacaggccccagcgccttcagcatccccctgcccatccggcagaagctgtgcagcagcctggatgccccccagacccggggccatgactggaggatgctggcccacaagctgaacctggaccgctacctgaactactttgccaccaagagcagccccaccggggtcatcctggacctgtgggaggcccagaacttcccagatggcaacctgtccatgctggccgctgtgctggaggagatgggcagacatgagaccgtggtgtccctggccgctgagggccagtactag

SEQ ID NO: 175485 - DNA, 2796 bp, Artificial Sequence
  Description of Artificial Sequence: Synthetic coding sequence
atgaggaagggcctgcgggccacagctgcccgctgtggcctgggcctgggctacctgctgcagatgctggtgctgcctgccctggccctgctgagcgccagcggcaccggcagcgctgcccaggatgatgacttcttccacgagctgcctgagaccttccccagcgaccccccagagcccctgccccacttcctgattgagcctgaggaggcctacatcgtgaagaacaagcctgtgaacctgtactgcaaggccagccctgccacccagatctacttcaagtgcaacagcgagtgggtgcaccagaaggaccacatcgtggatgagcgggtggatgagaccagcggcctcatcgtgcgggaggtgtccattgagatcagccggcagcaggtggaggagctgtttggacctgaggactactggtgccagtgtgtggcctggagcagcgctggcaccaccaagagcaggaaggcctacgtgcgcatcgcctacctgaggaagacctttgagcaggagcccctgggcaaggaggtgtccctggagcaggaggtgctgctgcagtgccggcccccagagggcatccctgtggccgaggtggagtggctgaagaatgaagacatcatcgaccctgtggaggacaggaacttctacatcaccatcgaccacaacctgatcatcaagcaggcccggctgagtgacacagccaactacacctgtgtggccaagaacatcgtggccaagaggaagagcaccacagccaccgtcatcgtgtatgtgaatggaggctggagcacctggacagagtggagcgtgtgcaacagccgctgtggccggggctaccagaagaggaccaggacctgcaccaacccagcccccctgaatggaggagccttctgtgagggccagagcgtgcagaagatcgcctgcaccaccctgtgccctgtggatggccgctggaccccctggagcaagtggagcacctgtggcacagaatgtacccactggaggagaagagaatgtacagccccagcccccaagaatggaggcaaggactgtgatggcctggtgctgcagagcaagaactgcacagatggcctgtgcatgcagacagccccagacagtgatgatgtggccctgtatgtgggcatcgtgattgctgtgattgtgtgcctggccatctctgtggtggtggccctgtttgtgtacaggaagaaccaccgggactttgaaagtgacatcatcgacagcagcgccctgaatggaggcttccagcctgtgaacatcaaggccgcccggcaggacctgctggccgtgcccccagacctgaccagcgctgctgccatgtaccggggccctgtgtatgccctgcatgatgtgtctgacaagatccccatgaccaacagccccatcctggaccccctgcccaacctgaagatcaaggtgtacaacaccagcggggctgtgaccccccaggatgacctgtctgagttcaccagcaagctgagcccccagatgacccagagcctgctggagaatgaggccctgagcctgaagaaccagagcctggcccggcagacagaccccagctgcacagccttcggcagcttcaacagcctgggcggccacctgattgtgcccaacagcggcgtgtccctgctgatcccagctggggccatcccccagggccgggtgtatgagatgtatgtgacagtgcacaggaaggagaccatgaggcctcccatggatgacagccagaccctgctgacccctgtggtgtcctgtggccccccaggggccctgctgaccaggcctgtggtgctgaccatgcaccactgtgccgaccccaacacagaggactggaagatcctgctgaagaaccaggccgcccagggccagtgggaggatgtggtggtggtgggggaggagaacttcaccaccccctgctacatccagctggatgctgaggcctgccacatcctgacagagaacctgagcacctacgccctggtgggccacagcaccaccaaggccgccgccaagaggctgaagctggccatcttcggccccctgtgctgcagcagcctggagtacagcatccgggtgtactgcctggatgacacccaggatgccctgaaggagatcctgcacctggagcggcagatgggcggccagctgctggaggagcccaaggccctgcacttcaagggcagcacccacaacctgcggctgagcatccatgacatcgcccacagcctgtggaagagcaagctgctggccaagtaccaggagatccccttctaccacgtgtggagcggcagccagaggaacctgcactgcaccttcaccctggagcgcttcagcctgaacacagtggagctggtgtgcaagctgtgtgtgcggcaggtggagggggagggccagatcttccagctgaactgcaccgtgtctgaggagcccaccggcatcgacctgcccctgctggaccctgccaacaccatcaccaccgtgacaggccccagcgccttcagcatccccctgcccatccggcagaagctgtgcagcagcctggatgccccccagacccggggccatgactggaggatgctggcccacaagctgaacctggaccgctacctgaactactttgccaccaagagcagccccactggagtcatcctggacctgtgggaggcccagaacttcccagatggcaacctgtccatgctggccgctgtgctggaggagatgggcagacatgaaacagtggtgtccctggccgctgagggccagtactag

SEQ ID NO: 175486 - DNA, 3153 bp, Artificial Sequence
  Description of Artificial Sequence: Synthetic coding sequence
atggagcccggccggggcggcacagagaccgtgggcaagtttgagttcagcaggaaggacctgattggccacggggcctttgctgtggtgttcaagggccgccaccgggagaagcatgacctggaggtggccgtgaagtgcatcaacaagaagaacctggccaagagccagaccctgctgggcaaggagatcaagatcctgaaggagctgaagcatgaaaatattgtggccctgtatgacttccaggagatggccaacagcgtgtacctggtgatggagtactgcaatggaggagacctggccgactacctgcacgccatgaggaccctgtctgaggacaccatccgcctcttcctgcagcagattgctggggccatgaggctgctgcacagcaagggcatcatccaccgggacctgaagccccagaacatcctgctgagcaacccagctggccggcgggccaaccccaacagcatccgggtgaagattgctgactttggatttgcccgctacctgcagagcaacatgatggccgccaccctgtgtggcagccccatgtacatggcccctgaggtgatcatgagccagcactatgatggcaaggctgacctgtggagcatcggcaccatcgtgtaccagtgcctgaccgggaaggcccccttccaggccagcagcccccaggacctgcggctcttctatgagaagaacaagaccctggtgcccaccatcccccgggagaccagcgcccccctgcggcagctgctgctggccctgctgcagaggaaccacaaggacaggatggactttgatgagttcttccaccaccccttcctggatgccagccccagcgtgaggaagagcccccctgtgcctgtgcccagctaccccagcagcggcagcggcagcagcagcagcagcagcagcaccagccacctggccagcccccccagcctgggggagatgcagcagctgcagaagaccctggccagccctgctgacacagctggcttcctgcacagcagccgggacagcggcggcagcaaggacagcagctgtgacacagatgactttgtgatggtgcctgcccagtttcctggggacctggtggccgaggcccccagcgccaagcccccaccagacagcctgatgtgcagcggcagcagcctggtggccagcgctggcctggagagccacggccgcacccccagccccagccccccctgcagcagcagccccagccccagcggccgggccggccccttcagcagcagccgctgtggggcctctgtgcccatccctgtgcccacccaggtgcagaactaccagagaattgaaagaaacctgcagagccccacccagttccagacccccaggagcagcgccatcagaagaagtggcagcaccagccccctgggctttgcccgggccagccccagccccccagcccacgccgagcacggcggcgtgctggccaggaagatgagcctgggcggcggccggccctacacccccagcccccaggtgggcaccatccctgagaggcctggctggagcggcacccccagcccccagggcgctgagatgaggggcggccgcagcccccggcccggcagcagcgcccctgagcacagccccaggaccagcggcctgggctgccgcctgcacagcgcccccaacctgagtgacctgcacgtggtgcggcccaagctgcccaagcccccaacagaccccctgggcgctgtgttcagccccccccaggccagccccccccagcccagccacggcctgcagagctgcaggaacctgcggggcagccccaagctgcctgacttcctgcagaggaaccccctgccccccatcctgggcagccccaccaaggctgtgcccagctttgacttccccaagacccccagcagccagaacctgctggccctgctggcccggcagggcgtggtgatgaccccaccaagaaacagaaccctgcctgacctgtctgaggtgggccccttccacggccagcccctgggccctggcctgcggcctggagaggaccccaagggccccttcggccgctccttcagcaccagccggctgacagacctgctgctgaaggccgccttcggcacccaggccccagaccccggcagcacagagagcctgcaggagaagcccatggagatcgcccccagcgctggctttggaggcagcctgcaccctggggcccgggccggcggcaccagcagccccagccctgtggtgttcaccgtgggcagccccccatctggcagcaccccaccccagggccccaggaccaggatgttttctgctggccccactggaagtgccagcagcagcgcccggcacctggtgcccggcccctgcagcgaggccccagcccctgagctgcctgcccctggccacggctgcagctttgctgaccccatcacagccaacctggagggcgctgtgacctttgaggccccagacctgcctgaggagaccctgatggagcaggagcacacagagatcctgcggggcctgcgcttcaccctgctgtttgtgcagcacgtgctggagattgctgccctgaagggcagcgccagcgaggccgccggcggccctgagtaccagctgcaggagagcgtggtggccgaccagatcagcctgctgagccgggagtggggctttgctgagcagctggtgctgtacctgaaggtggccgagctgctgagcagcggcctgcagagcgccatcgaccagatccgggccggcaagctgtgcctgagcagcacagtgaagcaggtggtgcggcggctgaatgagctgtacaaggcctctgtggtgtcctgccagggcctgagcctgcggctgcagcgcttcttcctggacaagcagaggctgctggaccgcatccacagcatcacagctgagcggctcatcttcagccatgctgtgcagatggtgcagagcgctgccctggatgagatgttccagcaccgggagggctgtgtgccccgctaccacaaggccctgctgctgctggagggcctgcagcacatgctgagtgaccaggccgacattgaaaatgtgaccaagtgcaagctgtgcattgaaagaaggctgagcgccctgctgaccggcatctgtgcctag

SEQ ID NO: 175487 - DNA, 1452 bp, Artificial Sequence
  Description of Artificial Sequence: Synthetic coding sequence
atgcagagaaatggcagcgccagccggggcctggagaagacccggctgcggctgtgccgggaggcccgcatccctgagagcgccttcctgaccggcctgacccgggagagctgggaggcccgctgctggtgtgccaaggacacccgggaggtggtggccatcaagtgtgtggccaagaagagcctgaacaaggcctctgtggagaacctgctgacagaaattgagatcctgaagggcatccgccacccccacatcgtgcagctgaaggacttccagtgggacagcgacaacatctacctgatcatggagttctgtgccggcggggacctgagccgcttcatccacacccggcgcatcctgcctgagaaggtggcccgggtcttcatgcagcagctggccagcgccctgcagttcctgcacgagaggaacatcagccacctggacctgaagccccagaacatcctgctgagcagcctggagaagccccacctgaagctggccgactttggatttgcccagcacatgagcccctgggatgagaagcacgtgctgcggggcagccccctgtacatggcccctgagatggtgtgccagaggcagtatgatgcccgggtggacctgtggagcatgggcgtcatcctgtatgaggccctgtttggccagcccccatttgccagccgctccttcagcgagctggaggagaagatccgcagcaacagagtcatcgagctgcccctgcggcccctgctgagccgggactgccgggacctgctgcagaggctgctggagcgggaccccagccgccgcatctccttccaggacttctttgcccacccctgggtggacctggagcacatgcccagcggggagagcctgggccgggccacagccctggtggtgcaggccgtgaagaaggaccaggagggggacagcgctgctgccctgagcctgtactgcaaggccctggacttctttgtgcctgccctgcactatgaggtggatgcccagaggaaggaggccatcaaggccaaggtgggccagtatgtgtccagagctgaggagctgaaggccatcgtgagcagcagcaaccaggccctgctgcggcagggcaccagcgcccgggacctgctgcgggagatggcccgggacaagccccggctgctggccgccctggaggtggccagcgctgccatggccaaggaggaggccgccggcggggagcaggatgccctggacctgtaccagcacagcctgggggagctgctgctgctgctggccgctgagcccccaggaagaagaagagagctgctgcacacagaggtgcagaacctgatggcccgggcagagtacctgaaggagcaggtgaagatgagggagagccgctgggaggccgacaccctggacaaggagggcctgtctgagagcgtgcgcagcagctgcaccctgcagtag

SEQ ID NO: 175488 - DNA, 1419 bp, Artificial Sequence
  Description of Artificial Sequence: Synthetic coding sequence
atggccggccctggctggggccccccccggctggatggcttcatcctgacagagcggctgggcagcggcacctacgccaccgtgtacaaggcctatgccaagaaggacacccgggaggtggtggccatcaagtgtgtggccaagaagagcctgaacaaggcctctgtggagaacctgctgacagaaattgagatcctgaagggcatccgccacccccacatcgtgcagctgaaggacttccagtgggacagcgacaacatctacctgatcatggagttctgtgccggcggggacctgagccgcttcatccacacccggcgcatcctgcctgagaaggtggcccgggtcttcatgcagcagctggccagcgccctgcagttcctgcatgaaagaaacatcagccacctggacctgaagccccagaacatcctgctgagcagcctggagaagccccacctgaagctggccgactttggatttgcccagcacatgagcccctgggatgagaagcacgtgctgcggggcagccccctgtacatggcccctgagatggtgtgccagaggcagtatgatgcccgggtggacctgtggagcatgggcgtcatcctgtatgaggccctgtttggccagcccccatttgccagccgctccttcagcgagctggaggagaagatccgcagcaacagagtgattgagctgcccctgcggcccctgctgagccgggactgccgggacctgctgcagaggctgctggagcgggaccccagccgccgcatctccttccaggacttctttgcccacccctgggtggacctggagcacatgcccagcggggagagcctgggccgggccacagccctggtggtgcaggccgtgaagaaggaccaggagggggacagcgctgctgccctgagcctgtactgcaaggccctggacttctttgtgcctgccctgcactatgaggtggatgcccagaggaaggaggccatcaaggccaaggtgggccagtatgtgtccagagctgaggagctgaaggccatcgtgagcagcagcaaccaggccctgctgcggcagggcaccagcgcccgggacctgctgcgggagatggcccgggacaagccccggctgctggccgccctggaggtggccagcgctgccatggccaaggaggaggccgccggcggggagcaggatgccctggacctgtaccagcacagcctgggggagctgctgctgctgctggccgctgagcccccaggaagaagaagagagctgctgcacacagaggtgcagaacctgatggcccgggcagagtacctgaaggagcaggtgaagatgagggagagccgctgggaggccgacaccctggacaaggagggcctgtctgagagcgtgcgcagcagctgcaccctgcagtag

SEQ ID NO: 175489 - DNA, 9705 bp, Artificial Sequence
  Description of Artificial Sequence: Synthetic coding sequence
atggtgaagaggaagagcagcgagggccaggagcaggacggcggccggggcatccccctgcccatccagaccttcctgtggaggcagaccagcgccttcctgcggcccaagctgggcaagcagtatgaggccagctgtgtgtcctttgagcgggtgctggtggagaacaagctgcacggcctgagccctgccctgtctgaggccatccagagcatcagccgctgggagctggtgcaggccgccctgccccacgtgctgcactgcacagccaccctgctgagcaacagaaacaagctgggccaccaggacaagctgggcgtggccgagaccaagctgctgcacaccctgcactggatgctgctggaggccccccaggactgcaacaatgaaagatttggaggaacagaccggggcagctcctggggcggcagcagcagcgccttcatccaccaggtggagaaccagggcagccctggccagccctgccagagcagcagcaatgatgaggaggagaacaacagaaggaagatcttccagaacagcatggccaccgtggagctgtttgtgttcctgtttgcccccctggtgcaccgcatcaaggagagtgacctgaccttccggctggccagcggcctggtgatctggcagcccatgtgggagcaccggcagcccggggtgtctggcttcaccgccctggtgaagcccatccggaacatcatcacagccaagaggagcagccccatcaacagccagagcaggacctgtgagagccccaaccaggatgcccggcacctggagggcctgcaggtggtgtgtgagaccttccagagcgacagcatcagccccaaggccaccatcagcggctgccaccggggcaacagctttgatggcagcctgagcagccagaccagccaggagcggggccccagccacagccgggccagcctggtgattcctccctgccagaggagccgctatgccacctactttgatgtggccgtgctgcgctgcctgctgcagccccactggagcgaggagggcacccagtggagcctgatgtactacctgcagaggctgcggcacatgctggaggagaagccagagaagcccccagagccagacatccccctgctgccccggcccaggagcagctccatggtggccgccgcccccagcctggtgaacacccacaagacccaggacctgaccatgaagtgcaatgaggaggagaagagcctgagcagcgaggccttcagcaaggtgtccctgaccaacctgcggcgctctgctgtgcctgacctgagcagtgacctgggcatgaacatcttcaagaagttcaagagcaggaaagaagatcgggagaggaagggcagcatccccttccaccacacaggcaagagaagacccaggaggatgggcgtgcccttcctgctgcacgaggaccacctggatgtgagccccaccaggagcaccttctcctttggcagcttcagcggcctgggggaggaccggcggggcattgaaaaaggaggctggcagaccaccatcctgggcaagctgacccggcggggcagcagtgatgctgccacagagatggagagcctgagcgcccggcacagccacagccaccacaccctggtgtctgacctgcctgaccccagcaacagccatggagaaaatacagtgaaggaggtgcgcagccagatcagcaccatcaccgtggccaccttcaacaccaccctggccagcttcaacgtgggctatgctgacttcttcaatgagcacatgaggaagctgtgcaaccaggtgcccatccctgagatgcctcatgagcccctggcctgtgccaacctgcccaggagcctgacagacagctgcatcaactacagctacctggaggacacagagcacattgatggcaccaacaactttgtgcacaagaatggcatgctggacctgtctgtggtgctgaaggctgtgtacctggtgctgaaccacgacatcagcagccgcatctgtgatgtggccctgaacatcgtggagtgcctgctgcagctgggcgtggtgccctgtgtggagaagaacaggaagaagtctgagaacaaggaaaatgagaccctggagaagaggcccagcgagggcgccttccagttcaagggcgtgtctggcagcagcacctgtggctttggaggccctgctgtgtctggagctggagatggcggcggggaggagggcggcggcggagatggcggcggcggcggcggagatggcggcggcggcggcggcggcggcggcggcccctatgagaagaatgacaagaaccaggagaaggatgagagcacccctgtgagcaaccaccggctggccctgaccatgctgatcaagatcgtgaagagcctgggctgtgcctacggctgtggggagggccaccggggcctgagcggggaccggctgcggcaccaggcccagaactgcctgaccaagctgtacaagctggacaagatgcagttccggcagaccatgagggactatgtgaacaaggacagcctgaacaacgtggtggacttcctgcacgccctgctgggcttctgcatggagcctgtgacagacaacaaggccggctttggaaacaacttcaccaccgtggacaacaagagcacagcccagaatgtggagggcatcatcgtgtctgccatgttcaagagcctcatcacccgctgtgccagcaccacccatgagctgcacagccctgagaacctgggcctgtactgtgacatccggcagctggtgcagttcatcaaggaggcccatggaaatgtgttccggcgggtggccctgagcgccctgctggacagcgctgagaagctggcccctgggaagaaggtggaggagaatgagcaggagagcaagccagctggcagcaagaggtctgaggccggcagcatcgtggacaagggccaggtgagcagcgcccctgaggagtgccgctccttcatgagcggccggcccagccagaccccagagcatgatgagcagatgcagggcgccaacctgggcaggaaggacttctggaggaagatgttcaagagccagagcgctgccagtgacaccagcagccagagcgagcaggacaccagtgaatgtaccacagcccacagcggcaccaccagtgacagaagagcccggagccgcagccgccgcatcagcctgaggaagaagctgaagctgcccatcggcaagaggaactggctgaagaggagcagcctgagcggcctggctgatggagtggaggacctgctggacatcagctctgtggaccggctgtccttcatccggcagagcagcaaggtgaagttcaccagcgctgtgaagctgtctgagggcggccctggcagcggcatggagaatggaagagatgaggaggagaacttcttcaagaggctgggctgccacagctttgatgaccacctgagccccaaccaggacggcggcaagagcaagaatgtggtgaacctgggcgccatccggcagggcatgaagcgcttccagttcctgctgaactgctgtgagcccggcaccatcccagatgccagcatcctggccgccgccctggacctggaggcccctgtggtggcccgggccgccctcttcctggagtgtgccaggtttgtgcaccgctgcaacagaggcaactggccagagtggatgaagggccaccacgtgaacatcaccaagaagggcctgagccggggccgcagccccatcgtgggcaacaagaggaaccagaagctgcagtggaatgctgccaagctgttctaccagtggggagatgccatcggcgtgcggctgaatgagctgtgccacggggagagcgagagccctgccaacctgctgggcctcatctatgatgaggagaccaagaggcggctgaggaaagaagatgaggaggaggacttcctggatgacagcacagtgaaccccagcaaatgtggctgcccctttgccctgaagatggccgcctgccagctgctgctggagatcaccaccttcctgcgggagaccttcagctgcctgccccggcccaggacagagcccctggtggacctggagagctgccgcctgcggctggaccctgagctggacagacacagatatgaaaggaagatcagctttgctggggtgctggatgaaaatgaagacagcaaggacagcctgcacagcagcagccacaccctgaagagtgatgctggggtggaggagaagaaggagggcagcccctggagcgccagcgagcccagcattgagcctgagggcatgagcaatgctggagctgaggagaactaccacaggaacatgtcctggctgcacgtgatgatcctgctgtgcaaccagcagagcttcatctgcacccacgtggactactgccacccccactgctacctgcaccacagccgcagctgtgcccggctggtgcgggccatcaagctgctgtatggagacagcgtggacagcctgcgggagagcagcaacatcagctctgtggccctgcggggcaagaagcagaaggaatgtagtgacaagagctgcctgcggacccccagcctgaagaagagggtgtctgatgccaacctggagggcaagaaggacagcggcatgctgaagtacatccggctgcaggtgatgagcctgagccctgcccccctgagcctgctgatcaaggccgcccccatcctgacagaggagatgtatggagacatccagcctgctgcctgggagctgctgctgtccatggatgagcacatggccggggctgctgctgccatgttcctgctgtgtgctgtgaaggtgcctgaggccgtgtctgacatgctgatgtctgagttccaccaccctgagaccgtgcagaggctgaatgctgtgctgaagttccacaccctgtggaggttccgctaccaggtgtggcccaggatggaggagggcgcccagcagatcttcaagatccccccacccagcatcaacttcaccctgcccagccctgtgctgggcatgcccagcgtgcccatgtttgatcctccctgggtgccccagtgcagcggctctgtgcaggaccccatcaatgaagaccagagcaagagcttcagcgcccgggctgtgagccgcagccaccagagagctgagcacatcctgaagaacctgcagcaggaggaggagaagaagaggctgggccgggaggccagcctcatcacagccatccccatcacccaggaggcctgctatgagcccacctgcacccccaacagcgagcctgaggaggaggtggaggaggtgaccaacctggccagccggcggctgtctgtgagccccagctgcaccagcagcaccagccacaggaactacagcttccggcggggctctgtgtggagcgtgcgctctgctgtgtctgcagaagatgaggagcacaccacagagcacacccccaaccaccacgtgccccagcccccccaggccgtgtttcctgcctgcatctgtgccgctgtgctgcccatcgtgcacctgatggaggatggagaggtgcgggaggatggagtggccgtgtctgctgtggcccagcaggtgctgtggaactgcctgattgaggaccccagcacagtgctgcggcacttcctggagaagctgaccatcagcaaccggcaggatgagctgatgtacatgctgaggaagctgctgctgaacatcggggacttccctgcccagaccagccacatcctcttcaactacctggtgggcctcatcatgtactttgtgaggaccccctgtgagtggggcatggatgccatcagcgccaccctgaccttcctgtgggaggtggtgggctacgtggagggcctcttcttcaaggacctgaagcagaccatgaagaaggagcagtgtgaggtgaagctgctggtgacagcctccatgcctggcaccaagaccctggtggtgcacggccagaatgaatgtgacatccccacccagctgcctgtgcatgaggacacccagtttgaggccctgctgaaggaatgtctggagttcttcaacatccctgagagccagagcacccactacttcctgatggacaagcgctggaacctgatccactacaacaagacctacgtgcgggacatctaccccttccgccgctctgtgagcccccagctgaacctggtgcacatgcaccctgagaagggccaggagctgatccagaagcaggtgttcaccaggaagctggaggaggtgggccgggtgctcttcctgatcagcctgacccagaagatccccacagcccacaagcagagccacgtgtccatgctgcaggaggacctgctgcggctgcccagcttccccaggtctgccattgatgctgagttcagcctcttcagtgacccccaggccggcaaggagctgtttggcctggacaccctgcagaagagcctgtggatccagctgctggaggagatgttcctgggcatgcccagcgagttcccctggggagatgagatcatgctgttcctgaatgtgttcaatggagccctgatcctgcacccagaagattctgccctgctgcggcagtatgctgccaccgtcatcaacacagctgtgcacttcaaccacctgttcagcctgagcggctaccagtggatcctgcccaccatgctgcaggtgtacagcgactatgagagcaacccccagctgcggcaggccattgaatttgcctgccaccagttctacatcctgcacaggaagccctttgtgctgcagctgtttgcctctgtggcccccctgctggagttcccagatgctgccaacaacggccccagcaagggcgtgtctgcccagtgcctgtttgacctgctgcagagcctggagggggagaccacagacatcctggacatcctggagctggtgaaggccgagaagcccctgaagagcctggacttctgctatggaaatgaagacctgaccttcagcatcagcgaggccatcaagctgtgtgtgacagtggtggcctatgcccctgagagcttccgcagcctgcagatgctgatggtgctggaggccctggtgccctgctacctgcagaagctgaagaggcagaccagccaggtggagaccgtgcctgctgcccgggaggagattgctgccacagctgccctggccaccagcctgcaggccctgctgtacagcgtggaggtgctgacccggcccatgacagccccccagatgagccgctgtgaccagggccacaagggcaccaccacagccaaccacaccatgagcagtggagtgaacacccgctaccaggagcagggcgccaagctgcacttcatccgggagaacctgcacctgctggaggagggccagggcatcccccgggaggagctggatgaaagaattgcccgggaggagttcagaagaccccgggagagcctgctgaacatctgcacagagttctacaagcactgcggcccccggctgaagatcctgcagaacctggccggggagccccgggtgattgccctggagctgctggatgtgaagagccacatgaggctggccgagatcgcccacagcctgctgaagctggccccctatgacacccagaccatggagagccggggcctgcggcgctacatcatggagatgctgcccatcacagactggacagctgaggccgtgcggcctgccctgatcctgatcctgaagaggctggacaggatgttcaacaagatccacaagatgcccaccctgcggcggcaggtggagtgggagcccgccagcaacctgattgagggcgtgtgcctgaccctgcagaggcagcccatcatctccttcctgccccacctgcggagcctcatcaacgtgtgtgtgaacctggtgatgggcgtggtgggccccagctctgtggctgatggcctgcccctgctgcacctgagcccctacctgagcccccccctgcccttcagcacagctgtggtgcggctggtggccctgcagatccaggccctgaaggaggacttccccctgagccacgtgatcagccccttcaccaaccaggagcggcgggagggcatgctgctgaacctgctgatcccctttgtgctgactgtgggcagcggcagcaaggacagcccctggctggagcagcctgaggtgcagctgctgctgcagaccgtcatcaacgtgctgctgcccccacgcatcatcagcaccagccgcagcaagaacttcatgctggagagcagccctgcccactgcagcaccccaggagatgctgggaaggacctgcggcgggagggcctggccgagagcaccagccaggccgcctacctggccctgaaggtgatcctggtgtgctttgagcggcagctgggcagccagtggtactggctgagcctgcaggtgaaggagatggccctgaggaaggtgggcggcctggccctgtgggacttcctggacttcatcgtgaggacccgcatccccatctttgtgctgctgcggcccttcatccagtgcaagctgctggcccagcctgctgagaaccacgaggagctgagcgcccggcagcacatcgctgaccagctggagcggcgcttcatcccccggcccctgtgcaagagcagcctgattgctgagttcaacagcgagctgaagatcctgaaggaggccgtgcacagcggcagcgcctaccagggcaagaccagcatcagcacagtgggcaccagcaccagcgcctaccgcctgagcctggccaccatgagccgcagcaacacaggcaccggcaccgtgtgggagcaggacagcgagcccagccagcaggccagccaggacaccctgagcaggacagatgaagaagatgaggagaatgacagcatctccatgcccagcgtggtgtctgagcaggaggcctacctgctgagcgccatcggcagaagacgcttcagcagccacgtgtcctccatgtctgtgccccaggccgaggtgggcatgctgcccagccagagggtggccagcatccagagcgagcccggccagcagaacctgctggtgcagcagcccctgggcaggaagaggggcctgcggcagctgcggcggcccctgctgagccggcagaagacccagacagagcccaggaaccggcagggcgcccggctgagcaccaccaggaggagcatccagcccaagaccaagcccagcgctgaccagaagaggtctgtgaccttcatcgaggcccagcctgagcctgctgctgcccccacagatgccctgcctgccaccggccagctgcagggctgcagccctgcccccagcaggaagccagaggccatggatgagcctgtgctgaccagcagccctgccatcgtggtggccgacctgcacagcgtgagccccaagcagagcgagaacttccccacagaggagggggagaaggaggaggacacagaggcccagggcgccacagcccacagccccctgagcgcccagctgagtgaccctgatgacttcaccggcctggagaccagcagcctgctgcagcacggggacacagtgctgcacatcagtgaagaaaatggcatggagaaccccctgctgagcagccagttcaccttcacccccacagagctgggcaagacagatgctgtgctggatgagagccacgtgtag

SEQ ID NO: 175490 - DNA, 9777 bp, Artificial Sequence
  Description of Artificial Sequence: Synthetic coding sequence
atggtgaagaggaagagcagcgagggccaggagcaggacggcggccggggcatccccctgcccatccagaccttcctgtggaggcagaccagcgccttcctgcggcccaagctgggcaagcagtatgaggccagctgtgtgtcctttgagcgggtgctggtggagaacaagctgcacggcctgagccctgccctgtctgaggccatccagagcatcagccgctgggagctggtgcaggccgccctgccccacgtgctgcactgcacagccaccctgctgagcaacagaaacaagctgggccaccaggacaagctgggcgtggccgagaccaagctgctgcacaccctgcactggatgctgctggaggccccccaggactgcaacaatgaaagatttggaggaacagaccggggcagctcctggggcggcagcagcagcgccttcatccaccaggtggagaaccagggcagccctggccagccctgccagagcagcagcaatgatgaggaggagaacaacagaaggaagatcttccagaacagcatggccaccgtggagctgtttgtgttcctgtttgcccccctggtgcaccgcatcaaggagagtgacctgaccttccggctggccagcggcctggtgatctggcagcccatgtgggagcaccggcagcccggggtgtctggcttcaccgccctggtgaagcccatccggaacatcatcacagccaagaggagcagccccatcaacagccagagcaggacctgtgagagccccaaccaggatgcccggcacctggagggcctgcaggtggtgtgtgagaccttccagagcgacagcatcagccccaaggccaccatcagcggctgccaccggggcaacagctttgatggcagcctgagcagccagaccagccaggagcggggccccagccacagccgggccagcctggtgattcctccctgccagaggagccgctatgccacctactttgatgtggccgtgctgcgctgcctgctgcagccccactggagcgaggagggcacccagtggagcctgatgtactacctgcagaggctgcggcacatgctggaggagaagccagagaagcccccagagccagacatccccctgctgccccggcccaggagcagctccatggtggccgccgcccccagcctggtgaacacccacaagacccaggacctgaccatgaagtgcaatgaggaggagaagagcctgagcagcgaggccttcagcaaggtgtccctgaccaacctgcggcgctctgctgtgcctgacctgagcagtgacctgggcatgaacatcttcaagaagttcaagagcaggaaagaagatcgggagaggaagggcagcatccccttccaccacacaggcaagagaagacccaggaggatgggcgtgcccttcctgctgcacgaggaccacctggatgtgagccccaccaggagcaccttctcctttggcagcttcagcggcctgggggaggaccggcggggcattgaaaaaggaggctggcagaccaccatcctgggcaagctgacccggcggggcagcagtgatgctgccacagagatggagagcctgagcgcccggcacagccacagccaccacaccctggtgtctgacctgcctgaccccagcaacagccatggagaaaatacagtgaaggaggtgcgcagccagatcagcaccatcaccgtggccaccttcaacaccaccctggccagcttcaacgtgggctatgctgacttcttcaatgagcacatgaggaagctgtgcaaccaggtgcccatccctgagatgcctcatgagcccctggcctgtgccaacctgcccaggagcctgacagacagctgcatcaactacagctacctggaggacacagagcacattgatggcaccaacaactttgtgcacaagaatggcatgctggacctgtctgtggtgctgaaggctgtgtacctggtgctgaaccacgacatcagcagccgcatctgtgatgtggccctgaacatcgtggagtgcctgctgcagctgggcgtggtgccctgtgtggagaagaacaggaagaagtctgagaacaaggaaaatgagaccctggagaagaggcccagcgagggcgccttccagttcaagggcgtgtctggcagcagcacctgtggctttggaggccctgctgtgtctggagctggagatggcggcggggaggagggcggcggcggagatggcggcggcggcggcggagatggcggcggcggcggcggcggcggcggcggcccctatgagaagaatgacaagaaccaggagaaggatgagagcacccctgtgagcaaccaccggctggccctgaccatgctgatcaagatcgtgaagagcctgggctgtgcctacggctgtggggagggccaccggggcctgagcggggaccggctgcggcaccaggtgttcagagaaaatgcccagaactgcctgaccaagctgtacaagctggacaagatgcagttccggcagaccatgagggactatgtgaacaaggacagcctgaacaacgtggtggacttcctgcacgccctgctgggcttctgcatggagcctgtgacagacaacaaggccggcttcggcaacaacttcaccaccgtggacaacaagagcacagcccagaatgtggagggcatcatcgtgtctgccatgttcaagagcctcatcacccgctgtgccagcaccacccatgagctgcacagccctgagaacctgggcctgtactgtgacatccggcagctggtgcagttcatcaaggaggcccacggcaatgtgttcagaagagtggccctgagcgccctgctggacagcgctgagaagctggcccctgggaagaaggtggaggagaatgagcaggagagcaagccagctggcagcaagaggtctgaggccggcagcatcgtggacaagggccaggtgtcctctgccccagaagaatgtcgctccttcatgagcggccggcccagccagaccccagagcatgatgagcagatgcagggcgccaacctgggcaggaaggacttctggaggaagatgttcaagagccagagcgctgccagtgacaccagcagccagagcgagcaggacaccagcgagtgcaccacagcccacagcggcaccaccagtgaccggcgggcccggagccgcagccgccgcatcagcctgaggaagaagctgaagctgcccatcggcaagaggaactggctgaagaggagcagcctgagcggcctggctgatggagtggaggacctgctggacatcagctctgtggaccggctgtccttcatccggcagagcagcaaggtgaagttcaccagcgctgtgaagctgtctgagggcggccctggcagcggcatggagaatggaagagatgaggaggagaacttcttcaagaggctgggctgccacagctttgatgaccacctgagccccaaccaggacggcggcaagagcaagaatgtggtgaacctgggcgccatccggcagggcatgaagcgcttccagttcctgctgaactgctgtgagcccggcaccatcccagatgccagcatcctggccgccgccctggacctggaggcccctgtggtggcccgggccgccctcttcctggagtgtgccaggtttgtgcaccgctgcaacagaggcaactggccagagtggatgaagggccaccacgtgaacatcaccaagaagggcctgagccggggccgcagccccatcgtgggcaacaagaggaaccagaagctgcagtggaatgctgccaagctgttctaccagtggggagatgccatcggcgtgcggctgaatgagctgtgccacggggagagcgagagccctgccaacctgctgggcctcatctatgatgaggagaccaagaggcggctgaggaaggaggatgaggaggaggacttcctggatgacagcacagtgaaccccagcaaatgtggctgcccctttgccctgaagatggccgcctgccagctgctgctggagatcaccaccttcctgcgggagaccttcagctgcctgccccggcccaggacagagcccctggtggacctggagagctgccgcctgcggctggaccctgagctggacagacacagatatgaaaggaagatcagctttgctggggtgctggatgaaaatgaagacagcaaggacagcctgcacagcagcagccacaccctgaagagtgatgctggggtggaggagaagaaggagggcagcccctggagcgccagcgagcccagcattgagcctgagggcatgagcaatgctggagctgaggagaactaccacaggaacatgtcctggctgcacgtgatgatcctgctgtgcaaccagcagagcttcatctgcacccacgtggactactgccacccccactgctacctgcaccacagccgcagctgtgcccggctggtgcgggccatcaagctgctgtatggagacagcgtggacagcctgcgggagagcagcaacatcagctctgtggccctgcggggcaagaagcagaaggagtgcagcgacaagagctgcctgcggacccccagcctgaagaagagggtgtctgatgccaacctggagggcaagaaggacagcggcatgctgaagtacatccggctgcaggtgatgagcctgagccctgcccccctgagcctgctgatcaaggccgcccccatcctgacagaggagatgtacggggacatccagcctgctgcctgggagctgctgctgtccatggatgagcacatggccggggctgctgctgccatgttcctgctgtgtgctgtgaaggtgcctgaggccgtgtctgacatgctgatgtctgagttccaccaccctgagaccgtgcagaggctgaatgctgtgctgaagttccacaccctgtggaggttccgctaccaggtgtggcccaggatggaggagggcgcccagcagatcttcaagatccccccacccagcatcaacttcaccctgcccagccctgtgctgggcatgcccagcgtgcccatgtttgaccccccctgggtgccccagtgcagcggctctgtgcaggaccccatcaatgaagaccagagcaagagcttcagcgcccgggctgtgagccgcagccaccagagagctgagcacatcctgaagaacctgcagcaggaggaggagaagaagaggctgggccgggaggccagcctcatcacagccatccccatcacccaggaggcctgctatgagcccacctgcacccccaacagcgagcctgaggaggaggtggaggaggtgaccaacctggccagccggcggctgtctgtgagccccagctgcaccagcagcaccagccacaggaactacagcttcagaagaggctctgtgtggagcgtgcgctctgctgtgtctgcagaagatgaggagcacaccacagagcacacccccaaccaccacgtgccccagcccccccaggccgtgtttcctgcctgcatctgtgccgctgtgctgcccatcgtgcacctgatggaggatggagaggtgagagaagatggagtggccgtgtctgctgtggcccagcaggtgctgtggaactgcctgattgaggaccccagcacagtgctgcggcacttcctggagaagctgaccatcagcaaccggcaggatgagctgatgtacatgctgaggaagctgctgctgaacattggagacttccctgcccagaccagccacatcctcttcaactacctggtgggcctcatcatgtactttgtgaggaccccctgtgagtggggcatggatgccatcagcgccaccctgaccttcctgtgggaggtggtgggctacgtggagggcctcttcttcaaggacctgaagcagaccatgaagaaggagcagtgtgaggtgaagctgctggtgacagcctccatgcctggcaccaagaccctggtggtgcacggccagaatgaatgtgacatccccacccagctgcctgtgcatgaggacacccagtttgaggccctgctgaaggagtgcctggagttcttcaacatccctgagagccagagcacccactacttcctgatggacaagcgctggaacctgatccactacaacaagacctacgtgcgggacatctaccccttcagaagatctgtgagcccccagctgaacctggtgcacatgcaccctgagaagggccaggagctgatccagaagcaggtgttcaccaggaagctggaggaggtgggccgggtgctcttcctgatcagcctgacccagaagatccccacagcccacaagcagagccacgtgtccatgctgcaggaggacctgctgcggctgcccagcttccccaggtctgccattgatgctgagttcagcctcttcagtgacccccaggccggcaaggagctgtttggcctggacaccctgcagaagagcctgtggatccagctgctggaggagatgttcctgggcatgcccagcgagttcccctggggagatgagatcatgctgttcctgaatgtgttcaacggggccctgatcctgcaccctgaggacagcgccctgctgcggcagtatgctgccaccgtcatcaacacagctgtgcacttcaaccacctgttcagcctgagcggctaccagtggatcctgcccaccatgctgcaggtgtacagcgactatgagagcaacccccagctgcggcaggccatcgagtttgcctgccaccagttctacatcctgcacaggaagccctttgtgctgcagctgtttgcctctgtggcccccctgctggagttcccagatgctgccaacaacggccccagcaaaggagtgtctgcccagtgcctgtttgacctgctgcagagcctggagggggagaccacagacatcctggacatcctggagctggtgaaggccgagaagcccctgaagagcctggacttctgctatggaaatgaagacctgaccttcagcatcagcgaggccatcaagctgtgtgtgacagtggtggcctatgcccctgagagcttccgcagcctgcagatgctgatggtgctggaggccctggtgccctgctacctgcagaagctgaagaggcagaccagccaggtggagaccgtgcctgctgcccgggaggagattgctgccacagctgccctggccaccagcctgcaggccctgctgtacagcgtggaggtgctgacccggcccatgacagccccccagatgagccgctgtgaccagggccacaagggcaccaccacagccaaccacaccatgagcagcggcgtgaacacccgctaccaggagcagggcgccaagctgcacttcatccgggagaacctgcacctgctggaggagggccagggcatcccccgggaggagctggatgagcgcatcgcccgggaggagttccggcggccccgggagagcctgctgaacatctgcacagagttctacaagcactgcggcccccggctgaagatcctgcagaacctggccggggagcccagggtcatcgccctggagctgctggatgtgaagagccacatgaggctggccgagatcgcccacagcctgctgaagctggccccctatgacacccagaccatggagagccggggcctgcggcgctacatcatggagatgctgcccatcacagactggacagctgaggccgtgcggcctgccctgatcctgatcctgaagaggctggacaggatgttcaacaagatccacaagatgcccaccctgcggcggcaggtggagtgggagcccgccagcaacctgattgaaggagtgtgcctgaccctgcagaggcagcccatcatctccttcctgccccacctgcggagcctcatcaacgtgtgtgtgaacctggtgatgggcgtggtgggccccagctctgtggctgatggcctgcccctgctgcacctgagcccctacctgagcccccccctgcccttcagcacagctgtggtgcggctggtggccctgcagatccaggccctgaaggaggacttccccctgagccacgtgatcagccccttcaccaaccaggagcggcgggagggcatgctgctgaacctgctgatcccctttgtgctgactgtgggcagcggcagcaaggacagcccctggctggagcagcctgaggtgcagctgctgctgcagaccgtcatcaacgtgctgctgcccccacgcatcatcagcaccagccgcagcaagaacttcatgctggagagcagccctgcccactgcagcaccccaggagatgctgggaaggacctgcggcgggagggcctggccgagagcaccagccaggccgcctacctggccctgaaggtgatcctggtgtgctttgagcggcagctgggcagccagtggtactggctgagcctgcaggtgaaggagatggccctgaggaaggtgggcggcctggccctgtgggacttcctggacttcatcgtgaggacccgcatccccatctttgtgctgctgcggcccttcatccagtgcaagctgctggcccagcctgcagaaaatcatgaggagctgagcgcccggcagcacatcgctgaccagctggagcggcgcttcatcccccggcccctgtgcaagagcagcctgattgctgagttcaacagcgagctgaagatcctgaaggaggccgtgcacagcggcagcgcctaccagggcaagaccagcatcagcacagtgggcaccagcaccagcgcctaccgcctgagcctggccaccatgagccgcagcaacacaggaactggaacagtgtgggagcaggacagcgagcccagccagcaggccagccaggacaccctgagcaggacagatgaggaggatgaagaaaatgacagcatctccatgcccagcgtggtgtctgagcaggaggcctacctgctgagcgccatcggcagaagacgcttcagcagccacgtgtcctccatgtctgtgccccaggccgaggtgggcatgctgcccagccagagcgagcccaacgtgctggatgacagccagggcctggccgctgagggcagcctgagccgggtggccagcatccagagcgagcccggccagcagaacctgctggtgcagcagcccctgggcaggaagaggggcctgcggcagctgcggcggcccctgctgagccggcagaagacccagacagagcccaggaaccggcagggcgcccggctgagcaccaccaggaggagcatccagcccaagaccaagcccagcgctgaccagaagaggtctgtgaccttcatcgaggcccagcctgagcctgctgctgcccccacagatgccctgcctgccaccggccagctgcagggctgcagccctgcccccagcaggaagccagaggccatggatgagcctgtgctgaccagcagccctgccatcgtggtggccgacctgcacagcgtgagccccaagcagagcgagaacttccccacagaggagggggagaaggaggaggacacagaggcccagggcgccacagcccacagccccctgagcgcccagctgagtgaccctgatgacttcaccggcctggagaccagcagcctgctgcagcacggggacacagtgctgcacatcagtgaagaaaatggcatggagaaccccctgctgagcagccagttcaccttcacccccacagagctgggcaagacagatgctgtgctggatgagagccacgtgtag

SEQ ID NO: 175491 - DNA, 1401 bp, Artificial Sequence
  Description of Artificial Sequence: Synthetic coding sequence
atggagagccggggcctgcggcgctacatcatggagatgctgcccatcacagactggacagctgaggccgtgcggcctgccctgatcctgatcctgaagaggctggacaggatgttcaacaagatccacaagatgcccaccctgcggcggcaggtggagtgggagcccgccagcaacctgattgaaggagtgtgcctgaccctgcagaggcagcccatcatctccttcctgccccacctgcggagcctcatcaacgtgtgtgtgaacctggtgatgggcgtggtgggccccagctctgtggctgatggcctgcccctgctgcacctgagcccctacctgagcccccccctgcccttcagcacagctgtggtgcggctggtggccctgcagatccaggccctgaaggaggacttccccctgagccacgtgatcagccccttcaccaaccaggagcggcgggagggcatgctgctgaacctgctgatcccctttgtgctgactgtgggcagcggcagcaaggacagcccctggctggagcagcctgaggtgcagctgctgctgcagaccgtcatcaacgtgctgctgcccccacgcatcatcagcaccagccgcagcaagaacttcatgctggagagcagccctgcccactgcagcaccccaggagatgctgggaaggacctgcggcgggagggcctggccgagagcaccagccaggccgcctacctggccctgaaggtgatcctggtgtgctttgagcggcagctgggcagccagtggtactggctgagcctgcaggtgaaggagatggccctgaggaaggtgggcggcctggccctgtgggacttcctggacttcatcgtgaggacccgcatccccatctttgtgctgctgcggcccttcatccagtgcaagctgctggcccagcctgcagaaaatcatgaggagctgagcgcccggcagcacatcgctgaccagctggagcggcgcttcatcccccggcccctgtgcaagagcagcctgattgctgagttcaacagcgagctgaagatcctgaaggaggccgtgcacagcggcagcgcctaccagggcaagaccagcatcagcacagtgggcaccagcaccagcgcctaccgcctgagcctggccaccatgagccgcagcaacacaggaactggaacagtgtgggagcaggacagcgagcccagccagcaggccagccaggacaccctgagcaggacagatgaggaggatgaagaaaatgacagcatctccatgcccagcgtggtgtctgagcaggaggcctacctgctgagcgccatcggcagaagacgcttcagcagccacgtgtcctccatgtctgtgccccaggccgaggtgggcatgctgcccagccagaggtag

SEQ ID NO: 175492 - DNA, 786 bp, Artificial Sequence; identical to SEQ ID NO: 155762
  Description of Artificial Sequence: Synthetic coding sequence

SEQ ID NO: 175493 - DNA, 1248 bp, Artificial Sequence
  Description of Artificial Sequence: Synthetic coding sequence
atggacaggagcctgagaaatgtgctggtggtgtcctttggcttcctgctgctcttcaccgcctacggcggcctgcagagcctgcagagcagcctgtacagcgaggagggcctgggcgtgacagccctgagcaccctgtatggaggcatgctgctgagctccatgttcctgccccccctgctgattgaaaggctgggctgcaagggcaccatcatcctgtccatgtgtggctacgtggccttctctgtgggcaacttctttgcctcctggtacaccctcatccccaccagcatcctgctgggcctgggcgccgcccccctgtggagcgcccagtgcacctacctgaccatcaccggcaacacccatgctgagaaggccggcaagaggggcaaggacatggtgaaccagtacttcggcatcttcttcctgatcttccagagcagcggcgtgtggggcaacctgatcagcagcctggtgtttggccagacccccagccagggcagcggcgtgctggccgtgctgatgattgctgccttcctgcagcccatcagagatgtgcagcgggagagcgagggggagaagaagtctgtgcccttctggagcaccctgctgagcaccttcaagctgtacagagacaagaggctgtgcctgctgatcctgctgcccctgtacagcggcctgcagcagggcttcctgagcagcgagtacaccaggagctatgtgacctgcaccctgggcatccagtttgtgggctacgtgatgatctgcttcagcgccacagatgccctgtgcagcgtgctgtatggcaaggtgtcccagtacacaggccgggctgtgctgtatgtgctgggcgctgtgacccacgtgtcctgcatgattgccctgctgctgtggaggcccagggctgaccacctggccgtgttctttgtgttcagcggcctgtggggcgtggctgatgctgtgtggcagacccagaacaatgccctgtatggagtgctgtttgagaagagcaaggaggccgcctttgccaactaccgcctgtgggaggccctgggctttgtgattgccttcggctacagcatgttcctgtgtgtgcacgtgaagctgtacatcctgctgggcgtgctgagcctgaccatggtggcctacggcctggtggagtgtgtggagagcaagaaccccatccggccccacgcccctggccaggtgaaccaggctgaagatgaggagatccagaccaagatgtag

SEQ ID NO: 175494 - DNA, 435 bp, Artificial Sequence
  Description of Artificial Sequence: Synthetic coding sequence
atggacaggagcctgagaaatgtgctggtggtgtcctttggcttcctgctgctcttcaccgcctacggcggcctgcagagcctgcagagcagcctgtacagcgaggagggcctgggcgtgacagccctgagcaccctgtatggaggcatgctgctgagctccatgttcctgccccccctgctgattgaaaggctgggctgcaagggcaccatcatcctgtccatgtgtggctacgtggccttctctgtgggcaacttctttgcctcctggtacaccctcatccccaccagcatcctgctgggcctgggcgccgcccccctgtggagcgcccagtgcacctacctgaccatcaccggcaacacccatgctgagaaggccggcaagaggggcaaggacatggtgaaccagtacttcggcatcttcttcctgatctag

SEQ ID NO: 175495 - DNA, 1545 bp, Artificial Sequence
  Description of Artificial Sequence: Synthetic coding sequence
atgagccgctggctgtggccctggagcaactgtgtgaaggagcgggtgtgccgctacctgctgcaccactacctgggccacttcttccaggagcacctgagcctggaccagctgagcctggacctgtacaagggctctgtggccctgcgggacatccacctggagatctggagcgtgaatgaggtgctggagagcatggagagccccctggagctggtggagggctttgtgggcagcattgaggtggccgtgccctgggccgccctgctgacagaccactgcaccgtgcgggtgtctggcctgcagctgaccctgcagccccggcggggccctgcccctggagctgctgacagccagagctgggccagctgcatgaccaccagcctgcagctggcccaggagtgcctgagagatggcctgcctgagcccagcgagcccccccagcccctggagggcctggagatgtttgcccagaccatcgagaccgtgctgcggcgcatcaaggtgaccttcctggacacagtggtgcgggtggagcacagccctggagatggagagcggggcgtggccgtggaggtgcgggtgcagaggctggagtactgtgatgaggccgtgcgggaccccagccaggcccctcctgtggatgtgcaccagcccccagccttcctgcacaagctgctgcagctggccggcgtgcggctgcactatgaggagctgcctgcccaggaggagcccccagagccccccctgcagatcggcagctgcagcggctacatggagctgatggtgaagctgaagcagaatgaggccttccctggccccaagctggaggtggccggccagctgggcagcctgcacctgctgctgaccccccggcagctgcagcagctgcaggagctgctgtctgctgtgtccctgacagaccacgagggcctggccgacaagctgaacaagagccggcccctgggcgctgaggacctgtggctgattgagcaggacctgaaccagcagctgcaggccggggctgtggccgagcccctgagcccagaccccctgaccaaccccctgctgaacctggacaacacagacctcttcttctccatggccggcctgaccagctctgtggccagcgccctgtctgagctgagcctgagtgatgtggacctggccagctctgtgcggagtgacatggccagccggcggctgagcgcccaggcccggcccggcctggccctgcagggcatggccaccgtgaaggatgccttccctgcctgccccctgcccatctgctgtgagcggggggccagcctgccctggggcctgagccctggcagcgccctcttcctgcggggggagaggaccctgcccctgccccggcccggccccaccctgctgcccagccccaggacagaggccttcggccccagcgaccccatccccctgagccaggtgtccttctgtgtgtggggcgaggagggcatgatctctgtgtggtttgatgtgctcttcctgagctctgtgtctgcctgggtgtctgtgtgctag

SEQ ID NO: 175496 - DNA, 924 bp, Artificial Sequence
  Description of Artificial Sequence: Synthetic coding sequence
atgggcggcctgacagccagtgatgtgcaccccaccctgggcgtgcagctgttctctgctggcattgctgcctgcctggctgatgtgatcaccttccccctggacacagccaaggtgcggctgcaggtgcagggcgagtgccccaccagcagcgtcatccgctacaagggcgtgctgggcaccatcacagctgtggtgaagacagagggccgcatgaagctgtacagcggcctgcctgctggcctgcagaggcagatcagcagcgccagcctgagaattggcctgtatgacacagtgcaggagttcctgacagctgggaaggagacagcccccagcctgggcagcaagatcctggccggcctgaccactggaggagtggccgtgttcatcggccagcccacagaggtggtgaaggtgcggctgcaggcccagagccacctgcacggcatcaagccccgctacacaggcacctacaatgcctaccgcatcatcgccaccacagagggcctgaccggcctgtggaagggcaccacccccaacctgatgaggagcgtcatcatcaactgcacagagctggtgacctatgacctgatgaaggaggcctttgtgaagaacaacatcctggctgatgatgtgccctgccacctggtgtctgccctgattgctggcttctgtgccacagccatgagcagccctgtggatgtggtgaagacccgcttcatcaacagccccccaggccagtacaagtctgtgcccaactgtgccatgaaggtgttcaccaatgaaggccccacagccttcttcaagggcctggtgcccagcttcctgcggctgggctcctggaatgtcatcatgtttgtgtgctttgagcagctgaagcgggagctgagcaagagccggcagaccatggactgtgccacctag

SEQ ID NO: 175497 - DNA, 930 bp, Artificial Sequence
  Description of Artificial Sequence: Synthetic coding sequence
atggtgggcttcaaggccacagatgtgcccccaacagccaccgtgaagttcctgggcgccggcacagctgcctgcatcgctgacctgatcaccttccccctggacacagccaaggtgcggctgcagatccagggcgagagccagggccctgtgcgggccacagccagcgcccagtacagaggagtgatgggcaccatcctgaccatggtgaggacagagggccccaggagcctgtacaacggcctggtggccggcctgcagaggcagatgagctttgcctctgtgagaattggcctgtatgacagcgtgaagcagttctacaccaagggcagcgagcacgccagcatcggcagccggctgctggccggcagcaccaccggggccctggccgtggccgtggcccagcccacagatgtggtgaaggtgcgcttccaggcccaggcccgggccggcggcggccgccgctaccagagcacagtgaatgcctacaagaccatcgcccgggaggagggcttccggggcctgtggaagggcaccagccccaacgtggccagaaatgccatcgtgaactgtgccgagctggtgacctatgacctgatcaaggatgccctgctgaaggccaacctgatgacagatgacctgccctgccacttcaccagcgccttcggggccggcttctgcaccaccgtgattgccagccctgtggatgtggtgaagacccgctacatgaacagcgccctgggccagtacagcagcgctggccactgtgccctgaccatgctgcagaaggagggcccccgggccttctacaagggcttcatgcccagcttcctgcggctgggctcctggaatgtggtgatgtttgtgacctatgagcagctgaagagggccctgatggccgcctgcaccagccgggaggcccccttctag

SEQ ID NO: 175498 - DNA, 102 bp, Artificial Sequence
  Description of Artificial Sequence: Synthetic coding sequence
atggtgggcttcaaggccacagatgtgcccccaacagccaccgtgaagttcctgggcgccggcacagctgcctgcatcgctgacctgatcaccttcccctag

SEQ ID NO: 175499 - DNA, 939 bp, Artificial Sequence
  Description of Artificial Sequence: Synthetic coding sequence
atggtgggcctgaagcccagtgatgtgccccccaccatggctgtgaagttcctgggcgccggcacagctgcctgctttgctgacctggtgaccttccccctggacacagccaaggtgcggctgcagatccagggcgagaaccaggccgtgcagacagcccggctggtgcagtaccggggcgtgctgggcaccatcctgaccatggtgaggacagagggcccctgcagcccctacaacggcctggtggccggcctgcagaggcagatgagctttgccagcatccgcatcggcctgtatgattctgtgaagcaggtgtacacccccaagggagctgacaacagcagcctgaccacccgcatcctggccggctgcaccaccggggccatggctgtgacctgtgcccagcccacagatgtggtgaaggtgcgcttccaggccagcatccacctgggccccagcagaagtgacaggaagtacagcggcaccatggatgcctaccgcaccatcgcccgggaggagggcgtgcggggcctgtggaagggcaccctgcccaacatcatgagaaatgccatcgtgaactgtgccgaggtggtgacctatgacatcctgaaggagaagctgctggactaccacctgctgacagacaacttcccctgccactttgtgtctgcctttggagctggcttctgtgccaccgtggtggccagccctgtggatgtggtgaagacccgctacatgaacagccccccaggccagtacttcagccccctggactgcatgatcaagatggtggcccaggagggccccacagccttctacaagggcttcacccccagcttcctgcggctgggctcctggaatgtggtgatgtttgtgacctatgagcagctgaagagggccctgatgaaggtgcagatgctgcgggagagccccttctag

SEQ ID NO: 175500 - DNA, 633 bp, Artificial Sequence
  Description of Artificial Sequence: Synthetic coding sequence
atggtgggcctgaagcccagtgatgtgccccccaccatggctgtgaagttcctgggcgccggcacagctgcctgctttgctgacctggtgaccttccccctggacacagccaaggtgcggctgcagatccagggcgagaaccaggccgtgcagacagcccggctggtgcagtaccggggcgtgctgggcaccatcctgaccatggtgaggacagagggcccctgcagcccctacaacggcctggtggccggcctgcagaggcagatgagctttgccagcatccgcatcggcctgtatgattctgtgaagcaggtgtacacccccaagggagctgacaacaacttcccctgccactttgtgtctgcctttggagctggcttctgtgccaccgtggtggccagccctgtggatgtggtgaagacccgctacatgaacagccccccaggccagtacttcagccccctggactgcatgatcaagatggtggcccaggagggccccacagccttctacaagggcttcacccccagcttcctgcggctgggctcctggaatgtggtgatgtttgtgacctatgagcagctgaagagggccctgatgaaggtgcagatgctgcgggagagccccttctag

SEQ ID NO: 175501 - DNA, 828 bp, Artificial Sequence
  Description of Artificial Sequence: Synthetic coding sequence
atggtgggcctgaagcccagtgatgtgccccccaccatggctgtgaagttcctgggcgccggcacagctgcctgctttgctgacctggtgaccttccccctggacacagccaaggtgcggctgcagatccagggcgagaaccaggccgtgcagacagcccggctggtgcagtaccggggcgtgctgggcaccatcctgaccatggtgaggacagagggcccctgcagcccctacaacggcctggtggccggcctgcagaggcagatgagctttgccagcatccgcatcggcctgtatgattctgtgaagcaggtgtacacccccaagggagctgacaacagcagcctgaccacccgcatcctggccggctgcaccaccggggccatggctgtgacctgtgcccagcccacagatgtggtgaaggtgcgcttccaggccagcatccacctgggccccagcagaagtgacaggaagtacagcggcaccatggatgcctaccgcaccatcgcccgggaggagggcgtgcggggcctgtggaagggcaccctgcccaacatcatgagaaatgccatcgtgaactgtgccgaggtggtgacctatgacatcctgaaggagaagctgctggactaccacctgctgacagacaacttcccctgccactttgtgtctgcctttggagctggcttctgtgccaccgtggtggccagccctgtggatgtggtgaagacccgctacatgaacagccccccaggccagtacttcagccccctggactgcatgatcaagatggtggcccaggagggccccacagccttctacaagggctag

SEQ ID NO: 175502 - DNA, 291 bp, Artificial Sequence
  Description of Artificial Sequence: Synthetic coding sequence
atggtgggcctgaagcccagtgatgtgccccccaccatggctgtgaagttcctgggcgccggcacagctgcctgctttgctgacctggtgaccttccccctggacacagccaaggtgcggctgcagatccagggcgagaaccaggccgtgcagacagcccggctggtgcagtaccggggcgtgctgggcaccatcctgaccatggtgaggacagagggcccctgcagcccctacaacggcctggtggccggcctgcagaggcagatgagctttgccagcatccgcatctag

SEQ ID NO: 175503 - DNA, 1026 bp, Artificial Sequence
  Description of Artificial Sequence: Synthetic coding sequence
atgctgctgcggccccggcggcccccacccctggcccccccagccccacccagccctgccagcccagaccctgagcccaggaccccaggagatgcccctggcaccccaccccggcggcctgccagccccagcgccctgggggagctgggcctgcctgtgtccccaggcagcgcccagaggaccccctggagcgcccgggagacagagctgctgctgggcaccctgctgcagcctgctgtgtggagggccctgctgctggaccggcggcaggccctgcccacctaccgccgggtgtctgctgccctggcccagcagcaggtgcggaggaccccagcccagtgcagaagacgctacaagttcctgaaggacaagttccgggaggcccacggccagcccccaggcccctttgatgagcagatcaggaagctgatgggcctgctgggggacaatggaaggaagaggcccaggagaagaagccctggcagcggccggccccagagggcccggcggcctgtgcccaatgcccacgccccagcccccagcgagccagatgccacccccctgcccacagcccgggacagagatgctgaccccacctggaccctgcgcttcagccccagcccccccaagtctgcagatgccagccctgcccctggcagccccccagccccagcccccacagccctggccacctgcatcccagaagatcgggcccctgtgcggggccctggcagccccccacctcctccagccagagaagatcctgacagccccccaggccggcctgaggactgtgcccctcctcctgctgccccacccagcctgaacacagccctgctgcagaccctgggccacctgggggacatcgccaacatcctgggccccctgcgggaccagctgctgaccctgaaccagcacgtggagcagctgcggggggcctttgaccagacagtgtccctggccgtgggcttcatcctgggcagcgctgctgctgagcggggcgtgctgcgggacccctgccagtag

SEQ ID NO: 175504 - DNA, 3357 bp, Artificial Sequence
  Description of Artificial Sequence: Synthetic coding sequence
atgtctgtggaggcctacggccccagcagccagaccctgaccttcctggacacagaggaggccgagctgctgggcgctgacacccagggcagcgagtttgagttcacagacttcaccctgcccagccagacccagaccccacctgggggccctgggggccctgggggcggcggggccggcggccctgggggcgctggggccggggctgctgctggccagctggatgcccaggtgggccctgagggcatcctgcagaatggagctgtggatgacagcgtggccaagaccagccagctgctggccgagctgaactttgaagaagatgaggaggacacctactacaccaaggacctgcccatccacgcctgcagctactgcggcatccatgaccctgcctgtgtggtgtactgcaacaccagcaagaagtggttctgcaatggccggggcaacaccagcggcagccacatcgtgaaccacctggtgcgggccaagtgcaaggaggtgaccctgcacaaggatggccccctgggggagaccgtgctggagtgctacaactgtggctgcagaaatgtgttcctgctgggcttcatcccagccaaggctgacagcgtggtggtgctgctgtgccggcagccctgtgccagccagagcagcctgaaggacatcaactgggacagcagccagtggcagcccctcatccaggaccgctgcttcctgtcctggctggtgaagatccccagcgagcaggagcagctgcgggcccggcagatcacagcccagcagatcaacaagctggaggagctgtggaaggagaaccccagcgccaccctggaggacctggagaagccaggagtggatgaggagccccagcacgtgctgctgcgctatgaagatgcctaccagtaccagaacatcttcggccccctggtgaagctggaggccgactatgacaagaagctgaaggagagccagacccaggacaacatcaccgtgcgctgggacctgggcctgaacaagaagagaattgcctacttcaccctgcccaagacagacagcgacatgaggctgatgcagggagatgagatctgcctgcgctacaagggggacctggcccccctgtggaagggcattggacatgtgatcaaggtgcctgacaactatggagatgaaattgccatcgagctgcggagctctgtgggcgcccctgtggaggtgacccacaacttccaggtggactttgtgtggaagagcaccagctttgacaggatgcagagcgccctgaagacctttgctgtggatgagacctctgtgtctggctacatctaccacaagctgctgggccacgaggtggaggatgtgatcatcaagtgccagctgcccaagcgcttcaccgcccagggcctgcctgacctgaaccacagccaggtgtatgctgtgaagacagtgctgcagaggcccctgagcctcatccagggccccccaggcaccgggaagacagtgaccagcgccaccatcgtgtaccacctggcccggcagggcaatggacctgtgctggtgtgtgcccccagcaacattgctgtggaccagctgacagagaagatccaccagacaggcctgaaggtggtgcggctgtgtgccaagagccgggaggccatcgacagccctgtgtccttcctggccctgcacaaccagatccggaacatggacagcatgcctgagctgcagaagctgcagcagctgaaggatgagaccggggagctgagcagcgcagatgagaagcgctaccgggccctgaagaggacagctgagcgggagctgctgatgaatgctgatgtgatctgctgcacctgtgtgggcgctggggacccccggctggccaagatgcagttccgcagcatcctgattgatgagagcacccaggccacagagcctgagtgcatggtgcctgtggtgctgggcgccaagcagctgatcctggtgggggaccactgccagctgggccctgtggtgatgtgcaagaaggccgccaaggccggcctgagccagagcctgtttgagcggctggtggtgctgggcatccggcccatccggctgcaggtgcagtacaggatgcacccagccctgagcgccttccccagcaacatcttctatgagggcagcctgcagaatggagtgacagctgctgacagagtgaagaagggctttgacttccagtggccccagcctgacaagcccatgttcttctacgtgacccagggccaggaggagatcgccagcagcggcaccagctacctgaacagaacagaggccgccaacgtggagaagatcaccaccaagctgctgaaggccggggccaagccagaccagatcggcatcatcaccccctatgagggccagaggagctacctggtgcagtacatgcagttcagcggcagcctgcacaccaagctgtaccaggaggtggagatcgcctctgtggatgccttccagggccgggagaaggacttcatcatcctgagctgtgtgcgggccaatgagcaccagggcatcggcttcctgaatgacccccggcggctgaatgtggccctgacccgggcccgctatggagtcatcatcgtgggcaaccccaaggccctgagcaagcagcccctgtggaaccacctgctgaactactacaaggagcagaaggtgctggtggagggccccctgaacaacctgcgggagagcctgatgcagttcagcaagcccaggaagctggtgaacaccatcaaccctggggcccgcttcatgaccacagccatgtatgatgcccgggaggccatcatccctggctctgtgtatgacaggagcagccagggccggcccagctccatgtacttccagacccatgaccagatcggcatgatctctgctggccccagccacgtggccgccatgaacatccccatccccttcaacctggtgatgccacccatgcctcctcctggctacttcggccaggccaacggccctgctgctggccggggcacccccaagggcaagacaggccggggcggccggcagaagaacagatttggcctgcccggccccagccagaccaacctgcccaacagccaggccagccaggatgtggccagccagcccttcagccagggcgccctgacccagggctacatctccatgagccagcccagccagatgagccagcccggcctgagccagcctgagctgagccaggacagctacctgggagatgagttcaagagccagattgatgtggccctgagccaggacagcacctaccagggcgagcgggcctaccagcacggcggcgtgacaggcctgagccagtactag

SEQ ID NO: 175505 - DNA, 1740 bp, Artificial Sequence
  Description of Artificial Sequence: Synthetic coding sequence
atgcctgctgagaggaagaagccagcctccatggaggagaaggacagcctgcccaacaacaaggagaaggactgcagcgagaggagaacagtgagcagcaaggagcggcccaaggatgacatcaagctgacagccaagaaggaggtgtccaaggcccctgaggagagcaagaagaaggaggaggaggagaagaagaagcaccaggaggaggagaggaagaagcaggaggagcaggccaagaggcagcaggaggaggaggccgccgcccagatgaaggagaaggaggagagcatccagctgcaccaggaggcctgggagcggcaccacctgaggaaggagctgcggagcaagaaccagaatgccccagacagcaggcctgaggagaacttcttcagccggctggacagcagcctgaagaagaacacagcctttgtgaagaagctgaagaccatcacagagcagcagagggacagcctgagccatgacttcaacggcctgaacctgagcaagtacatcgccgaggccgtggccagcatcgtggaggccaagctgaagatcagtgatgtgaactgtgctgtgcacctgtgcagcctcttccaccagagatatgctgactttgcccccagcctgctgcaggtgtggaagaagcactttgaggccaggaaggaggagaagacccccaacatcaccaagctgaggacagacctgcgcttcatcgccgagctgaccatcgtgggcatcttcacagacaaggagggcctgagcctcatctatgagcagctgaagaacatcatcaatgctgaccgggagagccacacccacgtgtctgtggtgatctccttctgccgccactgtggagatgacattgctggcctggtgcccaggaaggtgaagtctgctgctgagaagttcaacctgtccttccccccatctgagatcatcagccctgagaagcagcagcccttccagaacctgctgaaggagtacttcaccagcctgaccaagcacctgaagagggaccaccgggagctgcagaacacagagcggcagaacagacgcatcctgcacagcaagggggagctgtctgaagatagacacaagcagtatgaggagtttgccatgagctaccagaagctgctggccaacagccagagcctggccgacctgctggatgagaacatgccagacctgccccaggacaagcccaccccagaggagcacggccctggcatcgacatcttcacccctgggaagccaggagaatatgacctggagggcggcatctgggaggatgaagatgccaggaacttctatgagaacctgattgacctgaaggcctttgtgcctgccatcctcttcaaggacaatgagaagagctgccagaacaaggagagcaacaaggatgacaccaaggaggccaaggagagcaaggagaacaaggaggtgagcagcccagatgacctggagctggagctggagaacctggagatcaatgatgacaccctggagctggagggcggagatgaagctgaggacctgaccaagaagctgctggatgagcaggagcaggaggatgaggaggccagcacaggcagccacctgaagctgattgtggatgccttcctgcagcagctgcccaactgtgtgaacagagacctgattgacaaggccgagaaggccttctgcaatggaaacctggcccgggtgaacctgctgctgaggatggctgtgaagaagtag

SEQ ID NO: 175506 - DNA, 3819 bp, Artificial Sequence
  Description of Artificial Sequence: Synthetic coding sequence
atgcctgctgagaggaagaagccagcctccatggaggagaaggacagcctgcccaacaacaaggagaaggactgcagcgagaggagaacagtgagcagcaaggagcggcccaaggatgacatcaagctgacagccaagaaggaggtgtccaaggcccctgaggacaagaagaagaggctggaggatgacaagaggaagaaggaggacaaggagaggaagaagaaggatgaggagaaggtgaaggccgaggaggagagcaagaagaaggaggaggaggagaagaagaagcaccaggaggaggagaggaagaagcaggaggagcaggccaagaggcagcaggaggaggaggccgccgcccagatgaaggagaaggaggagagcatccagctgcaccaggaggcctgggagcggcaccacctgaggaaggagctgcggagcaagaaccagaatgccccagacagcaggcctgaggagaacttcttcagccggctggacagcagcctgaagaagaacacagcctttgtgaagaagctgaagaccatcacagagcagcagagggacagcctgagccatgacttcaacggcctgaacctgagcaagtacatcgccgaggccgtggccagcatcgtggaggccaagctgaagatcagtgatgtgaactgtgctgtgcacctgtgcagcctcttccaccagagatatgctgactttgcccccagcctgctgcaggtgtggaagaagcactttgaggccaggaaggaggagaagacccccaacatcaccaagctgaggacagacctgcgcttcatcgccgagctgaccatcgtgggcatcttcacagacaaggagggcctgagcctcatctatgagcagctgaagaacatcatcaatgctgaccgggagagccacacccacgtgtctgtggtgatctccttctgccgccactgtggagatgacattgctggcctggtgcccaggaaggtgaagtctgctgctgagaagttcaacctgtccttccccccatctgagatcatcagccctgagaagcagcagcccttccagaacctgctgaaggagtacttcaccagcctgaccaagcacctgaagagggaccaccgggagctgcagaacacagagcggcagaacagacgcatcctgcacagcaagggggagctgtctgaagatagacacaagcagtatgaggagtttgccatgagctaccagaagctgctggccaacagccagagcctggccgacctgctggatgagaacatgccagacctgccccaggacaagcccaccccagaggagcacggccctggcatcgacatcttcacccctgggaagccaggagaatatgacctggagggcggcatctgggaggatgaagatgccaggaacttctatgagaacctgattgacctgaaggcctttgtgcctgccatcctcttcaaggacaatgagaagagctgccagaacaaggagagcaacaaggatgacaccaaggaggccaaggagagcaaggagaacaaggaggtgagcagcccagatgacctggagctggagctggagaacctggagatcaatgatgacaccctggagctggagggcggagatgaagctgaggacctgaccaagaagctgctggatgagcaggagcaggaggatgaggaggccagcacaggcagccacctgaagctgattgtggatgccttcctgcagcagctgcccaactgtgtgaacagagacctgattgacaaggccgccatggacttctgcatgaacatgaacaccaaggccaacaggaagaagctggtgcgggccctcttcatcgtgccccggcagaggctggacctgctgcccttctacgcccggctggtggccaccctgcacccctgcatgtctgatgtggccgaggacctgtgcagcatgctgcggggggacttccgcttccacgtgaggaagaaggaccagatcaacatcgagaccaagaacaagacagtgcgcttcatcggggagctgaccaagttcaagatgttcaccaagaatgacaccctgcactgcctgaagatgctgctgagtgacttcagccaccaccacatcgagatggcctgcaccctgctggagacctgtggccgcttcctgttccgcagccctgagagccacctgcggacctctgtgctgctggagcagatgatgaggaagaagcaggccatgcacctggatgcccgctacgtgaccatggtggagaatgcctactactactgcaaccccccacctgctgagaagacagtgaagaagaagaggcctcccctgcaggagtatgtgaggaagctgctgtacaaggacctgagcaaggtgaccacagagaaggtgctgcggcagatgaggaagctgccctggcaggaccaggaggtgaaggactatgtgatctgctgcatgatcaacatctggaatgtgaagtacaacagcatccactgtgtggccaacctgctggccggcctggtgctgtaccaggaggatgtgggcatccacgtggtggatggagtgctggaggacatccggctgggcatggaggtgaaccagcccaagttcaaccagaggcgcatcagcagcgccaagttcctgggggagctgtacaactacaggatggtggagagcgctgtgatcttccgcaccctgtacagcttcaccagctttggagtgaacccagatggcagccccagcagcctggaccccccagagcacctgttccgcatccggctggtgtgcaccatcctggacacctgtggccagtactttgaccggggcagcagcaagaggaagctggactgcttcctggtgtacttccagcgctacgtgtggtggaagaagagcctggaggtgtggaccaaggaccaccccttccccatcgacatcgactacatgatcagtgacaccctggagctgctgcggcccaagatcaagctgtgcaacagcctggaggagagcatccggcaggtgcaggacctggagcgggagttcctgatcaagctgggcctggtgaatgacaaggacagcaaggacagcatgacagaaggagagaacctggaggaggatgaggaggaggaggagggcggcgctgagacagaggagcagagcggaaatgaaagtgaggtgaatgaacctgaggaggaggagggcagtgacaatgatgatgatgaaggagaggaggaggaggaggagaacacagactacctgacagacagcaacaaggaaaatgaaacagatgaagaaaatacagaggtgatgatcaagggcggcggcctgaagcacgtgccctgtgtggaggatgaggacttcatccaggccctggacaagatgatgctggagaacctgcagcagaggtctggagagagcgtgaaggtgcaccagctggatgtggccatccccctgcacctgaagagccagctgaggaagggcccccccctgggcggcggggagggggaggccgagagcgctgacaccatgccctttgtgatgctgaccaggaaaggaaacaagcagcagttcaagatcctgaatgtgcccatgagcagccagctggccgccaaccactggaaccagcagcaggccgagcaggaggagaggatgaggatgaagaagctgaccctggacatcaatgaaaggcaggagcaggaggactaccaggagatgctgcagagcctggcccagaggcctgccccagccaacaccaaccgggagcggcggccccgctaccagcaccccaagggggccccaaatgctgacctgatcttcaagacaggaggaagaagaagatag

SEQ ID NO: 175507 - DNA, 3819 bp, Artificial Sequence; identical to SEQ ID NO: 175506
  Description of Artificial Sequence: Synthetic coding sequence

SEQ ID NO: 175508 - DNA, 375 bp, Artificial Sequence
  Description of Artificial Sequence: Synthetic coding sequence
atgatcaagggcggcggcctgaagcacgtgccctgtgtggaggatgaggacttcatccaggccctggacaagatgatgctggagaacctgcagcagaggtctggagagagcgtgaaggtgcaccagctggatgtggccatccccctgcacctgaagagccagctgaggaaaggaccacccctgggcggcggggagggggaggccgagagcgctgacaccatgccctttgtgatgctgaccaggaagggcaacaagcagcagttcaagatcctgaatgtgcccatgagcagccagctggccgccaaccactggaaccagcagcaggccgagaggagagaagatgaaaatgagaaggcccacacccgctaccagtag

SEQ ID NO: 175509 - DNA, 1740 bp, Artificial Sequence; identical to SEQ ID NO: 175505
  Description of Artificial Sequence: Synthetic coding sequence

SEQ ID NO: 175510 - DNA, 3819 bp, Artificial Sequence; identical to SEQ ID NO: 175506
  Description of Artificial Sequence: Synthetic coding sequence

SEQ ID NO: 175511 - DNA, 1332 bp, Artificial Sequence
  Description of Artificial Sequence: Synthetic coding sequence
atgaggtctgagaaggagggcgctgggggcctgcgggctgctgtggccgcccggggccccagcggccgggagaagctgagcgccctggaggtgcagttccaccgggacagccagcagcaggaggccgagaccccacccaccagcagcagcggctgcggcggcggggccggcaagccccgggaggagaagaggacagccctgagcaaggtggtgatccggcggctgcccccaggcctgaccaaggagcagctggaggagcagctgcggcccctgcctgcccatgactactttgagttctttgctgctgacctgagcctgtacccccacctgtacagccgggcctacatcaacttcagaaatccagatgacatcctgctcttccgggacagatttgatggctacatcttcctggacagcaaggaccctgagtacaagaagttcctggagacctactgtgtggaggaggagaagaccagcgccaaccctgagaccctgctgggggagatggaggccaagacccgggagctgattgcccggaggaccacccccctgctggagtacatcaagaacaggaagctggagaagcagaggatccgggaggagaagcgggaggagaggagaagaagagagctggagaagaagaggctgcgggaggaggagaagagaagaagaagagaggaggagcgctgcaagaagaaggagacagacaagcagaagaagattgctgagaaggaggtgcgcatcaagctgctgaagaagccagagaagggggaggagcccaccacagagaagcccaaggagcggggggaggagattgacaccggcggcggcaagcaggagagctgtgcccctggagctgtggtgaaggcccggcccatggagggcagcctggaggagccccaggagaccagccacagcggcagtgacaaggagcacagagatgtggagaggagccaggagcaggagagcgaggcccagcgctaccacgtggatgatggccgccgccaccgggcccaccacgagcctgagcggctgagcagaagaagtgaagatgagcagcgctggggcaaaggacctggccaggaccggggcaagaagggcagccaggacagcggggcccctggagaggccatggagcggctgggccgggcccagagatgtgatgacagccctgcccccaggaaggagcggctggccaacaaggacaggcctgccctgcagctgtatgaccccggggcccgcttccgggccagagaatgtggcggcaacagacgcatctgcaaggccgagggcagcggcaccggccctgagaagcgggaggaggccgagtag

SEQ ID NO: 175512 - DNA, 1431 bp, Artificial Sequence
  Description of Artificial Sequence: Synthetic coding sequence
atgaggtctgagaaggagggcgctgggggcctgcgggctgctgtggccgcccggggccccagcggccgggagaagctgagcgccctggaggtgcagttccaccgggacagccagcagcaggaggccgagaccccacccaccagcagcagcggctgcggcggcggggccggcaagccccgggaggagaagaggacagccctgagcaaggtggtgatccggcggctgcccccaggcctgaccaaggagcagctggaggagcagctgcggcccctgcctgcccatgactactttgagttctttgctgctgacctgagcctgtacccccacctgtacagccgggcctacatcaacttcagaaatccagatgacatcctgctcttccgggacagatttgatggctacatcttcctggacagcaagggcctggagtacccagctgtggtggagtttgcccccttccagaagatcgccaagaagaagctgaggaagaaggatgccaagacaggcagcattgaagatgatcctgagtacaagaagttcctggagacctactgtgtggaggaggagaagaccagcgccaaccctgagaccctgctgggggagatggaggccaagacccgggagctgattgcccggaggaccacccccctgctggagtacatcaagaacaggaagctggagaagcagaggatccgggaggagaagcgggaggagaggagaagaagagagctggagaagaagaggctgcgggaggaggagaagagaagaagaagagaggaggagcgctgcaagaagaaggagacagacaagcagaagaagattgctgagaaggaggtgcgcatcaagctgctgaagaagccagagaagggggaggagcccaccacagagaagcccaaggagcggggggaggagattgacacaggaggcggcaagcaggagagctgtgcccctggagctgtggtgaaggcccggcccatggagggcagcctggaggagccccaggagaccagccacagcggcagtgacaaggagcacagagatgtggagaggagccaggagcaggagagcgaggcccagcgctaccacgtggatgatggaagaagacaccgggcccaccacgagcctgagcggctgagccgccgctcagaagatgagcagcgctggggcaagggccctggccaggaccggggcaagaagggcagccaggacagcggggcccctggagaggccatggagcggctgggccgggcccagagatgtgatgacagccctgcccccaggaaggagcggctggccaacaaggacaggcctgccctgcagctgtatgaccccggggcccgcttccgggcccgggagtgtggcggcaacagacgcatctgcaaggccgagggcagcggcactggacctgagaagcgggaggaggccgagtag

SEQ ID NO: 175513 - DNA, 627 bp, Artificial Sequence
  Description of Artificial Sequence: Synthetic coding sequence
atggaggccaagacccgggagctgattgcccggaggaccacccccctgctggagtacatcaagaacaggaagctggagaagcagaggatccgggaggagaagcgggaggagaggagaagaagagagctggagaagaagaggctgcgggaggaggagaagagaagaagaagagaggaggagcgctgcaagaagaaggagacagacaagcagaagaagattgctgagaaggaggtgcgcatcaagctgctgaagaagccagagaagggggaggagcccaccacagagaagcccaaggagcggggggaggagattgacaccggcggcggcaagcaggagagctgtgcccctggagctgtggtgaaggcccggcccatggagggcagcctggaggagccccaggagaccagccacagcggcagtgacaaggagcacagagatgtggagaggagccaggagcaggagagcgaggcccccaggaaggagcggctggccaacaaggacaggcctgccctgcagctgtatgaccccggggcccgcttccgggcccgggagtgtggcggcaacagacgcatctgcaaggccgagggcagcggcactggacctgagaagcgggaggaggccgagtag

SEQ ID NO: 175514 - DNA, 1452 bp, Artificial Sequence
  Description of Artificial Sequence: Synthetic coding sequence
atgaaggaggagaaggagcaccggcccaaggagaagagggtgaccctgctgaccccagctggggccactggaagtggcggcggcaccagcggggacagcagcaaaggagaggacaagcaggacaggaacaaggagaagaaggaggccctgagcaaggtggtgatccggcggctgccccccaccctgaccaaggagcagctgcaggagcacctgcagcccatgcctgagcatgactactttgagttcttcagcaatgacaccagcctgtacccccacatgtatgcccgggcctacatcaacttcaagaaccaggaggacatcatcctcttccgggacagatttgatggctacgtgttcctggacaacaagggccaggagtacccagccatcgtggagtttgcccccttccagaaggccgccaagaagaagaccaagaagagggacaccaaggtgggcaccattgatgatgatcctgagtacaggaagttcctggagagctatgccacagacaatgagaagatgaccagcaccccagagaccctgctggaggagattgaggccaagaaccgggagctgattgccaagaagaccacccccctgctgtccttcctgaagaacaagcagaggatgagggaggagaagcgggaggagaggagaagaagagaaattgaaaggaagaggcagcgggaggaggagaggaggaagtggaaggaggaggagaagaggaagaggaaggacatcgagaagctgaagaagattgaccgcatccctgagcgggacaagctgaaggatgagcccaagatcaaggtgcaccgcttcctgctgcaggccgtgaaccagaagaacctgctgaagaagccagagaagggagatgagaaggagctggacaagcgggagaaggccaagaagctggacaaggagaacctgagtgatgagcgggccagcggccagagctgcaccctgcccaagagaagtgacagcgagctgaaggatgagaagcccaagaggccagaagatgaaagtggccgggactaccgggagcgggagcgggagtatgaaagagaccaggagcgcatcctgcgggagcgggagcggctgaagaggcaggaggaggagcggcggcggcagaaggagagatatgagaaggagaagaccttcaagaggaaggaggaggagatgaagaaggagaaggacaccctgcgggacaagggcaagaaggccgagagcacagagagcatcggcagcagcgagaagacagagaagaaggaggaggtggtgaagagggaccgcatccggaacaaggacaggcctgccatgcagctgtaccagcccggggcccggagcaggaaccggctgtgccccccagatgacagcaccaagagcggggacagcgctgctgagaggaagcaggagagcggcatcagccacaggaaggagggcggggaggagtag

SEQ ID NO: 175515 - DNA, 1413 bp, Artificial Sequence
  Description of Artificial Sequence: Synthetic coding sequence
atgaaggaggagaaggagcaccggcccaaggagaagagggtgaccctgctgaccccagctggggccactggaagtggcggcggcaccagcggggacagcagcaaaggagaggacaagcaggacaggaacaaggagaagaaggaggccctgagcaaggtggtgatccggcggctgccccccaccctgaccaaggagcagctgcaggagcacctgcagcccatgcctgagcatgactactttgagttcttcagcaatgacaccagcctgtacccccacatgtatgcccgggcctacatcaacttcaagaaccaggaggacatcatcctcttccgggacagatttgatggctacgtgttcctggacaacaagggccaggagtacccagccatcgtggagtttgcccccttccagaaggccgccaagaagaagaccaagaagagggacaccaaggtgggcaccattgatgatgatcctgagtacaggaagttcctggagagctatgccacagacaatgagaagatgaccagcaccccagagaccctgctggaggagattgaggccaagaaccgggagctgattgccaagaagaccacccccctgctgtccttcctgaagaacaagcagaggatgagggaggagaagcgggaggagaggagaagaagagaaattgaaaggaagaggcagcgggaggaggagaggaggaagtggaaggaggaggagaagaggaagaggaaggacatcgagaagctgaagaagattgaccgcatccctgagcgggacaagctgaaggatgagcccaagatcaagctgctgaagaagccagagaagggagatgagaaggagctggacaagcgggagaaggccaagaagctggacaaggagaacctgagtgatgagcgggccagcggccagagctgcaccctgcccaagagaagtgacagcgagctgaaggatgagaagcccaagaggccagaagatgagagcggccgggactaccgggagcgggagcgggagtatgagcgggaccaggagcgcatcctgcgggagcgggagcggctgaagaggcaggaggaggagcggcggcggcagaaggagagatatgagaaggagaagaccttcaagaggaaggaggaggagatgaagaaggagaaggacaccctgcgggacaagggcaagaaggccgagagcacagagagcatcggcagcagcgagaagacagagaagaaggaggaggtggtgaagagggaccgcatccggaacaaggacaggcctgccatgcagctgtaccagcccggggcccggagcaggaaccggctgtgccccccagatgacagcaccaagagcggggacagcgctgctgagaggaagcaggagagcggcatcagccacaggaaggagggcggggaggagtag

SEQ ID NO: 175516 - DNA, 657 bp, Artificial Sequence
  Description of Artificial Sequence: Synthetic coding sequence
atgaaggaggagaaggagcaccggcccaaggagaagagggtgaccctgctgaccccagctggggccactggaagtggcggcggcaccagcggggacagcagcaaaggagaggacaagcaggacaggaacaaggagaagaaggaggccctgagcaaggtggtgatccggcggctgccccccaccctgaccaaggagcagctgcaggagcacctgcagcccatgcctgagcatgactactttgagttcttcagcaatgacaccagcctgtacccccacatgtatgcccgggcctacatcaacttcaagaaccaggaggacatcatcctcttccgggacagatttgatggctacgtgttcctggacaacaagggccaggagtacccagccatcgtggagtttgcccccttccagaaggccgccaagaagaagaccaagaagagggacaccaaggtgggcaccattgatgatgatcctgagtacaggaagttcctggagagctatgccacagacaatgagaagatgaccagcaccccagagaccctgctggaggagattgaggccaagaaccgggagctgattgccaagaagaccacccccctgctgtccttcctgaagaacaagcagaggatgagggaggagaagcgggaggacttctag

SEQ ID NO: 175517 - DNA, 441 bp, Artificial Sequence
  Description of Artificial Sequence: Synthetic coding sequence
atgatgtggcagaagtatgccggcagccgccgctccatgcccctgggcgcccgcatcctcttccacggcgtcttctacgccggcggctttgccatcgtgtactacctgatccagaagttccacagccgggccctgtactacaagctggccgtggagcagctgcagagccaccctgaggcccaggaggccctgggcccccccctgaacatccactacctgaagctgattgacagagaaaattttgtggacatcgtggatgccaagctgaagatccctgtgtctggcagcaagtctgagggcctgctgtatgtgcacagcagcagaggaggccccttccagcgctggcacctggatgaggtgttcctggagctgaaggatggccagcagatccctgtgttcaagctgagcggggagaatggagatgaggtgaagaaggagtag

SEQ ID NO: 175518 - DNA, 2667 bp, Artificial Sequence
  Description of Artificial Sequence: Synthetic coding sequence
atggagggagatgactgtgagttccgctatggagatggcaccaatgaggcccaggacaatgacttccccaccgtggagaggagccggctgcaggagatgctgagcctgctgggcctggagacctaccaggtgcagaagctgagcctgcaggacagcctgcagatcagctttgacagcatgaagaactgggccccccaggtgcccaaggacctgccctggaacttcctgaggaagctgcaggccctgaatgctgatgccaggaacaccaccatggtgctggatgtgctgcctgatgcccggcctgtggagaaggagagccagatggaggaggagatcatctactgggaccctgcagatgacctggccgctgacatctacagcttcagcgagctgcccaccccagacacccctgtgaaccccctggacctgctgtgtgccctgctgctgagcagtgacagcttcctgcagcaggagatcgccctgaagatggccctgtgccagtttgccctgcccctggtgctgcctgattctgagaaccactaccacaccttcctgctgtgggccatgaggggcatcgtgaggacctggtggagccagcccccccggggcatgggcagcttcagagaagattctgtggtgctgagccgggccccagcctttgcctttgtgaggatggatgtgagcagcaacagcaagagccagctgctgaatgctgtgctgagccctggccaccggcagtgggactgcttctggcaccgggacctgaacctgggcaccaatgcccgggagatcagtgatggcctggtggagatctcctggttcttccccagcggccgggaggacctggacatcttccctgagcctgtggccttcctgaacctgcggggggacatcggcagccactggctgcagttcaagctgctgacagagatcagcagcgctgtgttcatcctgacagacaacatcagcaagaaggagtacaagctgctgtacagcatgaaggagagcaccaccaagtactacttcatcctgagcccctaccggggcaagaggaacaccaacctgcgcttcctgaacaagctgatccctgtgctgaagattgaccacagccacgtgctggtgaaggtgagcagcacagacagcgacagctttgtgaagaggatccgggccatcgtgggcaatgtgctgcgggccccctgcagaagagtgtctgtggaggacatggcccatgctgccaggaagctgggcctgaaggtggatgaggactgtgaggagtgccagaaggccaaggacaggatggagcgcatcaccaggaagatcaaggacagtgatgcctacagaagagatgagctgcggctgcagggcgacccctggaggaaggccgcccaggtggagaaggagttctgccagctgcagtgggccgtggaccccccagagaagcacagagctgagctgcggcggcggctgctggagctgaggatgcagcagaatggacatgaccccagcagtggagtgcaggagttcatcagcggcatcagcagccccagcctgtctgagaagcagtacttcctgcgctggatggagtggggcctggcccgggtggcccagccccggctgcggcagcccccagagaccctgctgaccctgcggcccaagcatggaggcaccacagatgtgggggagcccctgtggccagagcccctgggcgtggagcacttcctgcgggagatgggccagttctatgaagctgagagctgcctggtggaggccggccgcctgcctgctggccagaggagatttgcccacttccctggcctggccagcgagctgctgctgaccggcctgcccctggagctgattgatggcagcaccctgtccatgcctgtgcgctgggtgacaggcctgctgaaggagctgcacgtgcggctggagaggaggagccggctggtggtgctgagcacagtgggcgtgcccggcaccgggaagagcaccctgctgaacaccatgtttggcctgcgctttgccaccgggaagagctgtggccccaggggggccttcatgcagctgatcaccgtggccgagggcttcagccaggacctgggctgtgaccacatcctggtgattgacagcggcggcctcatcggcggggccctgaccagcgctggggacagatttgagctggaggccagcctggccaccctgctgatgggcctgagcaatgtgaccgtcatcagcctggccgagaccaaggacatcccagctgccatcctgcacgccttcctgcggctggagaagacaggccacatgcccaactaccagtttgtgtaccagaacctgcatgatgtgtctgtgcccggcccccggccccgggacaagaggcagctgctggaccccccaggggacctgagcagagctgctgcccagatggagaagcagggagatggcttccgggccctggccggcctggccttctgtgaccctgagaagcagcacatctggcacatccctggcctgtggcacggggccccacccatggctgctgtgtccctggcctacagcgaggccatctttgagctgaagcgctgcctgctggagaacatcagaaatggcctgagcaaccagaacaagaacatccagcagctgattgagctggtgcggcggctgtag

SEQ ID NO: 175519 - DNA, 2769 bp, Artificial Sequence
  Description of Artificial Sequence: Synthetic coding sequence
atggccagccctggccacagcgacctgggggaggtggcccctgagatcaaggccagcgagaggagaacagctgtggccatcgctgacctggagtggagggagatggagggagatgactgtgagttccgctatggagatggcaccaatgaggcccaggacaatgacttccccaccgtggagaggagccggctgcaggagatgctgagcctgctgggcctggagacctaccaggtgcagaagctgagcctgcaggacagcctgcagatcagctttgacagcatgaagaactgggccccccaggtgcccaaggacctgccctggaacttcctgaggaagctgcaggccctgaatgctgatgccaggaacaccaccatggtgctggatgtgctgcctgatgcccggcctgtggagaaggagagccagatggaggaggagatcatctactgggaccctgcagatgacctggccgctgacatctacagcttcagcgagctgcccaccccagacacccctgtgaaccccctggacctgctgtgtgccctgctgctgagcagtgacagcttcctgcagcaggagatcgccctgaagatggccctgtgccagtttgccctgcccctggtgctgcctgattctgagaaccactaccacaccttcctgctgtgggccatgaggggcatcgtgaggacctggtggagccagcccccccggggcatgggcagcttcagagaagattctgtggtgctgagccgggccccagcctttgcctttgtgaggatggatgtgagcagcaacagcaagagccagctgctgaatgctgtgctgagccctggccaccggcagtgggactgcttctggcaccgggacctgaacctgggcaccaatgcccgggagatcagtgatggcctggtggagatctcctggttcttccccagcggccgggaggacctggacatcttccctgagcctgtggccttcctgaacctgcggggggacatcggcagccactggctgcagttcaagctgctgacagagatcagcagcgctgtgttcatcctgacagacaacatcagcaagaaggagtacaagctgctgtacagcatgaaggagagcaccaccaagtactacttcatcctgagcccctaccggggcaagaggaacaccaacctgcgcttcctgaacaagctgatccctgtgctgaagattgaccacagccacgtgctggtgaaggtgagcagcacagacagcgacagctttgtgaagaggatccgggccatcgtgggcaatgtgctgcgggccccctgcagaagagtgtctgtggaggacatggcccatgctgccaggaagctgggcctgaaggtggatgaggactgtgaggagtgccagaaggccaaggacaggatggagcgcatcaccaggaagatcaaggacagtgatgcctacagaagagatgagctgcggctgcagggcgacccctggaggaaggccgcccaggtggagaaggagttctgccagctgcagtgggccgtggaccccccagagaagcacagagctgagctgcggcggcggctgctggagctgaggatgcagcagaatggacatgaccccagcagtggagtgcaggagttcatcagcggcatcagcagccccagcctgtctgagaagcagtacttcctgcgctggatggagtggggcctggcccgggtggcccagccccggctgcggcagcccccagagaccctgctgaccctgcggcccaagcatggaggcaccacagatgtgggggagcccctgtggccagagcccctgggcgtggagcacttcctgcgggagatgggccagttctatgaagctgagagctgcctggtggaggccggccgcctgcctgctggccagaggagatttgcccacttccctggcctggccagcgagctgctgctgaccggcctgcccctggagctgattgatggcagcaccctgtccatgcctgtgcgctgggtgacaggcctgctgaaggagctgcacgtgcggctggagaggaggagccggctggtggtgctgagcacagtgggcgtgcccggcaccgggaagagcaccctgctgaacaccatgtttggcctgcgctttgccaccgggaagagctgtggccccaggggggccttcatgcagctgatcaccgtggccgagggcttcagccaggacctgggctgtgaccacatcctggtgattgacagcggcggcctcatcggcggggccctgaccagcgctggggacagatttgagctggaggccagcctggccaccctgctgatgggcctgagcaatgtgaccgtcatcagcctggccgagaccaaggacatcccagctgccatcctgcacgccttcctgcggctggagaagacaggccacatgcccaactaccagtttgtgtaccagaacctgcatgatgtgtctgtgcccggcccccggccccgggacaagaggcagctgctggaccccccaggggacctgagcagagctgctgcccagatggagaagcagggagatggcttccgggccctggccggcctggccttctgtgaccctgagaagcagcacatctggcacatccctggcctgtggcacggggccccacccatggctgctgtgtccctggcctacagcgaggccatctttgagctgaagcgctgcctgctggagaacatcagaaatggcctgagcaaccagaacaagaacatccagcagctgattgagctggtgcggcggctgtag

SEQ ID NO: 175520 - DNA, 492 bp, Artificial Sequence
  Description of Artificial Sequence: Synthetic coding sequence
atggagggagatgactgtgagttccgctatggagatggcaccaatgaggcccaggacaatgacttccccaccgtggagaggagccggctgcaggagatgctgagcctgctgggcctggagacctaccaggtgcagaagctgagcctgcaggacagcctgcagatcagctttgacagcatgaagaactgggccccccaggtgcccaaggacctgccctggaacttcctgaggaagctgcaggccctgaatgctgatgccaggaacaccaccatggtgctggatgtgctgcctgatgcccggcctgtggagaaggagagccagatggaggaggagatcatctactgggaccctgcagatgacctggccgctgacatctacagcttcagcgagctgcccaccccagacacccctgtgaaccccctggacctgctgtgtgccctgctgctgagcagtgacagcttcctgcagcaggagatcgccctgaagatgtag

SEQ ID NO: 175521 - DNA, 2667 bp, Artificial Sequence; identical to SEQ ID NO: 175518
  Description of Artificial Sequence: Synthetic coding sequence

SEQ ID NO: 175522 - DNA, 2667 bp, Artificial Sequence; identical to SEQ ID NO: 175518
  Description of Artificial Sequence: Synthetic coding sequence

SEQ ID NO: 175523 - DNA, 2796 bp, Artificial Sequence
  Description of Artificial Sequence: Synthetic coding sequence
atggccagccctggcatcgaggtggagctgctgggcaagggccacagcgacctgggggaggtggcccctgagatcaaggccagcgagaggagaacagctgtggccatcgctgacctggagtggagggagatggagggagatgactgtgagttccgctatggagatggcaccaatgaggcccaggacaatgacttccccaccgtggagaggagccggctgcaggagatgctgagcctgctgggcctggagacctaccaggtgcagaagctgagcctgcaggacagcctgcagatcagctttgacagcatgaagaactgggccccccaggtgcccaaggacctgccctggaacttcctgaggaagctgcaggccctgaatgctgatgccaggaacaccaccatggtgctggatgtgctgcctgatgcccggcctgtggagaaggagagccagatggaggaggagatcatctactgggaccctgcagatgacctggccgctgacatctacagcttcagcgagctgcccaccccagacacccctgtgaaccccctggacctgctgtgtgccctgctgctgagcagtgacagcttcctgcagcaggagatcgccctgaagatggccctgtgccagtttgccctgcccctggtgctgcctgacagcgagaaccactaccacaccttcctgctgtgggccatgaggggcatcgtgaggacctggtggagccagcccccccggggcatgggcagcttccgggaggacagcgtggtgctgagccgggccccagcctttgcctttgtgaggatggatgtgagcagcaacagcaagagccagctgctgaatgctgtgctgagccctggccaccggcagtgggactgcttctggcaccgggacctgaacctgggcaccaatgcccgggagatcagtgatggcctggtggagatctcctggttcttccccagcggccgggaggacctggacatcttccctgagcctgtggccttcctgaacctgcggggggacatcggcagccactggctgcagttcaagctgctgacagagatcagcagcgctgtgttcatcctgacagacaacatcagcaagaaggagtacaagctgctgtacagcatgaaggagagcaccaccaagtactacttcatcctgagcccctaccggggcaagaggaacaccaacctgcgcttcctgaacaagctgatccctgtgctgaagattgaccacagccacgtgctggtgaaggtgagcagcacagacagcgacagctttgtgaagaggatccgggccatcgtgggcaatgtgctgcgggccccctgccggcgggtgtctgtggaggacatggcccacgccgccaggaagctgggcctgaaggtggatgaggactgtgaggagtgccagaaggccaaggacaggatggagcgcatcaccaggaagatcaaggacagtgatgcctacagaagagatgagctgcggctgcagggcgacccctggaggaaggccgcccaggtggagaaggagttctgccagctgcagtgggccgtggaccccccagagaagcacagagctgagctgcggcggcggctgctggagctgaggatgcagcagaatggacatgaccccagcagcggcgtgcaggagttcatcagcggcatcagcagccccagcctgtctgagaagcagtacttcctgcgctggatggagtggggcctggcccgggtggcccagccccggctgcggcagcccccagagaccctgctgaccctgcggcccaagcacggcggcaccacagatgtgggggagcccctgtggccagagcccctgggcgtggagcacttcctgcgggagatgggccagttctatgaggccgagagctgcctggtggaggccggccgcctgcctgctggccagaggagatttgcccacttccctggcctggccagcgagctgctgctgaccggcctgcccctggagctgattgatggcagcaccctgtccatgcctgtgcgctgggtgacaggcctgctgaaggagctgcacgtgcggctggagcggcgcagccggctggtggtgctgagcacagtgggcgtgcccggcaccgggaagagcaccctgctgaacaccatgtttggcctgcgctttgccaccgggaagagctgtggccccaggggggccttcatgcagctgatcaccgtggccgagggcttcagccaggacctgggctgtgaccacatcctggtgattgattctgggggcctgattggaggagccctgaccagcgctggggacagatttgagctggaggccagcctggccaccctgctgatgggcctgagcaatgtgaccgtcatcagcctggccgagaccaaggacatcccagctgccatcctgcacgccttcctgcggctggagaagacaggccacatgcccaactaccagtttgtgtaccagaacctgcatgatgtgtctgtgcccggcccccggccccgggacaagaggcagctgctggaccccccaggggacctgagcagagctgctgcccagatggagaagcagggagatggcttccgggccctggccggcctggccttctgtgaccctgagaagcagcacatctggcacatccctggcctgtggcatggagccccacccatggctgctgtgtccctggcctacagcgaggccatctttgagctgaagcgctgcctgctggagaacatcagaaatggcctgagcaaccagaacaagaacatccagcagctgattgagctggtgcggcggctgtag

SEQ ID NO: 175524 - DNA, 369 bp, Artificial Sequence
  Description of Artificial Sequence: Synthetic coding sequence
atggagggagatgactgtgagttccgctatggagatggcaccaatgaggcccaggacaatgacttccccaccgtggagaggagccggctgcaggagatgctgagcctgctgggcctggagacctaccaggtgcagaagctgagcctgcaggacagcctgcagatcagctttgacagcatgaagaactgggccccccaggtgcccaaggacctgccctggaacttcctgaggaagctgcaggccctgaatgctgatgccaggaacaccaccatggtgctggatgtgctgcctgatgcccggcctgtggagaaggagagccagatggaggaggagatcatctactgggaccctgcagatgacctggcctag

SEQ ID NO: 175525 - DNA, 1623 bp, Artificial Sequence
  Description of Artificial Sequence: Synthetic coding sequence
atggcctgggtgctgaagatggatgaggtgattgaaagtggcctggtgcatgactttgatgccagcctgagcggcatcggccaggagctgggcgctggggcctacagcatgtctgatgtgctggccctgcccatcttcaagcaggaggacagcagcctgcccctggatggagaaacagagcacccccccttccagtatgtgatgtgtgccgccaccagccctgctgtgaagctgcatgatgagaccctgacctacctgaaccagggccagagctatgagatccgcatgctggacaacaggaagatgggagacatgcctgagatcaatggcaagctggtgaagagcatcatccgggtggtgttccatgaccggcggctgcagtacacagagcaccagcagctggagggctggaagtggaacagacctggggaccggctgctggacctggacatccccatgtctgtgggcatcatcgacaccaggaccaaccccagccagctgaatgctgtggagttcctgtgggaccctgccaagaggaccagcgccttcatccaggtgcactgcatcagcacagagttcacccccaggaagcacggcggggagaagggcgtgcccttccgcatccaggtggacaccttcaagcagaatgaaaatggagagtacacagaccacctgcacagcgccagctgccagatcaaggtgttcaagcccaagggagctgacaggaagcagaagacagaccgggagaagatggagaagaggacagcccacgagaaggagaagtaccagcccagctatgacaccaccatcctgacagagatgaggctggagcccatcattgaagatgctgtggagcacgagcagaagaagagcagcaagaggaccctgcctgctgactatggagacagcctggccaagaggggcagctgcagcccctggccagatgcccccacagcctacgtgaacaacagccccagccctgcccccaccttcaccagcccccagcagagcacctgcagcgtgcctgacagcaacagcagcagccccaaccaccagggagatggagccagccagaccagcggggagcagatccagcccagcgccaccatccaggagacccagcagtggctgctgaagaaccgcttcagcagctacaccaggctcttcagcaacttctctggagctgacctgctgaagctgaccaaggaggacctggtgcagatctgtggggctgctgatggcatccggctgtacaacagcctgaagagccgctctgtgcggccccggctgaccatctacgtgtgccgggagcagcccagcagcacagtgctgcagggccagcagcaggccgccagcagcgcctctgaaaatggaagtggggccccctacgtgtaccacgccatctacctggaggagatgattgccagcgaggtggccaggaagctggccctggtgttcaacatccccctgcaccagatcaaccaggtgtaccggcagggccccaccggcatccacatcctggtgtctgaccagatggtgcagaacttccaggatgagagctgcttcctgttcagcacagtgaaggccgagagcagtgatggcatccacatcatcctgaagtag

SEQ ID NO: 175526 - DNA, 1623 bp, Artificial Sequence; identical to SEQ ID NO: 175525
  Description of Artificial Sequence: Synthetic coding sequence

SEQ ID NO: 175527 - DNA, 1515 bp, Artificial Sequence
  Description of Artificial Sequence: Synthetic coding sequence
atggcctgggtgctgaagatggatgaggtgattgaaagtggcctggtgcatgactttgatgccagcctgagcggcatcggccaggagctgggcgctggggcctacagcatgtctgatgtgctggccctgcccatcttcaagcaggaggacagcagcctgcccctggatggagaaacagagcacccccccttccagtatgtgatgtgtgccgccaccagccctgctgtgaagctgcatgatgagaccctgacctacctgaaccagggccagagctatgagatccgcatgctggacaacaggaagatgggagacatgcctgagatcaatggcaagctggtgaagagcatcatccgggtggtgttccatgaccggcggctgcagtacacagagcaccagcagctggagggctggaagtggaacagacctggggaccggctgctggacctggacatccccatgtctgtgggcatcatcgacaccaggaccaaccccagccagctgaatgctgtggagttcctgtgggaccctgccaagaggaccagcgccttcatccaggtgcactgcatcagcacagagttcacccccaggaagcacggcggggagaagggcgtgcccttccgcatccaggtggacaccttcaagcagaatgaaaatggagagtacacagaccacctgcacagcgccagctgccagatcaaggtgttcaagcccaagggagctgacaggaagcagaagacagaccgggagaagatggagaagaggacagcccacgagaaggagaagtaccagcccagctatgacaccaccatcctgacagaatgtagcccctggccagatgcccccacagcctacgtgaacaacagccccagccctgcccccaccttcaccagcccccagcagagcacctgcagcgtgcctgacagcaacagcagcagccccaaccaccagggagatggagccagccagaccagcggggagcagatccagcccagcgccaccatccaggagacccagcagtggctgctgaagaaccgcttcagcagctacaccaggctcttcagcaacttctctggagctgacctgctgaagctgaccaaggaggacctggtgcagatctgtggggctgctgatggcatccggctgtacaacagcctgaagagccgctctgtgcggccccggctgaccatctacgtgtgccgggagcagcccagcagcacagtgctgcagggccagcagcaggccgccagcagcgcctctgaaaatggaagtggggccccctacgtgtaccacgccatctacctggaggagatgattgccagcgaggtggccaggaagctggccctggtgttcaacatccccctgcaccagatcaaccaggtgtaccggcagggccccaccggcatccacatcctggtgtctgaccagatggtgcagaacttccaggatgagagctgcttcctgttcagcacagtgaaggccgagagcagtgatggcatccacatcatcctgaagtag

SEQ ID NO: 175528 - DNA, 447 bp, Artificial Sequence
  Description of Artificial Sequence: Synthetic coding sequence
atggcctgggtgctgaagatggatgaggtgattgaaagtggcctggtgcatgactttgatgccagcctgagcggcatcggccaggagctgggcgctggggcctacagcatgtctgatgtgctggccctgcccatcttcaagcaggaggacagcagcctgcccctggatggagaaacagagcacccccccttccagtatgtgatgtgtgccgccaccagccctgctgtgaagctgcatgatgagaccctgacctacctgaaccagggccagagctatgagatccgcatgctggacaacaggaagatgggagacatgcctgagatcaatggcaagctggtgaagagcatcatccgggtggtgttccatgaccggcggctgcagtacacagagcaccagcagctggagggctggaagtggaacagacctggggaccggctgctggactag

SEQ ID NO: 175529 - DNA, 2295 bp, Artificial Sequence
  Description of Artificial Sequence: Synthetic coding sequence
atgaatggagaggccgactgccccacagacctggagatggccgcccccaagggccaggaccgctggagccaggaggacatgctgaccctgctggagtgcatgaagaacaacctgcccagcaatgacagcagcaagttcaagaccacagagagccacatggactgggagaaggtggccttcaaggacttcagcggggacatgtgcaagctgaagtgggtggagatcagcaatgaggtgaggaagttccgcaccctgacagagctgatcctggatgcccaggagcacgtgaagaacccctacaagggcaagaagctgaagaagcacccagacttccccaagaagcccctgaccccctacttccgcttcttcatggagaagagggccaagtatgccaagctgcaccctgagatgagcaacctggacctgaccaagatcctgagcaagaagtacaaggagctgcctgagaagaagaagatgaagtacatccaggacttccagcgggagaagcaggagtttgagaggaacctggcccgcttccgggaggaccacccagacctgatccagaatgccaagaagagtgacatccctgagaagcccaagaccccccagcagctgtggtacacccatgagaagaaggtgtacctgaaggtgcggccagatgccaccaccaaggaggtgaaggacagcctgggcaagcagtggagccagctgagtgacaagaagaggctgaagtggatccacaaggccctggagcagaggaaggagtatgaggagatcatgagggactacatccagaagcaccctgagctgaacatcagcgaggagggcatcaccaagagcaccctgaccaaggccgagcggcagctgaaggacaagtttgatggccggcccaccaagcccccacccaacagctacagcctgtactgtgccgagctgatggccaacatgaaggatgtgcccagcacagagaggatggtgctgtgcagccagcagtggaagctgctgagccagaaggagaaggatgcctaccacaagaagtgtgaccagaagaagaaggactatgaggtggagctgctgcgcttcctggagagcctgcctgaggaggagcagcagagggtgctgggggaggagaagatgctgaacatcaacaagaagcaggccaccagccctgccagcaagaagccagcccaggagggcggcaaaggaggcagcgagaagcccaagaggcctgtgtctgccatgttcatcttcagcgaggagaagaggcggcagctgcaggaggagaggcctgagctgtctgagagcgagctgacccggctgctggccaggatgtggaatgacctgtctgagaagaagaaggccaagtacaaggcccgggaggccgccctgaaggcccagagcgagaggaagccaggaggagagcgggaggagcggggcaagctgcctgagagccccaagagagctgaggagatctggcagcagagcgtgattggagactacctggcccgcttcaagaatgacagagtgaaggccctgaaggccatggagatgacctggaacaacatggagaagaaggagaagctgatgtggatcaagaaggctgctgaggaccagaagagatatgagcgggagctgtctgagatgagggcccctcctgctgccaccaacagcagcaagaagatgaagttccagggcgagcccaagaagccacccatgaatggctaccagaagttcagccaggagctgctgagcaatggagagctgaaccacctgcccctgaaggagaggatggtggagatcggcagccgctggcagaggatcagccagagccagaaggagcactacaagaagctggccgaggagcagcagaagcagtacaaggtgcacctggacctgtgggtgaagagcctgagcccccaggacagagctgcctacaaggagtacatcagcaacaagaggaagtccatgaccaagctgcggggccccaaccccaagagcagcaggaccaccctgcagagcaagtctgagagtgaagaagatgatgaagaagatgaagatgatgaagatgaagatgaggaggaggaggatgatgaaaatggagacagcagtgaagatggaggagacagcagcgagagcagcagtgaagatgaaagtgaagatggagatgaaaatgaggaggatgatgaagatgaagatgatgatgaagatgatgatgaagatgaagataatgaaagtgagggcagcagcagcagcagcagcagcagcggggacagcagtgacagcgacagcaactag

SEQ ID NO: 175530 - DNA, 2184 bp, Artificial Sequence
  Description of Artificial Sequence: Synthetic coding sequence
atgaatggagaggccgactgccccacagacctggagatggccgcccccaagggccaggaccgctggagccaggaggacatgctgaccctgctggagtgcatgaagaacaacctgcccagcaatgacagcagcaagttcaagaccacagagagccacatggactgggagaaggtggccttcaaggacttcagcggggacatgtgcaagctgaagtgggtggagatcagcaatgaggtgaggaagttccgcaccctgacagagctgatcctggatgcccaggagcacgtgaagaacccctacaagggcaagaagctgaagaagcacccagacttccccaagaagcccctgaccccctacttccgcttcttcatggagaagagggccaagtatgccaagctgcaccctgagatgagcaacctggacctgaccaagatcctgagcaagaagtacaaggagctgcctgagaagaagaagatgaagtacatccaggacttccagcgggagaagcaggagtttgagaggaacctggcccgcttccgggaggaccacccagacctgatccagaatgccaagaagagtgacatccctgagaagcccaagaccccccagcagctgtggtacacccatgagaagaaggtgtacctgaaggtgcggccagatgagatcatgagggactacatccagaagcaccctgagctgaacatcagcgaggagggcatcaccaagagcaccctgaccaaggccgagcggcagctgaaggacaagtttgatggccggcccaccaagcccccacccaacagctacagcctgtactgtgccgagctgatggccaacatgaaggatgtgcccagcacagagaggatggtgctgtgcagccagcagtggaagctgctgagccagaaggagaaggatgcctaccacaagaagtgtgaccagaagaagaaggactatgaggtggagctgctgcgcttcctggagagcctgcctgaggaggagcagcagagggtgctgggggaggagaagatgctgaacatcaacaagaagcaggccaccagccctgccagcaagaagccagcccaggagggcggcaagggcggcagcgagaagcccaagaggcctgtgtctgccatgttcatcttcagcgaggagaagaggcggcagctgcaggaggagaggcctgagctgtctgagagcgagctgacccggctgctggccaggatgtggaatgacctgtctgagaagaagaaggccaagtacaaggcccgggaggccgccctgaaggcccagagcgagaggaagccaggaggagagcgggaggagcggggcaagctgcctgagagccccaagagagctgaggagatctggcagcagagcgtcatcggggactacctggcccgcttcaagaatgacagagtgaaggccctgaaggccatggagatgacctggaacaacatggagaagaaggagaagctgatgtggatcaagaaggctgctgaggaccagaagagatatgaaagagagctgtctgagatgagggcccccccagctgccaccaacagcagcaagaagatgaagttccagggcgagcccaagaagccacccatgaatggctaccagaagttcagccaggagctgctgagcaatggagagctgaaccacctgcccctgaaggagaggatggtggagatcggcagccgctggcagaggatcagccagagccagaaggagcactacaagaagctggccgaggagcagcagaagcagtacaaggtgcacctggacctgtgggtgaagagcctgagcccccaggaccgggccgcctacaaggagtacatcagcaacaagaggaagtccatgaccaagctgcggggccccaaccccaagagcagcaggaccaccctgcagagcaagtctgagagcgaggaggatgatgaggaggatgaagatgatgaagatgaagatgaggaggaggaggatgatgaaaatggagacagcagtgaagatggaggagacagcagcgagagcagcagtgaagatgaaagtgaagatggagatgaaaatgaagaagatgatgaagatgaagatgatgatgaagatgatgatgaagatgaggacaatgaaagtgagggcagcagcagcagcagcagcagcagcggggacagcagtgacagcgacagcaactag

SEQ ID NO: 175531 - DNA, 2184 bp, Artificial Sequence; identical to SEQ ID NO: 175530
  Description of Artificial Sequence: Synthetic coding sequence

SEQ ID NO: 175532 - DNA, 2295 bp, Artificial Sequence; identical to SEQ ID NO: 175529
  Description of Artificial Sequence: Synthetic coding sequence

SEQ ID NO: 175533 - DNA, 2184 bp, Artificial Sequence; identical to SEQ ID NO: 175530
  Description of Artificial Sequence: Synthetic coding sequence

SEQ ID NO: 175534 - DNA, 2295 bp, Artificial Sequence; identical to SEQ ID NO: 175529
  Description of Artificial Sequence: Synthetic coding sequence

SEQ ID NO: 175535 - DNA, 2184 bp, Artificial Sequence; identical to SEQ ID NO: 175530
  Description of Artificial Sequence: Synthetic coding sequence

SEQ ID NO: 175536 - DNA, 849 bp, Artificial Sequence
  Description of Artificial Sequence: Synthetic coding sequence
atgaagggccagcagaagacagctgagacagaggagggcaccgtgcagatccaggagggcgctgtggccaccggggaggaccccacctctgtggccatcgccagcatccagagcgctgccaccttcccagaccccaacgtgaagtatgtgttcagaacagaaaatggaggccaggtgatgtacagagtcatccaggtgtctgagggccagctggatggccagacagagggcaccggggccatcagcggctacccagccacccagagcatgacccaggccgtcatccagggcgccttcaccagtgatgatgctgtggacacagagggcacagctgctgagacccactacacctacttccccagcacagctgtgggagatggagctgggggccagttctttgtgatgatgagcccccaggaggtgctgcagggcggcagccagaggagcatcgcccccaggacccacccctacagccccaagtctgaggcccccaggaccaccagagatgagaagaggcgggcccagcacaatgaggtggagaggagaagaagagacaagatcaacaactggatcgtgcagctgagcaagatcatcccagactgcagcatggagagcaccaagagcggccagagcaagggcggcatcctgagcaaggcctgtgactacatccaggagctgcggcagagcaaccaccggctgtctgaggagctgcagggcctggaccagctgcagctggacaatgatgtgctgcggcagcaggtggaggacctgaagaacaagaacctgctgctgcgggcccagctgcggcaccacggcctggaggtggtgatcaagaatgacagcaactag

SEQ ID NO: 175537 - DNA, 933 bp, Artificial Sequence
  Description of Artificial Sequence: Synthetic coding sequence
atgaagggccagcagaagacagctgagacagaggagggcaccgtgcagatccaggagggcgctgtggccaccggggaggaccccacctctgtggccatcgccagcatccagagcgctgccaccttcccagaccccaacgtgaagtatgtgttcagaacagaaaatggaggccaggtgatgtacagagtcatccaggtgtctgagggccagctggatggccagacagagggcaccggggccatcagcggctacccagccacccagagcatgacccaggccgtcatccagggcgccttcaccagtgatgatgctgtggacacagagggcacagctgctgagacccactacacctacttccccagcacagctgtgggagatggagctgggggcaccaccagcggcagcacagctgctgtggtgaccacccagggcagcgaggccctgctgggccaggccaccccacctggcaccggccagttctttgtgatgatgagcccccaggaggtgctgcagggcggcagccagaggagcatcgcccccaggacccacccctacagccccaagtctgaggcccccaggaccaccagagatgagaagaggcgggcccagcacaatgaggtggagaggagaagaagagacaagatcaacaactggatcgtgcagctgagcaagatcatcccagactgcagcatggagagcaccaagagcggccagagcaagggcggcatcctgagcaaggcctgtgactacatccaggagctgcggcagagcaaccaccggctgtctgaggagctgcagggcctggaccagctgcagctggacaatgatgtgctgcggcagcaggtggaggacctgaagaacaagaacctgctgctgcgggcccagctgcggcaccacggcctggaggtggtgatcaagaatgacagcaactag

SEQ ID NO: 175538 - DNA, 933 bp, Artificial Sequence; identical to SEQ ID NO: 175537
  Description of Artificial Sequence: Synthetic coding sequence

SEQ ID NO: 175539 - DNA, 756 bp, Artificial Sequence
  Description of Artificial Sequence: Synthetic coding sequence
atgtacagagtcatccaggtgtctgagggccagctggatggccagacagagggcactggagccatcagcggctacccagccacccagagcatgacccaggccgtcatccagggcgccttcaccagtgatgatgctgtggacacagagggcacagctgctgagacccactacacctacttccccagcacagctgtgggagatggagctgggggcaccaccagcggcagcacagctgctgtggtgaccacccagggcagcgaggccctgctgggccaggccaccccacctggcaccggccagttctttgtgatgatgagcccccaggaggtgctgcagggcggcagccagaggagcatcgcccccaggacccacccctacagccccaagtctgaggcccccaggaccaccagagatgagaagagaagagcccagcacaatgaggtggagaggagaagaagagacaagatcaacaactggatcgtgcagctgagcaagatcatcccagactgcagcatggagagcaccaagagcggccagagcaaaggaggcatcctgagcaaggcctgtgactacatccaggagctgcggcagagcaaccaccggctgtctgaggagctgcagggcctggaccagctgcagctggacaatgatgtgctgcggcagcaggtggaggacctgaagaacaagaacctgctgctgcgggcccagctgcggcaccacggcctggaggtggtgatcaagaatgacagcaactag

SEQ ID NO: 175540 - DNA, 1155 bp, Artificial Sequence
  Description of Artificial Sequence: Synthetic coding sequence
atggccggggctgagtggaagagcctggaggagtgcctggagaagcacctgcccctgcctgacctgcaggaggtgaagagggtgctgtatggcaaggagctgaggaagctggacctgccccgggaggcctttgaggccgccagccgggaggactttgagctgcagggctacgcctttgaagctgctgaggagcagctgcggcggcccagaattgtgcacgtgggcctggtgcagaaccgcatccccctgcctgccaatgcccctgtggccgagcaggtgtctgccctgcaccggcgcatcaaggccatcgtggaggtggccgccatgtgtggggtgaacatcatctgcttccaggaggcctggaccatgccctttgccttctgcacccgggagaagctgccctggacagaatttgctgagagcgcagaagatggccccaccacccgcttctgccagaagctggccaagaaccacgacatggtggtggtgagccccatcctggagcgggacagcgagcacggagatgtgctgtggaacacagctgtggtgatcagcaacagcggggctgtgctgggcaagaccaggaagaaccacatcccccgggtgggggacttcaatgaaagcacctactacatggagggcaacctgggccaccctgtgttccagacccagtttggaagaattgctgtgaacatctgctacggccgccaccaccccctgaactggctgatgtacagcatcaacggggctgagatcatcttcaaccccagcgccaccatcggggccctgtctgagagcctgtggcccatcgaggccagaaatgctgccatcgccaaccactgcttcacctgtgccatcaacagagtgggcacagagcacttccccaatgagttcaccagcggagatggcaagaaggcccaccaggactttggctacttctacggcagcagctatgtggccgccccagacagcagcaggaccccaggcctgagccgcagcagagatggcctgctggtggccaagctggacctgaacctgtgccagcaggtgaatgatgtgtggaacttcaagatgacaggccgctatgagatgtatgcccgggagctggccgaggccgtgaagagcaactacagccccaccatcgtgaaggagtag

SEQ ID NO: 175541 - DNA, 951 bp, Artificial Sequence
  Description of Artificial Sequence: Synthetic coding sequence
atgctgggggaggccccagctgccccccggctggccggcagcgaggcccggagcctgtggcagggcacccaggtgtctgccctgcaccggcgcatcaaggccatcgtggaggtggccgccatgtgtggggtgaacatcatctgcttccaggaggcctggaccatgccctttgccttctgcacccgggagaagctgccctggacagaatttgctgagagcgcagaagatggccccaccacccgcttctgccagaagctggccaagaaccacgacatggtggtggtgagccccatcctggagcgggacagcgagcacggagatgtgctgtggaacacagctgtggtgatcagcaacagcggggctgtgctgggcaagaccaggaagaaccacatcccccgggtgggggacttcaatgaaagcacctactacatggagggcaacctgggccaccctgtgttccagacccagtttggaagaattgctgtgaacatctgctacggccgccaccaccccctgaactggctgatgtacagcatcaacggggctgagatcatcttcaaccccagcgccaccatcggggccctgtctgagagcctgtggcccatcgaggccagaaatgctgccatcgccaaccactgcttcacctgtgccatcaacagagtgggcacagagcacttccccaatgagttcaccagcggagatggcaagaaggcccaccaggactttggctacttctacggcagcagctatgtggccgccccagacagcagcaggaccccaggcctgagccgcagcagagatggcctgctggtggccaagctggacctgaacctgtgccagcaggtgaatgatgtgtggaacttcaagatgacaggccgctatgagatgtatgcccgggagctggccgaggccgtgaagagcaactacagccccaccatcgtgaaggagtag

SEQ ID NO: 175542 - DNA, 561 bp, Artificial Sequence
  Description of Artificial Sequence: Synthetic coding sequence
atggccggggctgagtggaagagcctggaggagtgcctggagaagcacctgcccctgcctgacctgcaggaggtgaagagggtgctgtatggcaaggagctgaggaagctggacctgccccgggaggcctttgaggccgccagccgggaggactttgagctgcagggctacgcctttgaagctgctgaggagcagctgcggcggcccagaattgtgcacgtgggcctggtgcagaaccgcatccccctgcctgccaatgcccctgtggccgagcaggtgtctgccctgcaccggcgcatcaaggccatcgtggaggtggccgccatgtgtggggtgaacatcatctgcttccaggaggcctggatcctgcggccccaccaccaggagccccggcccccctgctgctacgcccccagctgctgcctgatccccagcgtcttcccccacaggtctgagagcatccgcagcagccccagcctgtaccaccacctggtgcaggcccctggcagcagccccctggcctttgtgatccccagctcctggagccctgtgcccagctag

SEQ ID NO: 175543 - DNA, 2955 bp, Artificial Sequence
  Description of Artificial Sequence: Synthetic coding sequence
atggatgaccgctacccagccctgcagagggcccagctgcggctggacttcatccacgccaacagcaccacccacagcttcctgtttggagccctggccgagctgctggacaatgccagagatgctggagctgagcggctggatgtgttttctgtggacaatgagaagctgcagggcggcttcatgctgtgcttcctggatgatggctgcggcatgagccctgaggaggccagtgacatcatctacttcggccgcagcaagaagaggctgagcaccctgaagttcatcggccagtatggaaatggcctgaagagcggctccatgagaattggcaaggacttcatcctcttcaccaagaaggaggagaccatgacctgtgtgttcttcagccagaccttctgtgaggaggagagcctgtctgaggtggtggtgcccatgcccagctggctgatccgcacccgggagagcgtgacagatgacccccagaagtttgccatggagctgagcatcatctacaagtacagccccttcaagacagaagctgagctgatgcagcagtttgatgtgatctatggaaaatgtggcaccctgctggtgatctacaacctgaagctgctgctgaatggagagcctgagctggatgtgaagacagacaaggaggacatcctgatggccggggccctggaggacttccctgcccgctggagcttccgggcctacacctctgtgctgtacttcaacccctggatgaggatcttcatccaggccaagagggtgaagaccaagcacctgtgctactgcctgtaccggcccaggaagtacctgtatgtgaccagcagcttcaagggggccttcaaggatgaggtgaagaaggccgaggaggccgtgaagattgctgagagcatcctgaaggaggcccagatcaaggtgaaccagtgtgacaggaccagcctgagcagcgccaaggatgtgctgcagagggccctggaggatgtggaggccaagcagaagaacctgaaggagaagcagcgggagctgaagacagcccggaccctgagcctcttctacggcgtgaatgtggagaacagaagccaggccggcatgttcatctacagcaacaacagactcatcaagatgcatgagaaggtgggcagccagctgaagctgaagagcctgctgggcgccggcgtggtgggcatcgtgaacatccccctggaggtgatggagcccagccacaacaagcaggagttcctgaatgtgcaggagtacaaccacctgctgaaggtgatgggccagtacctggtgcagtactgcaaggacaccggcatcaacaacagaaacctgaccctcttctgcaatgaatttggctaccagaatgacattgatgtggagaagcccctgaacagcttccagtaccagaggcggcaggccatgggcatccccttcatcatccagtgtgacctgtgcctgaagtggagggtgctgcccagcagcaccaactaccaggagaaggagttctttgacatctggatctgtgccaacaaccccaaccggctggagaacagctgccaccaggtggagtgcctgcccagcatccccctgggcaccatgagcaccatcagccccagcaagaatgagaaggagaagcagctgcgggagagcgtcatcaagtaccagaaccggctggccgagcagcagccccagccccagttcatccctgtggatgagatcaccgtgaccagcacctgcctgaccagcgcccacaaggagaacaccaagacccagaagatccggctgctgggagatgacctgaagcatgagagcctgagcagctttgagctgagcgccagccggcggggccagaagagaaatattgaggagacagacagtgatgtggagtacatcagcgagaccaagatcatgaagaagtccatggaggagaagatgaacagccagcagcagagaattcctgtggccctgcctgaaaatgtgaagctggccgagaggagccagaggagccagatcgccaacatcaccaccgtgtggagggcccagcccacagagggctgcctgaagaatgcccaggccgcctcctgggagatgaagaggaagcagagcctgaactttgtggaggagtgcaaggtgctgacagaagatgagaacaccagtgacagcgacatcatcctggtgtctgacaagagcaacacagatgtgtccctgaagcaggagaagaaggagatccccctgctgaaccaggagaagcaggagctgtgcaatgatgtgctggccatgaagaggagcagcagcctgcccagctggaagagcctgctgaatgtgcccatggaggatgtgaacctgagcagcggccacatcgcccgggtgtctgtgtctggcagctgcaaggtggccagcagccctgccagcagccagagcacccctgtgaaggagaccgtgaggaagctgaagagcaagctgcgggagatcctgctgtacttcttccctgagcaccagctgcccagcgagctggaggagcccgccctgagctgtgagctggagcagtgcccagagcagatgaacaagaagctgaagatgtgcttcaaccagatccagaacacctacatggtgcagtatgagaagaagatcaagaggaagctgcagagcatcatctatgacagcaacacccggggcatccacaatgagatcagcctgggccagtgtgagaacaagaggaagatcagcgaggacaagctgaagaacctgcgcatcaagctggccctgctgctgcagaagctgcagctgggcggccctgagggggacctggagcagacagacacctacctggaggccctgctgaaggaggacaacctgctcttccagaacaacctgaacaaggtgaccattgatgcccggcaccggctgcccctggagaagaatgagaagaccagtgaaaattag

SEQ ID NO: 175544 - DNA, 618 bp, Artificial Sequence
  Description of Artificial Sequence: Synthetic coding sequence
atgctggagatcctggagcagcagaagaaggtggatgctgagaccgtgggccgggtgaagcgcttcatccaggagaatgtgtttgtggccgccaaccacaacggcagccccctgagcatcaaggaggcccccaaggagctgagctttggagcccgggcagagctgccccgcatccaccctgtggccagcaagctgctgcggctgatgcagaagaaggagaccaacctgtgcctgtctgcagatgtgtccctggcccgggagctgctgcagctggctgatgccctgggccccagcatctgcatgctgaagacccacgtggacatcctgaatgacttcaccctggatgtgatgaaggagctgatcaccctggccaagtgccacgagttcctgatctttgaggacaggaagtttgctgacatcggcaacacagtgaagaagcagtatgaaggagacaacctgggccagcagtacaacagcccccaggaggtgattggcaagaggggcagtgacatcatcatcgtgggccggggcatcatctctgctgctgaccggctggaggccgctgagatgtacaggaaggccgcctgggaggcctacctgagccggctgggcgtgtag

SEQ ID NO: 175545 - DNA, 1167 bp, Artificial Sequence
  Description of Artificial Sequence: Synthetic coding sequence
atgctgatccggaggaaggagaccaaggactatggcaccaagaggctggtggagggcaccatcaaccctggagagacctgcctgatcattgaagatgtggtgaccagcggcagctctgtgctggagaccgtggaggtgctgcagaaggagggcctgaaggtgacagatgccatcgtgctgctggaccgggagcagggcggcaaggacaagctgcaggcccacggcatccggctgcacagcgtgtgcaccctgagcaagatgctggagatcctggagcagcagaagaaggtggatgctgagaccgtgggccgggtgaagcgcttcatccaggagaatgtgtttgtggccgccaaccacaacggcagccccctgagcatcaaggaggcccccaaggagctgagctttggagcccgggcagagctgccccgcatccaccctgtggccagcaagctgctgcggctgatgcagaagaaggagaccaacctgtgcctgtctgcagatgtgtccctggcccgggagctgctgcagctggctgatgccctgggccccagcatctgcatgctgaagacccacgtggacatcctgaatgacttcaccctggatgtgatgaaggagctgatcaccctggccaagtgccacgagttcctgatctttgaggacaggaagtttgctgacatcggcaacacagtgaagaagcagtatgagggcggcatcttcaagatcgcctcctgggccgacctggtgaatgcccacgtggtgcccggcagcggcgtggtgaagggcctgcaggaggtgggcctgcccctgcaccggggctgcctgctgattgctgagatgagcagcacaggcagcctggccactggagactacaccagggctgctgtgaggatggccgaggagcacagcgagtttgtggtgggcttcatcagcggcagccgggtgtccatgaagccagagttcctgcacctgaccccaggagtgcagctggaggccggcggggacaacctgggccagcagtacaacagcccccaggaggtgattggcaagaggggcagtgacatcatcatcgtgggccggggcatcatctctgctgctgaccggctggaggccgctgagatgtacaggaaggccgcctgggaggcctacctgagccggctgggcgtgtag

SEQ ID NO: 175546 - DNA, 909 bp, Artificial Sequence
  Description of Artificial Sequence: Synthetic coding sequence
atgctggagatcctggagcagcagaagaaggtggatgctgagaccgtgggccgggtgaagcgcttcatccaggagaatgtgtttgtggccgccaaccacaacggcagccccctgagcatcaaggaggcccccaaggagctgagctttggagcccgggcagagctgccccgcatccaccctgtggccagcaagctgctgcggctgatgcagaagaaggagaccaacctgtgcctgtctgcagatgtgtccctggcccgggagctgctgcagctggctgatgccctgggccccagcatctgcatgctgaagacccacgtggacatcctgaatgacttcaccctggatgtgatgaaggagctgatcaccctggccaagtgccacgagttcctgatctttgaggacaggaagtttgctgacatcggcaacacagtgaagaagcagtatgagggcggcatcttcaagatcgcctcctgggccgacctggtgaatgcccacgtggtgcccggcagcggcgtggtgaagggcctgcaggaggtgggcctgcccctgcaccggggctgcctgctgattgctgagatgagcagcacaggcagcctggccactggagactacaccagggctgctgtgaggatggccgaggagcacagcgagtttgtggtgggcttcatcagcggcagccgggtgtccatgaagccagagttcctgcacctgaccccaggagtgcagctggaggccggcggggacaacctgggccagcagtacaacagcccccaggaggtgattggcaagaggggcagtgacatcatcatcgtgggccggggcatcatctctgctgctgaccggctggaggccgctgagatgtacaggaaggccgcctgggaggcctacctgagccggctgggcgtgtag

SEQ ID NO: 175547 - DNA, 933 bp, Artificial Sequence
  Description of Artificial Sequence: Synthetic coding sequence
atggccgccaccggggccaatgctgagaaggccgagagccacaatgactgccctgtgcggctgctgaaccccaacatcgccaagatgaaggaggacatcctgtaccacttcaacctgaccaccagccgccacaacttccctgccctgtttggagatgtgaagtttgtgtgtgtgggcggcagccccagcaggatgaaggccttcatccgctgtgtgggcgctgagctgggcctggactgccccggccgggactaccccaacatctgtgccggcacagacagatatgccatgtacaaggtgggccctgtgctgtctgtgagccacggcatgggcatccccagcatcagcatcatgctgcacgagctgatcaagctgctgtactatgcccgctgcagcaatgtgaccatcatcagaattggcaccagcggcggcatcggcctggagcccggcaccgtggtgatcacagagcaggccgtggacacctgcttcaaggccgagtttgagcagatcgtgctgggcaagagggtcatcaggaagacagacctgaacaagaagctggtgcaggagctgctgctgtgcagcgctgagctgtctgagttcaccaccgtggtgggcaacaccatgtgcaccctggacttctatgagggccagggccgcctggatggagccctgtgcagctacacagagaaggacaagcaggcctacctggaggccgcctatgctgctggggtgagaaatattgagatggagagctctgtgtttgctgccatgtgcagcgcctgtggcctgcaggccgctgtggtgtgtgtgaccctgctgaaccggctggagggggaccagatcagcagccccagaaatgtgctgtctgagtaccagcagaggccccagaggctggtgtcctacttcatcaagaagaagctgagcaaggcctag

SEQ ID NO: 175548 - DNA, 933 bp, Artificial Sequence; identical to SEQ ID NO: 175547
  Description of Artificial Sequence: Synthetic coding sequence

SEQ ID NO: 175549 - DNA, 933 bp, Artificial Sequence; identical to SEQ ID NO: 175547
  Description of Artificial Sequence: Synthetic coding sequence

SEQ ID NO: 175550 - DNA, 435 bp, Artificial Sequence
  Description of Artificial Sequence: Synthetic coding sequence
atggccgccaccggggccaatgctgagaaggccgagagccacaatgactgccctgtgcggctgctgaaccccaacatcgccaagatgaaggaggacatcctgtaccacttcaacctgaccaccagccgccacaacttccctgccctgtttggagatgtgaagtttgtgtgtgtgggcggcagccccagcaggatgaaggccttcatccgctgtgtgggcgctgagctgggcctggactgccccggccgggactaccccaacatctgtgccggcacagacagatatgccatgtacaaggtgggccctgtgctgtctgtgagccacggcatgggcatccccagcatcagcatcatgctgcacgagctgatcaagctgctgtactatgcccgctgcagcaatgtgaccatcatcagaattggcaccagcggcggctag

SEQ ID NO: 175551 - DNA, 516 bp, Artificial Sequence
  Description of Artificial Sequence: Synthetic coding sequence
atggccgccaccggggccaatgctgagaaggccgagagccacaatgactgccctgtgcggctgctgaaccccaacatcgccaagatgaaggaggacatcctgtaccacttcaacctgaccaccagccgccacaacttccctgccctgtttggagatgtgaagtttgtgtgtgtgggcggcagccccagcaggatgaaggccttcatccgctgtgtgggcgctgagctgggcctggactgccccggccgggactaccccaacatctgtgccggcacagacagatatgccatgtacaaggtgggccctgtgctgtctgtgagccacggcatgggcatccccagcatcagcatcatgctgcacgagctgatcaagctgctgtactatgcccgctgcagcaatgtgaccatcatcagaattggcaccagcggcggcatcggcatcctgaagcacctgcggaggaaggacaccgggaagagcaagggcggccgggagaggaggagcaccaagctgaggtag

SEQ ID NO: 175552 - DNA, 522 bp, Artificial Sequence
  Description of Artificial Sequence: Synthetic coding sequence
atgcagaggaagctgaaggtgaccagcctggagcccggcaccgtggtgatcacagagcaggccgtggacacctgcttcaaggccgagtttgagcagatcgtgctgggcaagagggtcatcaggaagacagacctgaacaagaagctggtgcaggagctgctgctgtgcagcgctgagctgtctgagttcaccaccgtggtgggcaacaccatgtgcaccctggacttctatgagggccagggccgcctggatggagccctgtgcagctacacagagaaggacaagcaggcctacctggaggccgcctatgctgctggggtgaggaacatcgagatggagagctctgtgtttgctgccatgtgcagcgcctgtggcctgcaggccgctgtggtgtgtgtgaccctgctgaaccggctggagggggaccagatcagcagccccagaaatgtgctgtctgagtaccagcagaggccccagaggctggtgtcctacttcatcaagaagaagctgagcaaggcctag

SEQ ID NO: 175553 - DNA, 90 bp, Artificial Sequence
  Description of Artificial Sequence: Synthetic coding sequence
atggccgccaccggggccaatgctgagaaggccgagagccacaatgactgccctgtgcggctgctgaaccccaacatcgccaagatgtag

SEQ ID NO: 175554 - DNA, 441 bp, Artificial Sequence
  Description of Artificial Sequence: Synthetic coding sequence
atggccgccaccggggccaatgctgagaaggccgagagccacaatgactgccctgtgcggctgctgaaccccaacatcgccaagatgaaggaggacatcctgtaccacttcaacctgaccaccagccgccacaacttccctgccctgtttggagatgtgaagtttgtgtgtgtgggcggcagccccagcaggatgaaggccttcatccgctgtgtgggcgctgagctgggcctggactgccccggccgggactaccccaacatctgtgccggcacagacagatatgccatgtacaaggtgggccctgtgctgtctgtgagccacggcatgggcatccccagcatcagcatcatgctgcacgagctgatcaagctgctgtactatgcccgctgcagcaatgtgaccatcatcagaattggcaccagcggcggcattggatag

SEQ ID NO: 175555 - DNA, 606 bp, Artificial Sequence
  Description of Artificial Sequence: Synthetic coding sequence
atggccagcgctggaggagaggactgtgagagccctgcccctgaggccgaccggccccaccagaggcccttcctgattggagtgtctgggggcacagccagcggcaagagcacagtgtgtgagaagatcatggagctgctgggccagaatgaggtggagcagaggcagaggaaggtggtgatcctgagccaggaccgcttctacaaggtgctgacagctgagcagaaggccaaggccctgaagggccagtacaactttgaccacccagatgcctttgacaatgacctgatgcacaggaccctgaagaacatcgtggagggcaagacagtggaggtgcccacctatgactttgtgacccacagccggctgcctgagaccaccgtggtgtacccagcagatgtggtgctgtttgagggcatcctggtgttctacagccaggagatccgggacatgttccacctgcggctgtttgtggacacagacagtgatgtgcggctgagccggcgggacaaggaggtgtgccgctgtgaccacccagcccggagcggccagtatggctgccaccagcctgacagagctgcccaccctggccacagcgagtggtag

SEQ ID NO: 175556 - DNA, 807 bp, Artificial Sequence
  Description of Artificial Sequence: Synthetic coding sequence
atggccagcgctggaggagaggactgtgagagccctgcccctgaggccgaccggccccaccagaggcccttcctgattggcagcacagtgtgtgagaagatcatggagctgctgggccagaatgaggtggagcagaggcagaggaaggtggtgatcctgagccaggaccgcttctacaaggtgctgacagctgagcagaaggccaaggccctgaagggccagtacaactttgaccacccagatgcctttgacaatgacctgatgcacaggaccctgaagaacatcgtggagggcaagacagtggaggtgcccacctatgactttgtgacccacagccggctgcctgagaccaccgtggtgtacccagcagatgtggtgctgtttgagggcatcctggtgttctacagccaggagatccgggacatgttccacctgcggctgtttgtggacacagacagtgatgtgcggctgagcagaagagtgctgagagatgtgcggcggggccgggacctggagcagatcctgacccagtacaccacctttgtgaagccagcctttgaggagttctgcctgcccaccaagaagtatgcagatgtgatcatcccccggggcgtggacaacatggtggccatcaacctgattgtgcagcacatccaggacatcctgaatggagacatctgcaagtggcaccggggcggcagcaatggccgcagctacaagaggaccttcagcgagcccggggaccaccctggcatgctgaccagcggcaagaggagccacctggagagcagcagccggccccactag

SEQ ID NO: 175557 - DNA, 849 bp, Artificial Sequence
  Description of Artificial Sequence: Synthetic coding sequence
atggccagcgctggaggagaggactgtgagagccctgcccctgaggccgaccggccccaccagaggcccttcctgattggagatgagcgcttccaggccggcatccccctgctgtgcctgcagagcacagtgtgtgagaagatcatggagctgctgggccagaatgaggtggagcagaggcagaggaaggtggtgatcctgagccaggaccgcttctacaaggtgctgacagctgagcagaaggccaaggccctgaagggccagtacaactttgaccacccagatgcctttgacaatgacctgatgcacaggaccctgaagaacatcgtggagggcaagacagtggaggtgcccacctatgactttgtgacccacagccggctgcctgagaccaccgtggtgtacccagcagatgtggtgctgtttgagggcatcctggtgttctacagccaggagatccgggacatgttccacctgcggctgtttgtggacacagacagtgatgtgcggctgagcagaagagtgctgagagatgtgcggcggggccgggacctggagcagatcctgacccagtacaccacctttgtgaagccagcctttgaggagttctgcctgcccaccaagaagtatgcagatgtgatcatcccccggggcgtggacaacatggtggccatcaacctgattgtgcagcacatccaggacatcctgaatggagacatctgcaagtggcaccggggcggcagcaatggccgcagctacaagaggaccttcagcgagcccggggaccaccctggcatgctgaccagcggcaagaggagccacctggagagcagcagccggccccactag

SEQ ID NO: 175558 - DNA, 834 bp, Artificial Sequence
  Description of Artificial Sequence: Synthetic coding sequence
atggccagcgctggaggagaggactgtgagagccctgcccctgaggccgaccggccccaccagaggcccttcctgattggagtgtctgggggcacagccagcggcaagagcacagtgtgtgagaagatcatggagctgctgggccagaatgaggtggagcagaggcagaggaaggtggtgatcctgagccaggaccgcttctacaaggtgctgacagctgagcagaaggccaaggccctgaagggccagtacaactttgaccacccagatgcctttgacaatgacctgatgcacaggaccctgaagaacatcgtggagggcaagacagtggaggtgcccacctatgactttgtgacccacagccggctgcctgagaccaccgtggtgtacccagcagatgtggtgctgtttgagggcatcctggtgttctacagccaggagatccgggacatgttccacctgcggctgtttgtggacacagacagtgatgtgcggctgagccggcgggtgctgagagatgtgagaagaggccgggacctggagcagatcctgacccagtacaccacctttgtgaagccagcctttgaggagttctgcctgcccaccaagaagtatgcagatgtgatcatcccccggggcgtggacaacatggtggccatcaacctgattgtgcagcacatccaggacatcctgaatggagacatctgcaagtggcacagaggaggcagcaatggccgcagctacaagaggaccttcagcgagcccggggaccaccctggcatgctgaccagcggcaagaggagccacctggagagcagcagccggccccactag

SEQ ID NO: 175559 - DNA, 1647 bp, Artificial Sequence
  Description of Artificial Sequence: Synthetic coding sequence
atggccgcccccccagcccgggcagatgctgaccccagccccaccagccccccaacagcccgggacaccccaggccggcaggccgagaagtcagaaacagcctgtgaggacaggagcaatgctgagagcctggaccggctgctgccccctgtgggcaccggccgcagccccaggaagaggaccaccagccagtgcaagtctgagccccccctgctgcggaccagcaagaggaccatctacacagctggccggcccccctggtacaatgaacatggcacccagagcaaggaggcctttgccatcggcctgggcggcggcagcgccagcggcaagaccaccgtggccaggatgatcatcgaggccctggatgtgccctgggtggtgctgctgtccatggacagcttctacaaggtgctgacagagcagcagcaggagcaggccgcccacaacaacttcaactttgaccacccagatgcctttgattttgacctgatcatcagcaccctgaagaagctgaagcagggcaagtctgtgaaggtgcccatctatgacttcaccacccacagcaggaagaaggactggaagaccctgtatggagccaacgtcatcatctttgagggcatcatggcctttgctgacaagaccctgctggagctgctggacatgaagatctttgtggacacagacagcgacatccggctggtgcggcggctgcggcgggacatcagcgagcggggccgggacattgaaggagtcatcaagcagtacaacaagtttgtgaagcccagctttgaccagtacatccagcccaccatgaggctggccgacatcgtggtgccccggggcagcggcaacacagtggccatcgacctgattgtgcagcacgtgcacagccagctggaggagcgggagctgtctgtgcgggccgccctggccagcgcccaccagtgccaccccctgcccaggaccctgtctgtgctgaagagcaccccccaggtgcggggcatgcacaccatcatccgggacaaggagaccagcagagatgagttcatcttctacagcaagaggctgatgaggctgctgattgagcacgccctgtccttcctgcccttccaggactgtgtggtgcagaccccccagggccaggactatgctggaaaatgttatgctgggaagcagatcactggagtgtccatcctgcgggccggggagaccatggagcccgccctgcgggctgtgtgcaaggatgtgagaattggcaccatcctgatccagaccaaccagctgaccggggagcctgagctgcactacctgcggctgcccaaggacatcagtgatgaccacgtgatcctgatggactgcaccgtgtccactggagctgctgccatgatggctgtgcgggtgctgctggaccatgatgtgcctgaggacaagatcttcctgctgagcctgctgatggccgagatgggcgtgcacagcgtggcctatgccttcccccgggtgcgcatcatcaccacagctgtggacaagagggtgaatgacctcttccgcatcatccctggcatcggcaactttggagaccgctacttcggcacagatgctgtgcctgatggcagtgatgaggaggaggtggcctacacaggatag

SEQ ID NO: 175560 - DNA, 1260 bp, Artificial Sequence
  Description of Artificial Sequence: Synthetic coding sequence
atggccgcccccccagcccgggcagatgctgaccccagccccaccagccccccaacagcccgggacaccccaggccggcaggccgagaagtcagaaacagcctgtgaggacaggagcaatgctgagagcctggaccggctgctgccccctgtgggcaccggccgcagccccaggaagaggaccaccagccagtgcaagtctgagccccccctgctgcggaccagcaagaggaccatctacacagctggccggcccccctggtacaatgaacatggcacccagagcaaggaggcctttgccatcggcctgggcggcggcagcgccagcggcaagaccaccgtggccaggatgatcatcgaggccctggatgtgccctgggtggtgctgctgtccatggacagcttctacaaggtgctgacagagcagcagcaggagcaggccgcccacaacaacttcaactttgaccacccagatgcctttgattttgacctgatcatcagcaccctgaagaagctgaagcagggcaagtctgtgaaggtgcccatctatgacttcaccacccacagcaggaagaaggactggaagaccctgtatggagccaacgtcatcatctttgagggcatcatggcctttgctgacaagaccctgctggagctgctggacatgaagatctttgtggacacagacagcgacatccggctggtgcggcggctgcggcgggacatcagcgagcggggccgggacattgaaggagtcatcaagcagtacaacaagtttgtgaagcccagctttgaccagtacatccagcccaccatgaggctggccgacatcgtggtgccccggggcagcggcaacacagtggccatcgacctgattgtgcagcacgtgcacagccagctggaggagggctgtgccggcctgggcacccctgtgcccccagctgccccagatgctgagaggcctgaggagcacgccgccggcaccggccacgcccaccaccaccaggtgcgggcccacctgggcaccggccggccccgggcccgggccccagcccagctgctggccccccagggccagggcgaccagagccggcgggtgcacctgctgctgcaggagacagatgctgctgcccaccgggcccgggccctgctgcctgccctgagcggcctgcggaggacagatcctgctggggccggcctgtgtggccaggtgctgtgtggggaggccgaccaccgctgtgtgcacagcgcccggaggtag

SEQ ID NO: 175561 - DNA, 1647 bp, Artificial Sequence
  Description of Artificial Sequence: Synthetic coding sequence
atggccgcccccccagcccgggcagatgctgaccccagccccaccagccccccaacagcccgggacaccccaggccggcaggccgagaagtcagaaacagcctgtgaggacaggagcaatgctgagagcctggaccggctgctgccccctgtgggcaccggccgcagccccaggaagaggaccaccagccagtgcaagtctgagccccccctgctgcggaccagcaagaggaccatctacacagctggccggcccccctggtacaatgaacatggcacccagagcaaggaggcctttgccatcggcctgggcggcggcagcgccagcggcaagaccaccgtggccaggatgatcatcgaggccctggatgtgccctgggtggtgctgctgtccatggacagcttctacaaggtgctgacagagcagcagcaggagcaggccgcccacaacaacttcaactttgaccacccagatgcctttgattttgacctgatcatcagcaccctgaagaagctgaagcagggcaagtctgtgaaggtgcccatctatgacttcaccacccacagcaggaagaaggactggaagaccctgtatggagccaacgtcatcatctttgagggcatcatggcctttgctgacaagaccctgctggagctgctggacatgaagatctttgtggacacagacagcgacatccggctggtgcggcggctgcggcgggacatcagcgagcggggccgggacattgaaggagtcatcaagcagtacaacaagtttgtgaagcccagctttgaccagtacatccagcccaccatgaggctggccgacatcgtggtgccccggggcagcggcaacacagtggccatcgacctgattgtgcagcacgtgcacagccagctggaggagctgcgctttgtgcccagggctgccctggccagcgcccaccagtgccaccccctgcccaggaccctgtctgtgctgaagagcaccccccaggtgcggggcatgcacaccatcatccgggacaaggagaccagcagagatgagttcatcttctacagcaagaggctgatgaggctgctgattgagcacgccctgtccttcctgcccttccaggactgtgtggtgcagaccccccagggccaggactatgctggaaaatgttatgctgggaagcagatcactggagtgtccatcctgcgggccggggagaccatggagcccgccctgcgggctgtgtgcaaggatgtgagaattggcaccatcctgatccagaccaaccagctgaccggggagcctgagctgcactacctgcggctgcccaaggacatcagtgatgaccacgtgatcctgatggactgcaccgtgtccactggagctgctgccatgatggctgtgcgggtgctgctggaccatgatgtgcctgaggacaagatcttcctgctgagcctgctgatggccgagatgggcgtgcacagcgtggcctatgccttcccccgggtgcgcatcatcaccacagctgtggacaagagggtgaatgacctcttccgcatcatccctggcatcggcaactttggagaccgctacttcggcacagatgctgtgcctgatggcagtgatgaggaggaggtggcctacacaggatag

SEQ ID NO: 175562 - DNA, 1602 bp, Artificial Sequence
  Description of Artificial Sequence: Synthetic coding sequence
atgagcagccccccagcctacccaggcatccgcatcagcggctgccgggccctgggcgctgagggcagcagcaatgctgagagcctggaccggctgctgccccctgtgggcaccggccgcagccccaggaagaggaccaccagccagtgcaagtctgagccccccctgctgcggaccagcaagaggaccatctacacagctggccggcccccctggtacaatgagcacggcacccagagcaaggaggcctttgccatcggcctgggcggcggcagcgccagcggcaagaccaccgtggccaggatgatcatcgaggccctggatgtgccctgggtggtgctgctgtccatggacagcttctacaaggtgctgacagagcagcagcaggagcaggccgcccacaacaacttcaactttgaccacccagatgcctttgattttgacctgatcatcagcaccctgaagaagctgaagcagggcaagtctgtgaaggtgcccatctatgacttcaccacccacagcaggaagaaggactggaagaccctgtatggagccaacgtcatcatctttgagggcatcatggcctttgctgacaagaccctgctggagctgctggacatgaagatctttgtggacacagacagcgacatccggctggtgcggcggctgcggcgggacatcagcgagcggggccgggacatcgagggcgtcatcaagcagtacaacaagtttgtgaagcccagctttgaccagtacatccagcccaccatgaggctggccgacatcgtggtgccccggggcagcggcaacacagtggccatcgacctgattgtgcagcacgtgcacagccagctggaggagcgggagctgtctgtgcgggccgccctggccagcgcccaccagtgccaccccctgcccaggaccctgtctgtgctgaagagcaccccccaggtgcggggcatgcacaccatcatccgggacaaggagaccagcagagatgagttcatcttctacagcaagaggctgatgaggctgctgattgaacatgccctgtccttcctgcccttccaggactgtgtggtgcagaccccccagggccaggactatgctgggaagtgctacgccggcaagcagatcaccggggtgtccatcctgcgggccggggagaccatggagcccgccctgcgggctgtgtgcaaggatgtgcgcatcggcaccatcctgatccagaccaaccagctgactggagagcctgagctgcactacctgcggctgcccaaggacatcagtgatgaccacgtgatcctgatggactgcaccgtgtccactggagctgctgccatgatggctgtgcgggtgctgctggaccatgatgtgcctgaggacaagatcttcctgctgagcctgctgatggccgagatgggcgtgcacagcgtggcctatgccttcccccgggtgcgcatcatcaccacagctgtggacaagagggtgaatgacctcttccgcatcatccctggcatcggcaactttggagaccgctactttggaacagatgctgtgcctgatggcagtgatgaggaggaggtggcctacacaggatag

SEQ ID NO: 175563 - DNA, 261 bp, Artificial Sequence
  Description of Artificial Sequence: Synthetic coding sequence
atgagcagccccccagcctacccaggcatccgcatcagcggctgccgggccctgggcgctgagggcagcagcaatgctgagagcctggaccggctgctgccccctgtgggcaccggccgcagccccaggaagaggaccaccagccagtgcaagtctgagccccccctgctgcggaccagcaagaggaccatctacacagctggccggcccccctggtacaatgagcacggcacccagagcaaggaggcctttgccatctag

SEQ ID NO: 175564 - DNA, 408 bp, Artificial Sequence
  Description of Artificial Sequence: Synthetic coding sequence
atgcacaccatcatccgggacaaggagaccagcagagatgagttcatcttctacagcaagaggctgatgaggctgctgattgaacatgccctgtccttcctgcccttccaggactgtgtggtgcagaccccccagggccaggactatgctgggaagtgctacgccggcaagcagatcaccggggtgtccatcctgcgggccggggagaccatggagcccgccctgcgggctgtgtgcaaggatgtgcgcatcggcaccatcctgatccagaccaaccagctgactggagagcctgagctgcactacctgcggctgcccaaggacatcagtgatgaccacgtgatcctgatggactgcaccgtgtccactggagctgctgccatgatggctgtgcgggtgctgctgtag

SEQ ID NO: 175565 - DNA, 786 bp, Artificial Sequence
  Description of Artificial Sequence: Synthetic coding sequence
atggccggggacagcgagcagaccctgcagaaccaccagcagcccaacggcggggagcccttcctgattggagtgtctgggggcacagccagcggcaagagctctgtgtgtgccaagatcgtgcagctgctgggccagaatgaggtggactaccggcagaagcaggtggtgatcctgagccaggacagcttctacagagtgctgaccagcgagcagaaggccaaggccctgaagggccagttcaactttgaccacccagatgcctttgacaatgaactcatcctgaagaccctgaaggagatcacagagggcaagacagtgcagatccctgtgtatgactttgtgagccacagcaggaaggaggagaccgtgacagtgtacccagcagatgtggtgctgtttgagggcatcctggccttctacagccaggaggtgcgggacctcttccagatgaagctgtttgtggacacagatgctgacacccggctgagcagaagagtgctgcgggacatcagcgagcggggccgggacctggagcagatcctgagccagtacatcacctttgtgaagccagcctttgaggagttctgcctgcccaccaagaagtatgcagatgtgatcatccccagaggagctgacaacctggtggccatcaacctgattgtgcagcacatccaggacatcctgaatggaggccccagcaagaggcagaccaacggctgcctgaatggctacacccccagcaggaagaggcaggccagcgagagcagcagccggccccactag

SEQ ID NO: 175566 - DNA, 393 bp, Artificial Sequence
  Description of Artificial Sequence: Synthetic coding sequence
atggccggggacagcgagcagaccctgcagaaccaccagcagcccaacggcggggagcccttcctgattggagtgtctgggggcacagccagcggcaagagctctgtgtgtgccaagatcgtgcagctgctgggccagaatgaggtggactaccggcagaagcaggtggtgatcctgagccaggacagcttctacagagtgctgaccagcgagcagaaggccaaggccctgaagggccagttcaactttgaccacccagatgcctttgacaatgaactcatcctgaagaccctgaaggagatcacagagggcaagacagtgcagatccctgtgtatgactttgtgagccacagccgcatcaagggccaccagcgggagcggcagggcagctag

SEQ ID NO: 175567 - DNA, 2031 bp, Artificial Sequence
  Description of Artificial Sequence: Synthetic coding sequence
atgagcagcctgcaggccctgtgcagcggcctgcccctgcggcccctgcctgagaacagaggccggcaggccggcgtgccccacgcccctgtgaggacccccagcctgagccctgtggagaagcagctggccctgagaaatgccctgcgctacttccccccagatgtgcaggagctgctggcccctgagtttgcccaggagctgcagctgtatggccacatctacatgtaccgcttctgcccagacatcgagatgagggcctaccccatcgagcagtacccctgccagaccaaggtggccgccgccatcatgcacatgatcatgaacaacctggaccctgctgtggcccagttcccccaggagctggtgacctatggaggaaatggccaggtgttcagcaactgggcccagttctggctgaccatgttctacctgagcaagatgacagaggagcagaccctggtgatgtacagcggccaccccctgggcctcttccccagcagccgcagcgccccccggctggtgatcaccaacggcatggtgatccccaactacagcagcaggacagaatatgagaagctgtttgccctgggcgtgaccatgtatggccagatgacagctggcagctactgctacatcggcccccagggcatcgtgcacggcaccgtgctgactgtgctgaatgctgcccggcgctacctgggcatcgaggacctggccggcaaggtgtttgtgaccagcggcctgggcggcatgtctggggcccaggccaaggccgccgtcatcgtgggctgcatcggcgtgattgctgaggtggacaaggccgccctggagaagaggcaccggcagggctggctgatggaggtgacagacagcctggaccgctgcatccagaggctgcgggaggccaggaagaagaaggaggtgctgagcctgggctaccatggaaatgtggtggccctgtgggagcggctggtgcatgagctggacaccaccggggagtgcctggtggacctgggcagtgaccagaccagctgccacaaccccttcaatggaggctactaccctgtgcagctgtccttcacagaggcccagagcctgatggccagcaacccagctgtgttcaaggacctggtgcaggagagcctgcggcggcaggtgtctgccatcaaccggctggccgaggagaagttcttcttctgggactatggaaatgccttcctgctggaggcccagagagctggagcagatgtggagaagaagggagctggccgcacagagttccgctaccccagctatgtgcagcacatcatgggagacatcttcagccagggcttcggccccttccgctgggtgtgcaccagcggggacccccaggacctggccgtgacagatgagctggccacctctgtgctggaggaggccatcgcagatggagtgaaggtgtctgtgaagctgcagtacatggacaacatccgctggatccgggaggccgcccggcaccggctggtggtgggcagccaggcccgcatcctgtacagcgaccagaagggccgggtggccatcgctgtggccatcaaccaggccatcgcctgccgccgcatcaaggcccctgtggtgctgagccgggaccaccatgatgtgtctggaacagacagccccttccgggagaccagcaacatctatgatggcagcgccttctgtgccgacatggctgtgcagaactttgtgggagatgcctgccgcggggccacctgggtggccctgcacaatggaggcggcgtgggctggggcgaggtgatcaatggaggcttcggcctggtgctggatggcaccccagaggccgagggccgggcccggctgatgctgtcctgggatgtgtccaatggagtggcccggcgctgctggagcggcaaccagaaggcctatgagatcatctgccagaccatgcaggagaacagcaccctggtggtgaccctgccccacaaggtggaggatgagcgggtgctgcagcaggccctgcagctgtag

SEQ ID NO: 175568 - DNA, 2211 bp, Artificial Sequence
  Description of Artificial Sequence: Synthetic coding sequence
atgagcagcctgcaggccctgtgcagcggcctgcccctgcggcccctgcctgagaacagaggccggcaggccggcgtgccccacgcccctgtgaggacccccagcctgagccctgtggagaagcagctggccctgagaaatgccctgcgctacttccccccagatgtgcaggagctgctggcccctgagtttgcccaggagctgcagctgtatggccacatctacatgtaccgcttctgcccagacatcgagatgagggcctaccccatcgagcagtacccctgccagaccaaggtggccgccgccatcatgcacatgatcatgaacaacctggaccctgctgtggcccagttcccccaggagctggtgacctatggaggaaatggccaggtgttcagcaactgggcccagttctggctgaccatgttctacctgagcaagatgacagaggagcagaccctggtgatgtacagcggccaccccctgggcctcttccccagcagccgcagcgccccccggctggtgatcaccaacggcatggtgatccccaactacagcagcaggacagaatatgagaagctgtttgccctgggcgtgaccatgtatggccagatgacagctggcagctactgctacatcggcccccagggcatcgtgcacggcaccgtgctgactgtgctgaatgctgcccggcgctacctgggcatcgaggacctggccggcaaggtgtttgtgaccagcggcctgggcggcatgtctggggcccaggccaaggccgccgtcatcgtgggctgcatcggcgtgattgctgaggtggacaaggccgccctggagaagaggcaccggcagggctggctgatggaggtgacagacagcctggaccgctgcatccagaggctgcgggtgctgcagctgggcctgcagcaggccctgggctgggccggcctgcctgctgccctgggcctgtgtgtgctgagctgctttgtgaacctggcccccctgggggagggccgctgcctggcccccagcggcttcagccggcccctgctgggcgcccctgtgctgctgctgtgccccagccgggaggccaggaagaagaaggaggtgctgagcctgggctaccatggaaatgtggtggccctgtgggagcggctggtgcatgagctggacaccaccggggagtgcctggtggacctgggcagtgaccagaccagctgccacaaccccttcaatggaggctactaccctgtgcagctgtccttcacagaggcccagagcctgatggccagcaacccagctgtgttcaaggacctggtgcaggagagcctgcggcggcaggtgtctgccatcaaccggctggccgaggagaagttcttcttctgggactatggaaatgccttcctgctggaggcccagagagctggagcagatgtggagaagaagggagctggccgcacagagttccgctaccccagctatgtgcagcacatcatgggagacatcttcagccagggcttcggccccttccgctgggtgtgcaccagcggggacccccaggacctggccgtgacagatgagctggccacctctgtgctggaggaggccatcgcagatggagtgaaggtgtctgtgaagctgcagtacatggacaacatccgctggatccgggaggccgcccggcaccggctggtggtgggcagccaggcccgcatcctgtacagcgaccagaagggccgggtggccatcgctgtggccatcaaccaggccatcgcctgccgccgcatcaaggcccctgtggtgctgagccgggaccaccatgatgtgtctggaacagacagccccttccgggagaccagcaacatctatgatggcagcgccttctgtgccgacatggctgtgcagaactttgtgggagatgcctgccgcggggccacctgggtggccctgcacaatggaggcggcgtgggctggggcgaggtgatcaatggaggcttcggcctggtgctggatggcaccccagaggccgagggccgggcccggctgatgctgtcctgggatgtgtccaatggagtggcccggcgctgctggagcggcaaccagaaggcctatgagatcatctgccagaccatgcaggagaacagcaccctggtggtgaccctgccccacaaggtggaggatgagcgggtgctgcagcaggccctgcagctgtag

SEQ ID NO: 175569 - DNA, 375 bp, Artificial Sequence
  Description of Artificial Sequence: Synthetic coding sequence
atgaggcaggccggccgggccgccctgctggccgccctgctgctgctggtgcagctgtgccccggcagcagccagaggagccctgaggccgccggcgtgcaggaccccagcctgcgctggagccctggggccaggaaccagggcggcggggcccgggccctgctgctgctgctggccgagcgcttcccccggcgggccggccctggccgcctgggcctgggcacagctggggagcggccccggcgggacaaccccagcctgagcattgacctgaccttccacctgctgcggaccctgctggagctggcccggacccagagccagcgggagcgggcagagcagaaccgcatcatctttgattctgtgggcaagtag

SEQ ID NO: 175570 - DNA, 339 bp, Artificial Sequence
  Description of Artificial Sequence: Synthetic coding sequence
atgacccgctgtgccctgctgctgctgatggtgctgatgctgggccgggtgctggtggtgcctgtgacccccatccccaccttccagctgcggccccagaacagcccccagaccacccccaggcctgctgccagcgagagccccagcgctgcccccacctggccctgggccgcccagagccactgcagccccaccaggcaccctggcagccgcatcgtgctgagcctggatgtgcccatcggcctgctgcagatcctgctggagcaggcccgggcccgggccgcccgggagcaggccaccaccaatgcccgcatcctggcccgggtgggccactgctag

SEQ ID NO: 175571 - DNA, 1923 bp, Artificial Sequence
  Description of Artificial Sequence: Synthetic coding sequence
atgggccagcccagcctgacctggatgctgatggtggtggtggcctcctggttcatcaccacagctgccacagacaccagcgaggcccgctggtgcagcgagtgccacagcaatgccacctgcacagaagatgaggccgtgaccacctgcacctgccaggagggcttcaccggagatggcctgacctgtgtggacctggatgaatgtgccatccctggggcccacaactgcagcgccaacagcagctgtgtgaacaccccaggcagcttcagctgtgtgtgcccagagggcttccggctgagccctggcctgggctgcacagatgtggatgaatgtgccgagcccggcctgagccactgccacgccctggccacctgtgtgaatgtggtgggcagctacctgtgtgtgtgcccagctggctacagaggagatggctggcactgtgaatgttctcctggcagctgtggccctggcctggactgtgtgcctgaaggagatgccctggtgtgtgccgacccctgccaggcccacaggaccctggatgagtactggaggagcacagaatatggagagggctacgcctgtgacacagacctgcggggctggtacagatttgtgggccagggcggggccaggatggccgagacctgtgtgcctgtgctgcgctgcaacacagctgcccccatgtggctgaatggcacccaccccagcagtgatgagggcatcgtgtccaggaaggcctgtgcccactggagcggccactgctgcctgtgggatgcctctgtgcaggtgaaggcctgtgccggcggctactacgtgtacaacctgacagcccccccagagtgccacctggcctactgcacagaccccagctctgtggagggcacctgtgaagaatgttccattgatgaggactgcaagagcaacaacggccgctggcactgccagtgcaagcaggacttcaacatcacagacatcagcctgctggagcaccggctggagtgtggggccaatgacatgaaggtgtccctgggcaagtgccagctgaagagcctgggctttgacaaggtgttcatgtacctgagtgacagccgctgcagcggcttcaatgaccgggacaacagagactgggtgtctgtggtgaccccagccagagatggcccctgtggcaccgtgctgaccagaaatgagacccacgccacctacagcaacaccctgtacctggctgatgagatcatcatccgggacctgaacatcaagatcaactttgcctgcagctaccccctggacatgaaggtgtccctgaagacagccctgcagcccatggtgtctgccctgaacatccgggtgggcggcaccggcatgttcaccgtgaggatggccctcttccagacccccagctacacccagccctaccagggcagctctgtgaccctgagcacagaggccttcctgtatgtgggcaccatgctggatggaggagacctgagcagatttgccctgctgatgaccaactgctacgccacccccagcagcaatgccacagaccccctgaagtacttcatcatccaggaccgctgcccccacacccgggacagcaccatccaggtggtggagaatggagagagcagccagggccgcttctctgtgcagatgttccgctttgctggcaactatgacctggtgtacctgcactgtgaggtgtacctgtgtgacaccatgaatgagaagtgcaagcccacctgcagcggcacccgcttccgcagcggctctgtgattgaccagagccgggtgctgaacctgggccccatcaccaggaaaggagtgcaggccaccgtgtcccgggccttcagcagcctgggcctgctgaaggtgtggctgcccctgctgctgagcgccaccctgaccctgaccttccagtag

SEQ ID NO: 175572 - DNA, 2022 bp, Artificial Sequence
  Description of Artificial Sequence: Synthetic coding sequence
atgggccagcccagcctgacctggatgctgatggtggtggtggcctcctggttcatcaccacagctgccacagacaccagcgaggcccggaccaagtacaactgcccagcccgctggagctggaggaccccccagagaggaggagacacagagcagggcccagatgaggacttcaccagccagggccgctggtgcagcgagtgccacagcaatgccacctgcacagaagatgaagctgtgaccacctgcacctgccaggagggcttcaccggagatggcctgacctgtgtggacctggatgaatgtgccatccctggggcccacaactgcagcgccaacagcagctgtgtgaacaccccaggcagcttcagctgtgtgtgcccagagggcttccggctgagccctggcctgggctgcacagatgtggatgaatgtgccgagcccggcctgagccactgccacgccctggccacctgtgtgaatgtggtgggcagctacctgtgtgtgtgcccagctggctacagaggagatggctggcactgtgagtgcagccctggcagctgtggccctggcctggactgtgtgcctgaaggagatgccctggtgtgtgccgacccctgccaggcccacaggaccctggatgagtactggaggagcacagaatatggagagggctacgcctgtgacacagacctgcggggctggtacagatttgtgggccagggcggggccaggatggccgagacctgtgtgcctgtgctgcgctgcaacacagctgcccccatgtggctgaatggcacccaccccagcagtgatgagggcatcgtgtccaggaaggcctgtgcccactggagcggccactgctgcctgtgggatgcctctgtgcaggtgaaggcctgtgccggcggctactacgtgtacaacctgacagcccctcctgagtgccacctggcctactgcacagaccccagctctgtggagggcacctgtgaggagtgcagcattgatgaggactgcaagagcaacaacggccgctggcactgccagtgcaagcaggacttcaacatcacagacatcagcctgctggagcaccggctggagtgtggggccaatgacatgaaggtgtccctgggcaagtgccagctgaagagcctgggctttgacaaggtgttcatgtacctgagtgacagccgctgcagcggcttcaatgaccgggacaacagagactgggtgtctgtggtgaccccagccagagatggcccctgtggcaccgtgctgaccagaaatgagacccacgccacctacagcaacaccctgtacctggctgatgagatcatcatccgggacctgaacatcaagatcaactttgcctgcagctaccccctggacatgaaggtgtccctgaagacagccctgcagcccatggtgtctgccctgaacatccgggtgggcggcaccggcatgttcaccgtgaggatggccctcttccagacccccagctacacccagccctaccagggcagctctgtgaccctgagcacagaggccttcctgtatgtgggcaccatgctggatggaggagacctgagcagatttgccctgctgatgaccaactgctacgccacccccagcagcaatgccacagaccccctgaagtacttcatcatccaggaccgctgcccccacacccgggacagcaccatccaggtggtggagaatggagagagcagccagggccgcttctctgtgcagatgttccgctttgctggcaactatgacctggtgtacctgcactgtgaggtgtacctgtgtgacaccatgaatgagaagtgcaagcccacctgcagcggcacccgcttccgcagcggcagcgtcatcgaccagagccgggtgctgaacctgggccccatcaccaggaagggcgtgcaggccaccgtgtcccgggccttcagcagcctgggcctgctgaaggtgtggctgcccctgctgctgagcgccaccctgaccctgaccttccagtag

SEQ ID NO: 175573 - DNA, 1923 bp, Artificial Sequence; identical to SEQ ID NO: 175571
  Description of Artificial Sequence: Synthetic coding sequence

SEQ ID NO: 175574 - DNA, 1923 bp, Artificial Sequence; identical to SEQ ID NO: 175571
  Description of Artificial Sequence: Synthetic coding sequence

SEQ ID NO: 175575 - DNA, 2022 bp, Artificial Sequence; identical to SEQ ID NO: 175572
  Description of Artificial Sequence: Synthetic coding sequence

SEQ ID NO: 175576 - DNA, 1857 bp, Artificial Sequence
  Description of Artificial Sequence: Synthetic coding sequence
atgggccagcccagcctgacctggatgctgatggtggtggtggcctcctggttcatcaccacagctgccacagacaccagcgaggcccgctggtgcagcgagtgccacagcaatgccacctgcacagaagatgaggccgtgaccacctgcacctgccaggagggcttcaccggagatggcctgacctgtgtggacctggatgaatgtgccatccctggggcccacaactgcagcgccaacagcagctgtgtgaacaccccaggcagcttcagctgtgtgtgcccagagggcttccggctgagccctggcctgggctgcacagatgtggatgaatgtgccgagcccggcctgagccactgccacgccctggccacctgtgtgaatgtggtgggcagctgtggccctggcctggactgtgtgcctgaaggagatgccctggtgtgtgccgacccctgccaggcccacaggaccctggatgagtactggaggagcacagaatatggagagggctacgcctgtgacacagacctgcggggctggtacagatttgtgggccagggcggggccaggatggccgagacctgtgtgcctgtgctgcgctgcaacacagctgcccccatgtggctgaatggcacccaccccagcagtgatgagggcatcgtgtccaggaaggcctgtgcccactggagcggccactgctgcctgtgggatgcctctgtgcaggtgaaggcctgtgccggcggctactacgtgtacaacctgacagcccccccagagtgccacctggcctactgcacagaccccagctctgtggagggcacctgtgaagaatgttccattgatgaggactgcaagagcaacaacggccgctggcactgccagtgcaagcaggacttcaacatcacagacatcagcctgctggagcaccggctggagtgtggggccaatgacatgaaggtgtccctgggcaagtgccagctgaagagcctgggctttgacaaggtgttcatgtacctgagtgacagccgctgcagcggcttcaatgaccgggacaacagagactgggtgtctgtggtgaccccagccagagatggcccctgtggcaccgtgctgaccagaaatgagacccacgccacctacagcaacaccctgtacctggctgatgagatcatcatccgggacctgaacatcaagatcaactttgcctgcagctaccccctggacatgaaggtgtccctgaagacagccctgcagcccatggtgtctgccctgaacatccgggtgggcggcaccggcatgttcaccgtgaggatggccctcttccagacccccagctacacccagccctaccagggcagctctgtgaccctgagcacagaggccttcctgtatgtgggcaccatgctggatggaggagacctgagcagatttgccctgctgatgaccaactgctacgccacccccagcagcaatgccacagaccccctgaagtacttcatcatccaggaccgctgcccccacacccgggacagcaccatccaggtggtggagaatggagagagcagccagggccgcttctctgtgcagatgttccgctttgctggcaactatgacctggtgtacctgcactgtgaggtgtacctgtgtgacaccatgaatgagaagtgcaagcccacctgcagcggcacccgcttccgcagcggctctgtgattgaccagagccgggtgctgaacctgggccccatcaccaggaaaggagtgcaggccaccgtgtcccgggccttcagcagcctgggcctgctgaaggtgtggctgcccctgctgctgagcgccaccctgaccctgaccttccagtag

SEQ ID NO: 175577 - DNA, 759 bp, Artificial Sequence
  Description of Artificial Sequence: Synthetic coding sequence
atggccccagccccccaggcccctgagcgggaccctgtgggctcctggtacaacgtgaccatcctggtgaagatggacttcaaggagctgcagcaggtggacccccggctgctgaaccacatgaggctgctgcacagcctggtgaccagcgccctgcagcccatggccagcacagtgcaccacctgcacagcgcccctggaaatgccagcaccaccgtgtcccggctgctgctgggcctgccccggcccctgcctgtggctgatgtgtccaccctgctgggggacatcgccaagagggtgtatgaagtcatctctgtgcaggtgcaggatgtgaatgaatgcttctatgaggagctgaatgcctgcagcggccgggagctgtgtgccaacctggagggcagctactggtgtgtgtgccaccaggaggccccagccaccagccccaggaagctgaacctggagtgggaggactgcccccctgtgtctgactatgtggtgctgaatgtgaccagtgacagcttccaggtgtcctggaggctgaacagcacccagaaccacaccttccacgtgcgggtgtaccggggcatggagctgctgcggagcgcccggacccagagccaggccctggccgtggccggcctggaggccggcgtgctgtacagagtgaagaccagctaccagggctgtggggctgatgtgtccaccaccctgaccatcaagaccaagtatgtgctggagaagctggacttccagagctag

SEQ ID NO: 175578 - DNA, 555 bp, Artificial Sequence
  Description of Artificial Sequence: Synthetic coding sequence
atggccccagccccccaggcccctgagcgggaccctgtgggctcctggtacaacgtgaccatcctggtgaagatggacttcaaggagctgcagcaggtggacccccggctgctgaaccacatgaggctgctgcacagcctggtgaccagcgccctgcagcccatggccagcacagtgcaccacctgcacagcgcccctggaaatgccagcaccaccgtgtcccggctgctgctgggcctgccccggcccctgcctgtggctgatgtgtccaccctgctgggggacatcgccaagagggtgtatgaagtcatctctgtgcaggtgcaggatgtgaatgaatgcttctatgaggagctgaatgcctgcagcggccgggagctgtgtgccaacctggagggcagctactggtgtgtgtgccaccaggaggccccagccaccagccccaggaagctgaacctggagtgggaggcccggggcctggagatccacctggagctgcgggccaccagcaccagccacggcacccccctgagcagcgctgagaactgcctgtag

SEQ ID NO: 175579 - DNA, 3741 bp, Artificial Sequence
  Description of Artificial Sequence: Synthetic coding sequence
atggtgtaccgcacccagtacctggtggtggaggtgcctgagagcagaaatgtgacagactgctgtgagggctatgagcagctgggcctgtactgtgtgctgcccctgaaccagagcggccagttcaccagcaggcctggggcctgcccagctgagggccctgagcccagcaccagcccctgcagcctggacatcgactgccccggcctggagaagtgctgcccctggagcggcggccgctactgcatggccccagccccccaggcccctgagcgggaccctgtgggctcctggtacaacgtgaccatcctggtgaagatggacttcaaggagctgcagcaggtggacccccggctgctgaaccacatgaggctgctgcacagcctggtgaccagcgccctgcagcccatggccagcacagtgcaccacctgcacagcgcccctggaaatgccagcaccaccgtgtcccggctgctgctgggcctgccccggcccctgcctgtggctgatgtgtccaccctgctgggggacatcgccaagagggtgtatgaagtcatctctgtgcaggtgcaggatgtgaatgaatgcttctatgaggagctgaatgcctgcagcggccgggagctgtgtgccaacctggagggcagctactggtgtgtgtgccaccaggaggccccagccaccagccccaggaagctgaacctggagtgggaggactgcccccctgtgtctgactatgtggtgctgaatgtgaccagtgacagcttccaggtgtcctggaggctgaacagcacccagaaccacaccttccacgtgcgggtgtaccggggcatggagctgctgcggagcgcccggacccagagccaggccctggccgtggccggcctggaggccggcgtgctgtacagagtgaagaccagctaccagggctgtggggctgatgtgtccaccaccctgaccatcaagaccaatgcccaggtgtttgaggtgaccatcaagatcgtgaaccacaacctgacagagaagctgctgaacagaagctctgtggagtaccaggacttcagccggcagctgctgcacgaggtggagagcagcttcccccctgtggtgtctgacctgtaccgcagcggcaagctgaggatgcagatcgtgtccctgcaggccggctctgtggtggtgcggctgaagctgactgtgcaggaccccggcttccccatgggcatcagcaccctggcccccatcctgcagcccctgctggccagcaccgtcttccagattgaccggcagggcaccagggtgcaggactgggatgaatgtgtggacagcgctgagcatgactgcagccctgctgcctggtgcatcaacctggagggcagctacacctgccagtgcaggaccaccagagatgccacccccagcagagctggccgggcctgtgagggggacctggtgagccccatgggcggcggcctgtctgctgccactggagtgacagtgcccggcctgggcaccggcacagctgccctgggcctggagaacttcaccctgagccccagccctggctacccccagggcaccccagctgctggccaggcctggaccccagagcccagcccccggcggggcggcagcaatgtggtgggctatgacaggaacaacacaggcaagggcgtggagcaggagctgcagggcaacagcatcatggagccccccagctggcccagccccacagaggaccccaccggccacttcctgtggcacgccaccaggagcacccgggagaccctgctgaaccccacctggctgagaaatgaagattctggccccagcggctctgtggacctgcccctgaccagcaccctgacagccctgaagaccccagcctgtgtgcctgtgtccatcggccgcatcatggtgtccaatgtgaccagcacaggcttccacctggcctgggaggccgacctggccatggacagcaccttccagctgaccctgacctccatgtggagccctgctgtggtgctggagacctggaacacctctgtgaccctgagcggcctggagcccggggtgctgcacctggtggagatcatggccaaggcctgtgggaaggagggcgcccgggcccacctgaaggtgaggacagctgccaggaagctgattggcaaggtgcgcatcaagaatgtgcgctacagcgagagcttcagaaatgccagcagccaggagtacagagacttcctggagctgttcttcaggatggtgcggggcagcctgcctgccaccatgtgccagcacatggatgctgggggcgtgaggatggaggtggtgtctgtgaccaacggcagcatcgtggtggagttccacctgctgatcatcgcagatgtggatgtgcaggaggtgtctgctgccttcctgacagccttccagacagtgcccctgctggaggtgatccggggggacaccttcatccaggactatgatgaatgtgagaggaaagaagatgactgtgtgcccggcaccagctgcaggaacaccctgggcagcttcacctgcagctgtgagggcggggccccagacttccctgtggagtacagcgagcggccctgtgagggggacagccctggaaatgagacctgggccaccagccctgagcggcccctgaccacagctggcaccaaggccgcctttgtgcagggcaccagccccaccccccagggcctgccccagaggctgaacctgaccggggctgtgcgggtgctgtgtgaaattgagaaggtggtggtggccatccagaagcgcttcctgcagcaggagagcatccctgagagcagcctgtacctgagccaccccagctgcaatgtgagccacagcaatggcacccacgtgctgctggaggccggctggagcgaatgtggcaccctgatgcagagcaacatgaccaacacagtggtgaggaccaccctgagaaatgacctgagccaggagggcatcatccaccacctgaagatcctgagccccatctactgtgccttccagaatgacctgctgaccagcagcggcttcaccctggagtggggcgtgtacaccatcatcgaggacctgcatggagctggcaactttgtgacagagatgcagctgttcatcggggacagccccatcccccagaactacagcgtgtctgccagtgatgatgtgagaattgaggtgggcctgtaccggcagaagagcaacctgaaggtggtgctgacagagtgctgggccacccccagcagcaatgcccgggaccccatcaccttctccttcatcaacaacagctgccctgtgcccaacacctacaccaacgtgattgaaaatggaaacagcaacaaggcccagttcaagctgcgcatcttctccttcatcaatgacagcatcgtgtacctgcactgcaagctgcgggtgtgcatggagagccctggggccacctgcaagatcaactgcaacaacttccggctgctgcagaacagcgagaccagcgccacccaccagatgtcctggggccccctcatccgctctgagggggagccccctcatgctgaggccggcctgggcgccggctacgtggtgctgattgtggtggccatctttgtgctggtggccggcacagccaccctgctgattgtgcgctaccagaggatgaatggccgctacaacttcaagatccagagcaacaacttctcctaccaggtgttctatgaatag

SEQ ID NO: 175580 - DNA, 4125 bp, Artificial Sequence
  Description of Artificial Sequence: Synthetic coding sequence
atggtgtaccgcacccagtacctggtggtggaggtgcctgagagcagaaatgtgacagactgctgtgagggctatgagcagctgggcctgtactgtgtgctgcccctgaaccagagcggccagttcaccagcaggcctggggcctgcccagctgagggccctgagcccagcaccagcccctgcagcctggacatcgactgccccggcctggagaagtgctgcccctggagcggcggccgctactgcatggccccagccccccaggcccctgagcgggaccctgtgggctcctggtacaacgtgaccatcctggtgaagatggacttcaaggagctgcagcaggtggacccccggctgctgaaccacatgaggctgctgcacagcctggtgaccagcgccctgcagcccatggccagcacagtgcaccacctgcacagcgcccctggaaatgccagcaccaccgtgtcccggctgctgctgggcctgccccggcccctgcctgtggctgatgtgtccaccctgctgggggacatcgccaagagggtgtatgaagtcatctctgtgcaggtgcaggatgtgaatgaatgcttctatgaggagctgaatgcctgcagcggccgggagctgtgtgccaacctggagggcagctactggtgtgtgtgccaccaggaggccccagccaccagccccaggaagctgaacctggagtgggaggactgcccccctgtgtctgactatgtggtgctgaatgtgaccagtgacagcttccaggtgtcctggaggctgaacagcacccagaaccacaccttccacgtgcgggtgtaccggggcatggagctgctgcggagcgcccggacccagagccaggccctggccgtggccggcctggaggccggcgtgctgtacagagtgaagaccagctaccagggctgtggggctgatgtgtccaccaccctgaccatcaagaccaatgcccaggtgtttgaggtgaccatcaagatcgtgaaccacaacctgacagagaagctgctgaacagaagctctgtggagtaccaggacttcagccggcagctgctgcacgaggtggagagcagcttcccccctgtggtgtctgacctgtaccgcagcggcaagctgaggatgcagatcgtgtccctgcaggccggctctgtggtggtgcggctgaagctgactgtgcaggaccccggcttccccatgggcatcagcaccctggcccccatcctgcagcccctgctggccagcaccgtcttccagattgaccggcagggcaccagggtgcaggactgggatgaatgtgtggacagcgctgagcatgactgcagccctgctgcctggtgcatcaacctggagggcagctacacctgccagtgcaggaccaccagagatgccacccccagcagagctggccgggcctgtgagggggacctggtgagccccatgggcggcggcctgtctgctgccactggagtgacagtgcccggcctgggcaccggcacagctgccctgggcctggagaacttcaccctgagccccagccctggctacccccagggcaccccagctgctggccaggcctggaccccagagcccagcccccggcggggcggcagcaatgtggtgggctatgacaggaacaacacaggcaagggcgtggagcaggaggtgcccagcacagcccctggcctgggcatggaccagggcagccccagccaggtgaaccccagccagggcagccccagccagggcagcctgcggcaggagagcaccagccaggccagccccagccagaggagcaccagccagggcagccccagccaggtgaaccccagccagaggagcaccagccacgccaacagcagccagggcagccccagccagggcagccccagccaggagagccccagccagggcagcaccagccaggccagccccagccacaggaacaccatcggggtcatcggcaccaccagcagccccaaggccaccggcagcacccacagcttccccccaggggccacagatggccccctggccctgcccggccagctgcagggcaacagcatcatggagccccccagctggcccagccccacagaggaccccaccggccacttcctgtggcacgccaccaggagcacccgggagaccctgctgaaccccacctggctgagaaatgaagattctggccccagcggctctgtggacctgcccctgaccagcaccctgacagccctgaagaccccagcctgtgtgcctgtgtccatcggccgcatcatggtgtccaatgtgaccagcacaggcttccacctggcctgggaggccgacctggccatggacagcaccttccagctgaccctgacctccatgtggagccctgctgtggtgctggagacctggaacacctctgtgaccctgagcggcctggagcccggggtgctgcacctggtggagatcatggccaaggcctgtgggaaggagggcgcccgggcccacctgaaggtgaggacagctgccaggaagctgattggcaaggtgcgcatcaagaatgtgcgctacagcgagagcttcagaaatgccagcagccaggagtacagagacttcctggagctgttcttcaggatggtgcggggcagcctgcctgccaccatgtgccagcacatggatgctgggggcgtgaggatggaggtggtgtctgtgaccaacggcagcatcgtggtggagttccacctgctgatcatcgcagatgtggatgtgcaggaggtgtctgctgccttcctgacagccttccagacagtgcccctgctggaggtgatccggggggacaccttcatccaggactatgatgaatgtgagaggaaagaagatgactgtgtgcccggcaccagctgcaggaacaccctgggcagcttcacctgcagctgtgagggcggggccccagacttccctgtggagtacagcgagcggccctgtgagggggacagccctggaaatgagacctgggccaccagccctgagcggcccctgaccacagctggcaccaaggccgcctttgtgcagggcaccagccccaccccccagggcctgccccagaggctgaacctgaccggggctgtgcgggtgctgtgtgaaattgagaaggtggtggtggccatccagaagcgcttcctgcagcaggagagcatccctgagagcagcctgtacctgagccaccccagctgcaatgtgagccacagcaatggcacccacgtgctgctggaggccggctggagcgaatgtggcaccctgatgcagagcaacatgaccaacacagtggtgaggaccaccctgagaaatgacctgagccaggagggcatcatccaccacctgaagatcctgagccccatctactgtgccttccagaatgacctgctgaccagcagcggcttcaccctggagtggggcgtgtacaccatcatcgaggacctgcatggagctggcaactttgtgacagagatgcagctgttcatcggggacagccccatcccccagaactacagcgtgtctgccagtgatgatgtgagaattgaggtgggcctgtaccggcagaagagcaacctgaaggtggtgctgacagagtgctgggccacccccagcagcaatgcccgggaccccatcaccttctccttcatcaacaacagctgccctgtgcccaacacctacaccaacgtgattgaaaatggaaacagcaacaaggcccagttcaagctgcgcatcttctccttcatcaatgacagcatcgtgtacctgcactgcaagctgcgggtgtgcatggagagccctggggccacctgcaagatcaactgcaacaacttccggctgctgcagaacagcgagaccagcgccacccaccagatgtcctggggccccctcatccgctctgagggggagccccctcatgctgaggccggcctgggcgccggctacgtggtgctgattgtggtggccatctttgtgctggtggccggcacagccaccctgctgattgtgcgctaccagaggatgaatggccgctacaacttcaagatccagagcaacaacttctcctaccaggtgttctatgaatag

SEQ ID NO: 175581 - DNA, 3957 bp, Artificial Sequence
  Description of Artificial Sequence: Synthetic coding sequence
atgctgcggaccagcggcctggccctgctggccctggtgtctgctgtgggccccagccaggccagcggcttcacagagaagggcctgagcctgctgggctaccagctgtgcagccaccgggtgacccacacagtgcagaaggtggaggccgtgcagaccagctacaccagctatgtgtcctgtggcggctggatcccctggaggcgctgccccaagatggtgtaccgcacccagtacctggtggtggaggtgcctgagagcagaaatgtgacagactgctgtgagggctatgagcagctgggcctgtactgtgtgctgcccctgaaccagagcggccagttcaccagcaggcctggggcctgcccagctgagggccctgagcccagcaccagcccctgcagcctggacatcgactgccccggcctggagaagtgctgcccctggagcggcggccgctactgcatggccccagccccccaggcccctgagcgggaccctgtgggctcctggtacaacgtgaccatcctggtgaagatggacttcaaggagctgcagcaggtggacccccggctgctgaaccacatgaggctgctgcacagcctggtgaccagcgccctgcagcccatggccagcacagtgcaccacctgcacagcgcccctggaaatgccagcaccaccgtgtcccggctgctgctgggcctgccccggcccctgcctgtggctgatgtgtccaccctgctgggggacatcgccaagagggtgtatgaagtcatctctgtgcaggtgcaggatgtgaatgaatgcttctatgaggagctgaatgcctgcagcggccgggagctgtgtgccaacctggagggcagctactggtgtgtgtgccaccaggaggccccagccaccagccccaggaagctgaacctggagtgggaggactgcccccctgtgtctgactatgtggtgctgaatgtgaccagtgacagcttccaggtgtcctggaggctgaacagcacccagaaccacaccttccacgtgcgggtgtaccggggcatggagctgctgcggagcgcccggacccagagccaggccctggccgtggccggcctggaggccggcgtgctgtacagagtgaagaccagctaccagggctgtggggctgatgtgtccaccaccctgaccatcaagaccaatgcccaggtgtttgaggtgaccatcaagatcgtgaaccacaacctgacagagaagctgctgaacagaagctctgtggagtaccaggacttcagccggcagctgctgcacgaggtggagagcagcttcccccctgtggtgtctgacctgtaccgcagcggcaagctgaggatgcagatcgtgtccctgcaggccggctctgtggtggtgcggctgaagctgactgtgcaggaccccggcttccccatgggcatcagcaccctggcccccatcctgcagcccctgctggccagcaccgtcttccagattgaccggcagggcaccagggtgcaggactgggatgaatgtgtggacagcgctgagcatgactgcagccctgctgcctggtgcatcaacctggagggcagctacacctgccagtgcaggaccaccagagatgccacccccagcagagctggccgggcctgtgagggggacctggtgagccccatgggcggcggcctgtctgctgccactggagtgacagtgcccggcctgggcaccggcacagctgccctgggcctggagaacttcaccctgagccccagccctggctacccccagggcaccccagctgctggccaggcctggaccccagagcccagcccccggcggggcggcagcaatgtggtgggctatgacaggaacaacacaggcaagggcgtggagcaggagctgcagggcaacagcatcatggagccccccagctggcccagccccacagaggaccccaccggccacttcctgtggcacgccaccaggagcacccgggagaccctgctgaaccccacctggctgagaaatgaagattctggccccagcggctctgtggacctgcccctgaccagcaccctgacagccctgaagaccccagcctgtgtgcctgtgtccatcggccgcatcatggtgtccaatgtgaccagcacaggcttccacctggcctgggaggccgacctggccatggacagcaccttccagctgaccctgacctccatgtggagccctgctgtggtgctggagacctggaacacctctgtgaccctgagcggcctggagcccggggtgctgcacctggtggagatcatggccaaggcctgtgggaaggagggcgcccgggcccacctgaaggtgaggacagctgccaggaagctgattggcaaggtgcgcatcaagaatgtgcgctacagcgagagcttcagaaatgccagcagccaggagtacagagacttcctggagctgttcttcaggatggtgcggggcagcctgcctgccaccatgtgccagcacatggatgctgggggcgtgaggatggaggtggtgtctgtgaccaacggcagcatcgtggtggagttccacctgctgatcatcgcagatgtggatgtgcaggaggtgtctgctgccttcctgacagccttccagacagtgcccctgctggaggtgatccggggggacaccttcatccaggactatgatgaatgtgagaggaaagaagatgactgtgtgcccggcaccagctgcaggaacaccctgggcagcttcacctgcagctgtgagggcggggccccagacttccctgtggagtacagcgagcggccctgtgagggggacagccctggaaatgagacctgggccaccagccctgagcggcccctgaccacagctggcaccaaggccgcctttgtgcagggcaccagccccaccccccagggcctgccccagaggctgaacctgaccggggctgtgcgggtgctgtgtgaaattgagaaggtggtggtggccatccagaagcgcttcctgcagcaggagagcatccctgagagcagcctgtacctgagccaccccagctgcaatgtgagccacagcaatggcacccacgtgctgctggaggccggctggagcgaatgtggcaccctgatgcagagcaacatgaccaacacagtggtgaggaccaccctgagaaatgacctgagccaggagggcatcatccaccacctgaagatcctgagccccatctactgtgccttccagaatgacctgctgaccagcagcggcttcaccctggagtggggcgtgtacaccatcatcgaggacctgcatggagctggcaactttgtgacagagatgcagctgttcatcggggacagccccatcccccagaactacagcgtgtctgccagtgatgatgtgagaattgaggtgggcctgtaccggcagaagagcaacctgaaggtggtgctgacagagtgctgggccacccccagcagcaatgcccgggaccccatcaccttctccttcatcaacaacagctgccctgtgcccaacacctacaccaacgtgattgaaaatggaaacagcaacaaggcccagttcaagctgcgcatcttctccttcatcaatgacagcatcgtgtacctgcactgcaagctgcgggtgtgcatggagagccctggggccacctgcaagatcaactgcaacaacttccggctgctgcagaacagcgagaccagcgccacccaccagatgtcctggggccccctcatccgctctgagggggagccccctcatgctgaggccggcctgggcgccggctacgtggtgctgattgtggtggccatctttgtgctggtggccggcacagccaccctgctgattgtgcgctaccagaggatgaatggccgctacaacttcaagatccagagcaacaacttctcctaccaggtgttctatgaatag

SEQ ID NO: 175582 - DNA, 4341 bp, Artificial Sequence
  Description of Artificial Sequence: Synthetic coding sequence
atgctgcggaccagcggcctggccctgctggccctggtgtctgctgtgggccccagccaggccagcggcttcacagagaagggcctgagcctgctgggctaccagctgtgcagccaccgggtgacccacacagtgcagaaggtggaggccgtgcagaccagctacaccagctatgtgtcctgtggcggctggatcccctggaggcgctgccccaagatggtgtaccgcacccagtacctggtggtggaggtgcctgagagcagaaatgtgacagactgctgtgagggctatgagcagctgggcctgtactgtgtgctgcccctgaaccagagcggccagttcaccagcaggcctggggcctgcccagctgagggccctgagcccagcaccagcccctgcagcctggacatcgactgccccggcctggagaagtgctgcccctggagcggcggccgctactgcatggccccagccccccaggcccctgagcgggaccctgtgggctcctggtacaacgtgaccatcctggtgaagatggacttcaaggagctgcagcaggtggacccccggctgctgaaccacatgaggctgctgcacagcctggtgaccagcgccctgcagcccatggccagcacagtgcaccacctgcacagcgcccctggaaatgccagcaccaccgtgtcccggctgctgctgggcctgccccggcccctgcctgtggctgatgtgtccaccctgctgggggacatcgccaagagggtgtatgaagtcatctctgtgcaggtgcaggatgtgaatgaatgcttctatgaggagctgaatgcctgcagcggccgggagctgtgtgccaacctggagggcagctactggtgtgtgtgccaccaggaggccccagccaccagccccaggaagctgaacctggagtgggaggactgcccccctgtgtctgactatgtggtgctgaatgtgaccagtgacagcttccaggtgtcctggaggctgaacagcacccagaaccacaccttccacgtgcgggtgtaccggggcatggagctgctgcggagcgcccggacccagagccaggccctggccgtggccggcctggaggccggcgtgctgtacagagtgaagaccagctaccagggctgtggggctgatgtgtccaccaccctgaccatcaagaccaatgcccaggtgtttgaggtgaccatcaagatcgtgaaccacaacctgacagagaagctgctgaacagaagctctgtggagtaccaggacttcagccggcagctgctgcacgaggtggagagcagcttcccccctgtggtgtctgacctgtaccgcagcggcaagctgaggatgcagatcgtgtccctgcaggccggctctgtggtggtgcggctgaagctgactgtgcaggaccccggcttccccatgggcatcagcaccctggcccccatcctgcagcccctgctggccagcaccgtcttccagattgaccggcagggcaccagggtgcaggactgggatgaatgtgtggacagcgctgagcatgactgcagccctgctgcctggtgcatcaacctggagggcagctacacctgccagtgcaggaccaccagagatgccacccccagcagagctggccgggcctgtgagggggacctggtgagccccatgggcggcggcctgtctgctgccactggagtgacagtgcccggcctgggcaccggcacagctgccctgggcctggagaacttcaccctgagccccagccctggctacccccagggcaccccagctgctggccaggcctggaccccagagcccagcccccggcggggcggcagcaatgtggtgggctatgacaggaacaacacaggcaagggcgtggagcaggaggtgcccagcacagcccctggcctgggcatggaccagggcagccccagccaggtgaaccccagccagggcagccccagccagggcagcctgcggcaggagagcaccagccaggccagccccagccagaggagcaccagccagggcagccccagccaggtgaaccccagccagaggagcaccagccacgccaacagcagccagggcagccccagccagggcagccccagccaggagagccccagccagggcagcaccagccaggccagccccagccacaggaacaccatcggggtcatcggcaccaccagcagccccaaggccaccggcagcacccacagcttccccccaggggccacagatggccccctggccctgcccggccagctgcagggcaacagcatcatggagccccccagctggcccagccccacagaggaccccaccggccacttcctgtggcacgccaccaggagcacccgggagaccctgctgaaccccacctggctgagaaatgaagattctggccccagcggctctgtggacctgcccctgaccagcaccctgacagccctgaagaccccagcctgtgtgcctgtgtccatcggccgcatcatggtgtccaatgtgaccagcacaggcttccacctggcctgggaggccgacctggccatggacagcaccttccagctgaccctgacctccatgtggagccctgctgtggtgctggagacctggaacacctctgtgaccctgagcggcctggagcccggggtgctgcacctggtggagatcatggccaaggcctgtgggaaggagggcgcccgggcccacctgaaggtgaggacagctgccaggaagctgattggcaaggtgcgcatcaagaatgtgcgctacagcgagagcttcagaaatgccagcagccaggagtacagagacttcctggagctgttcttcaggatggtgcggggcagcctgcctgccaccatgtgccagcacatggatgctgggggcgtgaggatggaggtggtgtctgtgaccaacggcagcatcgtggtggagttccacctgctgatcatcgcagatgtggatgtgcaggaggtgtctgctgccttcctgacagccttccagacagtgcccctgctggaggtgatccggggggacaccttcatccaggactatgatgaatgtgagaggaaagaagatgactgtgtgcccggcaccagctgcaggaacaccctgggcagcttcacctgcagctgtgagggcggggccccagacttccctgtggagtacagcgagcggccctgtgagggggacagccctggaaatgagacctgggccaccagccctgagcggcccctgaccacagctggcaccaaggccgcctttgtgcagggcaccagccccaccccccagggcctgccccagaggctgaacctgaccggggctgtgcgggtgctgtgtgaaattgagaaggtggtggtggccatccagaagcgcttcctgcagcaggagagcatccctgagagcagcctgtacctgagccaccccagctgcaatgtgagccacagcaatggcacccacgtgctgctggaggccggctggagcgaatgtggcaccctgatgcagagcaacatgaccaacacagtggtgaggaccaccctgagaaatgacctgagccaggagggcatcatccaccacctgaagatcctgagccccatctactgtgccttccagaatgacctgctgaccagcagcggcttcaccctggagtggggcgtgtacaccatcatcgaggacctgcatggagctggcaactttgtgacagagatgcagctgttcatcggggacagccccatcccccagaactacagcgtgtctgccagtgatgatgtgagaattgaggtgggcctgtaccggcagaagagcaacctgaaggtggtgctgacagagtgctgggccacccccagcagcaatgcccgggaccccatcaccttctccttcatcaacaacagctgccctgtgcccaacacctacaccaacgtgattgaaaatggaaacagcaacaaggcccagttcaagctgcgcatcttctccttcatcaatgacagcatcgtgtacctgcactgcaagctgcgggtgtgcatggagagccctggggccacctgcaagatcaactgcaacaacttccggctgctgcagaacagcgagaccagcgccacccaccagatgtcctggggccccctcatccgctctgagggggagccccctcatgctgaggccggcctgggcgccggctacgtggtgctgattgtggtggccatctttgtgctggtggccggcacagccaccctgctgattgtgcgctaccagaggatgaatggccgctacaacttcaagatccagagcaacaacttctcctaccaggtgttctatgaatag

SEQ ID NO: 175583 - DNA, 234 bp, Artificial Sequence
  Description of Artificial Sequence: Synthetic coding sequence
cctgtgggctcctggtacaacgtgaccatcctggtgaagatggacttcaaggagctgcagcaggtggacccccggctgctgaaccacatgaggctgctgcacagcctgatgtccatgtctgtgtccatgaggagctccatgcctgccctggagggcaactgtgcccagacctggagggccaggactggagcctctgtgaccaggaagctgcagccccggctgcacggcagctag

SEQ ID NO: 175584 - DNA, 411 bp, Artificial Sequence
  Description of Artificial Sequence: Synthetic coding sequence
atgcagctgttcatcggggacagccccatcccccagaactacagcgtgtctgccagtgatgatgtgcgcatcgaggtgggcctgtaccggcagaagagcaacctgaaggtggtgctgacagagtgctgggccacccccagcagcaatgcccgggaccccatcaccttctccttcatcaacaacagctgccctgtgcccaacacctacaccaacgtgattgaaaatggaaacagcaacaaggcccagttcaagctgcgcatcttctccttcatcaatgacagcatcgtgtacctgcactgcaagctgcgggtgtgcatggagagccctggggccacctgcaagattgctgccctgggccgccgcacccacgtggactggtgggccttccccatcagccagtggctgtcctag

SEQ ID NO: 175585 - DNA, 1221 bp, Artificial Sequence
  Description of Artificial Sequence: Synthetic coding sequence
atgaagaagaagcagcagcaccctgggggcggcgctgacccctggccccatggagcccccatgggcggggcccctcctggcctgggctcctggaagagaagagtgcccctgctgcccttcctgcgcttcagcctgcgggactatggcttctgcatggccaccctgctggtgttctgcctgggcagcctgctgtaccagctgagcggcggccccccacgcttcctgctggacctgcggcagtacctgggcaacagcacctacctggatgaccacggccccccacccagcaaggtgctgcccttccccagccaggtggtgtacaacagagtgggcaaatgtggcagcaggacagtggtgctgctgctgcgcatcctgtctgagaagcacggcttcaacctggtgaccagtgacatccacaacaagacccggctgaccaagaatgagcagatggagctgatcaagaacatcagcacagctgagcagccctacctgttcaccaggcatgtgcacttcctgaacttcagcagatttggaggagaccagcctgtgtacatcaacatcatccgggaccctgtgaaccgcttcctgagcaactacttcttccgccgctttggagactggagaggagagcagaaccacatgatccgcacccccagcatgaggcaggaggagcgctacctggacatcaatgaatgcatcctggagaactacccagaatgtagcaaccccaggctcttctacatcatcccctacttctgtggccagcacccccgctgccgggagcccggggagtgggccctggagcgggccaagctgaatgtgaatgaaaacttcctgctggtgggcatcctggaggagctggaggatgtgctgctgctgctggagcgcttcctgccccactacttcaagggcgtgctgagcatctacaaggaccctgagcacaggaagctgggcaacatgacagtgacagtgaagaagacagtgcccagccctgaggccgtgcagatcctgtaccagaggatgagatatgaatatgagttctaccactacgtgaaggagcagttccacctgctgaagaggaagtttggcctgaagagccacgtgtccaagccacccctgcggccccacttcttcatccccacccccctggagacagaggagcccattgatgatgaggagcaggatgatgagaagtggctggaggacatctacaagaggtag

SEQ ID NO: 175586 - DNA, 2274 bp, Artificial Sequence
  Description of Artificial Sequence: Synthetic coding sequence
atggtgcctgacacagcctgtgtgctgctgctgaccctggccgccctgggcgccagcggccagggccagagccccctgggcagtgacctgggcccccagatgctgcgggagctgcaggagaccaatgctgccctgcaggatgtgcgggagctgctgcggcagcaggtgcgggagatcaccttcctgaagaacacagtgatggagtgtgatgcctgtggcatgcagcagagcgtgaggacaggcctgcccagcgtgcggcccctgctgcactgtgcccctggcttctgcttccctggggtggcctgcatccagacagaaagtggggcccgctgtggcccctgcccagctggcttcaccggaaatggcagccactgcacagatgtgaatgaatgtaatgcccacccctgcttcccccgggtgcgctgcatcaacaccagccctggcttccgctgtgaggcctgccccccaggctacagcggccccacccaccagggcgtgggcctggcctttgccaaggccaacaagcaggtgtgcacagacatcaatgaatgtgagaccggccagcacaactgtgtgcccaacagcgtgtgcatcaacacccggggcagcttccagtgtggcccctgccagcccggctttgtgggggaccaggccagcggctgccagaggcgggcccagcgcttctgcccagatggcagccccagcgagtgccacgagcacgccgactgtgtgctggagagagatggcagccgcagctgtgtgtgtgctgtgggctgggccggaaatggcatcctgtgtggccgggacacagacctggatggcttcccagatgagaagctgcgctgcccagagcggcagtgcaggaaggacaactgtgtgacagtgcccaacagcggccaggaggatgtggacagagatggcattggagatgcctgtgaccctgatgctgatggagatggagtgcccaatgagaaggacaactgccccctggtgaggaacccagaccagaggaacacagatgaggacaagtggggagatgcctgtgacaactgccgcagccagaagaatgatgaccagaaggacacagaccaggacggcagaggagatgcctgtgatgatgacattgatggagaccgcatccggaaccaggccgacaactgcccccgggtgcccaacagcgaccagaaggacagtgatggagatggcattggagatgcctgtgacaactgcccccagaagagcaacccagaccaggctgatgtggaccatgactttgtgggagatgcctgtgacagcgaccaggaccaggatggagatggccaccaggacagccgggacaactgccccaccgtgcccaacagcgcccaggaggacagcgaccatgatggccagggagatgcctgtgatgatgatgatgacaatgatggagtgcctgacagccgggacaactgccgcctggtgcccaaccctggccaggaggatgctgacagagatggagtgggagatgtgtgccaggatgactttgatgctgacaaggtggtggacaagattgatgtgtgcccagaaaatgctgaggtgaccctgacagacttccgggccttccagacagtggtgctggaccctgaaggagatgcccagattgaccccaactgggtggtgctgaaccagggccgggagatcgtgcagaccatgaacagcgaccccggcctggccgtgggctacacagccttcaacggggtggactttgagggcaccttccacgtgaacacagtgacagatgatgattatgccggcttcatcttcggctaccaggacagcagcagcttctacgtggtgatgtggaagcagatggagcagacctactggcaggccaaccccttccgggctgtggccgagcccggcatccagctgaaggctgtgaagagcagcacaggccctggagagcagctgagaaatgccctgtggcacactggagacacagagagccaggtgcggctgctgtggaaggaccccagaaatgtgggctggaaggacaagaagagctaccgctggttcctgcagcaccggccccaggtgggctacatccgggtgcgcttctatgagggccctgagctggtggccgacagcaatgtggtgctggacaccaccatgagaggaggccgcctgggcgtcttctgcttcagccaggagaacatcatctgggccaacctgcgctaccgctgcaatgacaccatcccagaagattatgagacccaccagctgcggcaggcctag

SEQ ID NO: 175587 - DNA, 822 bp, Artificial Sequence
  Description of Artificial Sequence: Synthetic coding sequence
atggccagcgctgctgctgctgaggccgagaagggcagccctgtggtggtgggcctgctggtggtgggcaacatcatcatcctgctgagcggcctgagcctgtttgctgagaccatctgggtgacagctgaccagtacagagtgtaccccctgatgggcgtgtctgggaaggatgatgtgtttgctggggcctggatcgccatcttctgtggcttctccttcttcatggtggccagctttggagtgggcgccgccctgtgcagaagaagatccatggtgctgacctacctggtgctgatgctgattgtgtacatctttgaatgtgccagctgcatcaccagctacacccaccgggactacatggtgagcaaccccagcctcatcaccaagcagatgctgaccttctacagcgctgacacagaccagggccaggagctgacccggctgtgggacagagtgatgattgagcaggagtgctgcggcaccagcggccccatggactgggtgaacttcaccagcgccttccgggccgccaccccagaggtggtgttcccctggccacccctgtgctgcagaagaacaggcaacttcatccccctgaatgaggagggctgccgcctgggccacatggactacctgttcaccaaggccggcgtgcagtggcacaacctgagcagcctgcagaggctgcccccaggcttcaagggcttcagccacctgtccttccagagctcctgggactaccgggccgccagcaacaccagcgccacccccagcacagccacccggggcgtgtcccggggcctgggcctgcccagctag

SEQ ID NO: 175588 - DNA, 783 bp, Artificial Sequence
  Description of Artificial Sequence: Synthetic coding sequence
atggccaaggacaacagcacagtgcgctgcttccagggcctgctgatctttggaaatgtcatcatcggctgctgcggcatcgccctgacagctgagtgcatcttctttgtgtctgaccagcacagcctgtaccccctgctggaggccacagacaatgatgacatctacggggccgcctggattggcatctttgtgggcatctgcctcttctgcctgtctgtgctgggcatcgtgggcatcatgaagagcagcaggaagatcctgctggcctacttcatcctgatgtttattgtgtatgcctttgaggtggccagctgcatcacagctgccacccagcaggacttcttcacccccaacctcttcctgaagcagatgctggagcgctaccagaacaacagcccccccaacaatgatgaccagtggaagaacaacggggtgaccaagacctgggaccggctgatgctgcaggacaactgctgcggcgtgaatggccccagcgactggcagaagtacaccagcgccttcagaacagagaacaatgatgctgactacccctggccccggcagtgctgcgtgatgaacaacctgaaggagcccctgaacctggaggcctgcaagctgggcgtgcccggcttctaccacaaccagggctgctatgagctgatcagcggccccatgaacagacatgcctggggcgtggcctggtttggatttgccatcctgtgctggaccttctgggtgctgctgggcaccatgttctactggagccgcatcgagtactag

SEQ ID NO: 175589 - DNA, 510 bp, Artificial Sequence
  Description of Artificial Sequence: Synthetic coding sequence
atggccaaggacaacagcacagtgcgctgcttccagggcctgctgatctttggaaatgtcatcatcggctgctgcggcatcgccctgacagctgagtgcatcttctttgtgtctgaccagcacagcctgtaccccctgctggaggccacagacaatgatgacatctacggggccgcctggattggcatctttgtgggcatctgcctcttctgcctgtctgtgctgggcatcgtgggcatcatgaagagcagcaggaagatcctgctggcctacttcatcctgatgtttattgtgtatgcctttgaggtggccagctgcatcacagctgccacccagcaggacttcttcacccccaacctcttcctgaagcagatgctggagcgctaccagaacaacagcccccccaacaatgatgaccagtggaagaacaacggggtgaccaagacctgggaccggctgatgctgcaggacaactgctgcggcgtgaatggccccagcgactggcagtag

SEQ ID NO: 175590 - DNA, 570 bp, Artificial Sequence
  Description of Artificial Sequence: Synthetic coding sequence
atggccaaggacaacagcacagtgcgctgcttccagggcctgctgatctttggaaatgtcatcatcggctgctgcggcatcgccctgacagctgagtgcatcttctttgtgtctgaccagcacagcctgtaccccctgctggaggccacagacaatgatgacatctacggggccgcctggattggcatctttgtgggcatctgcctcttctgcctgtctgtgctgggcatcgtgggcatcatgaagagcagcaggaagatcctgctggcctacttcatcctgatgtttattgtgtatgcctttgaggtggccagctgcatcacagctgccacccagcaggacttcttcacccccaacctcttcctgaagcagatgctggagcgctaccagaacaacagcccccccaacaatgatgaccagtggaagaacaacggggtgaccaagacctgggaccggctgatgctgcaggacaactgctgcggcgtgaatggccccagcgactggcagaagtacaccagcgccttcagaacagagaacaatgatgctgactacccctggccccggcagtag

SEQ ID NO: 175591 - DNA, 555 bp, Artificial Sequence
  Description of Artificial Sequence: Synthetic coding sequence
atggcccccctgctgcccatccgcaccctgcccctcatcctgatcctgctggccctgctgagccctggagctgctgacttcaacatcagcagcctgagcggcctgctgagccctgccctgacagagagcctgctggtggccctgcccccctgccacctgaccggcggcaatgccaccctgatggtgagaagagccaatgacagcaaggtggtgaccagcagctttgtggtgcccccctgccggggcagaagagagctggtgtctgtggtggacagcggggccggcttcaccgtgacccggctgagcgcctaccaggtgaccaacctggtgcccggcaccaagttctacatctcctacctggtgaagaagggcacagccacagagagcagccgggagatccccatgagcaccctgcccaggaggaacatggagagcatcggcctgggcatggccaggactggaggcatggtggtgatcaccgtgctgctgtctgtggccatgttcctgctggtgctgggcttcatcatcgccctggccctgggcagcaggaagtag

SEQ ID NO: 175592 - DNA, 333 bp, Artificial Sequence; identical to SEQ ID NO: 163314
  Description of Artificial Sequence: Synthetic coding sequence

SEQ ID NO: 175593 - DNA, 501 bp, Artificial Sequence
  Description of Artificial Sequence: Synthetic coding sequence
atgccacccctgtgggccctgctggccctgggctgcctgcgctttggatctgctgtgaacctgcagccccagctggcctctgtgacctttgccaccaacaaccccaccctgaccaccgtggccctggagaagcccctgtgcatgtttgacagcaaggaggccctgaccggcacccatgaggtgtacctgtatgtgctggtggacagcgtgaccccctacagcaccatcgacacctggccaggccgccgcagcggcggcatgatcgtcatcaccagcatcctgggcagcctgcccttcttcctgctggtgggctttgctggggccatcgccctgagcctggtggacatgggcagcagtgatggagagaccacccatgacagccagatcacccaggaggccgtgcccaagagcctgggcgccagcgagagcagctacacctctgtgaacagaggcccccccctggacagagctgaggtgtacagcagcaagctgcaggactag

SEQ ID NO: 175594 - DNA, 963 bp, Artificial Sequence
  Description of Artificial Sequence: Synthetic coding sequence
atgggcctgccctggggccagccccacctgggcctgcagatgctgctgctggccctgaactgcctgcggcccagcctgagcctgggggagtggggctcctggatggatgccagcagccagacccagggcgctgggggccctgctggggtgattggcccctgggccccagcccccctgcggctgggggaggccgcccctggcacccccacccctgtgtctgtggcccacctgctgagccctgtggccacagagctggtgccctacaccccccagatcacagcctgggacctggagggcaaggtgacagccaccaccttcagcctggagcagccccgctgtgtgtttgatggcctggccagcgccagtgacacagtgtggctggtggtggccttcagcaatgccagccggggcttccagaaccctgagaccctggccgacatcccagccagcccccagctgctgacagatggccactacatgaccctgcccctgagcccagaccagctgccctgtggggaccccatggccggcagcggcggggcccctgtgctgcgggtgggccatgaccacggctgccaccagcagcccttctgcaatgcccccctgcccggccctggcccctaccgggaggacccccgcatccaccgccacctggcccgggccgccaagtggcagcacgacagacactacctgcaccccctcttcagcggccggccccccaccctgggcctgctgggcagcctgtaccacgccctgctgcagcctgtggtggccggcggcggccctggagctgctgctgaccggctgctgcacggccaggccctgcatgaccccccccaccccacccagaggggccgccacacagctgggggcctgcaggcctggccaggccccccaccccagccccagcccctggcctggcccctgtgcatgggcctgggggagatgggccgctgggagtag

SEQ ID NO: 175595 - DNA, 831 bp, Artificial Sequence
  Description of Artificial Sequence: Synthetic coding sequence
atgggcctgccctggggccagccccacctgggcctgcagatgctgctgctggccctgaactgcctgcggcccagcctgagcctggagctggtgccctacaccccccagatcacagcctgggacctggagggcaaggtgacagccaccaccttcagcctggagcagccccgctgtgtgtttgatggcctggccagcgccagtgacacagtgtggctggtggtggccttcagcaatgccagccggggcttccagaaccctgagaccctggccgacatcccagccagcccccagctgctgacagatggccactacatgaccctgcccctgagcccagaccagctgccctgtggggaccccatggccggcagcggcggggcccctgtgctgcgggtgggccatgaccacggctgccaccagcagcccttctgcaatgcccccctgcccggccctggcccctacagagtgaagttcctgctgatggacacccggggcagccccagggctgagaccaagtggagcgaccccatcaccctgcaccagggcaagaccccaggcagcattgacacctggccaggaagaagaagtggctccatgatcgtcatcaccagcatcctgagcagcctggccggcctgctgctgctggccttcctggccgccagcaccatgaggttcagcagcctgtggtggccagaggaggcccctgagcagctgagaattggcagcttcatgggcaagcgctacatgacccaccacatccccccccgggaggccgccaccctgcctgtgggctgcaagccaggcctggaccccctgcccagcctgagcccctag

SEQ ID NO: 175596 - DNA, 963 bp, Artificial Sequence; identical to SEQ ID NO: 175594
  Description of Artificial Sequence: Synthetic coding sequence

SEQ ID NO: 175597 - DNA, 831 bp, Artificial Sequence; identical to SEQ ID NO: 175595
  Description of Artificial Sequence: Synthetic coding sequence

SEQ ID NO: 175598 - DNA, 963 bp, Artificial Sequence; identical to SEQ ID NO: 175594
  Description of Artificial Sequence: Synthetic coding sequence

SEQ ID NO: 175599 - DNA, 1104 bp, Artificial Sequence
  Description of Artificial Sequence: Synthetic coding sequence
atggaggccaacggcctgggcccccagggcttccctgagctgaagaatgacaccttcctgcgggccgcctggggcgaggagacagactacacccctgtgtggtgcatgaggcaggccggccgctacctgcctgagttccgggagaccagggctgcccaggacttcttcagcacctgccgcagccctgaggcctgctgtgagctgaccctgcagcccctgcggcgcttccccctggatgctgccatcatcttcagtgacatcctggtggtgccccaggccctgggcatggaggtgaccatggtgcctgggaagggccccagcttccctgagcccctgcgggaggagcaggacctggagcggctgcgggaccctgaggtggtggccagcgagctgggctacgtgttccaggccatcaccctgacccggcagaggctggccggccgggtgcccctcatcggctttgctggggccccctggaccctgatgacctacatggtggagggcggcggcagcagcaccatggcccaggccaagcgctggctgtaccagaggccccaggccagccaccagctgctgcgcatcctgacagatgccctggtgccctacctggtgggccaggtggtggccggggcccaggccctgcagctgtttgagagccatgctggccacctgggcccccagctgttcaacaagtttgccctgccctacatcagagatgtggccaagcaggtgaaggcccggctgcgggaggccggcctggcccctgtgcccatgatcatctttgccaaggatggccactttgccctggaggagctggcccaggccggctatgaggtggtgggcctggactggacagtggcccccaagaaggccagagaatgtgtgggcaagacagtgaccctgcagggcaacctggacccctgtgccctgtatgccagcgaggaggagatcggccagctggtgaagcagatgctggatgactttggcccccaccgctacatcgccaacctgggccacggcctgtacccagacatggaccctgagcacgtgggcgcctttgtggatgctgtgcacaagcacagccggctgctgcggcagaactag

SEQ ID NO: 175600 - DNA, 582 bp, Artificial Sequence
  Description of Artificial Sequence: Synthetic coding sequence
atggaggccaacggcctgggcccccagggcttccctgagctgaagaatgacaccttcctgcgggccgcctggggcgaggagacagactacacccctgtgtggtgcatgaggcaggccggccgctacctgcctgagttccgggagaccagggctgcccaggacttcttcagcacctgccgcagccctgaggcctgctgtgagctgaccctgcaggccctgggcatggaggtgaccatggtgcctgggaagggccccagcttccctgagcccctgcgggaggagcaggacctggagcggctgcgggaccctgaggtggtggccagcgagctgggctacgtgttccaggccatcaccctgacccggcagaggctggccggccgggtgcccctgattggatttgctggggccccctggaccctgatgacctacatggtggagggcggcggcagcagcaccatggcccaggccaagcgctggctgtaccagaggccccaggccagccaccagctgctgcgcatcctgacagatgccctggtgccctacctggtgggccaggtggtggccggggcccaggccctgtag

SEQ ID NO: 175601 - DNA, 684 bp, Artificial Sequence
  Description of Artificial Sequence: Synthetic coding sequence
ccccagggcttccctgagctgaagaatgacaccttcctgcgggccgcctggggcgaggagacagactacacccctgtgtggtgcatgaggcaggccggccgctacctgcctgagttccgggagacccgggccgcccaggacttcttcagcacctgccgcagccctgaggcctgctgtgagctgaccctgcagcccctgcggcgcttccccctggatgctgccatcatcttcagtgacatcctggtggtgccccaggccctgggcatggaggtgaccatggtgcctgggaagggccccagcttccctgagcccctgcgggaggagcaggacctggagcggctgcgggaccctgaggtggtggccagcgagctgggctacgtgttccaggccatcaccctgacccggcagaggctggccggccgggtgcccctgattggatttgctggggccccagccctgcagctgtttgagagccacgccggccacctgggcccccagctgttcaacaagtttgccctgccctacatcagagatgtggccaagcaggtgaaggcccggctgcgggaggccggcctggcccctgtgcccatgatcatctttgccaaggatggccactttgccctggaggagctggcccaggccggctatgaggtggtgggcctggactggacagtggccccctag

SEQ ID NO: 175602 - DNA, 687 bp, Artificial Sequence
  Description of Artificial Sequence: Synthetic coding sequence
tgaccccagggcttccctgagctgaagaatgacaccttcctgcgggccgcctggggcgaggagacagactacacccctgtgtggtgcatgaggcaggccggccgctacctgcctgagttccgggagaccagggctgcccaggacttcttcagcacctgccgcagccctgaggcctgctgtgagctgaccctgcagcccctgcggcgcttccccctggatgctgccatcatcttcagtgacatcctggtggtgccccaggccctgggcatggaggtgaccatggtgcctgggaagggccccagcttccctgagcccctgcgggaggagcaggacctggagcggctgcgggaccctgaggtggtggccagcgagctgggctacgtgttccaggccatcaccctgacccggcagaggctggccggccgggtgcccctcatcggctttgctggggccccagccctgcagctgtttgagagccatgctggccacctgggcccccagctgttcaacaagtttgccctgccctacatcagagatgtggccaagcaggtgaaggcccggctgcgggaggccggcctggcccctgtgcccatgatcatctttgccaaggatggccactttgccctggaggagctggcccaggccggctatgaggtggtgggcctggactggacagtggccccctag

SEQ ID NO: 175603 - DNA, 582 bp, Artificial Sequence; identical to SEQ ID NO: 175600
  Description of Artificial Sequence: Synthetic coding sequence

SEQ ID NO: 175604 - DNA, 402 bp, Artificial Sequence
  Description of Artificial Sequence: Synthetic coding sequence
atgaaggtgctgctgctgaaggatgccaaggaggatgactgtggccaggacccctacatccgggagctgggcctgtatggcctggaggccaccctcatccctgtgctgagctttgagttcctgagcctgcccagcttcagcgagaagctgagccaccctgaggactatggaggcctcatcttcaccagccccagggctgtggaggccgctgagctgtgcctggagcagaacaacaagacagaggtgtgggagaggagcctgaaggagaagtggaatgccaagtctgtgtatgtggtgggcaatgccacagccagcctggtgtccaagattggcctggacacagaaggagagacctgtggaaatgctgagaagctggccgagtacatctgcagcagcaagtag

SEQ ID NO: 175605 - DNA, 420 bp, Artificial Sequence
  Description of Artificial Sequence: Synthetic coding sequence
atgaaggtgctgctgctgaaggatgccaaggaggatgactgtggccaggacccctacatccgggagctgggcctgtatggcctggaggccaccctcatccctgtgctgagctttgagttcctgagcctgcccagcttcagcgagaagctgagccaccctgaggactatggaggcctcatcttcaccagccccagggctgtggaggccgctgagctgtgcctggagcagaacaacaagacagaggtgtgggagaggagcctgaaggagaagtggaatgccaagtctgtgtatgtggtgggcaatgccacagccagcctggtgtccaagattggcctggacacagaaggagagacctgtggaaatgctgagaagctggccgagtacatctgcagcagcgaggaggtgaagggcatcttctag

SEQ ID NO: 175606 - DNA, 798 bp, Artificial Sequence
  Description of Artificial Sequence: Synthetic coding sequence
atgaaggtgctgctgctgaaggatgccaaggaggatgactgtggccaggacccctacatccgggagctgggcctgtatggcctggaggccaccctcatccctgtgctgagctttgagttcctgagcctgcccagcttcagcgagaagctgagccaccctgaggactatggaggcctcatcttcaccagccccagggctgtggaggccgctgagctgtgcctggagcagaacaacaagacagaggtgtgggagaggagcctgaaggagaagtggaatgccaagtctgtgtatgtggtgggcaatgccacagccagcctggtgtccaagattggcctggacacagaaggagagacctgtggaaatgctgagaagctggccgagtacatctgcagccgggagagcagcgccctgcccctgctcttcccctgtggcaacctgaagcgggagatcctgcccaaggccctgaaggacaagggcatcgccatggagagcatcaccgtgtaccagacagtggcccaccctggcatccagggcaacctgaacagctactacagccagcagggcgtgcctgccagcatcaccttcttcagccccagcggcctgacctacagcctgaagcacatccaggagctgagcggggacaacatcgaccagatcaagtttgctgccatcggccccaccacagcccgggccctggccgcccagggcctgcctgtgtcctgcacagctgagagccccaccccccaggccctggccaccggcatcaggaaggccctgcagccccacggctgctgctag

SEQ ID NO: 175607 - DNA, 798 bp, Artificial Sequence; identical to SEQ ID NO: 175606
  Description of Artificial Sequence: Synthetic coding sequence

SEQ ID NO: 175608 - DNA, 558 bp, Artificial Sequence
  Description of Artificial Sequence: Synthetic coding sequence
atgaaggtgctgctgctgaaggatgccaaggaggatgactgtggccaggacccctacatccggctgagccaccctgaggactatggaggcctcatcttcaccagccccagggctgtggaggccgctgagctgtgcctggagcagaacaacaagacagaggtgtgggagaggagcctgaaggagaagtggaatgccaagtctgtgtatgtggtgggcaatgccacagccagcctggtgtccaagattggcctggacacagaaggagagacctgtggaaatgctgagaagctggccgagtacatctgcagccgggagagcagcgccctgcccctgctcttcccctgtggcaacctgaagcgggagatcctgcccaaggccctgaaggacaagggcatcgccatggagagcatcaccgtgtaccagacagtggcccaccctggcatccagggcaacctgaacagctactacagccagcagggcgtgcctgccagcatcaccttcttcagccccagcggcctgacctacagcctgaagcacatccaggagctgagcggctag

SEQ ID NO: 175609 - DNA, 2700 bp, Artificial Sequence
  Description of Artificial Sequence: Synthetic coding sequence
atggacaggaaggtggcccgggagttccgccacaaggtggacttcctgattgaaaatgatgctgagaaggactacctgtatgatgtgctgaggatgtaccaccagaccatggatgtggccgtgctggtgggggacctgaagctggtgatcaatgagcccagccggctgcccctgtttgatgccatccggcccctcatccccctgaagcaccaggtggagtatgaccagctgaccccccggcgcagcaggaagctgaaggaggtgcggctggaccggctgcaccctgagggcctgggcctgtctgtgcggggcggcctggagtttggctgcggcctcttcatcagccacctgatcaagggcggccaggccgacagcgtgggcctgcaggtgggagatgagatcgtgcgcatcaatggctacagcatcagcagctgcacccatgaggaggtgatcaacctgatccgcaccaagaagacagtgtccatcaaggtgcgccacatcggcctcatccctgtgaagagcagcccagatgagcccctgacctggcagtatgtggaccagtttgtgtctgagagcggcggcgtgcggggcagcctgggcagccctggcaaccgggagaacaaggagaagaaggtgttcatcagcctggtgggcagccggggcctgggctgcagcatcagcagcggccccatccagaagccaggcatcttcatcagccacgtgaagccaggcagcctgtctgctgaggtgggcctggagatcggggaccagatcgtggaggtgaatggagtggacttcagcaacctggaccacaaggaggccgtgaatgtgctgaagagcagccgcagcctgaccatcagcatcgtggccgccgccggccgggagctgttcatgacagaccgggagcggctggccgaggcccggcagcgggagctgcagaggcaggagctgctgatgcagaagaggctggccatggagagcaacaagatcctgcaggagcagcaggagatggagcggcagaggaggaaggagatcgcccagaaggctgctgaggagaatgaaagatacaggaaggagatggagcagatcgtggaggaggaggagaagttcaagaagcagtgggaggaggactggggcagcaaggagcagctgctgctgcccaagaccatcacagctgaggtgcaccctgtgcccctgaggaagcccaagagctttggctggttctaccgctatgatggcaagttccccaccatcaggaagaagggcaaggacaagaagaaggccaagtatggcagcctgcaggacctgaggaagaacaagaaggagctggagtttgagcagaagctgtacaaggagaaggaggagatgctggagaaggagaagcagctgaagatcaaccggctggcccaggaggtgtctgaaacagagcgggaggacctggaggagagcgagaagatccagtactgggtggagcggctgtgccagacccggctggagcagatcagcagcgctgacaatgagatcagcgagatgaccactggacctcctcctcctcctccttctgtgagccccctggccccacccctgcggagatttgctgggggcctgcacctgcacaccacagacctggatgacatccccctggacatgttctactacccacccaagaccccatctgccctgcctgtgatgccccaccccccacccagcaaccccccccacaaggtgcctgcccctcctgtgctgcccctgagcggccacgtgtctgccagcagcagcccctgggtgcagaggaccccaccacccatccccatccccccaccacccagcgtgcccacccaggacctgacccccacccggcccctgcccagcgccctggaggaggccctgagcaaccaccccttcagaactggagacaccggcaaccctgtggaggactgggaggccaagaaccacagcggcaagcccaccaacagccctgtgcctgagcagagcttcccccccacccccaagaccttctgccccagcccccagcccccccggggccctggggtgtccaccatcagcaagcctgtgatggtgcaccaggagcccaacttcatctacagacctgctgtgaagtctgaggtgctgccccaggagatgctgaagaggatggtggtgtaccagacagccttccggcaggacttcagaaaatatgaggagggctttgacccctacagcatgttcaccccagagcagatcatgggcaaggatgtgcggctgctgcgcatcaagaaggagggcagcctggacctggccctggagggcggcgtggacagccccatcggcaaggtggtggtgtctgctgtgtatgaaagaggagctgctgagagacatggaggcatcgtgaagggagatgagatcatggccatcaacgggaagatcgtgacagactacaccctggccgaggccgaggccgccctgcagaaggcctggaaccagggcggggactggattgacctggtggtggccgtgtgcccccccaaggagtatgatgatgagctggccagcctgcccagctctgtggccgagagcccccagcctgtgaggaagctgctggaggacagagctgctgtgcaccgccacggcttcctgctgcagctggagcccacagacctgctgctgaagagcaagaggggcaaccagatccacaggtag

SEQ ID NO: 175610 - DNA, 1659 bp, Artificial Sequence
  Description of Artificial Sequence: Synthetic coding sequence
atggacaggaaggtggcccgggagttccgccacaaggtggacttcctgattgaaaatgatgctgagaaggactacctgtatgatgtgctgaggatgtaccaccagaccatggatgtggccgtgctggtgggggacctgaagctggtgatcaatgagcccagccggctgcccctgtttgatgccatccggcccctcatccccctgaagcaccaggtggagtatgaccagctgaccccccggcgcagcaggaagctgaaggaggtgcggctggaccggctgcaccctgagggcctgggcctgtctgtgcggggcggcctggagtttggctgcggcctcttcatcagccacctgatcaagggcggccaggccgacagcgtgggcctgcaggtgggagatgagatcgtgcgcatcaatggctacagcatcagcagctgcacccatgaggaggtgatcaacctgatccgcaccaagaagacagtgtccatcaaggtgcgccacatcggcctcatccctgtgaagagcagcccagatgagcccctgacctggcagtatgtggaccagtttgtgtctgagagcggcggcgtgcggggcagcctgggcagccctggcaaccgggagaacaaggagaagaaggtgttcatcagcctggtgggcagccggggcctgggctgcagcatcagcagcggccccatccagaagccaggcatcttcatcagccacgtgaagccaggcagcctgtctgctgaggtgggcctggagatcggggaccagatcgtggaggtgaatggagtggacttcagcaacctggaccacaaggaggccgtgaatgtgctgaagagcagccgcagcctgaccatcagcatcgtggccgccgccggccgggagctgttcatgacagaccgggagcggctggccgaggcccggcagcgggagctgcagaggcaggagctgctgatgcagaagaggctggccatggagagcaacaagatcctgcaggagcagcaggagatggagcggcagaggaggaaggagatcgcccagaaggctgctgaggagaatgaaagatacaggaaggagatggagcagatcgtggaggaggaggagaagttcaagaagcagtgggaggaggactggggcagcaaggagcagctgctgctgcccaagaccatcacagctgaggtgcaccctgtgcccctgaggaagcccaagtatgaccagggcgtggagcctgagctggagccagcagatgacctggatggcggcacagaggagcagggcgagcaggacttcagaaaatatgaggagggctttgacccctacagcatgttcaccccagagcagatcatgggcaaggatgtgcggctgctgcgcatcaagaaggagggcagcctggacctggccctggagggcggcgtggacagccccatcggcaaggtggtggtgtctgctgtgtatgaaagaggagctgctgagagacatggaggcatcgtgaagggagatgagatcatggccatcaacgggaagatcgtgacagactacaccctggccgaggccgaggccgccctgcagaaggcctggaaccagggcggggactggattgacctggtggtggccgtgtgcccccccaaggagtatgatgatgagctgaccttcttctag

SEQ ID NO: 175611 - DNA, 1602 bp, Artificial Sequence
  Description of Artificial Sequence: Synthetic coding sequence
atggacaggaaggtggcccgggagttccgccacaaggtggacttcctgattgaaaatgatgctgagaaggactacctgtatgatgtgctgaggatgtaccaccagaccatggatgtggccgtgctggtgggggacctgaagctggtgatcaatgagcccagccggctgcccctgtttgatgccatccggcccctcatccccctgaagcaccaggtggagtatgaccagctgaccccccggcgcagcaggaagctgaaggaggtgcggctggaccggctgcaccctgagggcctgggcctgtctgtgcggggcggcctggagtttggctgcggcctcttcatcagccacctgatcaagggcggccaggccgacagcgtgggcctgcaggtgggagatgagatcgtgcgcatcaatggctacagcatcagcagctgcacccatgaggaggtgatcaacctgatccgcaccaagaagacagtgtccatcaaggtgcgccacatcggcctcatccctgtgaagagcagcccagatgagcccctgacctggcagtatgtggaccagtttgtgtctgagagcggcggcgtgcggggcagcctgggcagccctggcaaccgggagaacaaggagaagaaggtgttcatcagcctggtgggcagccggggcctgggctgcagcatcagcagcggccccatccagaagccaggcatcttcatcagccacgtgaagccaggcagcctgtctgctgaggtgggcctggagatcggggaccagatcgtggaggtgaatggagtggacttcagcaacctggaccacaaggagggccgggagctgttcatgacagaccgggagcggctggccgaggcccggcagcgggagctgcagaggcaggagctgctgatgcagaagaggctggccatggagagcaacaagatcctgcaggagcagcaggagatggagcggcagaggaggaaggagatcgcccagaaggctgctgaagaaaatgaaagatacaggaaggagatggagcagatcgtggaggaggaggagaagttcaagaagcagtgggaggaggactggggcagcaaggagcagctgctgctgcccaagaccatcacagctgaggtgcaccctgtgcccctgaggaagcccaagtatgaccagggcgtggagcctgagctggagccagcagatgacctggatggcggcacagaggagcagggcgagcaggacttcagaaaatatgaggagggctttgacccctacagcatgttcaccccagagcagatcatgggcaaggatgtgcggctgctgcgcatcaagaaggagggcagcctggacctggccctggagggcggcgtggacagccccatcggcaaggtggtggtgtctgctgtgtatgaaagaggagctgctgagcggcacggcggcatcgtgaagggagatgagatcatggccatcaatggcaagatcgtgacagactacaccctggccgaggccgaggccgccctgcagaaggcctggaaccagggcggggactggattgacctggtggtggccgtgtgcccccccaaggagtatgatgatgagctgaccttcttctag

SEQ ID NO: 175612 - DNA, 1566 bp, Artificial Sequence
  Description of Artificial Sequence: Synthetic coding sequence
atgtaccaccagaccatggatgtggccgtgctggtgggggacctgaagctggtgatcaatgagcccagccggctgcccctgtttgatgccatccggcccctcatccccctgaagcaccaggtggagtatgaccagctgaccccaagaagaagcaggaagctgaaggaggtgcggctggaccggctgcaccctgagggcctgggcctgtctgtgcggggcggcctggagtttggctgcggcctcttcatcagccacctgatcaagggcggccaggccgacagcgtgggcctgcaggtgggagatgaaattgtgcgcatcaatggctacagcatcagcagctgcacccatgaggaggtgatcaacctgatccgcaccaagaagacagtgtccatcaaggtgcgccacatcggcctcatccctgtgaagagcagcccagatgagcccctgacctggcagtatgtggaccagtttgtgtctgagagcggaggagtgcggggcagcctgggcagccctggcaaccgggagaacaaggagaagaaggtgttcatcagcctggtgggcagccggggcctgggctgcagcatcagcagcggccccatccagaagccaggcatcttcatcagccacgtgaagccaggcagcctgtctgctgaggtgggcctggagattggagaccagatcgtggaggtgaatggagtggacttcagcaacctggaccacaaggaggccgtgaatgtgctgaagagcagccgcagcctgaccatcagcatcgtggccgctgctggccgggagctgttcatgacagaccgggagcggctggccgaggcccggcagcgggagctgcagaggcaggagctgctgatgcagaagaggctggccatggagagcaacaagatcctgcaggagcagcaggagatggagcggcagaggaggaaggagatcgcccagaaggctgctgaagaaaatgaaagatacaggaaggagatggagcagatcgtggaggaggaggagaagttcaagaagcagtgggaggaggactggggcagcaaggagcagctgctgctgcccaagaccatcacagctgaggtgcaccctgtgcccctgaggaagcccaagtatgaccagggcgtggagcctgagctggagccagcagatgacctggatggcggcacagaggagcagggcgagcaggacttcagaaaatatgaggagggctttgacccctacagcatgttcaccccagagcagatcatgggcaaggatgtgcggctgctgcgcatcaagaaggagggcagcctggacctggccctggagggcggcgtggacagccccatcggcaaggtggtggtgtctgctgtgtatgaaagaggagctgctgagcggcacggcggcatcgtgaagggagatgagatcatggccatcaatggcaagatcgtgacagactacaccctggccgaggccgaggccgccctgcagaaggcctggaaccagggcggggactggattgacctggtggtggccgtgtgcccccccaaggagtatgatgatgagctgaccttcttctag

SEQ ID NO: 175613 - DNA, 2112 bp, Artificial Sequence
  Description of Artificial Sequence: Synthetic coding sequence
atgtctgcccgggccacccggcccaggagcagaagaggaagacatgcccctcctggagagctggaccctgtggccgagagcagcgaggaggtggaggccgccagcggcagcagcaagcccagctttgcccctcctcctgtgagcagcggcctggagcagctgggccccatggaggaggtgtctggccagggcctgggcagcaggacagacaagaagatggatggcggcagcggccgggagctggccagcgcccctgaggtgccccacaagccagctgtggaggcccaccaggcccctgaggccgccctgcagtacaaggagaccgtgcccccaggaaatggagccccagatgtgttccagaccctgcagcacaccctgagcagcctggaggccgctgctgctgcctggaggcaccagccccccagccacagcggccccatggagtttgagggcaccagcgagggcggggccggcagcctgggcaagcaggagggcgccggcagctgccagcgggaggccgcccggctggccgagagaaatgcctggctgcggctggccctgagcagcagagaagatgagctggtgaggacccaggccagcctggaggccatccgggcagagaaggagaccctgcagaaggaggtgcaggagctgcaggacagcctgctgcggctggagccctgcccccacctgagccacaaccaggccggcggcagcggcagcggcagcagcagcagcgaggccgaccgggagccctgggagacccaggacagcttcagcctggcccaccccctgctgcggcggctgcggagccacagcagcacccagatcctgggcagcctgcccaaccagcccctgagccctgagatgcacatcatggaggcccagatggagcagctgcggggcagcattgagaagctgaagtgcttcaaccggctgctgtctgctgtgctgcagggctacaagggccgctgtgagggcctgtccatgcagctgggccagcgggaggccgaggccacagccctgcacctggccctgcagtacagcgagcactgtgaggaggcctacagagtgctgctggccctgcgggaggccgacagcggggctggagatgaggcccccatgtctgacctgcaggccgctgagaaggaggcctggaggctgctggcccaggaggaggccgccatggatgctggggcccagcagaacccccagcccagccctgagggcagctctgtggacaagcccaccccccaggaggtggccttccagctgcggagctatgtgcagaggctgcaggagaggaggagcctgatgaagatcctgtctgagcccggccccaccctggcccccatgcccaccgtgcccagggctgaggccatggtgcaggccatcctgggcacccaggccggccctgccctgccccggctggagaagacccagatccagcaggacctggtggccgcccgggaggccctggccgacctgatgctgcggctgcagctggtgcggcgggagaagaggggcctggagctgcgggaggccgccctgcgggccctgggccctgcccacgtgctgctgctggagcagctgcgctgggagcgggcagagctgcaggccggcggggccaacagcagcggcggccacagcagcggcggcggcagcagtggagatgaggaggagtggtaccagggcctgcctgctgtgcctgggggcaccagcggcattgatggcggccaggtgggccgggcctgggaccctgagaagctggcccaggagctggccgccagcctgaccaggaccctggacctgcaggagcagctgcagagcctgcggcgggagctggagcaggtggcccagaagggccgggcccggcgcagccagagcgctgagctgaacagagacctgtgcaaggcccacagcgccctggtgctggccttccggggggcccacaggaagcaggaggagcagaggaggaagctggagcagcagatggccctgatggaggcccagcaggccgaggaggtggccgtgctggaggccacagcccgggccctgggcaagcccaggcctcccctgcccccaccccagctgggggacaccttcctgtag

SEQ ID NO: 175614 - DNA, 1152 bp, Artificial Sequence
  Description of Artificial Sequence: Synthetic coding sequence
atgtctgcccgggccacccggcccaggagcagaagaggaagacatgcccctcctggagagctggaccctgtggccgagagcagcgaggaggtggaggccgccagcggcagcagcaagcccagctttgcccctcctcctgtgagcagcggcctggagcagctgggccccatggaggaggtgtctggccagggcctgggcagcaggacagacaagaagatggatggcggcagcggccgggagctggccagcgcccctgaggtgccccacaagccagctgtggaggcccaccaggcccctgaggccgccctgcagtacaaggagaccgtgcccccaggaaatggagccccagatgtgttccagaccctgcagcacaccctgagcagcctggaggccgctgctgctgcctggaggcaccagccccccagccacagcggccccatggagtttgagggcaccagcgagggcggggccggcagcctgggcaagcaggagggcgccggcagctgccagcgggaggccgcccggctggccgagagaaatgcctggctgcggctggccctgagcagcagagaagatgagctggtgaggacccaggccagcctggaggccatccgggcagagaaggagaccctgcagaaggaggtgcaggagctgcaggacagcctgctgcggctggagccctgcccccacctgagccacaaccaggccggcggcagcggcagcggcagcagcagcagcgaggccgaccgggagccctgggagacccaggacagcttcagcctggcccaccccctgctgcggcggctgcggagccacagcagcacccagatcctgggcagcctgcccaaccagcccctgagccctgagatgcacatcatggaggcccagatggagcagctgcggggcagcattgagaagctgaagtgcttcaaccggctgctgtctgctgtgctgcagggctacaagggccgctgtgagggcctgtccatgcagctgggccagcgggaggccgaggccacagccctgcacctggccctgcagtacagagtgctgctgtgccaccctggctggagcgctgtggtgcccagctggctgacagccaccagcgccagccctgtgcaggtgatcctgctgccccagcccccagagtag

SEQ ID NO: 175615 - DNA, 1920 bp, Artificial Sequence
  Description of Artificial Sequence: Synthetic coding sequence
atgctgcaccccacagacaagaagatggatggcggcagcggccgggagctggccagcgcccctgaggtgccccacaagccagctgtggaggcccaccaggcccctgaggccgccctgcagtacaaggagaccgtgcccccaggaaatggagccccagatgtgttccagaccctgcagcacaccctgagcagcctggaggccgctgctgctgcctggaggcaccagccccccagccacagcggccccatggagtttgagggcaccagcgagggcggggccggcagcctgggcaagcaggagggcgccggcagctgccagcgggaggccgcccggctggccgagagaaatgcctggctgcggctggccctgagcagcagagaagatgagctggtgaggacccaggccagcctggaggccatccgggcagagaaggagaccctgcagaaggaggtgcaggagctgcaggacagcctgctgcggctggagccctgcccccacctgagccacaaccaggccggcggcagcggcagcggcagcagcagcagcgaggccgaccgggagccctgggagacccaggacagcttcagcctggcccaccccctgctgcggcggctgcggagccacagcagcacccagatcctgggcagcctgcccaaccagcccctgagccctgagatgcacatcatggaggcccagatggagcagctgcggggcagcattgagaagctgaagtgcttcaaccggctgctgtctgctgtgctgcagggctacaagggccgctgtgagggcctgtccatgcagctgggccagcgggaggccgaggccacagccctgcacctggccctgcagtacagcgagcactgtgaggaggcctacagagtgctgctggccctgcgggaggccgacagcggggctggagatgaggcccccatgtctgacctgcaggccgctgagaaggaggcctggaggctgctggcccaggaggaggccgccatggatgctggggcccagcagaacccccagcccagccctgagggcagctctgtggacaagcccaccccccaggaggtggccttccagctgcggagctatgtgcagaggctgcaggagaggaggagcctgatgaagatcctgtctgagcccggccccaccctggcccccatgcccaccgtgcccagggctgaggccatggtgcaggccatcctgggcacccaggccggccctgccctgccccggctggagaagacccagatccagcaggacctggtggccgcccgggaggccctggccgacctgatgctgcggctgcagctggtgcggcgggagaagaggggcctggagctgcgggaggccgccctgcgggccctgggccctgcccacgtgctgctgctggagcagctgcgctgggagcgggcagagctgcaggccggcggggccaacagcagcggcggccacagcagcggcggcggcagcagtggagatgaggaggagtggtaccagggcctgcctgctgtgcctgggggcaccagcggcattgatggcggccaggtgggccgggcctgggaccctgagaagctggcccaggagctggccgccagcctgaccaggaccctggacctgcaggagcagctgcagagcctgcggcgggagctggagcaggtggcccagaagggccgggcccggcgcagccagagcgctgagctgaacagagacctgtgcaaggcccacagcgccctggtgctggccttccggggggcccacaggaagcaggaggagcagaggaggaagctggagcagcagatggccctgatggaggcccagcaggccgaggaggtggccgtgctggaggccacagcccgggccctgggcaagcccaggcctcccctgcccccaccccagctgggggacaccttcctgtag

SEQ ID NO: 175616 - DNA, 1386 bp, Artificial Sequence
  Description of Artificial Sequence: Synthetic coding sequence
atgaatgaccagtaccaccgggccgccagagatggctacctggagctgctgaaggaggccaccaggaaggagctgaatgccccagatgaagatggcatgacccccaccctgtgggccgcctaccacggcaacctggagagcctgcggctgattgtgtccagaggaggagaccctgacaagtgtgacatctggggcaacacccccctgcacctggccgccagcaatggccacctgcactgcctgtccttcctggtgtcctttggagccaacatctggtgcctggacaatgactaccacacccccctggacatggccgccatgaagggccacatggagtgtgtgcgctacctggacagcattgctgccaagcagagcagcctgaaccccaagctggtgggcaagctgaaggacaaggccttccgggaggccgagcggcgcatcagagaatgtgccaagctgcagaggaggcaccacgagaggatggagcggcgctaccgccgggagctggccgagaggagtgacaccctgtccttcagcagcctgaccagcagcaccctgagccggcggctgcagcacctggccctgggcagccacctgccctacagccaggccaccctgcatggaacagcccggggcaagaccaagatgcagaagaagctggagaggaggaagcagggcggggagggcaccttcaaggtgtctgaagatggcaggaagagcgcccggagcctgagcggcctgcagctgggcagtgatgtgatgtttgtgcggcagggcacctacgccaaccccaaggagtggggccgggcccccctgcgggacatgttcctgagtgatgaggacagcgtgtcccgggccaccctggccgctgagcccgcccacagcgaggtgtccacagattctggccatgacagcctcttcacccggcccggcctgggcaccatggtgttcagaagaaactacctgagcagcggcctgcacggcctgggccgggaggatggcggcctggatggagtgggcgccccccggggccgcctgcagagcagccccagcctggatgatgacagcctgggcagcgccaacagcctgcaggacaggagctgtggggaggagctgccctgggatgagctggacctgggcctggatgaggacctggagcctgagaccagccccctggagaccttcctggccagcctgcacatggaggactttgctgccctgctgcggcaggagaagattgacctggaggccctgatgctgtgcagcgacctggacctgcggagcatctctgtgcccctgggccccaggaagaagatcctgggcgctgtgagaagaagacggcaggccatggagcggcccccagccctggaggacacagagctgtag

SEQ ID NO: 175617 - DNA, 15609 bp, Artificial Sequence
  Description of Artificial Sequence: Synthetic coding sequence
atgaactgccctgtgctgagcctgggcagcggcttcctgttccaggtgattgagatgctgatctttgcctactttgccagcatcagcctgacagagagccggggcctcttcccccggctggagaatgtgggcgccttcaagaaggtgtccatcgtgcccacccaggccgtgtgtggcctgcctgacaggagcaccttctgccacagcagcgctgctgctgagagcatccagttctgcacccagcgcttctgcatccaggactgcccctaccgcagcagccaccccacctacacagccctcttctctgctggcctgagcagctgcatcaccccagacaagaatgacctgcaccccaatgcccacagcaacagcgccagcttcatctttggaaaccacaagagctgcttcagcagcccccccagccccaagctgatggccagcttcaccctggccgtgtggctgaagccagagcagcagggcgtgatgtgtgtgattgagaagacagtggatggccagatcgtgttcaagctgaccatcagcgagaaggagaccatgttctactacagaacagtgaatggcctgcagccccccatcaaggtgatgaccctgggccgcatcctggtgaagaagtggatccacctgtctgtgcaggtgcaccagaccaagatctccttcttcatcaacggggtggagaaggaccacacccccttcaatgcccggaccctgagcggcagcatcacagactttgccagcggcaccgtgcagatcggccagagcctgaatggcctggagcagtttgtgggccgcatgcaggacttccggctgtaccaggtggccctgaccaaccgggagatcctggaggtgttcagcggggacctgctgcggctgcacgcccagagccactgccgctgccccggcagccacccccgggtgcaccccctggcccagcgctactgcatccccaatgatgctggggacacagctgacaacagagtgtcccggctgaaccctgaggcccaccccctgagctttgtgaatgacaatgatgtgggcacctcctgggtgtccaatgtgttcaccaacatcacccagctgaaccagggcgtgaccatctctgtggacctggagaatggccagtaccaggtgttctacatcatcatccagttcttcagcccccagcccacagagatccgcatccagaggaagaaggagaacagcctggactgggaggactggcagtactttgccaggaactgtggggccttcggcatgaagaacaatggagacctggagaagccagattctgtgaactgcctgcagctgagcaacttcaccccctacagcagaggaaatgtgaccttcagcatcctgaccccaggccccaactacagacctggctacaacaacttctacaacacccccagcctgcaggagtttgtgaaggccacccagatccgcttccacttccacggccagtactacaccacagaaacagctgtgaacctgcggcaccgctactatgctgtggatgagatcaccatcagcggccgctgccagtgccacggccacgccgacaactgtgacaccaccagccagccctaccgctgcctgtgcagccaggagagcttcacagagggcctgcactgtgaccgctgcctgcccctgtacaatgacaagcccttccggcagggcgaccaggtgtatgccttcaactgcaagccctgccagtgcaacagccacagcaagagctgccactacaacatctctgtggaccccttcccctttgagcacttccggggcggcggcggcgtgtgtgatgactgtgagcacaacaccactggaagaaactgtgagctgtgcaaggactacttcttccggcaggtgggcgctgaccccagcgccattgatgtgtgcaagccctgtgactgtgacacagtgggcaccagaaatggcagcatcctgtgtgaccagatcggcggccagtgcaactgcaagagacatgtgtctggccggcagtgcaaccagtgccagaatggcttctacaacctgcaggagctggaccctgatggctgcagcccctgcaactgcaacaccagcggcaccgtggatggagacatcacctgccaccagaacagcggccagtgcaagtgcaaggccaacgtcatcggcctgcgctgtgaccactgcaactttggcttcaagttcctgcggagcttcaatgatgtgggctgtgagccctgccagtgcaacctgcacggctctgtgaacaagttctgcaacccccacagcggccagtgtgagtgcaagaaggaggccaagggcctgcagtgtgacacctgccgggagaacttctacggcctggatgtgaccaactgcaaggcctgtgactgtgacacagctggcagcctgcccggcaccgtgtgcaatgccaagacaggccagtgcatctgcaagcccaacgtggagggccggcagtgcaacaagtgcctggagggcaacttctacctgcggcagaacaacagcttcctgtgcctgccctgcaactgtgacaagacaggcaccatcaatggcagcctgctgtgcaacaagagcacaggccagtgcccctgcaagctgggcgtgacaggcctgcgctgcaaccagtgtgagccccaccgctacaacctgaccatcgacaacttccagcactgccagatgtgtgaatgtgacagcctgggcaccctgcccggcaccatctgtgaccccatcagcggccagtgcctgtgtgtgcccaaccggcagggccgccgctgcaaccagtgccagcccggcttctacatcagccctggaaatgccaccggctgcctgccctgcagctgccacaccaccggggctgtgaaccacatctgcaacagcctgaccggccagtgtgtgtgccaggatgccagcattgctggccagagatgtgaccagtgcaaggaccactacttcggctttgacccccagacaggccgctgccagccctgcaactgccacctgagcggggccctgaatgagacctgccacctggtgacaggccagtgcttctgcaagcagtttgtgacaggcagcaaatgtgatgcctgtgtgcccagcgccagccacctggatgtgaacaacctgctgggctgcagcaagacccccttccagcagcccccaccccggggccaggtgcagagcagcagcgccatcaacctgtcctggagccccccagacagccccaatgcccactggctgacctacagcctgctgagagatggctttgagatctacaccacagaggaccagtacccctacagcatccagtacttcctggacacagacctgctgccctacaccaagtacagctactacatcgagaccaccaacgtgcacggcagcaccaggtctgtggccgtgacctacaagaccaagccaggagtgcctgagggcaacctgaccctgagctacatcatccccatcggcagtgacagcgtgaccctgacctggaccaccctgagcaaccagagcggccccatcgagaagtacatcctgagctgtgcccccctggccggcggccagccctgtgtgtcctatgagggccacgagaccagcgccaccatctggaacctggtgccctttgccaagtatgacttctctgtgcaggcctgcaccagcggcggctgcctgcacagcctgcccatcaccgtgaccacagcccaggccccaccccagaggctgagcccccccaagatgcagaagatcagcagcacagagctgcacgtggagtggagccccccagctgagctgaatggcatcatcatccgctatgagctgtacatgaggcggctgcggagcaccaaggagaccaccagcgaggagagcagggtcttccagagcagcggctggctgagcccccacagctttgtggagagcgccaatgaaaatgccctgaagccaccccagaccatgaccaccatcaccggcctggagccctacaccaagtatgagttccgggtgctggccgtgaacatggccggctctgtgagcagcgcctgggtgtctgagaggactggagagagcgcccctgtgttcatgatccccccatctgtgttccccctgagcagctacagcctgaacatctcctgggagaagccagctgacaacgtgacccggggcaaggtggtgggctatgacatcaacatgctgtctgagcagagcccccagcagagcatccccatggccttcagccagctgctgcacacagccaagagccaggagctgagctacacagtggagggcctgaagccctaccgcatctatgagttcaccatcaccctgtgcaacagcgtgggctgtgtgaccagcgccagcggggccggccagaccctggccgccgccccagcccagctgcggccccccctggtgaagggcatcaacagcaccaccatccacctgcgctggttccccccagaggagctgaatggccccagccccatctaccagctggagcggcgggagagcagcctgcctgccctgatgaccaccatgatgaagggcatccgcttcatcggaaatggctactgcaagttccccagcagcacccaccctgtgaacacagacttcaccggcatcaaggccagcttccgcaccaaggtgcctgagggcctgattgtgtttgctgccagccctggcaaccaggaggagtactttgccctgcagctgaagaagggccgcctgtacttcctgtttgacccccagggcagccctgtggaggtgaccaccaccaatgaccacggcaagcagtacagtgatggcaagtggcatgagatcatcgccatccgccaccaggccttcggccagatcaccctggatggcatctacacaggcagcagcgccatcctgaatggcagcaccgtcatcggggacaacacaggagtcttcctgggcggcctgcccaggagctacaccatcctgaggaaggaccctgagatcatccagaagggctttgtgggctgcctgaaggatgtgcacttcatgaagaactacaaccccagcgccatctgggagcccctggactggcagagcagcgaggagcagatcaacgtgtacaacagctgggagggctgcccagccagcctgaatgaaggagcccagttcctgggcgccggcttcctggagctgcacccctacatgtttcatggaggcatgaactttgagatctccttcaagttcagaacagaccagctgaatggcctgctgctgtttgtgtacaacaaggatggccctgacttcctggccatggagctgaagagcggcatcctgaccttccggctgaacaccagcctggccttcacccaggtggacctgctgctgggcctgagctactgcaatggcaagtggaacaaggtgatcatcaagaaggagggcagcttcatcagcgcctctgtgaatggcctgatgaagcacgccagcgagagcggggaccagcccctggtggtgaacagccctgtgtatgtgggcggcatcccccaggagctgctgaacagctaccagcacctgtgcctggagcagggctttggaggctgcatgaaggatgtgaagttcaccagaggagctgtggtgaacctggcctctgtgtcctctggagctgtgcgggtgaacctggatggctgcctgagcacagacagcgctgtgaactgcagaggaaatgacagcatcctggtgtaccagggcaaggagcagagcgtgtatgaaggaggcctgcagcccttcacagagtacctgtacagagtcatcgccagccatgaaggaggctctgtgtacagcgactggagccggggccgcaccaccggggccgccccccagagcgtgcccacccccagccgggtgcgcagcctgaatggctacagcattgaggtgacctgggatgagcctgtggtgcggggcgtcatcgagaagtacatcctgaaggcctacagcgaggacagcaccaggcctcccaggatgcccagcgccagcgctgagtttgtgaacaccagcaacctgaccggcatcctgaccggcctgctgcccttcaagaactatgctgtgaccctgacagcctgcaccctggccggctgcacagagagcagccacgccctgaacatcagcaccccccaggaggccccccaggaggtgcagccccctgtggccaagagcctgcccagcagcctgctgctgtcctggaacccccccaagaaggccaacggcatcatcacccagtactgcctgtacatggatggccgcctcatctacagcggcagcgaggagaactacatcgtgacagacctggccgtgttcaccccccaccagttcctgctgagcgcctgcacccacgtgggctgcaccaacagctcctgggtgctgctgtacacagcccagctgcccccagagcacgtggacagccctgtgctgactgtgctggacagcaggaccatccacatccagtggaagcagcccaggaagatcagcggcatcctggagcgctacgtgctgtacatgagcaaccacacccatgacttcaccatctggagcgtcatctacaacagcacagagctgttccaggaccacatgctgcagtatgtgctgcccggcaacaagtacctgatcaagctgggcgcctgcaccggcggcggctgcaccgtgtctgaggccagcgaggccctgacagatgaggacatccctgagggcgtgcctgcccccaaggcccacagctacagcccagacagcttcaacgtgtcctggacagagcctgagtaccccaacggggtcatcaccagctatggcctgtacctggatggcatcctgatccacaacagcagcgagctgagctaccgggcctacggctttgccccctggagcctgcacagcttccgggtgcaggcctgcacagccaagggctgtgccctgggccccctggtggagaacagaaccctggaggcccctcctgagggcaccgtgaatgtgtttgtgaagacccagggcagcaggaaggcccacgtgcgctgggaggcccccttccggcccaacggcctgctgacccacagcgtgctcttcaccggcatcttctacgtggaccctgtgggcaacaactacaccctgctgaatgtgaccaaggtgatgtacagcggggaggagaccaacctgtgggtgctgattgatggcctggtgcccttcaccaactacacagtgcaggtgaacatcagcaacagccagggcagcctcatcacagaccccatcaccatcgccatgcctcctggggccccagatggagtgctgcccccccggctgagcagcgccacccccaccagcctgcaggtggtgtggagcaccccagccaggaacaatgcccctggcagcccccgctaccagctgcagatgaggtctggggacagcacccacggcttcctggagctgttcagcaaccccagcgccagcctgtcctatgaggtgtctgacctgcagccctacacagagtacatgttccggctggtggccagcaatggcttcggcagcgcccacagctcctggatccccttcatgacagctgaggacaagccaggccctgtggtgccccccatcctgctggatgtgaagagcaggatgatgctggtgacctggcagcaccccaggaagagcaatggagtcatcacccactacaacatctacctgcacggccgcctgtacctgcggaccccaggaaatgtgaccaactgcaccgtgatgcacctgcacccctacacagcctacaagttccaggtggaggcctgcaccagcaagggctgcagcctgagccctgagagccagacagtgtggaccctgcccggggcccctgagggcatccccagccctgagctgttcagtgacacccccaccagcgtcatcatctcctggcagccccccacccaccccaacggcctggtggagaacttcaccattgaaagaagagtgaagggcaaggaggaggtgaccaccctggtgaccctgcccaggagccacagcatgaggttcatcgacaagaccagcgccctgagcccctggaccaagtatgagtacagagtgctgatgagcaccctgcacggcggcaccaacagcagcgcctgggtggaggtgaccacccggcccagcaggcctgctggggtgcagccccctgtggtgacagtgctggagccagatgctgtgcaggtgacctggaagccacccctcatccagaatggagacatcctgtcctatgagatccacatgccagacccccacatcaccctgaccaacgtgaccagcgctgtgctgagccagaaggtgacccacctgatccccttcaccaactacagcgtgaccatcgtggcctgcagcggcggcaatggctacctgggcggctgcacagagagcctgcccacctacgtgaccacccaccccaccgtgccccagaatgtgggccccctgagcgtcatccccctgtctgagagctatgtggtgatctcctggcagccccccagcaagcccaacggccccaacctgcgctatgagctgctgcggaggaagatccagcagcccctggccagcaaccccccagaggacctgaaccgctggcacaacatctacagcggcacccagtggctgtatgaggacaagggcctgagccgcttcaccacctatgagtacatgctgtttgtgcacaacagcgtgggcttcacccccagccgggaggtgacagtgaccaccctggccggcctgcctgagcggggggccaacctgacagcctctgtgctgaaccacacagccattgatgtgcgctgggccaagcccaccgtgcaggacctgcagggcgaggtggagtactacaccctcttctggagcagcgccaccagcaatgacagcctgaagatcctgcctgatgtgaacagccacgtgattggccacctgaagcccaacacagagtactggatcttcatcagcgtcttcaatggagtgcacagcatcaacagcgctggcctgcacgccaccacctgtgatggagagccccagggcatgctgcccccagaggtggtgatcatcaacagcacagctgtgcgggtcatctggaccagccccagcaaccccaatggagtggtgacagagtacagcatctacgtgaacaacaagctgtacaagacaggcatgaatgtgcccggcagcttcatcctgcgggacctgagccccttcaccatctatgacatccaggtggaggtgtgcaccatctatgcctgtgtgaagagcaatggcacccagatcaccaccgtggaggacacccccagcgacatccccacccccaccatccggggcatcaccagccgcagcctgcagattgactgggtgagccccaggaagcccaacggcatcatcctgggctatgacctgctgtggaagacctggtacccctgtgccaagacccagaagctggtgcaggaccagagtgatgagctgtgcaaggctgtgcgctgccagaagccagagagcatctgtggccacatctgctacagcagcgaggccaaggtgtgctgcaatggagtgctgtacaaccccaagccaggccaccgctgctgtgaggagaagtacatcccctttgtgctgaacagcactggagtgtgctgcggcggccgcatccaggaggcccagcccaaccaccagtgctgcagcggctactatgcccgcatcctgcccggggaggtgtgctgcccagatgagcagcacaacagagtgtctgtgggcattggagacagctgctgcggccgcatgccctacagcaccagcggcaaccagatctgctgtgccggccgcctgcatgatggccacggccagaagtgctgcggccggcagatcgtgtccaatgacctggagtgctgcggcggggaggagggcgtggtgtacaaccggctgcccggcatgttctgctgcggccaggactatgtgaacatgtctgacaccatctgctgcagcgccagcagtggagagagcaaggcccacatcaagaagaatgaccctgtgcctgtgaagtgctgtgaaacagagctgatccccaagagccagaagtgctgcaatggagtgggctacaaccccctgaagtatgtgtgcagcgacaagatcagcacaggcatgatgatgaaggagaccaaggagtgccgcatcctgtgcccagcctccatggaggccacagagcactgcggccgctgtgacttcaacttcaccagccacatctgcaccgtcatccggggcagccacaacagcacaggcaaggccagcattgaggagatgtgcagcagcgctgaggagaccatccacactggatctgtgaacacctacagctacacagatgtgaacctgaagccctacatgacctatgagtaccgcatcagcgcctggaacagctatggccggggcctgagcaaggctgtgcgggcccggaccaaggaggatgtgccccagggcgtgagcccccccacctggaccaagattgacaacctggaggacaccatcgtgctgaactggaggaagcccatccagagcaatggccccatcatctactacatcctgctgagaaatggaattgagcgcttccggggcaccagcctgtccttcagtgacaaggagggcatccagcccttccaggagtacagctaccagctgaaggcctgcaccgtggccggctgtgccaccagcagcaaggtggtggccgccaccacccagggcgtgcctgagagcatcctgcccccatccatcacagccctgtctgctgtggccctgcacctgtcctggagcgtgcctgagaagagcaatggagtcatcaaggagtaccagatccggcaggtgggcaagggcctcatccacacagacaccacagaccggcggcagcacacagtgacaggcctgcagccctacaccaactacagcttcaccctgacagcctgcaccagcgctggctgcaccagcagcgagcccttcctgggccagaccctgcaggccgcccctgagggcgtgtgggtgacccccaggcacatcatcatcaacagcaccaccgtggagctgtactggagcctgcctgagaagcccaacggcctggtgtcccagtaccagctgagcagaaatggaaacctgctcttcctgggcggcagcgaggagcagaacttcacagacaagaacctggagcccaacagccgctacacctacaagctggaggtgaagacaggaggcggcagcagcgccagtgatgactacatcgtgcagacccccatgagcaccccagaggagatctacccaccctacaacatcaccgtcatcggcccctacagcatctttgtggcctggatccccccaggcatcctgatccctgagatccctgtggagtacaacgtgctgctgaatgatggctctgtgacccccctggccttctctgtgggccaccaccagagcaccctgctggagaacctgacccccttcacccagtatgagatccgcatccaggcctgccagaatggcagctgtggggtgagcagcaggatgtttgtgaagaccccagaggccgcccccatggacctgaacagccctgtgctgaaggccctgggcagcgcctgcatcgagatcaagtggatgcctcctgagaagcccaacggcatcatcatcaactacttcatctacagaagacctgctggcatcgaggaggagagcgtgctgtttgtgtggagcgagggcgccctggagttcatggatgaaggagacaccctgcggcccttcaccctgtatgagtacagagtgcgggcctgcaacagcaagggctctgtggagagcctgtggagcctgacccagaccctggaggccccaccccaggacttccctgccccctgggcccaggccaccagcgcccacagcgtgctgctgaactggaccaagccagagagccccaacggcatcatcagccactacagagtggtgtaccaggagaggccagatgaccccaccttcaacagccccaccgtgcacgccttcaccgtgaagggcaccagccaccaggcccacctgtatggcctggagcccttcaccacctacagaattggagtggtggccgccaaccacgccggggagatcctgagcccctggaccctcatccagaccctggagagcagccccagcggcctgaggaacttcatcgtggagcagaaggaaaatggccgggccctgctgctgcagtggagcgagcccatgaggaccaacggggtcatcaagacctacaacatcttcagtgatggcttcctggagtacagcggcctgaaccggcagttcctgttccggcggctggaccccttcaccctgtacaccctgaccctggaggcctgcacccgggccggctgtgcccacagcgccccccagcccctgtggacagatgaggcccccccagacagccagctggcccccaccgtgcacagcgtgaagagcacctctgtggagctgtcctggagcgagcctgtgaaccccaacgggaagatcatccgctatgaggtgatccgccgctgctttgagggcaaggcctggggcaaccagaccatccaggctgatgagaagatcgtgttcacagagtacaacacagagaggaacaccttcatgtacaatgacaccggcctgcagccctggacccagtgtgagtacaagatctacacctggaacagcgctggccacacctgcagctcctggaatgtggtgaggaccctgcaggcccctcctgagggcctgagcccccctgtgatctcctatgtgtccatgaacccccagaagctgctgatctcctggatccccccagagcagagcaatggcatcatccagagctaccgcctgcagagaaatgagatgctgtaccccttctcctttgatcctgtgaccttcaactacacagatgaggagctgctgcccttcagcacctacagctatgccctgcaggcctgcaccagcggcggctgcagcaccagcaagcccaccagcatcaccaccctggaggccgcccccagcgaggtgtccccaccagacctgtgggccgtgtctgccacccagatgaatgtgtgctggagcccccccaccgtgcagaatggcaagatcaccaagtacctggtgcgctatgacaacaaggagagcctggccggccagggcctgtgcctgctggtgagccacctgcagccctacagccagtacaacttcagcctggtggcctgcaccaacggcggctgcacagcctctgtgtccaagagcgcctggaccatggaggccctgcctgagaacatggacagccccaccctgcaggtgactggaagtgagagcattgagatcacctggaagccacccaggaaccccaacggccagatccgctcctatgagctgcggagagatggcaccatcgtgtacacaggcctggagacccgctacagagacttcaccctgaccccaggagtggagtacagctacacagtgacagccagcaacagccagggcggcatcctgagccccctggtgaaggacaggaccagccccagcgcccccagcggcatggagccccccaagctgcaggcccggggcccccaggagatcctggtgaactgggacccccctgtgaggaccaatggagacatcatcaactacaccctcttcatccgggagctgtttgagcgggagaccaagatcatccacatcaacaccacccacaacagctttggcatgcagagctacatcgtgaaccagctgaagcccttccacagatatgagatccgcatccaggcctgcaccaccctgggctgtgccagcagtgactggaccttcatccagaccccagagatcgcccccctgatgcagcccccaccccacctggaggtgcagatggcccctgggggcttccagcccaccgtgtccctgctgtggacaggccccctgcagcccaacgggaaggtgctgtactatgagctgtaccgccggcagatcgccacccagcccaggaagagcaaccctgtgctgatctacaacggcagcagcaccagcttcatcgacagcgagctgctgcccttcacagaatatgagtaccaggtgtgggccgtgaacagcgctgggaaggcccccagctcctggacctggtgcaggacaggccctgcccctcctgagggcctgcgggcccccaccttccacgtgatcagcagcacccaggccgtggtgaacatcagcgcccctgggaagcccaacggcatcgtgtccctgtaccgcctcttcagcagcagcgcccacggggctgagaccgtgctgtctgagggcatggccacccagcagaccctgcacggcctgcaggccttcaccaactacagcattggagtggaggcctgcacctgcttcaactgctgcagcaagggccccacagctgagctgcggacccacccagccccacccagcggcctgagcagcccccagatcggcaccctggccagcaggacagccagcttccgctggagcccccccatgttccccaacggggtcatccacagctatgagctgcagttccacgtggcctgccccccagacagcgccctgccctgcacccccagccagatcgagaccaagtacacaggcctgggccagaaggccagcctgggcggcctgcagccctacaccacctacaagctgcgggtggtggcccacaatgaggtgggcagcacagccagcgagtggatctccttcaccacccagaaggagctgccccagtaccgggcccccttctctgtggacagcaacctgtctgtggtgtgtgtgaactggagcgacaccttcctgctgaatggccagctgaaggagtatgtgctgacagatggcggcagaagagtgtacagcggcctggacaccaccctgtacatccccaggacagctgacaagaccttcttcttccaggtgatctgcaccacagatgagggctctgtgaagacccccctcatccagtatgacaccagcacaggcctgggcctggtgctgaccacccctgggaagaagaagggcagccgcagcaagagcacagagttctacagcgagctgtggttcatcgtgctgatggccatgctgggcctcatcctgctggccatcttcctgagcctcatcctgcagaggaagatccacaaggagccctacatccgggagaggcctcccctggtgcccctgcagaagaggatgagccccctgaatgtgtacccacctggagagaaccacatgggcctggccgacaccaagatccccaggagcggcacccctgtgtccatccgcagcaacagaagtgcctgtgtgctgcgcatccccagccagaaccagaccagcctgacctacagccagggcagcctgcacaggtctgtgtcccagctgatggacatccaggacaagaaggtgctgatggacaacagcctgtgggaggccatcatgggccacaacagcggcctgtatgtggatgaggaggacctgatgaatgccatcaaggacttcagctctgtgaccaaggagaggaccaccttcacagacacccacctgtag

SEQ ID NO: 175618 - DNA, 4641 bp, Artificial Sequence
  Description of Artificial Sequence: Synthetic coding sequence
atgaactgccctgtgctgagcctgggcagcggcttcctgttccaggtgattgagatgctgatctttgcctactttgccagcatcagcctgacagagagccggggcctcttcccccggctggagaatgtgggcgccttcaagaaggtgtccatcgtgcccacccaggccgtgtgtggcctgcctgacaggagcaccttctgccacagcagcgctgctgctgagagcatccagttctgcacccagcgcttctgcatccaggactgcccctaccgcagcagccaccccacctacacagccctcttctctgctggcctgagcagctgcatcaccccagacaagaatgacctgcaccccaatgcccacagcaacagcgccagcttcatctttggaaaccacaagagctgcttcagcagcccccccagccccaagctgatggccagcttcaccctggccgtgtggctgaagccagagcagcagggcgtgatgtgtgtgattgagaagacagtggatggccagatcgtgttcaagctgaccatcagcgagaaggagaccatgttctactacagaacagtgaatggcctgcagccccccatcaaggtgatgaccctgggccgcatcctggtgaagaagtggatccacctgtctgtgcaggtgcaccagaccaagatctccttcttcatcaacggggtggagaaggaccacacccccttcaatgcccggaccctgagcggcagcatcacagactttgccagcggcaccgtgcagatcggccagagcctgaatggcctggagcagtttgtgggccgcatgcaggacttccggctgtaccaggtggccctgaccaaccgggagatcctggaggtgttcagcggggacctgctgcggctgcacgcccagagccactgccgctgccccggcagccacccccgggtgcaccccctggcccagcgctactgcatccccaatgatgctggggacacagctgacaacagagtgtcccggctgaaccctgaggcccaccccctgagctttgtgaatgacaatgatgtgggcacctcctgggtgtccaatgtgttcaccaacatcacccagctgaaccagggcgtgaccatctctgtggacctggagaatggccagtaccaggtgttctacatcatcatccagttcttcagcccccagcccacagagatccgcatccagaggaagaaggagaacagcctggactgggaggactggcagtactttgccaggaactgtggggccttcggcatgaagaacaatggagacctggagaagccagattctgtgaactgcctgcagctgagcaacttcaccccctacagcagaggaaatgtgaccttcagcatcctgaccccaggccccaactacagacctggctacaacaacttctacaacacccccagcctgcaggagtttgtgaaggccacccagatccgcttccacttccacggccagtactacaccacagaaacagctgtgaacctgcggcaccgctactatgctgtggatgagatcaccatcagcggccgctgccagtgccacggccacgccgacaactgtgacaccaccagccagccctaccgctgcctgtgcagccaggagagcttcacagagggcctgcactgtgaccgctgcctgcccctgtacaatgacaagcccttccggcagggcgaccaggtgtatgccttcaactgcaagccctgccagtgcaacagccacagcaagagctgccactacaacatctctgtggaccccttcccctttgagcacttccggggcggcggcggcgtgtgtgatgactgtgagcacaacaccactggaagaaactgtgagctgtgcaaggactacttcttccggcaggtgggcgctgaccccagcgccattgatgtgtgcaagccctgtgactgtgacacagtgggcaccagaaatggcagcatcctgtgtgaccagatcggcggccagtgcaactgcaagagacatgtgtctggccggcagtgcaaccagtgccagaatggcttctacaacctgcaggagctggaccctgatggctgcagcccctgcaactgcaacaccagcggcaccgtggatggagacatcacctgccaccagaacagcggccagtgcaagtgcaaggccaacgtcatcggcctgcgctgtgaccactgcaactttggcttcaagttcctgcggagcttcaatgatgtgggctgtgagccctgccagtgcaacctgcacggctctgtgaacaagttctgcaacccccacagcggccagtgtgagtgcaagaaggaggccaagggcctgcagtgtgacacctgccgggagaacttctacggcctggatgtgaccaactgcaaggcctgtgactgtgacacagctggcagcctgcccggcaccgtgtgcaatgccaagacaggccagtgcatctgcaagcccaacgtggagggccggcagtgcaacaagtgcctggagggcaacttctacctgcggcagaacaacagcttcctgtgcctgccctgcaactgtgacaagacaggcaccatcaatggcagcctgctgtgcaacaagagcacaggccagtgcccctgcaagctgggcgtgacaggcctgcgctgcaaccagtgtgagccccaccgctacaacctgaccatcgacaacttccagcactgccagatgtgtgaatgtgacagcctgggcaccctgcccggcaccatctgtgaccccatcagcggccagtgcctgtgtgtgcccaaccggcagggccgccgctgcaaccagtgccagcccggcttctacatcagccctggaaatgccaccggctgcctgccctgcagctgccacaccaccggggctgtgaaccacatctgcaacagcctgaccggccagtgtgtgtgccaggatgccagcattgctggccagagatgtgaccagtgcaaggaccactacttcggctttgacccccagacaggccgctgccagccctgcaactgccacctgagcggggccctgaatgagacctgccacctggtgacaggccagtgcttctgcaagcagtttgtgacaggcagcaaatgtgatgcctgtgtgcccagcgccagccacctggatgtgaacaacctgctgggctgcagcaagacccccttccagcagcccccaccccggggccaggtgcagagcagcagcgccatcaacctgtcctggagccccccagacagccccaatgcccactggctgacctacagcctgctgagagatggctttgagatctacaccacagaggaccagtacccctacagcatccagtacttcctggacacagacctgctgccctacaccaagtacagctactacatcgagaccaccaacgtgcacggcagcaccaggtctgtggccgtgacctacaagaccaagccaggagtgcctgagggcaacctgaccctgagctacatcatccccatcggcagtgacagcgtgaccctgacctggaccaccctgagcaaccagagcggccccatcgagaagtacatcctgagctgtgcccccctggccggcggccagccctgtgtgtcctatgagggccacgagaccagcgccaccatctggaacctggtgccctttgccaagtatgacttctctgtgcaggcctgcaccagcggcggctgcctgcacagcctgcccatcaccgtgaccacagcccaggccccaccccagaggctgagcccccccaagatgcagaagatcagcagcacagagctgcacgtggagtggagccccccagctgagctgaatggcatcatcatccgctatgagctgtacatgaggcggctgcggagcaccaaggagaccaccagcgaggagagcagggtcttccagagcagcggctggctgagcccccacagctttgtggagagcgccaatgaaaatgccctgaagccaccccagaccatgaccaccatcaccggcctggagccctacaccaagtatgagttccgggtgctggccgtgaacatggccggctctgtgagcagcgcctgggtgtctgagaggactggagagagcgcccctgtgttcatgatccccccatctgtgttccccctgagcagctacagcctgaacatctcctgggagaagccagctgacaacgtgacccggggcaaggtggtgggctatgacatcaacatgctgtctgagcagagcccccagcagagcatccccatggccttcagccagctgctgcacacagccaagagccaggagctgagctacacagtggagggcctgaagccctaccgcatctatgagttcaccatcaccctgtgcaacagcgtgggctgtgtgaccagcgccagcggggccggccagaccctggccgccgccccagcccagctgcggccccccctggtgaagggcatcaacagcaccaccatccacctgcgctggttccccccagaggagctgaatggccccagccccatctaccagctggagcggcgggagagcagcctgcctgccctgatgaccaccatgatgaagggcatccgcttcatcggaaatggctactgcaagttccccagcagcacccaccctgtgaacacagacttcaccggaaaatgtgtgtag

SEQ ID NO: 175619 - DNA, 15681 bp, Artificial Sequence
  Description of Artificial Sequence: Synthetic coding sequence
atgaactgccctgtgctgagcctgggcagcggcttcctgttccaggtgattgagatgctgatctttgcctactttgccagcatcagcctgacagagagccggggcctcttcccccggctggagaatgtgggcgccttcaagaaggtgtccatcgtgcccacccaggccgtgtgtggcctgcctgacaggagcaccttctgccacagcagcgctgctgctgagagcatccagttctgcacccagcgcttctgcatccaggactgcccctaccgcagcagccaccccacctacacagccctcttctctgctggcctgagcagctgcatcaccccagacaagaatgacctgcaccccaatgcccacagcaacagcgccagcttcatctttggaaaccacaagagctgcttcagcagcccccccagccccaagctgatggccagcttcaccctggccgtgtggctgaagccagagcagcagggcgtgatgtgtgtgattgagaagacagtggatggccagatcgtgttcaagctgaccatcagcgagaaggagaccatgttctactacagaacagtgaatggcctgcagccccccatcaaggtgatgaccctgggccgcatcctggtgaagaagtggatccacctgtctgtgcaggtgcaccagaccaagatctccttcttcatcaacggggtggagaaggaccacacccccttcaatgcccggaccctgagcggcagcatcacagactttgccagcggcaccgtgcagatcggccagagcctgaatggcctggagcagtttgtgggccgcatgcaggacttccggctgtaccaggtggccctgaccaaccgggagatcctggaggtgttcagcggggacctgctgcggctgcacgcccagagccactgccgctgccccggcagccacccccgggtgcaccccctggcccagcgctactgcatccccaatgatgctggggacacagctgacaacagagtgtcccggctgaaccctgaggcccaccccctgagctttgtgaatgacaatgatgtgggcacctcctgggtgtccaatgtgttcaccaacatcacccagctgaaccagggcgtgaccatctctgtggacctggagaatggccagtaccaggtgttctacatcatcatccagttcttcagcccccagcccacagagatccgcatccagaggaagaaggagaacagcctggactgggaggactggcagtactttgccaggaactgtggggccttcggcatgaagaacaatggagacctggagaagccagattctgtgaactgcctgcagctgagcaacttcaccccctacagcagaggaaatgtgaccttcagcatcctgaccccaggccccaactacagacctggctacaacaacttctacaacacccccagcctgcaggagtttgtgaaggccacccagatccgcttccacttccacggccagtactacaccacagaaacagctgtgaacctgcggcaccgctactatgctgtggatgagatcaccatcagcggccgctgccagtgccacggccacgccgacaactgtgacaccaccagccagccctaccgctgcctgtgcagccaggagagcttcacagagggcctgcactgtgaccgctgcctgcccctgtacaatgacaagcccttccggcagggcgaccaggtgtatgccttcaactgcaagccctgccagtgcaacagccacagcaagagctgccactacaacatctctgtggaccccttcccctttgagcacttccggggcggcggcggcgtgtgtgatgactgtgagcacaacaccactggaagaaactgtgagctgtgcaaggactacttcttccggcaggtgggcgctgaccccagcgccattgatgtgtgcaagccctgtgactgtgacacagtgggcaccagaaatggcagcatcctgtgtgaccagatcggcggccagtgcaactgcaagagacatgtgtctggccggcagtgcaaccagtgccagaatggcttctacaacctgcaggagctggaccctgatggctgcagcccctgcaactgcaacaccagcggcaccgtggatggagacatcacctgccaccagaacagcggccagtgcaagtgcaaggccaacgtcatcggcctgcgctgtgaccactgcaactttggcttcaagttcctgcggagcttcaatgatgtgggctgtgagccctgccagtgcaacctgcacggctctgtgaacaagttctgcaacccccacagcggccagtgtgagtgcaagaaggaggccaagggcctgcagtgtgacacctgccgggagaacttctacggcctggatgtgaccaactgcaaggcctgtgactgtgacacagctggcagcctgcccggcaccgtgtgcaatgccaagacaggccagtgcatctgcaagcccaacgtggagggccggcagtgcaacaagtgcctggagggcaacttctacctgcggcagaacaacagcttcctgtgcctgccctgcaactgtgacaagacaggcaccatcaatggcagcctgctgtgcaacaagagcacaggccagtgcccctgcaagctgggcgtgacaggcctgcgctgcaaccagtgtgagccccaccgctacaacctgaccatcgacaacttccagcactgccagatgtgtgaatgtgacagcctgggcaccctgcccggcaccatctgtgaccccatcagcggccagtgcctgtgtgtgcccaaccggcagggccgccgctgcaaccagtgccagcccggcttctacatcagccctggaaatgccaccggctgcctgccctgcagctgccacaccaccggggctgtgaaccacatctgcaacagcctgaccggccagtgtgtgtgccaggatgccagcattgctggccagagatgtgaccagtgcaaggaccactacttcggctttgacccccagacaggccgctgccagccctgcaactgccacctgagcggggccctgaatgagacctgccacctggtgacaggccagtgcttctgcaagcagtttgtgacaggcagcaaatgtgatgcctgtgtgcccagcgccagccacctggatgtgaacaacctgctgggctgcagcaagacccccttccagcagcccccaccccggggccaggtgcagagcagcagcgccatcaacctgtcctggagccccccagacagccccaatgcccactggctgacctacagcctgctgagagatggctttgagatctacaccacagaggaccagtacccctacagcatccagtacttcctggacacagacctgctgccctacaccaagtacagctactacatcgagaccaccaacgtgcacggcagcaccaggtctgtggccgtgacctacaagaccaagccaggagtgcctgagggcaacctgaccctgagctacatcatccccatcggcagtgacagcgtgaccctgacctggaccaccctgagcaaccagagcggccccatcgagaagtacatcctgagctgtgcccccctggccggcggccagccctgtgtgtcctatgagggccacgagaccagcgccaccatctggaacctggtgccctttgccaagtatgacttctctgtgcaggcctgcaccagcggcggctgcctgcacagcctgcccatcaccgtgaccacagcccaggccccaccccagaggctgagcccccccaagatgcagaagatcagcagcacagagctgcacgtggagtggagccccccagctgagctgaatggcatcatcatccgctatgagctgtacatgaggcggctgcggagcaccaaggagaccaccagcgaggagagcagggtcttccagagcagcggctggctgagcccccacagctttgtggagagcgccaatgaaaatgccctgaagccaccccagaccatgaccaccatcaccggcctggagccctacaccaagtatgagttccgggtgctggccgtgaacatggccggctctgtgagcagcgcctgggtgtctgagaggactggagagagcgcccctgtgttcatgatccccccatctgtgttccccctgagcagctacagcctgaacatctcctgggagaagccagctgacaacgtgacccggggcaaggtggtgggctatgacatcaacatgctgtctgagcagagcccccagcagagcatccccatggccttcagccagctgctgcacacagccaagagccaggagctgagctacacagtggagggcctgaagccctaccgcatctatgagttcaccatcaccctgtgcaacagcgtgggctgtgtgaccagcgccagcggggccggccagaccctggccgccgccccagcccagctgcggccccccctggtgaagggcatcaacagcaccaccatccacctgcgctggttccccccagaggagctgaatggccccagccccatctaccagctggagcggcgggagagcagcctgcctgccctgatgaccaccatgatgaagggcatccgcttcatcggaaatggctactgcaagttccccagcagcacccaccctgtgaacacagacttcaccggcatcaaggccagcttccgcaccaaggtgcctgagggcctgattgtgtttgctgccagccctggcaaccaggaggagtactttgccctgcagctgaagaagggccgcctgtacttcctgtttgacccccagggcagccctgtggaggtgaccaccaccaatgaccacggcaagcagtacagtgatggcaagtggcatgagatcatcgccatccgccaccaggccttcggccagatcaccctggatggcatctacacaggcagcagcgccatcctgaatggcagcaccgtcatcggggacaacacaggagtcttcctgggcggcctgcccaggagctacaccatcctgaggaaggaccctgagatcatccagaagggctttgtgggctgcctgaaggatgtgcacttcatgaagaactacaaccccagcgccatctgggagcccctggactggcagagcagcgaggagcagatcaacgtgtacaacagctgggagggctgcccagccagcctgaatgaaggagcccagttcctgggcgccggcttcctggagctgcacccctacatgtttcatggaggcatgaactttgagatctccttcaagttcagaacagaccagctgaatggcctgctgctgtttgtgtacaacaaggatggccctgacttcctggccatggagctgaagagcggcatcctgaccttccggctgaacaccagcctggccttcacccaggtggacctgctgctgggcctgagctactgcaatggcaagtggaacaaggtgatcatcaagaaggagggcagcttcatcagcgcctctgtgaatggcctgatgaagcacgccagcgagagcggggaccagcccctggtggtgaacagccctgtgtatgtgggcggcatcccccaggagctgctgaacagctaccagcacctgtgcctggagcagggctttggaggctgcatgaaggatgtgaagttcaccagaggagctgtggtgaacctggcctctgtgtcctctggagctgtgcgggtgaacctggatggctgcctgagcacagacagcgctgtgaactgcagaggaaatgacagcatcctggtgtaccagggcaaggagcagagcgtgtatgaaggaggcctgcagcccttcacagagtacctgtacagagtcatcgccagccatgaaggaggctctgtgtacagcgactggagccggggccgcaccaccggggccgccccccagagcgtgcccacccccagccgggtgcgcagcctgaatggctacagcattgaggtgacctgggatgagcctgtggtgcggggcgtcatcgagaagtacatcctgaaggcctacagcgaggacagcaccaggcctcccaggatgcccagcgccagcgctgagtttgtgaacaccagcaacctgaccggcatcctgaccggcctgctgcccttcaagaactatgctgtgaccctgacagcctgcaccctggccggctgcacagagagcagccacgccctgaacatcagcaccccccaggaggccccccaggaggtgcagccccctgtggccaagagcctgcccagcagcctgctgctgtcctggaacccccccaagaaggccaacggcatcatcacccagtactgcctgtacatggatggccgcctcatctacagcggcagcgaggagaactacatcgtgacagacctggccgtgttcaccccccaccagttcctgctgagcgcctgcacccacgtgggctgcaccaacagctcctgggtgctgctgtacacagcccagctgcccccagagcacgtggacagccctgtgctgactgtgctggacagcaggaccatccacatccagtggaagcagcccaggaagatcagcggcatcctggagcgctacgtgctgtacatgagcaaccacacccatgacttcaccatctggagcgtcatctacaacagcacagagctgttccaggaccacatgctgcagtatgtgctgcccggcaacaagtacctgatcaagctgggcgcctgcaccggcggcggctgcaccgtgtctgaggccagcgaggccctgacagatgaggacatccctgagggcgtgcctgcccccaaggcccacagctacagcccagacagcttcaacgtgtcctggacagagcctgagtaccccaacggggtcatcaccagctatggcctgtacctggatggcatcctgatccacaacagcagcgagctgagctaccgggcctacggctttgccccctggagcctgcacagcttccgggtgcaggcctgcacagccaagggctgtgccctgggccccctggtggagaacagaaccctggaggcccctcctgagggcaccgtgaatgtgtttgtgaagacccagggcagcaggaaggcccacgtgcgctgggaggcccccttccggcccaacggcctgctgacccacagcgtgctcttcaccggcatcttctacgtggaccctgtgggcaacaactacaccctgctgaatgtgaccaaggtgatgtacagcggggaggagaccaacctgtgggtgctgattgatggcctggtgcccttcaccaactacacagtgcaggtgaacatcagcaacagccagggcagcctcatcacagaccccatcaccatcgccatgcctcctggggccccagatggagtgctgcccccccggctgagcagcgccacccccaccagcctgcaggtggtgtggagcaccccagccaggaacaatgcccctggcagcccccgctaccagctgcagatgaggtctggggacagcacccacggcttcctggagctgttcagcaaccccagcgccagcctgtcctatgaggtgtctgacctgcagccctacacagagtacatgttccggctggtggccagcaatggcttcggcagcgcccacagctcctggatccccttcatgacagctgaggacaagccaggccctgtggtgccccccatcctgctggatgtgaagagcaggatgatgctggtgacctggcagcaccccaggaagagcaatggagtcatcacccactacaacatctacctgcacggccgcctgtacctgcggaccccaggaaatgtgaccaactgcaccgtgatgcacctgcacccctacacagcctacaagttccaggtggaggcctgcaccagcaagggctgcagcctgagccctgagagccagacagtgtggaccctgcccggggcccctgagggcatccccagccctgagctgttcagtgacacccccaccagcgtcatcatctcctggcagccccccacccaccccaacggcctggtggagaacttcaccattgaaagaagagtgaagggcaaggaggaggtgaccaccctggtgaccctgcccaggagccacagcatgaggttcatcgacaagaccagcgccctgagcccctggaccaagtatgagtacagagtgctgatgagcaccctgcacggcggcaccaacagcagcgcctgggtggaggtgaccacccggcccagcaggcctgctggggtgcagccccctgtggtgacagtgctggagccagatgctgtgcaggtgacctggaagccacccctcatccagaatggagacatcctgtcctatgagatccacatgccagacccccacatcaccctgaccaacgtgaccagcgctgtgctgagccagaaggtgacccacctgatccccttcaccaactacagcgtgaccatcgtggcctgcagcggcggcaatggctacctgggcggctgcacagagagcctgcccacctacgtgaccacccaccccaccgtgccccagaatgtgggccccctgagcgtcatccccctgtctgagagctatgtggtgatctcctggcagccccccagcaagcccaacggccccaacctgcgctatgagctgctgcggaggaagatccagcagcccctggccagcaaccccccagaggacctgaaccgctggcacaacatctacagcggcacccagtggctgtatgaggacaagggcctgagccgcttcaccacctatgagtacatgctgtttgtgcacaacagcgtgggcttcacccccagccgggaggtgacagtgaccaccctggccggcctgcctgagcggggggccaacctgacagcctctgtgctgaaccacacagccattgatgtgcgctgggccaagcccaccgtgcaggacctgcagggcgaggtggagtactacaccctcttctggagcagcgccaccagcaatgacagcctgaagatcctgcctgatgtgaacagccacgtgattggccacctgaagcccaacacagagtactggatcttcatcagcgtcttcaatggagtgcacagcatcaacagcgctggcctgcacgccaccacctgtgatggagagccccagggcatgctgcccccagaggtggtgatcatcaacagcacagctgtgcgggtcatctggaccagccccagcaaccccaatggagtggtgacagagtacagcatctacgtgaacaacaagctgtacaagacaggcatgaatgtgcccggcagcttcatcctgcgggacctgagccccttcaccatctatgacatccaggtggaggtgtgcaccatctatgcctgtgtgaagagcaatggcacccagatcaccaccgtggaggacacccccagcgacatccccacccccaccatccggggcatcaccagccgcagcctgcagattgactgggtgagccccaggaagcccaacggcatcatcctgggctatgacctgctgtggaagacctggtacccctgtgccaagacccagaagctggtgcaggaccagagtgatgagctgtgcaaggctgtgcgctgccagaagccagagagcatctgtggccacatctgctacagcagcgaggccaaggtgtgctgcaatggagtgctgtacaaccccaagccaggccaccgctgctgtgaggagaagtacatcccctttgtgctgaacagcactggagtgtgctgcggcggccgcatccaggaggcccagcccaaccaccagtgctgcagcggctactatgcccgcatcctgcccggggaggtgtgctgcccagatgagcagcacaacagagtgtctgtgggcattggagacagctgctgcggccgcatgccctacagcaccagcggcaaccagatctgctgtgccggccgcctgcatgatggccacggccagaagtgctgcggccggcagatcgtgtccaatgacctggagtgctgcggcggggaggagggcgtggtgtacaaccggctgcccggcatgttctgctgcggccaggactatgtgaacatgtctgacaccatctgctgcagcgccagcagtggagagagcaaggcccacatcaagaagaatgaccctgtgcctgtgaagtgctgtgaaacagagctgatccccaagagccagaagtgctgcaatggagtgggctacaaccccctgaagtatgtgtgcagcgacaagatcagcacaggcatgatgatgaaggagaccaaggagtgccgcatcctgtgcccagcctccatggaggccacagagcactgcggccgctgtgacttcaacttcaccagccacatctgcaccgtcatccggggcagccacaacagcacaggcaaggccagcattgaggagatgtgcagcagcgctgaggagaccatccacactggatctgtgaacacctacagctacacagatgtgaacctgaagccctacatgacctatgagtaccgcatcagcgcctggaacagctatggccggggcctgagcaaggctgtgcgggcccggaccaaggaggatgtgccccagggcgtgagcccccccacctggaccaagattgacaacctggaggacaccatcgtgctgaactggaggaagcccatccagagcaatggccccatcatctactacatcctgctgagaaatggaattgagcgcttccggggcaccagcctgtccttcagtgacaaggagggcatccagcccttccaggagtacagctaccagctgaaggcctgcaccgtggccggctgtgccaccagcagcaaggtggtggccgccaccacccagggcgtgcctgagagcatcctgcccccatccatcacagccctgtctgctgtggccctgcacctgtcctggagcgtgcctgagaagagcaatggagtcatcaaggagtaccagatccggcaggtgggcaagggcctcatccacacagacaccacagaccggcggcagcacacagtgacaggcctgcagccctacaccaactacagcttcaccctgacagcctgcaccagcgctggctgcaccagcagcgagcccttcctgggccagaccctgcaggccgcccctgagggcgtgtgggtgacccccaggcacatcatcatcaacagcaccaccgtggagctgtactggagcctgcctgagaagcccaacggcctggtgtcccagtaccagctgagcagaaatggaaacctgctcttcctgggcggcagcgaggagcagaacttcacagacaagaacctggagcccaacagccgctacacctacaagctggaggtgaagacaggaggcggcagcagcgccagtgatgactacatcgtgcagacccccatgagcaccccagaggagatctacccaccctacaacatcaccgtcatcggcccctacagcatctttgtggcctggatccccccaggcatcctgatccctgagatccctgtggagtacaacgtgctgctgaatgatggctctgtgacccccctggccttctctgtgggccaccaccagagcaccctgctggagaacctgacccccttcacccagtatgagatccgcatccaggcctgccagaatggcagctgtggggtgagcagcaggatgtttgtgaagaccccagaggccgcccccatggacctgaacagccctgtgctgaaggccctgggcagcgcctgcatcgagatcaagtggatgcctcctgagaagcccaacggcatcatcatcaactacttcatctacagaagacctgctggcatcgaggaggagagcgtgctgtttgtgtggagcgagggcgccctggagttcatggatgaaggagacaccctgcggcccttcaccctgtatgagtacagagtgcgggcctgcaacagcaagggctctgtggagagcctgtggagcctgacccagaccctggaggccccaccccaggacttccctgccccctgggcccaggccaccagcgcccacagcgtgctgctgaactggaccaagccagagagccccaacggcatcatcagccactacagagtggtgtaccaggagaggccagatgaccccaccttcaacagccccaccgtgcacgccttcaccgtgaagggcaccagccaccaggcccacctgtatggcctggagcccttcaccacctacagaattggagtggtggccgccaaccacgccggggagatcctgagcccctggaccctcatccagaccctggagagcagccccagcggcctgaggaacttcatcgtggagcagaaggaaaatggccgggccctgctgctgcagtggagcgagcccatgaggaccaacggggtcatcaagacctacaacatcttcagtgatggcttcctggagtacagcggcctgaaccggcagttcctgttccggcggctggaccccttcaccctgtacaccctgaccctggaggcctgcacccgggccggctgtgcccacagcgccccccagcccctgtggacagatgaggcccccccagacagccagctggcccccaccgtgcacagcgtgaagagcacctctgtggagctgtcctggagcgagcctgtgaaccccaacgggaagatcatccgctatgaggtgatccgccgctgctttgagggcaaggcctggggcaaccagaccatccaggctgatgagaagatcgtgttcacagagtacaacacagagaggaacaccttcatgtacaatgacaccggcctgcagccctggacccagtgtgagtacaagatctacacctggaacagcgctggccacacctgcagctcctggaatgtggtgaggaccctgcaggcccctcctgagggcctgagcccccctgtgatctcctatgtgtccatgaacccccagaagctgctgatctcctggatccccccagagcagagcaatggcatcatccagagctaccgcctgcagagaaatgagatgctgtaccccttctcctttgatcctgtgaccttcaactacacagatgaggagctgctgcccttcagcacctacagctatgccctgcaggcctgcaccagcggcggctgcagcaccagcaagcccaccagcatcaccaccctggaggccgcccccagcgaggtgtccccaccagacctgtgggccgtgtctgccacccagatgaatgtgtgctggagcccccccaccgtgcagaatggcaagatcaccaagtacctggtgcgctatgacaacaaggagagcctggccggccagggcctgtgcctgctggtgagccacctgcagccctacagccagtacaacttcagcctggtggcctgcaccaacggcggctgcacagcctctgtgtccaagagcgcctggaccatggaggccctgcctgagaacatggacagccccaccctgcaggtgactggaagtgagagcattgagatcacctggaagccacccaggaaccccaacggccagatccgctcctatgagctgcggagagatggcaccatcgtgtacacaggcctggagacccgctacagagacttcaccctgaccccaggagtggagtacagctacacagtgacagccagcaacagccagggcggcatcctgagccccctggtgaaggacaggaccagccccagcgcccccagcggcatggagccccccaagctgcaggcccggggcccccaggagatcctggtgaactgggacccccctgtgaggaccaatggagacatcatcaactacaccctcttcatccgggagctgtttgagcgggagaccaagatcatccacatcaacaccacccacaacagctttggcatgcagagctacatcgtgaaccagctgaagcccttccacagatatgagatccgcatccaggcctgcaccaccctgggctgtgccagcagtgactggaccttcatccagaccccagagatcgcccccctgatgcagcccccaccccacctggaggtgcagatggcccctgggggcttccagcccaccgtgtccctgctgtggacaggccccctgcagcccaacgggaaggtgctgtactatgagctgtaccgccggcagatcgccacccagcccaggaagagcaaccctgtgctgatctacaacggcagcagcaccagcttcatcgacagcgagctgctgcccttcacagaatatgagtaccaggtgtgggccgtgaacagcgctgggaaggcccccagctcctggacctggtgcaggacaggccctgcccctcctgagggcctgcgggcccccaccttccacgtgatcagcagcacccaggccgtggtgaacatcagcgcccctgggaagcccaacggcatcgtgtccctgtaccgcctcttcagcagcagcgcccacggggctgagaccgtgctgtctgagggcatggccacccagcagaccctgcacggcctgcaggccttcaccaactacagcattggagtggaggcctgcacctgcttcaactgctgcagcaagggccccacagctgagctgcggacccacccagccccacccagcggcctgagcagcccccagatcggcaccctggccagcaggacagccagcttccgctggagcccccccatgttccccaacggggtcatccacagctatgagctgcagttccacgtggcctgccccccagacagcgccctgccctgcacccccagccagatcgagaccaagtacacaggcctgggccagaaggccagcctgggcggcctgcagccctacaccacctacaagctgcgggtggtggcccacaatgaggtgggcagcacagccagcgagtggatctccttcaccacccagaaggagctgccccagtaccgggcccccttctctgtggacagcaacctgtctgtggtgtgtgtgaactggagcgacaccttcctgctgaatggccagctgaaggagtatgtgctgacagatggcggcagaagagtgtacagcggcctggacaccaccctgtacatccccaggacagctgacaagaccttcttcttccaggtgatctgcaccacagatgagggctctgtgaagacccccctcatccagtatgacaccagcacaggcctgggcctggtgctgaccacccctgggaagaagaagggcagccgcagcaagagcacagagttctacagcgagctgtggttcatcgtgctgatggccatgctgggcctcatcctgctggccatcttcctgagcctcatcctgcagaggaagatccacaaggagccctacatccgggagaggcctcccctggtgcccctgcagaagaggatgagccccctgaatgtgtacccacctggagagaaccacatgtttgacagcgtggccgacatcagtgatgtgagcagcaatgtgaccctgaagagctacaccatgcactttgagggcctggccgacaccaagatccccaggagcggcacccctgtgtccatccgcagcaacagaagtgcctgtgtgctgcgcatccccagccagaaccagaccagcctgacctacagccagggcagcctgcacaggtctgtgtcccagctgatggacatccaggacaagaaggtgctgatggacaacagcctgtgggaggccatcatgggccacaacagcggcctgtatgtggatgaggaggacctgatgaatgccatcaaggacttcagctctgtgaccaaggagaggaccaccttcacagacacccacctgtag

SEQ ID NO: 175620 - DNA, 2538 bp, Artificial Sequence
  Description of Artificial Sequence: Synthetic coding sequence
atgaggacagaagctgtggtgaacagccagggccagacagactacctgaccaaggacagcgaccaggatgtggccctgaagctggcccaggagagagctgagatcgtggccaagtatgaccggggccgggagggcgctgagattgagccctgggaggatgctgactacctggtgtacaaggtgacagacagatttggcttcctgcacgaggaggagctgcctgaccacaacgtggccgtggagcggcagaagcacctggagattgaaagaaccaccaagtggctgaagatgctgaagggctgggagaagtacaagaacacagagaagttccaccggcgcatctacaagggcatccccctgcagctgcggggggaggtgtgggccctgctgctggagatccccaagatgaaggaggagacccgggacctgtacagcaagctgaagcaccgggcccggggctgcagcccagacatccggcagattgacctggatgtgaacagaaccttccgggaccacatcatgttccgggacagatatggagtgaagcagcagagcctcttccacgtgctggccgcctacagcatctacaacacagaggtgggctactgccagggcatgagccagatcacagccctgctgctgatgtacatgaatgaggaggatgccttctgggccctggtgaagctgttcagcggccccaagcacgccatgcacggcttctttgtgcagggcttccccaagctgctgcgcttccaggagcaccacgagaagatcctgaacaagttcctgagcaagctgaagcagcacctggacagccaggagatctacaccagcttctacaccatgaagtggttcttccagtgcttcctggacaggacccccttcaccctgaacctgcgcatctgggacatctacatctttgaaggagagcgggtgctgacagccatgagctacaccatcctgaagctgcacaagaagcacctgatgaagctgtccatggaggagctggtggagttcttccaggagaccctggccaaggacttcttctttgaagatgactttgtgattgagcagctgcagatctccatgacagagctgaagagggccaagctggacctgcctgagcccgggaaggaggatgagtaccccaagaagcccctgggccagctgcccccagagctgcagagctggggcgtgcaccacctgagcaatggccagaggtctgtgggccggcccagccccctggccagcggcagaagagagagcggggccccccacagaagacatgagcacagcccccacccccagagcaggacaggcaccccagagcgggcccagccccccaggaggaagtctgtggaggaggagagcaagaagctgaaggatgaggccgacttccagaggaagctgcccagcggcccccaggacagcagccggcagtacaaccacgccgccgccaaccagaacagcaatgccaccagcaacatcaggaaggagtttgtgcccaagtggaacaagcccagtgatgtgtctgccacagagaggacagccaagtacaccatggagggcaagggccgggccgcccacccagccctggccgtgacagtgcccggccctgctgaggtgcgggtgtccaatgtgcggcccaagatgaaggccctggatgctgaagatggcaagaggggcagcacagccagccagtatgacaacgtgcccggccctgagctggacagcggggcctctgtggaggaggccctggagcgggcctacagccagagccccaggcatgccctgtacccacccagccccaggaagcatgctgagcccagcagcagccccagcaaggtgagcaacaagttcaccttcaaggtgcagccccccagccacgcccgctaccccagccagctggatggagaggcccggggcctggcccacccccccagctacagcaacccccctgtgtaccacggcaacagccccaagcacttccccacagccaacagcagctttgccagcccccagttcagccctggcacccagctgaaccccagcagaagaccccacggcagcaccctgtctgtgtctgccagccctgagaagagctacagccggcccagccccctggtgctgcccagcagcagaattgaggtgctgcctgtggacaccggggccggcggctacagcggcaacagcggcagccccaagaatggcaagctgatcatcccccctgtggactacctgcctgacaacagaacctggagcgaggtgtcctacacctacagacctgagacccagggccagagctggaccagagatgccagccggggcaacctgcccaagtacagcgccttccagctggcccccttccaggaccacggcctgcctgctgtgtctgtggacagccctgtgcgctacaaggccagccctgctgctgaagatgccagccccagcggctacccctacagcggccccccacctccagcctaccactacagaaacagagatggcctgagcatccaggagagcgtgctgctgtag

SEQ ID NO: 175621 - DNA, 2487 bp, Artificial Sequence
  Description of Artificial Sequence: Synthetic coding sequence
atgaacagcgaccaggatgtggccctgaagctggcccaggagcgggcagagatcgtggccaagtatgaccggggccgggagggcgctgagattgagccctgggaggatgctgactacctggtgtacaaggtgacagaccgcttcggcttcctgcacgaggaggagctgcctgaccacaacgtggccgtggagcggcagaagcacctggagattgaaagaaccaccaagtggctgaagatgctgaagggctgggagaagtacaagaacacagagaagttccaccggcgcatctacaagggcatccccctgcagctgcggggggaggtgtgggccctgctgctggagatccccaagatgaaggaggagacccgggacctgtacagcaagctgaagcaccgggcccggggctgcagcccagacatccggcagattgacctggatgtgaacagaaccttccgggaccacatcatgttccgggacagatatggagtgaagcagcagagcctcttccacgtgctggccgcctacagcatctacaacacagaggtgggctactgccagggcatgagccagatcacagccctgctgctgatgtacatgaatgaagaagatgccttctgggccctggtgaagctgttcagcggccccaagcacgccatgcacggcttctttgtgcagggcttccccaagctgctgcgcttccaggagcaccacgagaagatcctgaacaagttcctgagcaagctgaagcagcacctggacagccaggagatctacaccagcttctacaccatgaagtggttcttccagtgcttcctggacaggacccccttcaccctgaacctgcgcatctgggacatctacatctttgaaggagagcgggtgctgacagccatgagctacaccatcctgaagctgcacaagaagcacctgatgaagctgtccatggaggagctggtggagttcttccaggagaccctggccaaggacttcttctttgaagatgactttgtgattgagcagctgcagatctccatgacagagctgaagagggccaagctggacctgcctgagcccgggaaggaggatgagtaccccaagaagcccctgggccagctgcccccagagctgcagagctggggcgtgcaccacctgagcaatggccagaggtctgtgggccggcccagccccctggccagcggccggcgggagagcggggccccccacagaagacatgagcacagcccccacccccagagcaggacaggcaccccagagcgggcccagccccccaggaggaagtctgtggaggaggagagcaagaagctgaaggatgaagctgacttccagaggaagctgcccagcggcccccaggacagcagccggcagtacaaccacgccgccgccaaccagaacagcaatgccaccagcaacatcaggaaggagtttgtgcccaagtggaacaagcccagtgatgtgtctgccacagagaggacagccaagtacaccatggagggcaagggccgggccgcccacccagccctggccgtgacagtgcccggccctgctgaggtgcgggtgtccaatgtgcggcccaagatgaaggccctggatgctgaagatggcaagaggggcagcacagccagccagtatgacaacgtgcccggccctgagctggacagcggggcctctgtggaggaggccctggagcgggcctacagccagagccccaggcatgccctgtacccacccagccccaggaagcacgccgagcccagcagcagccccagcaaggtgagcaacaagttcaccttcaaggtgcagccccccagccacgcccgctaccccagccagctggatggagaggcccggggcctggcccaccccccatcctacagcaacccccctgtgtaccacggcaacagccccaagcacttccccacagccaacagcagctttgccagcccccagttcagccctggcacccagctgaaccccagccggcggccccacggcagcaccctgtctgtgtctgccagccctgagaagagctacagccggcccagccccctggtgctgcccagcagccgcatcgaggtgctgcctgtggacacaggagctgggggctacagcggcaacagcggcagccccaagaatggcaagctgatcatcccccctgtggactacctgcctgacaacagaacctggagcgaggtgtcctacacctacagacctgagacccagggccagagctggaccagagatgccagccggggcaacctgcccaagtacagcgccttccagctggcccccttccaggaccacggcctgcctgctgtgtctgtggacagccctgtgcgctacaaggccagccctgctgctgaagatgccagccccagcggctacccctacagcggccccccacctccagcctaccactacagaaacagagatggcctgagcatccaggagagcgtgctgctgtag

SEQ ID NO: 175622 - DNA, 2487 bp, Artificial Sequence; identical to SEQ ID NO: 175621
  Description of Artificial Sequence: Synthetic coding sequence

SEQ ID NO: 175623 - DNA, 762 bp, Artificial Sequence
  Description of Artificial Sequence: Synthetic coding sequence
atggctgctgccttcaggaaggccgccaagagccggcagcgggagcaccgggagaggagccagcccggcttcaggaagcacctgggcctgctggagaagaagaaggactacaagctgcgggcagatgactacaggaagaagcaggagtacctgaaggccctgaggaagaaggccctggagaagaacccagatgagttctactacaagatgaccagggtgaagctgcaggatggagtgcacatcatcaaggagaccaaggaggaggtgaccccagagcagctgaagctgatgaggacccaggatgtgaagtacatcgagatgaagagggtggccgaggccaagaagattgaaaggctgaagtctgagctgcacctgctggacttccagggcaagcagcagaacaagcacgtgttcttctttgacaccaagaaggaggtggagcagtttgatgtggccacccacctgcagacagcccctgagctggtggacagagtcttcaaccggcccagaattgagaccctgcagaaggagaaggtgaagggcgtgaccaaccagacaggcctgaagagaattgccaaggagcggcagaagcagtacaactgcctgacccagagaattgaaagagagaagaagctgtttgtgattgcccagaagatccagaccaggaaggacctgatggacaagacccagaaggtgaaggtgaagaaggagaccgtgaacagccctgccatctacaagttccagagcaggaggaagaggtag

SEQ ID NO: 175624 - DNA, 447 bp, Artificial Sequence
  Description of Artificial Sequence: Synthetic coding sequence
atggctgctgccttcaggaaggccgccaagagccggcagcgggagcaccgggagaggagccagcccggcttcaggaagcacctgggcctgctggagaagaagaaggactacaagctgcgggcagatgactacaggaagaagcaggagtacctgaaggccctgaggaagaaggccctggagaagaacccagatgagttctactacaagatgaccagggtgaagctgcaggatggagtgcacatcatcaaggagaccaaggaggaggtgaccccagagcagctgaagctgatgaggacccaggatgtgaagtacatcgagatgaagagggtggccgaggccaagaagattgaaaggctgaagtctgagctgcacctgctggacttccagggcaagcagcagaacaagcacgtgttcttctttgacaccaagaaggaggccaacagctag

SEQ ID NO: 175625 - DNA, 2124 bp, Artificial Sequence
  Description of Artificial Sequence: Synthetic coding sequence
atgcctgaggaggccggcttccccccagccaagcgcttccggcccggcagcggcccccccagcagagctggcagcttccccccaggccggcaggtggtgatgctgctgacagctggcagcggcggccggggcggcggcggcggccggcggcagcagccccccctggcccagcccagcgccagcccctacccagaggccgtggagctgcagaggaggagcctgcccatcttccaggcccggggccagctgctggcccagctgaggaacctggacaatgctgtgctgattggagaaacaggcagcggcaagaccacccagatcccccagtacctgtatgagggcggcatcagccggcagggcatcatcgctgtgacccagccccggcgggtggccgccatcagcctggccaccagggtgtctgatgagaagaggacagagctgggcaagctggtgggctacacagtgcgctttgatgatgtgaccagcgaggacacccgcatcaagttcctgacagatggcatgctgctgcgggaggccatcagtgacagcctgctgaggaagtacagctgtgtgatcctggatgaggcccacgagaggaccatccacacagatgtgctgtttggagtggtgaaggccgcccagaagaggaggaaggagctgggcaagctgcccctgaaggtgattgtgatgtctgccaccatggatgtggacctcttcagccagtacttcaacggggcccctgtgctgtacctggagggccggcagcaccccatccaggtgttctacaccaagcagccccagaatgactacctgcatgctgccctggtgtctgtgttccagatccaccaggaggcccccagcagccaggacatcctggtgttcctgaccggccaggaggagattgaggccatgagcaagacctgccgggacatcgccaagcacctgcctgatggctgcccagccatgctggtgctgcccctgtatgccagcctgccctatgcccagcagctgcgggtcttccagggcgcccccaagggctacaggaaggtgatcatcagcaccaacattgctgagaccagcatcaccatcaccggcatcaagtatgtggtggacaccggcatggtgaaggccaagaagtacaacccagacagcggcctggaggtgctggccgtgcagagggtgtccaagacccaggcctggcagaggacaggccgggccggcagagaagattctggcatctgctaccgcctgtacacagaagatgaatttgagaagtttgacaagatgacagtgcctgagatccagcgctgcaacctggcctctgtgatgctgcagctgctggccatgaaggtgcccaacgtgctgacctttgacttcatgagcaagcccagcccagaccacatccaggccgccatcgcccagctggacctgctgggcgccctggagcacaaggatgaccagctgaccctgacccccatgggcaggaagatggccgccttccccctggagcccaagtttgccaagaccatcctgatgagccccaagttccactgcacagaggagatcctgaccatcgtgtccctgctgtctgtggacagcgtgctgcacaacccccccagcagaagagaggaggtgcagggcgtgaggaagaagttcatcagcagcgagggggaccacatgaccctgctgaacatctaccgcaccttcaagaacctgggcggcaacaaggactggtgcaaggaaaattttgtgaacagcaagaacatgaccctggtggccgaggtgcgggcccagctgcgggacatctgcctgaagatgtccatgcccatcgccagcagcagaggagatgtggagagcgtgcggcgctgcctggcccacagcctcttcatgagcacagctgagctgcagccagatggcacctacgccaccacagacacccaccagcctgtggccatccaccccagctctgtgctcttccactgcaagccagcctgtgtggtgtacacagagctgctgtacaccaacaagtgctacatgagggacctgtgtgtgattgatgcccagtggctgtatgaagctgcccctgagtacttccggaggaagctgaggacagccaggaactag

SEQ ID NO: 175626 - DNA, 1566 bp, Artificial Sequence
  Description of Artificial Sequence: Synthetic coding sequence
atgaggccagactggaaggccggggccggccctgggggccccccccagaagccagcccccagcagccagaggaagcccccagcccggcccagcgctgctgctgctgccatcgctgtggccgctgctgaggaggagcggcggctgcggcagaggaaccggctgcggctggaggaggacaagccagctgtggagcgctgcctggaggagctggtgtttggagatgtggagaatgatgaagatgccctgctgcggcggctgcggggcccccgggtgcaggagcatgaagattctggggacagcgaggtggagaatgaggccaagggcaacttccccccccagaagaagcctgtgtgggtggatgaggaggatgaagatgaggagatggtggacatgatgaacaaccgcttcaggaaggacatgatgaagaatgccagcgagagcaagctgagcaaggacaacctgaagaagaggctgaaggaggagttccagcacgccatgggcggcgtgcctgcctgggccgagaccaccaagaggaagaccagcagtgatgatgagagcgaggaggatgaagatgacctgctgcagaggactggaaacttcatcagcaccagcaccagcctgccccggggcatcctgaagatgaagaactgccagcacgccaatgctgagcggcccaccgtggcccgcatcagctctgtgcagttccaccctggggcccagatcgtgatggtggccggcctggacaatgctgtgtccctcttccaggtggatggcaagaccaaccccaagatccagagcatctacctggagcgcttccccatcttcaaggcctgcttcagcgccaacggggaggaggtgctggccaccagcacccacagcaaggtgctgtatgtgtatgacatgctggccggcaagctgatccctgtgcaccaggtgcggggcctgaaggagaagatcgtgcgcagctttgaggtgtccccagatggcagcttcctgctgatcaatggaattgctggctacctgcacctgctggccatgaagaccaaggagctgattggctccatgaagatcaatggccgggtggccgccagcaccttcagcagtgacagcaagaaggtgtatgccagcagtggagatggagaggtgtatgtgtgggatgtgaacagcaggaagtgcctgaacagatttgtggatgagggcagcctgtatggcctgagcatcgccaccagcagaaatggccagtatgtggcctgtggcagcaactgtggggtggtgaacatctacaaccaggacagctgcctgcaggagaccaaccccaagcccatcaaggccatcatgaacctggtgactggagtgaccagcctgaccttcaaccccaccacagagatcctggccatcgccagcgagaagatgaaggaggccgtgcggctggtgcacctgcccagctgcaccgtcttcagcaacttccctgtgatcaagaacaagaacatcagccacgtgcacaccatggacttcagccccaggagcggctactttgccctgggcaatgagaaggcccggccctag

SEQ ID NO: 175627 - DNA, 8358 bp, Artificial Sequence
  Description of Artificial Sequence: Synthetic coding sequence
atgaagaccaagcctgtgagccacaagacagagaacacctaccgcttcctgacctttgctgagcggctgggcaatgtgaacatcgacatcatccacagaattgacagaacagccagctatgaggaggaggtggagacctacttctttgagggcctgctgaagtggagggagctgaacctgacagagcactttgggaagttctacaaggaggtgattgacaagtgccagagcttcaaccagctggtgtaccaccagaatgagatcgtgcagagcctgaagacccacctgcaggtgaagaacagctttgcctaccagcccctgctggacctggtggtgcagctggcccgggacctgcagatggacttctacccccacttccctgagttcttcctgaccatcaccagcatcctggagacccaggacacagagctgctggagtgggccttcaccagcctgagctacctgtacaagtacctgtggaggctgatggtgaaggacatgagcagcatctacagcatgtacagcaccctgctggcccacaagaagctgcacatccggaactttgctgctgagagcttcaccttcctgatgaggaaggtgtctgacaagaatgccctcttcaacctgatgttcctggacctggacaagcaccctgagaaggtggagggcgtgggccagctgctgtttgagatgtgcaagggcgtgaggaacatgttccacagctgcaccggccaggccgtgaagctgatcctgaggaagctgggccctgtgacagaaacagagacccagctgccctggatgctgattggagagaccctgaagaacatggtgaagagcacagtgtcctacatcagcaaggagcacttcggcaccttctttgagtgcctgcaggagagcctgctggacctgcacaccaaggtgaccaagaccaactgctgtgagagcagcgagcagatcaagaggctgctggagacctacctgatcctggtgaagcacggcagcggcaccaagatccccaccccagcagatgtgtgcaaggtgctgagccagaccctgcaggtggccagcctgagcaccagctgctgggagaccctgctggatgtgatcagcgccctgatcctgggggagaatgtgtccctgcctgagaccctcatcaaggagaccatcgagaagatctttgagagcagatttgagaagaggctcatcttctccttcagcgaggtgatgtttgccatgaagcagtttgagcagctgttcctgcccagcttcctgagctacatcgtgaactgcttcctgattgatgatgctgtggtgaaggatgaggccctggccatcctggccaagctgatcctgaacaaggccgccccacccacagctggctccatggccatcgagaagtaccccctggtgttcagcccccagatggtgggcttctacatcaagcagaagaagaccaggagcaagggcagaaatgagcagtttcctgtgctggaccacctgctgagcatcatcaagctgccccccaacaaggacaccacctacctgagccagagctgggccgccctggtggtgctgccccacatccggcccctggagaaggagaaggtgatccccctggtgacaggcttcatcgaggccctcttcatgacagtggacaagggcagctttgggaagggcaacctgtttgtgctgtgccaggccgtgaacaccctgctgagcctggaggagagcagcgagctgctgcacctggtgcctgtggagcgggtgaagaacctggtgctgaccttccccctggagcccagcgtgctgctgctgacagacctgtactaccagaggctggccctgtgtggctgcaagggccccctgagccaggaggccctgatggagctgttccccaagctgcaggccaacatcagcactggagtgtccaagatccggctgctgaccatccgcatcctgaaccactttgatgtgcagctgcctgagagcatggaggatgatggcctgtctgagcggcagagcgtgtttgccatcctgcggcaggccgagctggtgcctgccaccgtgaatgactaccgggagaagctgctgcacctgaggaagctgcggcatgatgtggtgcagacagctgtgcctgatggccccctgcaggaggtgcccctgcgctacctgctgggcatgctgtacatcaacttcagcgccctgtgggaccccgtcatcgagctgatcagcagccacgcccacgagatggagaacaagcagttctggaaggtgtactatgagcacctggagaaggccgccacccacgccgagaaggagctgcagaatgacatgacagatgagaagtctgtgggagatgagagctgggagcagacccaggagggagatgtgggcgccctgtaccacgagcagctggccctgaagacagactgccaggagcggctggaccacaccaacttccgcttcctgctgtggagggccctgaccaagtttcctgagcgggtggagcccaggagccgggagctgagccccctcttcctgcgcttcatcaacaatgagtactacccagctgacctgcaggtggcccccacccaggacctgcggaggaagggcaagggcatggtggccgaggagattgaggaggagcctgctgctggagatgatgaggagctggaggaggaggccgtgccccaggatgagagcagccagaagaagaagacccggcgggctgctgccaagcagctgattgcccacctgcaggtgttcagcaagttcagcaacccccgggccctgtacctggagagcaagctgtatgagctgtacctgcagctgctgctgcaccaggaccagatggtgcagaagatcaccctggactgcatcatgacctacaagcacccccacgtgctgccctaccgggagaacctgcagaggctgctggaggaccgctccttcaaggaggagatcgtgcacttcagcatcagtgaagataatgctgtggtgaagacagcccacagagctgacctcttccccatcctgatgaggatcctgtatggccgcatgaagaacaagacaggcagcaagacccagggcaagagcgccagcggcaccaggatggccatcgtgctgcgcttcctggccggcacccagcctgaggagatccagatcttcctggacctgctgtttgagcctgtgcgccacttcaagaatggagagtgccacagcgctgtgatccaggccgtggaggacctggacctgagcaaggtgctgcccctgggccggcagcacggcatcctgaacagcctggagatcgtgctgaagaacatcagccacctgatcagcgcctacctgcccaagatcctgcagatcctgctgtgcatgacagccaccgtgagccacatcctggaccagcgggagaagatccagctgcgcttcatcaaccccctgaagaacctgcggcggctgggcatcaagatggtgacagacatcttcctggactgggagagctaccagttcagaacagaggagattgatgctgtgttccatggagctgtgtggccccagatcagccggctgggcagcgagagccagtacagccccacccccctgctgaagctgatcagcatctggagcagaaatgcccgctacttccccctgctggccaagcagaagccaggccacccagaatgtgacatcctgaccaacgtgtttgccatcctgagcgccaagaacctgagtgatgccacagccagcatcgtgatggacatcgtggatgacctgctgaacctgcctgactttgagcccacagagaccgtgctgaacctgctggtgacaggctgtgtgtacccaggcattgctgagaacatcggggagagcatcaccatcggcggccgcctcatcctgccccacgtgcctgccatcctgcagtacctgagcaagaccaccatctctgctgagaaggtgaagaagaagaagaacagagcccaggtgtccaaggagctgggcatcctgagcaagatcagcaagttcatgaaggacaaggagcagagctctgtgctgatcaccctgctgctgcccttcctgcaccggggcaacattgctgaggacacagaggtggacatcctggtgacagtgcagaacctgctgaagcactgtgtggaccccaccagcttcctgaagcccatcgccaagctgttcagcgtcatcaagaacaagctgagcaggaagctgctgtgcaccgtgtttgagaccctgagtgactttgagagcggcctgaagtacatcacagatgtggtgaagctgaatgcctttgaccagaggcacctggatgacatcaactttgatgtgcgctttgagaccttccagaccatcaccagctacatcaaggagatgcagatcgtggatgtgaactacctgatccctgtgatgcacaactgcttctacaacctggagctgggggacatgagcctgagtgacaatgcctccatgtgcctgatgagcatcatcaagaagctggccgccctgaatgtgacagagaaggactaccgggagatcatccacaggagcctgctggagaagctgaggaagggcctgaagagccagacagagagcatccagcaggactacaccaccatcctgagctgcctgatccagaccttccccaaccagctggagttcaaggacctggtgcagctgacccactaccatgaccctgagatggacttctttgagaacatgaagcacatccagatccacagaagagcccgggccctgaagaagctggccaagcagctgatggagggcaaggtggtgctgagcagcaagagcctgcagaactacatcatgccctatgccatgacccccatctttgatgagaagatgctgaagcatgagaacatcaccacagctgccacagagatcatcggggccatctgcaagcacctgtcctggagcgcctacatgtactacctgaagcacttcatccacgtgctgcagacaggccagatcaaccagaagctgggcgtgtccctgctggtgattgtgctggaggccttccactttgaccacaagaccctggaggagcagatgggcaagattgaaaatgaggagaatgccatcgaggccatcgagctgcctgagcctgaggccatggagctggagcgggtggatgaggaggagaaggagtacacctgcaagagcctgagtgacaatggccagcccggcaccccagaccctgctgacagcggcggcaccagcgccaaggagagcgagtgcatcaccaagcctgtgtccttcctgccccagaacaaggaggagattgaaagaaccatcaagaacatccagggcaccatcaccggggacatcctgccccggctgcacaagtgcctggccagcaccaccaagcgggaggaggagcacaagctggtgaagagcaaggtggtgaatgatgaggaggtggtgcgggtgcccctggcctttgccatggtgaagctgatgcagagcctgccccaggaggtgatggaggccaacctgcccagcatcctgctgaaggtgtgtgccctgctgaagaacagagcccaggagatccgggacatcgcccggagcaccctggccaagatcatcgaggacctgggcgtgcacttcctgctgtatgtgctgaaggagctgcagaccaccctggtgcggggctaccaggtgcacgtgctgaccttcaccgtgcacatgctgctgcagggcctgaccaacaagctgcaggtgggggacctggacagctgcctggacatcatgattgagatcttcaaccacgagctgtttggagctgtggccgaggagaaggaggtgaagcagatcctgagcaaggtgatggaggcccggcgcagcaagagctatgacagctatgagatcctgggcaagtttgtgggcaaggaccaggtgaccaagctgatcctgcccctgaaggagatcctgcagaacaccaccagcctgaagctggccaggaaggtgcatgagaccctgcggcgcatcaccgtgggcctcatcgtgaaccaggagatgacagctgagagcatcctgctgctgtcctatggcctcatcagcgagaacctgcccctgctgacagagaaggagaagaaccctgtggccccagccccagacccccggctgcccccccagagctgcctgctgctgccccccacccctgtgcggggcggccagaaggctgtggtgtccaggaagaccaacatgcacatcttcatcgagagcggcctgcggctgctgcacctgagcctgaagaccagcaagatcaagagcagtggagaatgtgtgctggagatgctggacccctttgtgtccctgctgattgactgcctgggctccatggatgtgaaggtgatcactggagccctgcagtgcctgatctgggtgctgcgcttccccctgcccagcattgagaccaaggccgagcagctgaccaagcacctgttcctgctgctgaaggactatgccaagctgggcgccgcccggggccagaacttccacctggtggtgaactgcttcaagtgtgtgaccatcctggtgaagaaggtgaagagctaccagatcacagagaagcagctgcaggtgctgctggcctatgcagaggaggacatctatgacaccagccggcaggccacagccttcggcctgctgaaggccatcctgagcaggaagctgctggtgcctgagattgatgaggtgatgaggaaggtgtccaagctggccgtgtctgcccagagcgagcccgcccgggtgcagtgccggcaggtgttcctgaagtacatcctggactaccccctgggggacaagctgcggcccaacctggagttcatgctggcccagctgaactatgagcacgagaccggccgggagagcaccctggagatgattgcctacctgtttgacaccttcccccagggcctgctgcacgagaactgtggcatgttcttcatccccctgtgcctgatgaccatcaatgatgattctgccacctgcaagaagatggcctccatgaccatcaagagcctgctgggcaagatcagcctggagaagaaggactggctgtttgacatggtgaccacctggtttggagccaagaagaggctgaaccggcagctggccgccctgatctgtggcctgtttgtggagagcgagggcgtggactttgagaagaggctgggcaccgtgctgcccgtcatcgagaaggagattgatcctgagaacttcaaggacatcatggaggagacagaggagaaggctgctgaccggctgctcttctccttcctgaccctcatcaccaagctgatcaaggagtgcaacatcatccagttcaccaagccagctgagaccctgagcaagatctggagccacgtgcacagccacctgcggcacccccacaactgggtgtggctgacagctgcccagatcttcggcctgctgtttgccagctgccagcctgaggagctgatccagaagtggaacaccaagaagaccaagaagcacctgcctgagcctgtggccatcaagttcctggccagtgacctggaccagaagatgaagagcatcagcctggccagctgccaccagctgcacagcaagttcctggaccagagcctgggggagcaggtggtgaagaacctgctgtttgctgccaaggtgctgtacctgctggagctgtactgtgaggacaagcagagcaagatcaaggaggacctggaggagcaggaggccctggaggatggagtggcctgtgctgatgagaaggccgagagtgatggagaggagaaggaggaggtgaaggaggagctgggccggcctgccaccctgctgtggctgatccagaagctgagcagaattgccaagctggaggccgcctacagccccaggaaccccctgaagaggacctgcatcttcaagttcctgggcgctgtggccatggacctgggcatcgacaaggtgaagccctacctgcccatgatcatcgcccccctcttccgggagctgaacagcacctacagcgagcaggaccccctgctgaagaacctgagccaggagatcatcgagctgctgaagaagctggtgggcctggagagcttcagcctggcctttgcctctgtgcagaagcaggccaatgagaagagggccctgaggaagaagaggaaggccctggagtttgtgaccaacccagacattgctgccaagaagaagatgaagaagcacaagaacaagtctgaggccaagaagaggaagattgagttcctgcggcccggctacaaggccaagaggcagaagagccacagcctgaaggacctggccatggtggagtag

SEQ ID NO: 175628 - DNA, 1440 bp, Artificial Sequence
  Description of Artificial Sequence: Synthetic coding sequence
atggtgggccgcagcagaagaagaggagctgccaagtgggccgctgtgcgggccaaggccggccccaccctgacagatgaaaatggagatgacctgggcctgccccccagccctggggacaccagctactaccaggaccaggtggatgacttccacgaggcccggagccgggccgccctggccaagggctggaatgaggtgcagagcggagatgaagaagatggagaggaggaggaggaggaggtgctggccctggacatggatgatgaagatgatgaagatggcggcaatgctggggaggaggaggaggaggagaatgctgatgatgatggcggcagctctgtgcagagcgaggccgaggcctctgtggaccccagcctgtcctggggccagaggaagaagctgtactatgacacagattatggcagcaagagccggggccggcagagccagcaggaggccgaggaggaggagcgggaggaggaggaggaggcccagatcatccagaggcggctggcccaggccctgcaggaggatgactttggagtggcctgggtggaggcctttgccaagcctgtgccccaggtggatgaagctgagaccagggtggtgaaggacctggccaaggtgtctgtgaaggagaagctgaagatgctgaggaaggagagccctgagctgctggagctgattgaggacctgaaggtgaagctgacagaggtgaaggatgagctggagcccctgctggagctggtggagcagggcatcatccccccaggcaagggcagccagtacctgcggaccaagtacaacctgtacctgaactactgcagcaacatctccttctacctgatcctgaaggcccggcgggtgcctgcccacggccaccctgtgattgaaaggctggtgacctacagaaacctgatcaacaagctgtctgtggtggaccagaagctgagcagcgagatccgccacctgctgaccctgaaggatgatgctgtgaagaaggagctgatccccaaggccaagagcaccaagcccaagcccaagtctgtgtccaagaccagcgctgctgcctgtgctgtgacagacctgagtgatgacagcgactttgatgagaaggccaagctgaagtactacaaggagattgaagatcggcagaagctgaagaggaagaaggaggagaacagcacagaggagcaggccctggaggaccagaatgccaagagggccatcacctaccagatcgccaagaacagaggcctgacccccaggaggaagaagattgacaggaacccccgggtgaagcaccgggagaagttcagaagagccaagatcagaagaagaggccaggtgcgggaggtgaggaaggaggagcagcgctacagcggggagctgagcggcatccgggccggcgtgaagaagagcatcaagctgaagtag

SEQ ID NO: 175629 - DNA, 756 bp, Artificial Sequence
  Description of Artificial Sequence: Synthetic coding sequence
tgaattggcctgatgagcctgagcaagggcctgctggaggagaagtaccgctacctgttcaaggaggtggccggccccacagagatgtgtgaccagaggcagctgggcctgctgctgcatgatgccatccagatcccccggcagctgggggaggtggccgcctttggaggcagcaacatcgagcccagcgtgcgcagctgcttccagcagaacaacaacaagccagagatctctgtgaaggagttcatcgactggatgcacctggagccccagagcatggtgtggctgcctgtgctgcaccgggtggccgctgctgagacagccaagcaccaggccaagtgcaacatctgcaaggaatgtcccatcgtgggcttccgctaccgcagcctgaagcacttcaactatgatgtgtgccagagctgcttcttcagcggccgcacagccaagggccacaagctgcactaccccatggtggagtactgcatccccaccaccagcggggaggatgtgcgggacttcaccaaggtgctgaagaacaagttccgcagcaagaagtactttgccaagcacccccggctgggctacctgcctgtgcagacagtgctggagggggacaacctggagacccccagccagagcccccagctgttccatgatgacacccacagcagaattgagcagtatgccacccggctggcccagatggagaggaccaacggcagcttcctgacagacagcagcagcaccaccggctag

SEQ ID NO: 175630 - DNA, 201 bp, Artificial Sequence
  Description of Artificial Sequence: Synthetic coding sequence
atgattggcctgaacttcaacctgcgggagctgctgaccaagtttgagaaggacatccaggccgagattgatgcccacaatgacatcttcaagagcattgatggcaaccggcagaagatggtgaaggccctgggcaacagcgaggaggccaccatgctgcagcaccggctggatgacatgaaccagcgctggaatgactag

SEQ ID NO: 175631 - DNA, 2967 bp, Artificial Sequence
  Description of Artificial Sequence: Synthetic coding sequence
atgcagatcctgcgctgcctgcagaagtgtgggaagctgaagatgatggctgtggtgaggaccagcctgcagaaggtggtggtgctgctgcaccggctgcagaggatggctgtgagcagcccccgctaccagaagctgtgcaaggacatccaggccgagattgatgcccacaatgacatcttcaagagcattgatggcaaccggcagaagatggtgaaggccctgggcaacagcgaggaggccaccatgctgcagcaccggctggatgacatgaaccagcgctggaatgacctgaaggccaagagcgccagcatccgggcccacctggaggccagcgctgagaagtggaaccggctgctgatgagcctggaggagctgatcaagtggctgaacatgaaggatgaggagctgaagaagcagatgcccatcggaggagatgtgcctgccctgcagctgcagtatgaccactgcaaggccctgcggcgggagctgaaggagaaggagtacagcgtgctgaatgctgtggaccaggcccgggtcttcctggccgaccagcccatcgaggcccctgaggagcccaggaggaacctgcagagcaagacagagctgaccccagaggagcgggcccagaagatcgccaaggccatgaggaagcagagcagcgaggtgaaggagaagtgggagagcctgaatgctgtgaccagcaactggcagaagcaggtggacaaggccctggagaagctgcgggacctgcagggcgccatggatgacctggatgctgacatgaaggaggccgagagcgtgagaaatggctggaagcctgtgggggacctgctgattgacagcctgcaggaccacatcgagaagatcatggccttccgggaggagatcgcccccatcaacttcaaggtgaagacagtgaatgacctgagcagccagctgagccccctggacctgcaccccagcctgaagatgagccggcagctggatgacctgaacatgcgctggaagctgctgcaggtgtctgtggatgaccggctgaagcagctgcaggaggcccaccgggactttggccccagcagccagcacttcctgagcacctctgtgcagctgccctggcagaggagcatcagccacaacaaggtgccctactacatcaaccaccagacccagaccacctgctgggaccaccccaagatgacagagctgttccagagcctggccgacctgaacaacgtgcgcttcagcgcctacagaacagccatcaagatccggcggctgcagaaggccctgtgcctggacctgctggagctgagcaccaccaatgagatcttcaagcagcacaagctgaaccagaatgaccagctgctgtctgtgcctgatgtgatcaactgcctgaccaccacctatgatggcctggagcagatgcacaaggacctggtgaatgtgcccctgtgtgtggacatgtgcctgaactggctgctgaatgtgtatgacaccggccgcacaggcaagatccgggtgcagagcctgaagattggcctgatgagcctgagcaagggcctgctggaggagaagtaccgctacctgttcaaggaggtggccggccccacagagatgtgtgaccagaggcagctgggcctgctgctgcatgatgccatccagatcccccggcagctgggggaggtggccgccttcggcggcagcaacatcgagcccagcgtgcgcagctgcttccagcagaacaacaacaagccagagatctctgtgaaggagttcatcgactggatgcacctggagccccagagcatggtgtggctgcctgtgctgcaccgggtggccgctgctgagacagccaagcaccaggccaagtgcaacatctgcaaggagtgccccatcgtgggcttccgctaccgcagcctgaagcacttcaactatgatgtgtgccagagctgcttcttcagcggccgcacagccaagggccacaagctgcactaccccatggtggagtactgcatccccaccaccagcggagaagatgtgcgggacttcaccaaggtgctgaagaacaagttccgcagcaagaagtactttgccaagcacccccggctgggctacctgcctgtgcagacagtgctggagggggacaacctggagacccccatcaccctcatctccatgtggccagagcactatgaccccagccagagcccccagctgttccatgatgacacccacagcagaattgagcagtatgccacccggctggcccagatggagaggaccaacggcagcttcctgacagacagcagcagcaccaccggctctgtggaggatgaacatgccctgatccagcagtactgccagaccctgggcggggagagccctgtgtcccagccccagagccctgcccagatcctgaagtctgtggagcgggaggagcggggggagctggagcgcatcatcgctgacctggaggaggagcagaggaacctgcaggtggagtatgagcagctgaaggaccagcacctgcggcggggcctgcctgtgggcagccccccagagagcatcatcagcccccaccacaccagtgaagattctgagctgattgctgaggccaagctgctgcggcagcacaagggccgcctggaggccaggatgcagatcctggaggaccacaacaagcagctggagagccagctgcaccggctgcggcagctgctggagcagcctgagagtgacagccgcatcaacggggtgagcccctgggccagcccccagcacagcgccctgagctacagcctggaccctgatgccagcggcccccagttccaccaggccgccggggaggacctgctggcccctcctcatgacaccagcacagacctgacagaggtgatggagcagatccacagcaccttccccagctgctgccccaacgtgcccagccggccccaggccatgtag

SEQ ID NO: 175632 - DNA, 3069 bp, Artificial Sequence
  Description of Artificial Sequence: Synthetic coding sequence
atggccaagtacggggagcacgaggccagcccagacaatggccagaatgagttcagtgacatcatcaagagcagaagtgatgagcacaatgatgtgcagaagaagaccttcaccaagtggatcaatgcccgcttcagcaagagcggcaagccacccatcaatgacatgttcacagacctgaaggatggcaggaagctgctggacctgctggagggcctgaccggcaccagcctgcccaaggagcggggcagcaccagggtgcacgccctgaacaacgtgaacagagtgctgcaggtgctgcaccagaacaacgtggagctggtgaacatcggcggcacagacatcgtggatggcaaccacaagctgaccctgggcctgctgtggagcatcatcctgcactggcaggtgaaggatgtgatgaaggatgtgatgtctgacctgcagcagaccaacagcgagaagatcctgctgtcctgggtgcggcagaccacccggccctacagccaggtgaatgtgctgaacttcaccacctcctggacagatggcctggccttcaatgctgtgctgcaccgccacaagccagacctcttctcctgggacaaggtggtgaagatgagccccatcgagcggctggagcacgccttcagcaaggcccagacctacctgggcatcgagaagctgctggaccctgaagatgtggccgtgcagctgcctgacaagaagagcatcatcatgtacctgaccagcctgtttgaggtgctgccccagcaggtgaccattgatgccatccgggaggtggagaccctgcccaggaagtacaagaaggaatgtgaggaggaggccatcaacatccagagcacagcccctgaggaggagcacgagagccccagggctgagacccccagcacagtgacagaggtggacatggacctggacagctaccagatcgccctggaggaggtgctgacctggctgctgtctgctgaggacaccttccaggagcaggatgacatcagtgatgatgtggaggaggtgaaggaccagtttgccacccatgaggccttcatgatggagctgacagcccaccagagctctgtgggctctgtgctgcaggccggcaaccagctgatcacccagggcaccctgagtgatgaggaggagtttgagatccaggagcagatgaccctgctgaatgcccgctgggaggccctgcgggtggagagcatggaccggcagagccggctgcatgatgtgctgatggagctgcagaagaagcagctgcagcagctgagcgcctggctgaccctgacagaggagcgcatccagaagatggagacctgccccctggatgatgatgtgaagagcctgcagaagctgctggaggagcacaagagcctgcagagcgacctggaggccgagcaggtgaaggtgaacagcctgacccacatggtggtgattgtggatgaaaattctggagagagcgccacagccatcctggaggaccagctgcagaagctgggggagcgctggacagctgtgtgccgctggacagaggagcgctggaaccggctgcaggagatcaacatcctgtggcaggagctgctggaggagcagtgcctgctgaaggcctggctgacagagaaggaggaggccctgaacaaggtgcagaccagcaacttcaaggaccagaaggagctgtctgtgtctgtgcggcggctggccatcctgaaggaggacatggagatgaagaggcagaccctggaccagctgtctgaaattggccaggatgtgggccagctgctggacaacagcaaggccagcaagaagatcaacagcgacagcgaggagctgacccagcgctgggacagcctggtgcagaggctggaggacagcagcaaccaggtgacccaggccgtggccaagctgggcatgagccagatcccccagaaggacctgctggagaccgtgcgggtgcgggagcaggccatcaccaagaagagcaagcaggagctgcccccacctcctccacccaagaagaggcagatccacgtggacatcgaggccaagaagaagtttgatgccatctctgctgagctgctgaactggatcctgaagtggaagacagccatccagaccacagagatcaaggagtacatgaagatgcaggacaccagcgagatgaagaagaagctgaaggccctggagaaggagcagcgggagcgcatccccagggcagatgagctgaaccagacaggccagatcctggtggagcagatgggcaaggagggcctgcccacagaggagatcaagaatgtgctggagaaggtgagcagcgagtggaagaatgtgtcccagcacctggaggacctggagaggaagatccagctgcaggaggacatcaatgcctacttcaagcagctggatgagctggagaaggtgatcaagaccaaggaggagtgggtgaagcacaccagcatcagcgagagcagccggcagagcctgcccagcctgaaggacagctgccagcgggagctgaccaacctgctgggcctgcaccccaagattgagatggcccgggccagctgcagcgccctgatgagccagcccagcgccccagactttgtgcagaggggctttgacagcttcctgggccgctaccaggccgtgcaggaggccgtggaggaccggcagcagcacctggagaatgagctgaagggccagcccggccacgcctacctggagaccctgaagaccctgaaggatgtgctgaatgacagcgagaacaaggcccaggtgtccctgaatgtgctgaatgacctggccaaggtggagaaggccctgcaggagaagaagaccctggatgagatcctggagaaccagaagccagccctgcacaagctggccgaggagaccaaggccctggagaagaatgtgcacccagatgtggagaagctgtacaagcaggagtttgatgatgtgcagggcaagtggaacaagctgaaggtgctggtgtccaaggacctgcacctgctggaggagatcgccctgaccctgcgggcctttgaatag

SEQ ID NO: 175633 - DNA, 10302 bp, Artificial Sequence
  Description of Artificial Sequence: Synthetic coding sequence
atggccaagtacggggagcacgaggccagcccagacaatggccagaatgagttcagtgacatcatcaagagcagaagtgatgagcacaatgatgtgcagaagaagaccttcaccaagtggatcaatgcccgcttcagcaagagcggcaagccacccatcaatgacatgttcacagacctgaaggatggcaggaagctgctggacctgctggagggcctgaccggcaccagcctgcccaaggagcggggcagcaccagggtgcacgccctgaacaacgtgaacagagtgctgcaggtgctgcaccagaacaacgtggagctggtgaacatcggcggcacagacatcgtggatggcaaccacaagctgaccctgggcctgctgtggagcatcatcctgcactggcaggtgaaggatgtgatgaaggatgtgatgtctgacctgcagcagaccaacagcgagaagatcctgctgtcctgggtgcggcagaccacccggccctacagccaggtgaatgtgctgaacttcaccacctcctggacagatggcctggccttcaatgctgtgctgcaccgccacaagccagacctcttctcctgggacaaggtggtgaagatgagccccatcgagcggctggagcacgccttcagcaaggcccagacctacctgggcatcgagaagctgctggaccctgaagatgtggccgtgcagctgcctgacaagaagagcatcatcatgtacctgaccagcctgtttgaggtgctgccccagcaggtgaccattgatgccatccgggaggtggagaccctgcccaggaagtacaagaaggaatgtgaggaggaggccatcaacatccagagcacagcccctgaggaggagcacgagagccccagggctgagacccccagcacagtgacagaggtggacatggacctggacagctaccagatcgccctggaggaggtgctgacctggctgctgtctgctgaggacaccttccaggagcaggatgacatcagtgatgatgtggaggaggtgaaggaccagtttgccacccatgaggccttcatgatggagctgacagcccaccagagctctgtgggctctgtgctgcaggccggcaaccagctgatcacccagggcaccctgagtgatgaggaggagtttgagatccaggagcagatgaccctgctgaatgcccgctgggaggccctgcgggtggagagcatggaccggcagagccggctgcatgatgtgctgatggagctgcagaagaagcagctgcagcagctgagcgcctggctgaccctgacagaggagcgcatccagaagatggagacctgccccctggatgatgatgtgaagagcctgcagaagctgctggaggagcacaagagcctgcagagcgacctggaggccgagcaggtgaaggtgaacagcctgacccacatggtggtgattgtggatgaaaattctggagagagcgccacagccatcctggaggaccagctgcagaagctgggggagcgctggacagctgtgtgccgctggacagaggagcgctggaaccggctgcaggagatcaacatcctgtggcaggagctgctggaggagcagtgcctgctgaaggcctggctgacagagaaggaggaggccctgaacaaggtgcagaccagcaacttcaaggaccagaaggagctgtctgtgtctgtgcggcggctggccatcctgaaggaggacatggagatgaagaggcagaccctggaccagctgtctgaaattggccaggatgtgggccagctgctggacaacagcaaggccagcaagaagatcaacagcgacagcgaggagctgacccagcgctgggacagcctggtgcagaggctggaggacagcagcaaccaggtgacccaggccgtggccaagctgggcatgagccagatcccccagaaggacctgctggagaccgtgcgggtgcgggagcaggccatcaccaagaagagcaagcaggagctgcccccacctcctccacccaagaagaggcagatccacgtggacatcgaggccaagaagaagtttgatgccatctctgctgagctgctgaactggatcctgaagtggaagacagccatccagaccacagagatcaaggagtacatgaagatgcaggacaccagcgagatgaagaagaagctgaaggccctggagaaggagcagcgggagcgcatccccagggcagatgagctgaaccagacaggccagatcctggtggagcagatgggcaaggagggcctgcccacagaggagatcaagaatgtgctggagaaggtgagcagcgagtggaagaatgtgtcccagcacctggaggacctggagaggaagatccagctgcaggaggacatcaatgcctacttcaagcagctggatgagctggagaaggtgatcaagaccaaggaggagtgggtgaagcacaccagcatcagcgagagcagccggcagagcctgcccagcctgaaggacagctgccagcgggagctgaccaacctgctgggcctgcaccccaagattgagatggcccgggccagctgcagcgccctgatgagccagcccagcgccccagactttgtgcagaggggctttgacagcttcctgggccgctaccaggccgtgcaggaggccgtggaggaccggcagcagcacctggagaatgagctgaagggccagcccggccacgcctacctggagaccctgaagaccctgaaggatgtgctgaatgacagcgagaacaaggcccaggtgtccctgaatgtgctgaatgacctggccaaggtggagaaggccctgcaggagaagaagaccctggatgagatcctggagaaccagaagccagccctgcacaagctggccgaggagaccaaggccctggagaagaatgtgcacccagatgtggagaagctgtacaagcaggagtttgatgatgtgcagggcaagtggaacaagctgaaggtgctggtgtccaaggacctgcacctgctggaggagatcgccctgaccctgcgggcctttgaagctgacagcaccgtcatcgagaagtggatggatggagtgaaggacttcctgatgaagcagcaggccgcccagggagatgatgctggcctgcagaggcagctggaccagtgcagcgcctttgtgaatgaaattgagaccatcgagagcagcctgaagaacatgaaggagattgagaccaacctgcggagcggccctgtggccggcatcaagacctgggtgcagacccggctgggggactaccagacccagctggagaagctgagcaaggagatcgccacccagaagagccggctgtctgagagccaggagaaggccgccaacctgaagaaggacctggccgagatgcaggagtggatgacccaggccgaggaggagtacctggagcgggactttgagtacaagagccctgaggagctggagagcgctgtggaggagatgaagagggccaaggaggatgtgctgcagaaggaggtgcgggtgaagatcctgaaggacaacatcaagctgctggccgccaaggtgcccagcggcggccaggagctgaccagcgagctgaatgtggtgctggagaactaccagctgctgtgcaaccgcatccggggcaagtgccacaccctggaggaggtgtggagctgctggattgagctgctgcactacctggacctggagaccacctggctgaacaccctggaggagaggatgaagagcacagaggtgctgcctgagaagacagatgctgtgaatgaggccctggagagcctggagagcgtgctgcggcaccctgctgacaacagaacccagatccgggagctgggccagaccctgattgatggcggcatcctggatgacatcatcagcgagaagctggaggccttcaacagccgctatgaggacctgagccacctggccgagagcaagcagatcagcctggagaagcagctgcaggtgctgcgggagacagaccagatgctgcaggtgctgcaggagagcctgggggagctggacaagcagctgaccacctacctgacagacagaattgatgccttccaggtgccccaggaggcccagaagatccaggccgagatcagcgcccacgagctgaccctggaggagctgcggaggaacatgaggagccagcccctgaccagccctgagagcaggacagcccggggcggcagccagatggatgtgctgcagaggaagctgcgggaggtgtccaccaagttccagctgttccagaagccagccaactttgagcagaggatgctggactgcaagagggtgctggatggagtgaaggccgagctgcacgtgctggatgtgaaggatgtggaccctgatgtgatccagacccacctggacaagtgcatgaagctgtacaagaccctgtctgaggtgaagctggaggtggagaccgtcatcaagacaggccgccacatcgtgcagaagcagcagacagacaaccccaagggcatggatgagcagctgaccagcctgaaggtgctgtacaatgacctgggcgcccaggtgacagagggcaagcaggacctggagcgggccagccagctggccaggaagatgaagaaggaggccgccagcctgtctgagtggctgagcgccacagaaacagagctggtgcagaagagcaccagcgagggcctgctgggggacctggacacagagatctcctgggccaagaatgtgctgaaggacctggagaagaggaaggctgacctgaacaccatcacagagagcagcgctgccctgcagaacctgattgagggcagcgagcccatcctggaggagcggctgtgtgtgctgaatgccggctggagccgggtgaggacctggacagaggactggtgcaacaccctgatgaaccaccagaaccagctggagatctttgatggaaatgtggcccacatcagcacctggctgtaccaggccgaggccctgctggatgaaattgagaagaagcccaccagcaagcaggaggagatcgtgaagaggctggtgtctgagctggatgatgccaacctgcaggtggagaatgtgcgggaccaggccctgatcctgatgaatgcccggggcagcagcagccgggagctggtggagcccaagctggccgagctgaacagaaactttgagaaggtgtcccagcacatcaagagcgccaagctgctgattgcccaggagcccctgtaccagtgcctggtgaccacagagacctttgagaccggggtgcccttcagtgacctggagaagctggagaatgacatcgagaacatgctgaagtttgtggagaagcacctggagagcagtgatgaagatgagaagatggatgaggagagcgcccagatcgaggaggtgctgcagagaggagaggagatgctgcaccagcccatggaggacaacaagaaggagaagatccggctgcagctgctgctgctgcacacccgctacaacaagatcaaggccatccccatccagcagaggaagatgggccagctggccagcggcatccgcagcagcctgctgcccacagactacctggtggagatcaacaagatcctgctgtgcatggatgatgtggagctgagcctgaatgtgcctgagctgaacacagccatctatgaggacttctccttccaggaggacagcctgaagaacatcaaggaccagctggacaagctgggggagcagattgctgtgatccacgagaagcagccagatgtgatcctggaggccagcggccctgaggccatccagatccgggacaccctgacccagctgaatgccaagtgggaccgcatcaacaggatgtacagcgacaggaagggctgctttgaccgggccatggaggagtggaggcagttccactgtgacctgaatgacctgacccagtggatcacagaagctgaggagctgctggtggacacctgtgcccctgggggcagcctggacctggagaaggcccgcatccaccagcaggagctggaggtgggcatcagcagccaccagcccagctttgctgccctgaacagaactggagatggcatcgtgcagaagctgagccaggctgatggcagcttcctgaaggagaagctggccggcctgaaccagcgctgggatgccatcgtggccgaggtgaaggaccggcagccccggctgaagggggagagcaagcaggtgatgaagtaccgccaccagctggatgagatcatctgctggctgaccaaggccgagcacgccatgcagaagaggagcaccacagagctgggggagaacctgcaggagctgcgggacctgacccaggagatggaggtgcatgctgagaagctgaagtggctgaacagaacagagctggagatgctgagtgacaagagcctgagcctgcctgagcgggacaagatcagcgagagcctgaggacagtgaacatgacctggaacaagatctgccgggaggtgcccaccaccctgaaggagtgcatccaggagcccagctctgtgtcccagaccagaattgctgcccaccccaacgtgcagaaggtggtgctggtgtcctctgccagtgacatccctgtgcagagccacaggaccagcgagatcagcatcccagctgacctggacaagaccatcacagagctggccgactggctggtgctgattgaccagatgctgaagagcaacatcgtgacagtgggagatgtggaggagatcaacaagacagtgtccaggatgaagatcaccaaggctgacctggagcagaggcacccccagctggactatgtgttcaccctggcccagaacctgaagaacaaggccagcagcagtgacatgaggacagccatcacagagaagctggagcgggtgaagaaccagtgggatggcacccagcacggcgtggagctgcggcagcagcagctggaggacatgatcatcgacagcctgcagtgggatgaccaccgggaggagacagaggagctgatgaggaaatatgaggcccggctgtacatcctgcagcaggcccggcgggaccccctgaccaagcagatcagtgacaaccagatcctgctgcaggagctgggccctggagatggcatcgtgatggcctttgacaacgtgctgcagaagctgctggaggagtatggcagtgatgacaccagaaatgtgaaggagaccacagagtacctgaagacctcctggatcaacctgaagcagagcattgctgaccggcagaatgccctggaggccgagtggaggacagtgcaggccagcagaagagacctggagaacttcctgaagtggatccaggaggccgagaccaccgtgaatgtgctggtggatgccagccaccgggagaatgccctgcaggacagcatcctggcccgggagctgaagcagcagatgcaggacatccaggccgagattgatgcccacaatgacatcttcaagagcattgatggcaaccggcagaagatggtgaaggccctgggcaacagcgaggaggccaccatgctgcagcaccggctggatgacatgaaccagcgctggaatgacctgaaggccaagagcgccagcatccgggcccacctggaggccagcgctgagaagtggaaccggctgctgatgagcctggaggagctgatcaagtggctgaacatgaaggatgaggagctgaagaagcagatgcccatcggaggagatgtgcctgccctgcagctgcagtatgaccactgcaaggccctgcggcgggagctgaaggagaaggagtacagcgtgctgaatgctgtggaccaggcccgggtcttcctggccgaccagcccatcgaggcccctgaggagcccaggaggaacctgcagagcaagacagagctgaccccagaggagcgggcccagaagatcgccaaggccatgaggaagcagagcagcgaggtgaaggagaagtgggagagcctgaatgctgtgaccagcaactggcagaagcaggtggacaaggccctggagaagctgcgggacctgcagggcgccatggatgacctggatgctgacatgaaggaggccgagagcgtgagaaatggctggaagcctgtgggggacctgctgattgacagcctgcaggaccacatcgagaagatcatggccttccgggaggagatcgcccccatcaacttcaaggtgaagacagtgaatgacctgagcagccagctgagccccctggacctgcaccccagcctgaagatgagccggcagctggatgacctgaacatgcgctggaagctgctgcaggtgtctgtggatgaccggctgaagcagctgcaggaggcccaccgggactttggccccagcagccagcacttcctgagcacctctgtgcagctgccctggcagaggagcatcagccacaacaaggtgccctactacatcaaccaccagacccagaccacctgctgggaccaccccaagatgacagagctgttccagagcctggccgacctgaacaacgtgcgcttcagcgcctacagaacagccatcaagatccggcggctgcagaaggccctgtgcctggacctgctggagctgagcaccaccaatgagatcttcaagcagcacaagctgaaccagaatgaccagctgctgtctgtgcctgatgtgatcaactgcctgaccaccacctatgatggcctggagcagatgcacaaggacctggtgaatgtgcccctgtgtgtggacatgtgcctgaactggctgctgaatgtgtatgacaccggccgcacaggcaagatccgggtgcagagcctgaagattggcctgatgagcctgagcaagggcctgctggaggagaagtaccgctacctgttcaaggaggtggccggccccacagagatgtgtgaccagaggcagctgggcctgctgctgcatgatgccatccagatcccccggcagctgggggaggtggccgcctttggaggcagcaacatcgagcccagcgtgcgcagctgcttccagcagaacaacaacaagccagagatctctgtgaaggagttcatcgactggatgcacctggagccccagagcatggtgtggctgcctgtgctgcaccgggtggccgctgctgagacagccaagcaccaggccaagtgcaacatctgcaaggaatgtcccatcgtgggcttccgctaccgcagcctgaagcacttcaactatgatgtgtgccagagctgcttcttcagcggccgcacagccaagggccacaagctgcactaccccatggtggagtactgcatccccaccaccagcggggaggatgtgcgggacttcaccaaggtgctgaagaacaagttccgcagcaagaagtactttgccaagcacccccggctgggctacctgcctgtgcagacagtgctggagggggacaacctggagacccccatcaccctcatctccatgtggccagagcactatgaccccagccagagcccccagctgttccatgatgacacccacagccgcatcgagcagtatgccacccggctggcccagatggagaggaccaacggcagcttcctgacagacagcagcagcaccactggatctgtggaggatgagcacgccctgatccagcagtactgccagaccctgggcggggagagccctgtgtcccagccccagagccctgcccagatcctgaagtctgtggagcgggaggagcggggggagctggagcgcatcatcgctgacctggaggaggagcagaggaacctgcaggtggagtatgagcagctgaaggaccagcacctgcggcggggcctgcctgtgggcagccccccagagagcatcatcagcccccaccacaccagcgaggacagcgagctgattgctgaggccaagctgctgcggcagcacaagggccgcctggaggccaggatgcagatcctggaggaccacaacaagcagctggagagccagctgcaccggctgcggcagctgctggagcagcctgagagtgacagccgcatcaatggagtgagcccctgggccagcccccagcacagcgccctgagctacagcctggaccctgatgccagcggcccccagttccaccaggccgccggggaggacctgctggcccctcctcatgacaccagcacagacctgacagaggtgatggagcagatccacagcaccttccccagctgctgccccaacgtgcccagccggccccaggccatgtag

SEQ ID NO: 175634 - DNA, 555 bp, Artificial Sequence
  Description of Artificial Sequence: Synthetic coding sequence
atgcacctggagccccagagcatggtgtggctgcctgtgctgcaccgggtggccgctgctgagacagccaagcaccaggccaagtgcaacatctgcaaggagtgccccatcgtgggcttccgctaccgcagcctgaagcacttcaactatgatgtgtgccagagctgcttcttcagcggccgcacagccaagggccacaagctgcactaccccatggtggagtactgcatccccaccaccagcggagaagatgtgcgggacttcaccaaggtgctgaagaacaagttccgcagcaagaagtactttgccaagcacccccggctgggctacctgcctgtgcagacagtgctggagggggacaacctggagacccccagccagagcccccagctgttccatgatgacacccacagccgcatcgagcagtatgccacccggctggcccagatggagaggaccaacggcagcttcctgacagacagcagcagcaccactggatctgtggaggatgagcacgccctgatccagcagtactgccagaccctgggcggctag

SEQ ID NO: 175635 - DNA, 462 bp, Artificial Sequence
  Description of Artificial Sequence: Synthetic coding sequence
atgagcggcctggccgccaccaccttccactggaagaagtgccgcctggacctgcccggccacgtggccctgcaggcctgcaagaggctgcctgatgagcacaatgatgtgcagaagaagaccttcaccaagtggatcaatgcccgcttcagcaagagcggcaagccacccatcaatgacatgttcacagacctgaaggatggcaggaagctgctggacctgctggagggcctgaccggcaccagcctgcccaaggagcggggcagcaccagggtgcacgccctgaacaacgtgaacagagtgctgcaggtgctgcaccagaacaacgtggagctggtgaacattggaggaacagacatcgtggatggcaaccacaagctgaccctgggcctgctgtggagcatcatcctgcactggcaggtggatgtgatgaaggatgtgatgtctgacctgcagcagtag

SEQ ID NO: 175636 - DNA, 546 bp, Artificial Sequence
  Description of Artificial Sequence: Synthetic coding sequence
atgcacctggagccccagagcatggtgtggctgcctgtgctgcaccgggtggccgctgctgagacagccaagcaccaggccaagtgcaacatctgcaaggagtgccccatcgtgggcttccgctaccgcagcctgaagcacttcaactatgatgtgtgccagagctgcttcttcagcggccgcacagccaagggccacaagctgcactaccccatggtggagtactgcatccccaccaccagcggagaagatgtgcgggacttcaccaaggtgctgaagaacaagttccgcagcaagaagtactttgccaagcacccccggctgggctacctgcctgtgcagacagtgctggagggggacaacctggagacccccatcaccctcatctccatgtggccagagcactatgaccccagccagagcccccagctgttccatgatgacacccacagcagaattgagcagtatgccacccggctggcccagatggagaggaccaacggcagcttcctgacagacagcagcagcaccaccggctctgtgtag

SEQ ID NO: 175637 - DNA, 144 bp, Artificial Sequence
  Description of Artificial Sequence: Synthetic coding sequence
atggccaagtacggggagcacgaggccagcccagacaatggccagaatgagttcagtgacatcatcaagagcagaagtgatgagcacaatgatgtgcagaagaagaccttcaccaagtggatcaatgcccgcttcagcaagtag

SEQ ID NO: 175638 - DNA, 561 bp, Artificial Sequence
  Description of Artificial Sequence: Synthetic coding sequence
atgctggaggaggaggagtggtaccgcagcctgaagcacttcaactatgatgtgtgccagagctgcttcttcagcggccgcacagccaagggccacaagctgcactaccccatggtggagtactgcatccccaccaccagcggagaagatgtgcgggacttcaccaaggtgctgaagaacaagttccgcagcaagaagtactttgccaagcacccccggctgggctacctgcctgtgcagacagtgctggagggggacaacctggagacccccagccagagcccccagctgttccatgatgacacccacagccgcatcgagcagtatgccacccggctggcccagatggagaggaccaacggcagcttcctgacagacagcagcagcaccactggatctgtggaggatgagcacgccctgatccagcagtactgccagaccctgggcggggagagccctgtgtcccagccccagagccctgcccagatcctgaagtctgtggagcgggaggagcggggggagctggagcgcatcatcgctgacctggaggaggagcagtag

SEQ ID NO: 175639 - DNA, 201 bp, Artificial Sequence; identical to SEQ ID NO: 175630
  Description of Artificial Sequence: Synthetic coding sequence

SEQ ID NO: 175640 - DNA, 555 bp, Artificial Sequence; identical to SEQ ID NO: 175634
  Description of Artificial Sequence: Synthetic coding sequence

SEQ ID NO: 175641 - DNA, 2100 bp, Artificial Sequence
  Description of Artificial Sequence: Synthetic coding sequence
atgtctgccagcgcctctgtgggcggccctgtgccccagcccccacctggccctgctgctgccctgcccccaggcagcgctgcccgggccctgcacgtggagctgcccagccagcagaggcggctgcggcacctgaggaacattgctgccagaaatattgtgaacagaaatggccaccagctgctggacacctacttcaccctgcacctgtgcagcacagagaagatctacaaggagttctacagaagtgaggtgatcaagaacagcctgaaccccacctggaggagcctggactttggcatcatgccagaccggctggacacctctgtgtcctgctttgtggtgaagatctggggcggcaaggagaacatctaccagctgctgattgagtggaaggtgtgcctggatggcctgaagtacctgggccagcagatccacgccaggaaccagaatgagatcatcttcggcctgaatgatggctactacggggccccctttgagcacaagggctacagcaatgcccagaagaccatcctgctgcaggtggaccagaactgtgtgaggaacagctatgatgtgttcagcctgctgcggctgcaccgggcccagtgtgccatcaagcagacccaggtgacagtgcagaagattggcaaggagattgaggagaagctgcggctgaccagcaccagcaatgagctgaagaagaagtctgagtgcctgcagctgaagatcctggtgctgcagaatgagctggagcggcagaagaaggccctgggccgggaggtggccctgctgcacaagcagcagatcgccctgcaggacaagggcagcgccttctctgctgagcacctgaagctgcagctgcagaaggagagcctgaatgagctgaggaaagaatgtacagccaagcgggagctgttcctgaagaccaatgcccagctgaccatccgctgccggcagctgctgtctgagctgagctacatctaccccatcgacctgaatgagcacaaggactactttgtgtgtggggtgaagctgcccaacagcgaggacttccaggccaaggatgatggcagcattgctgtggccctgggctacacagcccacctggtgtccatgatctccttcttcctgcaggtgcccctgcgctaccccatcatccacaagggcagccgcagcaccatcaaggacaacatcaatgacaagctgacagagaaggagcgggagttccccctgtaccccaagggcggggagaagctgcagtttgattatggagtgtacctgctgaacaagaacatcgcccagctgcgctaccagcacggcctgggcaccccagacctgcggcagaccctgcccaacctgaagaacttcatggagcacggcctgatggtgcgctgtgacagacaccacaccagcagcgccatccctgtgcccaagaggcagagcagcatctttggaggagcagatgtgggcttcagcggcggcatccccagcccagacaagggccacaggaagagggccagcagtgaaaatgaaaggctgcagtacaagaccccaccacccagctacaacagcgccctggcccagcctgtgaccaccgtgcccagcatgggagaaacagagaggaagatcaccagcctgagcagcagcctggacaccagcctggacttcagcaaggagaacaagaagaagggggaggacctggtgggcagcctgaatggaggccacgccaacgtgcaccccagccaggagcagggcgaggccctgagcggccaccgggccaccgtgaatggcaccctgctgcccagcgagcaggccggcagcgcctctgtgcagctgcccggggagttccaccctgtgtctgaggccgagctgtgctgcaccgtggagcaggccgaggagatcatcggcctggaggccactggatttgccagcggggaccagctggaggccttcaactgcatccctgtggacagcgctgtggccgtggagtgtgatgagcaggtgctgggggagtttgaggagttcagccgccgcatctatgccctgaatgaaaatgtgtcctccttcagaagaccccggcgcagcagtgacaagtag

SEQ ID NO: 175642 - DNA, 768 bp, Artificial Sequence
  Description of Artificial Sequence: Synthetic coding sequence
atgttcatctctgtggcccagaggcagagagaaaatgccttcagctgcagcaccttcctgcgctgtgacagacaccacaccagcagcgccatccctgtgcccaagaggcagagcagcatctttggaggagcagatgtgggcttcagcggcggcatccccagcccagacaagggccacaggaagagggccagcagtgaaaatgaaaggctgcagtacaagaccccaccacccagctacaacagcgccctggcccagcctgtgaccaccgtgcccagcatgggagaaacagagaggaagatcaccagcctgagcagcagcctggacaccagcctggacttcagcaaggagaacaagaagaagggggaggacctggtgggcagcctgaatggaggccacgccaacgtgcaccccagccaggagcagggcgaggccctgagcggccaccgggccaccgtgaatggcaccctgctgcccagcgagcaggccggcagcgcctctgtgcagctgcccggggagttccaccctgtgtctgaggccgagctgtgctgcaccgtggagcaggccgaggagatcatcggcctggaggccactggatttgccagcggggaccagctggaggccttcaactgcatccctgtggacagcgctgtggccgtggagtgtgatgagcaggtgctgggggagtttgaggagttcagccgccgcatctatgccctgaatgaaaatgtgtcctccttcagaagaccccggcgcagcagtgacaagtag

SEQ ID NO: 175643 - DNA, 984 bp, Artificial Sequence
  Description of Artificial Sequence: Synthetic coding sequence
atgatctccttcttcctgcaggtgcccctgcgctaccccatcatccacaagggcagccgcagcaccatcaaggacaacatcaatgacaagctgacagagaaggagcgggagttccccctgtaccccaagggcggggagaagctgcagtttgattatggagtgtacctgctgaacaagaacatcgcccagctgcgctaccagcacggcctgggcaccccagacctgcggcagaccctgcccaacctgaagaacttcatggagcacggcctgatggtgcgctgtgacagacaccacaccagcagcgccatccctgtgcccaagaggcagagcagcatctttggaggagcagatgtgggcttcagcggcggcatccccagcccagacaagggccacaggaagagggccagcagtgaaaatgaaaggctgcagtacaagaccccaccacccagctacaacagcgccctggcccagcctgtgaccaccgtgcccagcatgggagaaacagagaggaagatcaccagcctgagcagcagcctggacaccagcctggacttcagcaaggagaacaagaagaagggggaggacctggtgggcagcctgaatggaggccacgccaacgtgcaccccagccaggagcagggcgaggccctgagcggccaccgggccaccgtgaatggcaccctgctgcccagcgagcaggccggcagcgcctctgtgcagctgcccggggagttccaccctgtgtctgaggccgagctgtgctgcaccgtggagcaggccgaggagatcatcggcctggaggccactggatttgccagcggggaccagctggaggccttcaactgcatccctgtggacagcgctgtggccgtggagtgtgatgagcaggtgctgggggagtttgaggagttcagccgccgcatctatgccctgaatgaaaatgtgtcctccttcagaagaccccggcgcagcagtgacaagtag

SEQ ID NO: 175644 - DNA, 4251 bp, Artificial Sequence
  Description of Artificial Sequence: Synthetic coding sequence
atgaagagcctgaagagccggctgcggcggcaggatgtgcccggccctgccagcagtggagctgctgctgccagcgcccacgccgctgactggaacaagtatgatgaccggctgatgaaggctgctgagagaggagatgtggagaaggtgaccagcatcctggccaagaagggcgtgaaccctgggaagctggatgtggagggccgcagcgtcttccacgtggtgaccagcaagggcaacctggagtgcctgaatgccatcctgatccacggcgtggacatcaccaccagtgacacagctggaagaaatgccctgcacctggccgccaagtatggccacgccctgtgcctgcagaagctgctgcagtacaactgccccacagaacatgctgacctgcagggccgcacagccctgcatgatgctgccatggctgactgccccagcagcatccagctgctgtgtgaccacggggcctctgtgaatgccaaggatgtggatggccgcacccccctggtgctggccacccagatgagccggcccaccatctgccagctgctgattgacagaggagcagatgtgaacagccgggacaagcagaacagaacagccctgatgctgggctgtgaatatggctgcagagatgctgtggaggtgctgatcaagaatggagctgacatcagcctgctggatgccctgggccatgacagcagctactatgcccgcatcggggacaacctggacatcctgaccctgctgaagacagccagcgagaacaccaacaagggccgggagctgtggaagaagggccccagcctgcagcagaggaacctgacccacatgcaggatgaggtgaatgtgaagagccaccagcgggagcaccagaacatccaggacctggagattgaaaatgaagacctgaaggagcggctgaggaagatccagcaggagcagaggatcctgctggacaaggtgaatggcctgcagctgcagctgaatgaggaggtgatggtggctgatgacctggagagcgagcgggagaagctgaagagcctgctggccgccaaggagaagcagcacgaggagagcctgcggaccatcgaggccctgaagaaccgcttcaagtactttgaaagtgaccacctgggcagcggcagccacttcagcaacaggaaggaggacatgctgctgaagcagggccagatgtacatggctgacagccagtgcaccagccctggcatcccagcccacatgcagagccgctccatgctgcggcccctggagctgagcctgcccagccagaccagctacagtgaaaatgagatcctgaagaaggagctggaggccatgaggaccttctgtgagagcgccaagcaggaccggctgaagctgcagaatgagctggcccacaaggtggccgagtgcaaggccctggccctggagtgtgagcgggtgaaggaggacagtgatgagcagatcaagcagctggaggatgccctgaaggatgtgcagaagaggatgtatgaaagtgagggcaaggtgaagcagatgcagacccacttcctggccctgaaggagcacctgaccagcgaggccgccagcggcaaccaccggctgacagaggagctgaaggaccagctgaaggacctgaaggtgaagtatgaaggagccagcgctgaggtgggcaagctgaggaaccagatcaagcagaatgagatgattgtggaggagttcaagagagatgagggcaagctgattgaggagaacaagaggctgcagaaggagctgtccatgtgtgagatggagcgggagaagaagggcaggaaggtgacagagatggagggccaggccaaggagctgagcgccaagctggccctgagcatcccagctgagaagtttgagaacatgaagagcagcctgagcaatgaggtgaatgagaaggccaagaagctggtggagatggagcgggagcacgagaagagcctgtctgagatccggcagctgaagcgggagctggagaatgtgaaggccaagctggcccagcacgtgaagccagaggagcacgagcaggtgaagagccggctggagcagaagagcggggagctgggcaagaagatcacagagctgaccctgaagaaccagaccctgcagaaggagattgagaaggtgtacctggacaacaagctgctgaaggagcaggcccacaacctgaccatcgagatgaagaaccactacgtgcccctgaaggtgtctgaggacatgaagaagagccatgatgccatcattgatgacctgaacaggaagctgctggatgtgacccagaagtacacagagaagaagctggagatggagaagctgctgctggagaatgacagcctgagcaaggatgtgtcccggctggagaccgtgtttgtgcccccagagaagcatgagaaggagatcatcgccctgaagagcaacatcgtggagctgaagaagcagctgtctgagctgaagaagaagtgtggggaggaccaggagaagatccacgccctgaccagcgagaacaccaacctgaagaagatgatgagcaaccagtatgtgcctgtgaagacccatgaggaggtgaagatgaccctgaatgacaccctggccaagaccaaccgggagctgctggatgtgaagaagaagtttgaggacatcaaccaggagtttgtgaagatcaaggacaagaatgagatcctgaagaggaacctggagaacacccagaaccagatcaaggccgagtacatcagcctggccgagcacgaggccaagatgagcagcctgagccagagcatgaggaaggtgcaggacagcaatgctgagatcctggccaactacaggaagggccaggaggagatcgtgaccctgcatgctgagatcaaggcccagaagaaggagctggacaccatccaggagtgcatcaaggtgaagtatgcccccatcgtgtcctttgaagaatgtgagaggaagttcaaggccacagagaaggagctgaaggaccagctgtctgagcagacccagaagtacagcgtgtctgaggaggaggtgaagaagaacaagcaggagaatgacaagctgaagaaggagatcttcaccctgcagaaggacctgcgggacaagacagtgctgattgagaagagccatgagatggagcgggccctgagcaggaagacagatgagctgaacaagcagctgaaggacctgagccagaagtacacagaggtgaagaatgtgaaggagaagctggtggaggagaatgccaagcagaccagcgagatcctggccgtgcagaacctgctgcagaagcagcacgtgcccctggagcaggtggaggccctgaagaagagcctgaatggcaccatcgagaacctgaaggaggagctgaagtccatgcagcgctgctatgagaaggagcagcagacagtgaccaagctgcaccagctgctggagaaccagaagaacagctctgtgcccctggccgagcacctgcagatcaaggaggcctttgagaaggaggtgggcatcatcaaggccagcctgcgggagaaggaggaggagagccagaacaagatggaggaggtgtccaagctgcagagcgaggtgcagaacaccaagcaggccctgaagaagctggagacccgggaggtggtggacctgagcaagtacaaggccaccaagagtgacctggagacccagatcagcagcctgaatgagaagctggccaacctgaacagaaaatatgaggaggtgtgtgaggaggtgctgcacgccaagaagaaggagatcagcgccaaggatgagaaggagctgctgcacttcagcattgagcaggagatcaaggaccagaaggagcgctgtgacaagagcctgaccaccatcacagagctgcagaggcgcatccaggagagcgccaagcagatcgaggccaaggacaacaagatcacagagctgctgaatgatgtggagcggctgaagcaggccctgaatggcctgagccagctgacctacaccagcggcaaccccaccaagaggcagagccagctgattgacaccctgcagcaccaggtgaagagcctggagcagcagctggctgatgctgaccggcagcaccaggaggtgattgccatctaccgcacccacctgctgtctgctgcccagggccacatggatgaagatgtgcaggaggccctgctgcagatcatccagatgaggcagggcctggtgtgctag

SEQ ID NO: 175645 - DNA, 4212 bp, Artificial Sequence
  Description of Artificial Sequence: Synthetic coding sequence
atgatgaactgctggttcagctgcacccccaagaacagacatgctgctgactggaacaagtatgatgaccggctgatgaaggctgctgagagaggagatgtggagaaggtgaccagcatcctggccaagaagggcgtgaaccctgggaagctggatgtggagggccgctctgtgttccacgtggtgaccagcaaaggaaacctggagtgcctgaatgccatcctgattcatggagtggacatcaccaccagtgacacagctggaagaaatgccctgcacctggccgccaagtatggccacgccctgtgcctgcagaagctgctgcagtacaactgccccacagagcacgccgacctgcagggccgcacagccctgcatgatgctgccatggctgactgccccagcagcatccagctgctgtgtgaccatggagcctctgtgaatgccaaggatgtggatggccgcacccccctggtgctggccacccagatgagccggcccaccatctgccagctgctgattgacagaggagcagatgtgaacagccgggacaagcagaacagaacagccctgatgctgggctgtgaatatggctgcagagatgctgtggaggtgctgatcaagaatggagctgacatcagcctgctggatgccctgggccatgacagcagctactatgccagaattggagacaacctggacatcctgaccctgctgaagacagccagcgagaacaccaacaagggccgggagctgtggaagaagggccccagcctgcagcagaggaacctgacccacatgcaggatgaggtgaatgtgaagagccaccagcgggagcaccagaacatccaggacctggagattgaaaatgaagacctgaaggagcggctgaggaagatccagcaggagcagaggatcctgctggacaaggtgaatggcctgcagctgcagctgaatgaggaggtgatggtggctgatgacctggagagcgagcgggagaagctgaagagcctgctggccgccaaggagaagcagcacgaggagagcctgcggaccatcgaggccctgaagaaccgcttcaagtactttgaaagtgaccacctgggcagcggcagccacttcagcaacagaaaagaagacatgctgctgaagcagggccagatgtacatggctgacagccagtgcaccagccctggcatcccagcccacatgcagagccgctccatgctgcggcccctggagctgagcctgcccagccagaccagctacagtgaaaatgagatcctgaagaaggagctggaggccatgaggaccttctgtgagagcgccaagcaggaccggctgaagctgcagaatgagctggcccacaaggtggccgagtgcaaggccctggccctggagtgtgagcgggtgaaggaggacagtgatgagcagatcaagcagctggaggatgccctgaaggatgtgcagaagaggatgtatgagagcgagggcaaggtgaagcagatgcagacccacttcctggccctgaaggagcacctgaccagcgaggccgccagcggcaaccaccggctgacagaggagctgaaggaccagctgaaggacctgaaggtgaagtatgagggcgccagcgctgaggtgggcaagctgaggaaccagatcaagcagaatgagatgattgtggaggagttcaagagagatgagggcaagctgattgaggagaacaagaggctgcagaaggagctgtccatgtgtgagatggagcgggagaagaagggcaggaaggtgacagagatggagggccaggccaaggagctgagcgccaagctggccctgagcatcccagctgagaagtttgagaacatgaagagcagcctgagcaatgaggtgaatgagaaggccaagaagctggtggagatggagcgggagcacgagaagagcctgtctgagatccggcagctgaagcgggagctggagaatgtgaaggccaagctggcccagcacgtgaagccagaggagcacgagcaggtgaagagccggctggagcagaagtctggagagctgggcaagaagatcacagagctgaccctgaagaaccagaccctgcagaaggagattgagaaggtgtacctggacaacaagctgctgaaggagcaggcccacaacctgaccatcgagatgaagaaccactacgtgcccctgaaggtgtctgaggacatgaagaagagccatgatgccatcattgatgacctgaacaggaagctgctggatgtgacccagaagtacacagagaagaagctggagatggagaagctgctgctggagaatgacagcctgagcaaggatgtgtcccggctggagaccgtgtttgtgcccccagagaagcatgagaaggagatcatcgccctgaagagcaacatcgtggagctgaagaagcagctgtctgagctgaagaagaagtgtggggaggaccaggagaagatccacgccctgaccagcgagaacaccaacctgaagaagatgatgagcaaccagtatgtgcctgtgaagacccatgaggaggtgaagatgaccctgaatgacaccctggccaagaccaaccgggagctgctggatgtgaagaagaagtttgaggacatcaaccaggagtttgtgaagatcaaggacaagaatgagatcctgaagaggaacctggagaacacccagaaccagatcaaggccgagtacatcagcctggccgagcacgaggccaagatgagcagcctgagccagagcatgaggaaggtgcaggacagcaatgctgagatcctggccaactacaggaagggccaggaggagatcgtgaccctgcacgccgagatcaaggcccagaagaaggagctggacaccatccaggagtgcatcaaggtgaagtatgcccccatcgtgtcctttgaggagtgtgagaggaagttcaaggccacagagaaggagctgaaggaccagctgtctgagcagacccagaagtacagcgtgtctgaggaggaggtgaagaagaacaagcaggagaatgacaagctgaagaaggagatcttcaccctgcagaaggacctgcgggacaagacagtgctgattgagaagagccatgagatggagcgggccctgagcaggaagacagatgagctgaacaagcagctgaaggacctgagccagaagtacacagaggtgaagaatgtgaaggagaagctggtggaggagaatgccaagcagaccagcgagatcctggccgtgcagaacctgctgcagaagcagcacgtgcccctggagcaggtggaggccctgaagaagagcctgaatggcaccatcgagaacctgaaggaggagctgaagtccatgcagcgctgctatgagaaggagcagcagacagtgaccaagctgcaccagctgctggagaaccagaagaacagctctgtgcccctggccgagcacctgcagatcaaggaggcctttgagaaggaggtgggcatcatcaaggccagcctgcgggagaaggaggaggagagccagaacaagatggaggaggtgtccaagctgcagagcgaggtgcagaacaccaagcaggccctgaagaagctggagacccgggaggtggtggacctgagcaagtacaaggccaccaagagtgacctggagacccagatcagcagcctgaatgagaagctggccaacctgaacagaaaatatgaggaggtgtgtgaggaggtgctgcacgccaagaagaaggagatcagcgccaaggatgagaaggagctgctgcacttcagcattgagcaggagatcaaggaccagaaggagcgctgtgacaagagcctgaccaccatcacagagctgcagaggcgcatccaggagagcgccaagcagatcgaggccaaggacaacaagatcacagagctgctgaatgatgtggagcggctgaagcaggccctgaatggcctgagccagctgacctacaccagcggcaaccccaccaagaggcagagccagctgattgacaccctgcagcaccaggtgaagagcctggagcagcagctggctgatgctgaccggcagcaccaggaggtgattgccatctaccgcacccacctgctgtctgctgcccagggccacatggatgaagatgtgcaggaggccctgctgcagatcatccagatgaggcagggcctggtgtgctag

SEQ ID NO: 175646 - DNA, 1686 bp, Artificial Sequence
  Description of Artificial Sequence: Synthetic coding sequence
atgatgaactgctggttcagctgcacccccaagaacagacatgctgctgactggaacaagtatgatgaccggctgatgaaggctgctgagagaggagatgtggagaaggtgaccagcatcctggccaagaagggcgtgaaccctgggaagctggatgtggagggccgctctgtgttccacgtggtgaccagcaaaggaaacctggagtgcctgaatgccatcctgattcatggagtggacatcaccaccagtgacacagctggaagaaatgccctgcacctggccgccaagtatggccacgccctgtgcctgcagaagctgctgcagtacaactgccccacagagcacgccgacctgcagggccgcacagccctgcatgatgctgccatggctgactgccccagcagcatccagctgctgtgtgaccatggagcctctgtgaatgccaaggatgtggatggccgcacccccctggtgctggccacccagatgagccggcccaccatctgccagctgctgattgacagaggagcagatgtgaacagccgggacaagcagaacagaacagccctgatgctgggctgtgaatatggctgcagagatgctgtggaggtgctgatcaagaatggagctgacatcagcctgctggatgccctgggccatgacagcagctactatgccagaattggagacaacctggacatcctgaccctgctgaagacagccagcgagaacaccaacaagggccgggagctgtggaagaagggccccagcctgcagcagaggaacctgacccacatgcaggatgaggtgaatgtgaagagccaccagcgggagcaccagaacatccaggacctggagattgaaaatgaagacctgaaggagcggctgaggaagatccagcaggagcagaggatcctgctggacaaggtgaatggcctgcagctgcagctgaatgaaagagagaagctgaagagcctgctggccgccaaggagaagcagcacgaggagagcctgcggaccatcgaggccctgaagaaccgcttcaagtactttgaaagtgaccacctgggcagcggcagccacttcagcaacaggaaggaggacatgctgctgaagcagggccagatgtacatggctgacagccagtgcaccagccctggcatcccagcccacatgcagagccgctccatgctgcggcccctggagctgagcctgcccagccagaccagctacagtgaaaatgagatcctgaagaaggagctggaggccatgaggaccttctgtgagagcgccaagcaggaccggctgaagctgcagaatgagctggcccacaaggtggccgagtgcaaggccctggccctggagtgtgagcgggtgaaggaggacagtgatgagcagatcaagcagctggaggatgccctgaaggatgtgcagaagaggatgtatgaaagtgagggcaaggtgaagcagatgcagacccacttcctggccctgaaggagcacctgaccagcgaggccgccagcggcaaccaccggctgacagaggagctgaaggaccagctgaaggacctgaaggtgaagtatgaaggagccagcgctgaggtgggcaagctgaggaaccagatcaagcagaatgagatgattgtggaggagttcaagagagatgagggcaagctgatctag

SEQ ID NO: 175647 - DNA, 4206 bp, Artificial Sequence
  Description of Artificial Sequence: Synthetic coding sequence
atgatgaactgctggttcagctgcacccccaagaacagacatgctgctgactggaacaagtatgatgaccggctgatgaaggctgctgagagaggagatgtggagaaggtgaccagcatcctggccaagaagggcgtgaaccctgggaagctggatgtggagggccgctctgtgttccacgtggtgaccagcaaaggaaacctggagtgcctgaatgccatcctgattcatggagtggacatcaccaccagtgacacagctggaagaaatgccctgcacctggccgccaagtatggccacgccctgtgcctgcagaagctgctgcagtacaactgccccacagagcacgccgacctgcagggccgcacagccctgcatgatgctgccatggctgactgccccagcagcatccagctgctgtgtgaccatggagcctctgtgaatgccaaggatgtggatggccgcacccccctggtgctggccacccagatgagccggcccaccatctgccagctgctgattgacagaggagcagatgtgaacagccgggacaagcagaacagaacagccctgatgctgggctgtgaatatggctgcagagatgctgtggaggtgctgatcaagaatggagctgacatcagcctgctggatgccctgggccatgacagcagctactatgccagaattggagacaacctggacatcctgaccctgctgaagacagccagcgagaacaccaacaagggccgggagctgtggaagaagggccccagcctgcagcagaggaacctgacccacatgcaggatgaggtgaatgtgaagagccaccagcgggagcaccagaacatccaggacctggagattgaaaatgaagacctgaaggagcggctgaggaagatccagcaggagcagaggatcctgctggacaaggtgaatggcctgcagctgcagctgaatgaggaggtgatggtggctgatgacctggagagcgagcgggagaagctgaagagcctgctggccgccaaggagaagcagcacgaggagagcctgcggaccatcgaggccctgaagaaccgcttcaagtactttgaaagtgaccacctgggcagcggcagccacttcagaaaagaagacatgctgctgaagcagggccagatgtacatggctgacagccagtgcaccagccctggcatcccagcccacatgcagagccgctccatgctgcggcccctggagctgagcctgcccagccagaccagctacagtgaaaatgagatcctgaagaaggagctggaggccatgaggaccttctgtgagagcgccaagcaggaccggctgaagctgcagaatgagctggcccacaaggtggccgagtgcaaggccctggccctggagtgtgagcgggtgaaggaggacagtgatgagcagatcaagcagctggaggatgccctgaaggatgtgcagaagaggatgtatgagagcgagggcaaggtgaagcagatgcagacccacttcctggccctgaaggagcacctgaccagcgaggccgccagcggcaaccaccggctgacagaggagctgaaggaccagctgaaggacctgaaggtgaagtatgagggcgccagcgctgaggtgggcaagctgaggaaccagatcaagcagaatgagatgattgtggaggagttcaagagagatgagggcaagctgattgaggagaacaagaggctgcagaaggagctgtccatgtgtgagatggagcgggagaagaagggcaggaaggtgacagagatggagggccaggccaaggagctgagcgccaagctggccctgagcatcccagctgagaagtttgagaacatgaagagcagcctgagcaatgaggtgaatgagaaggccaagaagctggtggagatggagcgggagcacgagaagagcctgtctgagatccggcagctgaagcgggagctggagaatgtgaaggccaagctggcccagcacgtgaagccagaggagcacgagcaggtgaagagccggctggagcagaagtctggagagctgggcaagaagatcacagagctgaccctgaagaaccagaccctgcagaaggagattgagaaggtgtacctggacaacaagctgctgaaggagcaggcccacaacctgaccatcgagatgaagaaccactacgtgcccctgaaggtgtctgaggacatgaagaagagccatgatgccatcattgatgacctgaacaggaagctgctggatgtgacccagaagtacacagagaagaagctggagatggagaagctgctgctggagaatgacagcctgagcaaggatgtgtcccggctggagaccgtgtttgtgcccccagagaagcatgagaaggagatcatcgccctgaagagcaacatcgtggagctgaagaagcagctgtctgagctgaagaagaagtgtggggaggaccaggagaagatccacgccctgaccagcgagaacaccaacctgaagaagatgatgagcaaccagtatgtgcctgtgaagacccatgaggaggtgaagatgaccctgaatgacaccctggccaagaccaaccgggagctgctggatgtgaagaagaagtttgaggacatcaaccaggagtttgtgaagatcaaggacaagaatgagatcctgaagaggaacctggagaacacccagaaccagatcaaggccgagtacatcagcctggccgagcacgaggccaagatgagcagcctgagccagagcatgaggaaggtgcaggacagcaatgctgagatcctggccaactacaggaagggccaggaggagatcgtgaccctgcacgccgagatcaaggcccagaagaaggagctggacaccatccaggagtgcatcaaggtgaagtatgcccccatcgtgtcctttgaggagtgtgagaggaagttcaaggccacagagaaggagctgaaggaccagctgtctgagcagacccagaagtacagcgtgtctgaggaggaggtgaagaagaacaagcaggagaatgacaagctgaagaaggagatcttcaccctgcagaaggacctgcgggacaagacagtgctgattgagaagagccatgagatggagcgggccctgagcaggaagacagatgagctgaacaagcagctgaaggacctgagccagaagtacacagaggtgaagaatgtgaaggagaagctggtggaggagaatgccaagcagaccagcgagatcctggccgtgcagaacctgctgcagaagcagcacgtgcccctggagcaggtggaggccctgaagaagagcctgaatggcaccatcgagaacctgaaggaggagctgaagtccatgcagcgctgctatgagaaggagcagcagacagtgaccaagctgcaccagctgctggagaaccagaagaacagctctgtgcccctggccgagcacctgcagatcaaggaggcctttgagaaggaggtgggcatcatcaaggccagcctgcgggagaaggaggaggagagccagaacaagatggaggaggtgtccaagctgcagagcgaggtgcagaacaccaagcaggccctgaagaagctggagacccgggaggtggtggacctgagcaagtacaaggccaccaagagtgacctggagacccagatcagcagcctgaatgagaagctggccaacctgaacagaaaatatgaggaggtgtgtgaggaggtgctgcacgccaagaagaaggagatcagcgccaaggatgagaaggagctgctgcacttcagcattgagcaggagatcaaggaccagaaggagcgctgtgacaagagcctgaccaccatcacagagctgcagaggcgcatccaggagagcgccaagcagatcgaggccaaggacaacaagatcacagagctgctgaatgatgtggagcggctgaagcaggccctgaatggcctgagccagctgacctacaccagcggcaaccccaccaagaggcagagccagctgattgacaccctgcagcaccaggtgaagagcctggagcagcagctggctgatgctgaccggcagcaccaggaggtgattgccatctaccgcacccacctgctgtctgctgcccagggccacatggatgaagatgtgcaggaggccctgctgcagatcatccagatgaggcagggcctggtgtgctag

SEQ ID NO: 175648 - DNA, 3195 bp, Artificial Sequence
  Description of Artificial Sequence: Synthetic coding sequence
atggtgctgggcaccgtgctgctgccccccaacagctatggccgggaccaggacaccagcctgtgctgcctgtgcacagaggccagcgagagcgccctgcctgacctgacagaccactttgccagctgtgtggaggatggctttgaaggagacaagacaggaggcagcagccctgaggccctgcaccggccctacggctgtgatgtggagccccaggccctgaatgaggccatccgctggagcagcaaggagaacctgctgggcgccacagaaagtgaccccaacctgtttgtggccctgtatgactttgtggccagcggggacaacaccctgagcatcaccaagggggagaagctgcgggtgctgggctacaaccagaatggagagtggagcgaggtgcgcagcaagaatggccagggctgggtgcccagcaactacatcacccctgtgaacagcctggagaagcacagctggtaccacggccctgtgagccgctctgctgctgagtacctgctgagcagcctcatcaatggcagcttcctggtgcgggagagcgagagcagccctggccagctgagcatcagcctgcgctatgagggccgggtgtaccactaccgcatcaacaccacagcagatggcaaggtgtatgtgacagctgagagccgcttcagcaccctggccgagctggtgcaccaccacagcacagtggctgatggcctggtgaccaccctgcactacccagcccccaagtgcaacaagcccaccgtgtatggagtgagccccatccatgacaagtgggagatggagaggacagacatcaccatgaagcacaagctgggcggcggccagtacggggaggtgtatgtgggcgtgtggaagaagtacagcctgactgtggccgtgaagaccctgaaggaggacaccatggaggtggaggagttcctgaaggaggccgctgtgatgaaggagatcaagcaccccaacctggtgcagctgctgggcgtgtgcaccctggagccccccttctacatcgtgacagagtacatgccctacggcaacctgctggactacctgcgggagtgcaaccgggaggaggtgacagctgtggtgctgctgtacatggccacccagatcagcagcgccatggagtacctggagaagaagaacttcatccaccgggacctggccgccaggaactgcctggtgggggagaaccacgtggtgaaggtggccgactttggcctgagccggctgatgaccggggacacctacacagcccacgccggggccaagttccccatcaagtggacagcccctgagagcctggcctacaacaccttcagcatcaagagtgatgtgtgggccttcggcgtgctgctgtgggagatcgccacctacggcatgagcccctacccaggcatcgacctgagccaggtgtatgacctgctggagaagggctacaggatggagcagcctgagggctgcccccccaaggtgtatgagctgatgagggcctgctggaagtggagccctgctgaccggcccagctttgctgagacccaccaggcctttgagaccatgtttcatgacagcagcatcagcgaggaggtggccgaggagctgggccgggccgccagcagcagctctgtggtgccctacctgccccggctgcccatcctgcccagcaagaccaggaccctgaagaagcaggtggagaacaaggaaaatattgaaggagcccaggatgccacagaaaattctgccagcagcctggcccctggcttcatccggggggcccaggccagcagcggcagccctgccctgcccaggaagcagagggacaagagccccagcagcctgctggaggatgccaaggagacctgcttcacccgggacaggaagggcggcttcttcagcagcttcatgaagaagagaaatgcccccaccccacccaagaggagcagcagcttccgggagatggagaaccagccccacaagaagtatgagctgaccggcctgcctgagcaggacaggatggccatgaccctgcccaggaactgccagaggagcaagctgcagctggagaggacagtgtccaccagcagccagcctgaggagaatgtggaccgggccaatgacatgctgcccaagaagtctgaggagagcgctgcccccagccgggagcggcccaaggccaagctgctgcccaggggggccacagccctgcccctgcggacccccagcggggacctggccatcacagagaaggaccccccaggagtgggcgtggccggcgtggccgccgcccccaagggcaaggagaagaatggaggagcccggctgggcatggccggcgtgcctgaagatggagagcagcccggctggcccagccctgccaaggccgcccctgtgctgcccaccacccacaaccacaaggtgcctgtgctgatcagccccaccctgaagcacaccccagcagatgtgcagctgattggaacagacagccagggcaacaagttcaagctgctgtctgagcaccaggtgaccagcagcggggacaaggaccggccccggcgggtgaagcccaagtgtgcccctcctcctcctcctgtgatgaggctgctgcagcaccccagcatctgcagcgaccccacagaggagcccacagccctgacagctggccagagcaccagcgagacccaggagggcggcaagaaggccgccctgggcgctgtgcccatcagcggcaaggccggccggcctgtgatgcccccaccccaggtgcccctgcccaccagcagcatcagccctgccaagatggccaacggcacagctggcaccaaggtggccctgaggaagaccaagcaggccgctgagaagatctctgctgacaagatcagcaaggaggccctgctggagtgtgccgacctgctgagcagcgccctgacagagcctgtgcccaacagccagctggtggacaccggccaccagctgctggactactgcagcggctacgtggactgcatcccccagaccaggaacaagtttgccttccgggaggccgtgtccaagctggagctgagcctgcaggagctgcaggtgagcagcgctgctgctggggtgcccggcaccaaccctgtgctgaacaacctgctgagctgtgtgcaggagatcagtgatgtggtgcagaggtag

SEQ ID NO: 175649 - DNA, 1629 bp, Artificial Sequence
  Description of Artificial Sequence: Synthetic coding sequence
atgggccagcaggtgggccgggtgggggaggcccctggcctgcagcagccccagccccggggcatccggggcagcagcgctgcccggcccagcggcagaagaagagatcctgctggccgcaccacagagaccggcttcaacatcttcacccagcacgaggccctgcaccggccctacggctgtgatgtggagccccaggccctgaatgaggccatccgctggagcagcaaggagaacctgctgggcgccacagaaagtgaccccaacctgtttgtggccctgtatgactttgtggccagcggggacaacaccctgagcatcaccaagggggagaagctgcgggtgctgggctacaaccagaatggagagtggagcgaggtgcgcagcaagaatggccagggctgggtgcccagcaactacatcacccctgtgaacagcctggagaagcacagctggtaccacggccctgtgagccgctctgctgctgagtacctgctgagcagcctcatcaatggcagcttcctggtgcgggagagcgagagcagccctggccagctgagcatcagcctgcgctatgagggccgggtgtaccactaccgcatcaacaccacagcagatggcaaggtgtatgtgacagctgagagccgcttcagcaccctggccgagctggtgcaccaccacagcacagtggctgatggcctggtgaccaccctgcactacccagcccccaagtgcaacaagcccaccgtgtatggagtgagccccatccatgacaagtgggagatggagaggacagacatcaccatgaagcacaagctgggcggcggccagtacggggaggtgtatgtgggcgtgtggaagaagtacagcctgactgtggccgtgaagaccctgaaggaggacaccatggaggtggaggagttcctgaaggaggccgctgtgatgaaggagatcaagcaccccaacctggtgcagctgctgggcgtgtgcaccctggagccccccttctacatcgtgacagagtacatgccctacggcaacctgctggactacctgcgggagtgcaaccgggaggaggtgacagctgtggtgctgctgtacatggccacccagatcagcagcgccatggagtacctggagaagaagaacttcatccaccgggacctggccgccaggaactgcctggtgggggagaaccacgtggtgaaggtggccgactttggcctgagccggctgatgaccggggacacctacacagcccacgccggggccaagttccccatcaagtggacagcccctgagagcctggcctacaacaccttcagcatcaagagtgatgtgtgggccttcggcgtgctgctgtgggagatcgccacctacggcatgagcccctacccaggcatcgacctgagccaggtgtatgacctgctggagaagggctacaggatggagcagcctgagggctgcccccccaaggtgtatgagctgatgagggcctgctggaagtggagccctgctgaccggcccagctttgctgagacccaccaggcctttgagaccatgtttcatgacagcagcatcagcgaggtgctgctgcactgtgccaaccagacctgcatcaccctgtag

SEQ ID NO: 175650 - DNA, 3441 bp, Artificial Sequence
  Description of Artificial Sequence: Synthetic coding sequence
atggtgctgggcaccgtgctgctgccccccaacagctatggccgggaccaggacaccagcctgtgctgcctgtgcacagaggccagcgagagcgccctgcctgacctgacagaggccctgcaccggccctacggctgtgatgtggagccccaggccctgaatgaggccatccgctggagcagcaaagaaaacctgctgggcgccacagaaagtgaccccaacctgtttgtggccctgtatgactttgtggccagcggggacaacaccctgagcatcaccaagggggagaagctgcgggtgctgggctacaaccagaatggagagtggagcgaggtgcgcagcaagaatggccagggctgggtgcccagcaactacatcacccctgtgaacagcctggagaagcacagctggtaccacggccctgtgagccgctctgctgctgagtacctgctgagcagcctcatcaatggcagcttcctggtgcgggagagcgagagcagccctggccagctgagcatcagcctgcgctatgagggccgggtgtaccactaccgcatcaacaccacagcagatggcaaggtgtatgtgacagctgagagccgcttcagcaccctggccgagctggtgcaccaccacagcacagtggctgatggcctggtgaccaccctgcactacccagcccccaagtgcaacaagcccaccgtgtatggagtgagccccatccatgacaagtgggagatggagaggacagacatcaccatgaagcacaagctgggcggcggccagtatggagaggtgtatgtgggcgtgtggaagaagtacagcctgactgtggccgtgaagaccctgaaggaggacaccatggaggtggaggagttcctgaaggaggccgctgtgatgaaggagatcaagcaccccaacctggtgcagctgctgggcgtgtgcaccctggagccccccttctacatcgtgacagagtacatgccctacggcaacctgctggactacctgcgggagtgcaaccgggaggaggtgacagctgtggtgctgctgtacatggccacccagatcagcagcgccatggagtacctggagaagaagaacttcatccaccgggacctggccgccaggaactgcctggtgggagaaaatcatgtggtgaaggtggccgactttggcctgagccggctgatgactggagacacctacacagcccatgctggggccaagttccccatcaagtggacagcccctgagagcctggcctacaacaccttcagcatcaagagtgatgtgtgggcctttggagtgctgctgtgggagatcgccacctacggcatgagcccctacccaggcatcgacctgagccaggtgtatgacctgctggagaagggctacaggatggagcagcctgagggctgcccccccaaggtgtatgagctgatgagggcctgctggaagtggagccctgctgaccggcccagctttgctgagacccaccaggcctttgagaccatgtttcatgacagcagcatcagcgaggaggtggccgaggagctgggccgggccgccagcagcagctctgtggtgccctacctgccccggctgcccatcctgcccagcaagaccaggaccctgaagaagcaggtggagaacaaggagaacatcgagggcgcccaggatgccacagagaacagcgccagcagcctggcccctggcttcatccggggggcccaggccagcagcggcagccctgccctgcccaggaagcagagggacaagagccccagcagcctgctggaggatgccaaggagacctgcttcacccgggacagaaaaggaggcttcttcagcagcttcatgaagaagagaaatgcccccaccccacccaagaggagcagcagcttccgggagatggagaaccagccccacaagaagtatgagctgaccggcaacttcagctctgtggccagcctgcagcacgcagatggcttctccttcaccccagcccagcaggaggccaacctggtgccccccaagtgctacggcggcagctttgcccagaggaacctgtgcaatgatgatggcggcggcggcggcggcagcggcacagctgggggcggctggagcggcatcaccggcttcttcacccccaggctcatcaagaagaccctgggcctgcgggccggcaagcccacagccagtgatgacaccagcaagcccttccccaggagcaacagcaccagctccatgagcagcggcctgcctgagcaggacaggatggccatgaccctgcccaggaactgccagaggagcaagctgcagctggagaggacagtgtccaccagcagccagcctgaggagaatgtggaccgggccaatgacatgctgcccaagaagtctgaggagagcgctgcccccagccgggagcggcccaaggccaagctgctgcccaggggggccacagccctgcccctgcggacccccagcggggacctggccatcacagagaaggaccccccaggagtgggcgtggccggcgtggccgccgcccccaagggcaaggagaagaatggaggagcccggctgggcatggccggcgtgcctgaagatggagagcagcccggctggcccagccctgccaaggccgcccctgtgctgcccaccacccacaaccacaaggtgcctgtgctgatcagccccaccctgaagcacaccccagcagatgtgcagctgattggaacagacagccagggcaacaagttcaagctgctgtctgagcaccaggtgaccagcagcggggacaaggaccggccccggcgggtgaagcccaagtgtgcccctcctcctcctcctgtgatgaggctgctgcagcaccccagcatctgcagcgaccccacagaggagcccacagccctgacagctggccagagcaccagcgagacccaggagggcggcaagaaggccgccctgggcgctgtgcccatcagcggcaaggccggccggcctgtgatgcccccaccccaggtgcccctgcccaccagcagcatcagccctgccaagatggccaacggcacagctggcaccaaggtggccctgaggaagaccaagcaggccgctgagaagatctctgctgacaagatcagcaaggaggccctgctggagtgtgccgacctgctgagcagcgccctgacagagcctgtgcccaacagccagctggtggacaccggccaccagctgctggactactgcagcggctacgtggactgcatcccccagaccaggaacaagtttgccttccgggaggccgtgtccaagctggagctgagcctgcaggagctgcaggtgagcagcgctgctgctggggtgcccggcaccaaccctgtgctgaacaacctgctgagctgtgtgcaggagatcagtgatgtggtgcagaggtag

SEQ ID NO: 175651 - DNA, 3549 bp, Artificial Sequence
  Description of Artificial Sequence: Synthetic coding sequence
atgggccagcaggtgggccgggtgggggaggcccctggcctgcagcagccccagccccggggcatccggggcagcagcgctgcccggcccagcggcagaagaagagatcctgctggccgcaccacagagaccggcttcaacatcttcacccagcacgaccactttgccagctgtgtggaggatggctttgaaggagacaagacaggaggcagcagccctgaggccctgcaccggccctacggctgtgatgtggagccccaggccctgaatgaggccatccgctggagcagcaaagaaaacctgctgggcgccacagaaagtgaccccaacctgtttgtggccctgtatgactttgtggccagcggggacaacaccctgagcatcaccaagggggagaagctgcgggtgctgggctacaaccagaatggagagtggagcgaggtgcgcagcaagaatggccagggctgggtgcccagcaactacatcacccctgtgaacagcctggagaagcacagctggtaccacggccctgtgagccgctctgctgctgagtacctgctgagcagcctcatcaatggcagcttcctggtgcgggagagcgagagcagccctggccagctgagcatcagcctgcgctatgagggccgggtgtaccactaccgcatcaacaccacagcagatggcaaggtgtatgtgacagctgagagccgcttcagcaccctggccgagctggtgcaccaccacagcacagtggctgatggcctggtgaccaccctgcactacccagcccccaagtgcaacaagcccaccgtgtatggagtgagccccatccatgacaagtgggagatggagaggacagacatcaccatgaagcacaagctgggcggcggccagtatggagaggtgtatgtgggcgtgtggaagaagtacagcctgactgtggccgtgaagaccctgaaggaggacaccatggaggtggaggagttcctgaaggaggccgctgtgatgaaggagatcaagcaccccaacctggtgcagctgctgggcgtgtgcaccctggagccccccttctacatcgtgacagagtacatgccctacggcaacctgctggactacctgcgggagtgcaaccgggaggaggtgacagctgtggtgctgctgtacatggccacccagatcagcagcgccatggagtacctggagaagaagaacttcatccaccgggacctggccgccaggaactgcctggtgggagaaaatcatgtggtgaaggtggccgactttggcctgagccggctgatgactggagacacctacacagcccatgctggggccaagttccccatcaagtggacagcccctgagagcctggcctacaacaccttcagcatcaagagtgatgtgtgggcctttggagtgctgctgtgggagatcgccacctacggcatgagcccctacccaggcatcgacctgagccaggtgtatgacctgctggagaagggctacaggatggagcagcctgagggctgcccccccaaggtgtatgagctgatgagggcctgctggaagtggagccctgctgaccggcccagctttgctgagacccaccaggcctttgagaccatgtttcatgacagcagcatcagcgaggaggtggccgaggagctgggccgggccgccagcagcagctctgtggtgccctacctgccccggctgcccatcctgcccagcaagaccaggaccctgaagaagcaggtggagaacaaggagaacatcgagggcgcccaggatgccacagagaacagcgccagcagcctggcccctggcttcatccggggggcccaggccagcagcggcagccctgccctgcccaggaagcagagggacaagagccccagcagcctgctggaggatgccaaggagacctgcttcacccgggacagaaaaggaggcttcttcagcagcttcatgaagaagagaaatgcccccaccccacccaagaggagcagcagcttccgggagatggagaaccagccccacaagaagtatgagctgaccggcaacttcagctctgtggccagcctgcagcacgcagatggcttctccttcaccccagcccagcaggaggccaacctggtgccccccaagtgctacggcggcagctttgcccagaggaacctgtgcaatgatgatggcggcggcggcggcggcagcggcacagctgggggcggctggagcggcatcaccggcttcttcacccccaggctcatcaagaagaccctgggcctgcgggccggcaagcccacagccagtgatgacaccagcaagcccttccccaggagcaacagcaccagctccatgagcagcggcctgcctgagcaggacaggatggccatgaccctgcccaggaactgccagaggagcaagctgcagctggagaggacagtgtccaccagcagccagcctgaggagaatgtggaccgggccaatgacatgctgcccaagaagtctgaggagagcgctgcccccagccgggagcggcccaaggccaagctgctgcccaggggggccacagccctgcccctgcggacccccagcggggacctggccatcacagagaaggaccccccaggagtgggcgtggccggcgtggccgccgcccccaagggcaaggagaagaatggaggagcccggctgggcatggccggcgtgcctgaagatggagagcagcccggctggcccagccctgccaaggccgcccctgtgctgcccaccacccacaaccacaaggtgcctgtgctgatcagccccaccctgaagcacaccccagcagatgtgcagctgattggaacagacagccagggcaacaagttcaagctgctgtctgagcaccaggtgaccagcagcggggacaaggaccggccccggcgggtgaagcccaagtgtgcccctcctcctcctcctgtgatgaggctgctgcagcaccccagcatctgcagcgaccccacagaggagcccacagccctgacagctggccagagcaccagcgagacccaggagggcggcaagaaggccgccctgggcgctgtgcccatcagcggcaaggccggccggcctgtgatgcccccaccccaggtgcccctgcccaccagcagcatcagccctgccaagatggccaacggcacagctggcaccaaggtggccctgaggaagaccaagcaggccgctgagaagatctctgctgacaagatcagcaaggaggccctgctggagtgtgccgacctgctgagcagcgccctgacagagcctgtgcccaacagccagctggtggacaccggccaccagctgctggactactgcagcggctacgtggactgcatcccccagaccaggaacaagtttgccttccgggaggccgtgtccaagctggagctgagcctgcaggagctgcaggtgagcagcgctgctgctggggtgcccggcaccaaccctgtgctgaacaacctgctgagctgtgtgcaggagatcagtgatgtggtgcagaggtag

SEQ ID NO: 175652 - DNA, 3132 bp, Artificial Sequence
  Description of Artificial Sequence: Synthetic coding sequence
atggtgctgggcaccgtgctgctgccccccaacagctatggccgggaccaggacaccagcctgtgctgcctgtgcacagaggccagcgagagcgccctgcctgacctgacagaggccctgcaccggccctacggctgtgatgtggagccccaggccctgaatgaggccatccgctggagcagcaaagaaaacctgctgggcgccacagaaagtgaccccaacctgtttgtggccctgtatgactttgtggccagcggggacaacaccctgagcatcaccaagggggagaagctgcgggtgctgggctacaaccagaatggagagtggagcgaggtgcgcagcaagaatggccagggctgggtgcccagcaactacatcacccctgtgaacagcctggagaagcacagctggtaccacggccctgtgagccgctctgctgctgagtacctgctgagcagcctcatcaatggcagcttcctggtgcgggagagcgagagcagccctggccagctgagcatcagcctgcgctatgagggccgggtgtaccactaccgcatcaacaccacagcagatggcaaggtgtatgtgacagctgagagccgcttcagcaccctggccgagctggtgcaccaccacagcacagtggctgatggcctggtgaccaccctgcactacccagcccccaagtgcaacaagcccaccgtgtatggagtgagccccatccatgacaagtgggagatggagaggacagacatcaccatgaagcacaagctgggcggcggccagtatggagaggtgtatgtgggcgtgtggaagaagtacagcctgactgtggccgtgaagaccctgaaggaggacaccatggaggtggaggagttcctgaaggaggccgctgtgatgaaggagatcaagcaccccaacctggtgcagctgctgggcgtgtgcaccctggagccccccttctacatcgtgacagagtacatgccctacggcaacctgctggactacctgcgggagtgcaaccgggaggaggtgacagctgtggtgctgctgtacatggccacccagatcagcagcgccatggagtacctggagaagaagaacttcatccaccgggacctggccgccaggaactgcctggtgggagaaaatcatgtggtgaaggtggccgactttggcctgagccggctgatgactggagacacctacacagcccatgctggggccaagttccccatcaagtggacagcccctgagagcctggcctacaacaccttcagcatcaagagtgatgtgtgggcctttggagtgctgctgtgggagatcgccacctacggcatgagcccctacccaggcatcgacctgagccaggtgtatgacctgctggagaagggctacaggatggagcagcctgagggctgcccccccaaggtgtatgagctgatgagggcctgctggaagtggagccctgctgaccggcccagctttgctgagacccaccaggcctttgagaccatgtttcatgacagcagcatcagcgaggaggtggccgaggagctgggccgggccgccagcagcagctctgtggtgccctacctgccccggctgcccatcctgcccagcaagaccaggaccctgaagaagcaggtggagaacaaggagaacatcgagggcgcccaggatgccacagagaacagcgccagcagcctggcccctggcttcatccggggggcccaggccagcagcggcagccctgccctgcccaggaagcagagggacaagagccccagcagcctgctggaggatgccaaggagacctgcttcacccgggacagaaaaggaggcttcttcagcagcttcatgaagaagagaaatgcccccaccccacccaagaggagcagcagcttccgggagatggagaaccagccccacaagaagtatgagctgaccggcctgcctgagcaggacaggatggccatgaccctgcccaggaactgccagaggagcaagctgcagctggagaggacagtgtccaccagcagccagccagaagaaaatgtggaccgggccaatgacatgctgcccaagaagtctgaggagagcgctgcccccagccgggagcggcccaaggccaagctgctgcccaggggggccacagccctgcccctgcggaccccatctggggacctggccatcacagagaaggaccccccaggagtgggcgtggccggcgtggccgccgcccccaagggcaaggagaagaatggaggagcccggctgggcatggccggcgtgcctgaagatggagagcagcccggctggcccagccctgccaaggccgcccctgtgctgcccaccacccacaaccacaaggtgcctgtgctgatcagccccaccctgaagcacaccccagcagatgtgcagctgattggaacagacagccagggcaacaagttcaagctgctgtctgagcaccaggtgaccagcagcggggacaaggaccggcccaggagagtgaagcccaagtgtgcccctcctcctcctcctgtgatgaggctgctgcagcaccccagcatctgcagcgaccccacagaggagcccacagccctgacagctggccagagcaccagcgagacccaggagggcggcaagaaggccgccctgggcgctgtgcccatcagcggcaaggccggccggcctgtgatgcccccaccccaggtgcccctgcccaccagcagcatcagccctgccaagatggccaatggaacagctggcaccaaggtggccctgaggaagaccaagcaggccgctgagaagatctctgctgacaagatcagcaaggaggccctgctggagtgtgccgacctgctgagcagcgccctgacagagcctgtgcccaacagccagctggtggacaccggccaccagctgctggactactgcagcggctacgtggactgcatcccccagaccaggaacaagtttgccttccgggaggccgtgtccaagctggagctgagcctgcaggagctgcaggtgtcctctgctgctgctggggtgcccggcaccaaccctgtgctgaacaacctgctgagctgtgtgcaggagatcagtgatgtggtgcagaggtag

SEQ ID NO: 175653 - DNA, 3504 bp, Artificial Sequence
  Description of Artificial Sequence: Synthetic coding sequence
atggtgctgggcaccgtgctgctgccccccaacagctatggccgggaccaggacaccagcctgtgctgcctgtgcacagaggccagcgagagcgccctgcctgacctgacagaccactttgccagctgtgtggaggatggctttgaaggagacaagacaggaggcagcagccctgaggccctgcaccggccctacggctgtgatgtggagccccaggccctgaatgaggccatccgctggagcagcaaggagaacctgctgggcgccacagaaagtgaccccaacctgtttgtggccctgtatgactttgtggccagcggggacaacaccctgagcatcaccaagggggagaagctgcgggtgctgggctacaaccagaatggagagtggagcgaggtgcgcagcaagaatggccagggctgggtgcccagcaactacatcacccctgtgaacagcctggagaagcacagctggtaccacggccctgtgagccgctctgctgctgagtacctgctgagcagcctcatcaatggcagcttcctggtgcgggagagcgagagcagccctggccagctgagcatcagcctgcgctatgagggccgggtgtaccactaccgcatcaacaccacagcagatggcaaggtgtatgtgacagctgagagccgcttcagcaccctggccgagctggtgcaccaccacagcacagtggctgatggcctggtgaccaccctgcactacccagcccccaagtgcaacaagcccaccgtgtatggagtgagccccatccatgacaagtgggagatggagaggacagacatcaccatgaagcacaagctgggcggcggccagtacggggaggtgtatgtgggcgtgtggaagaagtacagcctgactgtggccgtgaagaccctgaaggaggacaccatggaggtggaggagttcctgaaggaggccgctgtgatgaaggagatcaagcaccccaacctggtgcagctgctgggcgtgtgcaccctggagccccccttctacatcgtgacagagtacatgccctacggcaacctgctggactacctgcgggagtgcaaccgggaggaggtgacagctgtggtgctgctgtacatggccacccagatcagcagcgccatggagtacctggagaagaagaacttcatccaccgggacctggccgccaggaactgcctggtgggggagaaccacgtggtgaaggtggccgactttggcctgagccggctgatgaccggggacacctacacagcccacgccggggccaagttccccatcaagtggacagcccctgagagcctggcctacaacaccttcagcatcaagagtgatgtgtgggccttcggcgtgctgctgtgggagatcgccacctacggcatgagcccctacccaggcatcgacctgagccaggtgtatgacctgctggagaagggctacaggatggagcagcctgagggctgcccccccaaggtgtatgagctgatgagggcctgctggaagtggagccctgctgaccggcccagctttgctgagacccaccaggcctttgagaccatgtttcatgacagcagcatcagcgaggaggtggccgaggagctgggccgggccgccagcagcagctctgtggtgccctacctgccccggctgcccatcctgcccagcaagaccaggaccctgaagaagcaggtggagaacaaggaaaatattgaaggagcccaggatgccacagaaaattctgccagcagcctggcccctggcttcatccggggggcccaggccagcagcggcagccctgccctgcccaggaagcagagggacaagagccccagcagcctgctggaggatgccaaggagacctgcttcacccgggacaggaagggcggcttcttcagcagcttcatgaagaagagaaatgcccccaccccacccaagaggagcagcagcttccgggagatggagaaccagccccacaagaagtatgagctgactggaaacttcagctctgtggccagcctgcagcacgcagatggcttctccttcaccccagcccagcaggaggccaacctggtgccccccaagtgctatggaggcagctttgcccagaggaacctgtgcaatgatgatggcggcggcggcggcggcagcggcacagctgggggcggctggagcggcatcaccggcttcttcacccccaggctcatcaagaagaccctgggcctgcgggccggcaagcccacagccagtgatgacaccagcaagcccttccccaggagcaacagcaccagctccatgagcagcggcctgcctgagcaggacaggatggccatgaccctgcccaggaactgccagaggagcaagctgcagctggagaggacagtgtccaccagcagccagccagaagaaaatgtggaccgggccaatgacatgctgcccaagaagtctgaggagagcgctgcccccagccgggagcggcccaaggccaagctgctgcccaggggggccacagccctgcccctgcggaccccatctggggacctggccatcacagagaaggaccccccaggagtgggcgtggccggcgtggccgccgcccccaagggcaaggagaagaatggaggagcccggctgggcatggccggcgtgcctgaagatggagagcagcccggctggcccagccctgccaaggccgcccctgtgctgcccaccacccacaaccacaaggtgcctgtgctgatcagccccaccctgaagcacaccccagcagatgtgcagctgattggaacagacagccagggcaacaagttcaagctgctgtctgagcaccaggtgaccagcagcggggacaaggaccggcccaggagagtgaagcccaagtgtgcccctcctcctcctcctgtgatgaggctgctgcagcaccccagcatctgcagcgaccccacagaggagcccacagccctgacagctggccagagcaccagcgagacccaggagggcggcaagaaggccgccctgggcgctgtgcccatcagcggcaaggccggccggcctgtgatgcccccaccccaggtgcccctgcccaccagcagcatcagccctgccaagatggccaatggaacagctggcaccaaggtggccctgaggaagaccaagcaggccgctgagaagatctctgctgacaagatcagcaaggaggccctgctggagtgtgccgacctgctgagcagcgccctgacagagcctgtgcccaacagccagctggtggacaccggccaccagctgctggactactgcagcggctacgtggactgcatcccccagaccaggaacaagtttgccttccgggaggccgtgtccaagctggagctgagcctgcaggagctgcaggtgtcctctgctgctgctggggtgcccggcaccaaccctgtgctgaacaacctgctgagctgtgtgcaggagatcagtgatgtggtgcagaggtag

SEQ ID NO: 175654 - DNA, 3486 bp, Artificial Sequence
  Description of Artificial Sequence: Synthetic coding sequence
atgggccagcaggtgggccgggtgggggaggcccctggcctgcagcagccccagccccggggcatccggggcagcagcgctgcccggcccagcggcagaagaagagatcctgctggccgcaccacagagaccggcttcaacatcttcacccagcacgaggccctgcaccggccctacggctgtgatgtggagccccaggccctgaatgaggccatccgctggagcagcaaggagaacctgctgggcgccacagaaagtgaccccaacctgtttgtggccctgtatgactttgtggccagcggggacaacaccctgagcatcaccaagggggagaagctgcgggtgctgggctacaaccagaatggagagtggagcgaggtgcgcagcaagaatggccagggctgggtgcccagcaactacatcacccctgtgaacagcctggagaagcacagctggtaccacggccctgtgagccgctctgctgctgagtacctgctgagcagcctcatcaatggcagcttcctggtgcgggagagcgagagcagccctggccagctgagcatcagcctgcgctatgagggccgggtgtaccactaccgcatcaacaccacagcagatggcaaggtgtatgtgacagctgagagccgcttcagcaccctggccgagctggtgcaccaccacagcacagtggctgatggcctggtgaccaccctgcactacccagcccccaagtgcaacaagcccaccgtgtatggagtgagccccatccatgacaagtgggagatggagaggacagacatcaccatgaagcacaagctgggcggcggccagtacggggaggtgtatgtgggcgtgtggaagaagtacagcctgactgtggccgtgaagaccctgaaggaggacaccatggaggtggaggagttcctgaaggaggccgctgtgatgaaggagatcaagcaccccaacctggtgcagctgctgggcgtgtgcaccctggagccccccttctacatcgtgacagagtacatgccctacggcaacctgctggactacctgcgggagtgcaaccgggaggaggtgacagctgtggtgctgctgtacatggccacccagatcagcagcgccatggagtacctggagaagaagaacttcatccaccgggacctggccgccaggaactgcctggtgggggagaaccacgtggtgaaggtggccgactttggcctgagccggctgatgaccggggacacctacacagcccacgccggggccaagttccccatcaagtggacagcccctgagagcctggcctacaacaccttcagcatcaagagtgatgtgtgggccttcggcgtgctgctgtgggagatcgccacctacggcatgagcccctacccaggcatcgacctgagccaggtgtatgacctgctggagaagggctacaggatggagcagcctgagggctgcccccccaaggtgtatgagctgatgagggcctgctggaagtggagccctgctgaccggcccagctttgctgagacccaccaggcctttgagaccatgtttcatgacagcagcatcagcgaggaggtggccgaggagctgggccgggccgccagcagcagctctgtggtgccctacctgccccggctgcccatcctgcccagcaagaccaggaccctgaagaagcaggtggagaacaaggaaaatattgaaggagcccaggatgccacagaaaattctgccagcagcctggcccctggcttcatccggggggcccaggccagcagcggcagccctgccctgcccaggaagcagagggacaagagccccagcagcctgctggaggatgccaaggagacctgcttcacccgggacaggaagggcggcttcttcagcagcttcatgaagaagagaaatgcccccaccccacccaagaggagcagcagcttccgggagatggagaaccagccccacaagaagtatgagctgactggaaacttcagctctgtggccagcctgcagcacgcagatggcttctccttcaccccagcccagcaggaggccaacctggtgccccccaagtgctatggaggcagctttgcccagaggaacctgtgcaatgatgatggcggcggcggcggcggcagcggcacagctgggggcggctggagcggcatcaccggcttcttcacccccaggctcatcaagaagaccctgggcctgcgggccggcaagcccacagccagtgatgacaccagcaagcccttccccaggagcaacagcaccagctccatgagcagcggcctgcctgagcaggacaggatggccatgaccctgcccaggaactgccagaggagcaagctgcagctggagaggacagtgtccaccagcagccagccagaagaaaatgtggaccgggccaatgacatgctgcccaagaagtctgaggagagcgctgcccccagccgggagcggcccaaggccaagctgctgcccaggggggccacagccctgcccctgcggaccccatctggggacctggccatcacagagaaggaccccccaggagtgggcgtggccggcgtggccgccgcccccaagggcaaggagaagaatggaggagcccggctgggcatggccggcgtgcctgaagatggagagcagcccggctggcccagccctgccaaggccgcccctgtgctgcccaccacccacaaccacaaggtgcctgtgctgatcagccccaccctgaagcacaccccagcagatgtgcagctgattggaacagacagccagggcaacaagttcaagctgctgtctgagcaccaggtgaccagcagcggggacaaggaccggcccaggagagtgaagcccaagtgtgcccctcctcctcctcctgtgatgaggctgctgcagcaccccagcatctgcagcgaccccacagaggagcccacagccctgacagctggccagagcaccagcgagacccaggagggcggcaagaaggccgccctgggcgctgtgcccatcagcggcaaggccggccggcctgtgatgcccccaccccaggtgcccctgcccaccagcagcatcagccctgccaagatggccaatggaacagctggcaccaaggtggccctgaggaagaccaagcaggccgctgagaagatctctgctgacaagatcagcaaggaggccctgctggagtgtgccgacctgctgagcagcgccctgacagagcctgtgcccaacagccagctggtggacaccggccaccagctgctggactactgcagcggctacgtggactgcatcccccagaccaggaacaagtttgccttccgggaggccgtgtccaagctggagctgagcctgcaggagctgcaggtgtcctctgctgctgctggggtgcccggcaccaaccctgtgctgaacaacctgctgagctgtgtgcaggagatcagtgatgtggtgcagaggtag

SEQ ID NO: 175655 - DNA, 3177 bp, Artificial Sequence
  Description of Artificial Sequence: Synthetic coding sequence
atgggccagcaggtgggccgggtgggggaggcccctggcctgcagcagccccagccccggggcatccggggcagcagcgctgcccggcccagcggcagaagaagagatcctgctggccgcaccacagagaccggcttcaacatcttcacccagcacgaggccctgcaccggccctacggctgtgatgtggagccccaggccctgaatgaggccatccgctggagcagcaaggagaacctgctgggcgccacagaaagtgaccccaacctgtttgtggccctgtatgactttgtggccagcggggacaacaccctgagcatcaccaagggggagaagctgcgggtgctgggctacaaccagaatggagagtggagcgaggtgcgcagcaagaatggccagggctgggtgcccagcaactacatcacccctgtgaacagcctggagaagcacagctggtaccacggccctgtgagccgctctgctgctgagtacctgctgagcagcctcatcaatggcagcttcctggtgcgggagagcgagagcagccctggccagctgagcatcagcctgcgctatgagggccgggtgtaccactaccgcatcaacaccacagcagatggcaaggtgtatgtgacagctgagagccgcttcagcaccctggccgagctggtgcaccaccacagcacagtggctgatggcctggtgaccaccctgcactacccagcccccaagtgcaacaagcccaccgtgtatggagtgagccccatccatgacaagtgggagatggagaggacagacatcaccatgaagcacaagctgggcggcggccagtacggggaggtgtatgtgggcgtgtggaagaagtacagcctgactgtggccgtgaagaccctgaaggaggacaccatggaggtggaggagttcctgaaggaggccgctgtgatgaaggagatcaagcaccccaacctggtgcagctgctgggcgtgtgcaccctggagccccccttctacatcgtgacagagtacatgccctacggcaacctgctggactacctgcgggagtgcaaccgggaggaggtgacagctgtggtgctgctgtacatggccacccagatcagcagcgccatggagtacctggagaagaagaacttcatccaccgggacctggccgccaggaactgcctggtgggggagaaccacgtggtgaaggtggccgactttggcctgagccggctgatgaccggggacacctacacagcccacgccggggccaagttccccatcaagtggacagcccctgagagcctggcctacaacaccttcagcatcaagagtgatgtgtgggccttcggcgtgctgctgtgggagatcgccacctacggcatgagcccctacccaggcatcgacctgagccaggtgtatgacctgctggagaagggctacaggatggagcagcctgagggctgcccccccaaggtgtatgagctgatgagggcctgctggaagtggagccctgctgaccggcccagctttgctgagacccaccaggcctttgagaccatgtttcatgacagcagcatcagcgaggaggtggccgaggagctgggccgggccgccagcagcagctctgtggtgccctacctgccccggctgcccatcctgcccagcaagaccaggaccctgaagaagcaggtggagaacaaggaaaatattgaaggagcccaggatgccacagaaaattctgccagcagcctggcccctggcttcatccggggggcccaggccagcagcggcagccctgccctgcccaggaagcagagggacaagagccccagcagcctgctggaggatgccaaggagacctgcttcacccgggacaggaagggcggcttcttcagcagcttcatgaagaagagaaatgcccccaccccacccaagaggagcagcagcttccgggagatggagaaccagccccacaagaagtatgagctgaccggcctgcctgagcaggacaggatggccatgaccctgcccaggaactgccagaggagcaagctgcagctggagaggacagtgtccaccagcagccagcctgaggagaatgtggaccgggccaatgacatgctgcccaagaagtctgaggagagcgctgcccccagccgggagcggcccaaggccaagctgctgcccaggggggccacagccctgcccctgcggacccccagcggggacctggccatcacagagaaggaccccccaggagtgggcgtggccggcgtggccgccgcccccaagggcaaggagaagaatggaggagcccggctgggcatggccggcgtgcctgaagatggagagcagcccggctggcccagccctgccaaggccgcccctgtgctgcccaccacccacaaccacaaggtgcctgtgctgatcagccccaccctgaagcacaccccagcagatgtgcagctgattggaacagacagccagggcaacaagttcaagctgctgtctgagcaccaggtgaccagcagcggggacaaggaccggccccggcgggtgaagcccaagtgtgcccctcctcctcctcctgtgatgaggctgctgcagcaccccagcatctgcagcgaccccacagaggagcccacagccctgacagctggccagagcaccagcgagacccaggagggcggcaagaaggccgccctgggcgctgtgcccatcagcggcaaggccggccggcctgtgatgcccccaccccaggtgcccctgcccaccagcagcatcagccctgccaagatggccaacggcacagctggcaccaaggtggccctgaggaagaccaagcaggccgctgagaagatctctgctgacaagatcagcaaggaggccctgctggagtgtgccgacctgctgagcagcgccctgacagagcctgtgcccaacagccagctggtggacaccggccaccagctgctggactactgcagcggctacgtggactgcatcccccagaccaggaacaagtttgccttccgggaggccgtgtccaagctggagctgagcctgcaggagctgcaggtgagcagcgctgctgctggggtgcccggcaccaaccctgtgctgaacaacctgctgagctgtgtgcaggagatcagtgatgtggtgcagaggtag

SEQ ID NO: 175656 - DNA, 3240 bp, Artificial Sequence
  Description of Artificial Sequence: Synthetic coding sequence
atgggccagcaggtgggccgggtgggggaggcccctggcctgcagcagccccagccccggggcatccggggcagcagcgctgcccggcccagcggcagaagaagagatcctgctggccgcaccacagagaccggcttcaacatcttcacccagcacgaccactttgccagctgtgtggaggatggctttgaaggagacaagacaggaggcagcagccctgaggccctgcaccggccctacggctgtgatgtggagccccaggccctgaatgaggccatccgctggagcagcaaagaaaacctgctgggcgccacagaaagtgaccccaacctgtttgtggccctgtatgactttgtggccagcggggacaacaccctgagcatcaccaagggggagaagctgcgggtgctgggctacaaccagaatggagagtggagcgaggtgcgcagcaagaatggccagggctgggtgcccagcaactacatcacccctgtgaacagcctggagaagcacagctggtaccacggccctgtgagccgctctgctgctgagtacctgctgagcagcctcatcaatggcagcttcctggtgcgggagagcgagagcagccctggccagctgagcatcagcctgcgctatgagggccgggtgtaccactaccgcatcaacaccacagcagatggcaaggtgtatgtgacagctgagagccgcttcagcaccctggccgagctggtgcaccaccacagcacagtggctgatggcctggtgaccaccctgcactacccagcccccaagtgcaacaagcccaccgtgtatggagtgagccccatccatgacaagtgggagatggagaggacagacatcaccatgaagcacaagctgggcggcggccagtatggagaggtgtatgtgggcgtgtggaagaagtacagcctgactgtggccgtgaagaccctgaaggaggacaccatggaggtggaggagttcctgaaggaggccgctgtgatgaaggagatcaagcaccccaacctggtgcagctgctgggcgtgtgcaccctggagccccccttctacatcgtgacagagtacatgccctacggcaacctgctggactacctgcgggagtgcaaccgggaggaggtgacagctgtggtgctgctgtacatggccacccagatcagcagcgccatggagtacctggagaagaagaacttcatccaccgggacctggccgccaggaactgcctggtgggagaaaatcatgtggtgaaggtggccgactttggcctgagccggctgatgactggagacacctacacagcccatgctggggccaagttccccatcaagtggacagcccctgagagcctggcctacaacaccttcagcatcaagagtgatgtgtgggcctttggagtgctgctgtgggagatcgccacctacggcatgagcccctacccaggcatcgacctgagccaggtgtatgacctgctggagaagggctacaggatggagcagcctgagggctgcccccccaaggtgtatgagctgatgagggcctgctggaagtggagccctgctgaccggcccagctttgctgagacccaccaggcctttgagaccatgtttcatgacagcagcatcagcgaggaggtggccgaggagctgggccgggccgccagcagcagctctgtggtgccctacctgccccggctgcccatcctgcccagcaagaccaggaccctgaagaagcaggtggagaacaaggagaacatcgagggcgcccaggatgccacagagaacagcgccagcagcctggcccctggcttcatccggggggcccaggccagcagcggcagccctgccctgcccaggaagcagagggacaagagccccagcagcctgctggaggatgccaaggagacctgcttcacccgggacagaaaaggaggcttcttcagcagcttcatgaagaagagaaatgcccccaccccacccaagaggagcagcagcttccgggagatggagaaccagccccacaagaagtatgagctgaccggcctgcctgagcaggacaggatggccatgaccctgcccaggaactgccagaggagcaagctgcagctggagaggacagtgtccaccagcagccagccagaagaaaatgtggaccgggccaatgacatgctgcccaagaagtctgaggagagcgctgcccccagccgggagcggcccaaggccaagctgctgcccaggggggccacagccctgcccctgcggaccccatctggggacctggccatcacagagaaggaccccccaggagtgggcgtggccggcgtggccgccgcccccaagggcaaggagaagaatggaggagcccggctgggcatggccggcgtgcctgaagatggagagcagcccggctggcccagccctgccaaggccgcccctgtgctgcccaccacccacaaccacaaggtgcctgtgctgatcagccccaccctgaagcacaccccagcagatgtgcagctgattggaacagacagccagggcaacaagttcaagctgctgtctgagcaccaggtgaccagcagcggggacaaggaccggcccaggagagtgaagcccaagtgtgcccctcctcctcctcctgtgatgaggctgctgcagcaccccagcatctgcagcgaccccacagaggagcccacagccctgacagctggccagagcaccagcgagacccaggagggcggcaagaaggccgccctgggcgctgtgcccatcagcggcaaggccggccggcctgtgatgcccccaccccaggtgcccctgcccaccagcagcatcagccctgccaagatggccaatggaacagctggcaccaaggtggccctgaggaagaccaagcaggccgctgagaagatctctgctgacaagatcagcaaggaggccctgctggagtgtgccgacctgctgagcagcgccctgacagagcctgtgcccaacagccagctggtggacaccggccaccagctgctggactactgcagcggctacgtggactgcatcccccagaccaggaacaagtttgccttccgggaggccgtgtccaagctggagctgagcctgcaggagctgcaggtgtcctctgctgctgctggggtgcccggcaccaaccctgtgctgaacaacctgctgagctgtgtgcaggagatcagtgatgtggtgcagaggtag

SEQ ID NO: 175657 - DNA, 2349 bp, Artificial Sequence
  Description of Artificial Sequence: Synthetic coding sequence
atgaaccctgagaaggactttgcccccctgacccccaacatcgtgcgggccctgaatgacaagctgtatgagaagaggaaggtggccgccctggagattgagaagctggtgcgggagtttgtggcccagaacaacacagtgcagatcaagcacgtgatccagaccctgagccaggagtttgccctgagccagcacccccacagcaggaagggcggcctcatcggcctggccgcctgcagcatcgccctgggcaaggacagcggcctgtacctgaaggagctgattgagcctgtgctgacctgcttcaatgatgctgacagccggctgcgctactatgcctgtgaggccctgtacaacatcgtgaaggtggcccggggagctgtgctgccccacttcaacgtgctgtttgatggcctgagcaagctggccgctgaccctgaccccaacgtgaagagcggcagcgagctgctggaccggctgctgaaggacatcgtgacagagagcaacaagtttgacctggtgtccttcatccccctgctgcgggagcgcatctacagcaacaaccagtatgcccggcagttcatcatctcctggatcctggtgctggagagcgtgcctgacatcaacctgctggactacctgcctgagatcctggatggcctcttccagatcctgggggacaacgggaaggagatcaggaagatgtgtgaggtggtgctgggggagttcctgaaggagatcaagaagaaccccagctctgtgaagtttgctgagatggccaacatcctggtgatccactgccagaccacagatgacctgatccagctgacagccatgtgctggatgagggagttcatccagctggccggccgggtgatgctgccctacagcagcggcatcctgacagctgtgctgccctgcctggcctatgatgacaggaagaagagcatcaaggaggtggccaacgtgtgcaaccagagcctgatgaagctggtgaccccagaagatgatgagctggatgagctgcggcccggccagaggcaggccgagcccaccccagatgatgccctgcccaagcaggagggcacagccagcggcggcccagatggcagctgtgacagcagcttcagcagcggcatctctgtgttcaccgctgccagcacagagcgggcccctgtgaccctgcacctggatggcatcgtgcaggtgctgaactgccacctgagtgacacagccatcggcatgatgaccagaattgctgtgctgaagtggctgtaccacctgtacatcaagacccccaggaagatgttccgccacacagacagcctcttccccatcctgctgcagaccctgagtgatgaaagtgatgaggtgatcctgaaggacctggaggtgctggccgagatcgccagcagccctgctggccagacagatgaccccggccccctggatggccctgacctgcaggccagccacagcgagctgcaggtgcccaccccaggccgggccggcctgctgaacaccagcggcaccaagggcctggagtgcagccccagcacccccaccatgaacagctacttctacaagttcatgatcaacctgctgaagcgcttcagcagcgagaggaagctgctggaggtgcggggccccttcatcatccggcagctgtgcctgctgctgaatgctgagaacatcttccacagcatggctgacatcctgctgcgggaggaggacctgaagtttgccagcaccatggtgcacgccctgaacaccatcctgctgaccagcacagagctgttccagctgaggaaccagctgaaggacctgaagaccctggagagccagaacctcttctgctgcctgtaccgctcctggtgccacaaccctgtgaccaccgtgtccctgtgcttcctgacccagaactacagacatgcctatgacctgatccagaagtttggagacctggaggtgacagtggacttcctggccgaggtggacaagctggtgcagctgattgaatgtcccatcttcacctacctgcggctgcagctgctggatgtgaagaacaacccctacctgatcaaggccctgtatggcctgctgatgctgctgccccagagcagcgccttccagctgctgagccaccggctgcagtgtgtgcccaaccctgagctgctgcagacagaggacagcctgaaggccgcccccaagagccagaaggctgacagccccagcattgattatgcagagctgctgcagcactttgagaaggtgcagaacaagcacctggaggtgcgccaccagaggagcggccgcggggaccacctggaccggcgggtggtgctgtag

SEQ ID NO: 175658 - DNA, 645 bp, Artificial Sequence
  Description of Artificial Sequence: Synthetic coding sequence
atggctgacatcctgctgcgggaggaggacctgaagtttgccagcaccatggtgcacgccctgaacaccatcctgctgaccagcacagagctgttccagctgaggaaccagctgaaggacctgaagaccctggagagccagaacctcttctgctgcctgtaccgctcctggtgccacaaccctgtgaccaccgtgtccctgtgcttcctgacccagaactacagacatgcctatgacctgatccagaagtttggagacctggaggtgacagtggacttcctggccgaggtggacaagctggtgcagctgattgaatgtcccatcttcacctacctgcggctgcagctgctggatgtgaagaacaacccctacctgatcaaggccctgtatggcctgctgatgctgctgccccagagcagcgccttccagctgctgagccaccggctgcagtgtgtgcccaaccctgagctgctgcagacagaggacagcctgaaggccgcccccaagagccagaaggctgacagccccagcattgattatgcagagctgctgcagcactttgagaaggtgcagaacaagcacctggaggtgcgccaccagaggagcggccgcggggaccacctggaccggcgggtggtgctgtag

SEQ ID NO: 175659 - DNA, 1062 bp, Artificial Sequence
  Description of Artificial Sequence: Synthetic coding sequence
atggccagctcctggccacccctggagctgcagagcagcaaccagagccagctgttcccccagaatgccacagcctgtgacaatgcccctgaggcctgggacctgctgcaccgggtgctgcccaccttcatcatcagcatctgcttcttcggcctgctgggcaacctgtttgtgctgctggtgttcctgctgccccggcggcagctgaatgtggccgagatctacctggccaacctggccgccagtgacctggtgtttgtgctgggcctgcccttctgggccgagaacatctggaaccagttcaactggccctttggagccctgctgtgcagggtcatcaacggggtcatcaaggccaacctcttcatcagcatcttcctggtggtggccatcagccaggaccgctacagagtgctggtgcaccccatggccagccggcggcagcagaggcggcggcaggcccgggtgacctgtgtgctgatctgggtggtgggcggcctgctgagcatccccaccttcctgctgcggagcatccaggccgtgcctgacctgaacatcacagcctgcatcctgctgctgccccatgaggcctggcactttgccagaattgtggagctgaacatcctgggcttcctgctgcccctggccgccatcgtgttcttcaactaccacatcctggccagcctgcggacccgggaggaggtgtccaggacccgctgtggcggcaggaaggacagcaagaccacagccctgatcctgaccctggtggtggccttcctggtgtgctgggccccctaccacttctttgccttcctggagttcctgttccaggtgcaggccgtgcggggctgcttctgggaggacttcatcgacctgggcctgcagctggccaacttctttgccttcaccaacagcagcctgaaccctgtgatctacgtgtttgtgggccgcctcttccgcaccaaggtgtgggagctgtacaagcagtgcacccccaagagcctggcccccatcagcagcagccacaggaaggagatcttccagctgttctggaggaactag

SEQ ID NO: 175660 - DNA, 1527 bp, Artificial Sequence
  Description of Artificial Sequence: Synthetic coding sequence
atgccacccaagagaaatgagaagtacaagctgcccatccccttccctgagggcaaggtgctggatgacatggagggcaaccagtgggtgctgggcaagaagattggcagcggcggcttcggcctcatctacctggccttccccaccaacaagccagagaaggatgcccggcacgtggtgaaggtggagtaccaggagaatggccccctcttcagcgagctgaagttctaccagagggtggccaagaaggactgcatcaagaagtggattgaaaggaagcagctggactacctgggcatccccctcttctacggcagcggcctgacagagttcaagggccgcagctaccgcttcatggtgatggagcggctgggcatcgacctgcagaagatcagcggccagaatggcaccttcaagaagagcacagtgctgcagctgggcatccgcatgctggatgtgctggagtacatccatgaaaatgaatatgtgcacggggacatcaaggccgccaacctgctgctgggctacaagaacccagaccaggtgtacctggccgactatggcctgagctaccgctactgccccaacggcaaccacaagcagtaccaggagaaccccaggaagggccacaacggcaccatcgagttcaccagcctggatgcccacaagggcgtggccctgagcagaagaagtgatgtggagatcctgggctactgcatgctgcgctggctgtgtgggaagctgccctgggagcagaacctgaaggaccctgtggccgtgcagacagccaagaccaacctgctggatgagctgccccagagcgtgctgaagtgggcccccagcggcagcagctgctgtgagatcgcccagttcctggtgtgtgcccacagcctggcctatgatgagaagcccaactaccaggccctgaagaagatcctgaacccccacggcatccccctgggccccctggacttcagcaccaagggccagagcatcaacgtgcacacccccaacagccagaaggtggacagccagaaggccgccaccaagcaggtgaacaaggcccacaacagactcatcgagaagaaggtgcacagcgagaggtctgctgagagctgtgccacctggaaggtgcagaaggaggagaagctgattggcctgatgaacaatgaggccgcccaggagagcacccggcggcggcagaagtaccaggagagccaggagcccctgaatgaggtgaacagcttcccccagaagatctcctacacccagttccccaacagcttctatgagccccaccaggacttcaccagcccagacatcttcaagaagagccgcagccccagctggtacaagtacaccagcacagtgtccacaggcatcacagacctggagagcagcacaggcctgtggcccaccatcagccagttcaccctgtctgaggagaccaatgctgatgtgtactactaccgcatcatcatccctgtgctgctgatgctggtgttcctggccctcttcttcctgtag

SEQ ID NO: 175661 - DNA, 1203 bp, Artificial Sequence
  Description of Artificial Sequence: Synthetic coding sequence
atgccacccaagagaaatgagaagtacaagctgcccatccccttccctgagggcaaggtgctggatgacatggagggcaaccagtgggtgctgggcaagaagattggcagcggcggcttcggcctcatctacctggccttccccaccaacaagccagagaaggatgcccggcacgtggtgaaggtggagtaccaggagaatggccccctcttcagcgagctgaagttctaccagagggtggccaagaaggactgcatcaagaagtggattgaaaggaagcagctggactacctgggcatccccctcttctacggcagcggcctgacagagttcaagggccgcagctaccgcttcatggtgatggagcggctgggcatcgacctgcagaagatcagcggccagaatggcaccttcaagaagagcacagtgctgcagctgggcatccgcatgctggatgtgctggagtacatccatgaaaatgaatatgtgcacggggacatcaaggccgccaacctgctgctgggctacaagaacccagaccaggtgtacctggccgactatggcctgagctaccgctactgccccaacggcaaccacaagcagtaccaggagaaccccaggaagggccacaacggcaccatcgagttcaccagcctggatgcccacaagggcgtggccctgagcagaagaagtgatgtggagatcctgggctactgcatgctgcgctggctgtgtgggaagctgccctgggagcagaacctgaaggaccctgtggccgtgcagacagccaagaccaacctgctggatgagctgccccagagcgtgctgaagtgggcccccagcggcagcagctgctgtgagatcgcccagttcctggtgtgtgcccacagcctggcctatgatgagaagcccaactaccaggccctgaagaagatcctgaacccccacggcatccccctgggccccctggacttcagcaccaagggccagagcatcaacgtgcacacccccaacagccagaaggtggacagccagaaggccgccaccaagcaggtgaacaaggcccacaacagactcatcgagaagaaggtgcacagcgagaggtctgctgagagctgtgccacctggaaggtgcagaaggaggagaagctgattggcctgatgaacaatgaggccgcccagatccggcagctgggctactag

SEQ ID NO: 175662 - DNA, 1191 bp, Artificial Sequence
  Description of Artificial Sequence: Synthetic coding sequence
atgccacccaagagaaatgagaagtacaagctgcccatccccttccctgagggcaaggtgctggatgacatggagggcaaccagtgggtgctgggcaagaagattggcagcggcggcttcggcctcatctacctggccttccccaccaacaagccagagaaggatgcccggcacgtggtgaaggtggagtaccaggagaatggccccctcttcagcgagctgaagttctaccagagggtggccaagaaggactgcatcaagaagtggattgaaaggaagcagctggactacctgggcatccccctcttctacggcagcggcctgacagagttcaagggccgcagctaccgcttcatggtgatggagcggctgggcatcgacctgcagaagatcagcggccagaatggcaccttcaagaagagcacagtgctgcagctgggcatccgcatgctggatgtgctggagtacatccatgaaaatgaatatgtgcacggggacatcaaggccgccaacctgctgctgggctacaagaacccagaccaggtgtacctggccgactatggcctgagctaccgctactgccccaacggcaaccacaagcagtaccaggagaaccccaggaagggccacaacggcaccatcgagttcaccagcctggatgcccacaagggcgtggccctgagcagaagaagtgatgtggagatcctgggctactgcatgctgcgctggctgtgtgggaagctgccctgggagcagaacctgaaggaccctgtggccgtgcagacagccaagaccaacctgctggatgagctgccccagagcgtgctgaagtgggcccccagcggcagcagctgctgtgagatcgcccagttcctggtgtgtgcccacagcctggcctatgatgagaagcccaactaccaggccctgaagaagatcctgaacccccacggcatccccctgggccccctggacttcagcaccaagggccagagcatcaacgtgcacacccccaacagccagaaggtggacagccagaaggccgccaccaagcaggtgaacaaggcccacaacagactcatcgagaagaaggtgcacagcgagaggtctgctgagagctgtgccacctggaaggtgcagaaggaggagaagctgattggcctgatgaacaatgaggccgcccagttcagatag

SEQ ID NO: 175663 - DNA, 876 bp, Artificial Sequence
  Description of Artificial Sequence: Synthetic coding sequence
atgccacccaagagaaatgagaagtacaagctgcccatccccttccctgagggcaaggtgctggatgacatggagggcaaccagtgggtgctgggcaagaagattggcagcggcggcttcggcctcatctacctggccttccccaccaacaagccagagaaggatgcccggcacgtggtgaaggtggagtaccaggagaatggccccctcttcagcgagctgaagttctaccagagggtggccaagaaggactgcatcgtgtttgtggtgaagaagtggattgaaaggaagcagctggactacctgggcatccccctcttctacggcagcggcctgacagagttcaagggccgcagctaccgcttcatggtgatggagcggctgggcatcgacctgcagaagatcagcggccagaatggcaccttcaagaagagcacagtgctgcagctgggcatccgcatgctggatgtgctggagtacatccatgaaaatgaatatgtgcacggggacatcaaggccgccaacctgctgctgggctacaagaacccagaccaggtgtacctggccgactatggcctgagctaccgctactgccccaacggcaaccacaagcagtaccaggagaaccccaggaagggccacaacggcaccatcgagttcaccagcctggatgcccacaagggcgtggccctgagcagaagaagtgatgtggagatcctgggctactgcatgctgcgctggctgtgtgggaagctgccctgggagcagaacctgaaggaccctgtggccgtgcagacagccaagaccaagtacaagttcagcagcatcagcagctgcacagcccctggcctgaagggctacatcaagggcagctag

SEQ ID NO: 175664 - DNA, 1527 bp, Artificial Sequence; identical to SEQ ID NO: 175660
  Description of Artificial Sequence: Synthetic coding sequence

SEQ ID NO: 175665 - DNA, 1458 bp, Artificial Sequence
  Description of Artificial Sequence: Synthetic coding sequence
atggagggcaaccagtgggtgctgggcaagaagattggcagcggcggcttcggcctcatctacctggccttccccaccaacaagccagagaaggatgcccggcacgtggtgaaggtggagtaccaggagaatggccccctcttcagcgagctgaagttctaccagagggtggccaagaaggactgcatcaagaagtggattgaaaggaagcagctggactacctgggcatccccctcttctacggcagcggcctgacagagttcaagggccgcagctaccgcttcatggtgatggagcggctgggcatcgacctgcagaagatcagcggccagaatggcaccttcaagaagagcacagtgctgcagctgggcatccgcatgctggatgtgctggagtacatccatgaaaatgaatatgtgcatggagacatcaaggccgccaacctgctgctgggctacaagaacccagaccaggtgtacctggccgactatggcctgagctaccgctactgccccaatggaaaccacaagcagtaccaggagaaccccaggaagggccacaacggcaccatcgagttcaccagcctggatgcccacaagggcgtggccctgagccgccgcagtgatgtggagatcctgggctactgcatgctgcgctggctgtgtgggaagctgccctgggagcagaacctgaaggaccctgtggccgtgcagacagccaagaccaacctgctggatgagctgccccagagcgtgctgaagtgggcccccagcggcagcagctgctgtgaaattgcccagttcctggtgtgtgcccacagcctggcctatgatgagaagcccaactaccaggccctgaagaagatcctgaacccccacggcatccccctgggccccctggacttcagcaccaagggccagagcatcaacgtgcacacccccaacagccagaaggtggacagccagaaggccgccaccaagcaggtgaacaaggcccacaaccggctgattgagaagaaggtgcacagcgagaggtctgctgagagctgtgccacctggaaggtgcagaaggaggagaagctgattggcctgatgaacaatgaagctgcccaggagagcacccggcggcggcagaagtaccaggagagccaggagcccctgaatgaggtgaacagcttcccccagaagatctcctacacccagttccccaacagcttctatgagccccaccaggacttcaccagcccagacatcttcaagaagagccgcagccccagctggtacaagtacaccagcacagtgtccacaggcatcacagacctggagagcagcacaggcctgtggcccaccatcagccagttcaccctgtctgaggagaccaatgctgatgtgtactactaccgcatcatcatccctgtgctgctgatgctggtgttcctggccctcttcttcctgtag

SEQ ID NO: 175666 - DNA, 531 bp, Artificial Sequence
  Description of Artificial Sequence: Synthetic coding sequence
atggccatgagctttgagtggccctggcagtaccgcttcccccccttcttcaccctgcagcccaacgtggacacccggcagaagcagctggccgcctggtgcagcctggtgctgtccttctgccgcctgcacaagcagagctccatgacagtgatggaggcccaggagagccccctcttcaacaacgtgaagctgcagaggaagctgcctgtggagagcatccagatcgtgctggaggagctgaggaagaagggcaacctggagtggctggacaagagcaagagcagcttcctgatcatgtggaggaggcctgaggagtggggcaagctgatctaccagtgggtgagccgcagcggccagaacaacagcgtcttcaccctgtatgagctgaccaacggggaggacacagaagatgaggagttccacggcctggatgaggccaccctgctgcgggccctgcaggccctgcagcaggagcacaaggccgagatcatcaccgtgtctgatggccggggcgtgaagttcttctag

SEQ ID NO: 175667 - DNA, 984 bp, Artificial Sequence
  Description of Artificial Sequence: Synthetic coding sequence
atgtccttcctgggcggcttcttcggccccatctgtgaaattgacatcgtgctgaatgatggagagaccaggaagatggccgagatgaagacagaagatggcaaggtggagaagcactacctgttctatgatggagagagcgtgtctgggaaggtgaacctggccttcaagcagcccgggaagaggctggagcaccagggcatccgcatcgagtttgtgggccagatcgagctgttcaatgacaagagcaacacccatgaatttgtgaacctggtgaaggagctggccctgcccggggagctgacccagagccgctcctatgactttgagttcatgcaggtggagaagccctatgagagctacatcggggccaacgtgcggctgcgctacttcctgaaggtgaccatcgtgcggcggctgacagacctggtgaaggagtatgacctgattgtgcaccagctggccacctacccagatgtgaacaacagcatcaagatggaggtgggcatcgaggactgcctgcacatcgagtttgagtacaacaagagcaagtaccacctgaaggatgtgattgtgggcaagatctacttcctgctggtgcgcatcaagatccagcacatggagctgcagctgatcaagaaggagatcactggaattggccccagcaccaccacagaaacagagaccatcgccaagtatgagatcatggatggagcccctgtgaagggggagagcatccccatccgcctcttcctggccggctatgaccccacccccaccatgagagatgtgaacaagaagttctctgtgcgctacttcctgaacctggtgctggtggatgaggaggaccggcgctacttcaagcagcaggagatcatcctgtggaggaaggcccctgagaagctgaggaagcagaggaccaacttccaccagagatttgagagccctgagagccaggccagcgctgagcagcctgagatgtag

SEQ ID NO: 175668 - DNA, 984 bp, Artificial Sequence; identical to SEQ ID NO: 175667
  Description of Artificial Sequence: Synthetic coding sequence

SEQ ID NO: 175669 - DNA, 756 bp, Artificial Sequence
  Description of Artificial Sequence: Synthetic coding sequence
atgtccttcctgggcggcttcttcggccccatctgtgaaattgacatcgtgctgaatgatggagagaccaggaagatggccgagatgaagacagaagatggcaaggtggagaagcactacctgttctatgatggagagagcgtgtctgggaaggtgaacctggccttcaagcagcccgggaagaggctggagcaccagggcatccgcatcgagtttgtgggccagatcgagctgttcaatgacaagagcaacacccatgaatttgtgaacctggtgaaggagctggccctgcccggggagctgacccagagccgctcctatgactttgagttcatgcaggtggagaagccctatgagagctacatcggggccaacgtgcggctgcgctacttcctgaaggtgaccatcgtgcggcggctgacagacctggtgaaggagtatgacctgattgtgcaccagctggccacctacccagatgtgaacaacagcatcaagatggaggtgggcatcgaggactgcctgcacatcgagtttgagtacaacaagagcaagtaccacctgaaggatgtgattgtgggcaagatctacttcctgctggtgcgcatcaagatccagcacatggagctgcagctgatcaagaaggagatcactggaattggccccagcaccaccacagaaacagagaccatcgccaagtatgagatcatggatggagcccctgtgaagggggacaacttcatggagaagagcagctag

SEQ ID NO: 175670 - DNA, 651 bp, Artificial Sequence
  Description of Artificial Sequence: Synthetic coding sequence
atgcaggtggagaagccctatgagagctacatcggggccaacgtgcggctgcgctacttcctgaaggtgaccatcgtgcggcggctgacagacctggtgaaggagtatgacctgattgtgcaccagctggccacctacccagatgtgaacaacagcatcaagatggaggtgggcatcgaggactgcctgcacattgaatttgagtacaacaagagcaagtaccacctgaaggatgtgattgtgggcaagatctacttcctgctggtgcgcatcaagatccagcacatggagctgcagctgatcaagaaggagatcaccggcatcggccccagcaccaccacagaaacagagaccatcgccaagtatgagatcatggatggagcccctgtgaagggggagagcatccccatccgcctcttcctggccggctatgaccccacccccaccatgagagatgtgaacaagaagttctctgtgcgctacttcctgaacctggtgctggtggatgaagaagatcggcgctacttcaagcagcaggagatcatcctgtggaggaaggcccctgagaagctgaggaagcagaggaccaacttccaccagagatttgagagccctgagagccaggccagcgctgagcagcctgagatgtag

SEQ ID NO: 175671 - DNA, 933 bp, Artificial Sequence
  Description of Artificial Sequence: Synthetic coding sequence
atgacagagaaccccttccaggagcgctacagcgtggaggacctgagcaccttcggcatgtgcctgtgcatggtgcgctacgtgtatgatgccttctacaaggtgaacctggccttcaagcagcccgggaagaggctggagcaccagggcatcagaattgaatttgtgggccagatcgagctgttcaatgacaagagcaacacccatgaatttgtgaacctggtgaaggagctggccctgcctggagagctgacccagagccgctcctatgactttgagttcatgcaggtggagaagccctatgagagctacatcggggccaacgtgcggctgcgctacttcctgaaggtgaccatcgtgcggcggctgacagacctggtgaaggagtatgacctgattgtgcaccagctggccacctacccagatgtgaacaacagcatcaagatggaggtgggcatcgaggactgcctgcacattgaatttgagtacaacaagagcaagtaccacctgaaggatgtgattgtgggcaagatctacttcctgctggtgcgcatcaagatccagcacatggagctgcagctgatcaagaaggagatcaccggcatcggccccagcaccaccacagaaacagagaccatcgccaagtatgagatcatggatggagcccctgtgaagggggagagcatccccatccgcctcttcctggccggctatgaccccacccccaccatgagagatgtgaacaagaagttctctgtgcgctacttcctgaacctggtgctggtggatgaagaagatcggcgctacttcaagcagcaggagatcatcctgtggaggaaggcccctgagaagctgaggaagcagaggaccaacttccaccagagatttgagagccctgagagccaggccagcgctgagcagcctgagatgtag

SEQ ID NO: 175672 - DNA, 1011 bp, Artificial Sequence
  Description of Artificial Sequence: Synthetic coding sequence
atgtccttcttcggcttcggccagagcgtggaggtggagatcctgctgaatgatgctgagagcaggaagagagctgagcacaagacagaagatggcaagaaggagaagtacttcctgttctatgatggagaaacagtgtctgggaaggtgtccctggccctgaagaaccccaacaagaggctggagcaccagggcatcaagattgagttcatcggccagatcgagctgtactatgaccggggcaaccaccacgagtttgtgtccctggtgaaggacctggcccggcctggagagatcacccagagccaggcctttgattttgagttcacccacgtggagaagccctatgagagctacacaggccagaatgtgaagctgcgctacttcctgcgggccaccatcagccggcggctgaatgatgtggtgaaggagatggacatcgtggtgcacaccctgagcacctacccagagctgaacagcagcatcaagatggaggtgggcatcgaggactgcctgcacatcgagtttgagtacaacaagagcaagtaccacctgaaggatgtgattgtgggcaagatctacttcctgctggtgcgcatcaagatcaagcacatggagattgacatcatcaagcgggagaccactggaacaggccccaacgtgtaccatgaaaatgacaccatcgccaagtatgagatcatggatggagcccctgtgcggggggagagcatccccatccgcctcttcctggccggctatgagctgacccccaccatgagggacatcaacaagaagttctctgtgcgctactacctgaacctggtgctgattgatgaggaggagcggcgctacttcaagcagcaggaggtggtgctgtggaggaaaggagacatcgtgaggaagtccatgagccaccaggccgccatcgccagccagagatttgagggcaccaccagcctgggggaggtgaggacccccagccagctgagtgacaacaactgccggcagtag

SEQ ID NO: 175673 - DNA, 666 bp, Artificial Sequence
  Description of Artificial Sequence: Synthetic coding sequence
atgtttcatggcatcccagccaccccaggcattggagcccctggcaacaagccagagctgtatgaggaggtgaagctgtacaagaatgcccgggagcgggagaagtatgacaacatggccgagctgtttgctgtggtgaagaccatgcaggccctggagaaggcctacatcaaggactgtgtgagccccagcgagtacacagctgcctgcagccggctgctggtgcagtacaaggccgccttccggcaggtgcagggcagcgagatcagcagcattgatgagttctgcaggaagttccggctggactgccccctggccatggagcgcatcaaggaggaccggcccatcaccatcaaggatgacaagggcaacctgaaccgctgcatcgcagatgtggtgtccctcttcatcaccgtgatggacaagctgcggctggagatccgggccatggatgagatccagcctgacctgcgggagctgatggagaccatgcacaggatgagccacctgcccccagactttgagggccggcagacagtgtcccagtggctgcagaccctgagcggcatgtctgccagtgatgagctggatgacagccaggtgcggcagatgctgtttgacctggagagcgcctacaatgccttcaaccgcttcctgcacgcctag

SEQ ID NO: 175674 - DNA, 702 bp, Artificial Sequence
  Description of Artificial Sequence: Synthetic coding sequence
atgtttcatggcatcccagccaccccaggcattggagcccctggcaacaagccagagctgtatgaggaggtgaagctgtacaagaatgcccgggagcgggagaagtatgacaacatggccgagctgtttgctgtggtgaagaccatgcaggccctggagaaggcctacatcaaggactgtgtgagccccagcgagtacacagctgcctgcagccggctgctggtgcagtacaaggccgccttccggcaggtgcagggcagcgagatcagcagcattgatgagttctgcaggaagttccggctggactgccccctggccatggagcgcatcaaggaggaccggcccatcaccatcaaggatgacaagggcaacctgaaccgctgcatcgcagatgtggtgtccctcttcatcaccgtgatggacaagctgcggctggagatccgggccatggatgagatccagcctgacctgcgggagctgatggagaccatgcacaggatgagccacctgcccccagactttgagggccggcagacagtgtcccagtggtgggtgtccctgcctgcccggcagagccctgctgtgcctgagaccctgcctgcccggcgcagccctgctgtgcccctgcggcccagcgcccccacctgccctgtgctgcacagccaggccgctgaccctgagagacatgtgggcgtgaggtag

SEQ ID NO: 175675 - DNA, 666 bp, Artificial Sequence; identical to SEQ ID NO: 175673
  Description of Artificial Sequence: Synthetic coding sequence

SEQ ID NO: 175676 - DNA, 1791 bp, Artificial Sequence
  Description of Artificial Sequence: Synthetic coding sequence
atggccgcccacctgtcctatggccgggtgaacctgaatgtgctgcgggaggccgtgcggcgggagctgcgggagttcctggacaagtgtgccggcagcaaggccatcgtgtgggatgagtacctgaccggccccttcggcctgattgcccagtacagcctgctgaaggagcacgaggtggagaagatgttcaccctgaagggcaaccggctgcctgctgctgatgtgaagaacatcatcttctttgtgcggccccggctggagctgatggacatcatcgcagaaaatgtgctgtctgaggaccggcggggccccacccgggacttccacatcctgtttgtgccccggcgcagcctgctgtgtgagcagaggctgaaggacctgggcgtgctgggcagcttcatccaccgggaggagtacagcctggacctgatcccctttgatggagacctgctgtccatggagagcgagggcgccttcaaggagtgctacctggagggggaccagaccagcctgtaccacgccgccaagggcctgatgaccctgcaggccctgtatggcaccatcccccagatctttggaaaaggagaatgtgcccggcaggtggccaacatgatgatccgcatgaagcgggagttcaccggcagccagaacagcatcttccctgtgtttgacaacctgctgctgctggacagaaatgtggacctgctgacccccctggccacccagctgacctatgagggcctgattgatgagatctacggcatccagaacagctatgtgaagctgcccccagagaagtttgcccccaagaagcagggagatggcggcaaggacctgcccacagaggccaagaagctgcagctgaacagcgctgaggagctgtatgcagagatccgggacaagaacttcaatgctgtgggctctgtgctgagcaagaaggccaagatcatctctgctgcctttgaggagcggcacaatgccaagacagtgggggagatcaagcagtttgtgtcccagctgccccacatgcaggccgcccggggcagcctggccaaccacaccagcattgctgagctgatcaaggatgtgaccaccagcgaggacttctttgacaagctgactgtggagcaggagttcatgagcggcatcgacacagacaaggtgaacaactacatcgaggactgcatcgcccagaagcacagcctcatcaaggtgctgcggctggtgtgcctgcagagcgtgtgcaacagcggcctgaagcagaaggtgctggactactacaagcgggagatcctgcagacctacggctatgagcacatcctgaccctgcacaacctggagaaggccggcctgctgaagccccagacaggaggcaggaacaactaccccaccatcaggaagaccctgcggctgtggatggatgatgtgaatgagcagaaccccacagacatctcctatgtgtacagcggctacgcccccctgtctgtgcggctggcccagctgctgagccggcccggctggaggagcattgaggaggtgctgcgcatcctgcccggcccccactttgaggagcggcagcccctgcccaccggcctgcagaagaagaggcagcctggagaaaatagagtgaccctcatcttcttcctgggcggcgtgacctttgctgagattgctgccctgcgcttcctgagccagctggaggatggcggcacagaatatgtgattgccaccaccaagctgatgaatggcacctcctggattgaggccctgatggagaagcccttctag

SEQ ID NO: 175677 - DNA, 1854 bp, Artificial Sequence
  Description of Artificial Sequence: Synthetic coding sequence
atggccttcccccacaggccagatgcccctgagctgcctgacttctccatgctgaagaggctggcccgggaccagctgatctacctgctggagcagctgcccgggaagaaggacctcttcattgaagctgacctgatgagccccctggaccgcatcgccaacgtgtccatcctgaagcagcacgaggtggacaagctgtacaaggtggagaacaagccagccctgagcagcaatgagcagctgtgcttcctggtgcggccccgcatcaagaacatgagatacatcgccagcctggtgaatgctgacaagctggccggccgcaccaggaagtacaaggtgatcttcagcccccagaagttctacgcctgtgagatggtgctggaggaggagggcatctatggagatgtgtcctgtgatgagtgggccttcagcctgctgcccctggatgtggacctgctgtccatggagctgcctgagttcttccgggactacttcctggagggggaccagcgctggatcaacacagtggcccaggccctgcacctgctgagcaccctgtatggccccttccccaactgctacggcatcggccgctgtgccaagatggcctatgagctgtggaggaacctggaggaggaggaggatggagagaccaagggcagaagacctgagatcggccacatcttcctgctggacagagatgtggactttgtgacagccctgtgcagccaggtggtgtatgagggcctggtggatgacaccttccgcatcaagtgtggctctgtggactttggacctgaggtgaccagcagtgacaagagcctgaaggtgctgctgaatgctgaggacaaggtgttcaatgagatcagaaatgagcacttcagcaatgtgtttggcttcctgagccagaaggccaggaacctgcaggcccagtatgacagaagaagaggcatggacatcaagcagatgaagaactttgtgtcccaggagctgaagggcctgaagcaggagcaccggctgctgagcctgcacatcggggcctgtgagagcatcatgaagaagaagaccaagcaggacttccaggagctgatcaagacagagcacgccctgctggagggcttcaacatccgggagagcaccagctacatcgaggagcacatcgaccggcaggtgagccccatcgagagcctgcggctgatgtgcctgctgagcatcacagaaaatggcctcatccccaaggactaccgcagcctgaagacccagtacctgcagagctatggccctgagcacctgctgaccttcagcaacctgcggcgggccggcctgctgacagagcaggcccctggggacaccctgacagctgtggagagcaaggtgtccaagctggtgacagacaaggccgccggcaagatcacagatgccttcagcagcctggccaagaggagcaacttccgggccatcagcaagaagctgaacctgatcccccgggtggatggagaatatgacctgaaggtgccccgggacatggcctacgtgtttggaggagcctacgtgcccctgagctgccgcatcatcgagcaggtgctggagaggaggtcctggcagggcctggatgaggtggtgcggctgctgaactgcagcgactttgccttcacagacatgaccaaggaggacaaggccagcagcgagagcctgcggctcatcctggtggtgttcctgggcggctgcaccttcagcgagatcagcgccctgcgcttcctgggccgggagaagggctaccgcttcatcttcctgaccacagctgtgaccaacagcgcccggctgatggaggccatgtctgaggtgaaggcctag

SEQ ID NO: 175678 - DNA, 1719 bp, Artificial Sequence
  Description of Artificial Sequence: Synthetic coding sequence
atgagccccctggacagaattgccaacgtgtccatcctgaagcagcacgaggtggacaagctgtacaaggtggagaacaagccagccctgagcagcaatgagcagctgtgcttcctggtgcggccccgcatcaagaacatgagatacatcgccagcctggtgaatgctgacaagctggccggccgcaccaggaagtacaaggtgatcttcagcccccagaagttctacgcctgtgagatggtgctggaggaggagggcatctatggagatgtgtcctgtgatgagtgggccttcagcctgctgcccctggatgtggacctgctgtccatggagctgcctgagttcttccgggactacttcctggagggggaccagcgctggatcaacacagtggcccaggccctgcacctgctgagcaccctgtatggccccttccccaactgctatggaattggccgctgtgccaagatggcctatgagctgtggaggaacctggaggaggaggaggatggagagaccaagggccggcggcctgagatcggccacatcttcctgctggacagagatgtggactttgtgacagccctgtgcagccaggtggtgtatgagggcctggtggatgacaccttccgcatcaagtgtggctctgtggactttggacctgaggtgaccagcagtgacaagagcctgaaggtgctgctgaatgctgaggacaaggtgttcaatgagatcagaaatgagcacttcagcaatgtgtttggcttcctgagccagaaggccaggaacctgcaggcccagtatgacagaagaagaggcatggacatcaagcagatgaagaactttgtgtcccaggagctgaagggcctgaagcaggagcaccggctgctgagcctgcacatcggggcctgtgagagcatcatgaagaagaagaccaagcaggacttccaggagctgatcaagacagaacatgccctgctggagggcttcaacatccgggagagcaccagctacatcgaggagcacatcgaccggcaggtgagccccatcgagagcctgcggctgatgtgcctgctgagcatcacagaaaatggcctcatccccaaggactaccgcagcctgaagacccagtacctgcagagctatggccctgagcacctgctgaccttcagcaacctgcggcgggccggcctgctgacagagcaggcccctggggacaccctgacagctgtggagagcaaggtgtccaagctggtgacagacaaggctgctgggaagatcacagatgccttcagcagcctggccaagaggagcaacttccgggccatcagcaagaagctgaacctgatcccccgggtggatggagaatatgacctgaaggtgccccgggacatggcctacgtgtttggaggagcctacgtgcccctgagctgccgcatcatcgagcaggtgctggagcggcgctcctggcagggcctggatgaggtggtgcggctgctgaactgcagcgactttgccttcacagacatgaccaaggaggacaaggccagcagcgagagcctgcggctcatcctggtggtgttcctgggcggctgcaccttcagcgagatcagcgccctgcgcttcctgggccgggagaagggctaccgcttcatcttcctgaccacagctgtgaccaacagcgcccggctgatggaggccatgtctgaggtgaaggcctag

SEQ ID NO: 175679 - DNA, 2391 bp, Artificial Sequence
  Description of Artificial Sequence: Synthetic coding sequence
atgcccaccacccagcagagcccccaggatgagcaggagaagctgctggatgaggccatccaggccgtgaaggtgcagagcttccagatgaagcgctgcctggacaagaacaagctgatggatgccctgaagcacgccagcaacatgctgggggagctgcggacctccatgctgagccccaagagctactatgagctgtacatggccatcagtgatgagctgcactacctggaggtgtacctgacagatgaatttgccaagggcaggaaggtggccgacctgtatgagctggtgcagtatgccggcaacatcatcccccggctgtacctgctgatcaccgtgggcgtggtgtatgtgaagagcttcccccagagcaggaaggacatcctgaaggacctggtggagatgtgccggggcgtgcagcaccccctgcggggcctcttcctgaggaactacctgctgcagtgcaccaggaacatcctgcctgatgaaggagagcccacagatgaggagaccactggagacatcagtgacagcatggactttgtgctgctgaactttgctgagatgaacaagctgtgggtgaggatgcagcaccagggccacagccgggaccgggagaagcgggagcgggagcggcaggagctgcgcatcctggtgggcaccaacctggtgcggctgagccagctggagggcgtgaatgtggagcgctacaagcagatcgtgctgaccggcatcctggagcaggtggtgaactgcagagatgccctggcccaggagtacctgatggagtgcatcatccaggtgtttcctgatgagttccacctgcagaccctgaaccccttcctgcgggcctgtgccgagctgcaccagaatgtgaatgtgaagaacatcatcatcgccctgattgaccggctggccctgtttgcccacagagaagatggccctggcatcccagctgacatcaagctgtttgacatcttcagccagcaggtggccaccgtcatccagagccggcaggacatgcccagtgaagatgtggtgtccctgcaggtgtccctcatcaacctggccatgaagtgctacccagacagagtggactatgtggacaaggtgctggagaccaccgtggagatcttcaacaagctgaacctggagcacatcgccaccagcagcgctgtgtccaaggagctgacccggctgctgaagatccctgtggacacctacaacaacatcctgactgtgctgaagctgaagcacttccaccccctgtttgagtactttgattatgagagcaggaagtccatgagctgctacgtgctgagcaatgtgctggactacaacacagaaattgtgtcccaggaccaggtggacagcatcatgaacctggtgtccaccctcatccaggaccagcctgaccagcctgtggaggaccctgaccctgaggactttgctgatgagcagagcctggtgggccgcttcatccacctgctgcggagtgaagatcctgaccagcagtacctgatcctgaacacagccaggaagcactttggagctgggggcaaccagaggatccgcttcaccctgccccccctggtgtttgctgcctaccagctggccttccgctacaaggagaacagcaaggtggatgacaagtgggagaagaagtgccagaagatcttctcctttgcccaccagaccatcagcgccctgatcaaggccgagctggccgagctgcccctgcggctcttcctgcagggcgccctggccgccggggagatcggctttgaaaatcatgaaacagtggcctatgagttcatgagccaggccttcagcctgtatgaagatgagatcagtgacagcaaggcccagctggccgccatcaccctcatcatcggcacctttgagaggatgaagtgcttcagcgaggagaaccacgagcccctgcggacccagtgtgccctggccgccagcaagctgctgaagaagccagaccagggccgggctgtgtccacctgtgcccacctgttctggagcggcaggaacacagacaagaatggagaggagctgcatggaggcaagagggtgatggagtgcctgaagaaggccctgaagatcgccaaccagtgcatggaccccagcctgcaggtgcagctgttcatcgagatcctgaaccgctacatctacttctatgagaaggaaaatgatgctgtgaccatccaggtgctgaaccagctgatccagaagatccgggaggacctgcccaacctggagagcagcgaggagacagagcagatcaacaagcacttccacaacaccctggagcacctgcggctgcggcgggagagccctgagagcgagggccccatctatgagggcctcatcctgtag

SEQ ID NO: 175680 - DNA, 1989 bp, Artificial Sequence
  Description of Artificial Sequence: Synthetic coding sequence
atgtgccggggcgtgcagcaccccctgcggggcctcttcctgaggaactacctgctgcagtgcaccaggaacatcctgcctgatgaaggagagcccacagatgaggagaccaccggggacatcagtgacagcatggactttgtgctgctgaactttgctgagatgaacaagctgtgggtgaggatgcagcaccagggccacagccgggaccgggagaagcgggagcgggagcggcaggagctgcgcatcctggtgggcaccaacctggtgcggctgagccagctggagggcgtgaatgtggagcgctacaagcagatcgtgctgaccggcatcctggagcaggtggtgaactgcagagatgccctggcccaggagtacctgatggagtgcatcatccaggtgtttcctgatgagttccacctgcagaccctgaaccccttcctgcgggcctgtgccgagctgcaccagaatgtgaatgtgaagaacatcatcatcgccctgattgaccggctggccctgtttgcccaccgggaggatggccctggcatcccagctgacatcaagctgtttgacatcttcagccagcaggtggccaccgtcatccagagccggcaggacatgcccagtgaagatgtggtgtccctgcaggtgtccctcatcaacctggccatgaagtgctacccagacagagtggactatgtggacaaggtgctggagaccaccgtggagatcttcaacaagctgaacctggagcacatcgccaccagcagcgctgtgtccaaggagctgacccggctgctgaagatccctgtggacacctacaacaacatcctgactgtgctgaagctgaagcacttccaccccctgtttgagtactttgattatgagagcaggaagtccatgagctgctacgtgctgagcaatgtgctggactacaacacagagatcgtgtcccaggaccaggtggacagcatcatgaacctggtgtccaccctcatccaggaccagcctgaccagcctgtggaggaccctgaccctgaagattttgctgatgagcagagcctggtgggccgcttcatccacctgctgcggtctgaggaccctgaccagcagtacctgatcctgaacacagccaggaagcactttggagctgggggcaaccagaggatccgcttcaccctgccccccctggtgtttgctgcctaccagctggccttccgctacaaggagaacagcaaggtggatgacaagtgggagaagaagtgccagaagatcttctcctttgcccaccagaccatcagcgccctgatcaaggccgagctggccgagctgcccctgcggctcttcctgcagggcgccctggccgccggggagattggatttgagaaccacgagaccgtggcctatgagttcatgagccaggccttcagcctgtatgaagatgagatcagtgacagcaaggcccagctggccgccatcaccctcatcatcggcacctttgagaggatgaagtgcttctctgaagaaaatcatgagcccctgcggacccagtgtgccctggccgccagcaagctgctgaagaagccagaccagggccgggctgtgtccacctgtgcccacctgttctggagcggcaggaacacagacaagaatggagaggagctgcacggcggcaagagggtgatggagtgcctgaagaaggccctgaagatcgccaaccagtgcatggaccccagcctgcaggtgcagctgttcatcgagatcctgaaccgctacatctacttctatgagaaggaaaatgatgccatcgtgaccatccaggtgctgaaccagctgatccagaagatccgggaggacctgcccaacctggagagcagcgaggagacagagcagatcaacaagcacttccacaacaccctggagcacctgcggctgcggcgggagagccctgagagcgagggccccatctatgagggcctcatcctgtag

SEQ ID NO: 175681 - DNA, 1161 bp, Artificial Sequence
  Description of Artificial Sequence: Synthetic coding sequence
atggacagatttgtgtggaccagcggcctgctggagatcaatgagaccctggtgatccagcagaggggcgtgcgcatctatgatggagaggagaagatcaagtttgatgctggcaccctgctgctgagcacccacaggctcatctggagggaccagaagaaccacgagtgctgcatggccatcctgctgagccagatcgtgttcatcgaggagcaggccgccggcatcggcaagagcgccaagatcgtggtgcacctgcacccagccccacccaacaaggagcccggccccttccagagcagcaagaacagctacatcaagctgtccttcaaggagcacggccagatcgagttctaccgccgcctgtctgaggagatgacccagaggcgctgggagaacatgcctgtgtcccagagcctgcagaccaacagaggcccccagcccggccgcatccgggctgtgggcatcgtgggcattgaaaggaagctggaggagaagaggaaggagacagacaagaacatcagcgaggcctttgaggacctgagcaagctgatgatcaaggccaaggagatggtggagctgagcaagagcatcgccaacaagatcaaggacaagcagggcgacatcacagaagatgagaccatccgcttcaagagctacctgctgtccatgggcatcgccaaccctgtgacccgggagacctacggcagcggcacccagtaccacatgcagctggccaagcagctggccggcatcctgcaggtgcccctggaggagcggggcggcatcatgagcctgacagaggtgtactgcctggtgaacagagcccggggcatggagctgctgagccctgaggacctggtgaatgcctgcaagatgctggaggccctgaagctgcccctgcggctgcgggtgtttgacagcggcgtgatggtgattgagctgcagagccacaaggaggaggagatggtggccagcgccctggagaccgtgtctgagaagggcagcctgaccagcgaggagtttgccaagctggtgggcatgtctgtgctgctggccaaggagcggctgctgctggccgagaagatgggccacctgtgcagagatgattctgtggagggcctgcgcttctaccccaacctcttcatgacccagagctag

SEQ ID NO: 175682 - DNA, 558 bp, Artificial Sequence
  Description of Artificial Sequence: Synthetic coding sequence
atgtcctggctgttccccctgaccaagagcgccagcagcagcgctgctggcagccctgggggcctgaccagcctgcagcagcagaagcagaggctgattgagagcctgaggaacagccacagcagcattgctgagatccagaaggatgtggagtaccgcctgcccttcaccatcaacaacctgaccatcaacatcaacatcctgctgcccccccagttcccccaggagaagcctgtgatctctgtgtacccacccatccgccaccacctgatggacaagcagggcgtgtatgtgaccagccccctggtgaacaacttcaccatgcacagcgacctgggcaagatcatccagagcctgctggatgagttctggaagaacccccctgtgctggcccccaccagcacagccttcccctaccagctggagatccgctggcaccacccccactgcctggagatcagcctggcccggagcagcaacagcctgggcttcagcatcagcagcagcatcagcagcaccaggagcaagcaggagtaccacttcttcatctgctgctag

SEQ ID NO: 175683 - DNA, 1194 bp, Artificial Sequence
  Description of Artificial Sequence: Synthetic coding sequence
atgtcctggctgttccccctgaccaagagcgccagcagcagcgctgctggcagccctgggggcctgaccagcctgcagcagcagaagcagaggctgattgagagcctgaggaacagccacagcagcattgctgagatccagaaggatgtggagtaccgcctgcccttcaccatcaacaacctgaccatcaacatcaacatcctgctgcccccccagttcccccaggagaagcctgtgatctctgtgtacccacccatccgccaccacctgatggacaagcagggcgtgtatgtgaccagccccctggtgaacaacttcaccatgcacagcgacctgggcaagatcatccagagcctgctggatgagttctggaagaacccccctgtgctggcccccaccagcacagccttcccctacctgtacagcaaccccagcggcatgagcccctatgccagccagggcttccccttcctgcccccctacccaccccaggaggccaacagaagcatcaccagcctgtctgtggccgacacagtgagcagcagcaccaccagccacaccacagccaagccagctgcccccagctttggagtgctgagcaacctgcccctgcccatccccaccgtggatgccagcatccccaccagccagaatggcttcggctacaagatgccagatgtgcctgatgccttccctgagctgtctgagctgtctgtgtcccagctgacagacatgaatgagcaggaggaggtgctgctggagcagttcctgaccctgccccagctgaagcagatcatcacagacaaggatgacctggtgaagagcattgaggagctggccaggaagaacctgctgctggagcccagcctggaggccaagaggcagacagtgctggacaagtatgagctgctgacccagatgaagagcacctttgagaagaagatgcagaggcagcacgagctgtctgagagctgcagcgccagcgccctgcaggcccggctgaaggtggccgcccatgaagctgaggaggagagtgacaacattgctgaggacttcctggagggcaagatggagattgatgacttcctgagcagcttcatggagaagaggaccatctgccactgccggcgggccaaggaggagaagctgcagcaggccatcgccatgcacagccagttccacgcccccctgtag

SEQ ID NO: 175684 - DNA, 1119 bp, Artificial Sequence
  Description of Artificial Sequence: Synthetic coding sequence
atgtcctggctgttccccctgaccaagagcgccagcagcagcgctgctggcagccctgggggcctgaccagcctgcagcagcagaagcagaggctgattgagagcctgaggaacagccacagccggctgctgcccccccagttcccccaggagaagcctgtgatctctgtgtacccacccatccgccaccacctgatggacaagcagggcgtgtatgtgaccagccccctggtgaacaacttcaccatgcacagcgacctgggcaagatcatccagagcctgctggatgagttctggaagaacccccctgtgctggcccccaccagcacagccttcccctacctgtacagcaaccccagcggcatgagcccctatgccagccagggcttccccttcctgcccccctacccaccccaggaggccaacagaagcatcaccagcctgtctgtggccgacacagtgagcagcagcaccaccagccacaccacagccaagccagctgcccccagctttggagtgctgagcaacctgcccctgcccatccccaccgtggatgccagcatccccaccagccagaatggatttggctacaagatgccagatgtgcctgatgccttccctgagctgtctgagctgtctgtgtcccagctgacagacatgaatgagcaggaggaggtgctgctggagcagttcctgaccctgccccagctgaagcagatcatcacagacaaggatgacctggtgaagagcattgaggagctggccaggaagaacctgctgctggagcccagcctggaggccaagaggcagacagtgctggacaagtatgagctgctgacccagatgaagagcacctttgagaagaagatgcagaggcagcacgagctgtctgagagctgcagcgccagcgccctgcaggcccggctgaaggtggccgcccacgaggccgaggaggagagtgacaacattgctgaggacttcctggagggcaagatggagattgatgacttcctgagcagcttcatggagaagaggaccatctgccactgcagaagagccaaggaggagaagctgcagcaggccatcgccatgcacagccagttccacgcccccctgtag

SEQ ID NO: 175685 - DNA, 858 bp, Artificial Sequence
  Description of Artificial Sequence: Synthetic coding sequence
atggccggggccggcagcgaggccaggtttgctggcctgagcctggtgcagctgaatgagctgctggaggatgagggccagctgacagagatggtgcagaagatggaggagacccagaatgtgcagctgaacaaggagatgaccctggccagcaacagaagcctggccgagggcaacctgctgtaccagccccagctggacaccctgaaggcccggctgacccagaagtaccaggagctgcaggtgctgtttgaggcctaccagatcaagaagaccaagctggaccggcagagcagcagcgccagcctggagaccctgctggccctgctgcaggccgagggcgccaagattgaggaggacacagagaacatggccgagaagttcctggatggagagctgcccctggacagcttcattgatgtgtaccagagcaagaggaagctggcccacatgagaagagtgaagattgagaagctgcaggagatggtgctgaagggccagaggctgccccaggccctggcccccctgcccccccggctgcctgagctggcccccacagcccccctgccctacccagcccctgaggccagcggccccccagctgtggccccccggcgcatccccccacctcctcctcctgtgcctgctggccgcctggccacccccttcaccgctgccatgagcagcggccaggccgtgccctacccaggcctgcagtgcccccccctgcccccccgggtgggcctgcccacccagcagggcttcagcagccagtttgtgagcccctaccccccacccctgccccagaggcccccaccccggctgcccccccaccagcccggcttcatcctgcagtag

SEQ ID NO: 175686 - DNA, 1068 bp, Artificial Sequence
  Description of Artificial Sequence: Synthetic coding sequence
atggagaccctgaaggacaagaccctgcaggagctggaggagctgcagaatgattctgaggccatcgaccagctggccctggagagccctgaggtgcaggacctgcagctggagcgggagatggccctggccaccaacagaagcctggccgagaggaacctggagttccagggccccctggagatcagccgcagcaacctgagtgaccgctaccaggagctgaggaagctggtggagcgctgccaggagcagaaggccaagctggagaagttcagcagcgccctgcagcccggcaccctgctggacctgctgcaggtggagggcatgaagattgaggaggagagcgaggccatggccgagaagttcctggagggggaggtgcccctggagaccttcctggagaacttcagctccatgaggatgctgagccacctgcggcgggtgcgggtggagaagctgcaggaggtggtgaggaagccccgggccagccaggagctggccggagatgcccccccacccaggcctcctcctcctgtgcggcctgtgccccagggcaccccacctgtggtggaggagcagccccagccccccctggccatgccaccctaccccctgccctacagccccagccccagcctgcctgtgggccccacagcccacggggccctgcccccagcccccttccctgtggtgtcccagcccagcttctacagcggccccctgggccccacctacccagctgcccagctgggccccagaggagctgctggctacagctggagcccccagaggtccatgccaccccggcccggctacccaggcacccccatgggcgccagcggccctggctaccccctgcggggcggccgggcccccagccctggctacccccagcagagcccctacccagccactggaggcaagccaccctaccccatccagccccagctgcccagcttccctggccagccccagcccagcgtgcccctgcagcccccctacccacctggccctgccccaccctacggcttccccccacctcctggccctgcctggccaggctactag

SEQ ID NO: 175687 - DNA, 447 bp, Artificial Sequence
  Description of Artificial Sequence: Synthetic coding sequence
atggagaccctgaaggacaagaccctgcaggagctggaggagctgcagaatgattctgaggccatcgaccagctggccctggagagccctgaggtgcaggacctgcagctggagcgggagatggccctggccaccaacagaagcctggccgagaggaacctggagttccagggccccctggagatcagccgcagcaacctgagtgaccgctaccaggagctgaggaagctggtggagcgctgccaggagcagaaggccaagctggagaagttcagcagcgccctgcagcccggcaccctgctggacctgctgcaggtggagggcatgaagattgaggaggagagcgaggccatggccgagaagttcctggagggggaggtgcccctggagaccttcctggagaacttcagctccatgaggatgctgagccacctgcggcgggtgtag

SEQ ID NO: 175688 - DNA, 969 bp, Artificial Sequence
  Description of Artificial Sequence: Synthetic coding sequence
atggagaccctgaaggacaagaccctgcaggagctggaggagctgcagaatgattctgaggccatcgaccagctggccctggagagccctgaggtgcaggacctgcagctggagcgggagatggccctggccaccaacagaagcctggccgagaggaacctggagttccagggccccctggagatcagccgcagcaacctgagtgaccgctaccaggagctgaggaagctggtggagcgctgccaggagcagaaggccaagctggagaagttcagcagcgccctgcagcccggcaccctgctggacctgctgcaggtggagggcatgaagattgaggaggagagcgaggccatggccgagaagttcctggagggggaggtgcccctggagaccttcctggagaacttcagctccatgaggatgctgagccacctgcggcgggtgcgggtggagaagctgcaggaggtggtgaggaagccccgggccagccaggagctggccggagatgcccccccacccaggcctcctcctcctgtgcggcctgtgccccagggcaccccacctgtggtggaggagcagccccagccccccctggccatgccaccctaccccctgccctacagccccagccccagcctgcctgtgggccccacagcccacggggccctgcccccagcccccttccctgtggtgtcccagcccagcttctacagcggccccctgggccccacctacccagctgcccagctgggccccagaggagctgctggctacagctggagcccccagaggtccatgccaccccggcccggctacccaggcacccccatgggcgccagcggccctggctaccccctgcggggcggccgggcccccagccctggctacccccagcagagcccctacccagccactggaggcaagccaccctaccccatccagccccagctgcccttcagcctgtgctag

SEQ ID NO: 175689 - DNA, 756 bp, Artificial Sequence
  Description of Artificial Sequence: Synthetic coding sequence
atgtaccgggcccgggccgcccgggccggccctgagcccggcagccctggccgcttcggcatcctgagcacaggccagctgcgggacctgctgcaggatgagcccaagctggaccgcatcgtgcggctgagcaggaagttccagggcctgcagctggagcgggaggcctgcctggccagcaactatgccctggccaaggagaacctggccctgcggccccggctggagatgggccgggccgccctggccatcaagtaccaggagctgcgggaggtggccgagaactgtgccgacaagctgcagaggctggaggagagcatgcaccgctggagcccccactgtgccctgggctggctgcaggccgagctggaggaggccgagcaggaggccgaggagcagatggagcagctgctgctgggggagcagagcctggaggccttcctgcctgccttccagaggggccgggccctggcccacctgcggaggacccaggccgagaagctgcaggagctgctgcggcggcgggagaggtctgcccagcctgcccccaccagcgctgctgacccccccaagagcttccctgctgctgctgtgctgcccactggagctgcccggggccccccagctgtgcccaggagcctgccccccctggacagcaggcctgtgccccccctgaagggcagccctggctgccccctgggccctgcccccctgctgagcccccggcccagccagcctgagcccccccacaggtag

SEQ ID NO: 175690 - DNA, 2628 bp, Artificial Sequence
  Description of Artificial Sequence: Synthetic coding sequence
atgcatgatgcctttgagcctgtgcccatcctggagaagctgcccctgcagattgactgcctggccgcctgggaggagtggctgctggtgggcaccaagcagggccacctgctgctgtaccgcatcaggaaggatgtgggctgcaacagatttgaggtgaccctggagaagagcaacaagaacttcagcaagaagatccagcagatccacgtggtgtcccagttcaagatcctggtgtccctgctggagaacaacatctacgtgcatgacctgctgaccttccagcagatcaccaccgtgtccaaggccaagggggccagcctcttcacctgtgacctgcagcacacagagaccggggaggaggtgctgaggatgtgtgtggccgtgaagaagaagctgcagctgtacttctggaaggaccgggagttccacgagctgcagggcgacttctctgtgcctgatgtgcccaagtccatggcctggtgtgaaaattccatctgtgtgggcttcaagagggactactacctgatccgggtggatggcaagggcagcatcaaggagctgttccccaccgggaagcagctggagcccctggtggcccccctggctgatggcaaggtggccgtgggccaggatgacctgactgtggtgctgaatgaggagggcatctgcacccagaagtgtgccctgaactggacagacatccctgtggccatggagcaccagcccccctacatcatcgctgtgctgcccaggtatgtggagatccgcacctttgagccccggctgctggtgcagagcattgagctgcagaggccccgcttcatcaccagcggcggcagcaacatcatctacgtggccagcaaccactttgtgtggaggctcatccctgtgcccatggccacccagatccagcagctgctgcaggacaagcagtttgagctggccctgcagctggccgagatgaaggatgacagcgacagcgagaagcagcagcagatccaccacatcaagaacctgtatgccttcaacctcttctgccagaagagatttgatgagagcatgcaggtgtttgccaagctgggcacagaccccacccacgtgatgggcctgtacccagacctgctgcccacagactacaggaagcagctgcagtaccccaaccccctgcctgtgctgagcggggctgagctggagaaggcccacctggccctgattgactacctgacccagaagaggagccagctggtgaagaagctgaatgacagcgaccaccagagcagcaccagccccctgatggagggcacccccaccatcaagagcaagaagaagctgctgcagatcatcgacaccaccctgctgaagtgctacctgcacaccaacgtggccctggtggcccccctgctgcggctggagaacaaccactgccacatcgaggagagcgagcacgtgctgaagaaggcccacaagtacagcgagctgatcatcctgtatgagaagaagggcctgcacgagaaggccctgcaggtgctggtggaccagagcaagaaggccaacagccccctgaagggccacgagaggacagtgcagtacctgcagcacctgggcacagagaacctgcacctgatcttctcctacagcgtgtgggtgctgcgggacttcccagaagatggcctgaagatcttcacagaggacctgcctgaggtggagagcctgccccgggacagagtgctgggcttcctgattgagaacttcaagggcctggccatcccctacctggagcacatcatccacgtgtgggaggagaccggcagccgcttccacaactgcctgatccagctgtactgtgagaaggtgcagggcctgatgaaggagtacctgctgtccttccctgctgggaagacccctgtgcctgctggggaggaggagggggagctgggggagtaccggcagaagctgctgatgttcctggagatcagcagctactatgaccccggccgcctcatctgtgacttcccctttgatggcctgctggaggagcgggccctgctgctgggccgcatgggcaagcatgagcaggccctcttcatctacgtgcacatcctgaaggacaccaggatggccgaggagtactgccacaagcactatgacaggaacaaggatggcaacaaggatgtgtacctgagcctgctgaggatgtacctgagccccccatccatccactgcctgggccccatcaagctggagctgctggagcccaaggccaacctgcaggccgccctgcaggtgctggagctgcaccacagcaagctggacaccaccaaggccctgaacctgctgcctgccaacacccagatcaatgacatccgcatcttcctggagaaggtgctggaggagaatgcccagaagaagcgcttcaaccaggtgctgaagaacctgctgcacgccgagttcctgcgggtgcaggaggagcgcatcctgcaccagcaggtgaagtgcatcatcacagaggagaaggtgtgcatggtgtgcaagaagaagattggcaacagcgcctttgcccgctaccccaacggggtggtggtgcactacttctgcagcaaggaggtgaacccagctgacacctag

SEQ ID NO: 175691 - DNA, 2661 bp, Artificial Sequence
  Description of Artificial Sequence: Synthetic coding sequence
atgcatgatgcctttgagcctgtgcccatcctggagaagctgcccctgcagattgactgcctggccgcctgggaggagtggctgctggtgggcaccaagcagggccacctgctgctgtaccgcatcaggaaggatgtggtgcctgcagatgtggccagccctgagagcggcagctgcaacagatttgaggtgaccctggagaagagcaacaagaacttcagcaagaagatccagcagatccacgtggtgtcccagttcaagatcctggtgtccctgctggagaacaacatctacgtgcatgacctgctgaccttccagcagatcaccaccgtgtccaaggccaagggggccagcctcttcacctgtgacctgcagcacacagaaacaggagaggaggtgctgaggatgtgtgtggccgtgaagaagaagctgcagctgtacttctggaaggaccgggagttccacgagctgcagggcgacttctctgtgcctgatgtgcccaagtccatggcctggtgtgagaacagcatctgtgtgggcttcaagagggactactacctgatccgggtggatggcaagggcagcatcaaggagctgttccccaccgggaagcagctggagcccctggtggcccccctggctgatggcaaggtggccgtgggccaggatgacctgactgtggtgctgaatgaggagggcatctgcacccagaagtgtgccctgaactggacagacatccctgtggccatggagcaccagcccccctacatcatcgctgtgctgccccgctacgtggagatccgcacctttgagccccggctgctggtgcagagcattgagctgcagaggccccgcttcatcaccagcggcggcagcaacatcatctacgtggccagcaaccactttgtgtggaggctcatccctgtgcccatggccacccagatccagcagctgctgcaggacaagcagtttgagctggccctgcagctggccgagatgaaggatgacagcgacagcgagaagcagcagcagatccaccacatcaagaacctgtatgccttcaacctcttctgccagaagagatttgatgagagcatgcaggtgtttgccaagctgggcacagaccccacccacgtgatgggcctgtacccagacctgctgcccacagactacaggaagcagctgcagtaccccaaccccctgcctgtgctgtctggagctgagctggagaaggcccacctggccctgattgactacctgacccagaagaggagccagctggtgaagaagctgaatgacagcgaccaccagagcagcaccagccccctgatggagggcacccccaccatcaagagcaagaagaagctgctgcagatcatcgacaccaccctgctgaagtgctacctgcacaccaacgtggccctggtggcccccctgctgcggctggagaacaaccactgccacatcgaggagagcgagcacgtgctgaagaaggcccacaagtacagcgagctgatcatcctgtatgagaagaagggcctgcacgagaaggccctgcaggtgctggtggaccagagcaagaaggccaacagccccctgaagggccacgagaggacagtgcagtacctgcagcacctgggcacagagaacctgcacctgatcttctcctacagcgtgtgggtgctgcgggacttcccagaagatggcctgaagatcttcacagaggacctgcctgaggtggagagcctgccccgggacagagtgctgggcttcctgattgagaacttcaagggcctggccatcccctacctggagcacatcatccacgtgtgggaggagaccggcagccgcttccacaactgcctgatccagctgtactgtgagaaggtgcagggcctgatgaaggagtacctgctgtccttccctgctgggaagacccctgtgcctgctggggaggaggagggggagctgggggagtaccggcagaagctgctgatgttcctggagatcagcagctactatgaccccggccgcctcatctgtgacttcccctttgatggcctgctggaggagcgggccctgctgctgggccgcatgggcaagcatgagcaggccctcttcatctacgtgcacatcctgaaggacaccaggatggccgaggagtactgccacaagcactatgacaggaacaaggatggcaacaaggatgtgtacctgagcctgctgaggatgtacctgagcccccccagcatccactgcctgggccccatcaagctggagctgctggagcccaaggccaacctgcaggccgccctgcaggtgctggagctgcaccacagcaagctggacaccaccaaggccctgaacctgctgcctgccaacacccagatcaatgacatccgcatcttcctggagaaggtgctggaggagaatgcccagaagaagcgcttcaaccaggtgctgaagaacctgctgcatgctgagttcctgcgggtgcaggaggagcgcatcctgcaccagcaggtgaagtgcatcatcacagaggagaaggtgtgcatggtgtgcaagaagaagattggcaacagcgcctttgcccgctacccaaatggagtggtggtgcactacttctgcagcaaggaggtgaacccagctgacacctag

SEQ ID NO: 175692 - DNA, 1314 bp, Artificial Sequence
  Description of Artificial Sequence: Synthetic coding sequence
atgaccaccagcaccctgcagaaggccatcgacctggtgaccaaggccacagaggaggacaaggccaagaactatgaggaggccctgcggctgtaccagcacgctgtggagtacttcctgcacgccatcaagtatgaggcccacagcgacaaggccaaggagagcatccgggccaagtgtgtgcagtacctggacagagctgagaagctgaaggactacctgcggagcaaggagaagcacggcaagaagcctgtgaaggagaaccagagcgagggcaaaggaagtgacagcgacagcgagggggacaaccctgagaagaagaagctgcaggagcagctgatgggcgctgtggtgatggagaagcccaacatccgctggaatgatgtggccggcctggagggcgccaaggaggccctgaaggaggccgtcatcctgcccatcaagttcccccacctgttcaccgggaagaggaccccctggaggggcatcctgctgtttggccccccaggcaccgggaagagctacctggccaaggctgtggccacagaggccaacaacagcaccttcttctctgtgagcagcagtgacctgatgagcaagtggctgggggagagcgagaagctggtgaagaacctgtttgagctggcccggcagcacaagcccagcatcatcttcattgatgaggtggacagcctgtgtggcagcagaaatgaaaatgaaagtgaagctgcccggcgcatcaagacagagttcctggtgcagatgcagggcgtgggcaacaacaatgatggcaccctggtgctgggcgccaccaacatcccctgggtgctggacagcgccatcagaagaagatttgagaagaggatctacatccccctgcctgaggaggccgcccgggcccagatgttccggctgcacctgggcagcaccccccacaacctgacagatgccaacatccacgagctggccaggaagacagagggctacagcggggctgacatcagcatcatcgtgcgggacagcctgatgcagcctgtgaggaaggtgcagagcgccacccacttcaagaaggtgtgtggccccagcaggaccaaccccagcatgatgattgatgacctgctgaccccctgcagccctggggaccccggggccatggagatgacctggatggatgtgcctggggacaagctgctggagcctgtggtgtgcatgtctgacatgctgcggagcctggccaccacccggcccaccgtgaatgctgatgacctgctgaaggtgaagaagttctctgaagattttggccaggagagctag

SEQ ID NO: 175693 - DNA, 1335 bp, Artificial Sequence
  Description of Artificial Sequence: Synthetic coding sequence
atgagcagcaccagccccaacctgcagaaggccatcgacctggccagcaaggccgcccaggaggacaaggccggcaactatgaggaggccctgcagctgtaccagcacgctgtgcagtacttcctgcacgtggtgaagtatgaggcccagggcgacaaggccaagcagagcatccgggccaagtgcacagagtacctggacagagctgagaagctgaaggagtacctgaagaacaaggagaagaaggcccagaagcctgtgaaggagggccagcccagccctgcagatgagaagggaaatgacagtgatggagagggggagagtgatgatcctgagaagaagaagctgcagaaccagctgcagggcgccatcgtcatcgagcggcccaacgtgaagtggagcgatgtggccggcctggagggcgccaaggaggccctgaaggaggccgtcatcctgcccatcaagttcccccacctgttcaccgggaagaggaccccctggaggggcatcctgctgtttggacctcctggcaccgggaagagctacctggccaaggctgtggccacagaggccaacaacagcaccttcttcagcatcagcagcagtgacctggtgtccaagtggctgggggagagcgagaagctggtgaagaacctcttccagctggcccgggagaacaagcccagcatcatcttcattgatgaaattgacagcctgtgtggcagccgctcagaaaatgaaagtgaggccgcccggcgcatcaagacagagttcctggtgcagatgcagggcgtgggcgtggacaatgatggcatcctggtgctgggcgccaccaacatcccctgggtgctggacagcgccatcagaagaagatttgagaagaggatctacatccccctgcctgagccccacgcccgggccgccatgttcaagctgcacctgggcaccacccagaacagcctgacagaggccgacttccgggagctgggcaggaagacagatggctacagcggggctgacatcagcatcatcgtgagagatgccctgatgcagcctgtgaggaaggtgcagagcgccacccacttcaagaaggtgcggggccccagcagagctgaccccaaccacctggtggatgacctgctgaccccctgcagccctggggaccccggggccatcgagatgacctggatggatgtgcctggggacaagctgctggagcctgtggtgtccatgtctgacatgctgcggagcctgagcaacaccaagcccaccgtgaatgaacatgacctgctgaagctgaagaagttcacagaggactttggccaggagggctag

SEQ ID NO: 175694 - DNA, 630 bp, Artificial Sequence
  Description of Artificial Sequence: Synthetic coding sequence
atggccgaggccgaggagcaggagaccggcagcctggaggagagcacagatgaaagtgaggaggaggagagcgaggaggagcccaagctgaagtatgaaaggctgagcaatggagtgacagagatcctgcagaaggatgctgccagctgcatgacagtgcatgacaagttcctggccctgggcacccactacggcaaggtgtacctgctggatgtgcagggcaacatcacccagaagtttgatgtgtcccctgtgaagatcaaccagatcagcctggatgaaagtggagagcacatgggcgtgtgcagtgaagatggcaaggtgcaggtgtttggcctgtacagcggggaggagttccacgagacctttgactgccccatcaagatcatcgctgtgcacccccactttgtgcgcagcagctgcaagcagtttgtgactggaggcaagaagctgctgctgtttgagaggtcctggatgaaccgctggaagtctgctgtgctgcacgagggggagggcaacatccgctctgtgaagtggaggggccacctgattgcctgggccaacaacatgagcaagaagccagaggcctggagggtggccaagaagatgaagagctacctgaacaactag

SEQ ID NO: 175695 - DNA, 2565 bp, Artificial Sequence
  Description of Artificial Sequence: Synthetic coding sequence
atggccgaggccgaggagcaggagaccggcagcctggaggagagcacagatgaaagtgaggaggaggagagcgaggaggagcccaagctgaagtatgaaaggctgagcaatggagtgacagagatcctgcagaaggatgctgccagctgcatgacagtgcatgacaagttcctggccctgggcacccactacggcaaggtgtacctgctggatgtgcagggcaacatcacccagaagtttgatgtgtcccctgtgaagatcaaccagatcagcctggatgaaagtggagagcacatgggcgtgtgcagtgaagatggcaaggtgcaggtgtttggcctgtacagcggggaggagttccacgagacctttgactgccccatcaagatcatcgctgtgcacccccactttgtgcgcagcagctgcaagcagtttgtgactggaggcaagaagctgctgctgtttgagaggtcctggatgaaccgctggaagtctgctgtgctgcacgagggggagggcaacatccgctctgtgaagtggaggggccacctgattgcctgggccaacaacatgggcgtgaagatctttgacatcatcagcaagcagaggatcaccaacgtgcccagagatgacatcagcctgcggccagacatgtacccctgcagcctgtgctggaaggacaacgtgaccctcatcatcggctggggcacctctgtgaaggtgtgcagcgtgaaggagagacatgccagcgagatgagggacctgcccagccgctacgtggagatcgtgtcccagtttgaaacagagttctacatcagcggcctggcccccctgtgtgaccagctggtggtgctgtcctatgtgaaggagatcagcgagaagacagagcgggagtactgtgcccggccccggctggacatcatccagcccctgtctgagacctgtgaggagatcagcagtgatgccctgactgtgcggggcttccaggagaatgaatgtcgggactaccacctggagtacagcgagggggagagcctcttctacatcgtgagccccagagatgtggtggtggccaaggagcgggaccaggatgaccacatcgactggctgctggagaagaagaagtatgaggaggccctgatggctgctgagatcagccagaagaacatcaagaggcacaagatcctggacatcggcctggcctacatcaaccacctggtggagcggggggactatgacattgctgccaggaagtgccagaagatcctgggcaagaatgctgccctgtgggagtatgaggtgtacaagttcaaggagatcggccagctgaaggccatcagcccctacctgcccaggggggaccctgtgctgaagcccctcatctatgagatgatcctgcacgagttcctggagagtgactatgagggctttgccaccctcatccgggagtggccaggggacctgtacaacaacagcgtgattgtgcaggccgtgcgggaccacctgaagaaggacagccagaacaagaccctgctgaagaccctggccgagctgtacacctatgacaagaactatggaaatgccctggagatctacctgaccctgcggcacaaggatgtgttccagctgatccacaagcacaacctcttcagcagcatcaaggacaagatcgtgctgctgatggactttgacagcgagaaggctgtggacatgctgctggacaatgaagacaagatcagcatcaagaaggtggtggaggagctggaggacaggcctgagctgcagcacgtgtacctgcacaagctgttcaagagggaccaccacaagggccagcgctaccacgagaagcagatcagcctgtatgcagaatatgaccggcccaacctgctgcccttcctgcgggacagcacccactgccccctggagaaggccctggagatctgccagcagaggaactttgtggaggagaccgtgtacctgctgagcaggatgggcaacagccgcagcgccctgaagatgatcatggaggagctgcatgatgtggacaaggccatcgagtttgccaaggagcaggatgatggagagctgtgggaggacctgatcctgtacagcattgacaagccacccttcatcaccggcctgctgaacaacatcggcacccacgtggaccccatcctgctgatccaccgcatcaaggagggcatggagatccccaacctgcgggacagcctggtgaagatcctgcaggactacaacctgcagatcctgctgcgggagggctgcaagaagatcctggtggccgacagcctgagcctgctgaagaagatgcacaggacccagatgaagggcgtgctggtggatgaggagaacatctgtgagagctgcctgagccccatcctgcccagtgatgctgccaagcccttctctgtggtggtgttccactgccgccacatgttccacaaggaatgtctgcccatgcccagcatgaacagcgctgcccagttctgcaacatctgcagcgccaagaacagaggccctggcagcgccatcctggagatgaagaagtag

SEQ ID NO: 175696 - DNA, 2490 bp, Artificial Sequence
  Description of Artificial Sequence: Synthetic coding sequence
atggccgaggccgaggagcaggagaccggcagcctggaggagagcacagatgaaagtgaggaggaggagagcgaggaggagcccaagctgaagtatgaaaggctgagcaatggagtgacagagatcctgcagaaggatgctgccagctgcatgacagtgcatgacaagttcctggccctgggcacccactacggcaaggtgtacctgctggatgtgcagggcaacatcacccagaagtttgatgtggtgcaggtgtttggcctgtacagcggggaggagttccacgagacctttgactgccccatcaagatcatcgctgtgcacccccactttgtgcgcagcagctgcaagcagtttgtgactggaggcaagaagctgctgctgtttgagaggtcctggatgaaccgctggaagtctgctgtgctgcatgaaggagagggcaacatccgctctgtgaagtggaggggccacctgattgcctgggccaacaacatgggcgtgaagatctttgacatcatcagcaagcagaggatcaccaacgtgcccagagatgacatcagcctgcggccagacatgtacccctgcagcctgtgctggaaggacaacgtgaccctcatcatcggctggggcacctctgtgaaggtgtgcagcgtgaaggagagacatgccagcgagatgagggacctgcccagccgctacgtggagatcgtgtcccagtttgaaacagagttctacatcagcggcctggcccccctgtgtgaccagctggtggtgctgtcctatgtgaaggagatcagcgagaagacagagcgggagtactgtgcccggccccggctggacatcatccagcccctgtctgagacctgtgaggagatcagcagtgatgccctgactgtgcggggcttccaggagaatgaatgtcgggactaccacctggagtacagcgagggggagagcctcttctacatcgtgagccccagagatgtggtggtggccaaggagcgggaccaggatgaccacatcgactggctgctggagaagaagaagtatgaggaggccctgatggctgctgagatcagccagaagaacatcaagaggcacaagatcctggacatcggcctggcctacatcaaccacctggtggagcggggggactatgacattgctgccaggaagtgccagaagatcctgggcaagaatgctgccctgtgggagtatgaggtgtacaagttcaaggagatcggccagctgaaggccatcagcccctacctgcccaggggggaccctgtgctgaagcccctcatctatgagatgatcctgcacgagttcctggagagtgactatgagggctttgccaccctcatccgggagtggccaggggacctgtacaacaacagcgtcatcgtgcaggccgtgcgggaccacctgaagaaggacagccagaacaagaccctgctgaagaccctggccgagctgtacacctatgacaagaactatggaaatgccctggagatctacctgaccctgcggcacaaggatgtgttccagctgatccacaagcacaacctcttcagcagcatcaaggacaagatcgtgctgctgatggactttgattctgagaaggctgtggacatgctgctggacaatgaagacaagatcagcatcaagaaggtggtggaggagctggaggacaggcctgagctgcagcacgtgtacctgcacaagctgttcaagagggaccaccacaagggccagcgctaccacgagaagcagatcagcctgtatgcagaatatgaccggcccaacctgctgcccttcctgcgggacagcacccactgccccctggagaaggccctggagatctgccagcagaggaactttgtggaggagaccgtgtacctgctgagcaggatgggcaacagccgcagcgccctgaagatgatcatggaggagctgcatgatgtggacaaggccattgaatttgccaaggagcaggatgatggagagctgtgggaggacctgatcctgtacagcattgacaagccacccttcatcaccggcctgctgaacaacatcggcacccacgtggaccccatcctgctgatccaccgcatcaaggagggcatggagatccccaacctgcgggacagcctggtgaagatcctgcaggactacaacctgcagatcctgctgcgggagggctgcaagaagatcctggtggccgacagcctgagcctgctgaagaagatgcacaggacccagatgaagggcgtgctggtggatgaggagaacatctgtgagagctgcctgagccccatcctgcccagtgatgctgccaagcccttctctgtggtggtgttccactgccgccacatgttccacaaggagtgcctgcccatgcccagcatgaacagcgctgcccagttctgcaacatctgcagcgccaagaacagaggccctggcagcgccatcctggagatgaagaagtag

SEQ ID NO: 175697 - DNA, 1617 bp, Artificial Sequence
  Description of Artificial Sequence: Synthetic coding sequence
atggtgtacacccagagcgagatcctgcagaaggaggtgtacctgtttgaaagaattgacagccagaaccgggagatcatgaagcacctgaaggccatctgcttcctgcggcccaccaaggaaaatgtggactacatcatccaggagctgcggcggcccaagtacaccatctacttcatctacttcagcaatgtcatcagcaagagtgatgtgaagagcctggccgaggctgatgagcaggaggtggtggccgaggtgcagcaggtgatcaccaaggagtatgagctgtttgagttccggaggacagaggtgccccccctgctgctgatcctggacagatgtgatgatgccatcacccccctgctgaaccagtggacctaccaggccatggtgcatgagctgctgggcatcaacaacaacagaattgacctgagccgggtgcccggcatcagcaaggacctgcgggaggtggtgctgtctgcagaaaatgatgagttctacgccaacaacatgtacctgaactttgctgagatcggcagcaacatcaagaacctgatggaggacttccagaagaagaagcccaaggagcagcagaagctggagagcattgctgacatgaaggcctttgtggagaactacccccagttcaagaagatgagcggcaccgtgtccaagcacgtgacagtggtgggggagctgagccggctggtgtctgagaggaacctgctggaggtgtctgaggtggagcaggagctggcctgccagaatgaccacagcagcgccctgcagaacatcaagaggctgctgcagaaccccaaggtgacagaatttgatgctgcccggctggtgatgctgtatgccctgcactatgaaagacacagcagcaacagcctgcccggcctgatgatggacctgaggaacaagggcgtgtctgagaagtacaggaagctggtgtctgctgtggtggagtatggaggcaagagggtgcggggcagtgacctcttcagccccaaggatgctgtggccatcaccaagcagttcctgaagggcctgaagggcgtggagaatgtgtacacccagcaccagcccttcctgcacgagaccctggaccacctgatcaagggccgcctgaaggaaaatctctacccctacctgggccccagcaccctgcgggaccggccccaggacatcatcgtgtttgtgattggaggagccacctatgaggaggccctgactgtgtacaacctgaacagaaccaccccaggagtgagaattgtgctgggcggcaccaccgtgcacaacaccaagagagatggagtgtccctgtgcagccctgcctggttccgcaccccaggcctgaagaggagcacccggctgagcctgcccaagtgctgggactacagcttcccccggggcagcagcggcttctggacagcccagcccaagcagggcgagctgagcagccacatcaaggtgtctgagcagaagatgaagcgctggctgggggagggccacagcttcctgagctgcccccactaccgcttcagcctgctgaacaagggcgtgggggagcagctgtgggtgctgtgctggctgctggagctgatcagcaggtag

SEQ ID NO: 175698 - DNA, 1713 bp, Artificial Sequence
  Description of Artificial Sequence: Synthetic coding sequence
atgaatgtggtgtttgctgtgaagcagtacatcagcaagatgattgaggacagcggccctggcatgaaggtgctgctgatggacaaggagaccaccggcatcgtgtccatggtgtacacccagagcgagatcctgcagaaggaggtgtacctgtttgaaagaattgacagccagaaccgggagatcatgaagcacctgaaggccatctgcttcctgcggcccaccaaggaaaatgtggactacatcatccaggagctgcggcggcccaagtacaccatctacttcatctacttcagcaatgtcatcagcaagagtgatgtgaagagcctggccgaggctgatgagcaggaggtggtggccgaggtgcaggagttctacggggactacatcgctgtgaacccccacctgttcagcctgaacatcctgggctgctgccagggcaggaactgggaccctgcccagctgagcaggaccacccagggcctgacagccctgctgctgagcctgaagaagtgccccatgatccgctaccagctgagcagcgaggccgccaagaggctggctgaatgtgtgaagcaggtgatcaccaaggagtatgagctgtttgagttcagaagaacagaggtgccccccctgctgctgatcctggacagatgtgatgatgccatcacccccctgctgaaccagtggacctaccaggccatggtgcatgagctgctgggcatcaacaacaacagaattgacctgagccgggtgcccggcatcagcaaggacctgcgggaggtggtgctgtctgcagaaaatgatgagttctacgccaacaacatgtacctgaactttgctgagatcggcagcaacatcaagaacctgatggaggacttccagaagaagaagcccaaggagcagcagaagctggagagcattgctgacatgaaggcctttgtggagaactacccccagttcaagaagatgtctggaacagtgtccaagcacgtgacagtggtgggggagctgagccggctggtgtctgaaagaaacctgctggaggtgtctgaggtggagcaggagctggcctgccagaatgaccacagcagcgccctgcagaacatcaagaggctgctgcagaaccccaaggtgacagaatttgatgctgcccggctggtgatgctgtatgccctgcactatgagcggcacagcagcaacagcctgcccggcctgatgatggacctgagaaataaaggagtgtctgagaagtacaggaagctggtgtctgctgtggtggagtatggaggcaagagggtgcggggcagtgacctcttcagccccaaggatgctgtggccatcaccaagcagttcctgaagggcctgaagggcgtggagaatgtgtacacccagcaccagcccttcctgcacgagaccctggaccacctgatcaagggccgcctgaaggagaacctgtacccctacctgggccccagcaccctgcgggaccggccccaggacatcatcgtgtttgtgattggaggagccacctatgaggaggccctgactgtgtacaacctgaacagaaccaccccaggagtgcgcatcgtgctgggcggcaccaccgtgcacaacaccaagagcttcctggaggaggtgctggccagcggcctgcacagccgcagcaaggagagcagccaggtgaccagccgcagcgccagcagaagatag

SEQ ID NO: 175699 - DNA, 951 bp, Artificial Sequence
  Description of Artificial Sequence: Synthetic coding sequence
atgaatgtggtgtttgctgtgaagcagtacatcagcaagatgattgaggacagcggccctggcatgaaggtgctgctgatggacaaggagaccaccggcatcgtgtccatggtgtacacccagagcgagatcctgcagaaggaggtgtacctgtttgaaagaattgacagccagaaccgggagatcatgaagcacctgaaggccatctgcttcctgcggcccaccaaggaaaatgtggactacatcatccaggagctgcggcggcccaagtacaccatctacttcatctacttcagcaatgtcatcagcaagagtgatgtgaagagcctggccgaggctgatgagcaggaggtggtggccgaggtgcagcaggtgatcaccaaggagtatgagctgtttgagttccggaggacagaggtgccccccctgctgctgatcctggacagatgtgatgatgccatcacccccctgctgaaccagtggacctaccaggccatggtgcatgagctgctgggcatcaacaacaacagaattgacctgagccgggtgcccggcatcagcaaggacctgcgggaggtggtgctgtctgcagaaaatgatgagttctacgccaacaacatgtacctgaactttgctgagatcggcagcaacatcaagaacctgatggaggacttccagaagaagaagcccaaggagcagcagaagctggagagcattgctgacatgaaggcctttgtggagaactacccccagttcaagaagatgagcggcaccgtgtccaagcacgtgacagtggtgggggagctgagccggctggtgtctgagaggaacctgctggaggtgtctgaggtggagcaggagctggcctgccagaatgaccacagcagcgccctgcagaacatcaagaggctgctgcagaaccccaaggtgacagaatttgatgctgcctag

SEQ ID NO: 175700 - DNA, 1305 bp, Artificial Sequence
  Description of Artificial Sequence: Synthetic coding sequence
atgaatgtggtgtttgctgtgaagcagtacatcagcaagatgattgaggacagcggccctggcatgaaggtgctgctgatggacaaggagaccaccggcatcgtgtccatggtgtacacccagagcgagatcctgcagaaggaggtgtacctgtttgaaagaattgacagccagaaccgggagatcatgaagcacctgaaggccatctgcttcctgcggcccaccaaggaaaatgtggactacatcatccaggagctgcggcggcccaagtacaccatctacttcatctacttcagcaatgtcatcagcaagagtgatgtgaagagcctggccgaggctgatgagcaggaggtggtggccgaggtgcagcaggtgatcaccaaggagtatgagctgtttgagttccggaggacagaggtgccccccctgctgctgatcctggacagatgtgatgatgccatcacccccctgctgaaccagtggacctaccaggccatggtgcatgagctgctgggcatcaacaacaacagaattgacctgagccgggtgcccggcatcagcaaggacctgcgggaggtggtgctgtctgcagaaaatgatgagttctacgccaacaacatgtacctgaactttgctgagatcggcagcaacatcaagaacctgatggaggacttccagaagaagaagcccaaggagcagcagaagctggagagcattgctgacatgaaggcctttgtggagaactacccccagttcaagaagatgagcggcaccgtgtccaagcacgtgacagtggtgggggagctgagccggctggtgtctgagaggaacctgctggaggtgtctgaggtggagcaggagctggcctgccagaatgaccacagcagcgccctgcagaacatcaagaggctgctgcagaaccccaaggtgacagaatttgatgctgcccggctggtgatgctgtatgccctgcactatgaaagacacagcagcaacagcctgcccggcctgatgatggacctgaggaacaagggcgtgtctgagaagtacaggaagctggtgtctgctgtggtggagtatggaggcaagagggtgcggggcagtgacctcttcagccccaaggatgctgtggccatcaccaagcagttcctgaagggcctgaagggcgtggagaatgtgtacacccagcaccagcccttcctgcacgagaccctggaccacctgatcaagggccgcctgaaggaaaatctctacccctacctgggccccagcaccctgcgggaccgcatcgccagctgcctgtag

SEQ ID NO: 175701 - DNA, 1338 bp, Artificial Sequence
  Description of Artificial Sequence: Synthetic coding sequence
atgaatgtggtgtttgctgtgaacccccacctgttcagcctgaacatcctgggctgctgccagggcaggaactgggaccctgcccagctgagcaggaccacccagggcctgacagccctgctgctgagcctgaagaagtgccccatgatccgctaccagctgagcagcgaggccgccaagaggctggccgagtgtgtgaagcaggtgatcaccaaggagtatgagctgtttgagttccggaggacagaggtgccccccctgctgctgatcctggacagatgtgatgatgccatcacccccctgctgaaccagtggacctaccaggccatggtgcatgagctgctgggcatcaacaacaacagaattgacctgagccgggtgcccggcatcagcaaggacctgcgggaggtggtgctgtctgcagaaaatgatgagttctacgccaacaacatgtacctgaactttgctgagatcggcagcaacatcaagaacctgatggaggacttccagaagaagaagcccaaggagcagcagaagctggagagcattgctgacatgaaggcctttgtggagaactacccccagttcaagaagatgagcggcaccgtgtccaagcacgtgacagtggtgggggagctgagccggctggtgtctgagaggaacctgctggaggtgtctgaggtggagcaggagctggcctgccagaatgaccacagcagcgccctgcagaacatcaagaggctgctgcagaaccccaaggtgacagaatttgatgctgcccggctggtgatgctgtatgccctgcactatgaaagacacagcagcaacagcctgcccggcctgatgatggacctgaggaacaagggcgtgtctgagaagtacaggaagctggtgtctgctgtggtggagtatggaggcaagagggtgcggggcagtgacctcttcagccccaaggatgctgtggccatcaccaagcagttcctgaagggcctgaagggcgtggagaatgtgtacacccagcaccagcccttcctgcacgagaccctggaccacctgatcaagggccgcctgaaggaaaatctctacccctacctgggccccagcaccctgcgggaccggccccaggacatcatcgtgtttgtgattggaggagccacctatgaggaggccctgactgtgtacaacctgaacagaaccaccccaggagtgagaattgtgctgggcggcaccaccgtgcacaacaccaagagcttcctggaggaggtgctggccagcggcctgcacagccgcagcaaggagagcagccaggtgaccagccgcagcgccagcagaagatag

SEQ ID NO: 175702 - DNA, 1128 bp, Artificial Sequence
  Description of Artificial Sequence: Synthetic coding sequence
atgagcctggccggcggccgggcccccaggaagacagctggcaaccggctgagcggcctgctggaggccgaggaggaggatgagttctaccagaccacctacggcggcttcacagaggagagcggagatgatgagtaccagggcgaccagagcgacacagaagatgaggtggacagcgactttgatattgatgaaggagatgagcccagcagtgatggagaggccgaggagcccaggaggaagagaagagtggtgaccaaggcctacaaggagcccctgaagagcctgcggcccaggaaggtgaacaccccagctggcagcagccagaaggcccgggaggagaaggccctgctgcccctggagctgcaggatgatggcagtgacagcaggaagtccatgaggcagagcacagctgagcacacccggcagaccttcctgcgggtgcaggagcggcagggccagagcagaagaaggaagggcccccactgtgagcggcccctgacccaggaggagctgctgcgggaggccaagatcacagaggagctgaacctgcggagcctggagacctatgaaaggctggaggccgacaagaagaagcaggtgcacaagaagaggaagtgccccggccccatcatcacctaccacagcgtgacagtgcccctggtgggggagcccggccccaaggaggagaatgtggacatcgagggcagcctgtgcttcagcctgagctttgtgctgcggctggaccctgcccccagcgtgtctgccctgacccctcatgctggcactggacctgtgaaccccccagcccgctgcagcaggaccttcatcaccttcagtgatgatgccacctttgaggagtggttcccccagggccggccccccaaggtgcctgtgcgggaggtgtgccctgtgacccacaggcctgccctgtacagagatcctgtgacagacatcccctatgccacagcccgggccttcaagatcatccgggaggcctacaagaagtacatcacagcccacggcctgcccccaacagccagcgccctgggccctggccccccacctcctgagcccctgcccggcagcggcccccgggccctgcggcagaagatcgtcatcaagtag

SEQ ID NO: 175703 - DNA, 1095 bp, Artificial Sequence
  Description of Artificial Sequence: Synthetic coding sequence
atgagcctggccggcggccgggcccccaggaagacagctggcaaccggctgagcggcctgctggaggccgaggaggaggatgagttctaccagaccacctacggcggcttcacagaggagagcggagatgatgagtaccagggcgaccagagcgacacagaagatgaggtggacagcgactttgatattgatgaaggagatgagcccagcagtgatggagaggccgaggagcccaggaggaagagaagagtggtgaccaaggcctacaaggagcccctgaagagcctgcggcccaggaaggtgaacaccccagctggcagcagccagaaggcccgggaggagaaggccctgctgcccctggagctgcaggatgatggcagtgacagcaggaagtccatgaggcagagcacagctgagcacacccggcagaccttcctgcgggtgcaggagcggcagggccagagcagaagaaggaagggcccccactgtgagcggcccctgacccaggaggagctgctgcgggaggccaagatcacagaggagctgaacctgcggagcctggagacctatgaaaggctggaggccgacaagaagaagcaggtgcacaagaagaggaagtgccccggccccatcatcacctaccacagcgtgacagtgcccctggtgggggagcccggccccaaggaggagaatgtggacatcgagggcctggaccctgcccccagcgtgtctgccctgacccctcatgctggcaccggccctgtgaaccccccagcccgctgcagcaggaccttcatcaccttcagtgatgatgccacctttgaggagtggttcccccagggccggccccccaaggtgcctgtgcgggaggtgtgccctgtgacccacaggcctgccctgtacagagatcctgtgacagacatcccctatgccacagcccgggccttcaagatcatccgggaggcctacaagaagtacatcacagcccacggcctgcccccaacagccagcgccctgggccctggccccccacctcctgagcccctgcccggcagcggcccccgggccctgcggcagaagatcgtcatcaagtag

SEQ ID NO: 175704 - DNA, 1221 bp, Artificial Sequence
  Description of Artificial Sequence: Synthetic coding sequence
atggctgaaaatggcaagaactgtgaccagaggagagtggccatgaacaaggagcaccacaatggaaacttcacagaccccagctctgtgaatgagaagaagagaagagagcgggaggagcggcagaacatcgtgctgtggaggcagcccctcatcaccctgcagtacttcagcctggagatcctggtgatcctgaaggagtggaccagcaagctgtggcaccggcagagcatcgtggtgtccttcctgctgctgctggccgtgctgattgccacctactacgtggagggcgtgcaccagcagtatgtgcagagaattgagaagcagttcctgctgtatgcctactggattggcctgggcatcctgagctctgtgggcctgggcaccggcctgcacaccttcctgctgtacctgggcccccacatcgcctctgtgaccctggccgcctatgagtgcaacagcgtgaacttccctgagcccccctacccagaccagatcatctgcccagatgaggagggcacagagggcaccatcagcctgtggagcatcatcagcaaggtgagaattgaggcctgcatgtggggcatcggcacagccatcggggagctgcccccctacttcatggcccgggccgcccggctgtctggagctgagccagatgatgaggagtaccaggagtttgaggagatgctggagcacgccgagagcgcccaggactttgccagccgggccaagctggccgtgcagaagctggtgcagaaggtgggcttcttcggcatcctggcctgtgccagcatccccaaccccctgtttgacctggccggcatcacctgtggccacttcctggtgcccttctggaccttctttggagccaccctcatcggcaaggccatcatcaagatgcacatccagaagatctttgtgatcatcaccttcagcaagcacatcgtggagcagatggtggccttcatcggggctgtgcccggcatcggccccagcctgcagaagcccttccaggagtacctggaggcccagaggcagaagctgcaccacaagtctgagatgggcaccccccagggcgagaactggctgtcctggatgtttgagaagctggtggtggtgatggtgtgctacttcatcctgagcatcatcaacagcatggcccagagctatgccaagaggatccagcagaggctgaacagcgaggagaagaccaagtag

SEQ ID NO: 175705 - DNA, 930 bp, Artificial Sequence
  Description of Artificial Sequence: Synthetic coding sequence
atggacctgaagtatgtgcagagaattgagaagcagttcctgctgtatgcctactggattggcctgggcatcctgagctctgtgggcctgggcaccggcctgcacaccttcctgctgtacctgggcccccacatcgcctctgtgaccctggccgcctatgagtgcaacagcgtgaacttccctgagcccccctacccagaccagatcatctgcccagatgaggagggcacagagggcaccatcagcctgtggagcatcatcagcaaggtgcgcatcgaggcctgcatgtggggcattggaacagccatcggggagctgcccccctacttcatggcccgggccgcccggctgagcggggctgagccagatgatgaggagtaccaggagtttgaggagatgctggagcacgccgagagcgcccaggactttgccagccgggccaagctggccgtgcagaagctggtgcagaaggtgggcttcttcggcatcctggcctgtgccagcatccccaaccccctgtttgacctggccggcatcacctgtggccacttcctggtgcccttctggaccttcttcggggccaccctgattggcaaggccatcatcaagatgcacatccagaagatcttcgtcatcatcaccttcagcaagcacatcgtggagcagatggtggccttcatcggggctgtgcccggcatcggccccagcctgcagaagcccttccaggagtacctggaggcccagaggcagaagctgcaccacaagtctgagatgggcaccccccagggcgagaactggctgtcctggatgtttgagaagctggtggtggtgatggtgtgctacttcatcctgagcatcatcaacagcatggcccagagctatgccaagaggatccagcagaggctgaacagcgaggagaagaccaagtag

SEQ ID NO: 175706 - DNA, 819 bp, Artificial Sequence
  Description of Artificial Sequence: Synthetic coding sequence
atggacctgaagggcccccacatcgcctctgtgaccctggccgcctatgagtgcaacagcgtgaacttccctgagcccccctacccagaccagatcatctgcccagatgaggagggcacagagggcaccatcagcctgtggagcatcatcagcaaggtgagaattgaggcctgcatgtggggcatcggcacagccatcggggagctgcccccctacttcatggcccgggccgcccggctgtctggagctgagccagatgatgaggagtaccaggagtttgaggagatgctggagcacgccgagagcgcccaggactttgccagccgggccaagctggccgtgcagaagctggtgcagaaggtgggcttcttcggcatcctggcctgtgccagcatccccaaccccctgtttgacctggccggcatcacctgtggccacttcctggtgcccttctggaccttctttggagccaccctcatcggcaaggccatcatcaagatgcacatccagaagatctttgtgatcatcaccttcagcaagcacatcgtggagcagatggtggccttcatcggggctgtgcccggcatcggccccagcctgcagaagcccttccaggagtacctggaggcccagaggcagaagctgcaccacaagtctgagatgggcaccccccagggcgagaactggctgtcctggatgtttgagaagctggtggtggtgatggtgtgctacttcatcctgagcatcatcaacagcatggcccagagctatgccaagaggatccagcagaggctgaacagcgaggagaagaccaagtag

SEQ ID NO: 175707 - DNA, 645 bp, Artificial Sequence
  Description of Artificial Sequence: Synthetic coding sequence
atgtggggcatcggcacagccatcggggagctgcccccctacttcatggcccgggccgcccggctgtctggagctgagccagatgatgaggagtaccaggagtttgaggagatgctggagcacgccgagagcgcccaggactttgccagccgggccaagctggccgtgcagaagctggtgcagaaggtgggcttcttcggcatcctggcctgtgccagcatccccaaccccctgtttgacctggccggcatcacctgtggccacttcctggtgcccttctggaccttctttggagccaccctcatcggcaaggccatcatcaagatgcacatccagaagatctttgtgatcatcaccttcagcaagcacatcgtggagcagatggtggccttcatcggggctgtgcccggcatcggccccagcctgcagaagcccttccaggagtacctggaggcccagaggcagaagctgcaccacaagtctgagatgggcaccccccagggcgagaactggctgtcctggatgtttgagaagctggtggtggtgatggtgtgctacttcatcctgagcatcatcaacagcatggcccagagctatgccaagaggatccagcagaggctgaacagcgaggagaagaccaagtag

SEQ ID NO: 175708 - DNA, 1053 bp, Artificial Sequence
  Description of Artificial Sequence: Synthetic coding sequence
atggctgaaaatggcaagaactgtgaccagaggagagtggccatgaacaaggagcaccacaatggaaacttcacagaccccagctctgtgaatgagaagaagagaagagagcgggaggagcggcagaacatcgtgctgtggaggcagcccctcatcaccctgcagtacttcagcctggagatcctggtgatcctgaaggagtggaccagcaagctgtggcaccggcagagcatcgtggtgtccttcctgctgctgctggccgtgctgattgccacctactacgtggagggcgtgcaccagcagtatgtgcagagaattgagaagcagttcctgctgtatgcctactggattggcctgggcatcctgagctctgtgggcctgggcaccggcctgcacaccttcctgctgtacctgggcatcggcacagccatcggggagctgcccccctacttcatggcccgggccgcccggctgtctggagctgagccagatgatgaggagtaccaggagtttgaggagatgctggagcacgccgagagcgcccaggactttgccagccgggccaagctggccgtgcagaagctggtgcagaaggtgggcttcttcggcatcctggcctgtgccagcatccccaaccccctgtttgacctggccggcatcacctgtggccacttcctggtgcccttctggaccttctttggagccaccctcatcggcaaggccatcatcaagatgcacatccagaagatctttgtgatcatcaccttcagcaagcacatcgtggagcagatggtggccttcatcggggctgtgcccggcatcggccccagcctgcagaagcccttccaggagtacctggaggcccagaggcagaagctgcaccacaagtctgagatgggcaccccccagggcgagaactggctgtcctggatgtttgagaagctggtggtggtgatggtgtgctacttcatcctgagcatcatcaacagcatggcccagagctatgccaagaggatccagcagaggctgaacagcgaggagaagaccaagtag

SEQ ID NO: 175709 - DNA, 1443 bp, Artificial Sequence
  Description of Artificial Sequence: Synthetic coding sequence
atgtctgatgtggccatcgtgaaggagggctggctgcacaagagaggagagtacatcaagacctggaggccccgctacttcctgctgaagaatgatggcaccttcatcggctacaaggagcggccccaggatgtggaccagcgggaggcccccctgaacaacttctctgtggcccagtgccagctgatgaagacagagcggccccggcccaacaccttcatcatccgctgcctgcagtggaccaccgtcatcgagaggaccttccacgtggagaccccagaggagcgggaggagtggaccacagccatccagacagtggctgatggcctgaagaagcaggaggaggaggagatggacttccgcagcggcagccccagcgacaacagcggggctgaggagatggaggtgtccctggccaagcccaagcaccgggtgaccatgaatgaatttgagtacctgaagctgctgggcaagggcaccttcggcaaggtgatcctggtgaaggagaaggccaccggccgctactatgccatgaagatcctgaagaaggaggtgattgtggccaaggatgaggtggcccacaccctgacagagaacagagtgctgcagaacagccgccaccccttcctgacagccctgaagtacagcttccagacccatgaccggctgtgctttgtgatggagtatgccaatggaggagagctgttcttccacctgagccgggagagggtcttctctgaagatcgggcccgcttctatggagctgagatcgtgtctgccctggactacctgcacagcgagaagaatgtggtgtacagagacctgaagctggagaacctgatgctggacaaggatggccacatcaagatcacagactttggcctgtgcaaggagggcatcaaggatggagccaccatgaagaccttctgtggcaccccagagtacctggcccctgaggtgctggaggacaatgactatggccgggctgtggactggtggggcctgggcgtggtgatgtatgagatgatgtgtggccgcctgcccttctacaaccaggaccacgagaagctgtttgagctgatcctgatggaggagatccgcttccccaggaccctgggccctgaggccaagagcctgctgagcggcctgctgaagaaggaccccaagcagaggctgggcggcggctctgaagatgccaaggagatcatgcagcaccgcttctttgctggcatcgtgtggcagcacgtgtatgagaagaagctgagcccccccttcaagccccaggtgaccagcgagacagacacccgctactttgatgaggagttcaccgcccagatgatcaccatcaccccaccagaccaggatgacagcatggagtgtgtggacagcgagcggcggccccacttcccccagttctcctacagcgccagcggcacagcctag

SEQ ID NO: 175710 - DNA, 1443 bp, Artificial Sequence; identical to SEQ ID NO: 175709
  Description of Artificial Sequence: Synthetic coding sequence

SEQ ID NO: 175711 - DNA, 1257 bp, Artificial Sequence
  Description of Artificial Sequence: Synthetic coding sequence
atgaagacagagcggccccggcccaacaccttcatcatccgctgcctgcagtggaccaccgtcatcgagaggaccttccacgtggagaccccagaggagcgggaggagtggaccacagccatccagacagtggctgatggcctgaagaagcaggaggaggaggagatggacttccgcagcggcagccccagcgacaacagcggggctgaggagatggaggtgtccctggccaagcccaagcaccgggtgaccatgaatgaatttgagtacctgaagctgctgggcaagggcaccttcggcaaggtgatcctggtgaaggagaaggccaccggccgctactatgccatgaagatcctgaagaaggaggtgattgtggccaaggatgaggtggcccacaccctgacagagaacagagtgctgcagaacagccgccaccccttcctgacagccctgaagtacagcttccagacccatgaccggctgtgctttgtgatggagtatgccaatggaggagagctgttcttccacctgagccgggagagggtcttctctgaagatcgggcccgcttctatggagctgagatcgtgtctgccctggactacctgcacagcgagaagaatgtggtgtacagagacctgaagctggagaacctgatgctggacaaggatggccacatcaagatcacagactttggcctgtgcaaggagggcatcaaggatggagccaccatgaagaccttctgtggcaccccagagtacctggcccctgaggtgctggaggacaatgactatggccgggctgtggactggtggggcctgggcgtggtgatgtatgagatgatgtgtggccgcctgcccttctacaaccaggaccacgagaagctgtttgagctgatcctgatggaggagatccgcttccccaggaccctgggccctgaggccaagagcctgctgagcggcctgctgaagaaggaccccaagcagaggctgggcggcggctctgaagatgccaaggagatcatgcagcaccgcttctttgctggcatcgtgtggcagcacgtgtatgagaagaagctgagcccccccttcaagccccaggtgaccagcgagacagacacccgctactttgatgaggagttcaccgcccagatgatcaccatcaccccaccagaccaggatgacagcatggagtgtgtggacagcgagcggcggccccacttcccccagttctcctacagcgccagcggcacagcctag

SEQ ID NO: 175712 - DNA, 1443 bp, Artificial Sequence; identical to SEQ ID NO: 175709
  Description of Artificial Sequence: Synthetic coding sequence

SEQ ID NO: 175713 - DNA, 1443 bp, Artificial Sequence; identical to SEQ ID NO: 175709
  Description of Artificial Sequence: Synthetic coding sequence

SEQ ID NO: 175714 - DNA, 1443 bp, Artificial Sequence; identical to SEQ ID NO: 175709
  Description of Artificial Sequence: Synthetic coding sequence

SEQ ID NO: 175715 - DNA, 279 bp, Artificial Sequence
  Description of Artificial Sequence: Synthetic coding sequence
atgtctgatgtggccatcgtgaaggagggctggctgcacaagagaggagagtacatcaagacctggaggccccgctacttcctgctgaagaatgatggcaccttcatcggctacaaggagcggccccaggatgtggaccagcgggaggcccccctgaacaacttctctgtggcccagtgccagctgatgaagacagagcggccccggcccaacaccttcatcatccgctgcctgcagtggaccaccgtcatcgagaggaccttccacgtggagacctag

SEQ ID NO: 175716 - DNA, 2421 bp, Artificial Sequence
  Description of Artificial Sequence: Synthetic coding sequence
atggccagcggggctgacagcaaaggagatgacctgagcacagccatcctgaagcagaagaaccggcccaaccggctgattgtggatgaggccatcaatgaagacaacagcgtggtgtccctgagccagcccaagatggatgagctgcagctgttccggggggacacagtgctgctgaagggcaagaagaggcgggaggccgtgtgcatcgtgctgagtgatgacacctgcagtgatgagaagatccgcatgaacagagtggtgaggaacaacctgcgggtgcggctgggagatgtgatcagcatccagccctgcccagatgtgaagtatggcaagagaattcatgtgctgcccattgatgacacagtggagggcatcactggaaacctgtttgaggtgtacctgaagccctacttcctggaggcctaccggcccatcaggaagggggacatcttcctggtgcggggcggcatgagagctgtggagttcaaggtggtggagacagaccccagcccctactgcatcgtggccccagacaccgtcatccactgtgagggggagcccatcaagcgggaggatgaggaggagagcctgaatgaggtgggctatgatgacatcggcggctgcaggaagcagctggcccagatcaaggagatggtggagctgcccctgcggcacccagccctcttcaaggccatcggcgtgaagccaccccggggcatcctgctgtatggccccccaggcaccgggaagaccctcatcgcccgggctgtggccaatgagaccggggccttcttcttcctgatcaatggacctgagatcatgagcaagctggccggggagagcgagagcaacctgaggaaggcctttgaggaggccgagaagaatgccccagccatcatcttcattgatgagctggatgccatcgcccccaagcgggagaagacccatggagaggtggagcggcgcatcgtgtcccagctgctgaccctgatggatggcctgaagcagagggcccacgtgattgtgatggccgccaccaaccggcccaacagcattgatcctgccctgcggcgcttcggccgctttgaccgggaggtggacatcggcatcccagatgccaccggccgcctggagatcctgcagatccacaccaagaacatgaagctggctgatgatgtggacctggagcaggtggccaatgagacccacggccacgtgggcgctgacctggccgccctgtgcagcgaggccgccctgcaggccatcaggaagaagatggacctgattgacctggaggatgagaccattgatgctgaggtgatgaacagcctggccgtgaccatggatgacttccgctgggccctgagccagagcaaccccagcgccctgcgggagaccgtggtggaggtgccccaggtgacctgggaggacattggaggcctggaggatgtgaagcgggagctgcaggagctggtgcagtaccctgtggagcacccagacaagttcctgaagtttggcatgacccccagcaagggcgtgctcttctacggccccccaggctgtgggaagaccctgctggccaaggccatcgccaatgaatgccaggccaacttcatcagcatcaagggccctgagctgctgaccatgtggtttggagagagcgaggccaacgtgcgggagatctttgacaaggcccggcaggccgccccctgtgtgctcttctttgatgagctggacagcatcgccaaggcccggggcggcaacattggagatggcggcggcgctgctgacagagtcatcaaccagatcctgacagagatggatggcatgagcaccaagaagaatgtgttcatcatcggggccaccaacagaccagacatcattgatcctgccatcctgcggcccggccgcctggaccagctgatctacatccccctgcctgatgagaagagccgggtggccatcctgaaggccaacctgaggaagagccctgtggccaaggatgtggacctggagttcctggccaagatgaccaacggcttctctggagctgacctgacagagatctgccagagggcctgcaagctggccatccgggagagcattgaaagtgagatccggcgggagcgggagcggcagaccaaccccagcgccatggaggtggaggaggatgatcctgtgcctgagatccggcgggaccactttgaggaggccatgagatttgcccggcgctctgtgtctgacaatgacatcagaaaatatgagatgtttgcccagaccctgcagcagagccggggcttcggcagcttccgcttccccagcggcaaccagggcggggccggccccagccagggcagcggcggcggcactggaggctctgtgtacacagaggacaatgatgatgacctgtatggatag

SEQ ID NO: 175717 - DNA, 3669 bp, Artificial Sequence
  Description of Artificial Sequence: Synthetic coding sequence
atgagccagcccccacctcctcctccacccctgcccccacctcctcctcctcctgaggccccccagacccccagcagcctggccagcgctgctgccagcggcggcctgctgaagagaagagaccggcgcatcctgagcggcagctgcccagaccccaagtgccaggcccggctcttcttccctgccagcggctctgtgtccattgaatgtacagaatgtggccagagacatgagcagcagcagctgctgggcgtggaggaggtgacagatcctgatgtggtgctgcacaacctgctgagaaatgccctgctgggcgtgactggagcccccaagaagaacacagagctggtgaaggtgatgggcctgagcaactaccactgcaagctgctgagccccatcctggcccgctatggcatggacaagcagacaggccgggccaagctgctgcgggacatgaaccagggcgagctgtttgactgtgccctgctgggggaccgggccttcctgattgagcctgagcacgtgaacacagtgggctacggcaaggacagaagtggcagcctgctgtacctgcatgacaccctggaggacatcaagagggccaacaagagccaggagtgcctgatccctgtgcacgtggatggagatggccactgcctggtgcatgctgtgtcccgggccctggtgggccgggagctgttctggcacgccctgcgggagaacctgaagcagcacttccagcagcacctggcccgctaccaggccctcttccatgacttcattgatgctgctgagtgggaggacatcatcaatgaatgtgaccccctgtttgtgcccccagagggcgtgcccctgggcctgaggaacatccacatcttcggcctggccaacgtgctgcaccggcccatcatcctgctggacagcctgagcggcatgaggagcagcggggactacagcgccaccttcctgcccggcctcatcccagctgagaagtgcaccgggaaggatggccacctgaacaagcccatctgcatcgcctggagcagcagcggcaggaaccactacatccccctggtgggcatcaagggggccgccctgcccaagctgcccatgaacctgctgcccaaggcctggggcgtgccccaggacctgatcaagaagtacatcaagctggaggaggatggcggctgtgtgattggaggagacaggagcctgcaggacaagtacctgctgcggctggtggccgccatggaggaggtgttcatggacaagcacggcatccaccccagcctggtggctgatgtgcaccagtacttctacagaagaactggagtcatcggcgtgcagcctgaggaggtgacagctgctgccaagaaggctgtgatggacaaccggctgcacaagtgcctgctgtgtggggccctgtctgagctgcacgtgcccccagagtggctggcccctgggggcaagctgtacaacctggccaagagcacccacggccagctgaggacagacaagaactacagcttccccctgaacaacctggtgtgcagctatgattctgtgaaggatgtgctggtgcctgactatggcatgagcaacctgacagcctgcaactggtgccacggcacctctgtgaggaaggtgagaggagatggcagcatcgtgtacctggatggagacaggaccaacagccgcagcactggaggaaaatgtggctgcggcttcaagcacttctgggatggcaaggagtatgacaacctgcctgaggccttccccatcaccctggagtggggcggccgggtggtgcgggagaccgtgtactggttccagtatgaaagtgacagcagcctgaacagcaatgtgtatgatgtggccatgaagctggtgaccaagcacttccctggagaatttggcagcgagatcctggtgcagaaggtggtgcacaccatcctgcaccagacagccaagaagaacccagatgactacacccctgtgaacattgatggagcccacgcccagagggtgggagatgtgcagggccaggagagcgagagccagctgcccaccaagatcatcctgaccggccagaagaccaagaccctgcacaaggaggagctgaacatgagcaagacagagaggaccatccagcagaacatcacagagcaggcctctgtgatgcagaagaggaagacagagaagctgaagcaggagcagaagggccagcccaggacagtgagccccagcaccatcagagatggccccagcagcgccccagccacccccaccaaggccccctacagccccaccaccagcaaggagaagaagatccgcatcaccaccaatgatggccggcagagcatggtgaccctgaagagcagcaccaccttctttgagctgcaggagagcatcgcccgggagttcaacatccccccctacctgcagtgcatccgctatggcttcccccccaaggagctgatgccaccccaggccggcatggagaaggagcctgtgcccctgcagcacggggaccgcatcaccatcgagatcctgaagagcaaggccgagggcggccagagcgctgctgcccacagcgcccacacagtgaagcaggaggacattgctgtgacaggcaagctgagcagcaaggagctgcaggagcaggccgagaaggagatgtacagcctgtgcctgctggccaccctgatgggagaagatgtgtggagctatgccaagggcctgccccacatgttccagcagggcggcgtcttctacagcatcatgaagaagaccatgggcatggctgatggcaagcactgcaccttcccccacctgcccgggaagacctttgtgtacaatgccagcgaggaccggctggagctgtgtgtggatgctgctggccacttccccatcggcccagatgtggaggacctggtgaaggaggccgtgtcccaggtgcgggcagaggccaccaccaggagccgggagagcagccccagccacggcctgctgaagctgggcagcggcggcgtggtgaagaagaagtctgagcagctgcacaacgtgacagccttccagggcaagggccacagcctgggcacagccagcggcaacccccacctggacccccgggcccgggagacctctgtggtgaggaagcacaacacaggaacagacttcagcaacagcagcaccaagacagagcccagcgtcttcaccgccagcagcagcaacagcgagctgatccgcatcgcccctggggtggtgaccatgagagatggccggcagctggaccctgacctggtggaggcccagaggaagaagctgcaggagatggtgagcagcatccaggcctccatggacagacacctgcgggaccagagcacagagcagagccccagcgacctgccccagaggaagacagaggtggtgagcagcagcgccaagagcggcagcctgcagacaggcctgcctgagagcttccccctgaccggcggcacagagaacctgaacacagagaccacagatggctgtgtggctgatgccctgggcgccgcctttgccaccaggagcaaggcccagaggggcaacagcgtggaggagctggaggagatggacagccaggatgctgagatgaccaacaccacagagcccatggaccacagctag

SEQ ID NO: 175718 - DNA, 3381 bp, Artificial Sequence; identical to SEQ ID NO: 144903
  Description of Artificial Sequence: Synthetic coding sequence

SEQ ID NO: 175719 - DNA, 3795 bp, Artificial Sequence
  Description of Artificial Sequence: Synthetic coding sequence
atgagcaccctgtatgtgagcccccacccagatgccttccccagcctgcgggccctgattgctgcccgctacggggaggccggggagggccctggctggggcggggcccacccccgcatctgcctgcagcccccacccaccagcaggacccccttccccccaccccggctgcctgccctggagcagggccctgggggcctgtgggtgtggggcgccacagctgtggcccagctgctgtggccagctggcctgggcggccctgggggcagcagagctgctgtgctggtgcagcagtgggtgtcctatgctgacacagagctgatcccagctgcctgtggggccaccctgcctgccctgggcctgcggagcagcgcccaggacccccaggccgtgctgggcgccctgggccgggccctgagccccctggaggagtggctgcggctgcacacctacctggccggggaggcccccaccctggccgacctggccgctgtgacagccctgctgctgcccttccgctacgtgctggaccccccagcccggcgcatctggaacaacgtgacccgctggtttgtgacctgtgtgcggcagcctgagttccgggctgtgctgggggaggtggtgctgtacagcggggcccggcccctgagccaccagcccggccctgaggccccagccctgcccaagacagctgcccagctgaagaaggaggccaagaagcgggagaagctggagaagttccagcagaagcagaagatccagcagcagcagcccccacctggagagaagaagcccaagccagagaagcgggagaagagggaccccggggtcatcacctatgacctgcccaccccacctggagagaagaaggatgtgtctggccccatgccagacagctacagcccccgctacgtggaggccgcctggtacccctggtgggagcagcagggcttcttcaagccagaatatggccggcccaacgtgtctgctgccaacccccggggcgtcttcatgatgtgcatccccccaccaaatgtgacaggcagcctgcacctgggccacgccctgaccaatgccatccaggacagcctgacccgctggcacaggatgagaggagagaccaccctgtggaaccctggctgtgaccacgccggcatcgccacccaggtggtggtggagaagaagctgtggagggagcagggcctgagccgccaccagctgggccgggaggccttcctgcaggaggtgtggaagtggaaggaggagaagggggaccgcatctaccaccagctgaagaagctgggcagcagcctggactgggaccgggcctgcttcaccatggaccccaagctgtctgctgctgtgacagaggcctttgtgcggctgcacgaggagggcatcatctaccgcagcacccggctggtgaactggagctgcaccctgaacagcgccatcagtgacatcgaggtggacaagaaggagctgaccggccgcaccctgctgtctgtgcccggctacaaggagaaggtggagtttggagtgctggtgtcctttgcctacaaggtgcagggcagtgacagtgatgaggaggtggtggtggccaccacccgcatcgagaccatgctgggagatgtggccgtggccgtgcaccccaaggacacccgctaccagcacctgaagggcaagaatgtcatccaccccttcctgagccgcagcctgcccatcgtgtttgatgaatttgtggacatggactttggaactggagctgtgaagatcaccccagcccatgaccagaatgactatgaggtgggccagagacatggcctggaggccatcagcatcatggacagcagaggagccctgatcaacgtgcccccacccttcctgggcctgcccaggtttgaggccaggaaggctgtgctggtggccctgaaggagcggggcctcttccggggcatcgaggacaaccccatggtggtgcccctgtgcaacagaagcaaggatgtggtggagcccctgctgcggccccagtggtacgtgcgctgtggggagatggcccaggccgccagcgctgctgtgaccaggggggacctgcgcatcctgcctgaggcccaccagaggacctggcacgcctggatggacaacatccgggagtggtgcatcagccggcagctgtggtggggccaccgcatcccagcctactttgtgacagtgtctgaccctgctgtgcccccaggagaagatcctgatggccgctactgggtgtctggaagaaatgaagctgaggcccgggagaaggccgccaaggagtttggagtgtccccagacaagatcagcctgcagcaggatgaagatgtgctggacacctggttcagcagcggcctcttccccctgagcatcctgggctggcccaaccagagcgaggacctgtctgtgttctacccaggcaccctgctggagactggacatgacatcctcttcttctgggtggccaggatggtgatgctgggcctgaagctgaccggccgcctgcccttccgggaggtgtacctgcacgccatcgtgagagatgcccacggcaggaagatgagcaagagcctgggcaatgtgattgaccccctggatgtgatctacggcatcagcctgcagggcctgcacaaccagctgctgaacagcaacctggaccccagcgaggtggagaaggccaaggagggccagaaggctgacttccctgctggcatcccagaatgtggcacagatgccctgcgcttcggcctgtgtgcctacatgagccagggccgggacatcaacctggatgtgaaccgcatcctgggctaccgccacttctgcaacaagctgtggaatgccaccaagtttgccctgcggggcctgggcaagggctttgtgcccagccccaccagccagcccggcggccacgagagcctggtggaccgctggatccgcagccggctgacagaggccgtgcggctgagcaaccagggcttccaggcctatgacttccctgctgtgaccacagcccagtacagcttctggctgtatgagctgtgtgatgtgtacctggagtgcctgaagcctgtgctgaatggagtggaccaggtggccgcagaatgtgcccggcagaccctgtacacctgcctggatgtgggcctgcggctgctgagccccttcatgccctttgtgacagaggagctgttccagaggctgcccaggaggatgccccaggccccacccagcctgtgtgtgaccccctacccagagcccagcgagtgctcctggaaggaccctgaggccgaggccgccctggagctggccctgagcatcaccagggctgtgcgcagcctgcgggctgactacaacctgacccgcatccggccagactgcttcctggaggtggctgatgaggccactggagccctggccagcgctgtgtctggctacgtgcaggccctggccagcgctggggtggtggccgtgctggccctgggcgccccagccccccagggctgtgctgtggccctggccagtgaccgctgcagcatccacctgcagctgcagggcctggtggaccctgcccgggagctgggcaagctgcaggccaagagggtggaggcccagaggcaggcccagaggctgcgggagaggagagctgccagcggctaccctgtgaaggtgcccctggaggtgcaggaggctgatgaggccaagctgcagcagacagaggccgagctgaggaaggtggatgaggccatcgccctcttccagaagatgctgtag

SEQ ID NO: 175720 - DNA, 525 bp, Artificial Sequence
  Description of Artificial Sequence: Synthetic coding sequence
atgagcaccctgtatgtgagcccccacccagatgccttccccagcctgcgggccctgattgctgcccgctacggggaggccggggagggccctggctggggcggggcccacccccgcatctgcctgcagcccccacccaccagcaggaccagcttccccccaccccggctgcctgccctggagcagggccctgggggcctgtgggtgtggggcgccacagctgtggcccagctgctgtggccagctggcctgggcggccctgggggcagcagagctgctgtgctggtgcagcagtgggtgtcctatgctgacacagagctgatcccagctgcctgtggggccaccctgcctgccctgggcctgcggagcagcgcccaggacccccaggccgtgctgggcgccctgggccgggccctgagccccctggaggagtggctgcggctgcacacctacctggccggggaggcccccaccctggccgacctggccgctgtgacagccctgctgctgcccttccgctactag

SEQ ID NO: 175721 - DNA, 525 bp, Artificial Sequence; identical to SEQ ID NO: 175720
  Description of Artificial Sequence: Synthetic coding sequence

SEQ ID NO: 175722 - DNA, 867 bp, Artificial Sequence
  Description of Artificial Sequence: Synthetic coding sequence
tgaaaggagcggggcctcttccggggcatcgaggacaaccccatggtggtgcccctgtgcaacagaagcaaggatgtggtggagcccctgctgcggccccagtgggagtggtgcatcagccggcagctgtggtggggccaccgcatcccagcctactttgtgacagtgtctgaccctgctgtgcccccaggagaagatcctgatggccgctactgggtgtctggaagaaatgaagctgaggcccgggagaaggccgccaaggagtttggagtgtccccagacaagatcagcctgcagcaggatgaagatgtgctggacacctggttcagcagcggcctcttccccctgagcatcctgggctggcccaaccagagcgaggacctgtctgtgttctacccaggcaccctgctggagactggacatgacatcctcttcttctgggtggccaggatggtgatgctgggcctgaagctgaccggccgcctgcccttccgggaggtgtacctgcacgccatcgtgagagatgcccacggcaggaagatgagcaagagcctgggcaatgtgattgaccccctggatgtgatctacggcatcagcctgcagggcctgcacaaccagctgctgaacagcaacctggaccccagcgaggtggagaaggccaaggagggccagaaggctgacttccctgctggcatcccagaatgtggcacagatgccctgcgcttcggcctgtgtgcctacatgagccagggccgggacatcaacctggatgtgaaccgcatcctgggctaccgccacttctgcaacaagctgtggaatgccaccaagtttgccctgcggggcctgggcaagggctttgtgccctag

SEQ ID NO: 175723 - DNA, 3795 bp, Artificial Sequence
  Description of Artificial Sequence: Synthetic coding sequence
atgagcaccctgtatgtgagcccccacccagatgccttccccagcctgcgggccctgattgctgcccgctacggggaggccggggagggccctggctggggcggggcccacccccgcatctgcctgcagcccccacccaccagcaggaccagcttccccccaccccggctgcctgccctggagcagggccctgggggcctgtgggtgtggggcgccacagctgtggcccagctgctgtggccagctggcctgggcggccctgggggcagcagagctgctgtgctggtgcagcagtgggtgtcctatgctgacacagagctgatcccagctgcctgtggggccaccctgcctgccctgggcctgcggagcagcgcccaggacccccaggccgtgctgggcgccctgggccgggccctgagccccctggaggagtggctgcggctgcacacctacctggccggggaggcccccaccctggccgacctggccgctgtgacagccctgctgctgcccttccgctacgtgctggaccccccagcccggcgcatctggaacaacgtgacccgctggtttgtgacctgtgtgcggcagcctgagttccgggctgtgctgggggaggtggtgctgtacagcggggcccggcccctgagccaccagcccggccctgaggccccagccctgcccaagacagctgcccagctgaagaaggaggccaagaagcgggagaagctggagaagttccagcagaagcagaagatccagcagcagcagcccccacctggagagaagaagcccaagccagagaagcgggagaagagggaccccggggtcatcacctatgacctgcccaccccacctggagagaagaaggatgtgtctggccccatgccagacagctacagcccccgctacgtggaggccgcctggtacccctggtgggagcagcagggcttcttcaagccagaatatggccggcccaacgtgtctgctgccaacccccggggcgtcttcatgatgtgcatccccccaccaaatgtgacaggcagcctgcacctgggccacgccctgaccaatgccatccaggacagcctgacccgctggcacaggatgagaggagagaccaccctgtggaaccctggctgtgaccacgccggcatcgccacccaggtggtggtggagaagaagctgtggagggagcagggcctgagccgccaccagctgggccgggaggccttcctgcaggaggtgtggaagtggaaggaggagaagggggaccgcatctaccaccagctgaagaagctgggcagcagcctggactgggaccgggcctgcttcaccatggaccccaagctgtctgctgctgtgacagaggcctttgtgcggctgcacgaggagggcatcatctaccgcagcacccggctggtgaactggagctgcaccctgaacagcgccatcagtgacatcgaggtggacaagaaggagctgaccggccgcaccctgctgtctgtgcccggctacaaggagaaggtggagtttggagtgctggtgtcctttgcctacaaggtgcagggcagtgacagtgatgaggaggtggtggtggccaccacccgcatcgagaccatgctgggagatgtggccgtggccgtgcaccccaaggacacccgctaccagcacctgaagggcaagaatgtcatccaccccttcctgagccgcagcctgcccatcgtgtttgatgaatttgtggacatggactttggaactggagctgtgaagatcaccccagcccatgaccagaatgactatgaggtgggccagagacatggcctggaggccatcagcatcatggacagcagaggagccctgatcaacgtgcccccacccttcctgggcctgcccaggtttgaggccaggaaggctgtgctggtggccctgaaggagcggggcctcttccggggcatcgaggacaaccccatggtggtgcccctgtgcaacagaagcaaggatgtggtggagcccctgctgcggccccagtggtacgtgcgctgtggggagatggcccaggccgccagcgctgctgtgaccaggggggacctgcgcatcctgcctgaggcccaccagaggacctggcacgcctggatggacaacatccgggagtggtgcatcagccggcagctgtggtggggccaccgcatcccagcctactttgtgacagtgtctgaccctgctgtgcccccaggagaagatcctgatggccgctactgggtgtctggaagaaatgaagctgaggcccgggagaaggccgccaaggagtttggagtgtccccagacaagatcagcctgcagcaggatgaagatgtgctggacacctggttcagcagcggcctcttccccctgagcatcctgggctggcccaaccagagcgaggacctgtctgtgttctacccaggcaccctgctggagactggacatgacatcctcttcttctgggtggccaggatggtgatgctgggcctgaagctgaccggccgcctgcccttccgggaggtgtacctgcacgccatcgtgagagatgcccacggcaggaagatgagcaagagcctgggcaatgtgattgaccccctggatgtgatctacggcatcagcctgcagggcctgcacaaccagctgctgaacagcaacctggaccccagcgaggtggagaaggccaaggagggccagaaggctgacttccctgctggcatcccagaatgtggcacagatgccctgcgcttcggcctgtgtgcctacatgagccagggccgggacatcaacctggatgtgaaccgcatcctgggctaccgccacttctgcaacaagctgtggaatgccaccaagtttgccctgcggggcctgggcaagggctttgtgcccagccccaccagccagcccggcggccacgagagcctggtggaccgctggatccgcagccggctgacagaggccgtgcggctgagcaaccagggcttccaggcctatgacttccctgctgtgaccacagcccagtacagcttctggctgtatgagctgtgtgatgtgtacctggagtgcctgaagcctgtgctgaatggagtggaccaggtggccgcagaatgtgcccggcagaccctgtacacctgcctggatgtgggcctgcggctgctgagccccttcatgccctttgtgacagaggagctgttccagaggctgcccaggaggatgccccaggccccacccagcctgtgtgtgaccccctacccagagcccagcgagtgctcctggaaggaccctgaggccgaggccgccctggagctggccctgagcatcaccagggctgtgcgcagcctgcgggctgactacaacctgacccgcatccggccagactgcttcctggaggtggctgatgaggccactggagccctggccagcgctgtgtctggctacgtgcaggccctggccagcgctggggtggtggccgtgctggccctgggcgccccagccccccagggctgtgctgtggccctggccagtgaccgctgcagcatccacctgcagctgcagggcctggtggaccctgcccgggagctgggcaagctgcaggccaagagggtggaggcccagaggcaggcccagaggctgcgggagaggagagctgccagcggctaccctgtgaaggtgcccctggaggtgcaggaggctgatgaggccaagctgcagcagacagaggccgagctgaggaaggtggatgaggccatcgccctcttccagaagatgctgtag

SEQ ID NO: 175724 - DNA, 1101 bp, Artificial Sequence
  Description of Artificial Sequence: Synthetic coding sequence
atgagcaccctgtatgtgagcccccacccagatgccttccccagcctgcgggccctgattgctgcccgctacggggaggccggggagggccctggctggggcggggcccacccccgcatctgcctgcagcccccacccaccagcaggacccccttccccccaccccggctgcctgccctggagcagggccctgggggcctgtgggtgtggggcgccacagctgtggcccagctgctgtggccagctggcctgggcggccctgggggcagcagagctgctgtgctggtgcagcagtgggtgtcctatgctgacacagagctgatcccagctgcctgtggggccaccctgcctgccctgggcctgcggagcagcgcccaggacccccaggccgtgctgggcgccctgggccgggccctgagccccctggaggagtggctgcggctgcacacctacctggccggggaggcccccaccctggccgacctggccgctgtgacagccctgctgctgcccttccgctacgtgctggaccccccagcccggcgcatctggaacaacgtgacccgctggtttgtgacctgtgtgcggcagcctgagttccgggctgtgctgggggaggtggtgctgtacagcggggcccggcccctgagccaccagcccggccctgaggccccagccctgcccaagacagctgcccagctgaagaaggaggccaagaagcgggagaagctggagaagttccagcagaagcagaagatccagcagcagcagcccccacctggagagaagaagcccaagccagagaagcgggagaagagggaccccggggtcatcacctatgacctgcccaccccacctggagagaagaaggatgtgtctggccccatgccagacagctacagcccccgctacgtggaggccgcctggtacccctggtgggagcagcagggcttcttcaagccagaatatggccggcccaacgtgtctgctgccaacccccggggcgtcttcatgatgtgcatccccccaccaaatgtgacaggcagcctgcacctgggccacgccctgaccaatgccatccaggacagcctgaccaggtag

SEQ ID NO: 175725 - DNA, 525 bp, Artificial Sequence
  Description of Artificial Sequence: Synthetic coding sequence
atgagcaccctgtatgtgagcccccacccagatgccttccccagcctgcgggccctgattgctgcccgctacggggaggccggggagggccctggctggggcggggcccacccccgcatctgcctgcagcccccacccaccagcaggacccccttccccccaccccggctgcctgccctggagcagggccctgggggcctgtgggtgtggggcgccacagctgtggcccagctgctgtggccagctggcctgggcggccctgggggcagcagagctgctgtgctggtgcagcagtgggtgtcctatgctgacacagagctgatcccagctgcctgtggggccaccctgcctgccctgggcctgcggagcagcgcccaggacccccaggccgtgctgggcgccctgggccgggccctgagccccctggaggagtggctgcggctgcacacctacctggccggggaggcccccaccctggccgacctggccgctgtgacagccctgctgctgcccttccgctactag

SEQ ID NO: 175726 - DNA, 3552 bp, Artificial Sequence
  Description of Artificial Sequence: Synthetic coding sequence
tgaggactgggcggccctgggggcagcagagctgctgtgctggtgcagcagtgggtgtcctatgctgacacagagctgatcccagctgcctgtggggccaccctgcctgccctgggcctgcggagcagcgcccaggacccccaggccgtgctgggcgccctgggccgggccctgagccccctggaggagtggctgcggctgcacacctacctggccggggaggcccccaccctggccgacctggccgctgtgacagccctgctgctgcccttccgctacgtgctggaccccccagcccggcgcatctggaacaacgtgacccgctggtttgtgacctgtgtgcggcagcctgagttccgggctgtgctgggggaggtggtgctgtacagcggggcccggcccctgagccaccagcccggccctgaggccccagccctgcccaagacagctgcccagctgaagaaggaggccaagaagcgggagaagctggagaagttccagcagaagcagaagatccagcagcagcagcccccacctggagagaagaagcccaagccagagaagcgggagaagagggaccccggggtcatcacctatgacctgcccaccccacctggagagaagaaggatgtgtctggccccatgccagacagctacagccccaggtatgtggaggccgcctggtacccctggtgggagcagcagggcttcttcaagccagaatatggccggcccaacgtgtctgctgccaacccccggggcgtcttcatgatgtgcatccccccacccaacgtgacaggcagcctgcacctgggccacgccctgaccaatgccatccaggacagcctgacccgctggcacaggatgagaggagagaccaccctgtggaaccctggctgtgaccatgctggcatcgccacccaggtggtggtggagaagaagctgtggagggagcagggcctgagccgccaccagctgggccgggaggccttcctgcaggaggtgtggaagtggaaggaggagaagggggaccgcatctaccaccagctgaagaagctgggcagcagcctggactgggaccgggcctgcttcaccatggaccccaagctgtctgctgctgtgacagaggcctttgtgcggctgcacgaggagggcatcatctaccgcagcacccggctggtgaactggagctgcaccctgaacagcgccatcagtgacatcgaggtggacaagaaggagctgactggaagaaccctgctgtctgtgcccggctacaaggagaaggtggagtttggagtgctggtgtcctttgcctacaaggtgcagggcagtgacagtgatgaggaggtggtggtggccaccaccagaattgagaccatgctgggagatgtggccgtggccgtgcaccccaaggacacccgctaccagcacctgaagggcaagaatgtcatccaccccttcctgagccgcagcctgcccatcgtgtttgatgaatttgtggacatggactttggcaccggggctgtgaagatcaccccagcccatgaccagaatgactatgaggtgggccagagacatggcctggaggccatcagcatcatggacagcagaggagccctgatcaacgtgcccccacccttcctgggcctgcccaggtttgaggccaggaaggctgtgctggtggccctgaaggagcggggcctcttccggggcatcgaggacaaccccatggtggtgcccctgtgcaacagaagcaaggatgtggtggagcccctgctgcggccccagtggtacgtgcgctgtggggagatggcccaggccgccagcgctgctgtgaccaggggggacctgcgcatcctgcctgaggcccaccagaggacctggcacgcctggatggacaacatccgggagtggtgcatcagccggcagctgtggtggggccaccgcatcccagcctactttgtgacagtgtctgaccctgctgtgcccccaggagaggaccctgatggccgctactgggtgtctggaagaaatgaggccgaggcccgggagaaggccgccaaggagtttggagtgtccccagacaagatcagcctgcagcaggatgaagatgtgctggacacctggttcagcagcggcctcttccccctgagcatcctgggctggcccaaccagagcgaggacctgagcgtcttctacccaggcaccctgctggagaccggccatgacatcctcttcttctgggtggccaggatggtgatgctgggcctgaagctgaccggccgcctgcccttccgggaggtgtacctgcacgccatcgtgagagatgcccacggcaggaagatgagcaagagcctgggcaatgtcatcgaccccctggatgtgatctacggcatcagcctgcagggcctgcacaaccagctgctgaacagcaacctggaccccagcgaggtggagaaggccaaggagggccagaaggctgacttccctgctggcatcccagaatgtggcacagatgccctgcgcttcggcctgtgtgcctacatgagccagggccgggacatcaacctggatgtgaaccgcatcctgggctaccgccacttctgcaacaagctgtggaatgccaccaagtttgccctgcggggcctgggcaaaggatttgtgcccagccccaccagccagcccggcggccacgagagcctggtggaccgctggatccgcagccggctgacagaagctgtgcggctgagcaaccagggcttccaggcctatgacttccctgctgtgaccacagcccagtacagcttctggctgtatgagctgtgtgatgtgtacctggagtgcctgaagcctgtgctgaatggagtggaccaggtggccgcagaatgtgcccggcagaccctgtacacctgcctggatgtgggcctgcggctgctgagccccttcatgccctttgtgacagaggagctgttccagaggctgcccaggaggatgccccaggccccacccagcctgtgtgtgaccccctacccagagcccagtgaatgttcctggaaggaccctgaggccgaggccgccctggagctggccctgagcatcaccagggctgtgcgcagcctgcgggctgactacaacctgacccgcatccggccagactgcttcctggaggtggctgatgaggccaccggggccctggccagcgctgtgtctggctacgtgcaggccctggccagcgctggggtggtggccgtgctggccctgggcgccccagccccccagggctgtgctgtggccctggccagtgaccgctgcagcatccacctgcagctgcagggcctggtggaccctgcccgggagctgggcaagctgcaggccaagagggtggaggcccagaggcaggcccagaggctgcgggagcggcgggccgccagcggctaccctgtgaaggtgcccctggaggtgcaggaggctgatgaggccaagctgcagcagacagaagctgagctgaggaaggtggatgaggccatcgccctcttccagaagatgctgtag

SEQ ID NO: 175727 - DNA, 525 bp, Artificial Sequence; identical to SEQ ID NO: 175725
  Description of Artificial Sequence: Synthetic coding sequence

SEQ ID NO: 175728 - DNA, 867 bp, Artificial Sequence; identical to SEQ ID NO: 175722
  Description of Artificial Sequence: Synthetic coding sequence

SEQ ID NO: 175729 - DNA, 525 bp, Artificial Sequence; identical to SEQ ID NO: 175725
  Description of Artificial Sequence: Synthetic coding sequence

SEQ ID NO: 175730 - DNA, 867 bp, Artificial Sequence; identical to SEQ ID NO: 175722
  Description of Artificial Sequence: Synthetic coding sequence

SEQ ID NO: 175731 - DNA, 867 bp, Artificial Sequence; identical to SEQ ID NO: 175722
  Description of Artificial Sequence: Synthetic coding sequence

SEQ ID NO: 175732 - DNA, 3795 bp, Artificial Sequence; identical to SEQ ID NO: 175723
  Description of Artificial Sequence: Synthetic coding sequence

SEQ ID NO: 175733 - DNA, 525 bp, Artificial Sequence; identical to SEQ ID NO: 175725
  Description of Artificial Sequence: Synthetic coding sequence

SEQ ID NO: 175734 - DNA, 894 bp, Artificial Sequence
  Description of Artificial Sequence: Synthetic coding sequence
atgccagacagctacagccccaggtatgtggaggccgcctggtacccctggtgggagcagcagggcttcttcaagccagaatatggccggcccaacgtgtctgctgccaacccccggggcgtcttcatgatgtgcatccccccacccaacgtgacaggcagcctgcacctgggccacgccctgaccaatgccatccaggacagcctgacccgctggcacaggatgagaggagagaccaccctgtggaaccctggctgtgaccatgctggcatcgccacccaggtggtggtggagaagaagctgtggagggagcagggcctgagccgccaccagctgggccgggaggccttcctgcaggaggtgtggaagtggaaggaggagaagggggaccgcatctaccaccagctgaagaagctgggcagcagcctggactgggaccgggcctgcttcaccatggaccccaagctgtctgctgctgtgacagaggcctttgtgcggctgcacgaggagggcatcatctaccgcagcacccggctggtgaactggagctgcaccctgaacagcgccatcagtgacatcgaggtggacaagaaggagctgactggaagaaccctgctgtctgtgcccggctacaaggagaaggtggagtttggagtgctggtgtcctttgcctacaaggtgcagggcagtgacagtgatgaggaggtggtggtggccaccaccagaattgagaccatgctgggagatgtggccgtggccgtgcaccccaaggacacccgctaccagcacctgaagggcaagaatgtcatccaccccttcctgagccgcagcctgcccatcgtgtttgatgaatttgtggacatggactttggcaccggccctgcccaggtgtag

SEQ ID NO: 175735 - DNA, 867 bp, Artificial Sequence; identical to SEQ ID NO: 175722
  Description of Artificial Sequence: Synthetic coding sequence

SEQ ID NO: 175736 - DNA, 867 bp, Artificial Sequence; identical to SEQ ID NO: 175722
  Description of Artificial Sequence: Synthetic coding sequence

SEQ ID NO: 175737 - DNA, 288 bp, Artificial Sequence
  Description of Artificial Sequence: Synthetic coding sequence
tgaccagctggcctgggcggccctgggggcagcagagctgctgtgctggtgcagcagtgggtgtcctatgctgacacagagctgatcccagctgcctgtggggccaccctgcctgccctgggcctgcggagcagcgcccaggacccccaggccgtgctgggcgccctgggccgggccctgagccccctggaggagtggctgcggctgcacacctacctggccggggaggcccccaccctggccgacctggccgctgtgacagccctgctgctgcccttccgctactag

SEQ ID NO: 175738 - DNA, 3795 bp, Artificial Sequence; identical to SEQ ID NO: 175719
  Description of Artificial Sequence: Synthetic coding sequence

SEQ ID NO: 175739 - DNA, 2031 bp, Artificial Sequence
  Description of Artificial Sequence: Synthetic coding sequence
atgagcaccctgtatgtgagcccccacccagatgccttccccagcctgcgggccctgattgctgcccgctacggggaggccggggagggccctggctggggcggggcccacccccgcatctgccgcctgcccaggtttgaggccaggaaggctgtgctggtggccctgaaggagcggggcctcttccggggcatcgaggacaaccccatggtggtgcccctgtgcaacagaagcaaggatgtggtggagcccctgctgcggccccagtggtacgtgcgctgtggggagatggcccaggccgccagcgctgctgtgaccaggggggacctgcgcatcctgcctgaggcccaccagaggacctggcacgcctggatggacaacatccgggagtggtgcatcagccggcagctgtggtggggccaccgcatcccagcctactttgtgacagtgtctgaccctgctgtgcccccaggagaagatcctgatggccgctactgggtgtctggaagaaatgaagctgaggcccgggagaaggccgccaaggagtttggagtgtccccagacaagatcagcctgcagcaggatgaagatgtgctggacacctggttcagcagcggcctcttccccctgagcatcctgggctggcccaaccagagcgaggacctgtctgtgttctacccaggcaccctgctggagactggacatgacatcctcttcttctgggtggccaggatggtgatgctgggcctgaagctgaccggccgcctgcccttccgggaggtgtacctgcacgccatcgtgagagatgcccacggcaggaagatgagcaagagcctgggcaatgtgattgaccccctggatgtgatctacggcatcagcctgcagggcctgcacaaccagctgctgaacagcaacctggaccccagcgaggtggagaaggccaaggagggccagaaggctgacttccctgctggcatcccagaatgtggcacagatgccctgcgcttcggcctgtgtgcctacatgagccagggccgggacatcaacctggatgtgaaccgcatcctgggctaccgccacttctgcaacaagctgtggaatgccaccaagtttgccctgcggggcctgggcaagggctttgtgcccagccccaccagccagcccggcggccacgagagcctggtggaccgctggatccgcagccggctgacagaggccgtgcggctgagcaaccagggcttccaggcctatgacttccctgctgtgaccacagcccagtacagcttctggctgtatgagctgtgtgatgtgtacctggagtgcctgaagcctgtgctgaatggagtggaccaggtggccgcagaatgtgcccggcagaccctgtacacctgcctggatgtgggcctgcggctgctgagccccttcatgccctttgtgacagaggagctgttccagaggctgcccaggaggatgccccaggccccacccagcctgtgtgtgaccccctacccagagcccagcgagtgctcctggaaggaccctgaggccgaggccgccctggagctggccctgagcatcaccagggctgtgcgcagcctgcgggctgactacaacctgacccgcatccggccagactgcttcctggaggtggctgatgaggccactggagccctggccagcgctgtgtctggctacgtgcaggccctggccagcgctggggtggtggccgtgctggccctgggcgccccagccccccagggctgtgctgtggccctggccagtgaccgctgcagcatccacctgcagctgcagggcctggtggaccctgcccgggagctgggcaagctgcaggccaagagggtggaggcccagaggcaggcccagaggctgcgggagaggagagctgccagcggctaccctgtgaaggtgcccctggaggtgcaggaggctgatgaggccaagctgcagcagacagaggccgagctgaggaaggtggatgaggccatcgccctcttccagaagatgctgtag

SEQ ID NO: 175740 - DNA, 2031 bp, Artificial Sequence; identical to SEQ ID NO: 175739
  Description of Artificial Sequence: Synthetic coding sequence

SEQ ID NO: 175741 - DNA, 894 bp, Artificial Sequence; identical to SEQ ID NO: 175734
  Description of Artificial Sequence: Synthetic coding sequence

SEQ ID NO: 175742 - DNA, 894 bp, Artificial Sequence; identical to SEQ ID NO: 175734
  Description of Artificial Sequence: Synthetic coding sequence

SEQ ID NO: 175743 - DNA, 894 bp, Artificial Sequence; identical to SEQ ID NO: 175734
  Description of Artificial Sequence: Synthetic coding sequence

SEQ ID NO: 175744 - DNA, 2031 bp, Artificial Sequence; identical to SEQ ID NO: 175739
  Description of Artificial Sequence: Synthetic coding sequence

SEQ ID NO: 175745 - DNA, 2031 bp, Artificial Sequence; identical to SEQ ID NO: 175739
  Description of Artificial Sequence: Synthetic coding sequence

SEQ ID NO: 175746 - DNA, 894 bp, Artificial Sequence; identical to SEQ ID NO: 175734
  Description of Artificial Sequence: Synthetic coding sequence

SEQ ID NO: 175747 - DNA, 3192 bp, Artificial Sequence
  Description of Artificial Sequence: Synthetic coding sequence
atgccccacctgcccctggccagcttccggccccccttctggggcctgcggcacagccggggcctgccccgcttccacagcgtgtccacccagagcgagccccacggcagccccatcagcagaagaaaccgggaggccaagcagaagaggctgcgggagaagcaggccaccctggaggccgagattgctggggagagcaagagccctgctgagagcatcaaggcctggaggcccaaggagctggtgctgtatgagatccccaccaagccaggagagaagaaggatgtgtctggccccctgcccccagcctacagcccccgctacgtggaggccgcctggtacccctggtgggtgcgggagggcttcttcaagccagagtaccaggcccggctgccccaggccactggagagaccttctccatgtgcatccccccaccaaatgtgacaggcagcctgcacatcggccacgccctgactgtggccatccaggatgccctggtgcgctggcacaggatgagaggagaccaggtgctgtgggtgcccggcagtgaccacgccggcatcgccacccaggccgtggtggagaagcagctgtggaaggagcggggcgtgagaagacatgagctgagccgggaggccttcctgcgggaggtgtggcagtggaaggaggccaagggcggggagatctgtgagcagctgcgggccctgggcgccagcctggactgggaccgggagtgcttcaccatggatgtgggcagctctgtggccgtgacagaggcctttgtgcggctgtacaaggccggcctgctgtacagaaaccaccagctggtgaactggagctgtgccctgcggagcgccatcagtgacatcgaggtggagaaccggcccctgcccggccacacccagctgcggctgcccggctgccccacccctgtgtcctttggcctgctcttctctgtggccttccctgtggatggagagccagatgctgaggtggtggtgggcaccaccaggcctgagaccctgcctggagatgtggccgtggccgtgcacccagatgacagccgctacacccacctgcacggccggcagctgcggcaccccctgatgggccagcccctgcccctcatcacagattatgctgtgcagccccacgtgggcaccggggctgtgaaggtgaccccagcccacagccctgcagatgctgagatgggcgcccggcacggcctgagccccctgaatgtgattgctgaagatggcaccatgaccagcctgtgtggggactggctgcagggcctgcacagatttgtggcccgggagaagatcatgtctgtgctgtctgagtggggcctcttccggggcctgcagaaccaccccatggtgctgcccatctgcagccgctctggagatgtgattgagtacctgctgaagaaccagtggtttgtgcgctgccaggagatgggcgcccgggccgccaaggctgtggagagcggggccctggagctgagccccagcttccaccagaagaactggcagcactggttcagccacatcggggactggtgtgtgtcccggcagctgtggtggggccaccagatcccagcctacctggtggtggaggaccacgcccagggcgaggaggactgctgggtggtgggccgctctgaggccgaggcccgggaggtggccgctgagctgaccggccggcctggagctgagctgaccctggagcgggaccctgatgtgctggacacctggttcagcagcgccctcttccccttcagcgccctgggctggccccaggagaccccagacctggcccgcttctaccccctgagcctgctggagactggaagtgacctgctgctcttctgggtgggccgcatggtgatgctgggcacccagctgaccggccagctgcccttcagcaaggtgctgctgcaccccatggtgcgggaccggcagggcaggaagatgagcaagagcctgggcaatgtgctggacccccgggacatcatcagcggcgtggagatgcaggtgctgcaggagaagctgcggagcggcaacctggaccctgctgagctggccatcgtggccgccgcccagaagaaggacttcccccacggcatcccagaatgtggcacagatgccctgcgcttcaccctgtgcagccatggagtgcaggccggggacctgcacctgtctgtgtctgaggtgcagagctgccgccacttctgcaacaagatctggaatgccctgcgcttcatcctgaatgccctgggggagaagtttgtgccccagcctgctgaggagctgagccccagcagccccatggatgcctggatcctgagccggctggccctggccgcccaggagtgtgagcggggcttcctgacccgggagctgagcctggtgacccacgccctgcaccacttctggctgcacaacctgtgtgatgtgtacctggaggccgtgaagcctgtgctgtggcacagcccccggcccctgggccccccccaggtgctcttcagctgtgccgacctgggcctgcggctgctggcccccctgatgcccttcctggccgaggagctgtggcagaggctgcccccccggcccggctgccccccagcccccagcatctctgtggccccctaccccagcgcctgcagcctggagcactggaggcagcctgagctggagcggcgcttcagccgggtgcaggaggtggtgcaggtgctgcgggccctgcgggccacctaccagctgaccaaggcccggccccgggtgctgctgcagagcagcgagcccggggaccagggcctgtttgaggccttcctggagcccctgggcaccctgggctactgtggggctgtgggcctgctgcccccaggagctgctgcccccagcggctgggcccaggcccccctgagtgacacagcccaggtgtacatggagctgcagggcctggtggacccccagatccagctgcccctgctggccgcccggcgctacaagctgcagaagcagctggacagcctgacagcccggaccccatctgagggggaggccggcacccagaggcagcagaagctgagcagcctgcagctggagctgagcaagctggacaaggccgccagccacctgcggcagctgatggatgagcccccagcccctggcagccctgagctgtag

SEQ ID NO: 175748 - DNA, 774 bp, Artificial Sequence
  Description of Artificial Sequence: Synthetic coding sequence
atgccccacctgcccctggccagcttccggccccccttctggggcctgcggcacagccggggcctgccccgcttccacagcgtgtccacccagagcgagccccacggcagccccatcagcagaagaaaccgggaggccaagcagaagaggctgcgggagaagcaggccaccctggaggccgagattgctggggagagcaagagccctgctgagagcatcaaggcctggaggcccaaggagctggtgctgtatgagatccccaccaagccaggagagaagaaggatgtgtctggccccctgcccccagcctacagcccccgctacgtggaggccgcctggtacccctggtgggtgcgggagggcttcttcaagccagagtaccaggcccggctgccccaggccactggagagaccttctccatgtgcatccccccaccaaatgtgacaggcagcctgcacatcggccacgccctgactgtggccatccaggatgccctggtgcgctggcacaggatgagaggagaccaggtgctgtgggtgcccggcagtgaccacgccggcatcgccacccaggccgtggtggagaagcagctgtggaaggagcggggcgtgagaagacatgagctgagccgggaggccttcctgcgggaggtgtggcagtggaaggaggccaagggcggggagatctgtgagcagctgcgggccctgggcgccagcctggactgggacagagtcttctaccacggctgctggctgctgagcggctgtgactag

SEQ ID NO: 175749 - DNA, 3192 bp, Artificial Sequence; identical to SEQ ID NO: 175747
  Description of Artificial Sequence: Synthetic coding sequence

SEQ ID NO: 175750 - DNA, 348 bp, Artificial Sequence
  Description of Artificial Sequence: Synthetic coding sequence
atgccccacctgcccctggccagcttccggccccccttctggggcctgcggcacagccggggcctgccccgcttccacagcgtgtccacccagagcgagccccacggcagccccatcagcagaagaaaccgggaggccaagcagaagaggctgcgggagaagcaggccaccctggaggccgagattgctggggagagcaagagccctgctgagagcatcaaggcctggaggcccaaggagctggtgctgtatgagatccccaccaagccaggagagaagaaggatgtgtctggccccctgcccccagcctacagcccccgctacgtggaggccgcctggtacccctag

SEQ ID NO: 175751 - DNA, 981 bp, Artificial Sequence
  Description of Artificial Sequence: Synthetic coding sequence
atgccccacctgcccctggccagcttccggccccccttctggggcctgcggcacagccggggcctgccccgcttccacagcgtgtccacccagagcgagccccacggcagccccatcagcagaagaaaccgggaggccaagcagaagaggctgcgggagaagcaggccaccctggaggccgagattgctggggagagcaagagccctgctgagagcatcaaggcctggaggcccaaggagctggtgctgtatgagatccccaccaagccaggagagaagaaggatgtgtctggccccctgcccccagcctacagcccccgctacgtggaggccgcctggtacccctggtgggtgcgggagggcttcttcaagccagagtaccaggcccggctgccccaggccactggagagaccttctccatgtgcatccccccaccaaatgtgacaggcagcctgcacatcggccacgccctgactgtggccatccaggatgccctggtgcgctggcacaggatgagaggagaccaggtgctgtgggtgcccggcagtgaccacgccggcatcgccacccaggccgtggtggagaagcagctgtggaaggagcggggcgtgagaagacatgagctgagccgggaggccttcctgcgggaggtgtggcagtggaaggaggccaagggcggggagatctgtgagcagctgcgggccctgggcgccagcctggactgggaccgggagtgcttcaccatggatgtgggcagctctgtggccgtgacagaggcctttgtgcggctgtacaaggccggcctgctgtacagaaaccaccagctggtgaactggagctgtgccctgcggagcgccatcagtgacatcgaggtggagaaccggcccctgcccggccacacccagctgcggctgcccggctgccccacccctgtgtcctttggcctgctcttctctgtggccttccctgtggatggatag

SEQ ID NO: 175752 - DNA, 3282 bp, Artificial Sequence
  Description of Artificial Sequence: Synthetic coding sequence
atgggcggcaaggcctggccccggcgggctgtgggcacagctgggggcccctgtgccgagcagatcagcgcccccttccagaccctgctgatgccccacctgcccctggccagcttccggccccccttctggggcctgcggcacagccggggcctgccccgcttccacagcgtgtccacccagagcgagccccacggcagccccatcagcagaagaaaccgggaggccaagcagaagaggctgcgggagaagcaggccaccctggaggccgagattgctggggagagcaagagccctgctgagagcatcaaggcctggaggcccaaggagctggtgctgtatgagatccccaccaagccaggagagaagaaggatgtgtctggccccctgcccccagcctacagcccccgctacgtggaggccgcctggtacccctggtgggtgcgggagggcttcttcaagccagagtaccaggcccggctgccccaggccactggagagaccttctccatgtgcatccccccaccaaatgtgacaggcagcctgcacatcggccacgccctgactgtggccatccaggatgccctggtgcgctggcacaggatgagaggagaccaggtgctgtgggtgcccggcagtgaccacgccggcatcgccacccaggccgtggtggagaagcagctgtggaaggagcggggcgtgagaagacatgagctgagccgggaggccttcctgcgggaggtgtggcagtggaaggaggccaagggcggggagatctgtgagcagctgcgggccctgggcgccagcctggactgggaccgggagtgcttcaccatggatgtgggcagctctgtggccgtgacagaggcctttgtgcggctgtacaaggccggcctgctgtacagaaaccaccagctggtgaactggagctgtgccctgcggagcgccatcagtgacatcgaggtggagaaccggcccctgcccggccacacccagctgcggctgcccggctgccccacccctgtgtcctttggcctgctcttctctgtggccttccctgtggatggagagccagatgctgaggtggtggtgggcaccaccaggcctgagaccctgcctggagatgtggccgtggccgtgcacccagatgacagccgctacacccacctgcacggccggcagctgcggcaccccctgatgggccagcccctgcccctcatcacagattatgctgtgcagccccacgtgggcaccggggctgtgaaggtgaccccagcccacagccctgcagatgctgagatgggcgcccggcacggcctgagccccctgaatgtgattgctgaagatggcaccatgaccagcctgtgtggggactggctgcagggcctgcacagatttgtggcccgggagaagatcatgtctgtgctgtctgagtggggcctcttccggggcctgcagaaccaccccatggtgctgcccatctgcagccgctctggagatgtgattgagtacctgctgaagaaccagtggtttgtgcgctgccaggagatgggcgcccgggccgccaaggctgtggagagcggggccctggagctgagccccagcttccaccagaagaactggcagcactggttcagccacatcggggactggtgtgtgtcccggcagctgtggtggggccaccagatcccagcctacctggtggtggaggaccacgcccagggcgaggaggactgctgggtggtgggccgctctgaggccgaggcccgggaggtggccgctgagctgaccggccggcctggagctgagctgaccctggagcgggaccctgatgtgctggacacctggttcagcagcgccctcttccccttcagcgccctgggctggccccaggagaccccagacctggcccgcttctaccccctgagcctgctggagactggaagtgacctgctgctcttctgggtgggccgcatggtgatgctgggcacccagctgaccggccagctgcccttcagcaaggtgctgctgcaccccatggtgcgggaccggcagggcaggaagatgagcaagagcctgggcaatgtgctggacccccgggacatcatcagcggcgtggagatgcaggtgctgcaggagaagctgcggagcggcaacctggaccctgctgagctggccatcgtggccgccgcccagaagaaggacttcccccacggcatcccagaatgtggcacagatgccctgcgcttcaccctgtgcagccatggagtgcaggccggggacctgcacctgtctgtgtctgaggtgcagagctgccgccacttctgcaacaagatctggaatgccctgcgcttcatcctgaatgccctgggggagaagtttgtgccccagcctgctgaggagctgagccccagcagccccatggatgcctggatcctgagccggctggccctggccgcccaggagtgtgagcggggcttcctgacccgggagctgagcctggtgacccacgccctgcaccacttctggctgcacaacctgtgtgatgtgtacctggaggccgtgaagcctgtgctgtggcacagcccccggcccctgggccccccccaggtgctcttcagctgtgccgacctgggcctgcggctgctggcccccctgatgcccttcctggccgaggagctgtggcagaggctgcccccccggcccggctgccccccagcccccagcatctctgtggccccctaccccagcgcctgcagcctggagcactggaggcagcctgagctggagcggcgcttcagccgggtgcaggaggtggtgcaggtgctgcgggccctgcgggccacctaccagctgaccaaggcccggccccgggtgctgctgcagagcagcgagcccggggaccagggcctgtttgaggccttcctggagcccctgggcaccctgggctactgtggggctgtgggcctgctgcccccaggagctgctgcccccagcggctgggcccaggcccccctgagtgacacagcccaggtgtacatggagctgcagggcctggtggacccccagatccagctgcccctgctggccgcccggcgctacaagctgcagaagcagctggacagcctgacagcccggaccccatctgagggggaggccggcacccagaggcagcagaagctgagcagcctgcagctggagctgagcaagctggacaaggccgccagccacctgcggcagctgatggatgagcccccagcccctggcagccctgagctgtag

SEQ ID NO: 175753 - DNA, 2772 bp, Artificial Sequence
  Description of Artificial Sequence: Synthetic coding sequence
atgtgcatccccccaccaaatgtgacaggcagcctgcacatcggccacgccctgactgtggccatccaggatgccctggtgcgctggcacaggatgagaggagaccaggtgctgtgggtgcccggcagtgaccacgccggcatcgccacccaggccgtggtggagaagcagctgtggaaggagcggggcgtgagaagacatgagctgagccgggaggccttcctgcgggaggtgtggcagtggaaggaggccaagggcggggagatctgtgagcagctgcgggccctgggcgccagcctggactgggaccgggagtgcttcaccatggatgtgggcagctctgtggccgtgacagaggcctttgtgcggctgtacaaggccggcctgctgtacagaaaccaccagctggtgaactggagctgtgccctgcggagcgccatcagtgacatcgaggtggagaaccggcccctgcccggccacacccagctgcggctgcccggctgccccacccctgtgtcctttggcctgctcttctctgtggccttccctgtggatggagagccagatgctgaggtggtggtgggcaccaccaggcctgagaccctgcctggagatgtggccgtggccgtgcacccagatgacagccgctacacccacctgcacggccggcagctgcggcaccccctgatgggccagcccctgcccctcatcacagattatgctgtgcagccccacgtgggcaccggggctgtgaaggtgaccccagcccacagccctgcagatgctgagatgggcgcccggcacggcctgagccccctgaatgtgattgctgaagatggcaccatgaccagcctgtgtggggactggctgcagggcctgcacagatttgtggcccgggagaagatcatgtctgtgctgtctgagtggggcctcttccggggcctgcagaaccaccccatggtgctgcccatctgcagccgctctggagatgtgattgagtacctgctgaagaaccagtggtttgtgcgctgccaggagatgggcgcccgggccgccaaggctgtggagagcggggccctggagctgagccccagcttccaccagaagaactggcagcactggttcagccacatcggggactggtgtgtgtcccggcagctgtggtggggccaccagatcccagcctacctggtggtggaggaccacgcccagggcgaggaggactgctgggtggtgggccgctctgaggccgaggcccgggaggtggccgctgagctgaccggccggcctggagctgagctgaccctggagcgggaccctgatgtgctggacacctggttcagcagcgccctcttccccttcagcgccctgggctggccccaggagaccccagacctggcccgcttctaccccctgagcctgctggagactggaagtgacctgctgctcttctgggtgggccgcatggtgatgctgggcacccagctgaccggccagctgcccttcagcaaggtgctgctgcaccccatggtgcgggaccggcagggcaggaagatgagcaagagcctgggcaatgtgctggacccccgggacatcatcagcggcgtggagatgcaggtgctgcaggagaagctgcggagcggcaacctggaccctgctgagctggccatcgtggccgccgcccagaagaaggacttcccccacggcatcccagaatgtggcacagatgccctgcgcttcaccctgtgcagccatggagtgcaggccggggacctgcacctgtctgtgtctgaggtgcagagctgccgccacttctgcaacaagatctggaatgccctgcgcttcatcctgaatgccctgggggagaagtttgtgccccagcctgctgaggagctgagccccagcagccccatggatgcctggatcctgagccggctggccctggccgcccaggagtgtgagcggggcttcctgacccgggagctgagcctggtgacccacgccctgcaccacttctggctgcacaacctgtgtgatgtgtacctggaggccgtgaagcctgtgctgtggcacagcccccggcccctgggccccccccaggtgctcttcagctgtgccgacctgggcctgcggctgctggcccccctgatgcccttcctggccgaggagctgtggcagaggctgcccccccggcccggctgccccccagcccccagcatctctgtggccccctaccccagcgcctgcagcctggagcactggaggcagcctgagctggagcggcgcttcagccgggtgcaggaggtggtgcaggtgctgcgggccctgcgggccacctaccagctgaccaaggcccggccccgggtgctgctgcagagcagcgagcccggggaccagggcctgtttgaggccttcctggagcccctgggcaccctgggctactgtggggctgtgggcctgctgcccccaggagctgctgcccccagcggctgggcccaggcccccctgagtgacacagcccaggtgtacatggagctgcagggcctggtggacccccagatccagctgcccctgctggccgcccggcgctacaagctgcagaagcagctggacagcctgacagcccggaccccatctgagggggaggccggcacccagaggcagcagaagctgagcagcctgcagctggagctgagcaagctggacaaggccgccagccacctgcggcagctgatggatgagcccccagcccctggcagccctgagctgtag

SEQ ID NO: 175754 - DNA, 885 bp, Artificial Sequence
  Description of Artificial Sequence: Synthetic coding sequence
atggccagcgccagcggggccatggccaagcatgagcagatcctggtgctggaccccccaacagacctgaagttcaagggccccttcacagatgtggtgaccaccaacctgaagctgaggaaccccagcgacaggaaggtgtgcttcaaggtgaagaccacagccccccggcgctactgtgtgcggcccaacagcggcatcatcgaccccggcagcacagtgacagtgtctgtgatgctgcagccctttgattatgaccccaatgagaagagcaagcacaagttcatggtgcagaccatctttgccccacccaacaccagtgacatggaggccgtgtggaaggaggccaagccagatgagctgatggacagcaagctgcgctgtgtgtttgagatgcccaatgaaaatgacaagctgggcatcaccccacctggaaatgcccccaccgtgacctccatgagcagcatcaacaacacagtggccaccccagccagctaccacaccaaggatgacccccggggcctgtctgtgctgaagcaggagaagcagaagaatgacatggagcccagcaaggctgtgcccctgaatgccagcaagcaggacggccccatgcccaagccccacagcgtgtccctgaatgacacagagaccaggaagctgatggaggagtgcaagaggctgcagggcgagatgatgaagctgtctgaagaaaatagacacctgagagatgagggcctgcggctgaggaaggtggcccacagcgacaagccaggcagcaccagcacagccagcttccgggacaacgtgaccagccccctgcccagcctgctggtggtgattgctgccatcttcatcggcttcttcctgggcaagttcatcctgtag

SEQ ID NO: 175755 - DNA, 750 bp, Artificial Sequence
  Description of Artificial Sequence: Synthetic coding sequence
atggccagcgccagcggggccatggccaagcatgagcagatcctggtgctggaccccccaacagacctgaagttcaagggccccttcacagatgtggtgaccaccaacctgaagctgaggaaccccagcgacaggaaggtgtgcttcaaggtgaagaccacagccccccggcgctactgtgtgcggcccaacagcggcatcatcgaccccggcagcacagtgacagtgtctgtgatgctgcagccctttgattatgaccccaatgagaagagcaagcacaagttcatggtgcagaccatctttgccccacccaacaccagtgacatggaggccgtgtggaaggaggccaagccagatgagctgatggacagcaagctgcgctgtgtgtttgagatgcccaatgaaaatgacaagctgaatgacatggagcccagcaaggctgtgcccctgaatgccagcaagcaggacggccccatgcccaagccccacagcgtgtccctgaatgacacagagaccaggaagctgatggaggagtgcaagaggctgcagggcgagatgatgaagctgtctgaggagaacagacacctgagagatgagggcctgcggctgaggaaggtggcccacagcgacaagccaggcagcaccagcacagccagcttccgggacaacgtgaccagccccctgcccagcctgctggtggtgattgctgccatcttcatcggcttcttcctgggcaagttcatcctgtag

SEQ ID NO: 175756 - DNA, 300 bp, Artificial Sequence
  Description of Artificial Sequence: Synthetic coding sequence
atggccaaggtggagcaggtgctgagcctggagccccagcacgagctgaagttccggggccccttcacagatgtggtgaccaccaacctgaagctgggcaaccccacagacagaaatgtgtgcttcaaggtgaagaccacagccccccggcgctactgtgtgcggcccaacagcggcatcattgatgctggggccagcatcaacgtgtctggccgccgctggacagcagatgaagaagattctgctgagcagcagccccacttcagcatcagccccaactgggagggcagaagaccctag

SEQ ID NO: 175757 - DNA, 732 bp, Artificial Sequence
  Description of Artificial Sequence: Synthetic coding sequence
atggccaaggtggagcaggtgctgagcctggagccccagcacgagctgaagttccggggccccttcacagatgtggtgaccaccaacctgaagctgggcaaccccacagacagaaatgtgtgcttcaaggtgaagaccacagccccccggcgctactgtgtgcggcccaacagcggcatcattgatgctggggccagcatcaacgtgtctgtgatgctgcagccctttgattatgaccccaatgagaagagcaagcacaagttcatggtgcagagcatgtttgcccccacagacaccagtgacatggaggccgtgtggaaggaggccaagccagaggacctgatggacagcaagctgcgctgtgtgtttgagctgcctgcagaaaatgacaagccccatgatgtggagatcaacaagatcatcagcaccacagccagcaagacagagacccccatcgtgtccaagagcctgagcagcagcctggatgacacagaggtgaagaaggtgatggaggagtgcaagaggctgcagggcgaggtgcagaggctgcgggaggagaacaagcagttcaaggaggaggatggcctgaggatgaggaagacagtgcagagcaacagccccatcagcgccctggcccccaccgggaaggaggagggcctgagcacccggctgctggccctggtggtgctcttcttcatcgtgggcgtcatcatcggcaagatcgccctgtag

SEQ ID NO: 175758 - DNA, 1575 bp, Artificial Sequence
  Description of Artificial Sequence: Synthetic coding sequence
atggacacagagagcacctacagcggctacagctactacagcagccacagcaagaagagccaccggcagggcgagaggacccgggagcggcacaagagccccaggaacaaggatggccggggcagcgagaagtctgtgaccatccagccccccaccggggagcccctgctgggcaatgacagcaccaggacagaggaggtgcaggatgacaactggggcgagaccaccacagccatcaccggcaccagcgagcacagcatcagccaggaggacatcgcccgcatcagcaaggacatggaggacagcgtgggcctggactgcaagcgctacctgggcctgactgtggccagcttcctgggcctgctggtgttcctgacccccatcgccttcatcctgctgccccccatcctgtggagagatgagctggagccctgtggcaccatctgtgagggcctcttcatctccatggccttcaagctgctgatcctgctgattggcacctgggccctcttcttcaggaagagaagagctgacatgccccgggtgtttgtgttccgggccctgctgctggtgctgatcttcctgtttgtggtgtcctactggctgttctacggcgtgcgcatcctggacagccgggacaggaactaccagggcatcgtgcagtatgctgtgtccctggtggatgccctgctcttcatccactacctggccatcgtgctgctggagctgcggcagctgcagcccatgttcaccctgcaggtggtgcgcagcacagatggagagagccgcttctacagcctgggccacctgagcatccagagagctgccctggtggtgctggagaactactacaaggacttcaccatctacaaccccaacctgctgacagccagcaagttccgggccgccaagcacatggccggcctgaaggtgtacaacgtggatggccccagcaacaatgccaccggccagagccgggccatgattgctgctgctgccaggagaagagacagcagccacaatgagctgtactatgaggaggccgagcacgagcggcgggtgaagaagaggaaggcccggctggtggtggccgtggaggaggccttcatccacatccagaggctgcaggccgaggagcagcagaaggcccctggagaggtgatggacccccgggaggccgcccaggccatcttccccagcatggcccgggccctgcagaagtacctgcgcatcacccggcagcagaactaccacagcatggagagcatcctgcagcacctggccttctgcatcaccaacggcatgacccccaaggccttcctggagcgctacctgtctgctggccccaccctgcagtatgacaaggaccgctggctgagcacccagtggaggctggtgtctgatgaggccgtgaccaacggcctgagagatggcatcgtgtttgtgctgaagtgcctggacttcagcctggtggtgaatgtgaagaagatccccttcatcatcctgtctgaggagttcatcgaccccaagagccacaagtttgtgctgcggctgcagagcgagacctctgtgtag

SEQ ID NO: 175759 - DNA, 1575 bp, Artificial Sequence; identical to SEQ ID NO: 175758
  Description of Artificial Sequence: Synthetic coding sequence

SEQ ID NO: 175760 - DNA, 1575 bp, Artificial Sequence; identical to SEQ ID NO: 175758
  Description of Artificial Sequence: Synthetic coding sequence

SEQ ID NO: 175761 - DNA, 1569 bp, Artificial Sequence
  Description of Artificial Sequence: Synthetic coding sequence
atggacacagagagcacctacagcggctacagctactacagcagccacagcaagaagagccaccggcagggcgagaggacccgggagcggcacaagagccccaggaacaaggatggccggggcagcgagaagtctgtgaccatccagccccccaccggggagcccctgctgggcaatgacagcaccaggacagaggaggatgacaactggggcgagaccaccacagccatcaccggcaccagcgagcacagcatcagccaggaggacatcgcccgcatcagcaaggacatggaggacagcgtgggcctggactgcaagcgctacctgggcctgactgtggccagcttcctgggcctgctggtgttcctgacccccatcgccttcatcctgctgccccccatcctgtggagagatgagctggagccctgtggcaccatctgtgagggcctcttcatctccatggccttcaagctgctgatcctgctgattggcacctgggccctcttcttcaggaagagaagagctgacatgccccgggtgtttgtgttccgggccctgctgctggtgctgatcttcctgtttgtggtgtcctactggctgttctacggcgtgcgcatcctggacagccgggacaggaactaccagggcatcgtgcagtatgctgtgtccctggtggatgccctgctcttcatccactacctggccatcgtgctgctggagctgcggcagctgcagcccatgttcaccctgcaggtggtgcgcagcacagatggagagagccgcttctacagcctgggccacctgagcatccagagagctgccctggtggtgctggagaactactacaaggacttcaccatctacaaccccaacctgctgacagccagcaagttccgggccgccaagcacatggccggcctgaaggtgtacaacgtggatggccccagcaacaatgccaccggccagagccgggccatgattgctgctgctgccaggagaagagacagcagccacaatgagctgtactatgaggaggccgagcacgagcggcgggtgaagaagaggaaggcccggctggtggtggccgtggaggaggccttcatccacatccagaggctgcaggccgaggagcagcagaaggcccctggagaggtgatggacccccgggaggccgcccaggccatcttccccagcatggcccgggccctgcagaagtacctgcgcatcacccggcagcagaactaccacagcatggagagcatcctgcagcacctggccttctgcatcaccaacggcatgacccccaaggccttcctggagcgctacctgtctgctggccccaccctgcagtatgacaaggaccgctggctgagcacccagtggaggctggtgtctgatgaggccgtgaccaacggcctgagagatggcatcgtgtttgtgctgaagtgcctggacttcagcctggtggtgaatgtgaagaagatccccttcatcatcctgtctgaggagttcatcgaccccaagagccacaagtttgtgctgcggctgcagagcgagacctctgtgtag

SEQ ID NO: 175762 - DNA, 1566 bp, Artificial Sequence
  Description of Artificial Sequence: Synthetic coding sequence
atggacacagagagccagtacagcggctacagctacaagagcggccacagccgcagcagcaggaagcaccgggaccggcgggacagacacaggagcaagagcagagatggcggccgcggggacaagtctgtgaccatccaggcccctggagagcccctgctggacaatgaaagcaccagaggagatgaaagagatgacaactggggcgagaccaccaccgtggtgacaggcaccagcgagcacagcatcagccatgatgacctgaccagaattgccaaggacatggaggacagcgtgcccctggactgcagccgccacctgggcgtggccgccggggccaccctggccctgctgtccttcctgacccccctggccttcctgctgctgccccccctgctgtggagggaggagctggagccctgtggcacagcctgtgagggcctcttcatctctgtggccttcaagctgctgatcctgctgctgggctcctgggccctcttcttcagaagacccaaggccagcctgccccgggtgtttgtgctgcgggccctgctgatggtgctggtgttcctgctggtggtgtcctactggctgttctacggcgtgcgcatcctggatgcccgggagaggagctaccagggcgtggtgcagtttgctgtgtccctggtggatgccctgctgtttgtgcactacctggccgtggtgctgctggagctgcggcagctgcagccccagttcaccctgaaggtggtgcgcagcacagatggagccagccgcttctacaacgtgggccacctgagcatccagagggtggccgtgtggatcctggagaagtactaccatgacttccctgtgtacaacccagccctgctgaacctgcccaagtctgtgctggccaagaaggtgtctggcttcaaggtgtacagcctgggggaggagaacagcaccaacaacagcacaggccagagcagagctgtgattgctgctgctgccaggagaagagacaacagccacaatgagtactactatgaggaggccgagcacgagcggcgggtgaggaagagaagagcccggctggtggtggccgtggaggaggccttcacccacatcaagaggctgcaggaggaggagcagaagaacccccgggaggtgatggacccccgggaggccgcccaggccatctttgcctccatggcccgggccatgcagaagtacctgcggaccaccaagcagcagccctaccacaccatggagagcatcctgcagcacctggagttctgcatcacccatgacatgacccccaaggccttcctggagcgctacctggccgccggccccaccatccagtaccacaaggagcgctggctggccaagcagtggaccctggtgtctgaggagcctgtgaccaacggcctgaaggatggcatcgtgttcctgctgaagaggcaggacttcagcctggtggtgtccaccaagaaggtgcccttcttcaagctgtctgaggagtttgtggaccccaagagccacaagtttgtgatgaggctgcagagcgagacctctgtgtag

SEQ ID NO: 175763 - DNA, 1542 bp, Artificial Sequence
  Description of Artificial Sequence: Synthetic coding sequence
atgaccacccagctgcctgcctacgtggccatcctgctcttctacgtgtcccgggccagctgccaggacaccttcaccgctgctgtgtatgagcacgccgccatcctgcccaatgccaccctgacccctgtgtcccgggaggaggccctggccctgatgaacagaaacctggacatcctggagggcgccatcaccagcgctgctgaccagggcgcccacatcatcgtgaccccagaagatgccatctacggctggaacttcaacagagacagcctgtacccctacctggaggacatcccagaccctgaggtgaactggatcccctgcaacaacagaaacagatttggccagacccctgtgcaggagcggctgagctgcctggccaagaacaacagcatctacgtggtggccaacattggagacaagaagccctgtgacaccagtgacccccagtgccccccagatggccgctaccagtacaacacagatgtggtgtttgacagccagggcaagctggtggcccgctaccacaagcagaacctcttcatgggagagaaccagttcaacgtgcccaaggagcctgagatcgtgaccttcaacaccaccttcggcagctttggcatcttcacctgctttgacatcctcttccatgaccctgctgtgaccctggtgaaggacttccacgtggacaccatcgtgttccccacagcctggatgaatgtgctgccccacctgtctgctgtggagttccacagcgcctgggccatgggcatgagggtgaacttcctggccagcaacatccactaccccagcaagaagatgactggaagtggcatctatgcccccaacagcagccgggccttccactatgacatgaagacagaggagggcaagctgctgctgagccagctggacagccaccccagccacagcgctgtggtgaactggaccagctatgccagcagcattgaggccctgagcagcggcaacaaggagttcaagggcaccgtcttctttgatgagttcacctttgtgaagctgactggagtggccggcaactacacagtgtgccagaaggacctgtgctgccacctgagctacaagatgtctgagaacatccccaatgaggtgtatgccctgggcgcctttgatggcctgcacacagtggagggccgctactacctgcagatctgcaccctgctgaagtgcaagaccaccaacctgaacacctgtggggacagcgctgagacagccagcaccaggtttgagatgttcagcctgagcggcaccttcggcacccagtatgtgtttcctgaggtgctgctgtctgagaaccagctggcccctggagagttccaggtgtccacagatggccgcctcttcagcctgaagcccaccagcggccctgtgctgactgtgaccctgtttggccgcctgtatgagaaggactgggccagcaatgccagcagcggcctgacagcccaggcccgcatcatcatgctgattgtcatcgcccccatcgtgtgcagcctgtcctggtag

SEQ ID NO: 175764 - DNA, 1563 bp, Artificial Sequence
  Description of Artificial Sequence: Synthetic coding sequence
atggtgaccagcagcttccccatctctgtggccgtgtttgccctgatcaccctgcaggtgggcacccaggacagcttcatcgctgctgtgtatgaacatgctgtgatcctgcccaacaagacagagacccctgtgtcccaggaggatgccctgaacctgatgaatgaaaacatcgacatcctggagacagccatcaagcaggccgctgagcagggcgcccgcatcatcgtgaccccagaagatgccctgtatggctggaagttcacccgggagaccgtcttcccctacctggaggacatcccagacccccaggtgaactggatcccctgccaggacccccaccgcttcggccacacccctgtgcaggcccggctgagctgcctggccaaggacaacagcatctacgtgctggccaacctgggggacaagaagccctgcaacagccgggacagcacctgcccccccaacggctacttccagtacaacaccaacgtggtgtacaacacagagggcaagctggtggcccgctaccacaagtaccacctgtacagcgagccccagttcaacgtgcctgagaagccagagctggtgaccttcaacacagccttcggccgcttcggcatcttcacctgctttgacatcttcttctatgaccccggggtgaccctggtgaaggacttccacgtggacaccatcctcttccccacagcctggatgaatgtgctgcccctgctgacagccatcgagttccacagcgcctgggccatgggcatgggcgtgaacctgctggtggccaacacccaccacgtgtccctgaacatgactggaagtggcatctatgccccaaatggccccaaggtgtaccactatgacatgaagacagagctgggcaagctgctgctgtctgaggtggacagccaccccctgagcagcctggcctaccccacagctgtgaactggaatgcctatgccaccaccatcaagcccttccctgtgcagaagaacaccttccggggcttcatcagcagagatggcttcaacttcacagagctgtttgaaaatgccggcaacctgactgtgtgccagaaggagctgtgctgccacctgagctacaggatgctgcagaaggaggagaatgaggtgtatgtgctgggcgccttcaccggcctgcatggaagaagaagaagagagtactggcaggtgtgcaccctgctgaagtgcaagaccaccaacctgaccacctgtggccggcctgtggagacagccagcaccaggtttgagatgttcagcctgagcggcacctttggaacagaatatgtgtttcctgaggtgctgctgacagagatccacctgagccctgggaagtttgaggtgctgaaggatggccgcctggtgaacaagaatggcagcagcggccccatcctgactgtgtccctgtttggccgctggtacaccaaggacagcctgtacagcagctgtggcaccagcaacagcgccatcacctacctgctgatcttcatcctgctgatgatcatcgccctgcagaacatcgtgatgctgtag

SEQ ID NO: 175765 - DNA, 501 bp, Artificial Sequence
  Description of Artificial Sequence: Synthetic coding sequence
atggtgaccagcagcttccccatctctgtggccgtgtttgccctgatcaccctgcaggtgggcacccaggacagcttcatcgctgctgtgtatgaacatgctgtgatcctgcccaacaagacagagacccctgtgtcccaggaggatgccctgaacctgatgaatgaaaacatcgacatcctggagacagccatcaagcaggccgctgagcagggcgcccgcatcatcgtgaccccagaagatgccctgtatggctggaagttcacccgggagaccgtcttcccctacctggaggacatcccagacccccaggtgaactggatcccctgccaggacccccaccgcttcggccacacccctgtgcaggcccggctgagctgcctggccaaggacaacagcatctacgtgctggccaacctgggggacaagaagccctgcaacagccgggacagcacctgcccccccaacggctacttccagtacaacaccaacgtggtgtag

SEQ ID NO: 175766 - DNA, 1404 bp, Artificial Sequence
  Description of Artificial Sequence: Synthetic coding sequence
atgaatgaaaatattgacatcctggagacagccatcaagcaggccgctgagcagggcgcccgcatcatcgtgaccccagaagatgccctgtatggctggaagttcacccgggagaccgtcttcccctacctggaggacatcccagacccccaggtgaactggatcccctgccaggacccccacagatttggccacacccctgtgcaggcccggctgagctgcctggccaaggacaacagcatctacgtgctggccaacctgggggacaagaagccctgcaacagccgggacagcacctgccccccaaatggctacttccagtacaacaccaacgtggtgtacaacacagagggcaagctggtggcccgctaccacaagtaccacctgtacagcgagccccagttcaacgtgcctgagaagccagagctggtgaccttcaacacagccttcggccgcttcggcatcttcacctgctttgacatcttcttctatgaccccggggtgaccctggtgaaggacttccacgtggacaccatcctcttccccacagcctggatgaatgtgctgcccctgctgacagccatcgagttccacagcgcctgggccatgggcatgggcgtgaacctgctggtggccaacacccaccacgtgtccctgaacatgacaggcagcggcatctatgcccccaacggccccaaggtgtaccactatgacatgaagacagagctgggcaagctgctgctgtctgaggtggacagccaccccctgagcagcctggcctaccccacagctgtgaactggaatgcctatgccaccaccatcaagcccttccctgtgcagaagaacaccttccggggcttcatcagcagagatggcttcaacttcacagagctgtttgaaaatgccggcaacctgactgtgtgccagaaggagctgtgctgccacctgagctacaggatgctgcagaaggaggagaatgaggtgtatgtgctgggcgccttcaccggcctgcacggcagaagaagaagagagtactggcaggtgtgcaccctgctgaagtgcaagaccaccaacctgaccacctgtggccggcctgtggagacagccagcaccaggtttgagatgttcagcctgagcggcaccttcggcacagaatatgtgtttcctgaggtgctgctgacagagatccacctgagccctgggaagtttgaggtgctgaaggatggccgcctggtgaacaagaatggcagcagcggccccatcctgactgtgtccctgtttggccgctggtacaccaaggacagcctgtacagcagctgtggcaccagcaacagcgccatcacctacctgctgatcttcatcctgctgatgatcatcgccctgcagaacatcgtgatgctgtag

SEQ ID NO: 175767 - DNA, 309 bp, Artificial Sequence
  Description of Artificial Sequence: Synthetic coding sequence
atgaatgaaaatattgacatcctggagacagccatcaagcaggccgctgagcagggcgcccgcatcatcgtgaccccagaagatgccctgtatggctggaagttcacccgggagaccgtcttcccctacctggaggacatcccagacccccaggtgaactggatcccctgccaggacccccacagatttggccacacccctgtgcaggcccggctgagctgcctggccaaggacaacagcatctacgtgctggccaacctgggggacaagaagccctgcaacagccgggacagcacctgccccccatag

SEQ ID NO: 175768 - DNA, 306 bp, Artificial Sequence
  Description of Artificial Sequence: Synthetic coding sequence
atggtgaccagcagcttccccatctctgtggccgtgtttgccctgatcaccctgcaggtgggcacccaggacagcttcatcgctgctgtgtatgaacatgctgtgatcctgcccaacaagacagagacccctgtgtcccaggaggatgccctgaacctgatgaatgaaaacatcgacatcctggagacagccatcaagcaggccgctgagcagggcgcccgcatcatcgtgaccccagaagatgccctgtatggctggaagttcacccgggagaccgtcttcccctacctggaggacatcccctag

SEQ ID NO: 175769 - DNA, 2931 bp, Artificial Sequence
  Description of Artificial Sequence: Synthetic coding sequence
atggaggagaggaagcatgagaccatgaacccagcccacgtgctgtttgacagatttgtgcaggccaccacctgcaagggcaccctgaaggccttccaggagctgtgtgaccacctggagctgaagcccaaggactaccgctccttctaccacaagctgaagagcaagctgaactactggaaggccaaggccctgtgggccaagctggacaagaggggcagccacaaggactacaagaagggcaaggcctgcaccaacaccaagtgcctgatcatcggggccggcccctgtggcctgaggacagccatcgacctgagcctgctgggcgccaaggtggtggtgattgagaagagagatgccttcagcagaaataatgtgctgcacctgtggcccttcaccatccatgacctgcggggcctgggcgccaagaagttctacggcaagttctgtgccggggccatcgaccacatcagcatccggcagctgcagctgatcctgctgaaggtggccctgatcctgggcatcgagatccacgtgaatgtggagttccagggcctcatccagcccccagaggaccaggagaatgaaagaattggctggagggccctggtgcaccccaagacccaccctgtgtctgaatatgaatttgaggtgatcattggaggagatggaagaagaaacaccctggagggcttccggaggaaggagttccggggcaagctggccatcgccatcacagccaacttcatcaacagaaacaccacagctgaggccaaggtggaggagatcagcggcgtggccttcatcttcaaccagaagttcttccaggagctgcgggaggccaccggcatcgacctggagaacatcgtgtactacaaggatgacacccactactttgtgatgacagccaagaagcagagcctgctggacaagggcgtcatcctgcatgactatgctgacacagagctgctgctgagccgggagaatgtggaccaggaggccctgctgtcctatgcccgggaggccgctgacttcagcacccagcagcagctgcccagcctggactttgccatcaaccactacggccagccagatgtggccatgtttgacttcacctgcatgtatgcctctgaaaatgctgccctggtgcgggagcagaatggccaccagctgctggtggccctggtgggggacagcctgctggagcccttctggcccatgggcactggaattgcccggggcttcctggccgccatggattctgcctggatggtgcgctcctggagcctgggcaccagccccctggaggtgctggccgagcgggagagcatctaccgcctgctgccccagaccaccccagaaaatgtgtccaagaacttcagccagtacagcattgatcctgtgacccgctaccccaacatcaacgtgaacttcctgcggcccagccaggtgcgccacctgtatgacaccggggagaccaaggacatccacctggagatggagagcctggtgaacagcaggaccacccccaagctgaccagaaatgaatctgtggcccggagcagcaagctgctgggctggtgccagaggcagacagatggctacgccggcgtgaatgtgacagacctgaccatgtcctggaagagcggcctggccctgtgtgccatcatccaccgctacagaccagacctgattgactttgacagcctggatgagcagaatgtggagaagaacaaccagctggcctttgatattgctgagaaggagctgggcatcagccccatcatgaccgggaaggagatggcctctgtgggggagccagacaagctgtccatggtgatgtacctgacccagttctatgagatgttcaaggacagcctgcccagcagtgacaccctggacctgaatgctgaggagaaggctgtgctgattgccagcaccaggagccccatctccttcctgagcaagctgggccagaccatcagcaggaagaggagccccaaggacaagaaggagaaggacctggatggagctgggaagaggaggaagaccagccagagcgaggaggaggaggccccccggggccacagaggagagcggcccaccctggtgtccaccctgacagacaggaggatggatgtggccgtgggcaaccagaacaaggtgaagtacatggccacccagctgctggccaagtttgaagaaaatgccccagcccagagcatcggcatccggcggcagctgacccaggagcggggggccagccagcccagctgctgcctgcccggccaggtgcggcctgcccccaccccccgctggaagcagggctccatgaagaaggagttcccccagaacctgggcggcagtgacacctgctacttctgccagaagagggtgtatgtgatggagcggctgtctgctgagggcaagttcttccacaggagctgcttcaagtgtgagtactgtgccaccaccctgcggctgagcgcctatgcctatgacattgaagatggcaagttctactgcaagccccactactgctaccgcctgagcggctacgcccagaggaagaggcctgctgtggcccccctgagcggcaaggaggccaagggccccctgcaggatggagccaccacagatgccaacggccgggccaatgctgtggccagcagcacagagaggaccccaggcagcggcgtgaatggcctggaggagcccagcatcgccaagaggctgcggggcaccccagagagaattgagctggagaactaccgcctgagcctgcggcaggccgaggccctgcaggaggtgcctgaggagacccaggccgagcacaacctgagctctgtgctggacacaggagcagaagaagatgtggccagccgcagcgccaggagagctgctggccggcccccagccacccggccctag

SEQ ID NO: 175770 - DNA, 825 bp, Artificial Sequence
  Description of Artificial Sequence: Synthetic coding sequence
atgatcatcagccacttccccaagtgtgtggccgtgtttgccctgctggccctgtctgtgggcgccctggacaccttcatcgctgctgtgtatgaacatgctgtgatcctgcccaacagaacagagacccctgtgtccaaggaggaggccctgctgctgatgaacaagaacattgatgtgctggagaaggctgtgaagctggccgccaagcagggcgcccacatcatcgtgaccccagaagatggcatctacggctggatcttcacccgggagagcatctacccctacctggaggacatcccagaccccggggtgaactggatcccctgccgggacccctggaggtttggaaacacccctgtgcagcagaggctgagctgcctggccaaggacaacagcatctacgtggtggccaacatcggggacaagaagccctgcaatgccagtgacagccagtgccccccagatggccgctaccagtacaacacagatgtggtgtttgacagccagggcaagctgctggcccgctaccacaagtacaacctgtttgcccctgagatccagtttgacttccccaaggacagcgagctggtgacctttgacaccccatttgggaagtttggcatcttcacctgctttgacatcttcagccatgaccctgctgtggtggtggtggatgagttccagctgacagccttcagcaccccccagcacggcaccacccgctgccccagcagccgcctcttccccagcatccagcacggcccccggccctgggagagcatctacctgctgcagatccccaccaccccagcctgcacctag

SEQ ID NO: 175771 - DNA, 444 bp, Artificial Sequence
  Description of Artificial Sequence: Synthetic coding sequence
atgatcatcagccacttccccaagtgtgtggccgtgtttgccctgctggccctgtctgtgggcgccctggacaccttcatcgctgctgtgtatgaacatgctgtgatcctgcccaacagaacagagacccctgtgtccaaggaggaggccctgctgctgatgaacaagaacattgatgtgctggagaaggctgtgaagctggccgccaagcagggcgcccacatcatcgtgaccccagaagatggcatctacggctggatcttcacccgggagagcatctacccctacctggaggacatcccagaccccggggtgaactggatcccctgccgggacccctggaggaagagcaagaagatgaatgaacctgtgtccaaggagctgtgctaccactgccacagcgagtgcaaccagtatggccagtggaagctgtaccgcacctag

SEQ ID NO: 175772 - DNA, 624 bp, Artificial Sequence
  Description of Artificial Sequence: Synthetic coding sequence
atgatcatcagccacttccccaagtgtgtggccgtgtttgccctgctggccctgtctgtgggcgccctggacaccttcatcgctgctgtgtatgaacatgctgtgatcctgcccaacagaacagagacccctgtgtccaaggaggaggccctgctgctgatgaacaagaacattgatgtgctggagaaggctgtgaagctggccgccaagcagggcgcccacatcatcgtgaccccagaagatggcatctacggctggatcttcacccgggagagcatctacccctacctggaggacatcccagaccccggggtgaactggatcccctgccgggacccctggaggtttggaaacacccctgtgcagcagaggctgagctgcctggccaaggacaacagcatctacgtggtggccaacatcggggacaagaagccctgcaatgccagtgacagccagtgccccccagatggccgctaccagtacaacacagatgtggtgtttgacagccagggcaagctgctggcccgctaccacaagggcgtggagagcaccccccagaagcagagccgctgcaccaccatgacctggaagcagagggtggtgtcctgctgctaccagaactag

SEQ ID NO: 175773 - DNA, 561 bp, Artificial Sequence
  Description of Artificial Sequence: Synthetic coding sequence
atgagccccaagccccgggccagcggccccccagccaaggccacagaagctgggaagaggaagagcagcagccagcccagccccagcgaccccaagaagaagaccaccaaggtggccaagaagggcaaggctgtgcggcggggcagaagaggcaagaagggagctgccaccaagatggctgctgtgacagcccctgaggccgagagcgccccagctgcccctggccccagcgaccagcccagccaggagctgccccagcacgagctgcccccagaggagcctgtgtctgagggcacccagcacgaccccctgagccaggaggccgagctggaggagcccctgagccaggagagcgaggtggaggagcccctgagccaggagagccaggtggaggagcccctgagccaggagagcgaggtggaggagcccctgagccaggagagccaggtggaggagcccctgagccaggagagcgagatggaggagcccctgagccaggagagccaggtggaggagccccccagccaggagagcgagatggaggagctgcccagcgtgtag

SEQ ID NO: 175774 - DNA, 621 bp, Artificial Sequence
  Description of Artificial Sequence: Synthetic coding sequence
atgagccccaagccccgggccagcggccccccagccaaggccacagaagctgggaagaggaagagcagcagccagcccagccccagcgaccccaagaagaagaccaccaaggtggccaagaagggcaaggctgtgcggcggggcagaagaggcaagaagggagctgccaccaagatggctgctgtgacagcccctgaggccgagagcgccccagctgcccctggccccagcgaccagcccagccaggagctgccccagcacgagctgcccccagaggagcctgtgtctgagggcacccagcacgaccccctgagccaggaggccgagctggaggagcccctgagccaggagagcgaggtggaggagcccctgagccaggagagccaggtggaggagcccctgagccaggagagcgaggtggaggagcccctgagccaggagagccaggtggaggagcccctgagccaggagagcgaggtggaggagcccctgagccaggagagccaggtggaggagcccctgagccaggagagcgagatggaggagcccctgagccaggagagccaggtggaggagccccccagccaggagagcgagatggaggagctgcccagcgtgtag

SEQ ID NO: 175775 - DNA, 420 bp, Artificial Sequence
  Description of Artificial Sequence: Synthetic coding sequence
atgagccccaagccccgggccagcggccccccagccaaggccacagaagctgggaagaggaagagcagcagccagcccagccccagcgaccccaagaagaagaccaccaaggtggccaagaagggcaaggctgtgcggcggggcagaagaggcaagaagggagctgccaccaagatggctgctgtgacagcccctgaggccgagagcgccccagctgcccctggccccagcgaccagcccagccaggagctgccccagcacgagctgcccccagaggagcctgtgtctgagggcacccagcacgaccccctgagccaggagagcgaggtggaggagcccctgagccaggagagcgaggtggaggagcccctgactgtgtggatggccagcttcagccctgtgtctgagagcacagactag

SEQ ID NO: 175776 - DNA, 561 bp, Artificial Sequence
  Description of Artificial Sequence: Synthetic coding sequence
atgagccccaagccccgggccagcggccccccagccaaggccacagaagctgggaagaggaagagcagcagccagcccagccccagcgaccccaagaagaagaccaccaaggtggccaagaagggcaaggctgtgcggcggggcagaagaggcaagaagggagctgccaccaagatggctgctgtgacagcccctgaggccgagagcggccctgctgcccctggccccagcgaccagcccagccaggagctgccccagcacgagctgcccccagaggagcctgtgtctgagggcacccagcacgaccccctgagccaggagagcgagctggaggagcccctgagccaggagagcgaggtggaggagcccctgagccaggagagccaggtggaggagcccctgagccaggagagcgaggtggaggagcccctgagccaggagagccaggtggaggagcccctgagccaggagagcgaggtggaggagcccctgagccaggagagccaggtggaggagcccctgagccaggagagcgagatggaggagctgcccagcgtgtag

SEQ ID NO: 175777 - DNA, 501 bp, Artificial Sequence
  Description of Artificial Sequence: Synthetic coding sequence
atgagccccaagccccgggccagcggccccccagccaaggccacagaagctgggaagaggaagagcagcagccagcccagccccagcgaccccaagaagaagaccaccaaggtggccaagaagggcaaggctgtgcggcggggcagaagaggcaagaagggagctgccaccaagatggctgctgtgacagcccctgaggccgagagcggccctgctgcccctggccccagcgaccagcccagccaggagctgccccagcacgagctgcccccagaggagcctgtgtctgagggcacccagcacgaccccctgagccaggagagcgagctggaggagcccctgagccaggagagcgaggtggaggagcccctgagccaggagagccaggtggaggagcccctgagccaggagagcgaggtggaggagcccctgagccaggagagccaggtggaggagcccctgagccaggagagcgagatggaggagctgcccagcgtgtag

SEQ ID NO: 175778 - DNA, 378 bp, Artificial Sequence
  Description of Artificial Sequence: Synthetic coding sequence
atgagccccaagccccgggccagcggccccccagccaaggccacagaagctgggaagaggaagagcagcagccagcccagccccagcgaccccaagaagaagaccaccaaggtggccaagaagggcaaggctgtgcggcggggcagaagaggcaagaagggagctgccaccaagatggctgctgtgacagcccctgaggccgagagcggccctgctgcccctggccccagcgaccagcccagccaggagctgccccagcacgagctgcccccagaggagcctgtgtctgagggcacccagcacgaccccctgagccaggagagcgagctggaggagcccctgagccaggagaggcctgccacccccctgagcccctag

SEQ ID NO: 175779 - DNA, 378 bp, Artificial Sequence
  Description of Artificial Sequence: Synthetic coding sequence
atgagccccaagccccgggccagcggccccccagccaaggccaaggagaccgggaagaggaagagcagcagccagcccagccccagcggccccaagaagaagaccaccaaggtggccgagaagggggaggccgtgcggggcggcagaagaggcaagaagggagctgccaccaagatggctgctgtgacagcccctgaggccgagagcggccctgctgcccctggccccagcgaccagcccagccaggagctgccccagcacgagctgcccccagaggagcctgtgtctgagggcacccagcacgaccccctgagccaggagagcgagctggaggagcccctgagcaagggccggcccagcacccccctgagcccctag

SEQ ID NO: 175780 - DNA, 2220 bp, Artificial Sequence
  Description of Artificial Sequence: Synthetic coding sequence
atgcctgggaagatggtggtgatcctgggcgccagcaacatcctgtggatcatgtttgctgccagccaggccttcaagattgagaccaccccagagagccgctacctggcccagattggagacagcgtgtccctgacctgcagcaccaccggctgtgagagccccttcttctcctggaggacccagattgacagccccctgaatggcaaggtgaccaatgaaggcaccaccagcaccctgaccatgaaccctgtgtcctttggaaatgagcacagctacctgtgcacagccacctgtgagagcaggaagctggagaagggcatccaggtggagatctacagcttccccaaggaccctgagatccacctgagcggccccctggaggccggcaagcccatcaccgtgaagtgcagcgtggctgatgtgtacccctttgaccggctggagattgacctgctgaagggggaccacctgatgaagagccaggagttcctggaggatgctgacaggaagagcctggagaccaagagcctggaggtgaccttcacccctgtgattgaagatattggcaaggtgctggtgtgccgggccaagctgcacattgatgagatggacagcgtgcccaccgtgcggcaggccgtgaaggagctgcaggtgtacatcagccccaagaacacagtcatctctgtgaaccccagcaccaagctgcaggagggcggctctgtgaccatgacctgcagcagcgagggcctgcctgcccctgagatcttctggagcaagaagctggacaatggaaacctgcagcacctgtctggaaatgccaccctgaccctgattgccatgaggatggaggacagcggcatctacgtgtgtgaaggagtgaacctgattggcaagaacaggaaggaggtggagctgattgtgcaggagaagcccttcaccgtggagatcagccctggccccagaattgctgcccagattggagacagcgtgatgctgacctgcagcgtgatgggctgtgagagccccagcttctcctggaggacccagattgacagccccctgagcggcaaggtgcgctctgagggcaccaacagcaccctgaccctgagccctgtgtcctttgaaaatgagcacagctacctgtgcaccgtgacctgtggccacaagaagctggagaagggcatccaggtggagctgtacagcttcccccgggaccctgagattgagatgtctgggggcctggtgaatggcagctctgtgacagtgtcctgcaaggtgcccagcgtgtaccccctggaccggctggagattgagctgctgaagggggagaccatcctggagaacatcgagttcctggaggacacagacatgaagagcctggagaacaagagcctggagatgaccttcatccccaccattgaagatactgggaaggccctggtgtgccaggccaagctgcacattgatgacatggagtttgagcccaagcagaggcagagcacccagaccctgtatgtgaatgtggccccccgggacaccaccgtgctggtgagccccagcagcatcctggaggagggcagctctgtgaacatgacctgcctgagccagggcttccctgcccccaagatcctgtggagccggcagctgcccaacggggagctgcagcccctgtctgaaaatgccaccctgaccctcatcagcaccaagatggaggacagcggcgtgtacctgtgtgagggcatcaaccaggccggccgcagcaggaaggaggtggagctgatcatccaggtgacccccaaggacatcaagctgacagccttccccagcgagagcgtgaaggagggggacaccgtcatcatcagctgcacctgtggaaatgtgcctgagacctggatcatcctgaagaagaaggccgagactggagacacagtgctgaagagcattgatggagcctacaccatcaggaaggcccagctgaaggatgctggggtgtatgaatgtgagagcaagaacaaggtgggcagccagctgcggagcctgaccctggatgtgcagggccgggagaacaacaaggactacttcagccctgagctgctggtgctgtactttgccagcagcctcatcatcccagccatcggcatgatcatctactttgccaggaaggccaacatgaagggcagctacagcctggtggaggcccagaagagcaaggtgtag

SEQ ID NO: 175781 - DNA, 1944 bp, Artificial Sequence
  Description of Artificial Sequence: Synthetic coding sequence
atgcctgggaagatggtggtgatcctgggcgccagcaacatcctgtggatcatgtttgctgccagccaggccttcaagattgagaccaccccagagagccgctacctggcccagattggagacagcgtgtccctgacctgcagcaccaccggctgtgagagccccttcttctcctggaggacccagattgacagccccctgaatggcaaggtgaccaatgaaggcaccaccagcaccctgaccatgaaccctgtgtcctttggaaatgagcacagctacctgtgcacagccacctgtgagagcaggaagctggagaagggcatccaggtggagatctacagcttccccaaggaccctgagatccacctgagcggccccctggaggccggcaagcccatcaccgtgaagtgcagcgtggctgatgtgtacccctttgaccggctggagattgacctgctgaagggggaccacctgatgaagagccaggagttcctggaggatgctgacaggaagagcctggagaccaagagcctggaggtgaccttcacccctgtgattgaagatattggcaaggtgctggtgtgccgggccaagctgcacattgatgagatggacagcgtgcccaccgtgcggcaggccgtgaaggagctgcaggtgtacatcagccccaagaacacagtcatctctgtgaaccccagcaccaagctgcaggagggcggctctgtgaccatgacctgcagcagcgagggcctgcctgcccctgagatcttctggagcaagaagctggacaatggaaacctgcagcacctgtctggaaatgccaccctgaccctgattgccatgaggatggaggacagcggcatctacgtgtgtgaaggagtgaacctgattggcaagaacaggaaggaggtggagctgattgtgcaggccttcccccgggaccctgagattgagatgtctgggggcctggtgaatggcagctctgtgacagtgtcctgcaaggtgcccagcgtgtaccccctggaccggctggagattgagctgctgaagggggagaccatcctggagaacatcgagttcctggaggacacagacatgaagagcctggagaacaagagcctggagatgaccttcatccccaccattgaagatactgggaaggccctggtgtgccaggccaagctgcacattgatgacatggagtttgagcccaagcagaggcagagcacccagaccctgtatgtgaatgtggccccccgggacaccaccgtgctggtgagccccagcagcatcctggaggagggcagctctgtgaacatgacctgcctgagccagggcttccctgcccccaagatcctgtggagccggcagctgcccaacggggagctgcagcccctgtctgaaaatgccaccctgaccctcatcagcaccaagatggaggacagcggcgtgtacctgtgtgagggcatcaaccaggccggccgcagcaggaaggaggtggagctgatcatccaggtgacccccaaggacatcaagctgacagccttccccagcgagagcgtgaaggagggggacaccgtcatcatcagctgcacctgtggaaatgtgcctgagacctggatcatcctgaagaagaaggccgagactggagacacagtgctgaagagcattgatggagcctacaccatcaggaaggcccagctgaaggatgctggggtgtatgaatgtgagagcaagaacaaggtgggcagccagctgcggagcctgaccctggatgtgcagggccgggagaacaacaaggactacttcagccctgagctgctggtgctgtactttgccagcagcctcatcatcccagccatcggcatgatcatctactttgccaggaaggccaacatgaagggcagctacagcctggtggaggcccagaagagcaaggtgtag

SEQ ID NO: 175782 - DNA, 1623 bp, Artificial Sequence
  Description of Artificial Sequence: Synthetic coding sequence
atgcctgggaagatggtggtgatcctgggcgccagcaacatcctgtggatcatgtttgctgccagccaggccttcaagattgagaccaccccagagagccgctacctggcccagattggagacagcgtgtccctgacctgcagcaccaccggctgtgagagccccttcttctcctggaggacccagattgacagccccctgaatggcaaggtgaccaatgaaggcaccaccagcaccctgaccatgaaccctgtgtcctttggaaatgagcacagctacctgtgcacagccacctgtgagagcaggaagctggagaagggcatccaggtggagatctacagcttccccaaggaccctgagatccacctgagcggccccctggaggccggcaagcccatcaccgtgaagtgcagcgtggctgatgtgtacccctttgaccggctggagattgacctgctgaagggggaccacctgatgaagagccaggagttcctggaggatgctgacaggaagagcctggagaccaagagcctggaggtgaccttcacccctgtgattgaagatattggcaaggtgctggtgtgccgggccaagctgcacattgatgagatggacagcgtgcccaccgtgcggcaggccgtgaaggagctgcaggtgtacatcagccccaagaacacagtcatctctgtgaaccccagcaccaagctgcaggagggcggctctgtgaccatgacctgcagcagcgagggcctgcctgcccctgagatcttctggagcaagaagctggacaatggaaacctgcagcacctgtctggaaatgccaccctgaccctgattgccatgaggatggaggacagcggcatctacgtgtgtgaaggagtgaacctgattggcaagaacaggaaggaggtggagctgattgtgcaggtggccccccgggacaccaccgtgctggtgagccccagcagcatcctggaggagggcagctctgtgaacatgacctgcctgagccagggcttccctgcccccaagatcctgtggagccggcagctgcccaatggagagctgcagcccctgtctgaaaatgccaccctgaccctcatcagcaccaagatggaggacagcggcgtgtacctgtgtgagggcatcaaccaggccggccgcagcaggaaggaggtggagctgatcatccaggtgacccccaaggacatcaagctgacagccttccccagcgagagcgtgaaggagggggacaccgtcatcatcagctgcacctgtggaaatgtgcctgagacctggatcatcctgaagaagaaggccgagaccggggacacagtgctgaagagcattgatggagcctacaccatcaggaaggcccagctgaaggatgctggggtgtatgaatgtgagagcaagaacaaggtgggcagccagctgcggagcctgaccctggatgtgcagggccgggagaacaacaaggactacttcagccctgagctgctggtgctgtactttgccagcagcctcatcatcccagccatcggcatgatcatctactttgccaggaaggccaacatgaagggcagctacagcctggtggaggcccagaagagcaaggtgtag

SEQ ID NO: 175783 - DNA, 2034 bp, Artificial Sequence
  Description of Artificial Sequence: Synthetic coding sequence
atgcctgggaagatggtggtgatcctgggcgccagcaacatcctgtggatcatgtttgctgccagccaggccttcaagattgagaccaccccagagagccgctacctggcccagattggagacagcgtgtccctgacctgcagcaccaccggcagcttccccaaggaccctgagatccacctgagcggccccctggaggccggcaagcccatcaccgtgaagtgcagcgtggctgatgtgtacccctttgaccggctggagattgacctgctgaagggggaccacctgatgaagagccaggagttcctggaggatgctgacaggaagagcctggagaccaagagcctggaggtgaccttcacccctgtgattgaagatattggcaaggtgctggtgtgccgggccaagctgcacattgatgagatggacagcgtgcccaccgtgcggcaggccgtgaaggagctgcaggtgtacatcagccccaagaacacagtcatctctgtgaaccccagcaccaagctgcaggagggcggctctgtgaccatgacctgcagcagcgagggcctgcctgcccctgagatcttctggagcaagaagctggacaatggaaacctgcagcacctgtctggaaatgccaccctgaccctgattgccatgaggatggaggacagcggcatctacgtgtgtgaaggagtgaacctgattggcaagaacaggaaggaggtggagctgattgtgcaggagaagcccttcaccgtggagatcagccctggccccagaattgctgcccagattggagacagcgtgatgctgacctgcagcgtgatgggctgtgagagccccagcttctcctggaggacccagattgacagccccctgagcggcaaggtgcgctctgagggcaccaacagcaccctgaccctgagccctgtgtcctttgaaaatgagcacagctacctgtgcaccgtgacctgtggccacaagaagctggagaagggcatccaggtggagctgtacagcttcccccgggaccctgagattgagatgtctgggggcctggtgaatggcagctctgtgacagtgtcctgcaaggtgcccagcgtgtaccccctggaccggctggagattgagctgctgaagggggagaccatcctggagaacatcgagttcctggaggacacagacatgaagagcctggagaacaagagcctggagatgaccttcatccccaccattgaagatactgggaaggccctggtgtgccaggccaagctgcacattgatgacatggagtttgagcccaagcagaggcagagcacccagaccctgtatgtgaatgtggccccccgggacaccaccgtgctggtgagccccagcagcatcctggaggagggcagctctgtgaacatgacctgcctgagccagggcttccctgcccccaagatcctgtggagccggcagctgcccaacggggagctgcagcccctgtctgaaaatgccaccctgaccctcatcagcaccaagatggaggacagcggcgtgtacctgtgtgagggcatcaaccaggccggccgcagcaggaaggaggtggagctgatcatccaggtgacccccaaggacatcaagctgacagccttccccagcgagagcgtgaaggagggggacaccgtcatcatcagctgcacctgtggaaatgtgcctgagacctggatcatcctgaagaagaaggccgagactggagacacagtgctgaagagcattgatggagcctacaccatcaggaaggcccagctgaaggatgctggggtgtatgaatgtgagagcaagaacaaggtgggcagccagctgcggagcctgaccctggatgtgcagggccgggagaacaacaaggactacttcagccctgagctgctggtgctgtactttgccagcagcctcatcatcccagccatcggcatgatcatctactttgccaggaaggccaacatgaagggcagctacagcctggtggaggcccagaagagcaaggtgtag

SEQ ID NO: 175784 - DNA, 1566 bp, Artificial Sequence
  Description of Artificial Sequence: Synthetic coding sequence
atggaggccaactggacagccttcctgttccaggcccacgaggccagccaccaccagcagcaggccgcccagaacagcctgctgcccctgctgagcagcgctgtggagcccccagaccagaagcccctgctgcccatccccatcacccagaagccccagggcgcccctgagaccctgaaggatgccatcggcatcaagaaggagaagcccaagaccagctttgtgtgcacctactgcagcaaggccttccgggacagctaccacctgcggagacatgagagctgccacacaggcatcaagctggtgtcccggcccaagaagacccccaccaccgtggtgcccctcatcagcaccatcgccggggacagcagcaggaccagcctggtgtccaccatcgccggcatcctgagcacagtgaccaccagcagcagcggcaccaaccccagcagcagcgccagcaccacagccatgcctgtgacccagagcgtgaagaagcccagcaagcctgtgaagaagaaccacgcctgtgagatgtgtgggaaggccttcagagatgtgtaccacctgaacagacacaagctgagccacagtgatgagaagccctttgaatgtcccatctgcaaccagcgcttcaagaggaaggacaggatgacctaccacgtgcgcagccatgagggcggcatcaccaagccctacacctgcagcgtgtgtgggaagggcttcagcaggccagaccacctgagctgccacgtgaagcacgtgcacagcacagagcggcccttcaagtgccagacctgcacagctgcctttgccaccaaggaccggctgcggacccacatggtgagacatgagggcaaggtgtcctgcaacatctgtgggaagctgctgtctgctgcctacatcaccagccacctgaagacccacggccagagccagagcatcaactgcaacacctgcaagcagggcatcagcaagacctgcatgtctgaggagaccagcaaccagaagcagcagcagcagcagcagcagcagcagcagcagcagcagcagcagcagcagcagcacgtgacctcctggccaggcaagcaggtggagaccctgcggctgtgggaggaggccgtgaaggccaggaagaaggaggccgccaacctgtgccagaccagcacagctgccaccacccctgtgaccctgaccacccccttcagcatcaccagctctgtgagcagcggcaccatgagcaaccctgtgacagtggccgccgccatgtccatgaggagccctgtgaatgtgagcagcgctgtgaacatcaccagccccatgaacatcggccaccctgtgaccatcaccagccccctgtccatgaccagccccctgaccctgaccacccctgtgaacctgcccacccctgtgacagcccctgtgaacatcgcccaccctgtgaccatcaccagccccatgaacctgcccacccccatgaccctggccgcccccctgaacatcgccatgaggcctgtggagagcatgcccttcctgccccaggccctgcccaccagccccccctggtag

SEQ ID NO: 175785 - DNA, 1566 bp, Artificial Sequence; identical to SEQ ID NO: 175784
  Description of Artificial Sequence: Synthetic coding sequence

SEQ ID NO: 175786 - DNA, 1374 bp, Artificial Sequence
  Description of Artificial Sequence: Synthetic coding sequence
atgaggcctcccagccccctgcctgcccgctggctgtgtgtgctggccggggccctggcctgggccctgggccctgctgggggccaggccgcccggctgcaggaggagtgtgactatgtgcagatgattgaggtgcagcacaagcagtgcctggaggaggcccagctggagaatgagaccatcggctgcagcaagatgtgggacaacctgacctgctggccagccaccccccggggccaggtggtggtgctggcctgccccctcatcttcaagctgttcagcagcatccagggcagaaatgtgagccgcagctgcacagatgagggctggacccacctggagcccggcccctaccccatcgcctgtggcctggatgacaaggccgccagcctggatgagcagcagaccatgttttatggctctgtgaagacaggctacaccatcggctacggcctgagcctggccaccctgctggtggccacagccatcctgagcctcttcaggaagctgcactgcaccaggaactacatccacatgcacctgttcatctccttcatcctgcgggctgctgctgtgttcatcaaggacctggccctgtttgacagcggggagagtgaccagtgcagcgagggctctgtgggctgcaaggccgccatggtgttcttccagtactgtgtgatggccaacttcttctggctgctggtggagggcctgtacctgtacaccctgctggccgtgtccttcttcagcgagaggaagtacttctggggctacatcctgattggctggggcgtgcccagcaccttcaccatggtgtggaccatcgcccgcatccactttgaagattatggctgctgggacaccatcaacagcagcctgtggtggatcatcaagggccccatcctgaccagcatcctggtgaacttcatcctcttcatctgcatcatccgcatcctgctgcagaagctgcggcccccagacatcaggaagagtgacagcagcccctacagccggctggcccggagcaccctgctgctgatccccctgtttggagtgcactacatcatgtttgccttcttcccagacaacttcaagccagaggtgaagatggtgtttgagctggtggtgggcagcttccagggctttgtggtggccatcctgtactgcttcctgaatggagaggtgcaggccgagctgcggaggaagtggaggcgctggcacctgcagggcgtgctgggctggaaccccaagtaccgccaccccagcggcggcagcaatggagccacctgcagcacccaggtgtccatgctgaccagggtgtcccctggggcccggcgcagcagcagcttccaggccgaggtgtccctggtgtag

SEQ ID NO: 175787 - DNA, 1251 bp, Artificial Sequence
  Description of Artificial Sequence: Synthetic coding sequence
atgattgaggtgcagcacaagcagtgcctggaggaggcccagctggagaatgagaccatcggctgcagcaagatgtgggacaacctgacctgctggccagccaccccccggggccaggtggtggtgctggcctgccccctcatcttcaagctgttcagcagcatccagggcagaaatgtgagccgcagctgcacagatgagggctggacccacctggagcccggcccctaccccatcgcctgtggcctggatgacaaggccgccagcctggatgagcagcagaccatgttctacggctctgtgaagacaggctacaccatcggctacggcctgagcctggccaccctgctggtggccacagccatcctgagcctcttcaggaagctgcactgcaccaggaactacatccacatgcacctgttcatctccttcatcctgcgggctgctgctgtgttcatcaaggacctggccctgtttgattctggagagagtgaccagtgcagcgagggctctgtgggctgcaaggccgccatggtgttcttccagtactgtgtgatggccaacttcttctggctgctggtggagggcctgtacctgtacaccctgctggccgtgtccttcttcagcgagaggaagtacttctggggctacatcctgattggctggggcgtgcccagcaccttcaccatggtgtggaccatcgcccgcatccactttgaggactatggctgctgggacaccatcaacagcagcctgtggtggatcatcaagggccccatcctgaccagcatcctggtgaacttcatcctcttcatctgcatcatccgcatcctgctgcagaagctgcggcccccagacatcaggaagagtgacagcagcccctacagccggctggcccggagcaccctgctgctgatccccctgtttggagtgcactacatcatgtttgccttcttcccagacaacttcaagccagaggtgaagatggtgtttgagctggtggtgggcagcttccagggctttgtggtggccatcctgtactgcttcctgaatggagaggtgcaggccgagctgcggaggaagtggaggcgctggcacctgcagggcgtgctgggctggaaccccaagtaccgccaccccagcggcggcagcaatggagccacctgcagcacccaggtgtccatgctgaccagggtgtcccctggggcccggcgcagcagcagcttccaggccgaggtgtccctggtgtag

SEQ ID NO: 175788 - DNA, 744 bp, Artificial Sequence
  Description of Artificial Sequence: Synthetic coding sequence
atgacccggcagagggtgtggatgcgctgggccgtgcggcagccctggagcttcagcaacatcgtgtcctggctgaccagcagcggctgctggtggagggccagcacctgcaccccctgcctgcccagccccagcagcctgagcggcagcaccagcggcggcgtgcccagcaccttcaccatggtgtggaccatcgcccgcatccactttgaagattatggctgctgggacaccatcaacagcagcctgtggtggatcatcaagggccccatcctgaccagcatcctggtgaacttcatcctcttcatctgcatcatccgcatcctgctgcagaagctgcggcccccagacatcaggaagagtgacagcagcccctacagccggctggcccggagcaccctgctgctgatccccctgtttggagtgcactacatcatgtttgccttcttcccagacaacttcaagccagaggtgaagatggtgtttgagctggtggtgggcagcttccagggctttgtggtggccatcctgtactgcttcctgaatggagaggtgcaggccgagctgcggaggaagtggaggcgctggcacctgcagggcgtgctgggctggaaccccaagtaccgccaccccagcggcggcagcaatggagccacctgcagcacccaggtgtccatgctgaccagggtgtcccctggggcccggcgcagcagcagcttccaggccgaggtgtccctggtgtag

SEQ ID NO: 175789 - DNA, 1230 bp, Artificial Sequence
  Description of Artificial Sequence: Synthetic coding sequence
atgagagctggaagaagaccccggctgggcccctgggccggcggctgcagcaagatgtgggacaacctgacctgctggccagccaccccccggggccaggtggtggtgctggcctgccccctcatcttcaagctgttcagcagcatccagggcagaaatgtgagccgcagctgcacagatgagggctggacccacctggagcccggcccctaccccatcgcctgtggcctggatgacaaggccgccagcctggatgagcagaccatgttttatggctctgtgaagacaggctacaccatcggctacggcctgagcctggccaccctgctggtggccacagccatcctgagcctcttcaggaagctgcactgcaccaggaactacatccacatgcacctgttcatctccttcatcctgcgggctgctgctgtgttcatcaaggacctggccctgtttgacagcggggagagtgaccagtgcagcgagggctctgtgggctgcaaggccgccatggtgttcttccagtactgtgtgatggccaacttcttctggctgctggtggagggcctgtacctgtacaccctgctggccgtgtccttcttcagcgagaggaagtacttctggggctacatcctgattggctggggcgtgcccagcaccttcaccatggtgtggaccatcgcccgcatccactttgaagattatggctgctgggacaccatcaacagcagcctgtggtggatcatcaagggccccatcctgaccagcatcctggtgaacttcatcctcttcatctgcatcatccgcatcctgctgcagaagctgcggcccccagacatcaggaagagtgacagcagcccctacagccggctggcccggagcaccctgctgctgatccccctgtttggagtgcactacatcatgtttgccttcttcccagacaacttcaagccagaggtgaagatggtgtttgagctggtggtgggcagcttccagggctttgtggtggccatcctgtactgcttcctgaatggagaggtgcaggccgagctgcggaggaagtggaggcgctggcacctgcagggcgtgctgggctggaaccccaagtaccgccaccccagcggcggcagcaatggagccacctgcagcacccaggtgtccatgctgaccagggtgtcccctggggcccggcgcagcagcagcttccaggccgaggtgtccctggtgtag

SEQ ID NO: 175790 - DNA, 1317 bp, Artificial Sequence
  Description of Artificial Sequence: Synthetic coding sequence
atgaggaccctgctgcccccagccctgctgacctgctggctgctggcccctgtgaacagcatccaccctgagtgccgcttccacctggagatccaggaggaggagaccaagtgtgccgagctgctgcggagccagacagagaagcacaaggcctgcagcggcgtgtgggacaacatcacctgctggaggcctgccaacgtgggggagaccgtgacagtgccctgccccaaggtgttcagcaacttctacagcaaggccggcaacatcagcaagaactgcaccagtgatggctggagcgagaccttcccagactttgtggatgcctgtggctacagcgaccctgaagatgagagcaagatcaccttctacatcctggtgaaggccatctacaccctgggctacagcgtgtccctgatgagcctggccaccggcagcatcatcctgtgcctcttcaggaagctgcactgcaccaggaactacatccacctgaacctcttcctgtccttcatcctgcgggccatctctgtgctggtgaaggatgatgtgctgtacagcagcagcggcaccctgcactgcccagaccagcccagctcctgggtgggctgcaagctgagcctggtgttcctgcagtactgcatcatggccaacttcttctggctgctggtggagggcctgtacctgcacaccctgctggtggccatgctgcccccccggcgctgcttcctggcctacctgctgattggctggggcctgcccaccgtgtgcatcggggcctggacagctgcccggctgtacctggaggacaccggctgctgggacaccaatgaccacagcgtgccctggtgggtgatccgcatccccatcctgatcagcatcatcgtgaactttgtgctcttcatcagcatcatccgcatcctgctgcagaagctgaccagcccagatgtgggcggcaatgaccagagccagtacaagaggctggccaagagcaccctgctgctgatccccctgtttggagtgcactacatggtgtttgctgtgttccccatcagcatcagcagcaagtaccagatcctgtttgagctgtgcctgggcagcttccagggcctggtggtggccgtgctgtactgcttcctgaacagcgaggtgcagtgtgagctgaagaggaagtggaggagccgctgccccacccccagcgccagccgggactacagagtgtgtggcagcagcttcagcagaaatggaagtgaaggagccctgcagttccaccggggcagccgggcccagagcttcctgcagacagagaccagcgtcatctag

SEQ ID NO: 175791 - DNA, 1269 bp, Artificial Sequence
  Description of Artificial Sequence: Synthetic coding sequence
atgcccctgtgggaggcccccagcgaccacccagccaaccccccagccaccctgcagggccacaccagcctgcccggctgccaggaggagcccgcccgggacccccagagcggcctgccccagatcaccagcgagagcagcagcttcagcgagggcagcctgcccagctggagcagcggccctgctggggccaagctgaatgccagccatgagggcatcggcagcagcagtgatggaaatggagacagcaaggccgccacagagcgggtggtgtctgccatggacacagtgcggaggaagcaccctgagatcaccttctacatcctggtgaaggccatctacaccctgggctacagcgtgtccctgatgagcctggccaccggcagcatcatcctgtgcctcttcaggaagctgcactgcaccaggaactacatccacctgaacctcttcctgtccttcatcctgcgggccatctctgtgctggtgaaggatgatgtgctgtacagcagcagcggcaccctgcactgcccagaccagcccagctcctgggtgggctgcaagctgagcctggtgttcctgcagtactgcatcatggccaacttcttctggctgctggtggagggcctgtacctgcacaccctgctggtggccatgctgcccccccggcgctgcttcctggcctacctgctgattggctggggcctgcccaccgtgtgcatcggggcctggacagctgcccggctgtacctggaggacaccggctgctgggacaccaatgaccacagcgtgccctggtgggtgatccgcatccccatcctgatcagcatcatcgtgaactttgtgctcttcatcagcatcatccgcatcctgctgcagaagctgaccagcccagatgtgggcggcaatgaccagagccagtacaagaggctggccaagagcaccctgctgctgatccccctgtttggagtgcactacatggtgtttgctgtgttccccatcagcatcagcagcaagtaccagatcctgtttgagctgtgcctgggcagcttccagggcctggtggtggccgtgctgtactgcttcctgaacagcgaggtgcagtgtgagctgaagaggaagtggaggagccgctgccccacccccagcgccagccgggactacagagtgtgtggcagcagcttcagcagaaatggaagtgaaggagccctgcagttccaccggggcagccgggcccagagcttcctgcagacagagaccagcgtcatctag

SEQ ID NO: 175792 - DNA, 234 bp, Artificial Sequence
  Description of Artificial Sequence: Synthetic coding sequence
atgaggaccctgctgcccccagccctgctgacctgctggctgctggcccctgtgaacagcatccaccctgagtgccgcttccacctggagatccaggaggaggagaccaagtgtgccgagctgctgcggagccagacagagaagcacaagggccacaccaagggcttcatcctgattcatgctgggggcctgaagaggatcctggacccccacacctaccccctggccccctag

SEQ ID NO: 175793 - DNA, 2022 bp, Artificial Sequence
  Description of Artificial Sequence: Synthetic coding sequence
atgtgcagccgggtgcccctgctgctgcccctgctgctgctgctggccctgggccctggggtgcagggctgccccagcggctgccagtgcagccagccccagacagtgttctgcacagcccggcagggcaccaccgtgcccagagatgtgcccccagacacagtgggcctgtatgtgtttgaaaatggcatcaccatgctggatgctggcagctttgctggcctgcccggcctgcagctgctggacctgagccagaaccagatcgccagcctgcccagcggggtcttccagcccctggccaacctgagcaacctggacctgacagccaaccggctgcacgagatcaccaatgagaccttccggggcctgcggcggctggagcggctgtacctgggcaagaaccgcatccgccacatccagcccggggcctttgacaccctggaccggctgctggagctgaagctgcaggacaatgagctgcgggccctgccccccctgcggctgccccggctgctgctgctggacctgagccacaacagcctgctggccctggagcccggcatcctggacacagccaacgtggaggccctgcggctggccggcctgggcctgcagcagctggatgagggcctcttcagccggctgaggaacctgcatgacctggatgtgtctgacaaccagctggagcgggtgccccctgtgatccggggcctgcggggcctgacccggctgcggctggccggcaacacccgcatcgcccagctgcggcctgaggacctggccggcctggccgccctgcaggagctggatgtgagcaacctgagcctgcaggccctgcccggggacctgagcggcctcttcccccggctgcggctgctggccgccgccaggaaccccttcaactgtgtgtgccccctgtcctggtttggcccctgggtgcgggagagccacgtgaccctggccagccctgaggagacccgctgccacttcccccccaagaatgccggccgcctgctgctggagctggactatgctgactttggctgcccagccaccaccaccacagccaccgtgcccaccaccaggcctgtggtgcgggagcccacagccctgagcagcagcctggcccccacctggctgagccccacagagcccgccacagaggcccccagcccccccagcacagcccccccaacagtgggccctgtgccccagccccaggactgcccccccagcacctgcctgaatggaggcacctgccacctgggcaccaggcaccacctggcctgcctgtgcccagagggcttcaccggcctgtactgtgagagccagatgggccagggcacccggcccagccccacccctgtgaccccccggccccccaggagcctgaccctgggcatcgagcctgtgagccccaccagcctgcgggtgggcctgcagcgctacctgcagggcagctctgtgcagctgcggagcctgcggctgacctacagaaacctgagcggccctgacaagaggctggtgaccctgcggctgcctgccagcctggccgagtacacagtgacccagctgcggcccaatgccacctacagcgtgtgtgtgatgcccctgggccctggccgggtgcctgagggggaggaggcctgtggggaggcccacaccccacctgctgtgcacagcaaccacgcccctgtgacccaggcccgggagggcaacctgcccctgctgattgccccagccctggccgctgtgctgctggccgccctggccgctgtgggcgccgcctactgtgtgcggcggggccgggccatggctgctgctgcccaggacaagggccaggtgggccctggagctggccccctggagctggagggcgtgaaggtgcccctggagcccggccccaaggccacagagggcggcggggaggccctgcccagcggctctgaatgtgaggtgcccctgatgggcttccctggccctggcctgcagagccccctgcacgccaagccctacatctag

SEQ ID NO: 175794 - DNA, 2538 bp, Artificial Sequence
  Description of Artificial Sequence: Synthetic coding sequence
atggagctgtggaggcagtgcacccactggctgatccagtgccgggtgctgccccccagccaccgggtgacctgggatggagcccaggtgtgtgagctggcccaggccctgagagatggagtgctgctgtgccagctgctgaacaacctgctgccccacgccatcaacctgcgggaggtgaacctgcggccccagatgagccagttcctgtgcctgaagaacatccgcaccttcctgagcacctgctgtgagaagtttggcctgaagaggtctgagctgtttgaggcctttgacctgtttgatgtgcaggactttgggaaggtgatctacaccctgagcgccctgtcctggacccccatcgcccagaacagaggcatcatgcccttccccacagaggaggagagcgtgggagatgaggacatctacagcggcctgagtgaccagattgatgacacagtggaggaggatgaggacctgtatgactgtgtggagaatgaggaggccgagggagatgagatctatgaggacctgatgaggtctgagcctgtgtccatgccacccaagatgacagaatatgacaagcgctgctgctgcctgcgggagatccagcagacagaggagaagtacacagacaccctgggcagcatccagcagcacttcctgaagcccctgcagcgcttcctgaagccccaggacatcgagatcatcttcatcaacatcgaggacctgctgcgggtgcacacccacttcctgaaggagatgaaggaggccctgggcaccccaggagctgccaacctgtaccaggtgttcatcaagtacaaggagcgcttcctggtgtatggccgctactgcagccaggtggagagcgccagcaagcacctggacagagtggccgccgcccgggaggatgtgcagatgaagctggaggagtgcagccagagggccaacaacggccgcttcaccctgcgggacctgctgatggtgcccatgcagagggtgctgaagtaccacctgctgctgcaggagctggtgaagcacacccaggaggccatggagaaggagaacctgcggctggccctggatgccatgagggacctggcccagtgtgtgaatgaggtgaagagggacaatgagaccctgcggcagatcaccaacttccagctgagcattgagaacctggaccagagcctggcccactacggccggcccaagattgatggagagctgaagatcacctctgtggagcggcgcagcaagatggacagatatgccttcctgctggacaaggccctgctgatctgcaagagaagaggagacagctatgacctgaaggactttgtgaacctgcacagcttccaggtgagagatgacagcagcggggaccgggacaacaagaagtggagccacatgttcctgctgattgaggaccagggcgcccagggctatgagctgttcttcaagacccgggagctgaagaagaagtggatggagcagtttgagatggccatcagcaacatctacccagaaaatgccacagccaacggccatgacttccagatgttctcctttgaggagaccaccagctgcaaggcctgccagatgctgctgcggggcaccttctaccagggctaccgctgccaccgctgccgggccagcgcccacaaggagtgcctgggccgggtgcccccctgtggcagacatggccaggacttccctggcaccatgaagaaggacaagctgcaccggcgggcccaggacaagaagagaaatgagctgggcctgcccaagatggaggtgttccaggagtactacggcctgcccccacctcctggggccatcggccccttcctgcggctgaaccctggggacatcgtggagctgaccaaggccgaggccgagcagaactggtgggagggcaggaacaccagcaccaatgaaattggctggttcccctgcaacagagtgaagccctacgtgcacggccccccccaggacctgtctgtgcacctgtggtacgccggccccatggagagagctggagctgagagcatcctggccaacagaagtgatggcaccttcctggtgcggcagagggtgaaggatgctgctgagtttgccatcagcatcaagtacaacgtggaggtgaagcacatcaagatcatgacagctgagggcctgtaccgcatcacagagaagaaggccttccggggcctgacagagctggtggagttctaccagcagaacagcctgaaggactgcttcaagagcctggacaccaccctgcagttccccttcaaggagcctgagaagaggaccatcagcaggcctgctgtgggcagcaccaagtacttcggcacagccaaggcccgctatgacttctgtgcccgggacagaagtgagctgagcctgaaggagggggacatcatcaagatcctgaacaagaagggccagcagggctggtggagaggagagatctacggccgggtgggctggttccctgccaactacgtggaggaggactacagcgagtactgctag

SEQ ID NO: 175795 - DNA, 2247 bp, Artificial Sequence
  Description of Artificial Sequence: Synthetic coding sequence
atgagccagttcctgtgcctgaagaacatccgcaccttcctgagcacctgctgtgagaagtttggcctgaagaggtctgagctgtttgaggcctttgacctgtttgatgtgcaggactttgggaaggtgatctacaccctgagcgccctgtcctggacccccatcgcccagaacagaggcatcatgcccttccccacagaggaggagagcgtgggagatgaggacatctacagcggcctgagtgaccagattgatgacacagtggaggaggatgaggacctgtatgactgtgtggagaatgaggaggccgagggagatgagatctatgaggacctgatgaggtctgagcctgtgtccatgccccacttcctgaagcccctgcagcgcttcctgaagccccaggacatcgagatcatcttcatcaacatcgaggacctgctgcgggtgcacacccacttcctgaaggagatgaaggaggccctgggcacccctggggccgccaacctgtaccaggtgttcatcaagtacaaggagcgcttcctggtgtatggccgctactgcagccaggtggagagcgccagcaagcacctggacagagtggccgccgccagagaagatgtgcagatgaagctggaggagtgcagccagagggccaacaacggccgcttcaccctgcgggacctgctgatggtgcccatgcagagggtgctgaagtaccacctgctgctgcaggagctggtgaagcacacccaggaggccatggagaaggagaacctgcggctggccctggatgccatgagggacctggcccagtgtgtgaatgaggtgaagagggacaatgagaccctgcggcagatcaccaacttccagctgagcattgagaacctggaccagagcctggcccactacggccggcccaagattgatggagagctgaagatcacctctgtggagaggaggagcaagatggacagatatgccttcctgctggacaaggccctgctgatctgcaagagaagaggagacagctatgacctgaaggactttgtgaacctgcacagcttccaggtgagagatgacagcagcggggaccgggacaacaagaagtggagccacatgttcctgctgattgaggaccagggcgcccagggctatgagctgttcttcaagacccgggagctgaagaagaagtggatggagcagtttgagatggccatcagcaacatctacccagaaaatgccacagccaatggacatgacttccagatgttctcctttgaggagaccaccagctgcaaggcctgccagatgctgctgcggggcaccttctaccagggctaccgctgccaccgctgccgggccagcgcccacaaggaatgtctgggccgggtgcccccctgtggccgccacggccaggacttccctggcaccatgaagaaggacaagctgcacagaagagcccaggacaagaagagaaatgagctgggcctgcccaagatggaggtgttccaggagtactacggcctgcccccacctcctggggccatcggccccttcctgcggctgaaccctggggacatcgtggagctgaccaaggccgaggccgagcagaactggtgggagggcaggaacaccagcaccaatgagatcggctggttcccctgcaacagagtgaagccctacgtgcacggccccccccaggacctgtctgtgcacctgtggtacgccggccccatggagcgggccggggctgagagcatcctggccaacagaagtgatggcaccttcctggtgcggcagagggtgaaggatgctgctgagtttgccatcagcatcaagtacaacgtggaggtgaagcacatcaagatcatgacagctgagggcctgtaccgcatcacagagaagaaggccttccggggcctgacagagctggtggagttctaccagcagaacagcctgaaggactgcttcaagagcctggacaccaccctgcagttccccttcaaggagcctgagaagaggaccatcagcaggcctgctgtgggcagcaccaagtactttggaacagccaaggcccgctatgacttctgtgcccgggacagaagtgagctgagcctgaaggagggggacatcatcaagatcctgaacaagaagggccagcagggctggtggagaggagagatctacggccgggtgggctggttccctgccaactacgtggaggaggactacagcgagtactgctag

SEQ ID NO: 175796 - DNA, 2442 bp, Artificial Sequence
  Description of Artificial Sequence: Synthetic coding sequence
atggagctgtggaggcagtgcacccactggctgatccagtgccgggtgctgccccccagccaccgggtgacctgggatggagcccaggtgtgtgagctggcccaggccctgagagatggagtgctgctgtgccagctgctgaacaacctgctgccccacgccatcaacctgcgggaggtgaacctgcggccccagatgagccagttcctgtgcctgaagaacatccgcaccttcctgagcacctgctgtgagaagtttggcctgaagaggtctgagctgtttgaggcctttgacctgtttgatgtgcaggactttgggaaggtgatctacaccctgagcgccctgtcctggacccccatcgcccagaacagaggcatcatgcccttccccacagaggaggagagcgtgggagatgaggacatctacagcggcctgagtgaccagattgatgacacagtggaggaggatgaggacctgtatgactgtgtggagaatgaggaggccgagggagatgagatctatgaggacctgatgaggtctgagcctgtgtccatgccccacttcctgaagcccctgcagcgcttcctgaagccccaggacatcgagatcatcttcatcaacatcgaggacctgctgcgggtgcacacccacttcctgaaggagatgaaggaggccctgggcaccccaggagctgccaacctgtaccaggtgttcatcaagtacaaggagcgcttcctggtgtatggccgctactgcagccaggtggagagcgccagcaagcacctggacagagtggccgccgcccgggaggatgtgcagatgaagctggaggagtgcagccagagggccaacaacggccgcttcaccctgcgggacctgctgatggtgcccatgcagagggtgctgaagtaccacctgctgctgcaggagctggtgaagcacacccaggaggccatggagaaggagaacctgcggctggccctggatgccatgagggacctggcccagtgtgtgaatgaggtgaagagggacaatgagaccctgcggcagatcaccaacttccagctgagcattgagaacctggaccagagcctggcccactacggccggcccaagattgatggagagctgaagatcacctctgtggagcggcgcagcaagatggacagatatgccttcctgctggacaaggccctgctgatctgcaagagaagaggagacagctatgacctgaaggactttgtgaacctgcacagcttccaggtgagagatgacagcagcggggaccgggacaacaagaagtggagccacatgttcctgctgattgaggaccagggcgcccagggctatgagctgttcttcaagacccgggagctgaagaagaagtggatggagcagtttgagatggccatcagcaacatctacccagaaaatgccacagccaacggccatgacttccagatgttctcctttgaggagaccaccagctgcaaggcctgccagatgctgctgcggggcaccttctaccagggctaccgctgccaccgctgccgggccagcgcccacaaggagtgcctgggccgggtgcccccctgtggcagacatggccaggacttccctggcaccatgaagaaggacaagctgcaccggcgggcccaggacaagaagagaaatgagctgggcctgcccaagatggaggtgttccaggagtactacggcctgcccccacctcctggggccatcggccccttcctgcggctgaaccctggggacatcgtggagctgaccaaggccgaggccgagcagaactggtgggagggcaggaacaccagcaccaatgaaattggctggttcccctgcaacagagtgaagccctacgtgcacggccccccccaggacctgtctgtgcacctgtggtacgccggccccatggagagagctggagctgagagcatcctggccaacagaagtgatggcaccttcctggtgcggcagagggtgaaggatgctgctgagtttgccatcagcatcaagtacaacgtggaggtgaagcacatcaagatcatgacagctgagggcctgtaccgcatcacagagaagaaggccttccggggcctgacagagctggtggagttctaccagcagaacagcctgaaggactgcttcaagagcctggacaccaccctgcagttccccttcaaggagcctgagaagaggaccatcagcaggcctgctgtgggcagcaccaagtacttcggcacagccaaggcccgctatgacttctgtgcccgggacagaagtgagctgagcctgaaggagggggacatcatcaagatcctgaacaagaagggccagcagggctggtggagaggagagatctacggccgggtgggctggttccctgccaactacgtggaggaggactacagcgagtactgctag

SEQ ID NO: 175797 - DNA, 2538 bp, Artificial Sequence; identical to SEQ ID NO: 175794
  Description of Artificial Sequence: Synthetic coding sequence

SEQ ID NO: 175798 - DNA, 2607 bp, Artificial Sequence
  Description of Artificial Sequence: Synthetic coding sequence
atggagcagtggaggcagtgtggccgctggctgattgactgcaaggtgctgccccccaaccaccgggtggtgtggcccagcgctgtggtgtttgacctggcccaggccctgagagatggagtgctgctgtgccagctgctgcacaacctgagccctggcagcattgacctgaaggacatcaacttccggccccagatgagccagttcctgtgcctgaagaacatccgcaccttcctgaaggtgtgccacgacaagtttggcctgagaaattctgagctgtttgacccctttgacctgtttgatgtgcgggactttgggaaggtgatctctgctgtgtcccggctgagcctgcacagcatcgcccagaacaagggcatccggcccttccccagcgaggagaccacagaaaatgatgatgatgtgtaccgcagcctggaggagctggctgatgaacatgacctgggggaggacatctatgactgtgtgccctgtgaagatggaggagatgacatctatgaggacatcatcaaggtggaggtgcagcagcccatgaagatgggcatgacagaagatgacaagaggaactgctgcctgctggagatccaggagacagaggccaagtactaccgcaccctggaggacatcgagaagaactacatgagccccctgcggctggtgctgagccctgctgacatggctgctgtgttcatcaacctggaggacctgatcaaggtgcaccacagcttcctgcgggccattgatgtgtctgtgatggtgggcggcagcaccctggccaaggtgttcctggacttcaaggagcggctgctgatctacggggagtactgcagccacatggagcacgcccagaacaccctgaaccagctgctggccagccgggaggacttccggcagaaggtggaggagtgcaccctgaaggtgcaggacggcaagttcaagctgcaggacctgctggtggtgcccatgcagagggtgctgaagtaccacctgctgctgaaggagctgctgagccacagcgctgagaggcctgagcggcagcagctgaaggaggccctggaggccatgcaggacctggccatgtacatcaatgaggtgaagagggacaaggagaccctgaggaagatcagcgagttccagagcagcattgagaacctgcaggtgaagctggaggagtttggccggcccaagattgatggagagctgaaggtgcgcagcatcgtgaaccacaccaagcaggaccgctacctgttcctgtttgacaaggtggtgattgtgtgcaagaggaagggctacagctatgagctgaaggagatcatcgagctgctcttccacaagatgacagatgaccccatgaacaacaaggatgtgaagaagtggagctatggcttctacctgatccacctgcagggcaagcagggcttccagttcttctgcaagacagaggacatgaagaggaagtggatggagcagtttgagatggccatgagcaacatcaagccagacaaggccaatgccaaccaccacagcttccagatgtacacctttgacaagaccaccaactgcaaggcctgcaagatgttcctgcggggcaccttctaccagggctacatgtgcaccaagtgtggggtgggcgcccacaaggagtgcctggaggtgatccccccctgcaagttccgcaccagcggggacagagatgccagcggggccggccctggccccaagatggtggccatgcagaactaccacggcaacccagcccctcctgggaagcctgtgctgaccttccagacaggagatgtgctggagctgctgcggggggaccctgagagcccctggtgggagggccgcctggtgcagaccaggaagagcggctacttccccagcagctctgtgaagccctgccctgtggatggccggccccccatcagcaggcctcccagccgggagattgactacacagcctacccctggtttgctggcaacatggagcggcagcagacagacaacctgctgaagagccacgccagcggcacctacctgatccgggagaggcctgctgaggccgagagatttgccatcagcatcaagttcaatgatgaggtgaagcacatcaaggtggtggagaaggacaactggatccacatcacagaggccaagaagtttgacagcctgctggagctggtggagtactaccagtgccacagcctgaaggagagcttcaagcagctggacaccaccctgaagtacccctacaagagccgggagaggtctgccagccgggccagcagccgcagccctgccagctgtgccagctacaacttctccttcctgagcccccagggcctgagctttgccagccagggccccagcgcccccttctggagcgtcttcacccccagggtcatcggcacagctgtggcccgctacaactttgctgcccgggacatgagggagctgagcctgcgggagggagatgtggtgcgcatctacagcagaattggaggagaccagggctggtggaagggggagaccaacggccgcatcggctggttccccagcacctacgtggaggaggagggcatccagtag

SEQ ID NO: 175799 - DNA, 2637 bp, Artificial Sequence
  Description of Artificial Sequence: Synthetic coding sequence
atggagcagtggaggcagtgtggccgctggctgattgactgcaaggtgctgccccccaaccaccgggtggtgtggcccagcgctgtggtgtttgacctggcccaggccctgagagatggagtgctgctgtgccagctgctgcacaacctgagccctggcagcattgacctgaaggacatcaacttccggccccagatgagccagttcctgtgcctgaagaacatccgcaccttcctgaaggtgtgccacgacaagtttggcctgagaaattctgagctgtttgacccctttgacctgtttgatgtgcgggactttgggaaggtgatctctgctgtgtcccggctgagcctgcacagcatcgcccagaacaagggcatccggcccttccccagcgaggagaccacagaaaatgatgatgatgtgtaccgcagcctggaggagctggctgatgaacatgacctgggggaggacatctatgactgtgtgccctgtgaagatggaggagatgacatctatgaggacatcatcaaggtggaggtgcagcagcccatgatccgctacatgcagaagatgggcatgacagaagatgacaagaggaactgctgcctgctggagatccaggagacagaggccaagtactaccgcaccctggaggacatcgagaagaactacatgagccccctgcggctggtgctgagccctgctgacatggctgctgtgttcatcaacctggaggacctgatcaaggtgcaccacagcttcctgcgggccattgatgtgtctgtgatggtgggcggcagcaccctggccaaggtgttcctggacttcaaggagcggctgctgatctatggagagtactgcagccacatggagcacgcccagaacaccctgaaccagctgctggccagccgggaggacttccggcagaaggtggaggagtgcaccctgaaggtgcaggacggcaagttcaagctgcaggacctgctggtggtgcccatgcagagggtgctgaagtaccacctgctgctgaaggagctgctgagccacagcgctgagaggcctgagcggcagcagctgaaggaggccctggaggccatgcaggacctggccatgtacatcaatgaggtgaagagggacaaggagaccctgaggaagatcagcgagttccagagcagcattgagaacctgcaggtgaagctggaggagtttggccggcccaagattgatggagagctgaaggtgcgcagcatcgtgaaccacaccaagcaggaccgctacctgttcctgtttgacaaggtggtgattgtgtgcaagaggaagggctacagctatgagctgaaggagatcatcgagctgctcttccacaagatgacagatgaccccatgaacaacaaggatgtgaagaagagccacggcaagatgtggagctatggcttctacctgatccacctgcagggcaagcagggcttccagttcttctgcaagacagaggacatgaagaggaagtggatggagcagtttgagatggccatgagcaacatcaagccagacaaggccaatgccaaccaccacagcttccagatgtacacctttgacaagaccaccaactgcaaggcctgcaagatgttcctgcggggcaccttctaccagggctacatgtgcaccaagtgtggggtgggcgcccacaaggagtgcctggaggtgatccccccctgcaagttcaccagccctgctgacctggatgccagcggggccggccctggccccaagatggtggccatgcagaactaccacggcaacccagcccctcctgggaagcctgtgctgaccttccagacaggagatgtgctggagctgctgcggggggaccctgagagcccctggtgggagggccgcctggtgcagaccaggaagagcggctacttccccagcagctctgtgaagccctgccctgtggatggccggccccccatcagcaggcctcccagccgggagattgactacacagcctacccctggtttgctggcaacatggagcggcagcagacagacaacctgctgaagagccacgccagcggcacctacctgatccgggagaggcctgctgaggccgagagatttgccatcagcatcaagttcaatgatgaggtgaagcacatcaaggtggtggagaaggacaactggatccacatcacagaggccaagaagtttgacagcctgctggagctggtggagtactaccagtgccacagcctgaaggagagcttcaagcagctggacaccaccctgaagtacccctacaagagccgggagaggtctgccagccgggccagcagccgcagccctgccagctgtgccagctacaacttctccttcctgagcccccagggcctgagctttgccagccagggccccagcgcccccttctggagcgtcttcacccccagggtcatcggcacagctgtggcccgctacaactttgctgcccgggacatgagggagctgagcctgcgggagggagatgtggtgcgcatctacagcagaattggaggagaccagggctggtggaagggggagaccaacggccgcatcggctggttccccagcacctacgtggaggaggagggcatccagtag

SEQ ID NO: 175800 - DNA, 2607 bp, Artificial Sequence
  Description of Artificial Sequence: Synthetic coding sequence
atggagcagtggaggcagtgtggccgctggctgattgactgcaaggtgctgccccccaaccaccgggtggtgtggcccagcgctgtggtgtttgacctggcccaggccctgagagatggagtgctgctgtgccagctgctgcacaacctgagccctggcagcattgacctgaaggacatcaacttccggccccagatgagccagttcctgtgcctgaagaacatccgcaccttcctgaaggtgtgccacgacaagtttggcctgagaaattctgagctgtttgacccctttgacctgtttgatgtgcgggactttgggaaggtgatctctgctgtgtcccggctgagcctgcacagcatcgcccagaacaagggcatccggcccttccccagcgaggagaccacagaaaatgatgatgatgtgtaccgcagcctggaggagctggctgatgaacatgacctgggggaggacatctatgactgtgtgccctgtgaagatggaggagatgacatctatgaggacatcatcaaggtggaggtgcagcagcccatgaagatgggcatgacagaagatgacaagaggaactgctgcctgctggagatccaggagacagaggccaagtactaccgcaccctggaggacatcgagaagaactacatgagccccctgcggctggtgctgagccctgctgacatggctgctgtgttcatcaacctggaggacctgatcaaggtgcaccacagcttcctgcgggccattgatgtgtctgtgatggtgggcggcagcaccctggccaaggtgttcctggacttcaaggagcggctgctgatctacggggagtactgcagccacatggagcacgcccagaacaccctgaaccagctgctggccagccgggaggacttccggcagaaggtggaggagtgcaccctgaaggtgcaggacggcaagttcaagctgcaggacctgctggtggtgcccatgcagagggtgctgaagtaccacctgctgctgaaggagctgctgagccacagcgctgagaggcctgagcggcagcagctgaaggaggccctggaggccatgcaggacctggccatgtacatcaatgaggtgaagagggacaaggagaccctgaggaagatcagcgagttccagagcagcattgagaacctgcaggtgaagctggaggagtttggccggcccaagattgatggagagctgaaggtgcgcagcatcgtgaaccacaccaagcaggaccgctacctgttcctgtttgacaaggtggtgattgtgtgcaagaggaagggctacagctatgagctgaaggagatcatcgagctgctcttccacaagatgacagatgaccccatgaacaacaaggatgtgaagaagtggagctatggcttctacctgatccacctgcagggcaagcagggcttccagttcttctgcaagacagaggacatgaagaggaagtggatggagcagtttgagatggccatgagcaacatcaagccagacaaggccaatgccaaccaccacagcttccagatgtacacctttgacaagaccaccaactgcaaggcctgcaagatgttcctgcggggcaccttctaccagggctacatgtgcaccaagtgtggggtgggcgcccacaaggagtgcctggaggtgatccccccctgcaagttcaccagccctgctgacctggatgccagcggggccggccctggccccaagatggtggccatgcagaactaccacggcaacccagcccctcctgggaagcctgtgctgaccttccagacaggagatgtgctggagctgctgcggggggaccctgagagcccctggtgggagggccgcctggtgcagaccaggaagagcggctacttccccagcagctctgtgaagccctgccctgtggatggccggccccccatcagcaggcctcccagccgggagattgactacacagcctacccctggtttgctggcaacatggagcggcagcagacagacaacctgctgaagagccacgccagcggcacctacctgatccgggagaggcctgctgaggccgagagatttgccatcagcatcaagttcaatgatgaggtgaagcacatcaaggtggtggagaaggacaactggatccacatcacagaggccaagaagtttgacagcctgctggagctggtggagtactaccagtgccacagcctgaaggagagcttcaagcagctggacaccaccctgaagtacccctacaagagccgggagaggtctgccagccgggccagcagccgcagccctgccagctgtgccagctacaacttctccttcctgagcccccagggcctgagctttgccagccagggccccagcgcccccttctggagcgtcttcacccccagggtcatcggcacagctgtggcccgctacaactttgctgcccgggacatgagggagctgagcctgcgggagggagatgtggtgcgcatctacagcagaattggaggagaccagggctggtggaagggggagaccaacggccgcatcggctggttccccagcacctacgtggaggaggagggcatccagtag

SEQ ID NO: 175801 - DNA, 2520 bp, Artificial Sequence
  Description of Artificial Sequence: Synthetic coding sequence
atggagcagtggaggcagtgtggccgctggctgattgactgcaaggtgctgccccccaaccaccgggtggtgtggcccagcgctgtggtgtttgacctggcccaggccctgagagatggagtgctgctgtgccagctgctgcacaacctgagccctggcagcattgacctgaaggacatcaacttccggccccagatgagccagttcctgtgcctgaagaacatccgcaccttcctgaaggtgtgccacgacaagtttggcctgagaaattctgagctgtttgacccctttgacctgtttgatgtgcgggactttgggaaggtgatctctgctgtgtcccggctgagcctgcacagcatcgcccagaacaagggcatccggcccttccccagcgaggagaccacagaaaatgatgatgatgtgtaccgcagcctggaggagctggctgatgaacatgacctgggggaggacatctatgactgtgtgccctgtgaagatggaggagatgacatctatgaggacatcatcaaggtggaggtgcagcagcccatgaagatgggcatgacagaagatgacaagaggaactgctgcctgctggagatccaggagacagaggccaagtactaccgcaccctggaggacatcgagaagaactacatgagccccctgcggctggtgctgagccctgctgacatggctgctgtgttcatcaacctggaggacctgatcaaggtgcaccacagcttcctgcgggccattgatgtgtctgtgatggtgggcggcagcaccctggccaaggtgttcctggacttcaaggagcggctgctgatctacggggagtactgcagccacatggagcacgcccagaacaccctgaaccagctgctggccagccgggaggacttccggcagaaggtggaggagtgcaccctgaaggtgcaggacggcaagttcaagctgcaggacctgctggtggtgcccatgcagagggtgctgaagtaccacctgctgctgaaggagctgctgagccacagcgctgagaggcctgagcggcagcagctgaaggaggccctggaggccatgcaggacctggccatgtacatcaatgaggtgaagagggacaaggagaccctgaggaagatcagcgagttccagagcagcattgagaacctgcaggtgaagctggaggagtttggccggcccaagattgatggagagctgaaggtgcgcagcatcgtgaaccacaccaagcaggaccgctacctgttcctgtttgacaaggtggtgattgtgtgcaagaggaagggctacagctatgagctgaaggagatcatcgagctgctcttccacaagatgacagatgaccccatgaacaacaaggatgtgaagaagtggagctatggcttctacctgatccacctgcagggcaagcagggcttccagttcttctgcaagacagaggacatgaagaggaagtggatggagcagtttgagatggccatgagcaacatcaagccagacaaggccaatgccaaccaccacagcttccagatgtacacctttgacaagaccaccaactgcaaggcctgcaagatgttcctgcggggcaccttctaccagggctacatgtgcaccaagtgtggggtgggcgcccacaaggagtgcctggaggtgatccccccctgcaagttcaccagccctgctgacctggatgccagcggggccggccctggccccaagatggtggccatgcagaactaccacggcaacccagcccctcctgggaagcctgtgctgaccttccagacaggagatgtgctggagctgctgcggggggaccctgagagcccctggtgggagggccgcctggtgcagaccaggaagagcggctacttccccagcagctctgtgaagccctgccctgtggatggccggccccccatcagcaggcctcccagccgggagattgactacacagcctacccctggtttgctggcaacatggagcggcagcagacagacaacctgctgaagagccacgccagcggcacctacctgatccgggagaggcctgctgaggccgagagatttgccatcagcatcaagttcaatgatgaggtgaagcacatcaaggtggtggagaaggacaactggatccacatcacagaggccaagaagtttgacagcctgctggagctggtggagtactaccagtgccacagcctgaaggagagcttcaagcagctggacaccaccctgaagtacccctacaagagccgggagaggtctgccagccgggccagcagccgcagccctgtgttcaccccccgggtgattggaacagctgtggcccgctacaactttgctgcccgggacatgagggagctgagcctgcgggagggagatgtggtgcgcatctacagccgcatcggcggggaccagggctggtggaagggggagaccaacggcagaattggctggttccccagcacctacgtggaggaggagggcatccagtag

SEQ ID NO: 175802 - DNA, 2544 bp, Artificial Sequence
  Description of Artificial Sequence: Synthetic coding sequence
atggagccctggaagcagtgtgcccagtggctgatccactgcaaggtgctgcccaccaaccaccgggtgacctgggacagcgcccaggtgtttgacctggcccagaccctgagagatggagtgctgctgtgccagctgctgaacaacctgcgggcccacagcatcaacctgaaggagatcaacctgcggccccagatgagccagttcctgtgcctgaagaacatccgcaccttcctgacagcctgctgtgagaccttcggcatgaggaagtctgagctgtttgaggcctttgacctgtttgatgtgcgggactttgggaaggtgattgagaccctgagccggctgagcaggacccccatcgccctggccaccggcatccggcccttccccacagaggagagcatcaatgatgaggacatctacaagggcctgcctgacctgattgatgagaccctggtggaggatgaggaggacctgtatgactgtgtgtatggagaagatgaaggaggagaggtgtatgaggacctgatgaaggccgaggaggcccaccagcccaagtgcccagaaaatgacatccgcagctgctgcctggccgagatcaagcagacagaggagaagtacacagagaccctggagagcattgagaagtacttcatggcccccctgaagcgcttcctgacagctgctgagtttgattctgtgttcatcaacatccctgagctggtgaagctgcacaggaacctgatgcaggagatccatgacagcatcgtgaacaagaatgaccagaacctgtaccaggtgttcatcaactacaaggagcggctggtgatctacggccagtactgcagcggcgtggagagcgccatcagcagcctggactacatcagcaagaccaaggaggatgtgaagctgaagctggaggagtgcagcaagagggccaacaacgggaagttcaccctgcgggacctgctggtggtgcccatgcagagggtgctgaagtaccacctgctgctgcaggagctggtgaagcacaccacagaccccacagagaaggccaacctgaagctggccctggatgccatgaaggacctggcccagtatgtgaatgaggtgaagagggacaatgagaccctgcgggagatcaagcagttccagctgagcattgagaacctgaaccagcctgtgctgctgtttggccggccccagggagatggagagatccgcatcaccaccctggacaagcacaccaagcaggagcggcacatcttcctgtttgacctggccgtcatcgtgtgcaagaggaaaggagacaactatgagatgaaggagatcatcgacctgcagcagtacaagatcgccaacaaccccaccacagacaaggagaacaagaagtggagctatggcttctacctgatccacacccagggccagaatggcctggagttctactgcaagaccaaggacctgaagaagaagtggctggagcagtttgagatggccctgagcaacatccggccagactatgctgacagcaacttccatgacttcaagatgcacaccttcaccagggtgaccagctgcaaggtgtgccagatgctgctgcggggcaccttctaccagggctacctgtgcttcaagtgtggggcccgggcccacaaggagtgcctgggccgggtggacaactgtggccgggtgaacagcggggagcagggcaccctgaagctgcctgagaagaggaccaacggcctgcggaggacccccaagcaggtggaccccggcctgcccaagatgcaggtgatccggaactacagcggcaccccacctccagccctgcacgagggcccccccctgcagctgcaggccggggacacagtggagctgctgaagggagatgcccacagcctcttctggcagggcaggaacctggccagcggggaggtgggcttcttccccagtgatgctgtgaagccctgcccctgtgtgcccaagcctgtggactacagctgccagccctggtacgccggggccatggagcggctgcaggccgagacagagctgatcaacagagtgaacagcacctacctggtgcgccacaggaccaaggagagcggggagtatgccatcagcatcaagtacaacaatgaggccaagcacatcaagatcctgaccagagatggcttcttccacatcgccgagaacaggaagttcaagagcctgatggagctggtggagtactacaagcaccacagcctgaaggagggcttccgcaccctggacaccaccctgcagttcccctacaaggagcctgagcacagcgctggccagaggggcaacagagctggcaacagcctgctgagccccaaggtgctgggcatcgccatcgcccgctatgacttctgtgcccgggacatgagggagctgagcctgctgaagggagatgtggtgaagatctacaccaagatgtctgccaacggctggtggagaggagaggtgaatggccgggtgggctggttccccagcacctacgtggaggaggatgaatag

SEQ ID NO: 175803 - DNA, 1671 bp, Artificial Sequence
  Description of Artificial Sequence: Synthetic coding sequence
atgagccagttcctgtgcctgaagaacatccgcaccttcctgacagcctgctgtgagaccttcggcatgaggaagtctgagctgtttgaggcctttgacctgtttgatgtgcgggactttgggaaggtgattgagaccctgagccggctgagcaggacccccatcgccctggccaccggcatccggcccttccccacagaggagagcatcaatgatgaggacatctacaagggcctgcctgacctgattgatgagaccctggtggaggatgaggaggacctgtatgactgtgtgtatggagaagatgagggcggggaggtgtatgaggacctgatgaaggccgaggaggcccaccagcccaagtgcccagaaaatgacatccgcagctgctgcctggccgagatcaagcagacagaggagaagtacacagagaccctggagagcattgagaagtacttcatggcccccctgaagcgcttcctgacagctgctgagtttgacagcgtcttcatcaacatccctgagctggtgaagctgcacaggaacctgatgcaggagatccatgacagcatcgtgaacaagaatgaccagaacctgtaccaggtgttcatcaactacaaggagcggctggtgatctacggccagtactgcagcggcgtggagagcgccatcagcagcctggactacatcagcaagaccaaggaggatgtgaagctgaagctggaggagtgcagcaagagggccaacaacgggaagttcaccctgcgggacctgctggtggtgcccatgcagagggtgctgaagtaccacctgctgctgcaggagctggtgaagcacaccacagaccccacagagaaggccaacctgaagctggccctggatgccatgaaggacctggcccagtatgtgaatgaggtgaagagggacaatgagaccctgcgggagatcaagcagttccagctgagcattgagaacctgaaccagcctgtgctgctgtttggccggccccagggagatggagagatccgcatcaccaccctggacaagcacaccaagcaggagcggcacatcttcctgtttgacctggccgtgattgtgtgcaagaggaagggggacaactatgagatgaaggagatcatcgacctgcagcagtacaagatcgccaacaaccccaccacagacaaggagaacaagaagtggagctatggcttctacctgatccacacccagggccagaatggcctggagttctactgcaagaccaaggacctgaagaagaagtggctggagcagtttgagatggccctgagcaacatccggccagactatgctgacagcaacttccatgacttcaagatgcacaccttcaccagggtgaccagctgcaaggtgtgccagatgctgctgcggggcaccttctaccagggctacctgtgcttcaagtgtggggcccgggcccacaaggaatgtctgggccgggtggacaactgtggccgggtgaacagcggggagcagggcaccctgaagctgcctgagaagaggaccaacggcctgcggaggacccccaagcaggtggaccctgatgtgccctgcctgctgcacttcttcatctccatggccccagccaccaggagcatcgtgaagagccagaagaagaacaagaagttctag

SEQ ID NO: 175804 - DNA, 864 bp, Artificial Sequence
  Description of Artificial Sequence: Synthetic coding sequence
atgcccatcttcaccttcctgtctgagcagggcaccctgaagctgcctgagaagaggaccaacggcctgcggaggacccccaagcaggtggaccccggcctgcccaagatgcaggtgatccggaactacagcggcaccccacctccagccctgcacgagggcccccccctgcagctgcaggccggggacacagtggagctgctgaagggagatgcccacagcctcttctggcagggcaggaacctggccagcggggaggtgggcttcttccccagtgatgctgtgaagccctgcccctgtgtgcccaagcctgtggactacagctgccagccctggtacgccggggccatggagcggctgcaggccgagacagagctgatcaacagagtgaacagcacctacctggtgcgccacaggaccaaggagagcggggagtatgccatcagcatcaagtacaacaatgaggccaagcacatcaagatcctgaccagagatggcttcttccacatcgccgagaacaggaagttcaagagcctgatggagctggtggagtactacaagcaccacagcctgaaggagggcttccgcaccctggacaccaccctgcagttcccctacaaggagcctgagcacagcgctggccagaggggcaacagagctggcaacagcctgctgagccccaaggtgctgggcatcgccatcgcccgctatgacttctgtgcccgggacatgagggagctgagcctgctgaagggagatgtggtgaagatctacaccaagatgtctgccaacggctggtggagaggagaggtgaatggccgggtgggctggttccccagcacctacgtggaggaggatgaatag

SEQ ID NO: 175805 - DNA, 2628 bp, Artificial Sequence
  Description of Artificial Sequence: Synthetic coding sequence
atggagccctggaagcagtgtgcccagtggctgatccactgcaaggtgctgcccaccaaccaccgggtgacctgggacagcgcccaggtgtttgacctggcccagaccctgagagatggagtgctgctgtgccagctgctgaacaacctgcgggcccacagcatcaacctgaaggagatcaacctgcggccccagatgagccagttcctgtgcctgaagaacatccgcaccttcctgacagcctgctgtgagaccttcggcatgaggaagtctgagctgtttgaggcctttgacctgtttgatgtgcgggactttgggaaggtgattgagaccctgagccggctgagcaggacccccatcgccctggccaccggcatccggcccttccccacagaggagagcatcaatgatgaggacatctacaagggcctgcctgacctgattgatgagaccctggtggaggatgaggaggacctgtatgactgtgtgtatggagaagatgaaggaggagaggtgtatgaggacctgatgaaggccgaggaggcccaccagcccaagtgcccagaaaatgacatccgcagctgctgcctggccgagatcaagcagacagaggagaagtacacagagaccctggagagcattgagaagtacttcatggcccccctgaagcgcttcctgacagctgctgagtttgattctgtgttcatcaacatccctgagctggtgaagctgcacaggaacctgatgcaggagatccatgacagcatcgtgaacaagaatgaccagaacctgtaccaggtgttcatcaactacaaggagcggctggtgatctacggccagtactgcagcggcgtggagagcgccatcagcagcctggactacatcagcaagaccaaggaggatgtgaagctgaagctggaggagtgcagcaagagggccaacaacgggaagttcaccctgcgggacctgctggtggtgcccatgcagagggtgctgaagtaccacctgctgctgcaggagctggtgaagcacaccacagaccccacagagaaggccaacctgaagctggccctggatgccatgaaggacctggcccagtatgtgaatgaggtgaagagggacaatgagaccctgcgggagatcaagcagttccagctgagcattgagaacctgaaccagcctgtgctgctgtttggccggccccagggagatggagagatccgcatcaccaccctggacaagcacaccaagcaggagcggcacatcttcctgtttgacctggccgtcatcgtgtgcaagaggaaaggagacaactatgagatgaaggagatcatcgacctgcagcagtacaagatcgccaacaaccccaccacagacaaggagaacaagaagtggagctatggcttctacctgatccacacccagggccagaatggcctggagttctactgcaagaccaaggacctgaagaagaagtggctggagcagtttgagatggccctgagcaacatccggccagactatgctgacagcaacttccatgacttcaagatgcacaccttcaccagggtgaccagctgcaaggtgtgccagatgctgctgcggggcaccttctaccagggctacctgtgcttcaagtgtggggcccgggcccacaaggagtgcctgggccgggtggacaactgtggccgggtgaacagcggggagcagggcaccctgaagctgcctgagaagaggaccaacggcctgcggaggacccccaagcaggtggaccccggcctgcccaagatgcaggtgatccggaactacagcggcaccccacctccagccctgcacgagggcccccccctgcagctgcaggccggggacacagtggagctgctgaagggagatgcccacagcctcttctggcagggcaggaacctggccagcggggaggtgggcttcttccccagtgatgctgtgaagccctgcccctgtgtgcccaagcctgtggactacagctgccagccctggtacgccggggccatggagcggctgcaggccgagacagagctgatcaacagagtgaacagcacctacctggtgcgccacaggaccaaggagagcggggagtatgccatcagcatcaagtacaacaatgaggccaagcacatcaagatcctgaccagagatggcttcttccacatcgccgagaacaggaagttcaagagcctgatggagctggtggagtactacaagcaccacagcctgaaggagggcttccgcaccctggacaccaccctgcagttcccctacaaggagcctgagcacagcgctggccagaggggcaacagagctggcaacagcagccccagcctcttctgtggcttctcctttgtgaccccaccagactacagctttgtgccccccagcagcacccccttctggagcgtgctgagccccaaggtgctgggcatcgccatcgcccgctatgacttctgtgcccgggacatgagggagctgagcctgctgaagggagatgtggtgaagatctacaccaagatgtctgccaacggctggtggagaggagaggtgaatggccgggtgggctggttccccagcacctacgtggaggaggatgaatag

SEQ ID NO: 175806 - DNA, 756 bp, Artificial Sequence
  Description of Artificial Sequence: Synthetic coding sequence
atgcaggtgatccggaactacagcggcaccccacctccagccctgcacgagggcccccccctgcagctgcaggccggggacacagtggagctgctgaagggagatgcccacagcctcttctggcagggcaggaacctggccagcggggaggtgggcttcttccccagtgatgctgtgaagccctgcccctgtgtgcccaagcctgtggactacagctgccagccctggtacgccggggccatggagcggctgcaggccgagacagagctgatcaacagagtgaacagcacctacctggtgcgccacaggaccaaggagagcggggagtatgccatcagcatcaagtacaacaatgaggccaagcacatcaagatcctgaccagagatggcttcttccacatcgccgagaacaggaagttcaagagcctgatggagctggtggagtactacaagcaccacagcctgaaggagggcttccgcaccctggacaccaccctgcagttcccctacaaggagcctgagcacagcgctggccagaggggcaacagagctggcaacagcctgctgagccccaaggtgctgggcatcgccatcgcccgctatgacttctgtgcccgggacatgagggagctgagcctgctgaagggagatgtggtgaagatctacaccaagatgtctgccaacggctggtggagaggagaggtgaatggccgggtgggctggttccccagcacctacgtggaggaggatgaatag

SEQ ID NO: 175807 - DNA, 912 bp, Artificial Sequence
  Description of Artificial Sequence: Synthetic coding sequence
atgagcagcgccaggtttgacagcagtgacagaagtgcctggtacatgggccctgtgtcccggcaggaggcccagacccggctgcagggccagagacatggcatgttcctggtgcgggacagcagcacctgccctggggactatgtgctgtctgtgtctgagaacagccgggtgagccactacatcatcaacagcctgcccaacagacgcttcaagattggagaccaggagtttgaccacctgcctgccctgctggagttctacaagatccactacctggacaccaccaccctgattgaaccagccccccgctaccccagcccccccatgggctctgtgtctgcccccaacctgcccacagctgaggacaacctggagtatgtgaggaccctgtatgacttccctggaaatgatgctgaggacctgcccttcaagaagggggagatcctggtgatcatcgagaagccagaggagcagtggtggagcgccaggaacaaggatggccgggtgggcatgatccctgtgccctacgtggagaagctggtgcgcagcagcccccacggcaagcacggcaacagaaacagcaacagctatggcatccctgagcccgcccacgcctatgcccagccccagaccaccacccccctgcctgctgtgtctggcagccctggagctgccatcacccccctgcccagcacccagaatggacctgtgtttgccaaggccatccagaagagggtgccctgtgcctatgacaagacagccctggccctggaggtgggggacatcgtgaaggtgaccaggatgaacatcaatggccagtgggagggggaggtgaatggaaggaagggcctcttccccttcacccacgtgaagatctttgacccccagaacccagatgaaaatgaatag

SEQ ID NO: 175808 - DNA, 912 bp, Artificial Sequence; identical to SEQ ID NO: 175807
  Description of Artificial Sequence: Synthetic coding sequence

SEQ ID NO: 175809 - DNA, 3132 bp, Artificial Sequence
  Description of Artificial Sequence: Synthetic coding sequence
atggagtttgtgcgggccctgtggctgggcctggccctggccctgggccctggcagcgctgggggccacccccagccctgtggggtgctggcccggctgggcggctctgtgcggctgggcgccctgctgccccgggcccccctggcccgggcccgggcccgggccgccctggcccgggccgccctggccccccggctgccccacaacctgagcctggagctggtggtggccgcccccccagcccgggaccctgccagcctgacccggggcctgtgccaggccctggtgcccccaggagtggccgccctgctggccttccctgaggcccggcctgagctgctgcagctgcacttcctggccgccgccacagagacccctgtgctgagcctgctgcggcgggaggcccgggcccccctgggcgcccccaaccccttccacctgcagctgcactgggccagccccctggagaccctgctggatgtgctggtggccgtgctgcaggcccacgcctgggaggatgtgggcctggccctgtgcaggacccaggaccccggcggcctggtggccctgtggaccagcagagctggccggcccccccagctggtgctggacctgagcagaagagacacaggagatgctggcctgcgggcccggctggcccccatggccgcccctgtgggcggggaggcccctgtgcctgctgctgtgctgctgggctgtgacatcgcccgggcccggcgggtgctggaggccgtgcccccaggcccccactggctgctgggcacccccctgccccccaaggccctgcccacagctggcctgcccccaggcctgctggccctgggggaggtggcccggccccccctggaggccgccatccatgacatcgtgcagctggtggcccgggccctgggcagcgctgcccaggtgcagcccaagagggccctgctgcctgcccctgtgaactgtggggacctgcagcctgctggccctgagagccctggccgcttcctggcccgcttcctggccaacaccagcttccagggccgcactggacctgtgtgggtgacaggcagcagccaggtgcacatgagccgccacttcaaggtgtggagcctgcggcgggaccccaggggggccccagcctgggccaccgtgggctcctggagagatggccagctggacctggagcccggcggggccagcgcccggcccccaccaccccagggcgcccaggtgtggcccaagctgcgggtggtgaccctgctggagcacccctttgtgtttgcccgggaccctgatgaagatggccagtgcccagctggccagctgtgcctggaccccggcaccaatgattctgccaccctggatgccctgtttgctgccctggccaatggaagtgccccccgggccctgaggaagtgctgctacggctactgcatcgacctgctggagcggctggccgaggacaccccatttgattttgagctgtacctggtgggagatggcaagtatggagccctgagagatggccgctggacaggcctggtgggggacctgctggccggccgggcccacatggctgtgaccagcttcagcatcaacagcgcccggagccaggtggtggacttcaccagccccttcttcagcaccagcctgggcatcatggtgcgggcccgggacacagccagccccatcggggccttcatgtggcccctgcactggagcacctggctgggcgtgtttgctgccctgcacctgacagccctcttcctgactgtgtatgagtggaggagcccctacggcctgaccccccggggcaggaacagaagcaccgtcttctcctacagcagcgccctgaacctgtgctacgccatcctcttcagaagaacagtgagcagcaagacccccaagtgccccaccggccgcctgctgatgaacctgtgggccatcttctgcctgctggtgctgagcagctacacagccaacctggccgctgtgatggtgggggacaagacctttgaggagctgagcggcatccatgaccccaagctgcaccacccagcccagggcttccgcttcggcaccgtgtgggagagcagcgctgaggcctacatcaagaagagcttcccagacatgcacgcccacatgaggaggcacagcgcccccaccaccccccggggcgtggccatgctgaccagtgacccccccaagctgaatgccttcatcatggacaagagcctgctggactatgaggtgtccattgatgctgactgcaagctgctgactgtgggcaagccctttgccatcgagggctatggaattggcctgccccagaacagccccctgaccagcaacctgtctgagttcatcagccgctacaagagcagcggcttcatcgacctgctgcatgacaagtggtacaagatggtgccctgtgggaagagggtgtttgctgtgacagagaccctgcagatgagcatctaccactttgctggcctgtttgtgctgctgtgcctgggcctgggcagcgccctgctgagcagcctgggggagcacgccttcttccggctggccctgccccgcatcaggaagggcagccggctgcagtactggctgcacaccagccagaagatccaccgggccctgaacacagagcccccagagggcagcaaggaggagacagctgaggccgagcccagcggccctgaggtggagcagcagcagcagcagcaggaccagcccacagcccctgagggctggaagagggccaggagagctgtggacaaggagcggcgggtgcgcttcctgctggagcctgctgtggtggtggcccctgaggctgatgctgaggccgaggccgccccccgggagggccctgtgtggctgtgcagctatggccggcccccagctgcccggcccactggagccccccagcccggggagctgcaggagctggagcggcgcatcgaggtggcccgggagcggctgcggcaggccctggtgagaagaggccagctgctggcccagctgggggacagcgcccggcaccggccccggcggctgctgcaggcccgggccgccccagctgaggccccaccccacagcggccggcccggcagccaggagtag

SEQ ID NO: 175810 - DNA, 2502 bp, Artificial Sequence
  Description of Artificial Sequence: Synthetic coding sequence
atgcaccagctgttccggctggtgctgggccagaaggacctgagcagagctggggacctcttcagcctggatgacagcgagattgaggacagcctgacagaggccctggagcagatcaagatcatcagcagcagcagtgactaccagaccaacaacaatgaccaggccgtggtggagatctgcatcacccgcatcaccacagccatccgggagacagagagcattgagaagcacgccaaggccctggtgggcctgtgggacagctgcctggagcacaacctgcggccctttgggaaggatgaggacacccctcatgccaagatcgccagtgacatcatgagctgcatcctgcagaactacaacagacctcctgtgatggccctggccatccccatcgctgtgaagttcctgcaccggggcaacaaggagctgtgcaggaacatgagcaactacctgagcctggccgccatcaccaaggctgacctgctggccgaccacacagaggtgattgtgaagagcatcctgcagggcaacaccatgctgctgcgggtgctgcctgctgtgtatgagaagcagccccagcccatcaacagacacctgacagagctgctggccctgatgagccagctggagcagcctgagcagtaccacctgctgcggctgctgcacgtggccgccaagaagaagcagctggaggtggtgcagaagtgcatccccttcctgattggccacctgaaggacagcacccacaatgacatcatcctgaacatcctgattgaaattgctgtgtatgagcctgtggccctgaacagcttcctgcccatgctgaaggagattggagagcgcttcccctacctgaccggccagatggcccgcatctacggggctgtgggccacgtggatgaggagcgggcccggagctgcctgacctacctggtgtcccagctggccaacatggagcacagcttccaccacatcctgctgctggagatcaagagcatcacagacaccttcagcagcatcctgggcccccagagccgggacatcttcaggatgagcaacagcttcaccgccatcgccaagctgctgacccggcagctggagaacaccaaggccggcagcggccgcaggaagatcagcacagaaattgagttccctgagaagctggaggagaccaagctgattgtgacagaaaatgaagaccacgagaagctgcaggtgaagatccaggcctttgaggacaagatcaatgccggcagcaacaccccaggcagcatccgccgctacagcctgggccaggtgtccaaggaggagaggaagaacatccgcttcaacagaagcaagagcctggccttccacaccatgctgaccaagggcgtgggcagtgatgatggagaagatgagaacagaggagacatcccagccagcatcagcctgtctgaaattgaccccctgggccagggcaatgacaagctgcccttcaagacagacacagagaggagccagctgggggagagctctgtgtcctaccccaacatcatccacatcgacagcgagaacctgtctgagaccgtgaaggagaacagccaggaggagaccccagagaccacagccagccccatcgagtaccaggacaagctgtacctgcacctgaagaagaacctgagcaaggtgaaggcctatgccatggagatcggcaagaagatccctgtgcctgaccagtgcaccatcgaggacacagtgcgcagctgtgtggccaagctgttcttcacctgcagcctgaagggccactactgcctgtacagcaagagcagcttcatcctgatcagccaggagccccagccctggatccagatcatgttcctgttccagcagagcctcttccctgagcccctgagcatccagagccacagcgtgcagttcctgcgggccctgtgggagaagacccaggccggcggggcccacagctttgaaacagccatgatggagagcaccttcccccagcagaaggacctggaccaggtgcagctgcacctggaggaggtgcgcttctttgatgtgtttggcttcagcgagacagctggggcctggcagtgcttcatgtgcaacaaccctgagaaggccaccgtggtgaaccaggacggccagcccctgattgagggcaagctgaaggagaagcaggtgcgctggaagttcatcaagcgctggaagacccgctacttcaccctggccggcaaccagctgctcttccagaagggcaagagcaaggatgatcctgatgactgccccatcgagctgagcaaggtgcagagcgtgaaggctgtggccaagaagagaagagacaggagcctgccccgggcctttgagatcttcacagacaacaagacctacgtgttcaaggccaaggatgagaagaatgctgaggagtggctgcagtgcatcaacgtggccgtggcccaggccaaggagcgggagagccgggaggtgaccacctacctgtag

SEQ ID NO: 175811 - DNA, 2502 bp, Artificial Sequence; identical to SEQ ID NO: 175810
  Description of Artificial Sequence: Synthetic coding sequence

SEQ ID NO: 175812 - DNA, 2367 bp, Artificial Sequence
  Description of Artificial Sequence: Synthetic coding sequence
atgcaccagctgttccggctggtgctgggccagaaggacctgagcagagctggggacctcttcagcctggatgacagcgagattgaggacagcctgacagaggccctggagcagatcaagatcatcagcagcagcagtgactaccagaccaacaacaatgaccaggccgtggtggagatctgcatcacccgcatcaccacagccatccgggagacagagagcattgagaagcacgccaaggccctggtgggcctgtgggacagctgcctggagcacaacctgcggccctttgggaaggatgaggacacccctcatgccaagatcgccagtgacatcatgagctgcatcctgcagaactacaacagacctcctgtgatggccctggccatccccatcgctgtgaagttcctgcaccggggcaacaaggagctgtgcaggaacatgagcaactacctgagcctggccgccatcaccaaggctgacctgctggccgaccacacagaggtgattgtgaagagcatcctgcagggcaacaccatgctgctgcgggtgctgcctgctgtgtatgagaagcagccccagcccatcaacagacacctgacagagctgctggccctgatgagccagctggagcagcctgagcagtaccacctgctgcggctgctgcacgtggccgccaagaagaagcagctggaggtggtgcagaagtgcatccccttcctgattggccacctgaaggacagcacccacaatgacatcatcctgaacatcctgattgaaattgctgtgtatgagcctgtggccctgaacagcttcctgcccatgctgaaggagattggagagcgcttcccctacctgaccggccagatggcccgcatctacggggctgtgggccacgtggatgaggagcgggcccggagctgcctgacctacctggtgtcccagctggccaacatggagcacagcttccaccacatcctgctgctggagatcaagagcatcacagacaccttcagcagcatcctgggcccccagagccgggacatcttcaggatgagcaacagcttcaccgccatcgccaagctgctgacccggcagctggagaacaccaaggccggcagcggccgcaggaagatcagcacagaaattgagttccctgagaagctggaggagaccaagctgattgtgacagaaaatgaagaccacgagaagctgcaggtgaagatccaggcctttgaggacaagatcaatgccggcagcaacaccccaggcagcatccgccgctacagcctgggccaggtgtccaaggaggagaggaagaacatccgcttcaacagaagcaagagcctggccttccacaccatgctgaccaagggcgtgggcagtgatgatggagaagatgagaacagaggagacatcccagccagcatcagcctgtctgaaattgaccccctgggccagggcaatgacaagctgcccttcaagacagacacagagaggagccagctgggggagagctctgtgtcctaccccaacatcatccacatcgacagcgagaacctgtctgagaccgtgaaggagaacagccaggaggagaccccagagaccacagccagccccatcgagtaccaggacaagctgtacctgcacctgaagaagaacctgagcaaggtgaaggcctatgccatggagatcggcaagaagatccctgtgcctgaccagtgcaccatcgaggacacagtgcgcagctgtgtggccaagctgttcttcacctgcagcctgaagggccactactgcctgtacagcaagagcagcttcatcctgatcagccaggagccccagccctggatccagatcatgttcctgttccagcaggacctggaccaggtgcagctgcacctggaggaggtgcgcttctttgatgtgtttggcttcagcgagacagctggggcctggcagtgcttcatgtgcaacaaccctgagaaggccaccgtggtgaaccaggacggccagcccctcatcgagggcaagctgaaggagaagcaggtgcgctggaagttcatcaagcgctggaagacccgctacttcaccctggccggcaaccagctgctcttccagaagggcaagagcaaggatgatcctgatgactgccccatcgagctgagcaaggtgcagagcgtgaaggctgtggccaagaagaggcgggacaggagcctgccccgggcctttgagatcttcacagacaacaagacctacgtgttcaaggccaaggatgagaagaatgctgaggagtggctgcagtgcatcaacgtggccgtggcccaggccaaggagcgggagagccgggaggtgaccacctacctgtag

SEQ ID NO: 175813 - DNA, 192 bp, Artificial Sequence
  Description of Artificial Sequence: Synthetic coding sequence
atgcaccagctgttccggctggtgctgggccagaaggacctgagcagagctggggacctcttcagcctggatgacagcgagattgaggacagcctgacagaggccctggagcagatcaagatcatcagcagcagcagtgactaccagaccaacaacaatgaccaggccgtggtggagatctgcatcacctag

SEQ ID NO: 175814 - DNA, 642 bp, Artificial Sequence
  Description of Artificial Sequence: Synthetic coding sequence
atgcaccagctgttccggctggtgctgggccagaaggacctgagcagagctggggacctcttcagcctggatgacagcgagattgaggacagcctgacagaggccctggagcagatcaagatcatcagcagcagcagtgactaccagaccaacaacaatgaccaggccgtggtggagatctgcatcacccgcatcaccacagccatccgggagacagagagcattgagaagcacgccaaggccctggtgggcctgtgggacagctgcctggagcacaacctgcggccctttgggaaggatgaggacacccctcatgccaagatcgccagtgacatcatgagctgcatcctgcagaactacaacagacctcctgtgatggccctggccatccccatcgctgtgaagttcctgcaccggggcaacaaggagctgtgcaggaacatgagcaactacctgagcctggccgccatcaccaaggctgacctgctggccgaccacacagaggtgattgtgaagagcatcctgcagggcatggtgaggaagctgagcctgggcacctgcttcggccgctacctgaaggtgttcagcagcagcatctacggcctgtgggaggcccggccccgggtgctggaggccaactag

SEQ ID NO: 175815 - DNA, 498 bp, Artificial Sequence
  Description of Artificial Sequence: Synthetic coding sequence
atgcaccagctgttccggctggtgctgggccagaaggacctgagcagagctggggacctcttcagcctggatgacagcgagattgaggacagcctgacagaggccctggagcagatcaagatcatcagcagcagcagtgactaccagaccaacaacaatgaccaggccgtggtggagatctgcatcacccgcatcaccacagccatccgggagacagagagcattgagaagcacgccaaggccctggtgggcctgtgggacagctgcctggagcacaacctgcggccctttgggaaggatgaggacacccctcatgccaagatcgccagtgacatcatgagctgcatcctgcagaactacaacagacctcctgtgatggccctggccatccccatcgctgtgaagttcctgcaccggggcaacaaggagctgtgcaggaacatgagcaactacctgagcctggccgccatcaccaaggctgacctgctggccgactag

SEQ ID NO: 175816 - DNA, 168 bp, Artificial Sequence
  Description of Artificial Sequence: Synthetic coding sequence
atgcaccagctgttccggctggtgctgggccagaaggacctgagcagagctggggacctcttcagcctggatgacagcgagattgaggacagcctgacagaggccctggagcagatcaagatcatcagcagcagcagtgactaccagaccaacaacaatgaccagtag

SEQ ID NO: 175817 - DNA, 642 bp, Artificial Sequence; identical to SEQ ID NO: 175814
  Description of Artificial Sequence: Synthetic coding sequence

SEQ ID NO: 175818 - DNA, 534 bp, Artificial Sequence
  Description of Artificial Sequence: Synthetic coding sequence
atgcaccagctgttccggctggtgctgggccagaaggacctgagcagagctggggacctcttcagcctggatgacagcgagattgaggacagcctgacagaggccctggagcagatcaagatcatcagcagcagcagtgactaccagaccaacaacaatgaccaggccgtggtggagatctgcatcacccgcatcaccacagccatccgggagacagagagcattgagaagcacgccaaggccctggtgggcctgtgggacagctgcctggagcacaacctgcggccctttgggaaggatgaggacacccctcatgccaagatcgccagtgacatcatgagctgcatcctgcagaactacaacagacctcctgtgatggccctggccatccccatcgctgtgaagttcctgcaccggggcaacaaggagctgtgcaggaacatgagcaactacctgagcctggccgccatcaccaaggctgacctgctggccgaccacacagaggtgattgtgaagagcatcctgcaggtgtag

SEQ ID NO: 175819 - DNA, 2367 bp, Artificial Sequence; identical to SEQ ID NO: 175812
  Description of Artificial Sequence: Synthetic coding sequence

SEQ ID NO: 175820 - DNA, 3768 bp, Artificial Sequence
  Description of Artificial Sequence: Synthetic coding sequence
atggagctggccgccctgtgccgctggggcctgctgctggccctgctgcccccaggggccgccagcacccaggtgtgcacaggaacagacatgaagctgcggctgcctgccagccctgagacccacctggacatgctgcggcacctgtaccagggctgccaggtggtgcagggcaacctggagctgacctacctgcccaccaatgccagcctgtccttcctgcaggacatccaggaggtgcagggctacgtgctgattgcccacaaccaggtgcggcaggtgcccctgcagaggctgagaattgtgcggggcacccagctgtttgaggacaactatgccctggccgtgctggacaatggagaccccctgaacaacaccacccctgtgactggagccagccctgggggcctgcgggagctgcagctgcggagcctgacagagatcctgaagggcggcgtgctgatccagaggaacccccagctgtgctaccaggacaccatcctgtggaaggacatcttccacaagaacaaccagctggccctgaccctgattgacaccaacagaagccgggcctgccacccctgcagccccatgtgcaagggcagccgctgctggggcgagagcagcgaggactgccagagcctgaccaggacagtgtgtgccggcggctgtgcccgctgcaagggccccctgcccacagactgctgccacgagcagtgtgccgccggctgcaccggccccaagcacagcgactgcctggcctgcctgcacttcaaccacagcggcatctgtgagctgcactgcccagccctggtgacctacaacacagacacctttgagagcatgcccaaccctgagggccgctacacctttggagccagctgtgtgacagcctgcccctacaactacctgagcacagatgtgggcagctgcaccctggtgtgccccctgcacaaccaggaggtgacagcagaagatggcacccagagatgtgagaagtgcagcaagccctgtgcccgggtgtgctacggcctgggcatggagcacctgcgggaggtgcgggctgtgaccagcgccaacatccaggagtttgctggctgcaagaagatcttcggcagcctggccttcctgcctgagagctttgatggagaccctgccagcaacacagcccccctgcagcctgagcagctgcaggtgtttgagaccctggaggagatcaccggctacctgtacatcagcgcctggccagacagcctgcctgacctgtctgtgttccagaacctgcaggtgatccggggccgcatcctgcacaacggggcctacagcctgaccctgcagggcctgggcatctcctggctgggcctgcggagcctgcgggagctgggcagcggcctggccctgatccaccacaacacccacctgtgctttgtgcacacagtgccctgggaccagctgttcaggaacccccaccaggccctgctgcacacagccaacagaccagaagatgaatgtgtgggggagggcctggcctgccaccagctgtgtgcccggggccactgctggggccctggccccacccagtgtgtgaactgcagccagttcctgcggggccaggagtgtgtggaggagtgccgggtgctgcagggcctgccccgggagtatgtgaatgcccggcactgcctgccctgccaccctgagtgccagccccagaatggatctgtgacctgctttggacctgaggccgaccagtgtgtggcctgtgcccactacaaggacccccccttctgtgtggcccgctgccccagcggcgtgaagccagacctgagctacatgcccatctggaagttcccagatgaggagggcgcctgccagccctgccccatcaactgcacccacagctgtgtggacctggatgacaagggctgcccagctgagcagagggccagccccctgaccagcatcatctctgctgtggtgggcatcctgctggtggtggtgctgggcgtggtgtttggcatcctgatcaagaggcggcagcagaagatcaggaagtacaccatgaggcggctgctgcaggagacagagctggtggagcccctgaccccatctggggccatgcccaaccaggcccagatgaggatcctgaaggagacagagctgaggaaggtgaaggtgctgggcagcggggcctttggaacagtgtacaagggcatctggatcccagatggagaaaatgtgaagatccctgtggccatcaaggtgctgcgggagaacaccagccccaaggccaacaaggagatcctggatgaggcctacgtgatggccggcgtgggcagcccctacgtgtcccggctgctgggcatctgcctgaccagcacagtgcagctggtgacccagctgatgccctacggctgcctgctggaccacgtgcgggagaacagaggccgcctgggcagccaggacctgctgaactggtgcatgcagatcgccaagggcatgagctacctggaggatgtgcggctggtgcaccgggacctggccgccagaaatgtgctggtgaagagccccaaccacgtgaagatcacagactttggcctggcccggctgctggacattgatgaaacagagtaccacgcagatggcggcaaggtgcccatcaagtggatggccctggagagcatcctgcggcggcgcttcacccaccagagtgatgtgtggagctatggagtgacagtgtgggagctgatgaccttcggggccaagccctatgatggcatcccagcccgggagatcccagacctgctggagaagggggagcggctgccccagccccccatctgcaccattgatgtgtacatgatcatggtgaagtgctggatgattgattctgagtgccggccccgcttccgggagctggtgtctgagttcagcaggatggcccgggacccccagagatttgtggtgatccagaatgaagacctgggccctgccagccccctggacagcaccttctaccgcagcctgctggaggatgatgacatgggagacctggtggatgctgaggagtacctggtgccccagcagggcttcttctgcccagaccctgcccctggagctgggggcatggtgcaccaccgccacaggagcagcagcaccaggtctgggggcggggacctgaccctgggcctggagcccagcgaggaggaggcccccaggagccccctggcccccagcgagggcgccggcagtgatgtgtttgatggagacctgggcatgggcgccgccaagggcctgcagagcctgcccacccatgaccccagccccctgcagcgctacagcgaggaccccaccgtgcccctgcccagcgagacagatggctacgtggcccccctgacctgcagcccccagccagaatatgtgaaccagccagatgtgcggccccagccccccagcccccgggagggccccctgcctgctgcccggcctgctggggccaccctggagcggcccaagaccctgagccctgggaagaatggagtggtgaaggatgtgtttgcctttggaggagctgtggagaaccctgagtacctgaccccccagggcggggccgccccccagccccaccccccaccagccttctccccagcctttgacaacctgtactactgggaccaggaccccccagagcggggggccccacccagcaccttcaagggcacccccacagctgagaaccctgagtacctgggcctggatgtgcctgtgtag

SEQ ID NO: 175821 - DNA, 3678 bp, Artificial Sequence
  Description of Artificial Sequence: Synthetic coding sequence
atgaagctgcggctgcctgccagccctgagacccacctggacatgctgcggcacctgtaccagggctgccaggtggtgcagggcaacctggagctgacctacctgcccaccaatgccagcctgtccttcctgcaggacatccaggaggtgcagggctacgtgctgattgcccacaaccaggtgcggcaggtgcccctgcagaggctgagaattgtgcggggcacccagctgtttgaggacaactatgccctggccgtgctggacaatggagaccccctgaacaacaccacccctgtgactggagccagccctgggggcctgcgggagctgcagctgcggagcctgacagagatcctgaagggcggcgtgctgatccagaggaacccccagctgtgctaccaggacaccatcctgtggaaggacatcttccacaagaacaaccagctggccctgaccctgattgacaccaacagaagccgggcctgccacccctgcagccccatgtgcaagggcagccgctgctggggcgagagcagcgaggactgccagagcctgaccaggacagtgtgtgccggcggctgtgcccgctgcaagggccccctgcccacagactgctgccacgagcagtgtgccgccggctgcaccggccccaagcacagcgactgcctggcctgcctgcacttcaaccacagcggcatctgtgagctgcactgcccagccctggtgacctacaacacagacacctttgagagcatgcccaaccctgagggccgctacacctttggagccagctgtgtgacagcctgcccctacaactacctgagcacagatgtgggcagctgcaccctggtgtgccccctgcacaaccaggaggtgacagcagaagatggcacccagagatgtgagaagtgcagcaagccctgtgcccgggtgtgctacggcctgggcatggagcacctgcgggaggtgcgggctgtgaccagcgccaacatccaggagtttgctggctgcaagaagatcttcggcagcctggccttcctgcctgagagctttgatggagaccctgccagcaacacagcccccctgcagcctgagcagctgcaggtgtttgagaccctggaggagatcaccggctacctgtacatcagcgcctggccagacagcctgcctgacctgtctgtgttccagaacctgcaggtgatccggggccgcatcctgcacaacggggcctacagcctgaccctgcagggcctgggcatctcctggctgggcctgcggagcctgcgggagctgggcagcggcctggccctgatccaccacaacacccacctgtgctttgtgcacacagtgccctgggaccagctgttcaggaacccccaccaggccctgctgcacacagccaacagaccagaagatgaatgtgtgggggagggcctggcctgccaccagctgtgtgcccggggccactgctggggccctggccccacccagtgtgtgaactgcagccagttcctgcggggccaggagtgtgtggaggagtgccgggtgctgcagggcctgccccgggagtatgtgaatgcccggcactgcctgccctgccaccctgagtgccagccccagaatggatctgtgacctgctttggacctgaggccgaccagtgtgtggcctgtgcccactacaaggacccccccttctgtgtggcccgctgccccagcggcgtgaagccagacctgagctacatgcccatctggaagttcccagatgaggagggcgcctgccagccctgccccatcaactgcacccacagctgtgtggacctggatgacaagggctgcccagctgagcagagggccagccccctgaccagcatcatctctgctgtggtgggcatcctgctggtggtggtgctgggcgtggtgtttggcatcctgatcaagaggcggcagcagaagatcaggaagtacaccatgaggcggctgctgcaggagacagagctggtggagcccctgaccccatctggggccatgcccaaccaggcccagatgaggatcctgaaggagacagagctgaggaaggtgaaggtgctgggcagcggggcctttggaacagtgtacaagggcatctggatcccagatggagaaaatgtgaagatccctgtggccatcaaggtgctgcgggagaacaccagccccaaggccaacaaggagatcctggatgaggcctacgtgatggccggcgtgggcagcccctacgtgtcccggctgctgggcatctgcctgaccagcacagtgcagctggtgacccagctgatgccctacggctgcctgctggaccacgtgcgggagaacagaggccgcctgggcagccaggacctgctgaactggtgcatgcagatcgccaagggcatgagctacctggaggatgtgcggctggtgcaccgggacctggccgccagaaatgtgctggtgaagagccccaaccacgtgaagatcacagactttggcctggcccggctgctggacattgatgaaacagagtaccacgcagatggcggcaaggtgcccatcaagtggatggccctggagagcatcctgcggcggcgcttcacccaccagagtgatgtgtggagctatggagtgacagtgtgggagctgatgaccttcggggccaagccctatgatggcatcccagcccgggagatcccagacctgctggagaagggggagcggctgccccagccccccatctgcaccattgatgtgtacatgatcatggtgaagtgctggatgattgattctgagtgccggccccgcttccgggagctggtgtctgagttcagcaggatggcccgggacccccagagatttgtggtgatccagaatgaagacctgggccctgccagccccctggacagcaccttctaccgcagcctgctggaggatgatgacatgggagacctggtggatgctgaggagtacctggtgccccagcagggcttcttctgcccagaccctgcccctggagctgggggcatggtgcaccaccgccacaggagcagcagcaccaggtctgggggcggggacctgaccctgggcctggagcccagcgaggaggaggcccccaggagccccctggcccccagcgagggcgccggcagtgatgtgtttgatggagacctgggcatgggcgccgccaagggcctgcagagcctgcccacccatgaccccagccccctgcagcgctacagcgaggaccccaccgtgcccctgcccagcgagacagatggctacgtggcccccctgacctgcagcccccagccagaatatgtgaaccagccagatgtgcggccccagccccccagcccccgggagggccccctgcctgctgcccggcctgctggggccaccctggagcggcccaagaccctgagccctgggaagaatggagtggtgaaggatgtgtttgcctttggaggagctgtggagaaccctgagtacctgaccccccagggcggggccgccccccagccccaccccccaccagccttctccccagcctttgacaacctgtactactgggaccaggaccccccagagcggggggccccacccagcaccttcaagggcacccccacagctgagaaccctgagtacctgggcctggatgtgcctgtgtag

SEQ ID NO: 175822 - DNA, 2940 bp, Artificial Sequence
  Description of Artificial Sequence: Synthetic coding sequence
atggagctggccgccctgtgccgctggggcctgctgctggccctgctgcccccaggggccgccagcacccaggacaactacctgagcacagatgtgggcagctgcaccctggtgtgccccctgcacaaccaggaggtgacagcagaagatggcacccagagatgtgagaagtgcagcaagccctgtgcccgggtgtgctacggcctgggcatggagcacctgcgggaggtgcgggctgtgaccagcgccaacatccaggagtttgctggctgcaagaagatcttcggcagcctggccttcctgcctgagagctttgatggagaccctgccagcaacacagcccccctgcagcctgagcagctgcaggtgtttgagaccctggaggagatcaccggctacctgtacatcagcgcctggccagacagcctgcctgacctgtctgtgttccagaacctgcaggtgatccggggccgcatcctgcacaacggggcctacagcctgaccctgcagggcctgggcatctcctggctgggcctgcggagcctgcgggagctgggcagcggcctggccctgatccaccacaacacccacctgtgctttgtgcacacagtgccctgggaccagctgttcaggaacccccaccaggccctgctgcacacagccaacagaccagaagatgaatgtgtgggggagggcctggcctgccaccagctgtgtgcccggggccactgctggggccctggccccacccagtgtgtgaactgcagccagttcctgcggggccaggagtgtgtggaggagtgccgggtgctgcagggcctgccccgggagtatgtgaatgcccggcactgcctgccctgccaccctgagtgccagccccagaatggatctgtgacctgctttggacctgaggccgaccagtgtgtggcctgtgcccactacaaggacccccccttctgtgtggcccgctgccccagcggcgtgaagccagacctgagctacatgcccatctggaagttcccagatgaggagggcgcctgccagccctgccccatcaactgcacccacagctgtgtggacctggatgacaagggctgcccagctgagcagagggccagccccctgaccagcatcatctctgctgtggtgggcatcctgctggtggtggtgctgggcgtggtgtttggcatcctgatcaagaggcggcagcagaagatcaggaagtacaccatgaggcggctgctgcaggagacagagctggtggagcccctgaccccatctggggccatgcccaaccaggcccagatgaggatcctgaaggagacagagctgaggaaggtgaaggtgctgggcagcggggcctttggaacagtgtacaagggcatctggatcccagatggagaaaatgtgaagatccctgtggccatcaaggtgctgcgggagaacaccagccccaaggccaacaaggagatcctggatgaggcctacgtgatggccggcgtgggcagcccctacgtgtcccggctgctgggcatctgcctgaccagcacagtgcagctggtgacccagctgatgccctacggctgcctgctggaccacgtgcgggagaacagaggccgcctgggcagccaggacctgctgaactggtgcatgcagatcgccaagggcatgagctacctggaggatgtgcggctggtgcaccgggacctggccgccagaaatgtgctggtgaagagccccaaccacgtgaagatcacagactttggcctggcccggctgctggacattgatgaaacagagtaccacgcagatggcggcaaggtgcccatcaagtggatggccctggagagcatcctgcggcggcgcttcacccaccagagtgatgtgtggagctatggagtgacagtgtgggagctgatgaccttcggggccaagccctatgatggcatcccagcccgggagatcccagacctgctggagaagggggagcggctgccccagccccccatctgcaccattgatgtgtacatgatcatggtgaagtgctggatgattgattctgagtgccggccccgcttccgggagctggtgtctgagttcagcaggatggcccgggacccccagagatttgtggtgatccagaatgaagacctgggccctgccagccccctggacagcaccttctaccgcagcctgctggaggatgatgacatgggagacctggtggatgctgaggagtacctggtgccccagcagggcttcttctgcccagaccctgcccctggagctgggggcatggtgcaccaccgccacaggagcagcagcaccaggtctgggggcggggacctgaccctgggcctggagcccagcgaggaggaggcccccaggagccccctggcccccagcgagggcgccggcagtgatgtgtttgatggagacctgggcatgggcgccgccaagggcctgcagagcctgcccacccatgaccccagccccctgcagcgctacagcgaggaccccaccgtgcccctgcccagcgagacagatggctacgtggcccccctgacctgcagcccccagccagaatatgtgaaccagccagatgtgcggccccagccccccagcccccgggagggccccctgcctgctgcccggcctgctggggccaccctggagcggcccaagaccctgagccctgggaagaatggagtggtgaaggatgtgtttgcctttggaggagctgtggagaaccctgagtacctgaccccccagggcggggccgccccccagccccaccccccaccagccttctccccagcctttgacaacctgtactactgggaccaggaccccccagagcggggggccccacccagcaccttcaagggcacccccacagctgagaaccctgagtacctgggcctggatgtgcctgtgtag

SEQ ID NO: 175823 - DNA, 1812 bp, Artificial Sequence
  Description of Artificial Sequence: Synthetic coding sequence
atgaagctgcggctgcctgccagccctgagacccacctggacatgctgcggcacctgtaccagggctgccaggtggtgcagggcaacctggagctgacctacctgcccaccaatgccagcctgtccttcctgcaggacatccaggaggtgcagggctacgtgctgattgcccacaaccaggtgcggcaggtgcccctgcagaggctgagaattgtgcggggcacccagctgtttgaggacaactatgccctggccgtgctggacaatggagaccccctgaacaacaccacccctgtgactggagccagccctgggggcctgcgggagctgcagctgcggagcctgacagagatcctgaagggcggcgtgctgatccagaggaacccccagctgtgctaccaggacaccatcctgtggaaggacatcttccacaagaacaaccagctggccctgaccctgattgacaccaacagaagccgggcctgccacccctgcagccccatgtgcaagggcagccgctgctggggcgagagcagcgaggactgccagagcctgaccaggacagtgtgtgccggcggctgtgcccgctgcaagggccccctgcccacagactgctgccacgagcagtgtgccgccggctgcaccggccccaagcacagcgactgcctggcctgcctgcacttcaaccacagcggcatctgtgagctgcactgcccagccctggtgacctacaacacagacacctttgagagcatgcccaaccctgagggccgctacacctttggagccagctgtgtgacagcctgcccctacaactacctgagcacagatgtgggcagctgcaccctggtgtgccccctgcacaaccaggaggtgacagcagaagatggcacccagagatgtgagaagtgcagcaagccctgtgcccgggtgtgctacggcctgggcatggagcacctgcgggaggtgcgggctgtgaccagcgccaacatccaggagtttgctggctgcaagaagatcttcggcagcctggccttcctgcctgagagctttgatggagaccctgccagcaacacagcccccctgcagcctgagcagctgcaggtgtttgagaccctggaggagatcaccggctacctgtacatcagcgcctggccagacagcctgcctgacctgtctgtgttccagaacctgcaggtgatccggggccgcatcctgcacaacggggcctacagcctgaccctgcagggcctgggcatctcctggctgggcctgcggagcctgcgggagctgggcagcggcctggccctgatccaccacaacacccacctgtgctttgtgcacacagtgccctgggaccagctgttcaggaacccccaccaggccctgctgcacacagccaacagaccagaagatgaatgtgtgggggagggcctggcctgccaccagctgtgtgcccggggccactgctggggccctggccccacccagtgtgtgaactgcagccagttcctgcggggccaggagtgtgtggaggagtgccgggtgctgcagggcctgccccgggagtatgtgaatgcccggcactgcctgccctgccaccctgagtgccagccccagaatggatctgtgacctgctttggacctgaggccgaccagtgtgtggcctgtgcccactacaaggacccccccttctgtgtggcccgctgccccagcggcgtgaagccagacctgagctacatgcccatctggaagttcccagatgaggagggcgcctgccagccctgccccatcaactgcacccacagctag

SEQ ID NO: 175824 - DNA, 3678 bp, Artificial Sequence; identical to SEQ ID NO: 175821
  Description of Artificial Sequence: Synthetic coding sequence

SEQ ID NO: 175825 - DNA, 3723 bp, Artificial Sequence
  Description of Artificial Sequence: Synthetic coding sequence
atgccccggggctcctggaagccccaggtgtgcaccggcacagacatgaagctgcggctgcctgccagccctgagacccacctggacatgctgcggcacctgtaccagggctgccaggtggtgcagggcaacctggagctgacctacctgcccaccaatgccagcctgtccttcctgcaggacatccaggaggtgcagggctacgtgctgattgcccacaaccaggtgcggcaggtgcccctgcagaggctgcgcatcgtgcggggcacccagctgtttgaggacaactatgccctggccgtgctggacaacggggaccccctgaacaacaccacccctgtgactggagccagccctgggggcctgcgggagctgcagctgcggagcctgacagagatcctgaagggcggcgtgctgatccagaggaacccccagctgtgctaccaggacaccatcctgtggaaggacatcttccacaagaacaaccagctggccctgaccctgattgacaccaacagaagccgggcctgccacccctgcagccccatgtgcaagggcagccgctgctggggcgagagcagcgaggactgccagagcctgaccaggacagtgtgtgccggcggctgtgcccgctgcaagggccccctgcccacagactgctgccacgagcagtgtgccgccggctgcaccggccccaagcacagcgactgcctggcctgcctgcacttcaaccacagcggcatctgtgagctgcactgcccagccctggtgacctacaacacagacacctttgagagcatgcccaaccctgagggccgctacaccttcggggccagctgtgtgacagcctgcccctacaactacctgagcacagatgtgggcagctgcaccctggtgtgccccctgcacaaccaggaggtgacagcagaagatggcacccagagatgtgagaagtgcagcaagccctgtgcccgggtgtgctacggcctgggcatggagcacctgcgggaggtgcgggctgtgaccagcgccaacatccaggagtttgctggctgcaagaagatcttcggcagcctggccttcctgcctgagagctttgatggagaccctgccagcaacacagcccccctgcagcctgagcagctgcaggtgtttgagaccctggaggagatcaccggctacctgtacatcagcgcctggccagacagcctgcctgacctgagcgtcttccagaacctgcaggtgatccggggccgcatcctgcacaatggagcctacagcctgaccctgcagggcctgggcatctcctggctgggcctgcggagcctgcgggagctgggcagcggcctggccctgatccaccacaacacccacctgtgctttgtgcacacagtgccctgggaccagctgttcaggaacccccaccaggccctgctgcacacagccaacagaccagaagatgaatgtgtgggggagggcctggcctgccaccagctgtgtgcccggggccactgctggggccctggccccacccagtgtgtgaactgcagccagttcctgcggggccaggagtgtgtggaggagtgccgggtgctgcagggcctgccccgggagtatgtgaatgcccggcactgcctgccctgccaccctgagtgccagccccagaatggatctgtgacctgcttcggccctgaggccgaccagtgtgtggcctgtgcccactacaaggacccccccttctgtgtggcccgctgccccagcggcgtgaagccagacctgagctacatgcccatctggaagttcccagatgaggagggcgcctgccagccctgccccatcaactgcacccacagctgtgtggacctggatgacaagggctgcccagctgagcagagggccagccccctgaccagcatcatctctgctgtggtgggcatcctgctggtggtggtgctgggcgtggtgtttggcatcctgatcaagaggcggcagcagaagatcaggaagtacaccatgaggcggctgctgcaggagacagagctggtggagcccctgacccccagcggggccatgcccaaccaggcccagatgaggatcctgaaggagacagagctgaggaaggtgaaggtgctgggcagcggggccttcggcaccgtgtacaagggcatctggatcccagatggagaaaatgtgaagatccctgtggccatcaaggtgctgcgggagaacaccagccccaaggccaacaaggagatcctggatgaggcctacgtgatggccggcgtgggcagcccctacgtgtcccggctgctgggcatctgcctgaccagcacagtgcagctggtgacccagctgatgccctacggctgcctgctggaccacgtgagagaaaatagaggccgcctgggcagccaggacctgctgaactggtgcatgcagatcgccaagggcatgagctacctggaggatgtgcggctggtgcaccgggacctggccgccagaaatgtgctggtgaagagccccaaccacgtgaagatcacagactttggcctggcccggctgctggacattgatgaaacagagtaccacgcagatggcggcaaggtgcccatcaagtggatggccctggagagcatcctgcggcggcgcttcacccaccagagtgatgtgtggagctatggagtgacagtgtgggagctgatgacctttggagccaagccctatgatggcatcccagcccgggagatcccagacctgctggagaagggggagcggctgccccagccccccatctgcaccattgatgtgtacatgatcatggtgaagtgctggatgattgacagtgaatgtcggccccgcttccgggagctggtgtctgagttcagcaggatggcccgggacccccagagatttgtggtgatccagaatgaagacctgggccctgccagccccctggacagcaccttctaccgcagcctgctggaggatgatgacatgggagacctggtggatgctgaggagtacctggtgccccagcagggcttcttctgcccagaccctgcccctggggccggcggcatggtgcaccaccgccacaggagcagcagcaccaggtctgggggcggggacctgaccctgggcctggagcccagcgaggaggaggcccccaggagccccctggcccccagcgagggcgccggcagtgatgtgtttgatggagacctgggcatgggcgccgccaagggcctgcagagcctgcccacccatgaccccagccccctgcagcgctacagcgaggaccccaccgtgcccctgcccagcgagacagatggctacgtggcccccctgacctgcagcccccagccagaatatgtgaaccagccagatgtgcggccccagccccccagcccccgggagggccccctgcctgctgcccggcctgctggggccaccctggagcggcccaagaccctgagccctgggaagaatggagtggtgaaggatgtgtttgccttcggcggcgctgtggagaaccctgagtacctgaccccccagggcggggccgccccccagccccaccccccaccagccttcagccctgcctttgacaacctgtactactgggaccaggaccccccagagcggggggccccacccagcaccttcaagggcacccccacagcagaaaatcctgagtacctgggcctggatgtgcctgtgtag

SEQ ID NO: 175826 - DNA, 2259 bp, Artificial Sequence
  Description of Artificial Sequence: Synthetic coding sequence
atgggcaccagcgccctgtgggccctgtggctgctgctggccctgtgctgggccccccgggagagcggggccactggaactggaaggaaggccaagtgtgagcccagccagttccagtgcaccaacggccgctgcatcaccctgctgtggaagtgtgatggagatgaggactgtgtggatggcagtgatgagctggactgtgccccacccacctgtggggcccacgagttccagtgcagcaccagcagctgcatccccatctcctgggtgtgtgatgatgatgctgactgcagcgaccagagtgatgagagcctggagcagtgtggccggcagcccgtcatccacaccaagtgcccagccagcgagatccagtgtggcagcggggagtgcatccacaagaagtggaggtgtgatggagaccctgactgcaaggatggcagtgatgaggtgaactgccccagcaggacctgcaggccagaccagtttgaatgtgaagatggcagctgcatccacggcagccggcagtgcaatggcatccgggactgtgtggatggcagtgatgaggtgaactgcaagaatgtgaaccagtgcctgggccctgggaagttcaagtgccgctctggagaatgtattgacatcagcaaggtgtgcaaccaggagcaggactgccgggactggagcgatgagcccctgaaggagtgccacatcaatgaatgtctggtgaacaatggaggctgcagccacatctgcaaggacctggtgattggctatgaatgtgactgtgccgccggctttgagctgattgacaggaagacctgtggggacattgatgagtgccagaaccctggcatctgcagccagatctgcatcaacctgaagggcggctacaagtgtgaatgttcccggggctaccagatggacctggccaccggggtgtgcaaggctgtgggcaaggagcccagcctcatcttcaccaacagaagagacatcaggaagattggcctggagaggaaggagtacatccagctggtggagcagctgaggaacacagtggccctggatgctgacattgctgcccagaagctgttctgggccgacctgagccagaaggccatcttcagcgccagcattgatgacaaggtgggccgccacgtgaagatgattgacaacgtgtacaacccagctgccatcgctgtggactgggtgtacaagaccatctactggacagatgctgccagcaagaccatctctgtggccaccctggatggcaccaagaggaagttcctgttcaacagcgacctgcgggagcccgccagcattgctgtggaccccctgagcggctttgtgtactggagcgactggggcgagcccgccaagattgagaaggccggcatgaatggatttgaccggcggcccctggtgacagctgacatccagtggcccaacggcatcaccctggacctgatcaagagccggctgtactggctggacagcaagctgcacatgctgagctctgtggacctgaatggccaggacagaagaattgtgctgaagagcctggagttcctggcccaccccctggccctgaccatctttgaagatagagtgtactggattgatggagaaaatgaagctgtgtatggagccaacaagttcaccggcagcgagctggccaccctggtgaacaacctgaatgatgcccaggacatcatcgtgtaccacgagctggtgcagcccagcggcaagaactggtgtgaggaggacatggagaatggaggctgtgagtacctgtgcctgcctgccccccagatcaatgaccacagccccaagtacacctgcagctgccccagcggctacaacgtggaggagaatggccgggactgccagagcacagccaccaccgtgacctacagcgagaccaaggacaccaacaccacagagatcagcgccaccagcggcctggtgcctgggggcatcaacgtgaccacagctgtgtctgaggtgtctgtgccccccaagggcaccagcgctgcctgggccatcctgcccctgctgctgctggtgatggctgctgtgggcggctacctgatgtggaggaactggcagcacaagaacatgaagtccatgaactttgacaaccctgtgtacctgaagaccacagaggaggacctgagcattgacatcggccgccacagcgcctctgtgggccacacctacccagccatctctgtggtgtccacagatgatgacctggcctag

SEQ ID NO: 175827 - DNA, 522 bp, Artificial Sequence
  Description of Artificial Sequence: Synthetic coding sequence
atgggcaccagcgccctgtgggccctgtggctgctgctggccctgtgctgggccccccgggagagcggggccactggaactggaaggaaggccaagtgtgagcccagccagttccagtgcaccaacggccgctgcatcaccctgctgtggaagtgtgatggagatgaggactgtgtggatggcagtgatgagaagaactgtgtgaagaagacctgtgccgagagtgactttgtgtgcaacaacggccagtgtgtgcccagccgctggaagtgtgatggagaccctgactgtgaagatggcagtgatgagagccctgagcagtgcaggaacatcacctgcagcccagatgagttcacctgcagcagcggccgctgcatcagcaggaactttgtgtgcaatggccaggatgactgcagtgatggcagtgatgagctggactgtgccccacccacctgtggggcccacgagttccagtgcagcaccagcagctgcatccccatctcctgggtgtgtgatgactag

SEQ ID NO: 175828 - DNA, 2538 bp, Artificial Sequence
  Description of Artificial Sequence: Synthetic coding sequence
atgggcaccagcgccctgtgggccctgtggctgctgctggccctgtgctgggccccccgggagagcggggccactggaactggaaggaaggccaagtgtgagcccagccagttccagtgcaccaacggccgctgcatcaccctgctgtggaagtgtgatggagatgaggactgtgtggatggcagtgatgagaagaactgtgtgaagaagacctgtgccgagagtgactttgtgtgcaacaacggccagtgtgtgcccagccgctggaagtgtgatggagaccctgactgtgaagatggcagtgatgagagccctgagcagtgccacatgaggacctgccgcatccacgagatcagctgtggggcccacagcacccagtgcatccctgtgtcctggaggtgtgatggagaaaatgactgtgacagcggggaggatgaggagaactgtggcaacatcacctgcagcccagatgagttcacctgcagcagcggccgctgcatcagcaggaactttgtgtgcaatggccaggatgactgcagtgatggcagtgatgagctggactgtgccccacccacctgtggggcccacgagttccagtgcagcaccagcagctgcatccccatctcctgggtgtgtgatgatgatgctgactgcagcgaccagagtgatgagagcctggagcagtgtggccggcagcctgtgatccacaccaagtgcccagccagcgagatccagtgtggcagcggggagtgcatccacaagaagtggaggtgtgatggagaccctgactgcaaggatggcagtgatgaggtgaactgccccagcaggacctgcaggccagaccagtttgaatgtgaagatggcagctgcatccacggcagccggcagtgcaatggcatccgggactgtgtggatggcagtgatgaggtgaactgcaagaatgtgaaccagtgcctgggccctgggaagttcaagtgccgcagcggggagtgcatcgacatcagcaaggtgtgcaaccaggagcaggactgccgggactggagcgatgagcccctgaaggagtgccacatcaatgaatgtctggtgaacaacggcggctgcagccacatctgcaaggacctggtgattggctatgaatgtgactgtgccgccggctttgagctgattgacaggaagacctgtggggacattgatgagtgccagaaccctggcatctgcagccagatctgcatcaacctgaagggcggctacaagtgtgagtgcagccggggctaccagatggacctggccactggagtgtgcaaggctgtgggcaaggagcccagcctcatcttcaccaacagaagagacatcaggaagattggcctggagaggaaggagtacatccagctggtggagcagctgaggaacacagtggccctggatgctgacattgctgcccagaagctgttctgggccgacctgagccagaaggccatcttcagcgccagcattgatgacaaggtgggcagacatgtgaagatgattgacaacgtgtacaacccagctgccatcgctgtggactgggtgtacaagaccatctactggacagatgctgccagcaagaccatctctgtggccaccctggatggcaccaagaggaagttcctgttcaacagcgacctgcgggagcccgccagcattgctgtggaccccctgagcggctttgtgtactggagcgactggggcgagcccgccaagattgagaaggccggcatgaatggatttgacagaagacccctggtgacagctgacatccagtggcccaacggcatcaccctggacctgatcaagagccggctgtactggctggacagcaagctgcacatgctgagctctgtggacctgaatggccaggaccggcgcatcgtgctgaagagcctggagttcctggcccaccccctggccctgaccatctttgaggacagagtgtactggattgatggagaaaatgaggccgtgtatggagccaacaagttcaccggcagcgagctggccaccctggtgaacaacctgaatgatgcccaggacatcatcgtgtaccacgagctggtgcagcccagcggcaagaactggtgtgaggaggacatggagaatggaggctgtgagtacctgtgcctgcctgccccccagatcaatgaccacagccccaagtacacctgcagctgccccagcggctacaacgtggaggagaatggccgggactgccagaggatcaacgtgaccacagctgtgtctgaggtgtctgtgccccccaagggcaccagcgctgcctgggccatcctgcccctgctgctgctggtgatggctgctgtgggcggctacctgatgtggaggaactggcagcacaagaacatgaagtccatgaactttgacaaccctgtgtacctgaagaccacagaggaggacctgagcattgatattggccgccacagcgcctctgtgggccacacctacccagccatctctgtggtgtccacagatgatgacctggcctag

SEQ ID NO: 175829 - DNA, 2622 bp, Artificial Sequence
  Description of Artificial Sequence: Synthetic coding sequence
atgggcaccagcgccctgtgggccctgtggctgctgctggccctgtgctgggccccccgggagagcggggccactggaactggaaggaaggccaagtgtgagcccagccagttccagtgcaccaacggccgctgcatcaccctgctgtggaagtgtgatggagatgaggactgtgtggatggcagtgatgagaagaactgtgtgaagaagacctgtgccgagagtgactttgtgtgcaacaacggccagtgtgtgcccagccgctggaagtgtgatggagaccctgactgtgaagatggcagtgatgagagccctgagcagtgccacatgaggacctgccgcatccacgagatcagctgtggggcccacagcacccagtgcatccctgtgtcctggaggtgtgatggagaaaatgactgtgacagcggggaggatgaggagaactgtggcaacatcacctgcagcccagatgagttcacctgcagcagcggccgctgcatcagcaggaactttgtgtgcaatggccaggatgactgcagtgatggcagtgatgagctggactgtgccccacccacctgtggggcccacgagttccagtgcagcaccagcagctgcatccccatctcctgggtgtgtgatgatgatgctgactgcagcgaccagagtgatgagagcctggagcagtgtggccggcagcctgtgatccacaccaagtgcccagccagcgagatccagtgtggcagcggggagtgcatccacaagaagtggaggtgtgatggagaccctgactgcaaggatggcagtgatgaggtgaactgccccagcaggacctgcaggccagaccagtttgaatgtgaagatggcagctgcatccacggcagccggcagtgcaatggcatccgggactgtgtggatggcagtgatgaggtgaactgcaagaatgtgaaccagtgcctgggccctgggaagttcaagtgccgcagcggggagtgcatcgacatcagcaaggtgtgcaaccaggagcaggactgccgggactggagcgatgagcccctgaaggagtgccacatcaatgaatgtctggtgaacaacggcggctgcagccacatctgcaaggacctggtgattggctatgaatgtgactgtgccgccggctttgagctgattgacaggaagacctgtggggacattgatgagtgccagaaccctggcatctgcagccagatctgcatcaacctgaagggcggctacaagtgtgagtgcagccggggctaccagatggacctggccactggagtgtgcaaggctgtgggcaaggagcccagcctcatcttcaccaacagaagagacatcaggaagattggcctggagaggaaggagtacatccagctggtggagcagctgaggaacacagtggccctggatgctgacattgctgcccagaagctgttctgggccgacctgagccagaaggccatcttcagcgccagcattgatgacaaggtgggcagacatgtgaagatgattgacaacgtgtacaacccagctgccatcgctgtggactgggtgtacaagaccatctactggacagatgctgccagcaagaccatctctgtggccaccctggatggcaccaagaggaagttcctgttcaacagcgacctgcgggagcccgccagcattgctgtggaccccctgagcggctttgtgtactggagcgactggggcgagcccgccaagattgagaaggccggcatgaatggatttgacagaagacccctggtgacagctgacatccagtggcccaacggcatcaccctggacctgatcaagagccggctgtactggctggacagcaagctgcacatgctgagctctgtggacctgaatggccaggaccggcgcatcgtgctgaagagcctggagttcctggcccaccccctggccctgaccatctttgaggacagagtgtactggattgatggagaaaatgaggccgtgtatggagccaacaagttcaccggcagcgagctggccaccctggtgaacaacctgaatgatgcccaggacatcatcgtgtaccacgagctggtgcagcccagcggcaagaactggtgtgaggaggacatggagaatggaggctgtgagtacctgtgcctgcctgccccccagatcaatgaccacagccccaagtacacctgcagctgccccagcggctacaacgtggaggagaatggccgggactgccagagcacagccaccaccgtgacctacagcgagaccaaggacaccaacaccacagagatcagcgccaccagcggcctggtgcctgggggcatcaacgtgaccacagctgtgtctgaggtgtctgtgccccccaagggcaccagcgctgcctgggccatcctgcccctgctgctgctggtgatggctgctgtgggcggctacctgatgtggaggaactggcagcacaagaacatgaagtccatgaactttgacaaccctgtgtacctgaagaccacagaggaggacctgagcattgatattggccgccacagcgcctctgtgggccacacctacccagccatctctgtggtgtccacagatgatgacctggcctag

SEQ ID NO: 175830 - DNA, 729 bp, Artificial Sequence
  Description of Artificial Sequence: Synthetic coding sequence
atgtctgatgagcgggaggtggccgaggccgccaccggggaggatgccagcagccccccacccaagacagaagctgccagtgacccccagcaccctgctgccagcgagggcgctgctgctgctgctgccagcccccccctgctgcgctgcctggtgctgaccggctttggaggctatgacaaggtgaagctgcagagcaggcctgctgcccccccagcccctggccctggccagctgaccctgcggctgcgggcctgtggcctgaactttgctgacctgatggcccggcagggcctgtatgaccggctgccccccctgcctgtgaccccaggcatggagggcgccggcgtggtgattgctgtgggggagggcgtgtctgacaggaaggccggggacagagtgatggtgctgaacagaagtggcatgtggcaggaggaggtgacagtgcccagcgtgcagaccttcctgatccctgaggccatgacctttgaggaggccgccgccctgctggtgaactacatcacagcctacatggtgctgtttgattttggaaacctgcagcccggccacagcgtgctggtgcacatggccgccggcggcgtgggcatggctgctgtgcagctgccctacagcggagaatgtgacagcgtgagaaatggcctgggccagcaggcccggggcacagaaggagagtggggccacaccagccaccggctgagccatgactag

SEQ ID NO: 175831 - DNA, 1182 bp, Artificial Sequence
  Description of Artificial Sequence: Synthetic coding sequence
atgtctgatgagcgggaggtggccgaggccgccaccggggaggatgccagcagccccccacccaagacagaagctgccagtgacccccagcaccctgctgccagcgagggcgctgctgctgctgctgccagcccccccctgctgcgctgcctggtgctgaccggctttggaggctatgacaaggtgaagctgcagagcaggcctgctgcccccccagcccctggccctggccagctgaccctgcggctgcgggcctgtggcctgaactttgctgacctgatggcccggcagggcctgtatgaccggctgccccccctgcctgtgaccccaggcatggagggcgccggcgtggtgattgctgtgggggagggcgtgtctgacaggaaggccggggacagagtgatggtgctgaacagaagtggcatgtggcaggaggaggtgacagtgcccagcgtgcagaccttcctgatccctgaggccatgacctttgaggaggccgccgccctgctggtgaactacatcacagcctacatggtgctgtttgattttggaaacctgcagcccggccacagcgtgctggtgcacatggccgccggcggcgtgggcatggctgctgtgcagctgtgcaggacagtggagaatgtgacagtgtttggaacagccagcgccagcaagcatgaggccctgaaggaaaatggagtgacccaccccatcgactaccacaccacagattatgtggatgagatcaagaagatcagccccaagggcgtggacatcgtgatggaccccctgggcggcagtgacacagccaagggctacaacctgctgaagcccatgggcaaggtggtgacctacggcatggccaacctgctgaccggccccaagaggaacctgatggccctggcccggacctggtggaaccagttctctgtgacagccctgcagctgctgcaggccaacagagctgtgtgtggcttccacctgggctacctggatggagaggtggagctggtgtctggagtggtggcccggctgctggccctgtacaaccagggccacatcaagccccacatcgacagcgtgtggccctttgagaaggtggctgatgccatgaagcagatgcaggagaagaagaatgtgggcaaggtgctgctggtgcccggccctgagaaggagaactag

SEQ ID NO: 175832 - DNA, 780 bp, Artificial Sequence
  Description of Artificial Sequence: Synthetic coding sequence
atggtgctgaacagaagtggcatgtggcaggaggaggtgacagtgcccagcgtgcagaccttcctgatccctgaggccatgacctttgaggaggccgccgccctgctggtgaactacatcacagcctacatggtgctgtttgattttggaaacctgcagcccggccacagcgtgctggtgcacatggccgccggcggcgtgggcatggctgctgtgcagctgtgcaggacagtggagaatgtgacagtgtttggaacagccagcgccagcaagcatgaggccctgaaggaaaatggagtgacccaccccatcgactaccacaccacagattatgtggatgagatcaagaagatcagccccaagggcgtggacatcgtgatggaccccctgggcggcagtgacacagccaagggctacaacctgctgaagcccatgggcaaggtggtgacctacggcatggccaacctgctgaccggccccaagaggaacctgatggccctggcccggacctggtggaaccagttctctgtgacagccctgcagctgctgcaggccaacagagctgtgtgtggcttccacctgggctacctggatggagaggtggagctggtgtctggagtggtggcccggctgctggccctgtacaaccagggccacatcaagccccacatcgacagcgtgtggccctttgagaaggtggctgatgccatgaagcagatgcaggagaagaagaatgtgggcaaggtgctgctggtgcccggccctgagaaggagaactag

SEQ ID NO: 175833 - DNA, 903 bp, Artificial Sequence
  Description of Artificial Sequence: Synthetic coding sequence
atggcccggcagggcctgtatgaccggctgccccccctgcctgtgaccccaggcatggagggcgctggggtggtgattgctgtgggggagggcgtgtctgacaggaaggccggggacagagtgatggtgctgaacagaagtggcatgtggcaggaggaggtgacagtgcccagcgtgcagaccttcctgatccctgaggccatgacctttgaggaggccgccgccctgctggtgaactacatcacagcctacatggtgctgtttgattttggaaacctgcagcccggccacagcgtgctggtgcacatggctgctggaggagtgggcatggctgctgtgcagctgtgcaggacagtggagaatgtgacagtgtttggaacagccagcgccagcaagcatgaggccctgaaggaaaatggagtgacccaccccatcgactaccacaccacagattatgtggatgagatcaagaagatcagccccaagggcgtggacatcgtgatggaccccctgggcggcagtgacacagccaagggctacaacctgctgaagcccatgggcaaggtggtgacctacggcatggccaacctgctgaccggccccaagaggaacctgatggccctggcccggacctggtggaaccagttctctgtgacagccctgcagctgctgcaggccaacagagctgtgtgtggcttccacctgggctacctggatggagaggtggagctggtgtctggagtggtggcccggctgctggccctgtacaaccagggccacatcaagccccacattgattctgtgtggccctttgagaaggtggctgatgccatgaagcagatgcaggagaagaagaatgtgggcaaggtgctgctggtgcccggccctgagaaggaaaattag

SEQ ID NO: 175834 - DNA, 654 bp, Artificial Sequence
  Description of Artificial Sequence: Synthetic coding sequence
atgagcagtgactttgagggctatgagcaggactttgctgtgctgacagctgagatcaccagcaagatcgcccgggtgccccggctgcccccagatgagaagaagcagatggtggccaacgtggagaagcagctggaggaggccaaggagctgctggagcagatggacctggaggtgcgggagatccccccccagagccggggcatgtacagcaacaggatgaggagctacaagcaggagatgggcaagctggagacagacttcaagaggagcagaattgcctacagtgatgaggtgagaaatgagctgctgggagatgatggcaacagcagcgagaaccagagggcccacctgctggacaacacagagcggctggagaggagcagccggcggctggaggccggctaccagattgctgtggagacagagcagatcggccaggagatgctggagaacctgagccatgaccgggagaagatccagagggcccgggagcggctgcgggagacagatgccaacctgggcaagagcagccgcatcctgaccggcatgctgcggcgcatcatccagaaccgcatcctgctggtgatcctgggcatcatcgtggtgatcaccatcctgatggccatcaccttctctgtgagaagacactag

SEQ ID NO: 175835 - DNA, 612 bp, Artificial Sequence
  Description of Artificial Sequence: Synthetic coding sequence
atgagcagtgactttgagggctatgagcaggactttgctgtgctgacagctgagatcaccagcaagatcgcccgggtgccccggctgcccccagatgagaagaagcagatggtggccaacgtggagaagcagctggaggaggccaaggagctgctggagcagatggacctggaggtgcgggagatccccccccagagccggggcatgtacagcaacaggatgaggagctacaagcaggagatgggcaagctggagacagacttcaagaggagcagaattgcctacagtgatgaggtgagaaatgagctgctgggagatgatggcaacagcagcgagaaccagagggcccacctgctggacaacacagagcggctggagaggagcagccggcggctggaggccggctaccagattgctgtggagacagagcagatcggccaggagatgctggagaacctgagccatgaccgggagaagatccagagggcccgggagcggctgcgggagacagatgccaacctgggcaagagcagccgcatcctgaccggcatgctgcggcggggctgcagcgtgaagaagcagtgcaacctgagcctggcccccaaggcctag

SEQ ID NO: 175836 - DNA, 432 bp, Artificial Sequence
  Description of Artificial Sequence: Synthetic coding sequence
atgtctgccccagcccagcccccagctgagggcacagagggcacagcccctgggggcggccccccaggccccccacccaacatgaccagcaacagaaggctgcagcagacccaggcccaggtggaggaggtggtggacatcatccgggtgaatgtggacaaggtgctggagcgggaccagaagctgtctgagctggatgacagagcagatgccctgcaggccggggccagccagtttgagagcagcgctgccaagctgaagaggaagtactggtggaagaactgcaagatgatgatcatgctgggccgctggcagctgacccagtactgcctggtgatgtggagcttccccagctggaccaggcctgaggagggccctgggggcggccccaagagcaacctggtgtctgtgcagtaccccttcaggaagtag

SEQ ID NO: 175837 - DNA, 354 bp, Artificial Sequence
  Description of Artificial Sequence: Synthetic coding sequence
atgtctgccccagcccagcccccagctgagggcacagagggcacagcccctgggggcggccccccaggccccccacccaacatgaccagcaacagaaggctgcagcagacccaggcccaggtggaggaggtggtggacatcatccgggtgaatgtggacaaggtgctggagcgggaccagaagctgtctgagctggatgacagagcagatgccctgcaggccggggccagccagtttgagagcagcgctgccaagctgaagaggaagtactggtggaagaactgcaagatgatgatcatgctgggcgccatctgtgccatcatcgtggtggtgattgtgtccaagtacagatag

SEQ ID NO: 175838 - DNA, 357 bp, Artificial Sequence
  Description of Artificial Sequence: Synthetic coding sequence
atgtctgccccagcccagcccccagctgagggcacagagggcacagcccctgggggcggccccccaggccccccacccaacatgaccagcaacagaaggctgcagcagacccaggcccaggtggaggaggtggtggacatcatccgggtgaatgtggacaaggtgctggagcgggaccagaagctgtctgagctggatgacagagcagatgccctgcaggccggggccagccagtttgagagcagcgctgccaagctgaagaggaagtactggtggaagaactgcaagatgatgatcatgctgggcgccatctgtgccatcatcgtggtggtgattgtcatctacttcttcacctag

SEQ ID NO: 175839 - DNA, 744 bp, Artificial Sequence
  Description of Artificial Sequence: Synthetic coding sequence
atgtctgccccagcccagcccccagctgagggcacagagggcacagcccctgggggcggccccccaggccccccacccaacatgaccagcaacagaaggctgcagcagacccaggcccaggtggaggaggtggtggacatcatccgggtgaatgtggacaaggtgctggagcgggaccagaagctgtctgagctggatgacagagcagatgccctgcaggccggggccagccagtttgagagcagcgctgccaagctgaagaggaagtactggtggaagaactgcaagatgatgatcatgctgggcgccatctgtgccatcatcgtggtggtgattgtcatctacttctacctgaggatgtaccaccccttccctgtggtgcactgccacccccacagctgccccctgcccagcgtgtgcagcctgaacaccctgccccacccccccagcagcatcccagcccaggccagccccagccccatcccccccttcagcctgcggagctttgccctgtgccccagcaccctggagatgctgctggtggcccagagcaagagcctgcctgaggagcagcagctggcccccccaccctgcctgctcttcctgtacagccaggtgccccccaagccccagagggtgggcggccagggcaagggccagggcggggagtggctgcggcgcagcacccatgaggccgcccagacctgggaggagaagagcattggagcccacggggacttctag

SEQ ID NO: 175840 - DNA, 351 bp, Artificial Sequence
  Description of Artificial Sequence: Synthetic coding sequence
atgtctgccccagcccagcccccagctgagggcacagagggcacagcccctgggggcggccccccaggccccccacccaacatgaccagcaacagaaggctgcagcagacccaggcccaggtggaggaggtggtggacatcatccgggtgaatgtggacaaggtgctggagcgggaccagaagctgtctgagctggatgacagagcagatgccctgcaggccggggccagccagtttgagagcagcgctgccaagctgaagaggaagtactggtggaagaactgcaagatgatgatcatgctgggcgccatctgtgccatcatcgtggtggtgattgtgcggcgggactag

SEQ ID NO: 175841 - DNA, 351 bp, Artificial Sequence
  Description of Artificial Sequence: Synthetic coding sequence
atgtctgccacagctgccacagcccctcctgctgccccagctggggagggcggccccccagcccccccacccaacctgaccagcaacagaaggctgcagcagacccaggcccaggtggatgaggtggtggacatcatgagggtgaatgtggacaaggtgctggagcgggaccagaagctgtctgagctggatgacagagcagatgccctgcaggccggggccagccagtttgagaccagcgctgccaagctgaagaggaagtactggtggaagaacctgaagatgatgatcatcctgggcgtcatctgtgccatcatcctgatcatcatcatcgtgtacttcagcacctag

SEQ ID NO: 175842 - DNA, 303 bp, Artificial Sequence
  Description of Artificial Sequence: Synthetic coding sequence
atgagcacaggccccacagctgccaccggcagcaacagaaggctgcagcagacccagaaccaggtggatgaggtggtggacatcatgagggtgaatgtggacaaggtgctggagcgggaccagaagctgtctgagctggatgacagagcagatgccctgcaggccggggccagccagtttgagaccagcgctgccaagctgaagaggaagtactggtggaagaactgcaagatgtgggccatcggcatcaccgtgctggtgatcttcatcatcatcatcatcgtgtgggtggtgagcagctag

SEQ ID NO: 175843 - DNA, 351 bp, Artificial Sequence
  Description of Artificial Sequence: Synthetic coding sequence
atggccggcatcgagctggagcgctgccagcagcaggccaatgaggtgacagagatcatgaggaacaactttgggaaggtgctggagcggggcgtgaagctggccgagctgcagcagaggagtgaccagctgctggacatgagcagcaccttcaacaagaccacccagaacctggcccagaagaagtgctgggagaacatccgctaccgcatctgtgtgggcctggtggtggtgggcgtgctgctgatcatcctgattgtgctgctggtggtgttcctgccccagagcagtgacagcagcagcgcccccaggacccaggatgctggcatcgccagcggccctggcaactag

SEQ ID NO: 175844 - DNA, 783 bp, Artificial Sequence
  Description of Artificial Sequence: Synthetic coding sequence
atggccatcctgtttgctgtggtggcccggggcaccaccatcctggccaagcacgcctggtgtggcggcaacttcctggaggtgacagagcagatcctggccaagatccccagcgagaacaacaagctgacctacagccacggcaactacctgttccactacatctgccaggaccgcatcgtgtacctgtgcatcacagatgatgactttgagaggagccgggccttcaacttcctgaatgagatcaagaagcgcttccagaccacctacggcagccgggcccagacagccctgccctatgccatgaacagcgagttcagctctgtgctggccgcccagctgaagcaccacagtgaaaataaaggcctggacaaggtgatggagacccaggcccaggtggatgagctgaagggcatcatggtgaggaacatcgtgtgccacctgcagaactaccagcagaagagctgcagcagccacgtgtatgaggagccccaggcccactactaccaccaccaccgcatcaactgtgtgcacctgtaccactgcttcaccagcctgtggtggatctacatggccaagctgtgtgaggagatcggcaagaagaagctgcccctgaccaaggacatgagggagcagggcgtgaagagcaacccctgtgacagcagcctgagccacacagaccgctggtacctgcctgtgagcagcaccctcttcagcctcttcaagatcctcttccacgccagccgcttcatctttgtgctgagcaccagcctcttcctgtag

SEQ ID NO: 175845 - DNA, 663 bp, Artificial Sequence
  Description of Artificial Sequence: Synthetic coding sequence
atggccatcctgtttgctgtggtggcccggggcaccaccatcctggccaagcacgcctggtgtggcggcaacttcctggaggtgacagagcagatcctggccaagatccccagcgagaacaacaagctgacctacagccacggcaactacctgttccactacatctgccaggaccgcatcgtgtacctgtgcatcacagatgatgactttgagaggagccgggccttcaacttcctgaatgagatcaagaagcgcttccagaccacctacggcagccgggcccagacagccctgccctatgccatgaacagcgagttcagctctgtgctggccgcccagctgaagcaccacagtgaaaataaaggcctggacaaggtgatggagacccaggcccaggtggatgagctgaagggcatcatggtgaggaacatcgacctggtggcccagagaggagagcggctggagctgctgattgacaagacagagaacctggtggacagctctgtgaccttcaagaccaccagcaggaacctggcccgggccatgtgcatgaagaacctgaagctgaccatcatcatcatcatcgtgtccatcgtgttcatctacatcatcgtgagccccctgtgtggcggcttcacctggcccagctgtgtgaagaagtag

SEQ ID NO: 175846 - DNA, 540 bp, Artificial Sequence
  Description of Artificial Sequence: Synthetic coding sequence
atggccatcctgtttgctgtggtggcccggggcaccaccatcctggccaagcacgcctggtgtggcggcaacttcctggaggactttgagaggagccgggccttcaacttcctgaatgagatcaagaagcgcttccagaccacctacggcagccgggcccagacagccctgccctatgccatgaacagcgagttcagctctgtgctggccgcccagctgaagcaccacagcgagaacaagggcctggacaaggtgatggagacccaggcccaggtggatgagctgaagggcatcatggtgagaaatattgacctggtggcccagagaggagagcggctggagctgctgattgacaagacagagaacctggtggacagctctgtgaccttcaagaccaccagcaggaacctggcccgggccatgtgcatgaagaacctgaagctgaccatcatcatcatcatcgtgtccatcgtgttcatctacatcatcgtgagccccctgtgtggcggcttcacctggcccagctgtgtgaagaagtag

SEQ ID NO: 175847 - DNA, 303 bp, Artificial Sequence
  Description of Artificial Sequence: Synthetic coding sequence
atggaggaggccagcgagggcggcggcaatgacagagtgaggaacctgcagagcgaggtggagggcgtgaagaacatcatgacccagaatgtggagcgcatcctggcccggggggagaacctggagcacctgaggaacaagacagaggacctggaggccaccagcgagcacttcaagaccaccagccagaaggtggccaggaagttctggtggaagaatgtgaagatgattgtgctgatctgtgtgattgtgttcatcatcatcctcttcatcgtgctgtttgccaccggggccttctcctag

SEQ ID NO: 175848 - DNA, 777 bp, Artificial Sequence
  Description of Artificial Sequence: Synthetic coding sequence
atggaggagatgaagaagacagccatccggctgcccaagggcaagcagaagcccatcaagacagagtggaacagccgctgtgtgctcttcacctacttccagggcgacatcagctctgtggtggatgagcacttcagccgggccctgagcaacatcaagagcccccaggagctgacccccagcagccagagcgagggcgtgatgctgaagaatgatgacagcatgagccccaaccagtggagatacagcagcccctggaccaagccccagcctgaggtgcctgtgaccaacagagctgccaactgcaacctgcacgtgcccggccccatggctgtgaaccagttcagccccagcctggcccggcgggcctctgtgcggcctggagagctgtggcacttcagcagcctggccggcaccagcagcctggagcccggctacagccaccccttccctgcccggcacctggtgcctgagccccagccagatggcaagcgggagcccctgctgagcctgctgcagcaggaccgctgcctggcccggccccaggagagcgctgcccgggagaatggaaatcctggccagattgctggcagcacaggcctgctcttcaacctgcccccaggctctgtgcactacaagaagctgtatgtgtcccggggcagcgccagcaccagcctgcccaatgagaccctgtctgagctggagaccccaggcaagtacagcctgaccccacccaaccactggggccacccccaccgctacctgcagcacctgtag

SEQ ID NO: 175849 - DNA, 348 bp, Artificial Sequence
  Description of Artificial Sequence: Synthetic coding sequence
atgaagaagacagccatccggctgcccaagggcaagcagaagcccatcaagacagagtggaacagccgctgtgtgctcttcacctacttccagggcgacatcagctctgtggtggatgagcacttcagccgggccctgagcaacatcaagagcccccaggagctgacccccagcagccagagcgagggcgtgatgctgaagaatgacaagaagctgtatgtgtcccggggcagcgccagcaccagcctgcccaatgagaccctgtctgagctggagacccctgggaagtacagcctgaccccacccaaccactggggccacccccaccgctacctgcagcacctgtag

SEQ ID NO: 175850 - DNA, 492 bp, Artificial Sequence
  Description of Artificial Sequence: Synthetic coding sequence
tgaatcagctctgtggtggatgagcacttcagccgggccctgagcaacatcaagagcccccaggagctgacccccagcagccagagcgagggcgtgatgctgaagaatgatgacagcatgagccccaaccagtggagatacagcagcccctggaccaagccccagcctgaggtgcctgtgaccaacagagctgccaactgcaacctgcacgtgcccggccccatggctgtgaaccagttcagccccagcctggcccggcgggcctctgtgcggcctggagagctgtggcacttcagcagcctggccggcaccagcagcctggagcccggctacagccaccccttccctgcccggcacctggtgcctgagccccagccagatggcaagcacaagaagctgtatgtgtcccggggcagcgccagcaccagcctgcccaatgagaccctgtctgagctggagaccccaggcaagtacagcctgaccccaccctag

SEQ ID NO: 175851 - DNA, 183 bp, Artificial Sequence
  Description of Artificial Sequence: Synthetic coding sequence
acccccagcagccagagcgagggcgtgatgctgaagaatgacaagaagctgtatgtgtcccggggcagcgccagcaccagcctgcccaatgagaccctgtctgagctggagaccccaggcaagtacagcctgaccccacccaaccactggggccacccccaccgctacctgcagcacctgtag

SEQ ID NO: 175852 - DNA, 954 bp, Artificial Sequence
  Description of Artificial Sequence: Synthetic coding sequence
atgagctgcctggatgtgatgtaccaggtgtatggccccccccagccctactttgctgctgcctacaccccctaccaccagaagctggcctactacagcaagatgcaggaggcccaggagtgcaatgccagccccagcagcagcggcagcggcagcagcagcttcagcagccagaccccagccagcatcaaggaggaggagggcagccctgagaaggagaggcctcctgaggccgagtacatcaacagccgctgtgtgctcttcacctacttccagggcgacatcagctctgtggtggatgagcacttcagccgggccctgagccagcccagcagctacagccccagctgcaccagcagcaaggcccccaggagcagcggcccctggagggactgcagcttccccatgagccagaggagcttccctgccagcttctggaacagcgcctaccaggcccctgtgcccccacccctgggcagccccctggccacagcccacagcgagctgccctttgctgctgctgacccctacagccctgctgccctgcacggccacctgcaccagggcgccacagagccctggcaccacgcccacccccaccacgcccacccccaccacccctatgccctgggcggggccctgggcgcccaggccgccccctaccccaggcctgctgctgtgcatgaggtgtatgccccccactttgaccccaggtatggccccctgctgatgcctgctgccagcggccgcccagcccggctggccacagccccagccccagcccctggcagccccccctgtgagctgagcggcaagggggagcctgctggggccgcctgggccggccctgggggcccctttgccagccccagcggagatgtggcccagggcctgggcctgtctgtggacagcgcccggcgctacagcctgtgtggggccagcctgctgtcctag

SEQ ID NO: 175853 - DNA, 432 bp, Artificial Sequence
  Description of Artificial Sequence: Synthetic coding sequence
atgagctgcctggatgtgatgtaccaggtgtatggccccccccagccctactttgctgctgcctacaccccctaccaccagaagctggcctactacagcaagatgcaggaggcccaggagtgcaatgccagccccagcagcagcggcagcggcagcagcagcttcagcagccagaccccagccagcatcaaggaggaggagggcagccctgagaaggagaggcctcctgaggccgagtacatcaacagccgctgtgtgctcttcacctacttccagggcgacatcagctctgtggtggatgagcacttcagccgggccctgagccagcccagcagctacagccccagctgcaccagcagcaaggcccccaggagcagcggcccctggagggcccggcgctacagcctgtgtggggccagcctgctgtcctag

SEQ ID NO: 175854 - DNA, 963 bp, Artificial Sequence
  Description of Artificial Sequence: Synthetic coding sequence
atgagctgtgccgaggtgatgtaccacccccagccctatggagccagccagtacctgcccaaccccatggccgccaccacctgccccacagcctactaccagcctgccccccagcccggccagcagaagaagctggccgtgttcagcaagatgcaggacagcctggaggtgaccctgcccagcaagcaggaggaggaggatgaggaggaggaggaggaggagaaggaccagcctgctgagatggagtacctgaacagccgctgtgtgctcttcacctacttccagggcgacatcggctctgtggtggatgagcacttcagccgggccctgggccaggccatcaccctgcaccctgagagcgccatcagcaagagcaagatgggcctgacccccctgtggagggacagcagcgccctgagcagccagagaaattccttccccaccagcttctggaccagcagctaccagcccccaccagccccctgcctgggcggcgtgcacccagacttccaggtgactggacctcctggcaccttctctgctgctgaccccagcccctggccaggccacaacctgcaccagacaggccctgcccctcctcctgctgtgtctgagagctggccctaccccctgaccagccaggtgagccccagctacagccacatgcatgatgtgtacatgaggcaccaccacccccacgcccacatgcaccaccgccaccgccaccaccaccaccaccaccaccccccagctggcagcgccctggaccccagctatggccccctgctgatgcccagcgtgcatgctgcccgcatcccagccccccagtgtgacatcaccaagacagagcccaccaccgtgaccagcgccaccagcgcctgggccggggccttccatggaacagtggacatcgtgcccagcgtgggctttgacaccggctggagcgccatggcccggagctag

SEQ ID NO: 175855 - DNA, 981 bp, Artificial Sequence
  Description of Artificial Sequence: Synthetic coding sequence
atgagctgtgccgaggtgatgtaccacccccagccctatggagccagccagtacctgcccaaccccatggccgccaccacctgccccacagcctactaccagcctgccccccagcccggccagcagaagaagctggccgtgttcagcaagatgcaggacagcctggaggtgaccctgcccagcaagcaggaggaggaggatgaggaggaggaggaggaggagaaggaccagcctgctgagatggagtacctgaacagccgctgtgtgctcttcacctacttccagggcgacatcggctctgtggtggatgagcacttcagccgggccctgggccaggccatcaccctgcaccctgagagcgccatcagcaagagcaagatgggcctgacccccctgtggagggacagcagcgccctgagcagccagagaaattccttccccaccagcttctggaccagcagctaccagcccccaccagccccctgcctgggcggcgtgcacccagacttccaggtgactggacctcctggcaccttctctgctgctgaccccagcccctggccaggccacaacctgcaccagacaggccctgcccctcctcctgctgtgtctgagagctggccctaccccctgaccagccaggtgagccccagctacagccacatgcatgatgtgtacatgaggcaccaccacccccacgcccacatgcaccaccgccaccgccaccaccaccaccaccaccaccccccagctggcagcgccctggaccccagctatggccccctgctgatgcccagcgtgcatgctgcccgcatcccagccccccagtgtgacatcaccaagacagagcccaccaccgtgaccagcgccaccagcgcctgggccggggccttccatggaacagtggacatcgtgcccagcgtgggctttgacaccggcctgcagcaccaggacaagagcaaggagagcccctggtactag

SEQ ID NO: 175856 - DNA, 1326 bp, Artificial Sequence
  Description of Artificial Sequence: Synthetic coding sequence
atgaaggctgctgtggacctgaagcccaccctgaccatcatcaagacagagaaggtggacctggagctgttccccagcccagacatggagtgtgctgatgtgcccctgctgacccccagcagcaaggagatgatgagccaggccctgaaggccaccttcagcggcttcaccaaggagcagcagaggctgggcatccccaaggacccccggcagtggacagagacccacgtgcgggactgggtgatgtgggccgtgaatgagttcagcctgaagggcgtggacttccagaagttctgcatgaatggagctgccctgtgtgccctgggcaaggactgcttcctggagctggccccagactttgtgggggacatcctgtgggagcacctggagatcctgcagaaggaggatgtgaagccctaccaggtgaatggagtgaacccagcctacccagagagccgctacaccagtgactacttcatctcctatggcatcgagcacgcccagtgtgtgcccccatctgagttcagcgagcccagcttcatcacagagagctaccagaccctgcaccccatcagcagcgaggagctgctgagcctgaagtatgaaaatgactaccccagcgtcatcctgcgggaccccctgcagacagacaccctgcagaatgactactttgccatcaagcaggaggtggtgaccccagacaacatgtgcatgggccgcaccagccggggcaagctgggcggccaggacagctttgagagcattgagagctatgacagctgtgaccggctgacccagagctggagcagccagagcagcttcaacagcctgcagagggtgcccagctatgacagctttgacagcgaggactacccagctgccctgcccaaccacaagcccaagggcaccttcaaggactatgtgcgggacagagctgacctgaacaaggacaagcctgtgatcccagctgctgccctggccggctacacaggcagcggccccatccagctgtggcagttcctgctggagctgctgacagacaagagctgccagagcttcatctcctggacaggagatggctgggagttcaagctgagtgaccctgatgaggtggcccggcgctggggcaagaggaagaacaagcccaagatgaactatgagaagctgagccggggcctgcgctactactatgacaagaacatcatccacaagacagctgggaagcgctacgtgtacagatttgtgtgtgacctgcagagcctgctgggctacaccccagaggagctgcacgccatgctggatgtgaagccagatgctgatgaatag

SEQ ID NO: 175857 - DNA, 1065 bp, Artificial Sequence
  Description of Artificial Sequence: Synthetic coding sequence
atgaaggctgctgtggacctgaagcccaccctgaccatcatcaagacagagaaggtggacctggagctgttccccagcccagacatggagtgtgctgatgtgcccctgctgacccccagcagcaaggagatgatgagccaggccctgaaggccaccttcagcggcttcaccaaggagcagcagaggctgggcatccccaaggacccccggcagtggacagagacccacgtgcgggactgggtgatgtgggccgtgaatgagttcagcctgaagggcgtggacttccagaagttctgcatgaatggagctgccctgtgtgccctgggcaaggactgcttcctggagctggccccagactttgtgggggacatcctgtgggagcacctggagatcctgcagaaggaggatgtgaagccctaccaggtgaatggagtgaacccagcctacccagagagccgctacaccagtgactacttcatctcctatggcatcgagcacgcccagtgtgtgcccccatctgagttcagcgagcccagcttcatcacagagagctaccagaccctgcaccccatcagcagcgaggagctgctgagcctgaagtatgaaaatgactaccccagcgtcatcctgcgggaccccctgcagacagacaccctgcagaatgactactttgccatcaagcaggaggtggtgaccccagacaacatgtgcatgggccgcaccagccggggcagcggccccatccagctgtggcagttcctgctggagctgctgacagacaagagctgccagagcttcatctcctggacaggagatggctgggagttcaagctgagtgaccctgatgaggtggcccggcgctggggcaagaggaagaacaagcccaagatgaactatgagaagctgagccggggcctgcgctactactatgacaagaacatcatccacaagacagctgggaagagatatgtgtacagatttgtgtgtgacctgcagagcctgctgggctacaccccagaggagctgcacgccatgctggatgtgaagccagatgctgatgaatag

SEQ ID NO: 175858 - DNA, 1458 bp, Artificial Sequence
  Description of Artificial Sequence: Synthetic coding sequence
atgagctactttgtggacagcgctggcagcagccctgtgccctacagcgcccccaggcctgctgtggtgcggcagggccccagcaacacctatgaggaccccaggatgaactgtggcttccagagcaactaccaccagcagaggccctgctaccccttctgggatgagatggccacccaggaggtgcccaccggcctggagcactgtgtgtctgacatggagtgtgctgatgtgcccctgctgacccccagcagcaaggagatgatgagccaggccctgaaggccaccttcagcggcttcaccaaggagcagcagaggctgggcatccccaaggacccccggcagtggacagagacccacgtgcgggactgggtgatgtgggccgtgaatgagttcagcctgaagggcgtggacttccagaagttctgcatgaatggagctgccctgtgtgccctgggcaaggactgcttcctggagctggccccagactttgtgggggacatcctgtgggagcacctggagatcctgcagaaggaggatgtgaagccctaccaggtgaatggagtgaacccagcctacccagagagccgctacaccagtgactacttcatctcctatggcatcgagcacgcccagtgtgtgcccccatctgagttcagcgagcccagcttcatcacagagagctaccagaccctgcaccccatcagcagcgaggagctgctgagcctgaagtatgaaaatgactaccccagcgtcatcctgcgggaccccctgcagacagacaccctgcagaatgactactttgccatcaagcaggaggtggtgaccccagacaacatgtgcatgggccgcaccagccggggcaagctgggcggccaggacagctttgagagcattgagagctatgacagctgtgaccggctgacccagagctggagcagccagagcagcttcaacagcctgcagagggtgcccagctatgacagctttgacagcgaggactacccagctgccctgcccaaccacaagcccaagggcaccttcaaggactatgtgcgggacagagctgacctgaacaaggacaagcctgtgatcccagctgctgccctggccggctacacaggcagcggccccatccagctgtggcagttcctgctggagctgctgacagacaagagctgccagagcttcatctcctggacaggagatggctgggagttcaagctgagtgaccctgatgaggtggcccggcgctggggcaagaggaagaacaagcccaagatgaactatgagaagctgagccggggcctgcgctactactatgacaagaacatcatccacaagacagctgggaagcgctacgtgtacagatttgtgtgtgacctgcagagcctgctgggctacaccccagaggagctgcacgccatgctggatgtgaagccagatgctgatgaatag

SEQ ID NO: 175859 - DNA, 1065 bp, Artificial Sequence; identical to SEQ ID NO: 175857
  Description of Artificial Sequence: Synthetic coding sequence

SEQ ID NO: 175860 - DNA, 819 bp, Artificial Sequence
  Description of Artificial Sequence: Synthetic coding sequence
atgaaggctgctgtggacctgaagcccaccctgaccatcatcaagacagagaaggtggacctggagctgttccccagcccagacatggagtgtgctgatgtgcccctgctgacccccagcagcaaggagatgatgagccaggccctgaaggccaccttcagcggcttcaccaaggagcagcagaggctgggcatccccaaggacccccggcagtggacagagacccacgtgcgggactgggtgatgtgggccgtgaatgagttcagcctgaagggcgtggacttccagaagttctgcatgaatggagctgccctgtgtgccctgggcaaggactgcttcctggagctggccccagactttgtgggggacatcctgtgggagcacctggagatcctgcagaaggaggatgtgaagccctaccaggtgaatggagtgaacccagcctacccagagagccgctacaccagtgactacttcatctcctatggcatcgagcacgcccagtgtgtgcccccatctgagttcagcgagcccagcttcatcacagagagctaccagaccctgcaccccatcagcagcgaggagctgctgagcctgaagtatgaaaatgactaccccagcgtcatcctgcgggaccccctgcagacagacaccctgcagaatgactactttgccatcaagcaggaggtggtgaccccagacaacatgtgcatgggccgcaccagccggggcaagctgggcggccaggacagctttgagagcattgagagctatgacagctgtggccaggagatgggcaaggaggagaagcagacctag

SEQ ID NO: 175861 - DNA, 678 bp, Artificial Sequence
  Description of Artificial Sequence: Synthetic coding sequence
atgaaggctgctgtggacctgaagcccaccctgaccatcatcaagacagagaaggtggacctggagctgttccccagccctgggaagctgggcggccaggacagctttgagagcattgagagctatgacagctgtgaccggctgacccagagctggagcagccagagcagcttcaacagcctgcagagggtgcccagctatgacagctttgacagcgaggactacccagctgccctgcccaaccacaagcccaagggcaccttcaaggactatgtgcgggacagagctgacctgaacaaggacaagcctgtgatcccagctgctgccctggccggctacacaggcagcggccccatccagctgtggcagttcctgctggagctgctgacagacaagagctgccagagcttcatctcctggacaggagatggctgggagttcaagctgagtgaccctgatgaggtggcccggcgctggggcaagaggaagaacaagcccaagatgaactatgagaagctgagccggggcctgcgctactactatgacaagaacatcatccacaagacagctgggaagcgctacgtgtacagatttgtgtgtgacctgcagagcctgctgggctacaccccagaggagctgcacgccatgctggatgtgaagccagatgctgatgaatag

SEQ ID NO: 175862 - DNA, 1848 bp, Artificial Sequence
  Description of Artificial Sequence: Synthetic coding sequence
atgaaggccctgcggctgagcgccagcgccctcttctgcctgctgctgatcaatggcctgggcgccgcccctcctggccggcctgaggcccagcccccacccctgagcagcgagcacaaggagcctgtggccggagatgctgtgcccggccccaaggatggcagcgcccctgaggtgcggggggccagaaattctgagccccaggatgaaggagagctgttccagggcgtggacccccgggccctggccgctgtgctgctgcaggccctggacaggcctgccagccccccagcccccagcggcagccagcagggccctgaggaggaggccgctgaggccctgctgacagagaccgtgcgcagccagacccacagcctgcctgcccctgagagccctgagcctgctgccccaccccggccccagaccccagaaaatggacctgaggccagtgaccccagcgaggagctggaggccctggccagcctgctgcaggagctgcgggacttcagccccagcagcgccaagaggcagcaggagacagctgctgctgagacagagaccaggacccacaccctgaccagggtgaacctggagagccctggccctgagcgggtgtggagggcctcctggggcgagttccaggcccgggtgcctgagcgggcccccctgcccccaccagcccccagccagttccaggccaggatgccagacagcggccccctgcctgagacccacaagtttggagagggcgtgagcagccccaagacccacctgggggaggccctggcccccctgagcaaggcctaccagggcgtggccgcccccttccccaaggcccggcggcctgagagcgccctgctgggcggcagcgaggccggggagcggctgctgcagcagggcctggcccaggtggaggccggccggcggcaggccgaggccacccggcaggccgccgcccaggaggagcggctggccgacctggccagtgacctgctgctgcagtacctgctgcagggcggggcccggcagaggggcctgggcggccggggcctgcaggaggccgctgaggagcgggagagcgcccgggaggaggaggaggccgagcaggagaggagaggaggagaggagcgggtgggggaggaggatgaggaggccgctgaggccgaggccgaggccgaggaggccgagcgggcccggcagaatgccctgctgtttgctgaggaggaggatggagaggccggggctgaggacaagaggagccaggaggagaccccaggccacaggaggaaggaggccgagggcacagaggagggcggggaggaggaggatgatgaggagatggacccccagaccatcgacagcctcatcgagctgagcaccaagctgcacctgcctgcagatgatgtggtgtccatcatcgaggaggtggaggagaagaggaagaggaagaagaatgcccctcctgagcctgtgcccccaccccgggccgccccagcccccacccacgtgcgcagcccccagcccccacctccagccccagccccagccagagatgagctgcctgactggaatgaggtgctgcccccctgggaccgggaggaggatgaggtgtacccacctggcccctaccaccccttccccaactacatccggcccaggaccctgcagcccccatctgccctgcggcggcggcactaccaccacgccctgccccccagccgccactacccaggccgggaggcccaggcccggcgggcccaggaggaggccgaggccgaggagcggcggctgcaggagcaggaggagctggagaactacattgaacatgtgctgctgcggcggccctag

SEQ ID NO: 175863 - DNA, 1848 bp, Artificial Sequence; identical to SEQ ID NO: 175862
  Description of Artificial Sequence: Synthetic coding sequence

SEQ ID NO: 175864 - DNA, 1134 bp, Artificial Sequence
  Description of Artificial Sequence: Synthetic coding sequence
atgaaggccctgcggctgagcgccagcgccctcttctgcctgctgctgatcaatggcctgggcgccgcccctcctggccggcctgaggcccagcccccacccctgagcagcgagcacaaggagcctgtggccggagatgctgtgcccggccccaaggatggcagcgcccctgaggtgcggggggccagaaattctgagccccaggatgaaggagagctgttccagggcgtggacccccgggccctggccgctgtgctgctgcaggccctggacaggcctgccagccccccagcccccagcggcagccagcagggccctgaggaggaggccgctgaggccctgctgacagagaccgtgcgcagccagacccacagcctgcctgcccctgagagccctgagcctgctgccccaccccggccccagaccccagaaaatggacctgaggccagtgaccccagcgaggagctggaggccctggccagcctgctgcaggagctgcgggacttcagccccagcagcgccaagaggcagcaggagacagctgctgctgagacagagaccaggacccacaccctgaccagggtgaacctggagagccctggccctgagcgggtgtggagggcctcctggggcgagttccaggcccgggtgcctgagcgggcccccctgcccccaccagcccccagccagttccaggccaggatgccagacagcggccccctgcctgagacccacaagtttggagagggcgtgagcagccccaagacccacctgggggaggccctggcccccctgagcaaggcctaccagggcgtggccgcccccttccccaaggcccggcggcctgagagcgccctgctgggcggcagcgaggccggggagcggctgctgcagcagggcctggcccaggtggaggccggccggcggcaggccgaggccacccggcaggccgccgcccaggaggagcggctggccgacctggccagtgacctgctgctgcagtttgctgctggccggggccctgctgcccggccctgccccctggccctgcccctgagccctggctgtgtgggcacctgccagacccccctgcccggccctgagcctgagctgcctgagctgacccggggctag

SEQ ID NO: 175865 - DNA, 2484 bp, Artificial Sequence
  Description of Artificial Sequence: Synthetic coding sequence
atgaccaagctgagcgcccaggtgaagggcagcctgaacatcaccaccccaggcctgcagatctggagaattgaggccatgcagatggtgcctgtgcccagcagcaccttcggcagcttctttgatggagactgctacatcatcctggccatccacaagacagccagcagcctgtcctatgacatccactactggattggccaggacagcagcctggatgagcagggcgccgccgccatctacaccacccagatggatgacttcctgaagggccgggctgtgcagcaccgggaggtgcagggcaatgaaagtgaggccttccggggctacttcaagcagggcctggtgatcagaaaaggaggagtggccagcggcatgaagcacgtggagaccaacagctatgatgtgcagaggctgctgcacgtgaagggcaagagaaatgtggtggccggggaggtggagatgtcctggaagagcttcaacagaggagatgtgttcctgctggacctgggcaagctgatcatccagtggaatggacctgagagcaccaggatggagcggctgcggggcatgaccctggccaaggagatccgggaccaggagcggggcggccgcacctacgtgggcgtggtggatggagaaaatgagctggccagccccaagctgatggaggtgatgaaccacgtgctgggcaagagaagagagctgaaggctgctgtgcctgacacagtggtggagcccgccctgaaggccgccctgaagctgtaccacgtgtctgattctgagggcaacctggtggtgcgggaggtggccacccggcccctgacccaggacctgctgagccatgaggactgctacatcctggaccagggcggcctgaagatctacgtgtggaagggcaagaaggccaatgagcaggagaagaagggggccatgagccacgccctgaacttcatcaaggccaagcagtacccacccagcacccaggtggaggtgcagaatgatggagctgagagcgctgtgttccagcagctgttccagaagtggacagccagcaacagaaccagcggcctgggcaagacccacacagtgggctctgtggccaaggtggagcaggtgaagtttgatgccacctccatgcacgtgaagccccaggtggccgcccagcagaagatggtggatgatggcagcggggaggtgcaggtgtggagaattgagaacctggagctggtgcctgtggacagcaagtggctgggccacttctacggcggggactgctacctgctgctgtacacctacctgattggagagaagcagcactacctgctgtatgtgtggcagggcagccaggccagccaggatgagatcacagccagcgcctaccaggccgtcatcctggaccagaagtacaatggagagcctgtgcagatccgggtgcccatgggcaaggagcccccccacctgatgagcatcttcaagggccgcatggtggtgtaccagggcggcaccagcaggaccaacaacctggagaccggccccagcaccaggctcttccaggtgcagggcactggagccaacaacaccaaggcctttgaggtgcctgcccgggccaacttcctgaacagcaatgatgtgtttgtgctgaagacccagagctgctgctacctgtggtgtgggaagggctgcagcggagatgagcgggagatggccaagatggtggccgacaccatcagcaggacagagaagcaggtggtggtggagggccaggagcccgccaacttctggatggccctgggcggcaaggccccctatgccaacaccaagaggctgcaggaggagaacctggtgatcaccccccggctgtttgaatgtagcaacaagacaggccgcttcctggccacagagatcccagacttcaaccaggatgacctggaggaggatgatgtgttcctgctggatgtgtgggaccaggtgttcttctggattggcaagcacgccaatgaggaggagaagaaggccgccgccaccacagcccaggagtacctgaagacccaccccagcggccgggaccctgagacccccatcatcgtggtgaagcagggccacgagccccccaccttcaccggctggttcctggcctgggaccccttcaagtggagcaacaccaagagctatgaggacctgaaggccgagctgggcaacagccgggactggagccagatcacagctgaggtgaccagccccaaggtggatgtgttcaatgccaacagcaacctgagcagcggccccctgcccatcttccccctggagcagctggtgaacaagcctgtggaggagctgcctgagggcgtggaccccagcaggaaggaggagcacctgagcattgaggacttcacccaggccttcggcatgaccccagctgccttcagcgccctgccccgctggaagcagcagaacctgaagaaggagaagggcctcttctag

SEQ ID NO: 175866 - DNA, 1551 bp, Artificial Sequence
  Description of Artificial Sequence: Synthetic coding sequence
atgagccacgccctgaacttcatcaaggccaagcagtacccacccagcacccaggtggaggtgcagaatgatggagctgagagcgctgtgttccagcagctgttccagaagtggacagccagcaacagaacatctggcctgggcaagacccacacagtgggctctgtggccaaggtggagcaggtgaagtttgatgccacctccatgcacgtgaagccccaggtggccgcccagcagaagatggtggatgatggcagcggggaggtgcaggtgtggagaattgagaacctggagctggtgcctgtggacagcaagtggctgggccacttctatggaggagactgctacctgctgctgtacacctacctgattggagagaagcagcactacctgctgtatgtgtggcagggcagccaggccagccaggatgagatcacagccagcgcctaccaggccgtcatcctggaccagaagtacaacggggagcctgtgcagatccgggtgcccatgggcaaggagcccccccacctgatgagcatcttcaagggccgcatggtggtgtaccagggcggcaccagcaggaccaacaacctggagaccggccccagcaccaggctcttccaggtgcagggcaccggggccaacaacaccaaggcctttgaggtgcctgcccgggccaacttcctgaacagcaatgatgtgtttgtgctgaagacccagagctgctgctacctgtggtgtgggaagggctgcagcggagatgagcgggagatggccaagatggtggccgacaccatcagcaggacagagaagcaggtggtggtggagggccaggagcccgccaacttctggatggccctgggcggcaaggccccctatgccaacaccaagaggctgcaggaggagaacctggtgatcaccccccggctgtttgagtgcagcaacaagacaggccgcttcctggccacagagatcccagacttcaaccaggatgacctggaggaggatgatgtgttcctgctggatgtgtgggaccaggtgttcttctggattggcaagcacgccaatgaggaggagaagaaggctgctgccaccacagcccaggagtacctgaagacccaccccagcggccgggaccctgagacccccatcatcgtggtgaagcagggccacgagccccccaccttcaccggctggttcctggcctgggaccccttcaagtggagcaacaccaagagctatgaggacctgaaggccgagctgggcaacagccgggactggagccagatcacagctgaggtgaccagccccaaggtggatgtgttcaatgccaacagcaacctgagcagcggccccctgcccatcttccccctggagcagctggtgaacaagcctgtggaggagctgcctgagggcgtggaccccagcaggaaggaggagcacctgagcattgaggacttcacccaggccttcggcatgaccccagctgccttcagcgccctgccccgctggaagcagcagaacctgaagaaggagaagggcctcttctag

SEQ ID NO: 175867 - DNA, 1266 bp, Artificial Sequence
  Description of Artificial Sequence: Synthetic coding sequence
atgaccaagctgagcgcccaggtgaagggcagcctgaacatcaccaccccaggcctgcagatctggagaattgaggccatgcagatggtgcctgtgcccagcagcaccttcggcagcttctttgatggagactgctacatcatcctggccatccacaagacagccagcagcctgtcctatgacatccactactggattggccaggacagcagcctggatgagcagggcgccgccgccatctacaccacccagatggatgacttcctgaagggccgggctgtgcagcaccgggaggtgcagggcaatgaaagtgaggccttccggggctacttcaagcagggcctggtgatcagaaaaggaggagtggccagcggcatgaagcacgtggagaccaacagctatgatgtgcagaggctgctgcacgtgaagggcaagagaaatgtggtggccggggaggtggagatgtcctggaagagcttcaacagaggagatgtgttcctgctggacctgggcaagctgatcatccagtggaatggacctgagagcaccaggatggagcggctgcggggcatgaccctggccaaggagatccgggaccaggagcggggcggccgcacctacgtgggcgtggtggatggagaaaatgagctggccagccccaagctgatggaggtgatgaaccacgtgctgggcaagagaagagagctgaaggctgctgtgcctgacacagtggtggagcccgccctgaaggccgccctgaagctgtaccacgtgtctgattctgagggcaacctggtggtgcgggaggtggccacccggcccctgacccaggacctgctgagccatgaggactgctacatcctggaccagggcggcctgaagatctacgtgtggaagggcaagaaggccaatgagcaggagaagaagggggccatgagccacgccctgaacttcatcaaggccaagcagtacccacccagcacccaggtggaggtgcagaatgatggagctgagagcgctgtgttccagcagctgttccagaagtggacagccagcaacagaaccagcggcctgggcaagacccacacagtgggctctgtgggggagggccaggccggggctgtgcgggagcccggcagccgctcctgggcccggcgggccacctggagcaccacccacccccccagcctgacctgcatcttcaatgaagacttctacgccggcagcggcctggtgctggctgatggagatgtggacaagctgtag

SEQ ID NO: 175868 - DNA, 576 bp, Artificial Sequence
  Description of Artificial Sequence: Synthetic coding sequence
atgggcaagcagaacagcaagctggcccctgaggtgatggaggacctggtgaagagcacagagttcaatgaacatgagctgaagcagtggtacaagggcttcctgaaggactgccccagcggccgcctgaacctggaggagttccagcagctgtatgtgaagttcttcccctatggagatgccagcaagtttgcccagcacgccttccgcacctttgacaagaatggagatggcaccatcgacttccgggagttcatctgtgccctgagcatcaccagccggggcagctttgagcagaagctgaactgggccttcaacatgtatgacctggatggagatggcaagatcaccagggtggagatgctggagatcatcgaggccatctacaagatggtgggcaccgtcatcatgatgaagatgaatgaagatggcctgaccccagagcagagggtggacaagatcttcagcaagatggacaagaacaaggatgaccagatcaccctggatgagttcaaggaggccgccaagagtgaccccagcatcgtgctgctgctgcagtgtgacatccagaagtag

SEQ ID NO: 175869 - DNA, 576 bp, Artificial Sequence; identical to SEQ ID NO: 175868
  Description of Artificial Sequence: Synthetic coding sequence

SEQ ID NO: 175870 - DNA, 576 bp, Artificial Sequence; identical to SEQ ID NO: 175868
  Description of Artificial Sequence: Synthetic coding sequence

SEQ ID NO: 175871 - DNA, 315 bp, Artificial Sequence
  Description of Artificial Sequence: Synthetic coding sequence
atgggcaagcagaacagcaagctggcccctgaggtgatggaggacctggtgaagagcacagagttcaatgaacatgagctgaagcagtggtacaagggcttcctgaaggactgccccagcggccgcctgaacctggaggagttccagcagctgtatgtgaagttcttcccctatggagatgccagcaagtttgcccagcacgccttccgcacctttgacaagaatggagatggcaccatcgacttccgggagttcatctgtgccctgagcatcaccagccggggcagctttgagcagaagctgaactgggcctag

SEQ ID NO: 175872 - DNA, 357 bp, Artificial Sequence
  Description of Artificial Sequence: Synthetic coding sequence
atgggcaagcagaacagcaagctggcccctgaggtgatggaggacctggtgaagagcacagagttcaatgaacatgagctgaagcagtggtacaagggcttcctgaaggactgccccagcggccgcctgaacctggaggagttccagcagctgtatgtgaagttcttcccctatggagatgccagcaagtttgcccagcacgccttccgcacctttgacaagaatggagatggcaccatcgacttccgggagttcatctgtgccctgagcatcaccagccggggcagctttgagcagaagctgaactgggccttcaacatgtatgacctggatggagatggcaagatcaccaggtag

SEQ ID NO: 175873 - DNA, 720 bp, Artificial Sequence
  Description of Artificial Sequence: Synthetic coding sequence
atgacaggccgggacagcctgagtgatggccgcaccagcagccgggccctggtgcctgggggcagcccccggggcagccggccccggggctttgccatcacagacctgctgggcctggaggccgagctgcctgccccagctggccctggccagggcagcggctgtgagggccctgctgtggccccctgccccggccctggcctggatggcagcagcctggcccggggggccctgcccctgggcctgggcctgctgtgtggcttcggcacccagcccccagctgctgcccgggccccctgcctgctgctggctgatgtgcccttcctgcccccccggggccctgagcctgctgcccccctggcccccagcaggcctcctccagccctgggccggcagaagagaagtgacagcgtgtccaccagtgatgaggacagccagagcgaggacagaaatgacctgaaggccagccccaccctgggcaagaggaagaagagaagacacaggacagtgttcaccgcccaccagctggaggagctggagaaggccttcagcgaggcccactacccagatgtgtatgcccgggagatgctggccgtgaagacagagctgcctgaagatcgcatccaggtgtctggagtgcccttcctgcggagcaaggacaccacagaaaatgtgtccttcccccacagcgtgtcccagagcgctgtgcccagcctgtag

SEQ ID NO: 175874 - DNA, 1098 bp, Artificial Sequence
  Description of Artificial Sequence: Synthetic coding sequence
atgacaggccgggacagcctgagtgatggccgcaccagcagccgggccctggtgcctgggggcagcccccggggcagccggccccggggctttgccatcacagacctgctgggcctggaggccgagctgcctgccccagctggccctggccagggcagcggctgtgagggccctgctgtggccccctgccccggccctggcctggatggcagcagcctggcccggggggccctgcccctgggcctgggcctgctgtgtggcttcggcacccagcccccagctgctgcccgggccccctgcctgctgctggctgatgtgcccttcctgcccccccggggccctgagcctgctgcccccctggcccccagcaggcctcctccagccctgggccggcagaagagaagtgacagcgtgtccaccagtgatgaggacagccagagcgaggacagaaatgacctgaaggccagccccaccctgggcaagaggaagaagagaagacacaggacagtgttcaccgcccaccagctggaggagctggagaaggccttcagcgaggcccactacccagatgtgtatgcccgggagatgctggccgtgaagacagagctgcctgaagatcgcatccaggtgtggttccagaacagaagagccaagtggaggaagcgggagaagcgctggggcggcagctctgtgatggccgagtatggcctgtatggagccatggtgcgccactgcatccccctgcctgattctgtgctgaacagcgctgagggcggcctgctgggcagctgtgccccctggctgctgggcatgcacaagaagtccatgggcatgatcaggaagccaggcagcgaggacaagctggccggcctgtggggcagtgaccacttcaaggagggcagcagccagagcgagagcggcagccagaggggcagtgacaaggtgtccccagaaaatggcctggaggatgtggccatcgacctgagcagcagcgcccggcaggagaccaagaaggtgcaccctggagctggggcccagggcggcagcaacagcacagccctggagggcccccagcccgggaaggtgggcgccacctag

SEQ ID NO: 175875 - DNA, 432 bp, Artificial Sequence
  Description of Artificial Sequence: Synthetic coding sequence
atgacaggccgggacagcctgagtgatggccgcaccagcagccgggccctggtgcctgggggcagcccccggggcagccggccccggggctttgccatcacagacctgctgggcctggaggccgagctgcctgccccagctggccctggccagggcagcggctgtgagggccctgctgtggccccctgccccggccctggcctggatggcagcagcctggcccggggggccctgcccctgggcctgggcctgctgtgtggcttcggcacccagcccccagctgctgcccgggccccctgcctgctgctggctgatgtgcccttcctgcccccccggggccctgagcctgctgcccccctggcccccagcaggcctcctccagccctgggccggcagaagagaagtgacagcgtgtccaccagcgccatgtag

SEQ ID NO: 175876 - DNA, 843 bp, Artificial Sequence
  Description of Artificial Sequence: Synthetic coding sequence
atgacaggccgggacagcctgagtgatggccgcaccagcagccgggccctggtgcctgggggcagcccccggggcagccggccccggggctttgccatcacagacctgctgggcctggaggccgagctgcctgccccagctggccctggccagggcagcggctgtgagggccctgctgtggccccctgccccggccctggcctggatggcagcagcctggcccggggggccctgcccctgggcctgggcctgctgtgtggcttcggcacccagcccccagctgctgcccgggccccctgcctgctgctggctgatgtgcccttcctgcccccccggggccctgagcctgctgcccccctggcccccagcaggcctcctccagccctgggccggcagaagagaagtgacagcgtgtccaccagtgatgaggacagccagagcgaggacagaaatgacctgaaggccagccccaccctgggcaagaggaagaagagaagacacaggacagtgttcaccgcccaccagctggaggagctggagaaggccttcagcgaggcccactacccagatgtgtatgcccgggagatgctggccgtgaagacagagctgcctgaagatcgcatccaggtgtggttccagaacagaagagccaagtggaggaagcgggagaagcgctggggcggcagctctgtgatggccgagtatggcctgtatggagccatggtgcgccactgcatccccctgcctgattctgtgctgaacagcgctgagggcggcctgctgggcagctgtgccccctggctgctggagggggagaccctgggctgccgggagatgaagtag

SEQ ID NO: 175877 - DNA, 657 bp, Artificial Sequence
  Description of Artificial Sequence: Synthetic coding sequence
atgacaggccgggacagcctgagtgatggccgcaccagcagccgggccctggtgcctgggggcagcccccggggcagccggccccggggctttgccatcacagacctgctgggcctggaggccgagctgcctgccccagctggccctggccagggcagcggctgtgagggccctgctgtggccccctgccccggccctggcctggatggcagcagcctggcccggggggccctgcccctgggcctgggcctgctgtgtggcttcggcacccagcccccagctgctgcccgggccccctgcctgctgctggctgatgtgcccttcctgcccccccggggccctgagcctgctgcccccctggcccccagcaggcctcctccagccctgggccggcagaagagaagtgacagcgtgtccaccagtgatgaggacagccagagcgaggacagaaatgacctgaaggccagccccaccctgggcaagaggaagaagagaagacacaggacagtgttcaccgcccaccagctggaggagctggagaaggccttcagcgaggcccactacccagatgtgtatgcccgggagatgctggccgtgaagacagagctgcctgaagatcgcatccagagggtgcgccactgggccgctgagaagtag

SEQ ID NO: 175878 - DNA, 906 bp, Artificial Sequence
  Description of Artificial Sequence: Synthetic coding sequence
atgacaggccgggacagcctgagtgatggccgcaccagcagccgggccctggtgcctgggggcagcccccggggcagccggccccggggctttgccatcacagacctgctgggcctggaggccgagctgcctgccccagctggccctggccagggcagcggctgtgagggccctgctgtggccccctgccccggccctggcctggatggcagcagcctggcccggggggccctgcccctgggcctgggcctgctgtgtggcttcggcacccagcccccagctgctgcccgggccccctgcctgctgctggctgatgtgcccttcctgcccccccggggccctgagcctgctgcccccctggcccccagcaggcctcctccagccctgggccggcagaagagaagtgacagcgtgtccaccagtgatgaggacagccagagcgaggacagaaatgacctgaaggccagccccaccctgggcaagaggaagaagagaagacacaggacagtgttcaccgcccaccagctggaggagctggagaaggccttcagcgaggcccactacccagatgtgtatgcccgggagatgctggccgtgaagacagagctgcctgaagatcgcatccaggtgtggttccagaacagaagagccaagtggaggaagcgggagaagcgctggggcggcagctctgtgatggccgagtatggcctgtatggagccatggtgcgccactgcatccccctgcctgattctgtgctgaacagcgctgagggcggcctgctgggcagctgtgccccctggctgctggtgcagaccagcgcccctgggggcagccgcagcctggactttgctggggacacccaggccccccagaccccctggtggtgcctgatgaccttctcctag

SEQ ID NO: 175879 - DNA, 711 bp, Artificial Sequence
  Description of Artificial Sequence: Synthetic coding sequence
atgacaggccgggacagcctgagtgatggccgcaccagcagccgggccctggtgcctgggggcagcccccggggcagccggccccggggctttgccatcacagacctgctgggcctggaggccgagctgcctgccccagctggccctggccagggcagcggctgtgagggccctgctgtggccccctgccccggccctggcctggatggcagcagcctggcccggggggccctgcccctgggcctgggcctgctgtgtggcttcggcacccagcccccagctgctgcccgggccccctgcctgctgctggctgatgtgcccttcctgcccccccggggccctgagcctgctgcccccctggcccccagcaggcctcctccagccctgggccggcagaagagaagtgacagcgtgtccaccagtgatgaggacagccagagcgaggacagaaatgacctgaaggccagccccaccctgggcaagaggaagaagagaagacacaggacagtgttcaccgcccaccagctggaggagctggagaaggccttcagcgaggcccactacccagatgtgtatgcccgggagatgctggccgtgaagacagagctgcctgaagatcgcatccagtgcaagctgctgctgctggaggcccctgtgcactggaccctgcaggagacccaccggctgccccggccccggggcggggcctag

SEQ ID NO: 175880 - DNA, 1110 bp, Artificial Sequence
  Description of Artificial Sequence: Synthetic coding sequence
atgagggcctgcatcagcctggtgctggccgtgctgtgtggcctggcctgggccgaggaccacaaggagagcgagcccctgccccagctggaggaggagacagaggaggccctggccagcaacctgtacagcgcccccaccagctgccagggccgctgctatgaggcctttgacaagcaccaccagtgccactgcaatgcccgctgccaggagtttggaaactgctgcaaggactttgagagcctgtgcagcgaccacgaggtgagccacagcagtgatgccatcaccaaggaggagatccagagcatcagcgagaagatctacagagctgacaccaacaaggcccagaaggaggacatcgtgctgaacagccagaactgcatcagccccagcgagaccaggaaccaggtggaccgctgccccaagcccctcttcacctacgtgaatgagaagctgttcagcaagcccacctatgctgccttcatcaacctgctgaacaactaccagagggccaccggccacggggagcacttcagcgcccaggagctggccgagcaggatgccttcctgcgggagatcatgaagacagctgtgatgaaggagctgtacagcttcctgcaccaccagaacagatatggcagcgagcaggagtttgtggatgacctgaagaacatgtggtttggcctgtacagcagaggaaatgaggagggggacagcagcggctttgagcacgtgttttctggagaggtgaagaagggcaaggtgacaggcttccacaactggatccgcttctacctggaggagaaggagggcctggtggactactacagccacatctatgatggcccctgggacagctacccagatgtgctggccatgcagttcaactgggatggctactacaaggaggtgggcagcgccttcatcggcagcagccctgagtttgaatttgccctgtacagcctgtgcttcatcgcccggcctgggaaggtgtgccagctgagcctgggcggctaccccctggccgtgaggacctacacctgggacaagagcacctatggaaatggcaagaagtacatcgccacagcctacatcgtgagcagcacctag

SEQ ID NO: 175881 - DNA, 1284 bp, Artificial Sequence; identical to SEQ ID NO: 152896
  Description of Artificial Sequence: Synthetic coding sequence

SEQ ID NO: 175882 - DNA, 1188 bp, Artificial Sequence
  Description of Artificial Sequence: Synthetic coding sequence
atgtccatggagcacgccgccctgacagccactggagctgggggctcctggaggtccatgaagaggaaggccctcttcacctgccccttcaatggagactgccgcatcaccaaggacaacagaagacactgccaggcctgccgcctgaagagatgtgtggacatcggcatgatgaaggagttcatcctgacagatgaggaggtgcagaggaagcgggagatgatcctgaagaggaaggaggaggaggccctgaaggacagcctgcggcccaagctgtctgaggagcagcagaggatcatcgccatcctgctggatgcccaccacaagacctatgaccccacctacagcgacttctgccagttccggccccctgtgcgggtgaatgatggcggcggcagccaccccagccggcccaacagccgccacacccccagcttcagcggggacagcagcagcagctgcagcgaccactgcatcaccagcagtgacatgatggacagcagcagcttcagcaacctggacctgtctgaggaggacagtgatgaccccagcgtgaccctggagctgagccagctgtccatgctgccccacctggccgacctggtgtcctacagcatccagaaggtgattggatttgccaagatgatccctggcttccgggacctgaccagcgaggaccagatcgtgctgctgaagagcagcgccatcgaggtgatcatgctgcggagcaatgaaagcttcaccatggatgacatgtcctggacctgtggcaaccaggactacaagtacagagtgtctgatgtgaccaaggccggccacagcctggagctgattgagcccctcatcaagttccaggtgggcctgaagaagctgaacctgcacgaggaggagcacgtgctgctgatggccatctgcatcgtgtccccagacaggcctggggtgcaggatgctgccctgattgaggccatccaggaccggctgagcaacaccctgcagacctacatccgctgccgccaccccccacctggcagccacctgctgtatgccaagatgatccagaagctggccgacctgcggagcctgaatgaggagcacagcaagcagtaccgctgcctgtccttccagccagaatgttccatgaagctgacccccctggtgctggaggtgtttggaaatgagatctcctag

SEQ ID NO: 175883 - DNA, 753 bp, Artificial Sequence
  Description of Artificial Sequence: Synthetic coding sequence
atggaggccatggccgccagcaccagcctgcctgaccccggggactttgacagaaatgtgccccgcatctgtggggtgtgtggggaccgggccaccggcttccacttcaatgccatgacctgtgagggctgcaagggcttcttcagaagatccatgaagaggaaggccctcttcacctgccccttcaatggagactgccgcatcaccaaggacaacagaagacactgccaggcctgccgcctgaagagatgtgtggacatcggcatgatgaaggagttcatcctgacagatgaggaggtgcagaggaagcgggagatgatcctgaagaggaaggaggaggaggccctgaaggacagcctgcggcccaagctgtctgaggagcagcagaggatcatcgccatcctgctggatgcccaccacaagacctatgaccccacctacagcgacttctgccagttccggccccctgtgcgggtgaatgatggcggcggcagccaccccagccggcccaacagccgccacacccccagcttcagcggggacagcagcagcagctgcagcgaccactgcatcaccagcagtgacatgatggacagcagcagcttcagcaacctggacctgtctgaggaggacagtgatgaccccagcgtgaccctggagctgagccagctgtccatgctgccccacctggccgacctggtgtcctacagcatccagaaggtgattggatttgccaagatgatccctggatag

SEQ ID NO: 175884 - DNA, 306 bp, Artificial Sequence
  Description of Artificial Sequence: Synthetic coding sequence
atggaggccatggccgccagcaccagcctgcctgaccccggggactttgacagaaatgtgccccgcatctgtggggtgtgtggggaccgggccaccggcttccacttcaatgccatgacctgtgagggctgcaagggcttcttcagaagatccatgaagaggaaggccctcttcacctgccccttcaatggagactgccgcatcaccaaggacaacagaagacactgccaggcctgccgcctgaagagatgtgtggacatcggcatgatgaaggagttcatcctgacagatgaggaggtgcagtag

SEQ ID NO: 175885 - DNA, 1284 bp, Artificial Sequence; identical to SEQ ID NO: 152896
  Description of Artificial Sequence: Synthetic coding sequence

SEQ ID NO: 175886 - DNA, 321 bp, Artificial Sequence
  Description of Artificial Sequence: Synthetic coding sequence
atggaggccatggccgccagcaccagcctgcctgaccccggggactttgacagaaatgtgccccgcatctgtggggtgtgtggggaccgggccaccggcttccacttcaatgccatgacctgtgagggctgcaagggcttcttcagaagatccatgaagaggaaggccctcttcacctgccccttcaatggagactgccgcatcaccaaggacaacagaagacactgccaggcctgccgcctgaagagatgtgtggacatcggcatgatgaaggagttcatcctgacagatgaggaggtgcagaggaagcgggagatgtag

SEQ ID NO: 175887 - DNA, 1434 bp, Artificial Sequence
  Description of Artificial Sequence: Synthetic coding sequence
atggagtggaggaacaagaagagaagtgactggctgtccatggtgctgaggacagctggggtggaggaggcctttggaagtgaggtgtctgtgcggccccacagaagagcccccctgggcagcacctacctgcccccagcccccagcggcatggaggccatggccgccagcaccagcctgcctgaccccggggactttgacagaaatgtgccccgcatctgtggggtgtgtggggaccgggccaccggcttccacttcaatgccatgacctgtgagggctgcaagggcttcttcagaagatccatgaagaggaaggccctcttcacctgccccttcaatggagactgccgcatcaccaaggacaacagaagacactgccaggcctgccgcctgaagagatgtgtggacatcggcatgatgaaggagttcatcctgacagatgaggaggtgcagaggaagcgggagatgatcctgaagaggaaggaggaggaggccctgaaggacagcctgcggcccaagctgtctgaggagcagcagaggatcatcgccatcctgctggatgcccaccacaagacctatgaccccacctacagcgacttctgccagttccggccccctgtgcgggtgaatgatggcggcggcagccaccccagccggcccaacagccgccacacccccagcttcagcggggacagcagcagcagctgcagcgaccactgcatcaccagcagtgacatgatggacagcagcagcttcagcaacctggacctgtctgaggaggacagtgatgaccccagcgtgaccctggagctgagccagctgtccatgctgccccacctggccgacctggtgtcctacagcatccagaaggtgattggatttgccaagatgatccctggcttccgggacctgaccagcgaggaccagatcgtgctgctgaagagcagcgccatcgaggtgatcatgctgcggagcaatgaaagcttcaccatggatgacatgtcctggacctgtggcaaccaggactacaagtacagagtgtctgatgtgaccaaggccggccacagcctggagctgattgagcccctcatcaagttccaggtgggcctgaagaagctgaacctgcacgaggaggagcacgtgctgctgatggccatctgcatcgtgtccccagacaggcctggggtgcaggatgctgccctgattgaggccatccaggaccggctgagcaacaccctgcagacctacatccgctgccgccaccccccacctggcagccacctgctgtatgccaagatgatccagaagctggccgacctgcggagcctgaatgaggagcacagcaagcagtaccgctgcctgtccttccagccagaatgttccatgaagctgacccccctggtgctggaggtgtttggaaatgagatctcctag

SEQ ID NO: 175888 - DNA, 279 bp, Artificial Sequence
  Description of Artificial Sequence: Synthetic coding sequence
atgggcagcacctggggcagccctggctgggtgcggctggccctgtgcctgaccggcctggtgctgagcctgtatgccctgcacgtgaaggccgcccgggcccgggaccgggactaccgggccctgtgtgatgtgggcacagccatcagctgcagcagggtcttcagcagccggctgcctgctgacaccctgggcctgtgcccagatgctgctgagctgcccggggtgagccgctggttctgcctgcccggcctggaccctgtgctgcgggccctgtag

SEQ ID NO: 175889 - DNA, 492 bp, Artificial Sequence
  Description of Artificial Sequence: Synthetic coding sequence
atgggcagcacctggggcagccctggctgggtgcggctggccctgtgcctgaccggcctggtgctgagcctgtatgccctgcacgtgaaggccgcccgggcccgggaccgggactaccgggccctgtgtgatgtgggcacagccatcagctgcagcagggtcttcagcagccgctggggccggggcttcggcctggtggagcacgtgctgggccaggacagcatcctgaaccagagcaacagcatcttcggctgcatcttctacaccctgcagctgctgctgggctgcctgcggacccgctgggcctctgtgctgatgctgctgagcagcctggtgtccctggccggctctgtgtacctggcctggatcctcttctttgtgctgtatgacttctgcatcgtgtgcatcaccacctacgccatcaacgtgtccctgatgtggctgtccttcaggaaggtgcaggagccccagggcaaggccaagaggcactag

SEQ ID NO: 175890 - DNA, 5823 bp, Artificial Sequence; identical to SEQ ID NO: 160770
  Description of Artificial Sequence: Synthetic coding sequence

SEQ ID NO: 175891 - DNA, 357 bp, Artificial Sequence
  Description of Artificial Sequence: Synthetic coding sequence
atggcccccctgcggcccctgctgatcctggccctgctggcctgggtggccctggccgaccaggagagctgcaagggccgctgcacagagggcttcaacgtggacaagaagtgccagtgtgatgagctgtgcagctactaccagagctgctgcacagactacacagctgagtgcaagccccaggtgaccagaggagatgtgttcaccatgccagaagatgagtacacagtgtatgatgatggagaggagaagaacaatgccaccgtgcatgagcaggtgggcggccccagcctgaccagtgacctgcaggcccagagcaaaggaaatcctgagcagacccctgtgctgaagccctag

SEQ ID NO: 175892 - DNA, 495 bp, Artificial Sequence
  Description of Artificial Sequence: Synthetic coding sequence
atgtctgtggaccccctgagcagcaaggccctgaagatcaagcgggagctgtctgagaacaccccccacctgagtgatgaggccctgatgggcctgtctgtgcgggagctgaacagacacctgcggggcctgtctgctgaggaggtgacccggctgaagcagaggaggaggaccctgaagaacagaggctatgctgccagctgccgggtgaagagggtgtgccagaaggaggagctgcagaagcagaagtctgagctggagcgggaggtggacaagctggcccgggagaatgctgccatgaggctggagctggatgccctgcggggcaaatgtgaggccctgcagggctttgcccggtctgtggccgccgcccggggccctgccaccctggtggccccagccagcgtcatcaccatcgtgaagagcaccccaggcagcggcagcggccctgcccacggccctgaccctgcccacggccctgccagctgcagctag

SEQ ID NO: 175893 - DNA, 495 bp, Artificial Sequence; identical to SEQ ID NO: 175892
  Description of Artificial Sequence: Synthetic coding sequence

SEQ ID NO: 175894 - DNA, 381 bp, Artificial Sequence
  Description of Artificial Sequence: Synthetic coding sequence
atgtctgtggaccccctgagcagcaaggccctgaagatcaagcgggagctgtctgagaacaccccccacctgagtgatgaggccctgatgggcctgtctgtgcgggagctgaacagacacctgcggggcctgtctgctgaggaggtgacccggctgaagcagaggaggaggaccctgaagaacagaggctatgctgccagctgccgggtgaagagggtgtgccagaaggaggagctgcagaagcagaagtctgagctggagcgggaggtggacaagctggcccgggagaatgctgccatgaggctggagctggatgccctgcggggcaaatgtgaggccctgcagggctttgcccggtctgtggccgccgcccggggctag

SEQ ID NO: 175895 - DNA, 495 bp, Artificial Sequence; identical to SEQ ID NO: 175892
  Description of Artificial Sequence: Synthetic coding sequence

SEQ ID NO: 175896 - DNA, 282 bp, Artificial Sequence
  Description of Artificial Sequence: Synthetic coding sequence
atgggcctgtctgtgcgggagctgaacagacacctgcggggcctgtctgctgaggaggtgacccggctgaagcagaggaggaggaccctgaagaacagaggctacgccgccagctgccgggtgaagagggtgtgccagaaggaggagctgcagaagcagaagtctgagctggagcgggaggtggacaagctggccagagaaaatgctgccatgaggctggagctggatgccctgcggggcaaatgtgaggccctgcagggctttgcccggtctgtggcctag

SEQ ID NO: 175897 - DNA, 495 bp, Artificial Sequence; identical to SEQ ID NO: 175892
  Description of Artificial Sequence: Synthetic coding sequence

SEQ ID NO: 175898 - DNA, 408 bp, Artificial Sequence
  Description of Artificial Sequence: Synthetic coding sequence
atgggcctgtctgtgcgggagctgaacagacacctgcggggcctgtctgctgaggaggtgacccggctgaagcagaggaggaggaccctgaagaacagaggctacgccgccagctgccgggtgaagagggtgtgccagaaggaggagctgcagaagcagaagtctgagctggagcgggaggtggacaagctggccagagaaaatgctgccatgaggctggagctggatgccctgcggggcaaatgtgaggccctgcagggctttgcccggtctgtggccgccgcccggggccctgccaccctggtggccccagccagcgtcatcaccatcgtgaagagcaccccaggcagcggcagcggccctgcccacggccctgaccctgcccacggccctgccagctgcagctag

SEQ ID NO: 175899 - DNA, 489 bp, Artificial Sequence
  Description of Artificial Sequence: Synthetic coding sequence
atgaccacccccaacaagggcaacaaggccctgaaggtgaagcgggagcctggagaaaatggcaccagcctgacagatgaggagctggtgaccatgtctgtgcgggagctgaaccagcacctgcggggcctgagcaaggaggagatcgtgcagctgaagcagaggaggaggaccctgaagaacagaggctatgctgccagctgccgggtgaagagggtgacccagaaggaggagctggagaagcagaaggccgagctgcagcaggaggtggagaagctggcctctgaaaatgcctccatgaagctggagctggatgccctgcggagcaaatatgaggccctgcagacctttgccaggacagtggcccggagccctgtggccccagcccggggccccctggccgccggcctgggccccctggtgcctgggaaggtggccgccaccagcgtcatcaccatcgtgaagagcaagacagatgcccggagctag

SEQ ID NO: 175900 - DNA, 489 bp, Artificial Sequence; identical to SEQ ID NO: 175899
  Description of Artificial Sequence: Synthetic coding sequence

SEQ ID NO: 175901 - DNA, 471 bp, Artificial Sequence
  Description of Artificial Sequence: Synthetic coding sequence
atgaccaccaaccccaagcccaacaaggccctgaaggtgaagaaggaggccggagaaaatgcccctgtgctgagtgatgatgagctggtgtccatgtctgtgcgggagctgaaccagcacctgcggggcctgaccaaggaggaggtgacccggctgaagcagaggaggaggaccctgaagaacagaggctatgctgccagctgccgcatcaagagggtgacccagaaggaggagctggagcggcagagggtggagctgcagcaggaggtggagaagctggcccgggagaacagctccatgaggctggagctggatgccctgcggagcaaatatgaggccctgcagacctttgccaggacagtggcccggggccctgtggcccccagcaaggtggccaccaccagcgtcatcaccatcgtgaagagcacagagctgagcagcacctctgtgcccttctctgctgccagctag

SEQ ID NO: 175902 - DNA, 471 bp, Artificial Sequence; identical to SEQ ID NO: 175901
  Description of Artificial Sequence: Synthetic coding sequence

SEQ ID NO: 175903 - DNA, 471 bp, Artificial Sequence; identical to SEQ ID NO: 175901
  Description of Artificial Sequence: Synthetic coding sequence

SEQ ID NO: 175904 - DNA, 1041 bp, Artificial Sequence
  Description of Artificial Sequence: Synthetic coding sequence
atgcccagccccctggccctgcggccctacctgcggtctgagttcagccccagcgtggatgcccggccctgcagcagccccagcgagctgcctgccaagctgctgctgggcgccaccctgccccgggccccccggctgccccggcggctggcctggtgcagcattgactgggagcaggtgtgcctgctgcagaggctgggcgctgggggctttggatctgtgtacaaggccacctacagaggagtgcctgtggccatcaagcaggtgaacaagtgcaccaagaaccggctggccagccgccgctccttctgggccgagctgaatgtggcccggctgcggcatgacaacatcgtgcgggtggtggccgccagcaccaggaccccagctggcagcaacagcctgggcaccatcatcatggagtttggaggaaatgtgaccctgcaccaggtgatctacggggctgctggccacccagaaggagatgctggggagccccactgcaggactggaggccagctgagcctgggcaagtgcctgaagtacagcctggatgtggtgaatggcctgctcttcctgcacagccagagcatcgtgcacctggacctgaagccagccaacatcctgatcagcgagcaggatgtgtgcaagatcagtgactttggctgcagcgagaagctggaggacctgctgtgcttccagacccccagctaccccctgggcggcacctacacccaccgggcccctgagctgctgaagggggagggcgtgacccccaaggctgacatctacagctttgccatcaccctgtggcagatgaccaccaagcaggccccctacagcggggagcggcagcacatcctgtatgctgtggtggcctatgacctgcggcccagcctgtctgctgctgtgtttgaggacagcctgcccggccagaggctgggagatgtgatccagcgctgctggaggcccagcgctgcccagaggcccagcgcccggctgctgctggtggacctgaccagcctgaaggccgagctgggctag

SEQ ID NO: 175905 - DNA, 1839 bp, Artificial Sequence
  Description of Artificial Sequence: Synthetic coding sequence
atggcccggcggcccaggcacagcatctacagcagtgatgaagatgatgaagattttgagatgtgtgaccatgactatgatggcctgctgcccaagagcggcaagaggcacctgggcaagacccgctggacccgggaggaggatgagaagctgaagaagctggtggagcagaatggaacagatgactggaaggtgattgccaactacctgcccaacagaacagatgtgcagtgccagcaccgctggcagaaggtgctgaaccctgagctgatcaagggcccctggaccaaggaggaggaccagagggtcatcgagctggtgcagaagtatggccccaagcgctggagcgtcatcgccaagcacctgaagggccgcatcggcaagcagtgccgggagcgctggcacaaccacctgaaccctgaggtgaagaagacctcctggacagaggaggaggaccgcatcatctaccaggcccacaagaggctgggcaaccgctgggccgagatcgccaagctgctgcccggccgcacagacaatgccatcaagaaccactggaacagcaccatgaggaggaaggtggagcaggagggctacctgcaggagagcagcaaggccagccagcctgctgtggccaccagcttccagaagaacagccacctgatgggctttgcccaggccccacccacagcccagctgcctgccaccggccagcccaccgtgaacaatgactacagctactaccacatcagcgaggcccagaatgtgagcagccacgtgccctaccctgtggccctgcacgtgaacatcgtgaatgtgccccagcctgctgctgctgccatccagaggcactacaatgatgaagatcctgagaaggagaagaggatcaaggagctggagctgctgctgatgagcacagaaaatgagctgaagggccagcaggtgctgcccacccagaaccacacctgcagctacccaggctggcacagcaccaccatcgctgaccacacccggccccatggagacagcgcccctgtgtcctgcctgggggagcaccacagcacccccagcctgcctgctgaccccggcagcctgcctgaggagagcgccagccctgcccgctgcatgattgtgcaccagggcaccatcctggacaacgtgaagaacctgctggagtttgctgagaccctgcagttcatcgacagcttcctgaacaccagcagcaaccacgagaacagcgacctggagatgcccagcctgaccagcacccccctgattggccacaagctgactgtgaccacccccttccaccgggaccagacagtgaagacccagaaggagaacacagtgttccgcaccccagccatcaagaggagcatcctggagagcagccccaggacccccacccccttcaagcacgccctggccgcccaggagatcaagtatggccccctgaagatgctgccccagacccccagccacctggtggaggacctgcaggacgtcatcaagcaggagagtgatgaaagtggcatcgtggccgagttccaggagaatggcccccccctgctgaagaagatcaagcaggaggtggagagccccacagacaagagcggcaacttcttctgcagccaccactgggagggggacagcctgaacacccagctgttcacccagaccagccctgtggctgatgcccccaacatcctgaccagctctgtgctgatggccccagcctctgaagatgaggacaacgtgctgaaggccttcaccgtgcccaagaacagaagcctggccagccccctgcaggccaccaaggcccagaggctcttccagttctag

SEQ ID NO: 175906 - DNA, 2181 bp, Artificial Sequence
  Description of Artificial Sequence: Synthetic coding sequence
atggcccggcggcccaggcacagcatctacagcagtgatgaagatgatgaagattttgagatgtgtgaccatgactatgatggcctgctgcccaagagcggcaagaggcacctgggcaagacccgctggacccgggaggaggatgagaagctgaagaagctggtggagcagaatggaacagatgactggaaggtgattgccaactacctgcccaacagaacagatgtgcagtgccagcaccgctggcagaaggtgctgaaccctgagctgatcaagggcccctggaccaaggaggaggaccagagggtcatcgagctggtgcagaagtatggccccaagcgctggagcgtcatcgccaagcacctgaagggccgcatcggcaagcagtgccgggagcgctggcacaaccacctgaaccctgaggtgaagaagacctcctggacagaggaggaggaccgcatcatctaccaggcccacaagaggctgggcaaccgctgggccgagatcgccaagctgctgcccggccgcacagacaatgccatcaagaaccactggaacagcaccatgaggaggaaggtggagcaggagggctacctgcaggagagcagcaaggccagccagcctgctgtggccaccagcttccagaagaacagccacctgatgggctttgcccaggccccacccacagcccagctgcctgccaccggccagcccaccgtgaacaatgactacagctactaccacatcagcgaggcccagaatgtgagcagccacgtgccctaccctgtggccctgcacgtgaacatcgtgaatgtgccccagcctgctgctgctgccatccagaggcactacaatgatgaagatcctgagaaggagaagaggatcaaggagctggagctgctgctgatgagcacagaaaatgagctgaagggccagcaggtgctgcccacccagaaccacacctgcagctacccaggctggcacagcaccaccatcgctgaccacacccggccccatggagacagcgcccctgtgtcctgcctgggggagcaccacagcacccccagcctgcctgctgaccccggcagcctgcctgaggagagcgccagccctgcccgctgcatgattgtgcaccagggcaccatcctggacaacgtgaagaacctgctggagtttgctgagaccctgcagttcatcgacagcttcctgaacaccagcagcaaccacgagaacagcgacctggagatgcccagcctgaccagcacccccctgattggccacaagctgactgtgaccacccccttccaccgggaccagacagtgaagacccagaaggagaacacagtgttccgcaccccagccatcaagaggagcatcctggagagcagccccaggacccccacccccttcaagcacgccctggccgcccaggagatcaagtatggccccctgaagatgctgccccagacccccagccacctggtggaggacctgcaggacgtcatcaagcaggagagtgatgaaagtggcatcgtggccgagttccaggagaatggcccccccctgctgaagaagatcaagcaggaggtggagagccccacagacaagagcggcaacttcttctgcagccaccactgggagggggacagcctgaacacccagctgttcacccagaccagccctgtggctgatgcccccactggagtgcagtggcatgactttggcagcctgcagcccctgcccccaggcttcaagcgcttcagctgcctgagcctgcccaggtcctgggactaccgccaccccccacccaggcctgccaactttgagttcctggtggagaccggcttcctgcacgtgggccaggccggcctggagctgctgaccagcggggacctgcctgccagcgccagccagagcgcccgcatcactggagtgagccaccgggcccggccagacaacatcctgaccagctctgtgctgatggccccagcctctgaagatgaggacaacgtgctgaaggccttcaccgtgcccaagaacagaagcctggccagccccctgcagccctgcagcagcacctgggagcccgccagctgtgggaagatggaggagcagatgaccagcagcagccaggccaggaaatatgtgaatgccttcagcgcccggaccctggtgatgtag

SEQ ID NO: 175907 - DNA, 2286 bp, Artificial Sequence
  Description of Artificial Sequence: Synthetic coding sequence
atggcccggcggcccaggcacagcatctacagcagtgatgaagatgatgaagattttgagatgtgtgaccatgactatgatggcctgctgcccaagagcggcaagaggcacctgggcaagacccgctggacccgggaggaggatgagaagctgaagaagctggtggagcagaatggaacagatgactggaaggtgattgccaactacctgcccaacagaacagatgtgcagtgccagcaccgctggcagaaggtgctgaaccctgagctgatcaagggcccctggaccaaggaggaggaccagagggtcatcgagctggtgcagaagtatggccccaagcgctggagcgtcatcgccaagcacctgaagggccgcatcggcaagcagtgccgggagcgctggcacaaccacctgaaccctgaggtgaagaagacctcctggacagaggaggaggaccgcatcatctaccaggcccacaagaggctgggcaaccgctgggccgagatcgccaagctgctgcccggccgcacagacaatgccatcaagaaccactggaacagcaccatgaggaggaaggtggagcaggagggctacctgcaggagagcagcaaggccagccagcctgctgtggccaccagcttccagaagaacagccacctgatgggctttgcccaggccccacccacagcccagctgcctgccaccggccagcccaccgtgaacaatgactacagctactaccacatcagcgaggcccagaatgtgagcagccacgtgccctaccctgtggccctgcacgtgaacatcgtgaatgtgccccagcctgctgctgctgccatccagaggcactacaatgatgaagatcctgagaaggagaagaggatcaaggagctggagctgctgctgatgagcacagaaaatgagctgaagggccagcaggtgctgcccacccagaaccacacctgcagctacccaggctggcacagcaccaccatcgctgaccacacccggccccatggagacagcgcccctgtgtcctgcctgggggagcaccacagcacccccagcctgcctgctgaccccggcagcctgcctgaggagagcgccagccctgcccgctgcatgattgtgcaccagggcaccatcctggacaacgtgaagaacctgctggagtttgctgagaccctgcagttcatcgacagcgacagcagctcctggtgtgacctgagcagctttgagttctttgaggaggccgacttcagccccagccagcaccacacaggcaaggccctgcagctgcagcagcgggagggcaatggcaccaagccagctggggagcccagcccccgggtgaacaagaggatgctgtctgagagcagcctggacccccccaaggtgctgcccccagcccggcacagcaccatccccctggtgatcctgaggaagaagaggggccaggccagccccctggccaccggggactgcagcagcttcatctttgctgatgtgagcagcagcacccccaagaggagccctgtgaagagcctgcccttcagccccagccagttcctgaacaccagcagcaaccatgaaaattctgacctggagatgcccagcctgaccagcacccccctcatcggccacaagctgactgtgaccacccccttccaccgggaccagacagtgaagacccagaaggaaaatacagtgttccgcaccccagccatcaagaggagcatcctggagagcagccccaggacccccacccccttcaagcacgccctggccgcccaggagatcaagtatggccccctgaagatgctgccccagacccccagccacctggtggaggacctgcaggatgtgatcaagcaggagagtgatgagagcggcatcgtggccgagttccaggagaatggaccacccctgctgaagaagatcaagcaggaggtggagagccccacagacaagagcggcaacttcttctgcagccaccactgggagggggacagcctgaacacccagctgttcacccagaccagccctgtggctgatgcccccaacatcctgaccagctctgtgctgatggccccagcctctgaagatgaagataatgtgctgaaggccttcaccgtgcccaagaacagaagcctggccagccccctgcagccctgcagcagcacctgggagcccgccagctgtgggaagatggaggagcagatgaccagcagcagccaggccaggaaatatgtgaatgccttcagcgcccggaccctggtgatgtag

SEQ ID NO: 175908 - DNA, 1923 bp, Artificial Sequence
  Description of Artificial Sequence: Synthetic coding sequence
atggcccggcggcccaggcacagcatctacagcagtgatgaagatgatgaagattttgagatgtgtgaccatgactatgatggcctgctgcccaagagcggcaagaggcacctgggcaagacccgctggacccgggaggaggatgagaagctgaagaagctggtggagcagaatggaacagatgactggaaggtgattgccaactacctgcccaacagaacagatgtgcagtgccagcaccgctggcagaaggtgctgaaccctgagctgatcaagggcccctggaccaaggaggaggaccagagggtcatcgagctggtgcagaagtatggccccaagcgctggagcgtcatcgccaagcacctgaagggccgcatcggcaagcagtgccgggagcgctggcacaaccacctgaaccctgaggtgaagaagacctcctggacagaggaggaggaccgcatcatctaccaggcccacaagaggctgggcaaccgctgggccgagatcgccaagctgctgcccggccgcacagacaatgccatcaagaaccactggaacagcaccatgaggaggaaggtggagcaggagggctacctgcaggagagcagcaaggccagccagcctgctgtggccaccagcttccagaagaacagccacctgatgggctttgcccaggccccacccacagcccagctgcctgccaccggccagcccaccgtgaacaatgactacagctactaccacatcagcgaggcccagaatgtgagcagccacgtgccctaccctgtggccctgcacgtgaacatcgtgaatgtgccccagcctgctgctgctgccatccagaggcactacaatgatgaagatcctgagaaggagaagaggatcaaggagctggagctgctgctgatgagcacagaaaatgagctgaagggccagcaggtgctgcccacccagaaccacacctgcagctacccaggctggcacagcaccaccatcgctgaccacacccggccccatggagacagcgcccctgtgtcctgcctgggggagcaccacagcacccccagcctgcctgctgaccccggcagcctgcctgaggagagcgccagccctgcccgctgcatgattgtgcaccagggcaccatcctggacaacgtgaagaacctgctggagtttgctgagaccctgcagttcatcgacagcttcctgaacaccagcagcaaccacgagaacagcgacctggagatgcccagcctgaccagcacccccctgattggccacaagctgactgtgaccacccccttccaccgggaccagacagtgaagacccagaaggagaacacagtgttccgcaccccagccatcaagaggagcatcctggagagcagccccaggacccccacccccttcaagcacgccctggccgcccaggagatcaagtatggccccctgaagatgctgccccagacccccagccacctggtggaggacctgcaggacgtcatcaagcaggagagtgatgaaagtggcatcgtggccgagttccaggagaatggcccccccctgctgaagaagatcaagcaggaggtggagagccccacagacaagagcggcaacttcttctgcagccaccactgggagggggacagcctgaacacccagctgttcacccagaccagccctgtggctgatgcccccaacatcctgaccagctctgtgctgatggccccagcctctgaagatgaggacaacgtgctgaaggccttcaccgtgcccaagaacagaagcctggccagccccctgcagccctgcagcagcacctgggagcccgccagctgtgggaagatggaggagcagatgaccagcagcagccaggccaggaaatatgtgaatgccttcagcgcccggaccctggtgatgtag

SEQ ID NO: 175909 - DNA, 1914 bp, Artificial Sequence
  Description of Artificial Sequence: Synthetic coding sequence
atggcccggcggcccaggcacagcatctacagcagtgatgaagatgatgaagattttgagatgtgtgaccatgactatgatggcctgctgcccaagagcggcaagaggcacctgggcaagacccgctggacccgggaggaggatgagaagctgaagaagctggtggagcagaatggaacagatgactggaaggtgattgccaactacctgcccaacagaacagatgtgcagtgccagcaccgctggcagaaggtgctgaaccctgagctgatcaagggcccctggaccaaggaggaggaccagagggtcatcgagctggtgcagaagtatggccccaagcgctggagcgtcatcgccaagcacctgaagggccgcatcggcaagcagtgccgggagcgctggcacaaccacctgaaccctgaggtgaagaagacctcctggacagaggaggaggaccgcatcatctaccaggcccacaagaggctgggcaaccgctgggccgagatcgccaagctgctgcccggccgcacagacaatgccatcaagaaccactggaacagcaccatgaggaggaaggtggagcaggagggctacctgcaggagagcagcaaggccagccagcctgctgtggccaccagcttccagaagaacagccacctgatgggctttgcccaggccccacccacagcccagctgcctgccaccggccagcccaccgtgaacaatgactacagctactaccacatcagcgaggcccagaatgtgagcagccacgtgccctaccctgtggccctgcacgtgaacatcgtgaatgtgccccagcctgctgctgctgccatccagaggcactacaatgatgaagatcctgagaaggagaagaggatcaaggagctggagctgctgctgatgagcacagaaaatgagctgaagggccagcagacccagaaccacacctgcagctacccaggctggcacagcaccaccatcgctgaccacacccggccccacggggacagcgcccctgtgtcctgcctgggggagcaccacagcacccccagcctgcctgctgaccccggcagcctgcctgaggagagcgccagccctgcccgctgcatgattgtgcaccagggcaccatcctggacaacgtgaagaacctgctggagtttgctgagaccctgcagttcatcgacagcttcctgaacaccagcagcaaccatgaaaattctgacctggagatgcccagcctgaccagcacccccctcatcggccacaagctgactgtgaccacccccttccaccgggaccagacagtgaagacccagaaggaaaatacagtgttccgcaccccagccatcaagaggagcatcctggagagcagccccaggacccccacccccttcaagcacgccctggccgcccaggagatcaagtatggccccctgaagatgctgccccagacccccagccacctggtggaggacctgcaggatgtgatcaagcaggagagtgatgagagcggcatcgtggccgagttccaggagaatggaccacccctgctgaagaagatcaagcaggaggtggagagccccacagacaagagcggcaacttcttctgcagccaccactgggagggggacagcctgaacacccagctgttcacccagaccagccctgtggctgatgcccccaacatcctgaccagctctgtgctgatggccccagcctctgaagatgaagataatgtgctgaaggccttcaccgtgcccaagaacagaagcctggccagccccctgcagccctgcagcagcacctgggagcccgccagctgtgggaagatggaggagcagatgaccagcagcagccaggccaggaaatatgtgaatgccttcagcgcccggaccctggtgatgtag

SEQ ID NO: 175910 - DNA, 240 bp, Artificial Sequence
  Description of Artificial Sequence: Synthetic coding sequence
atggcccggcggcccaggcacagcatctacagcagtgatgaagatgatgaagattttgagatgtgtgaccatgactatgatggcctgctgcccaagagcggcaagaggcacctgggcaagacccgctggacccgggaggagaacagaacagatgtgcagtgccagcaccgctggcagaaggtgctgaaccctgagctgatcaagggcccctggaccaaggaggaggaccagaggaactag

SEQ ID NO: 175911 - DNA, 312 bp, Artificial Sequence
  Description of Artificial Sequence: Synthetic coding sequence
atggcccggcggcccaggcacagcatctacagcagtgatgaagatgatgaagattttgagatgtgtgaccatgactatgatggcctgctgcccaagagcggcaagaggcacctgggcaagacccgctggacccgggaggaggatgagaagctgaagaagctggtggagcagaatggaacagatgactggaaggtgattgccaactacctgcccaacagaacagatgtgcagtgccagcaccgctggcagaaggtgctgaaccctgagctgatcaagggcccctggaccaaggaggaggaccagaggaactag

SEQ ID NO: 175912 - DNA, 1818 bp, Artificial Sequence
  Description of Artificial Sequence: Synthetic coding sequence
atggcccggcggcccaggcacagcatctacagcagtgatgaagatgatgaagattttgagatgtgtgaccatgactatgatggcctgctgcccaagagcggcaagaggcacctgggcaagacccgctggacccgggaggaggatgagaagctgaagaagctggtggagcagaatggaacagatgactggaaggtgattgccaactacctgcccaacagaacagatgtgcagtgccagcaccgctggcagaaggtgctgaaccctgagctgatcaagggcccctggaccaaggaggaggaccagagggtcatcgagctggtgcagaagtatggccccaagcgctggagcgtcatcgccaagcacctgaagggccgcatcggcaagcagtgccgggagcgctggcacaaccacctgaaccctgaggtgaagaagacctcctggacagaggaggaggaccgcatcatctaccaggcccacaagaggctgggcaaccgctgggccgagatcgccaagctgctgcccggccgcacagacaatgccatcaagaaccactggaacagcaccatgaggaggaaggtggagcaggagggctacctgcaggagagcagcaaggccagccagcctgctgtggccaccagcttccagaagaacagccacctgatgggctttgcccaggccccacccacagcccagctgcctgccaccggccagcccaccgtgaacaatgactacagctactaccacatcagcgaggcccagaatgtgagcagccacgtgccctaccctgtggccctgcacgtgaacatcgtgaatgtgccccagcctgctgctgctgccatccagacccagaaccacacctgcagctacccaggctggcacagcaccaccatcgctgaccacacccggccccacggggacagcgcccctgtgtcctgcctgggggagcaccacagcacccccagcctgcctgctgaccccggcagcctgcctgaggagagcgccagccctgcccgctgcatgattgtgcaccagggcaccatcctggacaacgtgaagaacctgctggagtttgctgagaccctgcagttcatcgacagcttcctgaacaccagcagcaaccatgaaaattctgacctggagatgcccagcctgaccagcacccccctcatcggccacaagctgactgtgaccacccccttccaccgggaccagacagtgaagacccagaaggaaaatacagtgttccgcaccccagccatcaagaggagcatcctggagagcagccccaggacccccacccccttcaagcacgccctggccgcccaggagatcaagtatggccccctgaagatgctgccccagacccccagccacctggtggaggacctgcaggatgtgatcaagcaggagagtgatgagagcggcatcgtggccgagttccaggagaatggaccacccctgctgaagaagatcaagcaggaggtggagagccccacagacaagagcggcaacttcttctgcagccaccactgggagggggacagcctgaacacccagctgttcacccagaccagccctgtggctgatgcccccaacatcctgaccagctctgtgctgatggccccagcctctgaagatgaagataatgtgctgaaggccttcaccgtgcccaagaacagaagcctggccagccccctgcagccctgcagcagcacctgggagcccgccagctgtgggaagatggaggagcagatgaccagcagcagccaggccaggaaatatgtgaatgccttcagcgcccggaccctggtgatgtag

SEQ ID NO: 175913 - DNA, 717 bp, Artificial Sequence; identical to SEQ ID NO: 165822
  Description of Artificial Sequence: Synthetic coding sequence

SEQ ID NO: 175914 - DNA, 2031 bp, Artificial Sequence
  Description of Artificial Sequence: Synthetic coding sequence
atgagcaggaggacccgctgtgaggacctggatgagctgcactaccaggacacagacagtgatgtgcctgagcagagggacagcaagtgcaaggtgaagtggacccatgaggagaacagaacagaccagcagtgccagtaccgctggctgcgggtgctgaacccagacctggtgaagggcccctggaccaaggaggaggaccagaaggtgattgagctggtgaagaagtatggcaccaagcagtggaccctgattgccaagcacctgaagggccgcctgggcaagcagtgccgggagcgctggcacaaccacctgaaccctgaggtgaagaagagctgctggacagaggaggaggaccgcatcatctgtgaggcccacaaggtgctgggcaaccgctgggccgagatcgccaagatgctgcccggccgcacagacaatgctgtgaagaaccactggaacagcaccatcaagaggaaggtggacaccggcggcttcctgtctgagagcaaggactgcaagccccctgtgtacctgctgctggagctggaggacaaggatggcctgcagagcgcccagcccacagagggccagggcagcctgctgaccaactggcccagcgtgccccccaccatcaaggaggaggagaacagcgaggaggagctggccgccgccaccaccagcaaggagcaggagcccatcggcacagacctggatgctgtgaggaccccagagcccctggaggagttccccaagcgggaggaccaggagggcagccccccagagaccagcctgccctacaagtgggtggtggaggccgccaacctgctgatcccagctgtgggcagcagcctgtctgaggccctggacctgattgaaagtgaccctgatgcctggtgtgacctgagcaagtttgacctgcctgaggagcccagcgcagaagattccatcaacaacagcctggtgcagctgcaggccagccaccagcagcaggtgctgcccccccggcagcccagcgccctggtgcccagcgtgacagagtaccgcctggatggccacaccatcagtgacctgagccgcagcagcagaggagagctgatccccatcagccccagcacagaggtgggcggcagcggcatcggcaccccacccagcgtgctgaagaggcagaggaagagaagagtggccctgagccctgtgacagagaacagcaccagcctgtccttcctggacagctgcaacagcctgacccccaagagcacccctgtgaagaccctgcccttcagccccagccagttcctgaacttctggaacaagcaggacaccctggagctggagagccccagcctgaccagcacccctgtgtgcagccagaaggtggtggtgaccacccccctgcaccgggacaagacccccctgcaccagaagcatgctgcctttgtgaccccagaccagaagtacagcatggacaacaccccccacacccccacccccttcaagaatgccctggagaagtatggccccctgaagcccctgccccagaccccccacctggaggaggacctgaaggaggtgctgcggtctgaggccggcatcgagctgatcattgaagatgacatccggcctgagaagcagaagaggaagccaggcctgcggcgcagccccatcaagaaggtgaggaagagcctggccctggacatcgtggatgaagatgtgaagctgatgatgagcaccctgcccaagagcctgagcctgcccaccacagcccccagcaacagcagcagcctgaccctgagcggcatcaaggaggacaacagcctgctgaaccagggcttcctgcaggccaagccagagaaggctgctgtggcccagaagcccaggagccacttcaccaccccagcccccatgagcagcgcctggaagacagtggcctgtggcggcacccgggaccagctgttcatgcaggagaaggcccggcagctgctgggccgcctgaagcccagccacaccagcaggaccctcatcctgtcctag

SEQ ID NO: 175915 - DNA, 1395 bp, Artificial Sequence
  Description of Artificial Sequence: Synthetic coding sequence
atgcccagctgcagcaccagcaccatgcctggcatgatctgcaagaacccagacctggagtttgacagcctgcagccctgcttctacccagatgaagatgacttctactttggaggccctgacagcaccccacctggagaggacatctggaagaagtttgagctgctgcccaccccacccctgagccccagccggggctttgctgagcacagcagcgagccccccagctgggtgacagagatgctgctggagaatgagctgtggggcagccctgctgaggaggatgccttcggcctgggcggcctgggcggcctgacccccaaccctgtgatcctgcaggactgcatgtggagcggcttcagcgcccgggagaagctggagagagctgtgtctgagaagctgcagcacggccggggccccccaacagctggcagcacagcccagagccctggggccggggccgccagccctgctggccggggccacggcggggccgccggggccggccgggccggggccgccctgcctgctgagctggcccaccctgctgctgaatgtgtggaccctgctgtggtgttccccttccctgtgaacaagcgggagcccgcccctgtgcctgctgccccagccagcgccccagctgctggccctgctgtggccagcggggccggcattgctgccccagctggggcccctggggtggccccacccaggcctgggggccggcagaccagcggcggggaccacaaggccctgagcaccagcggggaggacaccctgagtgacagtgatgatgaagatgatgaggaggaggatgaggaggaggagattgatgtggtgacagtggagaagagaagaagcagcagcaacaccaaggctgtgaccaccttcaccatcaccgtgcggcccaagaatgctgccctgggccctggccgggcccagagcagcgagctgatcctgaagcgctgcctgcccatccaccagcagcacaactatgctgcccccagcccctacgtggagagtgaagatgccccaccccagaagaagatcaagtctgaggccagcccccggcccctgaagagcgtcatcccccccaaggccaagagcctgagccccaggaacagcgacagcgaggacagcgagaggagaagaaaccacaacatcctggagcggcagaggagaaatgacctgcggagcagcttcctgaccctgcgggaccacgtgcctgagctggtgaagaatgagaaggccgccaaggtggtgatcctgaagaaggccacagaatatgtgcacagcctgcaggccgaggagcaccagctgctgctggagaaggagaagctgcaggcccggcagcagcagctgctgaagaagattgagcacgcccggacctgctag

SEQ ID NO: 175916 - DNA, 1149 bp, Artificial Sequence
  Description of Artificial Sequence: Synthetic coding sequence
atgcccagctgcagcaccagcaccatgcctggcatgatctgcaagaacccagacctggagtttgacagcctgcagccctgcttctacccagatgaagatgacttctactttggaggccctgacagcaccccacctggagaggacatctggaagaagtttgagctgctgcccaccccacccctgagccccagccggggctttgctgagcacagcagcgagccccccagctgggtgacagagatgctgctggagaatgagctgtggggcagccctgctgaggaggatgccttcggcctgggcggcctgggcggcctgacccccaaccctgtgatcctgcaggactgcatgtggagcggcttcagcgcccgggagaagctggagagagctgtgtctgagaagctgcagcacggccggggccccccaacagctggcagcacagcccagagccctggggtggccccacccaggcctgggggccggcagaccagcggcggggaccacaaggccctgagcaccagcggggaggacaccctgagtgacagtgatgatgaagatgatgaggaggaggatgaggaggaggagattgatgtggtgacagtggagaagagaagaagcagcagcaacaccaaggctgtgaccaccttcaccatcaccgtgcggcccaagaatgctgccctgggccctggccgggcccagagcagcgagctgatcctgaagcgctgcctgcccatccaccagcagcacaactatgctgcccccagcccctacgtggagagtgaagatgccccaccccagaagaagatcaagtctgaggccagcccccggcccctgaagagcgtcatcccccccaaggccaagagcctgagccccaggaacagcgacagcgaggacagcgagaggagaagaaaccacaacatcctggagcggcagaggagaaatgacctgcggagcagcttcctgaccctgcgggaccacgtgcctgagctggtgaagaatgagaaggccgccaaggtggtgatcctgaagaaggccacagaatatgtgcacagcctgcaggccgaggagcaccagctgctgctggagaaggagaagctgcaggcccggcagcagcagctgctgaagaagattgagcacgcccggacctgctag

SEQ ID NO: 175917 - DNA, 852 bp, Artificial Sequence
  Description of Artificial Sequence: Synthetic coding sequence
atggctgtgccccccacctacgccgacctgggcaagagcgccagagatgtgttcaccaagggctacggcttcggcctcatcaagctggacctgaagaccaagtcagaaaatggcctggagttcaccagcagcggcagcgccaacacagagaccaccaaggtgacaggcagcctggagaccaagtaccgctggacagaatatggcctgaccttcacagagaagtggaacacagacaacaccctgggcacagagatcaccgtggaggaccagctggcccggggcctgaagctgacctttgacagcagcttcagccccaacacaggcaagaagaatgccaagatcaagacaggctacaagcgggagcacatcaacctgggctgtgacatggactttgatattgctggccccagcatccggggggccctggtgctgggctatgagggctggctggccggctaccagatgaactttgaaacagccaagagccgggtgacccagagcaactttgctgtgggctacaagacagatgagttccagctgcacaccaacgtgaatgatggaacagaatttggaggcagcatctaccagaaggtgaacaagaagctggagacagctgtgaacctggcctggacagctggcaacagcaacaccaggtttggaattgctgccaagtaccagattgatcctgatgcctgcttcagcgccaaggtgaacaacagcagcctgattggcctgggctacacccagaccctgaagccaggcatcaagctgaccctgagcgccctgctggatggcaagaatgtgaatgctgggggccacaagctgggcctgggcctggagttccaggcctag

SEQ ID NO: 175918 - DNA, 852 bp, Artificial Sequence; identical to SEQ ID NO: 175917
  Description of Artificial Sequence: Synthetic coding sequence

SEQ ID NO: 175919 - DNA, 852 bp, Artificial Sequence; identical to SEQ ID NO: 175917
  Description of Artificial Sequence: Synthetic coding sequence

SEQ ID NO: 175920 - DNA, 849 bp, Artificial Sequence
  Description of Artificial Sequence: Synthetic coding sequence
atggccacccacggccagacctgtgcccggcccatgtgcatccccccatcctatgctgacctgggcaaggccgcccgggacatcttcaacaagggctttggatttggcctggtgaagctggatgtgaagaccaagagctgcagcggcgtggagttcagcaccagcggcagcagcaacacagacaccgggaaggtgacaggcaccctggagaccaagtacaagtggtgtgaatatggcctgaccttcacagagaagtggaacacagacaacaccctgggcacagagatcgccatcgaggaccagatctgccagggcctgaagctgacctttgacaccaccttcagccccaacacaggcaagaagagcggcaagatcaagagcagctacaagcgggagtgcatcaacctgggctgtgatgtggactttgattttgctggccctgccatccacggcagcgctgtgtttggctatgagggctggctggccggctaccagatgacctttgacagcgccaagagcaagctgaccaggaacaactttgctgtgggctacagaactggagacttccagctgcacaccaacgtgaatgatggaacagaatttggaggcagcatctaccagaaggtgtgtgaggacctggacacctctgtgaacctggcctggaccagcggcaccaactgcacccgcttcggcattgctgccaagtaccagctggaccccacagccagcatcagcgccaaggtgaacaacagcagcctcatcggcgtgggctacacccagaccctgcggcctggggtgaagctgaccctgagcgccctggtggatggcaagagcatcaatgccggctag

SEQ ID NO: 175921 - DNA, 930 bp, Artificial Sequence
  Description of Artificial Sequence: Synthetic coding sequence
atgtcctggtgcaatgagctgcggctgcctgccctgaagcagcacagcatcggccggggcctggagagccacatcaccatgtgcatcccccccagctatgctgacctgggcaaggccgcccgggacatcttcaacaagggcttcggcttcggcctggtgaagctggatgtgaagaccaagagctgcagcggcgtggagttcagcaccagcggcagcagcaacacagacaccgggaaggtgacaggcaccctggagaccaagtacaagtggtgtgaatatggcctgaccttcacagagaagtggaacacagacaacaccctgggcacagaaattgccatcgaggaccagatctgccagggcctgaagctgacctttgacaccaccttcagccccaacacaggcaagaagagcggcaagatcaagagcagctacaagcgggagtgcatcaacctgggctgtgatgtggactttgattttgctggccctgccatccacggcagcgctgtgtttggctatgagggctggctggccggctaccagatgacctttgattctgccaagagcaagctgaccaggaacaactttgctgtgggctacagaactggagacttccagctgcacaccaacgtgaatgatggaacagaatttggaggcagcatctaccagaaggtgtgtgaggacctggacacctctgtgaacctggcctggaccagcggcaccaactgcaccaggtttggaattgctgccaagtaccagctggaccccacagccagcatcagcgccaaggtgaacaacagcagcctgattggagtgggctacacccagaccctgcggcctggggtgaagctgaccctgagcgccctggtggatggcaagagcatcaatgctgggggccacaaggtgggcctggccctggagctggaggcctag

SEQ ID NO: 175922 - DNA, 885 bp, Artificial Sequence
  Description of Artificial Sequence: Synthetic coding sequence
atggccacccacggccagacctgtgcccggcccatgtgcatccccccatcctatgctgacctgggcaaggccgcccgggacatcttcaacaagggctttggatttggcctggtgaagctggatgtgaagaccaagagctgcagcggcgtggagttcagcaccagcggcagcagcaacacagacaccgggaaggtgacaggcaccctggagaccaagtacaagtggtgtgaatatggcctgaccttcacagagaagtggaacacagacaacaccctgggcacagagatcgccatcgaggaccagatctgccagggcctgaagctgacctttgacaccaccttcagccccaacacaggcaagaagagcggcaagatcaagagcagctacaagcgggagtgcatcaacctgggctgtgatgtggactttgattttgctggccctgccatccacggcagcgctgtgtttggctatgagggctggctggccggctaccagatgacctttgacagcgccaagagcaagctgaccaggaacaactttgctgtgggctacagaactggagacttccagctgcacaccaacgtgaatgatggaacagaatttggaggcagcatctaccagaaggtgtgtgaggacctggacacctctgtgaacctggcctggaccagcggcaccaactgcacccgcttcggcattgctgccaagtaccagctggaccccacagccagcatcagcgccaaggtgaacaacagcagcctcatcggcgtgggctacacccagaccctgcggcctggggtgaagctgaccctgagcgccctggtggatggcaagagcatcaatgccggcggccacaaggtgggcctggccctggagctggaggcctag

SEQ ID NO: 175923 - DNA, 588 bp, Artificial Sequence
  Description of Artificial Sequence: Synthetic coding sequence
atggccacccacggccagacctgtgcccggcccatgtgcatccccccatcctatgctgacctgggcaaggccgcccgggacatcttcaacaagggctttggatttggcctggtgaagctggatgtgaagaccaagagctgcagcggcgtggagttcagcaccagcggcagcagcaacacagacaccgggaaggtgacaggcaccctggagaccaagtacaagtggtgtgaatatggcctgaccttcacagagaagtggaacacagacaacaccctgggcacagagatcgccatcgaggaccagatctgccagggcctgaagctgacctttgacaccaccttcagccccaacacaggcaagaagagcggcaagatcaagagcagctacaagcgggagtgcatcaacctgggctgtgatgtggactttgattttgctggccctgccatccacggcagcgctgtgtttggctatgagggctggctggccggctaccagatgacctttgacagcgccaagagcaagctgaccaggaacaactttgctgtgggctacagaactggagacttccagctgcacaccaacgtgtag

SEQ ID NO: 175924 - DNA, 330 bp, Artificial Sequence
  Description of Artificial Sequence: Synthetic coding sequence
atgtcctggtgcaatgagctgcggctgcctgccctgaagcagcacagcatcggccggggcctggagagccacatcaccatgtgcatcccccccagctatgctgacctgggcaaggccgcccgggacatcttcaacaagggcttcggcttcggcctggtgaagctggatgtgaagaccaagagctgcagcggcgtggagttcagcaccagcggcagcagcaacacagacaccgggaaggtgacaggcaccctggagaccaagtacaagtggtgtgaatatggcctgaccttcacagagaagtggaacacagacaacaccctgggcacctag

SEQ ID NO: 175925 - DNA, 615 bp, Artificial Sequence
  Description of Artificial Sequence: Synthetic coding sequence
atggccacccacggccagacctgtgcccggcccatgtgcatccccccatcctatgctgacctgggcaaggccgcccgggacatcttcaacaagggctttggatttggcctggtgaagctggatgtgaagaccaagagctgcagcggcgtggagttcagcaccagcggcagcagcaacacagacaccgggaaggtgacaggcaccctggagaccaagtacaagtggtgtgaatatggcctgaccttcacagagaagtggaacacagacaacaccctgggcacagagatcgccatcgaggaccagatctgccagggcctgaagctgacctttgacaccaccttcagccccaacacaggcaagaagagcggcaagatcaagagcagctacaagcgggagtgcatcaacctgggctgtgatgtggactttgattttgctggccctgccatccacggcagcgctgtgtttggctatgagggctggctggccggctaccagatgacctttgacagcgccaagagcaagctgaccaggaacaactttgctgtgggctacagaactggagacttccagctgcacaccaacgtgaatgatggaacagaatttggaggcagctag

SEQ ID NO: 175926 - DNA, 768 bp, Artificial Sequence
  Description of Artificial Sequence: Synthetic coding sequence
atgctggtgatcccagccacccaggaggccgaggagttcagcaccagcggcagcagcaacacagacaccgggaaggtgacaggcaccctggagaccaagtacaagtggtgtgaatatggcctgaccttcacagagaagtggaacacagacaacaccctgggcacagaaattgccatcgaggaccagatctgccagggcctgaagctgacctttgacaccaccttcagccccaacacaggcaagaagagcggcaagatcaagagcagctacaagcgggagtgcatcaacctgggctgtgatgtggactttgattttgctggccctgccatccacggcagcgctgtgtttggctatgagggctggctggccggctaccagatgacctttgattctgccaagagcaagctgaccaggaacaactttgctgtgggctacagaactggagacttccagctgcacaccaacgtgaatgatggaacagaatttggaggcagcatctaccagaaggtgtgtgaggacctggacacctctgtgaacctggcctggaccagcggcaccaactgcaccaggtttggaattgctgccaagtaccagctggaccccacagccagcatcagcgccaaggtgaacaacagcagcctgattggagtgggctacacccagaccctgcggcctggggtgaagctgaccctgagcgccctggtggatggcaagagcatcaatgctgggggccacaaggtgggcctggccctggagctggaggcctag

SEQ ID NO: 175927 - DNA, 885 bp, Artificial Sequence; identical to SEQ ID NO: 175922
  Description of Artificial Sequence: Synthetic coding sequence

SEQ ID NO: 175928 - DNA, 852 bp, Artificial Sequence
  Description of Artificial Sequence: Synthetic coding sequence
atgtgcaacacccccacctactgtgacctgggcaaggccgccaaggatgtgttcaacaagggctacggcttcggcatggtgaagattgacctgaagaccaagagctgcagcggcgtggagttcagcaccagcggccacgcctacacagacaccgggaaggccagcggcaacctggagaccaagtacaaggtgtgcaactacggcctgaccttcacccagaagtggaacacagacaacaccctgggcacagagatctcctgggagaacaagctggccgagggcctgaagctgaccctggacaccatctttgtgcccaacacaggcaagaagagcggcaagctgaaggccagctacaagagggactgcttctctgtgggcagcaatgtggacatcgacttcagcggccccaccatctacggctgggccgtgctggcctttgagggctggctggccggctaccagatgagctttgacacagccaagagcaagctgagccagaacaactttgccctgggctacaaggctgctgacttccagctgcacacccacgtgaatgatggaacagaatttggaggcagcatctaccagaaggtgaatgagaagattgagaccagcatcaacctggcctggacagctggcagcaacaacaccaggtttggaattgctgccaagtacatgctggactgcaggaccagcctgagcgccaaggtgaacaatgccagcctgattggcctgggctacacccagaccctgcggcctggggtgaagctgaccctgagcgccctgattgatggcaagaacttctctgctgggggccacaaggtgggcctgggctttgagctggaggcctag

SEQ ID NO: 175929 - DNA, 855 bp, Artificial Sequence
  Description of Artificial Sequence: Synthetic coding sequence
atgtgcaacacccccacctactgtgacctgggcaaggccgccaaggatgtgttcaacaagggctacggcttcggcatggtgaagattgacctgaagaccaagagctgcagcggcgtggtggagttcagcaccagcggccacgcctacacagacaccgggaaggccagcggcaacctggagaccaagtacaaggtgtgcaactacggcctgaccttcacccagaagtggaacacagacaacaccctgggcacagagatctcctgggagaacaagctggccgagggcctgaagctgaccctggacaccatctttgtgcccaacacaggcaagaagagcggcaagctgaaggccagctacaagagggactgcttctctgtgggcagcaatgtggacatcgacttcagcggccccaccatctacggctgggccgtgctggcctttgagggctggctggccggctaccagatgagctttgacacagccaagagcaagctgagccagaacaactttgccctgggctacaaggctgctgacttccagctgcacacccacgtgaatgatggaacagaatttggaggcagcatctaccagaaggtgaatgagaagattgagaccagcatcaacctggcctggacagctggcagcaacaacacccgcttcggcattgctgccaagtacatgctggactgcaggaccagcctgagcgccaaggtgaacaatgccagcctcatcggcctgggctacacccagaccctgcggcctggggtgaagctgaccctgagcgccctgattgatggcaagaacttctctgctgggggccacaaggtgggcctgggctttgagctggaggcctag

SEQ ID NO: 175930 - DNA, 498 bp, Artificial Sequence
  Description of Artificial Sequence: Synthetic coding sequence
atgtgcaacacccccacctactgtgacctgggcaaggccgccaaggatgtgttcaacaagggctacggcttcggcatggtgaagattgacctgaagaccaagagctgcagcggcgtggagttcagcaccagcggccacgcctacacagacaccgggaaggccagcggcaacctggagaccaagtacaaggtgtgcaactacggcctgaccttcacccagaagtggaacacagacaacaccctgggcacagagatctcctgggagaacaagctggccgagggcctgaagctgaccctggacaccatctttgtgcccaacacaggcaagaagagcggcaagctgaaggccagctacaagagggactgcttctctgtgggcagcaatgtggacatcgacttcagcggccccaccatctacggctgggccgtgctggcctttgagggctggctggccggctaccagatgagctttgacacagccaagagcaagctgtcctag

SEQ ID NO: 175931 - DNA, 855 bp, Artificial Sequence
  Description of Artificial Sequence: Synthetic coding sequence
atgtgcaacacccccacctactgtgacctgggcaaggccgccaaggatgtgttcaacaagggctacggcttcggcatggtgaagattgacctgaagaccaagagctgcagcggcgtgatggagttcagcaccagcggccacgcctacacagacaccgggaaggccagcggcaacctggagaccaagtacaaggtgtgcaactacggcctgaccttcacccagaagtggaacacagacaacaccctgggcacagagatctcctgggagaacaagctggccgagggcctgaagctgaccctggacaccatctttgtgcccaacacaggcaagaagagcggcaagctgaaggccagctacaagagggactgcttctctgtgggcagcaatgtggacatcgacttcagcggccccaccatctacggctgggccgtgctggcctttgagggctggctggccggctaccagatgagctttgacacagccaagagcaagctgagccagaacaactttgccctgggctacaaggctgctgacttccagctgcacacccacgtgaatgatggaacagaatttggaggcagcatctaccagaaggtgaatgagaagattgagaccagcatcaacctggcctggacagctggcagcaacaacacccgcttcggcattgctgccaagtacatgctggactgcaggaccagcctgagcgccaaggtgaacaatgccagcctcatcggcctgggctacacccagaccctgcggcctggggtgaagctgaccctgagcgccctgattgatggcaagaacttctctgctgggggccacaaggtgggcctgggctttgagctggaggcctag

SEQ ID NO: 175932 - DNA, 480 bp, Artificial Sequence
  Description of Artificial Sequence: Synthetic coding sequence
atgtgcaacacccccacctactgtgacctgggcaaggccgccaaggatgtgttcaacaagggctacggcttcggcatggtgaagattgacctgaagaccaagagctgcagcggcgtggagttcagcaccagcggccacgcctacacagacaccgggaaggccagcggcaacctggagaccaagtacaaggtgtgcaactacggcctgaccttcacccagaagtggaacacagacaacaccctgggcacagagatctcctgggagaacaagctggccgagggcctgaagctgaccctggacaccatctttgtgcccaacacaggcaagaagagcggcaagctgaaggccagctacaagagggactgcttctctgtgggcagcaatgtggacatcgacttcagcggccccaccatctacggctgggccgtgctggcctttgagggctggctggccggctaccagatgagctttgacacctag

SEQ ID NO: 175933 - DNA, 1062 bp, Artificial Sequence
  Description of Artificial Sequence: Synthetic coding sequence
atggtgggggacaccctgaagctgctgagccccctgatgacccgctacttcttcctgctcttctacagcacagacagcagtgacctgaatgaaaaccagcaccccctggactttgatgagatggccttcggcaaggtgaagagcggcatctccttcctgatccagacaggagtgggcatcctgggcaacagcttcctgctgtgcttctacaacctgatcctcttcaccggccacaagctgcggcccacagacctgatcctgagccagctggccctggccaacagcatggtgctcttcttcaagggcatcccccagaccatggccgccttcggcctgaagtacctgctgaatgacaccggctgcaagtttgtgttctactaccaccgggtgggcaccagggtgtccctgagcaccatctgcctgctgaatggcttccaggccatcaagctgaaccccagcatctgccgctggatggagatcaagatccgcagcccccgcttcatcgacttctgctgcctgctgtgctgggcccctcatgtgctgatgaatgcctctgtgctgctgctggtgaatggccccctgaacagcaagaacagcagcgccaagaacaactacggctactgcagctacaaggccagcaagcgcttcagcagcctgcatgctgtgctgtacttctccccagacttcatgagcctgggcttcatggtgtgggccagcggctccatggtgttcttcctgtaccgccacaagcagcaggtgcagcacaaccacagcaaccggctgagctgccggcccagccaggaggcccgggccacccacaccatcatggtgctggtgtcctccttctttgtgttctacagcgtgcacagcttcctgaccatctggaccaccgtggtggccaaccctggccagtggatcgtgaccaacagcgtgctggtggccagctgcttccctgcccggagcccctttgtgctgatcatgtctgacacccacatcagccagttctgctttgcctgcaggaccaggaagaccctcttccccaacctggtggtgatgccctag

SEQ ID NO: 175934 - DNA, 594 bp, Artificial Sequence
  Description of Artificial Sequence: Synthetic coding sequence
atggctgctgtgaaggacagctgtgggaagggggagatggccactggaaatggaagaaggctgcacctgggcatccctgaggccgtgtttgtggaggatgtggacagcttcatgaagcagcctggaaatgaaacagctgacacagtgctgaagaagctggatgagcagtaccagaagtacaagttcatggagctgaacctggcccagaagaagaggcggctgaagggccagatccctgagatcaagcagaccctggagatcctgaagtacatgcagaagaagaaggagagcaccaacagcatggagacccgcttcctgctggccgacaacctgtactgcaaggcctctgtgcccccaacagacaagatgtgcctgtggctgggcgccaacgtgatgctggagtatgacattgatgaggcccaggccctgctggagaagaacctgagcacagccaccaagaacctggacagcctggaggaggacctggacttcctgcgggaccagttcaccaccacagaggtgaacatggcccgggtgtacaactgggatgtgaagagaagaaacaaggatgacagcaccaagaacaaggcctag

SEQ ID NO: 175935 - DNA, 579 bp, Artificial Sequence
  Description of Artificial Sequence: Synthetic coding sequence
atggccccccagcccatgatccacacccagcagggcctgcggaccagcagccccagcacccccagccctgagcaccaggaggatgtggacagcttcatgaagcagcctggaaatgaaacagctgacacagtgctgaagaagctggatgagcagtaccagaagtacaagttcatggagctgaacctggcccagaagaagaggcggctgaagggccagatccctgagatcaagcagaccctggagatcctgaagtacatgcagaagaagaaggagagcaccaacagcatggagacccgcttcctgctggccgacaacctgtactgcaaggcctctgtgcccccaacagacaagatgtgcctgtggctgggcgccaacgtgatgctggagtatgacattgatgaggcccaggccctgctggagaagaacctgagcacagccaccaagaacctggacagcctggaggaggacctggacttcctgcgggaccagttcaccaccacagaggtgaacatggcccgggtgtacaactgggatgtgaagagaagaaacaaggatgacagcaccaagaacaaggcctag

SEQ ID NO: 175936 - DNA, 702 bp, Artificial Sequence
  Description of Artificial Sequence: Synthetic coding sequence
atgaggccccagcagctgcacgccacagagatcaccagcagcggcttccggctggcctggccacccctgctgacagctgacagcggctactacgtgctggagctggtgcccagcgcccagcctggagctgcccggcggcagcagctgcctggaaatgccacagactggatctgggccggcctggaccctgacacagattatgatgtggccctggtgcctgagagcaatgtgcggctgctgcggccccagatcctgcgggtgaggaccaggcctggagaggccggccctggggccagcggccctgagagcggggccggccctgcccccacccagctggccgccctgcctgcccctgaggaggccggccctgagcgcatcgtcatcagccacgcccggcccaggagcctgcgggtgtcctgggccccagccctgggcagcgctgctgccctgggctaccacgtgcagtttggccccctgcggggcggggaggcccagagggtggaggtgcctgctggaagaaactgcaccaccctgcagggcctggcccctggaacagcctacctggtgacagtgacagctgccttccgcagcggccgggagagcgccctgagcgccaaggcctgcaccccagatggcccccggccccggcccaggcctgtgccccgggcccccaccccaggcacagccagccgggagccctag

SEQ ID NO: 175937 - DNA, 1338 bp, Artificial Sequence
  Description of Artificial Sequence: Synthetic coding sequence
atgctgccctggacagccctgggcctggccctgagcctgcggctggccctggcccggagcggggctgagcggggccccccagccagcgcccccaggggggacctgatgttcctgctggacagcagcgcctctgtgagccactatgagttcagccgggtgcgggagtttgtgggccagctggtggcccccctgcccctgggcaccggggccctgcgggccagcctggtgcacgtgggcagccggccctacacagagttccccttcggccagcacagcagtggagaggccgcccaggatgctgtgcgggccagcgcccagaggatgggagacacccacacaggcctggccctggtgtatgccaaggagcagctgtttgctgaggccagcggggcccggcctggggtgcccaaggtgctggtgtgggtgacagatggcggcagcagtgaccctgtgggcccccccatgcaggagctgaaggacctgggcgtgaccgtcttcatcgtgtccacaggccggggcaacttcctggagctgtctgctgctgccagcgccccagctgagaagcacctgcactttgtggatgtggatgacctgcacatcatcgtgcaggagctgcggggcagcatcctggatgccatgaggccccagcagctgcacgccacagagatcaccagcagcggcttccggctggcctggccacccctgctgacagctgacagcggctactacgtgctggagctggtgcccagcgcccagcctggagctgcccggcggcagcagctgcctggaaatgccacagactggatctgggccggcctggaccctgacacagattatgatgtggccctggtgcctgagagcaatgtgcggctgctgcggccccagatcctgcgggtgaggaccaggcctggagaggccggccctggggccagcggccctgagagcggggccggccctgcccccacccagctggccgccctgcctgcccctgaggaggccggccctgagcgcatcgtcatcagccacgcccggcccaggagcctgcgggtgtcctgggccccagccctgggcagcgctgctgccctgggctaccacgtgcagtttggccccctgcggggcggggaggcccagagggtggaggtgcctgctggaagaaactgcaccaccctgcagggcctggcccctggaacagcctacctggtgacagtgacagctgccttccgcagcggccgggagagcgccctgagcgccaaggcctgcaccccagatggcccccggccccggcccaggcctgtgccccgggcccccaccccaggcacagccagccgggagccctag

SEQ ID NO: 175938 - DNA, 195 bp, Artificial Sequence
  Description of Artificial Sequence: Synthetic coding sequence
atgctgccctggacagccctgggcctggccctgagcctgcggctggccctggcccggagcggggctgagcggggggcccagggccctggccgccaccgggtgcactgccagcaccggccccggcagctgcccggggctgtgagccgctgcctgagcccctgccgggaggccccagccctgtgtggccggggctag

SEQ ID NO: 175939 - DNA, 978 bp, Artificial Sequence
  Description of Artificial Sequence: Synthetic coding sequence
atgcccagcagcacagccatggctgtgggcgccctgagcagcagcctgctggtgacctgctgcctgatggtggccctgtgcagccccagcatccccctggagaagctggcccaggcccctgagcagcccggccaggagaagcgggagcacgccagcagagatggccctggccgggtgaatgagctgggccgcccagccagagatgagggcggcagcggccgggactggaagagcaagagcggccggggcctggccggccgggagccctggagcaagctgaagcaggcctgggtgtcccagggcggcggggccaaggccggggacctgcaggtgcggcccaggggggacaccccccaggccgaggccctggccgccgccgcccaggatgccatcggccctgagctggcccccaccccagagcccccagaggagtatgtgtacccagactaccggggcaagggctgtgtggatgaaagtggctttgtgtatgccatcggggagaagtttgcccctggccccagcgcctgcccctgcctgtgcacagaggagggccccctgtgtgcccagccagaatgtccccggctgcacccccgctgcatccacgtggacaccagccagtgctgcccccagtgcaaggagaggaagaactactgtgagttccggggcaagacctaccagaccctggaggagtttgtggtgagcccctgtgagcgctgccgctgtgaggccaacggggaggtgctgtgcaccgtgtctgcctgcccccagacagaatgtgtggaccctgtgtatgagccagaccagtgctgccccatctgcaagaatggccccaactgctttgctgagacagctgtgatcccagctggccgggaggtgaagacagatgagtgcaccatctgccactgcacctatgaggagggcacctggagaattgagcggcaggccatgtgcaccaggcatgaatgtcggcagatgtag

SEQ ID NO: 175940 - DNA, 750 bp, Artificial Sequence
  Description of Artificial Sequence: Synthetic coding sequence
atgaccagcgagaccctgtggtggctgatcaccctgaagaagcagctgggggacaatgaggccatcacccaggagatcgtgggctgtgcccacctggagaactatgccctgaagatgttcctgtatgctgacaatgaagatagagctggccgcttccacaagaacatgatcaagagcttctacacagccagcctgctgattgatgtgatcaccgtgtttggagagctgacagatgaaaatgtgaagcacaggaaatatgcccgctggaaggccacctacatccacaactgcctgaagaatggagagaccccccaggccggccctgtgggcattgaagaagataatgacattgaagaaaatgaagatgctggagctgccagcctgcccacccagcccacccagcccagcagcagcagcacctatgaccccagcaacatgcccagcggcaactacacaggcatccagatccccccaggggcccacgccccagccaacaccccagctgaggtgccccacagcactggagtggccagcaacaccatccagcccaccccccagaccatcccagccattgatcctgccctcttcaacaccatcagccagggagatgtgcggctgaccccagaagattttgcccgggcccagaagtactgcaagtatgccggcagcgccctgcagtatgaagatgtgtccacagctgtgcagaacctgcagaaggccctgaagctgctgaccaccggccgggagtag

SEQ ID NO: 175941 - DNA, 924 bp, Artificial Sequence
  Description of Artificial Sequence: Synthetic coding sequence
atggccgccctggcccccctgccccccctgcctgcccagttcaagagcatccagcaccacctgaggacagcccaggagcatgacaagagggaccctgtggtggcctactactgccgcctgtatgccatgcagacaggcatgaagattgacagcaagaccccagaatgtaggaagttcctgagcaagctgatggaccagctggaggccctgaagaagcagctgggggacaatgaggccatcacccaggagatcgtgggctgtgcccacctggagaactatgccctgaagatgttcctgtatgctgacaatgaagatagagctggccgcttccacaagaacatgatcaagagcttctacacagccagcctgctgattgatgtgatcaccgtgtttggagagctgacagatgaaaatgtgaagcacaggaaatatgcccgctggaaggccacctacatccacaactgcctgaagaatggagagaccccccaggccggccctgtgggcattgaagaagataatgacattgaagaaaatgaagatgctggagctgccagcctgcccacccagcccacccagcccagcagcagcagcacctatgaccccagcaacatgcccagcggcaactacacaggcatccagatccccccaggggcccacgccccagccaacaccccagctgaggtgccccacagcactggagtggccagcaacaccatccagcccaccccccagaccatcccagccattgatcctgccctcttcaacaccatcagccagggagatgtgcggctgaccccagaagattttgcccgggcccagaagtactgcaagtatgccggcagcgccctgcagtatgaagatgtgtccacagctgtgcagaacctgcagaaggccctgaagctgctgaccaccggccgggagtag

SEQ ID NO: 175942 - DNA, 663 bp, Artificial Sequence
  Description of Artificial Sequence: Synthetic coding sequence
gagatggccgccctggcccccctgccccccctgcctgcccagttcaagagcatccagcaccacctgaggacagcccaggagcatgacaagagggaccctgtggtggcctactactgccgcctgtatgccatgcagacaggcatgaagattgacagcaagaccccagagtgcaggaagttcctgagcaagctgatggaccagctggaggccctgaagaagcagctgggggacaatgaggccatcacccaggagatcgtgggctgtgcccacctggagaactatgccctgaagatgttcctgtatgctgacaatgaagatcgggccggccgcttccacaagaacatgatcaagagcttctacacagccagcctgctgattgatgtgatcaccgtgtttggagagctgacagatgaaaatgtgaagcacaggaaatatgcccgctggaaggccacctacatccacaactgcaaggagtggggagacagcagcagccggccctgctggctgaagaagatcatgatcctgaagaagatgaagatgctggagcagcccctgtgccccctgagccagctgagccaccaccacctgcagctgatgacccagcacgccatccggcagctgtactggaacacagacagcagcggctgcaccaggagcagctag

SEQ ID NO: 175943 - DNA, 669 bp, Artificial Sequence
  Description of Artificial Sequence: Synthetic coding sequence
atgaccagcgagaccctgtggtggctgatcaccctgaagaagcagctgggggacaatgaggccatcacccaggagatcgtgggctgtgcccacctggagaactatgccctgaagatgttcctgtatgctgacaatgaagatagagctggccgcttccacaagaacatgatcaagagcttctacacagccagcctgctgattgatgtgatcaccgtgtttggagagctgacagatgaaaatgtgaagcacaggaaatatgcccgctggaaggccacctacatccacaactgcctgaagaatggagagaccccccaggccggccctgtgggcattgaagaagataatgacattgaagaaaatgaagatgctggagctgccagcctgcccacccagcccacccagcccagcagcagcagcacctatgaccccagcaacatgcccagcggcaactacacaggcatccagatccccccaggggcccacgccccagccaacaccccagctgaggtgccccacagcactggagatgtgcggctgaccccagaggactttgcccgggcccagaagtactgcaagtatgccggcagcgccctgcagtatgaagatgtgtccacagctgtgcagaacctgcagaaggccctgaagctgctgaccaccggccgggagtag

SEQ ID NO: 175944 - DNA, 621 bp, Artificial Sequence
  Description of Artificial Sequence: Synthetic coding sequence
atggccgccaacaagcccaagggccagaacagcctggccctgcacaaggtgatcatggtgggcagcggcggcgtgggcaagagcgccctgaccctgcagttcatgtatgatgaatttgtggaggactatgagcccaccaaggctgacagctacaggaagaaggtggtgctggatggagaggaggtgcagattgacatcctggacacagctggccaggaggactatgctgccatccgggacaactacttccgctctggagagggcttcctgtgtgtgttcagcatcacagagatggagagctttgctgccacagctgacttccgggagcagatcctgcgggtgaaggaggatgaaaatgtgcccttcctgctggtgggcaacaagagtgacctggaggacaagaggcaggtgtctgtggaggaggccaagaacagagctgagcagtggaatgtgaactacgtggagaccagcgccaagacccgggccaacgtggacaaggtgttctttgacctgatgagggagatccgggccaggaagatggaggacagcaaggagaagaatggcaagaagaagaggaagagcctggccaagaggatccgggagcgctgctgcatcctgtag

SEQ ID NO: 175945 - DNA, 306 bp, Artificial Sequence
  Description of Artificial Sequence: Synthetic coding sequence
atggccgccaacaagcccaagggccagaacagcctggccctgcacaaggtgatcatggtgggcagcggcggcgtgggcaagagcgccctgaccctgcagttcatgtatgatgaatttgtggaggactatgagcccaccaaggctgacagctacaggaagaaggtggtgctggatggagaggaggtgcagattgacatcctggacacagctggccaggaggactatgctgccatccgggacaactacttccgctctggagagggcttcctgtgtgtgttcagcatcacagagatggagagcttctag

SEQ ID NO: 175946 - DNA, 621 bp, Artificial Sequence
  Description of Artificial Sequence: Synthetic coding sequence
atggccgccaacaagagcaagggccagagcagcctggccctgcacaaggtgatcatggtgggcagcggcggcgtgggcaagagcgccctgaccctgcagttcatgtatgatgaatttgtggaggactatgagcccaccaaggctgacagctacaggaagaaggtggtgctggatggagaggaggtgcagattgacatcctggacacagctggccaggaggactatgctgccatccgggacaactacttccgctctggagagggcttcctgctggtgttcagcatcacagagcacgagagcttcaccgccacagctgagttccgggagcagatcctgcgggtgaaggccgaggaggacaagatccccctgctggtggtgggcaacaagagtgacctggaggagcggcggcaggtgcctgtggaggaggcccggagcaaggccgaggagtggggcgtgcagtatgtggagaccagcgccaagacccgggccaacgtggacaaggtgttctttgacctgatgagggagatccgcaccaagaagatgtctgagaacaaggacaagaatggcaagaagagcagcaagaacaagaagagcttcaaggagcgctgctgcctgctgtag

SEQ ID NO: 175947 - DNA, 684 bp, Artificial Sequence
  Description of Artificial Sequence: Synthetic coding sequence
atggccgccaacaagagcaagggccagagcagcctggccctgcacaaggtgatcatggtgggcagcggcggcgtgggcaagagcgccctgaccctgcagttcatgaatgtgtccaagagcctggcctatgacaagaagaagtacacagccaacaagaaggtggagggcatcctggagtttgtggaggactatgagcccaccaaggctgacagctacaggaagaaggtggtgctggatggagaggaggtgcagattgacatcctggacacagctggccaggaggactatgctgccatccgggacaactacttccgcagcggggagggcttcctgctggtgttcagcatcacagaacatgagagcttcaccgccacagctgagttccgggagcagatcctgcgggtgaaggccgaggaggacaagatccccctgctggtggtgggcaacaagagtgacctggaggagcggcggcaggtgcctgtggaggaggcccggagcaaggccgaggagtggggcgtgcagtatgtggagaccagcgccaagacccgggccaacgtggacaaggtgttctttgacctgatgagggagatccgcaccaagaagatgtctgagaacaaggacaagaatggcaagaagagcagcaagaacaagaagagcttcaaggagcgctgctgcctgctgtag

SEQ ID NO: 175948 - DNA, 504 bp, Artificial Sequence
  Description of Artificial Sequence: Synthetic coding sequence
atggccgccaacaagagcaagggccagagcagcctggccctgcacaaggtgatcatggtgggcagcggcggcgtgggcaagagcgccctgaccctgcagttcatgtatgatgaatttgtggaggactatgagcccaccaaggctgacagctacaggaagaaggtggtgctggatggagaggaggtgcagattgacatcctggacacagctggccaggaggactatgctgccatccgggacaactacttccgctctggagagggcttcctgctggtgttcagcatcacagagcacgagagcttcaccgccacagctgagttccgggagcagatcctgcgggtgaaggccgaggaggacaagatccccctgctggtggtgggcaacaagagtgacctggaggagcggcggcaggtgcctgtggaggaggcccggagcaaggccgaggagtggggcgtgcagtatgtggagaccagcgccaagacccgggccaacgtggacaagtag

SEQ ID NO: 175949 - DNA, 621 bp, Artificial Sequence; identical to SEQ ID NO: 175946
  Description of Artificial Sequence: Synthetic coding sequence

SEQ ID NO: 175950 - DNA, 687 bp, Artificial Sequence
  Description of Artificial Sequence: Synthetic coding sequence
atgaagcagaggcagagcgccctgcagtgggtgatctgtgtgtcccagccccagaagaccagcgagatggccgccaacaagagcaagggccagagcagcctggccctgcacaaggtgatcatggtgggcagcggcggcgtgggcaagagcgccctgaccctgcagttcatgtatgatgaatttgtggaggactatgagcccaccaaggctgacagctacaggaagaaggtggtgctggatggagaggaggtgcagattgacatcctggacacagctggccaggaggactatgctgccatccgggacaactacttccgctctggagagggcttcctgctggtgttcagcatcacagagcacgagagcttcaccgccacagctgagttccgggagcagatcctgcgggtgaaggccgaggaggacaagatccccctgctggtggtgggcaacaagagtgacctggaggagcggcggcaggtgcctgtggaggaggcccggagcaaggccgaggagtggggcgtgcagtatgtggagaccagcgccaagacccgggccaacgtggacaaggtgttctttgacctgatgagggagatccgcaccaagaagatgtctgagaacaaggacaagaatggcaagaagagcagcaagaacaagaagagcttcaaggagcgctgctgcctgctgtag

SEQ ID NO: 175951 - DNA, 1860 bp, Artificial Sequence
  Description of Artificial Sequence: Synthetic coding sequence
atggccagcggggcctacaacccctacatcgagatcatcgagcagccccggcagaggggcatgaggttccgctacaagtgtgagggccgctctgctggcagcatccctggagagcacagcacagacaacaacagaacctaccccagcatccagatcatgaactactacggcaagggcaaggtgcgcatcaccctggtgaccaagaatgacccctacaagccccacccccatgacctggtgggcaaggactgcagagatggctactatgaagctgagtttggccaggagcggcggcccctcttcttccagaacctgggcatccgctgtgtgaagaagaaggaggtgaaggaggccatcatcacccgcatcaaggccggcatcaaccccttcaacgtgcctgagaagcagctgaatgacatcgaggactgtgacctgaatgtggtgcggctgtgcttccaggtgttcctgcctgatgagcacggcaacctgaccacagccctgccccctgtggtgagcaaccccatctatgacaacagagcccccaacacagctgagctgcgcatctgccgggtgaacaagaactgtggctctgtgagaggaggagatgagatcttcctgctgtgtgacaaggtgcagaaggatgacatcgaggtgcgctttgtgctgaatgactgggaggccaagggcatcttcagccaggctgatgtgcaccggcaggtggccatcgtgttcaagaccccaccctactgcaaggccatcacagagcctgtgacagtgaagatgcagctgcggcggcccagcgaccaggaggtgtctgagagcatggacttccgctacctgcctgatgagaaggacacctacggcaacaaggccaagaagcagaagaccaccctgctcttccagaagctgtgccaggaccacgtggagaccggcttccgccacgtggaccaggacggcctggagctgctgaccagcggggacccccccaccctggccagccagagcgctggcatcaccgtgaacttccctgagcggccccggcccggcctgctgggcagcatcggggagggccgctacttcaagaaggagcccaacctcttcagccatgatgctgtggtgcgggagatgcccaccggggtgagcagccaggccgagagctactaccccagccctggccccatcagcagcggcctgagccaccacgcctccatggcccccctgcccagcagctcctggagctctgtggcccaccccacccccaggagcggcaacaccaaccccctgagcagcttcagcaccaggaccctgcccagcaacagccagggcatcccccccttcctgcgcatccctgtgggcaatgacctgaatgccagcaatgcctgcatctacaacaatgctgatgacatcgtgggcatggaggccagctccatgcccagcgctgacctgtatggcatcagtgaccccaacatgctgagcaactgcagcgtgaacatgatgaccaccagcagtgacagcatgggagaaacagacaacccccggctgctgtccatgaacctggagaaccccagctgcaacagcgtgctggacccccgggacctgcggcagctgcaccagatgagcagcagctccatgtctgctggggccaacagcaacaccaccgtgtttgtgtcccagagtgatgcctttgagggcagtgacttcagctgtgccgacaacagcatgatcaatgaaagtggccccagcaacagcaccaaccccaacagccacggctttgtgcaggacagccagtacagcggcatcggctccatgcagaatgagcagctgagtgacagcttcccctatgagttcttccaggtgtag

SEQ ID NO: 175952 - DNA, 1764 bp, Artificial Sequence
  Description of Artificial Sequence: Synthetic coding sequence
atggccagcggggcctacaacccctacatcgagatcatcgagcagccccggcagaggggcatgaggttccgctacaagtgtgagggccgctctgctggcagcatccctggagagcacagcacagacaacaacagaacctaccccagcatccagatcatgaactactacggcaagggcaaggtgcgcatcaccctggtgaccaagaatgacccctacaagccccacccccatgacctggtgggcaaggactgcagagatggctactatgaagctgagtttggccaggagcggcggcccctcttcttccagaacctgggcatccgctgtgtgaagaagaaggaggtgaaggaggccatcatcacccgcatcaaggccggcatcaaccccttcaacgtgcctgagaagcagctgaatgacatcgaggactgtgacctgaatgtggtgcggctgtgcttccaggtgttcctgcctgatgagcacggcaacctgaccacagccctgccccctgtggtgagcaaccccatctatgacaacagagcccccaacacagctgagctgcgcatctgccgggtgaacaagaactgtggctctgtgagaggaggagatgagatcttcctgctgtgtgacaaggtgcagaaggatgacatcgaggtgcgctttgtgctgaatgactgggaggccaagggcatcttcagccaggctgatgtgcaccggcaggtggccatcgtgttcaagaccccaccctactgcaaggccatcacagagcctgtgacagtgaagatgcagctgcggcggcccagcgaccaggaggtgtctgagagcatggacttccgctacctgcctgatgagaaggacacctacggcaacaaggccaagaagcagaagaccaccctgctcttccagaagctgtgccaggaccacgtgaacttccctgagcggccccggcccggcctgctgggcagcatcggggagggccgctacttcaagaaggagcccaacctcttcagccatgatgctgtggtgcgggagatgcccaccggggtgagcagccaggccgagagctactaccccagccctggccccatcagcagcggcctgagccaccacgcctccatggcccccctgcccagcagctcctggagctctgtggcccaccccacccccaggagcggcaacaccaaccccctgagcagcttcagcaccaggaccctgcccagcaacagccagggcatcccccccttcctgcgcatccctgtgggcaatgacctgaatgccagcaatgcctgcatctacaacaatgctgatgacatcgtgggcatggaggccagctccatgcccagcgctgacctgtatggcatcagtgaccccaacatgctgagcaactgcagcgtgaacatgatgaccaccagcagtgacagcatgggagaaacagacaacccccggctgctgtccatgaacctggagaaccccagctgcaacagcgtgctggacccccgggacctgcggcagctgcaccagatgagcagcagctccatgtctgctggggccaacagcaacaccaccgtgtttgtgtcccagagtgatgcctttgagggcagtgacttcagctgtgccgacaacagcatgatcaatgaaagtggccccagcaacagcaccaaccccaacagccacggctttgtgcaggacagccagtacagcggcatcggctccatgcagaatgagcagctgagtgacagcttcccctatgagttcttccaggtgtag

SEQ ID NO: 175953 - DNA, 1647 bp, Artificial Sequence
  Description of Artificial Sequence: Synthetic coding sequence
atggatgagctgttccccctcatcttccctgctgagcccgcccaggccagcggcccctacgtggagatcatcgagcagcccaagcagaggggcatgaggttccgctacaagtgtgagggccgctctgctggcagcatccctggagagaggagcacagacaccaccaagacccaccccaccatcaagatcaatggctacacaggccctggcaccgtgcgcatcagcctggtgaccaaggaccccccccaccggccccacccccatgagctggtgggcaaggactgcagagatggcttctatgaggccgagctgtgcccagaccgctgcatccacagcttccagaacctgggcatccagtgtgtgaagaagagggacctggagcaggccatcagccagaggatccagaccaacaacaaccccttccaggaggagcagagaggagactatgacctgaatgctgtgcggctgtgcttccaggtgacagtgcgggaccccagcggccggcccctgcggctgccccctgtgctgagccaccccatctttgacaacagagcccccaacacagctgagctgaagatctgccgggtgaacagaaacagcggcagctgcctgggcggagatgagatcttcctgctgtgtgacaaggtgcagaaggaggacatcgaggtgtacttcaccggccctggctgggaggcccggggcagcttcagccaggctgatgtgcaccggcaggtggccatcgtgttccgcaccccaccctatgctgaccccagcctgcaggcccctgtgcgggtgtccatgcagctgcggcggcccagcgaccgggagctgtctgagcccatggagttccagtacctgcctgacacagatgacagacacagaattgaggagaagaggaagaggacctatgagaccttcaagagcatcatgaagaagagccccttcagcggccccacagacccccggcccccacccaggagaattgctgtgcccagccgcagcagcgcctctgtgcccaagccagccccccagccctaccccttcaccagcagcctgagcaccatcaactatgatgagttccccaccatggtgttccccagcggccagatcagccaggccagcgccctggccccagccccaccccaggtgctgccccaggccccagccccagccccagccccagccatggtgtctgccctggcccaggccccagcccctgtgcctgtgctggcccctggccccccccaggccgtggcccccccagcccccaagcccacccaggccggggagggcaccctgtctgaggccctgctgcagctgcagtttgatgatgaggacctgggcgccctgctgggcaacagcacagatcctgctgtgttcacagacctggcctctgtggacaacagcgagttccagcagctgctgaaccagggcatccctgtggccccccacaccacagagcccatgctgatggagtacccagaggccatcacccggctggtgactggagcccagaggcccccagaccctgccccagcccccctgggcgcccctggcctgcccaacggcctgctgtctggagatgaggacttcagcagcattgctgacatggacttcagcgccctgctgagccagatcagcagctag

SEQ ID NO: 175954 - DNA, 1656 bp, Artificial Sequence
  Description of Artificial Sequence: Synthetic coding sequence
atggatgagctgttccccctcatcttccctgctgagcccgcccaggccagcggcccctacgtggagatcatcgagcagcccaagcagaggggcatgaggttccgctacaagtgtgagggccgctctgctggcagcatccctggagagaggagcacagacaccaccaagacccaccccaccatcaagatcaatggctacacaggccctggcaccgtgcgcatcagcctggtgaccaaggaccccccccaccggccccacccccatgagctggtgggcaaggactgcagagatggcttctatgaggccgagctgtgcccagaccgctgcatccacagcttccagaacctgggcatccagtgtgtgaagaagagggacctggagcaggccatcagccagaggatccagaccaacaacaaccccttccaggtgcccatcgaggagcagagaggagactatgacctgaatgctgtgcggctgtgcttccaggtgacagtgcgggaccccagcggccggcccctgcggctgccccctgtgctgagccaccccatctttgacaacagagcccccaacacagctgagctgaagatctgccgggtgaacagaaattctggcagctgcctgggcggagatgagatcttcctgctgtgtgacaaggtgcagaaggaggacatcgaggtgtacttcaccggccctggctgggaggcccggggcagcttcagccaggctgatgtgcaccggcaggtggccatcgtgttccgcaccccaccctatgctgaccccagcctgcaggcccctgtgcgggtgtccatgcagctgcggcggcccagcgaccgggagctgtctgagcccatggagttccagtacctgcctgacacagatgacagacaccgcatcgaggagaagaggaagaggacctatgagaccttcaagagcatcatgaagaagagccccttcagcggccccacagacccccggcccccaccaagaagaattgctgtgcccagccgcagcagcgcctctgtgcccaagccagccccccagccctaccccttcaccagcagcctgagcaccatcaactatgatgagttccccaccatggtgttccccagcggccagatcagccaggccagcgccctggccccagccccaccccaggtgctgccccaggccccagccccagccccagccccagccatggtgtctgccctggcccaggccccagcccctgtgcctgtgctggcccctggccccccccaggccgtggcccccccagcccccaagcccacccaggccggggagggcaccctgtctgaggccctgctgcagctgcagtttgatgatgaggacctgggcgccctgctgggcaacagcacagatcctgctgtgttcacagacctggcctctgtggacaacagcgagttccagcagctgctgaaccagggcatccctgtggccccccacaccacagagcccatgctgatggagtacccagaggccatcacccggctggtgactggagcccagaggcccccagaccctgccccagcccccctgggcgcccctggcctgcccaacggcctgctgtctggagatgaggacttcagcagcattgctgacatggacttcagcgccctgctgagccagatcagcagctag

SEQ ID NO: 175955 - DNA, 741 bp, Artificial Sequence
  Description of Artificial Sequence: Synthetic coding sequence
atggatgagctgttccccctcatcttccctgctgagcccgcccaggccagcggcccctacgtggagatcatcgagcagcccaagcagaggggcatgaggttccgctacaagtgtgagggccgctctgctggcagcatccctggagagaggagcacagacaccaccaagacccaccccaccatcaagatcaatggctacacaggccctggcaccgtgcgcatcagcctggtgaccaaggaccccccccaccggccccacccccatgagctggtgggcaaggactgcagagatggcttctatgaggccgagctgtgcccagaccgctgcatccacagcttccagaacctgggcatccagtgtgtgaagaagagggacctggagcaggccatcagccagaggatccagaccaacaacaaccccttccaggtgcccatcgaggagcagagaggagactatgacctgaatgctgtgcggctgtgcttccaggtgacagtgcgggaccccagcggccggcccctgcggctgccccctgtgctgagccaccccatctttgacaacagagcccccaacacagctgagctgaagatctgccgggtgaacagaaattctggcagctgcctgggcggagatgagatcttcctgctgtgtgacaaggtgcagaaggaggacatcgaggtgtgcccccaggccagcaccccagccctgagcctgtatgtgattcctgagcaccaccagctgtag

SEQ ID NO: 175956 - DNA, 1134 bp, Artificial Sequence
  Description of Artificial Sequence: Synthetic coding sequence
atggatgagctgttccccctcatcttccctgctgagcccgcccaggccagcggcccctacgtggagatcatcgagcagcccaagcagaggggcatgaggttccgctacaagtgtgagggccgctctgctggcagcatccctggagagaggagcacagacaccaccaagacccaccccaccatcaagatcaatggctacacaggccctggcaccgtgcgcatcagcctggtgaccaaggaccccccccaccggccccacccccatgagctggtgggcaaggactgcagagatggcttctatgaggccgagctgtgcccagaccgctgcatccacagcttccagaacctgggcatccagtgtgtgaagaagagggacctggagcaggccatcagccagaggatccagaccaacaacaaccccttccaggtgcccatcgaggagcagagaggagactatgacctgaatgctgtgcggctgtgcttccaggtgacagtgcgggaccccagcggccggcccctgcggctgccccctgtgctgagccaccccatctttgacaacagagcccccaacacagctgagctgaagatctgccgggtgaacagaaattctggcagctgcctgggcggagatgagatcttcctgctgtgtgacaaggtgcagaaggaggacatcgaggtgtacttcaccggccctggctgggaggcccggggcagcttcagccaggctgatgtgcaccggcaggtggccatcgtgttccgcaccccaccctatgctgaccccagcctgcaggcccctgtgcgggtgtccatgcagctgcggcggcccagcgaccgggagctgtctgagcccatggagttccagtacctgcctgacacagatgacagacaccgcatcgaggagaagaggaagaggacctatgagaccttcaagagcatcatgaagaagagccccttcagcggccccacagacccccggcccccaccaagaagaattgctgtgcccagccgcagcagcgcctctgtgcccaagccaggcaaggacttcctgctgagccactggaatgaccgcttcagctctgtgcagctgcggagcagtggagatgaggacagctgggcccccctgcagacctactag

SEQ ID NO: 175957 - DNA, 714 bp, Artificial Sequence
  Description of Artificial Sequence: Synthetic coding sequence
atggatgagctgttccccctcatcttccctgctgagcccgcccaggccagcggcccctacgtggagatcatcgagcagcccaagcagaggggcatgaggttccgctacaagtgtgagggccgctctgctggcagcatccctggagagaggagcacagacaccaccaagacccaccccaccatcaagatcaatggctacacaggccctggcaccgtgcgcatcagcctggtgaccaaggaccccccccaccggccccacccccatgagctggtgggcaaggactgcagagatggcttctatgaggccgagctgtgcccagaccgctgcatccacagcttccagaacctgggcatccagtgtgtgaagaagagggacctggagcaggccatcagccagaggatccagaccaacaacaaccccttccaggtgcccatcgaggagcagagaggagactatgacctgaatgctgtgcggctgtgcttccaggtgacagtgcgggaccccagcggccggcccctgcggctgccccctgtgctgagccaccccatctttgacaacagagcccccaacacagctgagctgaagatctgccgggtgaacagaaattctggcagctgcctgggcggagatgagatcttcctgctgtgtgacaaggtgcagaaggcccacggcatccctgtgcctgcccgctaccgccgcagcagcccagactag

SEQ ID NO: 175958 - DNA, 1278 bp, Artificial Sequence
  Description of Artificial Sequence: Synthetic coding sequence
atggatgagctgttccccctcatcttccctgctgagcccgcccaggccagcggcccctacgtggagatcatcgagcagcccaagcagaggggcatgaggttccgctacaagtgtgagggccgctctgctggcagcatccctggagagaggagcacagacaccaccaagacccaccccaccatcaaggtgtggatgagcggccccctgtacttcggccagatcaatggctacacaggccctggcaccgtgcgcatcagcctggtgaccaaggaccccccccaccggccccacccccatgagctggtgggcaaggactgcagagatggcttctatgaagctgagctgtgcccagaccgctgcatccacagcttccagaacctgggcatccagtgtgtgaagaagagggacctggagcaggccatcagccagaggatccagaccaacaacaaccccttccaggtgcccatcgaggagcagagaggagactatgacctgaatgctgtgcggctgtgcttccaggtgacagtgcgggaccccagcggccggcccctgcggctgccccctgtgctgagccaccccatctttgacaacagagcccccaacacagctgagctgaagatctgccgggtgaacagaaacagcggcagctgcctgggcggagatgagatcttcctgctgtgtgacaaggtgcagaaggaggacatcgaggtgtacttcaccggccctggctgggaggcccggggcagcttcagccaggctgatgtgcaccggcaggtggccatcgtgttccgcaccccaccctatgctgaccccagcctgcaggcccctgtgcgggtgtccatgcagctgcggcggcccagcgaccgggagctgtctgagcccatggagttccagtacctgcctgacacagatgacagacacagaattgaggagaagaggaagaggacctatgagaccttcaagagcatcatgaagaagagccccttcagcggccccacagacccccggcccccacccaggagaattgctgtgcccagccgcagcagcgcctctgtgcccaagccagccccccagccctaccccttcaccagcagcctgagcaccatcaactatgatgagttccccaccatggtgttccccagcggccagatcagccaggccagcgccctggccccagccccaccccaggtgctgccccaggccccagccccagccccagccccagccatggtgtctgccctggcccaggcccctgagcactgggtggccggggactag

SEQ ID NO: 175959 - DNA, 1314 bp, Artificial Sequence
  Description of Artificial Sequence: Synthetic coding sequence
atgacccagttcctgccccccaacctgctggccctgtttgccccccgggaccccatcccctacctgccccccctggagaagctgccccatgagaagcaccacaaccagccctactgcggcatcgccccctacatccgggagtttgaggaccccagagatgcccccccacccaccagggctgagacccgggaggagaggatggagaggaagagaagagagaagattgaaagacggcagcaggaggtggagacagagctgaagatgtgggacccccacaatgaccccaatgcccagggagatgccttcaagaccctgtttgtggcccgggtgaactatgacaccacagagagcaagctgcggcgggagtttgaggtgtatggccccatcaagaggatccacatggtgtacagcaagaggtctgggaagccccggggctacgccttcattgaatatgaacatgagcgggacatgcacagcgcctacaagcatgctgatggcaagaagattgatggccggcgggtgctggtggatgtggagcggggccgcacagtgaagggctggaggccccggcggctgggcggcggcctgggcggcacccggcggggcggcgcagatgtgaacatccgccacagcggcagagatgacaccagccgctatgatgagaggcctggccccagccccctgccccaccgggaccgggaccgggaccgggagcgggagcggcgggagaggagccgggagcgggacaaggagcgggagaggagaagaagccgcagccgggacagaagaagaagaagccgcagccgggacaaggaggagaggagaagaagccgggagaggagcaaggacaaggaccgggacaggaagaggaggagcagccgcagccgggagcgggcccggcgggagcgggagaggaaggaggagctgcggggcggcggcggggacatggccgagcccagcgaggccggagatgcccccccagatgatggccccccaggagagctgggcccagatggcccagatggccctgaggagaagggccgggaccgggaccgggagaggagaagaagccacaggtctgagcgggagaggagaagagaccgggaccgggaccgggaccgggaccgggagcacaagagaggagagcggggcagcgagcggggcagagatgaggcccggggcggcggcggcggccaggacaatggcctggagggcctgggcaatgacagccgggacatgtacatggagagcgagggcggagatggctacctggccccagaaaatggctacctgatggaggccgcccctgagtag

SEQ ID NO: 175960 - DNA, 1731 bp, Artificial Sequence
  Description of Artificial Sequence: Synthetic coding sequence
atgctgcggagcggccctgccagcggccccagcgtgcccaccggccgggccatgcccagcagaagagtggcccggcccccagctgcccctgagctgggcgccctgggcagcccagacctgagcagcctgagcctggccgtgagccgcagcacagagatcattgatgagtacatcaaggaaaatggatttggcctggatggcggccagcccggccctggagagggcctgccccggctggtgtccagaggagctgccagcctgagcacagtgaccctgggccctgtggcccccccagccaccccaccaccctggggctgccccctgggccgcctggtgtccccagcccctggccctggcccccagccccacctggtgatcacagagcagcccaagcagaggggcatgaggttccgctatgaatgtgagggccgctctgctggcagcatcctgggggagagcagcacagaggccagcaagaccctgcctgccatcgagctgcgggactgtggcggcctgcgggaggtggaggtgacagcctgcctggtgtggaaggactggccccaccgggtgcacccccacagcctggtgggcaaggactgcacagatggcatctgccgggtgcggctgcggccccacgtgagccccaggcacagcttcaacaacctgggcatccagtgtgtgaggaagaaggagattgaggccgccatcgagaggaagatccagctgggcatcgacccctacaatgccggcagcctgaagaaccaccaggaggtggacatgaatgtggtgcgcatctgcttccaggccagctacagagaccagcagggccagatgaggaggatggaccctgtgctgtctgagcctgtgtatgacaagaagagcaccaacaccagcgagctgcgcatctgccgcatcaacaaggagagcggcccctgcacaggaggagaggagctgtacctgctgtgtgacaaggtgcagaaggaggacatctctgtggtgttcagccgggcctcctgggagggccgggctgacttcagccaggctgatgtgcaccggcagatcgccatcgtgttcaagaccccaccctatgaggacctggagatcgtggagcctgtgacagtgaatgtgttcctgcagaggctgacagatggagtgtgcagcgagcccctgcccttcacctacctgccccgggaccatgacagctatggagtggacaagaagaggaagaggggcatgccagatgtgctgggggagctgaacagcagtgacccccatggaattgagagcaagaggaggaagaagaagccagccatcctggaccacttcctgcccaaccacggcagcggccccttcctgcccccatctgccctgctgcctgaccctgacttcttctctggaacagtgtccctgcccggcctggagcccccaggcggccctgacctgctggatgatggctttgcctatgaccccacagcccccaccctcttcaccatgctggacctgctgcccccagccccaccccacgccagcgctgtggtgtgcagcggcggggccggggctgtggtgggggagaccccaggccctgagcccctgaccctggacagctaccaggcccctggccctggagatggcggcacagccagcctggtgggcagcaacatgttccccaaccactaccgggaggccgccttcggcggcggcctgctgagccctggccctgaggccacctag

SEQ ID NO: 175961 - DNA, 1740 bp, Artificial Sequence
  Description of Artificial Sequence: Synthetic coding sequence
atgctgcggagcggccctgccagcggccccagcgtgcccaccggccgggccatgcccagcagaagagtggcccggcccccagctgcccctgagctgggcgccctgggcagcccagacctgagcagcctgagcctggccgtgagccgcagcacagatgagctggagatcattgatgagtacatcaaggaaaatggcttcggcctggatggcggccagcccggccctggagagggcctgccccggctggtgtccagaggagctgccagcctgagcacagtgaccctgggccctgtggcccccccagccaccccaccaccctggggctgccccctgggccgcctggtgtccccagcccctggccctggcccccagccccacctggtgatcacagagcagcccaagcagaggggcatgaggttccgctatgaatgtgagggccgctctgctggcagcatcctgggggagagcagcacagaggccagcaagaccctgcctgccatcgagctgcgggactgtggcggcctgcgggaggtggaggtgacagcctgcctggtgtggaaggactggccccaccgggtgcacccccacagcctggtgggcaaggactgcacagatggcatctgccgggtgcggctgcggccccacgtgagccccaggcacagcttcaacaacctgggcatccagtgtgtgaggaagaaggagattgaagctgccattgaaaggaagatccagctgggcatcgacccctacaatgccggcagcctgaagaaccaccaggaggtggacatgaatgtggtgcgcatctgcttccaggccagctacagagaccagcagggccagatgaggaggatggaccctgtgctgtctgagcctgtgtatgacaagaagagcaccaacaccagcgagctgcgcatctgccgcatcaacaaggagagcggcccctgcaccggcggggaggagctgtacctgctgtgtgacaaggtgcagaaggaggacatctctgtggtgttcagccgggcctcctgggagggccgggctgacttcagccaggctgatgtgcaccggcagatcgccatcgtgttcaagaccccaccctatgaggacctggagatcgtggagcctgtgacagtgaatgtgttcctgcagaggctgacagatggagtgtgcagcgagcccctgcccttcacctacctgccccgggaccatgacagctatggagtggacaagaagaggaagaggggcatgccagatgtgctgggggagctgaacagcagtgacccccacggcatcgagagcaagaggaggaagaagaagccagccatcctggaccacttcctgcccaaccacggcagcggccccttcctgccccccagcgccctgctgcctgaccctgacttcttcagcggcaccgtgtccctgcccggcctggagcccccaggcggccctgacctgctggatgatggctttgcctatgaccccacagcccccaccctcttcaccatgctggacctgctgcccccagcccctcctcatgccagcgctgtggtgtgcagcggcggggccggggctgtggtgggggagaccccaggccctgagcccctgaccctggacagctaccaggcccctggccctggagatggcggcacagccagcctggtgggcagcaacatgttccccaaccactaccgggaggccgcctttggaggcggcctgctgagccctggccctgaggccacctag

SEQ ID NO: 175962 - DNA, 2187 bp, Artificial Sequence
  Description of Artificial Sequence: Synthetic coding sequence
atggaggccgctgctgggggccggggctgcttccagccccaccctggcctgcagaagaccctggagcagttccacctgagctccatgagcagcctgggcggccctgctgccttcagcgcccgctgggcccaggaggcctacaagaaggagagcgccaaggaggccggggctgctgctgtgcctgcccctgtgcctgctgccacagagcccccacctgtgctgcacctgcctgccatccagcccccacctcctgtgctgcccggccccttcttcatgcccagcgacaggagcacagagcgctgtgaaacagtgctggagggggagaccatcagctgctttgtggtgggcggggagaagaggctgtgcctgccccagatcctgaacagcgtgctgcgggacttcagcctgcagcagatcaatgctgtgtgtgatgagctgcacatctactgcagccgctgcacagctgaccagctggagatcctgaaggtgatgggcatcctgcccttcagcgcccccagctgtggcctcatcaccaagacagatgctgagcggctgtgcaatgccctgctgtatggaggagcctaccccccaccctgcaagaaggagctggccgccagcctggccctgggcctggagctgtctgagaggtctgtgcgggtgtaccatgaatgttttggaaaatgtaaaggcctgctggtgcctgagctgtacagcagccccagcgctgcctgcatccagtgcctggactgccgcctgatgtacccaccccacaagtttgtggtgcacagccacaaggccctggagaacagaacctgccactggggctttgacagcgccaactggagggcctacatcctgctgagccaggactacaccgggaaggaggagcaggcccggctgggccgctgcctggatgatgtgaaggagaagtttgattatggcaacaagtacaagagaagagtgccccgggtgagcagcgagcccccagccagcatccggcccaagacagatgacaccagcagccagagccctgcccccagcgagaaggacaagcccagctcctggctgcggaccctggccggcagcagcaacaagagcctgggctgtgtgcacccccggcagaggctgagcgccttccggccctggagccctgctgtgtctgccagcgagaaggagctgagcccccacctgcctgccctgatccgggacagcttctacagctacaagagctttgaaacagctgtggcccccaacgtggccctggcccccccagcccagcagaaggtggtgagcagccccccctgtgccgctgctgtgtcccgggcccctgagcccctggccacctgcacccagcccaggaagaggaagctgactgtggacacccctggggcccctgagaccctggcccctgtggccgcccctgaggaggacaaggacagcgaggccgaggtggaggtggagagccgggaggagttcaccagcagcctgagcagcctgagcagccccagcttcaccagcagcagcagcgccaaggacctgggcagccctggggcccgggccctgcccagcgctgtgcctgatgctgctgccccagcagatgcccccagcggcctggaggccgagctggagcacctgcggcaggccctggagggcggcctggacaccaaggaggccaaggagaagttcctgcacgaggtggtgaagatgagggtgaagcaggaggagaagctgtctgctgccctgcaggccaagaggagcctgcaccaggagctggagttcctgcgggtggccaagaaggagaagctgcgggaggccacagaggccaagaggaacctgaggaaggagattgaaaggctgcgggcagaaaatgagaagaagatgaaggaggccaatgaaagccggctgcggctgaagcgggagctggagcaggcccggcaggcccgggtgtgtgacaagggctgtgaggccggccgcctgcgggccaagtacagcgcccagatcgaggacctgcaggtgaagctgcagcacgccgaggccgaccgggagcagctgcgggctgacctgctgcgggagcgggaggcccgggagcacctggagaaggtggtgaaggagctgcaggagcagctgtggccccgggcccggcctgaggccgccggcagcgagggcgctgctgagctggagccctag

SEQ ID NO: 175963 - DNA, 1632 bp, Artificial Sequence
  Description of Artificial Sequence: Synthetic coding sequence
atgggctgcatcaagagcaaggagaacaagagccctgccatcaagtacagacctgagaacaccccagagcctgtgtccacctctgtgagccactacggggctgagcccaccaccgtgagcccctgccccagcagcagcgccaagggcacagctgtgaacttcagcagcctgtccatgaccccatttggaggcagcagcggcgtgaccccatttggaggagccagcagcagcttctctgtggtgcccagcagctacccagctggcctgaccggcggcgtgaccatctttgtggccctgtatgactatgaggcccggaccacagaggacctgtccttcaagaagggggagcgcttccagatcatcaacaacacagaaggagactggtgggaggcccggagcatcgccaccgggaagaatggctacatccccagcaactacgtggccccagctgacagcatccaggccgaggagtggtactttgggaagatgggcaggaaggatgctgagcggctgctgctgaaccctggcaaccagaggggcatcttcctggtgcgggagagcgagaccaccaagggggcctacagcctgagcatccgggactgggatgagatccggggggacaacgtgaagcactacaagatcaggaagctggacaatggaggctactacatcaccacccgggcccagtttgacaccctgcagaagctggtgaagcactacacagaacatgctgatggcctgtgccacaagctgaccaccgtgtgccccaccgtgaagccccagacccagggcctggccaaggatgcctgggagatcccccgggagagcctgcggctggaggtgaagctgggccagggctgcttcggggaggtgtggatgggcacctggaatggcaccaccaaggtggccatcaagaccctgaagccaggcaccatgatgcctgaggccttcctgcaggaggcccagatcatgaagaagctgcggcatgacaagctggtgcccctgtatgctgtggtgtctgaggagcccatctacatcgtgacagagttcatgagcaagggcagcctgctggacttcctgaaggagggagatggcaagtacctgaagctgccccagctggtggacatggccgcccagattgctgatggcatggcctacattgaaagaatgaactacatccaccgggacctgcgggccgccaacatcctggtgggggagaacctggtgtgcaagattgctgactttggcctggcccggctgattgaggacaatgagtacacagcccggcagggcgccaagttccccatcaagtggacagcccctgaggccgccctgtatggccgcttcaccatcaagagtgatgtgtggagctttggcatcctgcagacagagctggtgaccaagggccgggtgccctacccaggcatggtgaaccgggaggtgctggagcaggtggagcggggctacaggatgccctgcccccagggctgcccagagagcctgcacgagctgatgaacctgtgctggaagaaggaccctgatgagcggcccacctttgagtacatccagagcttcctggaggactacttcaccgccacagagccccagtaccagcctggagagaacctgtag

SEQ ID NO: 175964 - DNA, 1632 bp, Artificial Sequence; identical to SEQ ID NO: 175963
  Description of Artificial Sequence: Synthetic coding sequence

SEQ ID NO: 175965 - DNA, 1632 bp, Artificial Sequence; identical to SEQ ID NO: 175963
  Description of Artificial Sequence: Synthetic coding sequence

SEQ ID NO: 175966 - DNA, 1539 bp, Artificial Sequence
  Description of Artificial Sequence: Synthetic coding sequence
atgggctgcatcaagagcaagggcaaggacagcctgagtgatgatggagtggacctgaagacccagcctgtgaggaacacagagaggaccatctacgtgcgggaccccaccagcaacaagcagcagaggcctgtgcctgagagccagctgctgcccggccagcgcttccagaccaaggaccctgaggagcagggcgacatcgtggtggccctgtacccctatgatggcatccacccagatgacctgtccttcaagaagggggagaagatgaaggtgctggaggagcacggggagtggtggaaggccaagagcctgctgaccaagaaggagggcttcatccccagcaactacgtggccaagctgaacaccctggagacagaggagtggttcttcaaggacatcaccaggaaggatgctgagcggcagctgctggcccctggcaacagcgctggggccttcctgatccgggagagcgagaccctgaagggcagcttcagcctgtctgtgcgggactttgatcctgtgcatggagatgtgatcaagcactacaagatccgcagcctggacaatggaggctactacatcagcccccgcatcaccttcccctgcatcagtgacatgatcaagcactaccagaagcaggctgatggcctgtgccggcggctggagaaggcctgcatcagccccaagccccagaagccctgggacaaggatgcctgggagatcccccgggagagcatcaagctggtgaagaggctgggcgccggccagtttggagaggtgtggatgggctactacaacaacagcaccaaggtggccgtgaagaccctgaagccaggcaccatgtctgtgcaggccttcctggaggaggccaacctgatgaagaccctgcagcacgacaagctggtgcggctgtatgctgtggtgacccgggaggagcccatctacatcatcacagagtacatggccaagggcagcctgctggacttcctgaagagtgatgagggcggcaaggtgctgctgcccaagctgattgacttcagcgcccagattgctgagggcatggcctacatcgagaggaagaactacatccaccgggacctgcgggccgccaacgtgctggtgtctgagagcctgatgtgcaagattgctgactttggcctggcccgggtgattgaagataatgagtacacagcccgggagggcgccaagttccccatcaagtggacagcccctgaggccatcaactttggctgcttcaccatcaagagtgatgtgtggagctttggcatcctgctgtatgagatcgtgacctacggcaagatcccctacccaggccgcaccaatgctgatgtgatgacagccctgagccagggctacaggatgccccgggtggagaactgcccagatgagctgtatgacatcatgaagatgtgctggaaggagaaggccgaggagcggcccacctttgactacctgcagagcgtgctggatgacttctacacagccacagagggccagtaccagcagcagccctag

SEQ ID NO: 175967 - DNA, 453 bp, Artificial Sequence
  Description of Artificial Sequence: Synthetic coding sequence
atgggctgcatcaagagcaagggcaaggacagcctgagtgatgatggagtggacctgaagacccagcctgtgaggaacacagagaggaccatctacgtgcgggaccccaccagcaacaagcagcagaggcctgtgcctgagagccagctgctgcccggccagcgcttccagaccaaggaccctgaggagcagggcgacatcgtggtggccctgtacccctatgatggcatccacccagatgacctgtccttcaagaagggggagaagatgaaggtgctggaggagcacggggagtggtggaaggccaagagcctgctgaccaagaaggagggcttcatccccagcaactacgtggccaagctgaacaccctggagacagaggagtggttcttcaaggacatcaccaggaaggatgctgagcggcagctgctggcccctggcaacagcgcctag

SEQ ID NO: 175968 - DNA, 1476 bp, Artificial Sequence
  Description of Artificial Sequence: Synthetic coding sequence
atgggctgcatcaagagcaagggcaaggacagcctgagtgatgatggagtggacctgaagacccagcctgtgcctgagagccagctgctgcccggccagcgcttccagaccaaggaccctgaggagcagggcgacatcgtggtggccctgtacccctatgatggcatccacccagatgacctgtccttcaagaagggggagaagatgaaggtgctggaggagcacggggagtggtggaaggccaagagcctgctgaccaagaaggagggcttcatccccagcaactacgtggccaagctgaacaccctggagacagaggagtggttcttcaaggacatcaccaggaaggatgctgagcggcagctgctggcccctggcaacagcgctggggccttcctgatccgggagagcgagaccctgaagggcagcttcagcctgtctgtgcgggactttgatcctgtgcatggagatgtgatcaagcactacaagatccgcagcctggacaatggaggctactacatcagcccccgcatcaccttcccctgcatcagtgacatgatcaagcactaccagaagcaggctgatggcctgtgccggcggctggagaaggcctgcatcagccccaagccccagaagccctgggacaaggatgcctgggagatcccccgggagagcatcaagctggtgaagaggctgggcgccggccagtttggagaggtgtggatgggctactacaacaacagcaccaaggtggccgtgaagaccctgaagccaggcaccatgtctgtgcaggccttcctggaggaggccaacctgatgaagaccctgcagcacgacaagctggtgcggctgtatgctgtggtgacccgggaggagcccatctacatcatcacagagtacatggccaagggcagcctgctggacttcctgaagagtgatgaaggaggcaaggtgctgctgcccaagctgattgacttcagcgcccagattgctgagggcatggcctacattgaaaggaagaactacatccaccgggacctgcgggccgccaacgtgctggtgtctgagagcctgatgtgcaagattgctgactttggcctggcccgggtgattgaggacaatgagtacacagcccgggagggcgccaagttccccatcaagtggacagcccctgaggccatcaactttggctgcttcaccatcaagagtgatgtgtggagctttggcatcctgctgtatgaaattgtgacctacggcaagatcccctacccaggccgcaccaatgctgatgtgatgacagccctgagccagggctacaggatgccccgggtggagaactgcccagatgagctgtatgacatcatgaagatgtgctggaaggagaaggccgaggagcggcccacctttgactacctgcagagcgtgctggatgacttctacacagccacagagggccagtaccagcagcagccctag

SEQ ID NO: 175969 - DNA, 993 bp, Artificial Sequence
  Description of Artificial Sequence: Synthetic coding sequence
atggctgctgtggacagcttctacctgctgtaccgggagatcgcccggagctgcaactgctacatggaggccctggccctggtgggcgcctggtacacagccaggaagagcatcaccgtcatctgtgacttctacagcctcatccggctgcacttcatcccccggctgggcagcagagctgacctgatcaagcagtatggccgctgggccgtggtgtctggggccacagatggcatcggcaaggcctatgcagaggagctggccagccggggcctgaacatcatcctgatcagcagaaatgaggagaagctgcaggtggtggccaaggacattgctgacacctacaaggtggagacagacatcatcgtggccgacttcagcagcggccgggagatctacctgcccatccgggaggccctgaaggacaaggatgtgggcatcctggtgaacaacgtgggcgtcttctacccctacccccagtacttcacccagctgtctgaggacaagctgtgggacatcatcaacgtgaacattgctgctgccagcctgatggtgcacgtggtgctgcccggcatggtggagaggaagaagggggccatcgtgaccatcagcagcggcagctgctgcaagcccaccccccagctggccgccttcagcgccagcaaggcctacctggaccacttcagccgggccctgcagtatgaatatgccagcaagggcatctttgtgcagagcctcatccccttctacgtggccacctccatgacagcccccagcaacttcctgcaccgctgctcctggctggtgcccagccccaaggtgtatgcccaccacgctgtgtccaccctgggcatcagcaagaggaccaccggctactggagccacagcatccagttcctgtttgcccagtacatgcctgagtggctgtgggtgtggggcgccaacatcctgaacagaagcctgaggaaggaggccctgagctgcacagcctag

SEQ ID NO: 175970 - DNA, 336 bp, Artificial Sequence
  Description of Artificial Sequence: Synthetic coding sequence
atgggcagcagcagcttcctggtgctgatggtgtccctggtgctggtgaccctggtggccgtggagggcgtgaaggagggcatcgagaaggccggcgtgtgcccagctgacaacgtgcgctgcttcaagagtgaccccccccagtgccacacagaccaggactgcctgggggagaggaagtgctgctacctgcactgcggcttcaagtgtgtgattcctgtgaaggagctggaggagggcggcaacaaggatgaagatgtgtcccggccctacccagagcccggctgggaggccaagtgccccggcagcagcagcacccgctgcccccagaagtag

SEQ ID NO: 175971 - DNA, 675 bp, Artificial Sequence
  Description of Artificial Sequence: Synthetic coding sequence
atgaggacccagagcctgctgctgctgggcgccctgctggccgtgggcagccagctgcctgctgtgtttggaaggaagaagggggagaagagcggcggctgccccccagatgatggcccctgcctgctgtctgtgcctgaccagtgtgtggaggacagccagtgccccctgaccaggaagtgctgctaccgggcctgcttccggcagtgtgtgccccgggtgtctgtgaagctgggcagctgcccagaggaccagctgcgctgcctgagccccatgaaccacctgtgccacaaggacagcgactgcagcggcaagaagcgctgctgccacagcgcctgtggccgggactgccgggaccctgcccggggcacagcccctggctgccccggccaggccaacagcgacctgggctctgtggccctgcacctgtcctggggccccacagagcgggtgcatgatggccggcctggggccctgcctgctggccagcactacctgtaccagcgctggttccagcccagcgacaaccactggccagctgacaccagcctgcagcccatccacccctggttcctgctgctgggcgtgaaggtgcacagcctgagcagcgaggagggcctgtgcatcacccctgtgctgtgcaccacagccatccgggccagccaccccagctag

SEQ ID NO: 175972 - DNA, 372 bp, Artificial Sequence
  Description of Artificial Sequence: Synthetic coding sequence
atgaggacccagagcctgctgctgctgggcgccctgctggccgtgggcagccagctgcctgctgtgtttggaaggaagaagggggagaagagcggcggctgccccccagatgatggcccctgcctgctgtctgtgcctgaccagtgtgtggaggacagccagtgccccctgaccaggaagtgctgctaccgggcctgcttccggcagtgtgtgccccgggtgtctgtgaagctgggcagctgcccagaggaccagctgcgctgcctgagccccatgaaccacctgtgccacaaggacagcgactgcagcggcaagaagcgctgctgccacagcgcctgtggccgggactgccgggaccctgcccggggctag

SEQ ID NO: 175973 - DNA, 1647 bp, Artificial Sequence
  Description of Artificial Sequence: Synthetic coding sequence
atgcctgccctgcggcccctgctgcccctgctgctgctgctgcggctgaccagcggggccggcctgctgcccggcctgggcagccaccctggggtgtgccccaaccagctgagccccaacctgtgggtggatgcccagagcacctgtgagcgggagtgcagccgggaccaggactgtgccgctgctgagaagtgctgcatcaacgtgtgtggcctgcacagctgtgtggccgcccgcttccctggcagccctgctgcccccaccacagctgccagctgtgagggctttgtgtgcccccagcagggcagtgactgtgacatctgggatggccagcctgtgtgccgctgccgggacagatgtgagaaggagcccagcttcacctgtgccagtgatggcctgacctactacaaccgctgctacatggatgctgaggcctgcctgcggggcctgcacctgcacatcgtgccctgcaagcacgtgctgtcctggccacccagcagccctggccccccagagaccacagcccggcccaccccaggagctgcccctgtgcccccagccctgtacagcagccccagcccccaggccgtgcaggtgggcggcacagccagcctgcactgtgatgtgtctggccggcccccacctgctgtgacctgggagaagcagagccaccagagagaaaatctcatcatgaggccagaccagatgtatggaaatgtggtggtgaccagcatcggccagctggtgctgtacaatgcccggccagaagatgctggcctgtacacctgcacagccagaaatgctgctggcctgctgcgggctgacttccccctgtctgtggtgcagcgggagcccgccagagatgctgcccccagcatcccagccccagctgagtgcctgcctgatgtgcaggcctgcaccggccccaccagcccccacctggtgctgtggcactatgacccccagaggggcggctgcatgaccttccctgcccggggctgtgatggagctgcccggggctttgagacctatgaggcctgccagcaggcctgtgcccggggccctggagatgcctgtgtgctgcctgctgtgcagggcccctgccggggctgggagccccgctgggcctacagccccctgctgcagcagtgccacccctttgtgtatggaggctgtgagggcaatggaaacaacttccacagccgggagagctgtgaagatgcctgccctgtgcccaggaccccaccctgccgggcctgccgcctgcggagcaagctggccctgagcctgtgccgcagtgactttgccatcgtgggccgcctgacagaggtgctggaggagcctgaggccgccggcggcatcgcccgggtggccctggaggatgtgctgaaggatgacaagatgggcctgaagttcctgggcaccaagtacctggaggtgaccctgagcggcatggactgggcctgcccctgccccaacatgacagctggagatggccccctggtgatcatgggagaggtgagagatggagtggccgtgctggatgctggcagctatgtgcgggccgccagcgagaagagggtgaagaagatcctggagctgctggagaagcaggcctgtgagctgctgaaccgcttccaggactag

SEQ ID NO: 175974 - DNA, 1731 bp, Artificial Sequence
  Description of Artificial Sequence: Synthetic coding sequence
atgtgggccccccgctgccgccgcttctggagccgctgggagcaggtggccgccctgctgctgctgctgctgctgctgggcgtgcccccaagaagcctggccctgccccccatccgctacagccatgctggcatctgccccaatgacatgaaccccaacctgtgggtggatgcccagagcacctgcagaagagaatgtgaaacagaccaggagtgtgagacctatgagaagtgctgccccaacgtgtgtggcaccaagagctgtgtggccgcccgctacatggatgtgaagggcaagaagggccctgtgggcatgcccaaggaggccacctgtgaccacttcatgtgcctgcagcagggctctgaatgtgacatctgggatggccagcctgtgtgcaagtgcaaggacagatgtgagaaggagcccagcttcacctgtgccagtgatggcctgacctactacaaccgctgctacatggatgctgaggcctgcagcaagggcatcaccctggccgtggtgacctgccgctaccacttcacctggcccaacaccagccccccacctcctgagaccaccatgcaccccaccacagccagccctgagaccccagagctggacatggccgccccagccctgctgaacaaccctgtgcaccagagcgtgaccatgggagagaccgtgtccttcctgtgtgatgtggtgggccggcccaggcctgagatcacctgggagaagcagctggaggacagagaaaatgtggtgatgaggcccaaccacgtgagaggaaatgtggtggtgaccaacatcgcccagctggtgatctacaatgcccagctgcaggatgctggcatctacacctgcacagccagaaatgtggccggcgtgctgcgggctgacttccccctgtctgtggtgcggggccaccaggccgccgccaccagcgagagcagccccaatggaacagccttccctgctgctgaatgtctgaagcccccagacagcgaggactgtggggaggagcagacccgctggcactttgatgcccaggccaacaactgcctgaccttcaccttcggccactgccacaggaacctgaaccactttgagacctatgaggcctgcatgctggcctgcatgagcggccccctggccgcctgcagcctgcctgccctgcagggcccctgcaaggcctatgccccccgctgggcctacaacagccagacaggccagtgccagagctttgtgtatggaggctgtgagggcaatggaaacaactttgagagccgggaggcctgtgaggagagctgccccttcccccggggcaaccagcgctgccgggcctgcaagccccggcagaagctggtgaccagcttctgccgcagtgactttgtgatcctgggccgggtgtctgagctgacagaggagccagacagcggccgggccctggtgacagtggatgaggtgctgaaggatgagaagatgggcctgaagttcctgggccaggagcccctggaggtgaccctgctgcacgtggactgggcctgcccctgccccaacgtgacagtgtctgagatgcccctcatcatcatgggagaggtggatggcggcatggccatgctgcggccagacagctttgtgggcgccagcagcgcccggcgggtgaggaagctgcgggaggtgatgcacaagaagacctgtgatgtgctgaaggagttcctgggcctgcactag

SEQ ID NO: 175975 - DNA, 849 bp, Artificial Sequence
  Description of Artificial Sequence: Synthetic coding sequence
atggatgtgaagggcaagaagggccctgtgggcatgcccaaggaggccacctgtgaccacttcatgtgcctgcagcagggctctgaatgtgacatctgggatggccagcctgtgtgcaagtgcaaggacagatgtgagaaggagcccagcttcacctgtgcccaggccaacaactgcctgaccttcaccttcggccactgccacaggaacctgaaccactttgagacctatgaggcctgcatgctggcctgcatgagcggccccctggccgcctgcagcctgcctgccctgcagggcccctgcaaggcctatgccccccgctgggcctacaacagccagacaggccagtgccagagctttgtgtatggaggctgtgagggcaatggaaacaactttgagagccgggaggcctgtgaggagagctgccccttcccccggggcaaccagcgctgccgggcctgcaagccccggcagaagctggtgaccagcttctgccgcagtgactttgtgatcctgggccgggtgtctgagctgacagaggagccagacagcggccgggccctggtgacagtggatgaggtgctgaaggatgagaagatgggcctgaagttcctgggccaggagcccctggaggtgaccctgctgcacgtggactgggcctgcccctgccccaacgtgacagtgtctgagatgcccctcatcatcatgggagaggtggatggcggcatggccatgctgcggccagacagctttgtgggcgccagcagcgcccggcgggtgaggaagctgcgggaggtgatgcacaagaagacctgtgatgtgctgaaggagttcctgggcctgcactag

SEQ ID NO: 175976 - DNA, 1509 bp, Artificial Sequence
  Description of Artificial Sequence: Synthetic coding sequence
atgcccctggtgaagaggaacatcgagcccaggcacctgtgccgcggggccctgcctgagggcatcaccagcgagctggagtgtgtgaccaacagcaccctggccgccatcatccggcagctgagcagcctgagcaagcatgctgaggacatctttggagagctgttcaatgaggccaacaacttctacatccgggccaacagcctgcaggacagaattgaccggctggccgtgaaggtgacccagctggacagcacagtggaggaggtgtccctgcaggacatcaacatgaagaaggccttcaagagcagcacagtgcaggaccagcaggtggtgtccaagaacagcatccccaaccctgtggccgacatctacaaccagagcgacaagcccccacccctgaacatcctgaccccctacagagatgacaagaaggatggcctgaagttctacacagaccccagctacttctttgacctgtggaaggagaagatgctgcaggacacagaggacaagaggaaggagaagaggcggcagaaggagcagaagagaattgatggcaccacccgggaggtgaagaaggtgaggaaggccaggaacagacggcaggagtggaacatgatggcctatgacaaggagctgcggccagacaaccggctgagccagagcgtgtaccacggggccagcagcgagggcagcctgagcccagacaccaggagccacgccagtgatgtgacagactacagctacccagccacccccaaccacagcctgcacccccagcctgtgacccccagctatgctgctggagatgtgccccctcatggccctgccagccaggccgctgagcacgagtaccggccccccagcgccagcgcccggcacatggccctgaaccggccccagcagcccccacctcctcctccaccccaggcccctgagggcagccaggccagcgcccccatggccccagctgactatggcatgctgcctgcccagatcatcgagtactacaaccccagcggccccccacctcctcctcctcctcctgtgatccccagcgcccagacagcctttgtgagccccctgcagatgcccatgcagccccccttccctgccagcgccagcagcacccacgccgccccaccccacccccccagcacaggcctgctggtgacagcccctcctcctcctggccccccacctcctcctcctggccccccaggccctggcagcagcctgagcagcagccccatgcacggcccccctgtggccgaggccaagaggcaggagcccgcccagccccccatcagtgatgcccggagtgacctgctggccgccatccgcatgggcatccagctgaagaaggtgcaggagcagcgggagcaggaggccaagcgggagcctgtgggcaatgatgtggccaccatcctgagcagaagaattgctgtggagtacagcgacagtgatgatgattctgaatttgatgaaaatgactggagcgactag

SEQ ID NO: 175977 - DNA, 1500 bp, Artificial Sequence
  Description of Artificial Sequence: Synthetic coding sequence
atgcccctggtgaagaggaacatcgagcccaggcacctgtgccgcggggccctgcctgagggcatcaccagcgagctggagtgtgtgaccaacagcaccctggccgccatcatccggcagctgagcagcctgagcaagcatgctgaggacatctttggagagctgttcaatgaggccaacaacttctacatccgggccaacagcctgcaggacagaattgaccggctggccgtgaaggtgacccagctggacagcacagtggaggaggtgtccctgcaggacatcaacatgaagaaggccttcaagagcagcacagtgcaggaccagcaggtggtgtccaagaacagcatccccaaccctgtggccgacatctacaaccagagcgacaagcccccacccctgaacatcctgaccccctacagagatgacaagaaggatggcctgaagttctacacagaccccagctacttctttgacctgtggaaggagaagatgctgcaggacacagaggacaagaggaaggagaagaggcggcagaagcgggagaagcacaagctgaaccccaacagaaaccagcaggtgaatgtgaggaaggtgaggaccaggaaggaggagtgggagaggaggaagatgggcatcgagttcatgtctgatgccaagaagctggagcaggccggcagcgccaaggaggacagagtgcccagcggcagccacgccagtgatgtgacagactacagctacccagccacccccaaccacagcctgcacccccagcctgtgacccccagctatgctgctggagatgtgcccccccacggccctgccagccaggccgctgagcacgagtacagacctccttctgccagcgcccggcacatggccctgaaccggccccagcagcccccacctcctcctccaccccaggcccctgagggcagccaggccagcgcccccatggccccagctgactatggcatgctgcctgcccagatcatcgagtactacaaccccagcggccccccacctcctcctcctcctcctgtgatccccagcgcccagacagcctttgtgagccccctgcagatgcccatgcagccccccttccctgccagcgccagcagcacccatgctgccccaccccacccccccagcacaggcctgctggtgacagcccctcctcctcctggccccccacctcctcctcctggccccccaggccctggcagcagcctgagcagcagccccatgcacggcccccctgtggccgaggccaagaggcaggagcccgcccagccccccatcagtgatgcccggagtgacctgctggccgccatccgcatgggcatccagctgaagaaggtgcaggagcagcgggagcaggaggccaagcgggagcctgtgggcaatgatgtggccaccatcctgagcagaagaattgctgtggagtacagcgacagtgatgatgacagcgagtttgatgaaaatgactggagcgactag

SEQ ID NO: 175978 - DNA, 786 bp, Artificial Sequence
  Description of Artificial Sequence: Synthetic coding sequence
atggagggcggcctgggccgggctgtgtgcctgctgactggagccagccggggctttggaagaaccctggcccccctgctggccagcctgctgagccctggctctgtgctggtgctgagcgccagaaatgatgaggccctgcggcagctggaggccgagctgggcgctgagaggagcggcctgcgggtggtgcgggtgcctgctgacctgggcgctgaggccggcctgcagcagctgctgggcgccctgcgggagctgccccggcccaagggcctgcagaggctgctgctgatcaacaatgccggcagcctgggagatgtgtccaaaggatttgtggacctgagtgacagcacccaggtgaacaactactgggccctgaacctgacctccatgctgtgcctgaccagctctgtgctgaaggccttcccagacagccctggcctgaacagaacagtggtgaacatcagcagcctgtgtgccctgcagcccttcaagggctgggccctgtactgtgccggcaaggccgcccgggacatgctgttccaggtgctggccctggaggagcccaacgtgcgggtgctgaactatgcccctggccccctggacacagacatgcagcagctggcccgggagacctctgtggaccctgacatgaggaagggcctgcaggagctgaaggccaagggcaagctggtggactgcaaggtgtctgcccagaagctgctgagcctgctggagaaggatgagttcaagagcggggcccacgtggacttctatgacaagtag

SEQ ID NO: 175979 - DNA, 2430 bp, Artificial Sequence
  Description of Artificial Sequence: Synthetic coding sequence
atggaggatgagcagcctgacagcctggagggctgggtgcctgtgcgggagggcctgtttgctgagcctgagcggcaccggctgcgcttcctggtggcctggaatggagctgagggcaagtttgctgtgacctgccacgacagaacagcccagcagaggcggctgcgggagggcgcccggctgggccctgagcctgagcccaagccagaggccgctgtgagccccagctcctgggccggcctgctgtctgctgctggcctgcggggggcccaccggcagctggccgccctgtggccacccctggagcgctgcttcccccggctgcccccagagctggatgtgggcggcggcggggcctggggcctgggcctgggcctgtgggccctgctgtggcccaccagggctggccctggagaggccgccctgcaggagctgtgtggccagctggagcgctacctgggcgctgctgctgatggctgcggcggggccaccgtgagagatgccctcttccctgctgagggcggcgctgctgactgtgagagcccccgggagttccgggagcgggccctgcgggcccgctgggtggaggctgatgcccggctgcggcaggtgatccagggccacggcaaggccaacaccatggtggccctgatgaatgtgtaccaggaggaggatgaggcctaccaggagctggtgacagtggccaccatgttcttccagtacctgctgcagcccttccgggccatgagggaggtggccaccctgtgcaagctggacatcctgaagagcctggatgaagatgacctgggcccccggcgggtggtggccctggagaaggaggccgaggagtggacccggcgggcagaggaggccgtggtgtccatccaggacatcaccgtgaactacttcaaggagaccgtgaaggccctggccggcatgcagaaggagatggagcaggatgccaagcgcttcggccaggccgcctgggccacagccatcccccggctggagaagctgcagctgatgctggcccgggagaccctgcagctgatgagggccaaggagctgtgcctgaaccacaagagagctgagatccagggcaagatggaggacctgcctgagcaggagaagaacaccaacgtggtggatgagctggagatccagttctatgagatccagctggagctgtatgaggtgaagtttgagatcctgaagaatgaggagatcctgctgaccacccagctggacagcctgaagaggctcatcaaggagaagcaggatgaggtggtgtactatgacccctgtgagaaccctgaggagctgaaggtgattgactgtgtggtgggcctgcaggatgacaagaacctggaggtgaaggagctgcggcggcagtgccagcagctggagagcaagaggggccgcatctgtgccaagagggccagcctgcggagcaggaaggaccagtgcaaggagaaccaccgcttccggctgcagcaggccgaggagagcatccgctacagccggcagcaccacagcatccagatgaagagggacaagatcaaggaggaggagcagaagaagaaggagtggatcaaccaggagcggcagaagaccctgcagaggctgcggagcttcaaggacaagaggctggcccagagcgtgaggaacaccagcggcagcgagcctgtggcccccaacctgcccagcgacctgagccagcagatgtgcctgcctgccagccatgctgtgtctgtcatccaccccagcagcaggaagacccggggcgtgcccctgtctgaggccggaaatgtgaagagccccaagtgccagaactgccacggcaacatccctgtgcaggtgtttgtgcctgtgggggaccagacccacagcaagagcagcgaggagctgagcctgcccccacctcctcctcctcctcctcctcctcctcctcctcctcctcctcctcctccacccctgcgggccctgagcagcagcagccaggccgccacccaccagaacctgggcttccgggcccctgtgaaggatgaccagccccggcccctggtgtgtgagagccctgctgagcggccccgggacagcctggagagcttcagctgccccggctccatggatgaggtgctggccagcctgcggcacggccgggcccccctgaggaaggtggaggtgcctgctgtgcggcccccccacgccagcatcaatgagcacatcctggccgccatccggcagggcgtgaagctgaagaaggtgcacccagacctgggccccaaccccagcagcaagcccaccagcaacagaaggaccagtgacctggagaggagcatcaaggccgccctgcagaggatcaagagggtgtctgctgacagtgaagaagattctgatgagcaggaccccggccagtgggatggatag

SEQ ID NO: 175980 - DNA, 1452 bp, Artificial Sequence
  Description of Artificial Sequence: Synthetic coding sequence
atgcctgtgcccccacctcctcctccacccctgcccccacctcctccacccctgggcgcccctcctcctcctcctccttctgcccctcctgtgtccacagacaccagcagcctgcggcgggctgaccccaagggccgcagcgccctgctggccgacatccagcagggcacccggctgaggaaggtgacccagatcaatgacagaagtgccccccagatcgagagcagcaagggcaccaacaaggagggcggcggcagcgccaacaccaggggggccagcaccccacccaccctgggggacctgtttgctgggggcttccctgtgctgcggcctgctggccagagagatgtggccggcggcaagacaggccagggccctggcagccgggcccccagcccccggctgcccaacaagaccatcagcggccccctcatccccccagccagcccccggctgggcaacaccagcgaggcccatggagctgccaggacagccccaccccggcccaacgtgcctgcccctcctccacccaccccacctcctcctcctccacccctgcccccacccctgcccagcagcagccccatcaagacccccctggtgtccccacctggccccctgaccaagggcaacctgcctgtggtggcccctcctgtgccctgtgcccctcctcctcctcctcctcctcctccacccaccccaccacccctgcccccagcctctgtgctgagtgacaaggctgtgaagccccagctggcccccctgcacctgccccccatccccccacccctgcccctgctgcccccctgtggctacccaggcctgaaggccgagcccgccagccctgcccaggatgcccaggagcccccagcccctcctccacccctgcccccctatgccagctgcagcccccgggccagcctgcctgccccacccctgcccggggtgaacagcagcagcgagaccccaccacccctgccccccaagagccccagcttccaggccccaccccagaaggccggggcccaggccctgcctgcccccccagcccctcctggcagccagcccttcctgcagaagaagagacatggccggcctggggccggcggcggcaagctgaaccccccaccagcccccccagcccggagccccaccacagagctgagcagcaagagccagcaggccacagcctggacccccacccagcagcccggcggccagctgagaaatggcagcctgcacatcattgatgactttgagagcaagttcaccttccacagcgtggaggacttccccccaccagatgagtacaagccctgccagaagatctaccccagcaagatccccaggagcaggaccccaggcccctggctgcaggccgaggccgtgggccagagcagtgatgacatcaagggcaggaacagccagctgagcctgaagaccctgaggtag

SEQ ID NO: 175981 - DNA, 1452 bp, Artificial Sequence
  Description of Artificial Sequence: Synthetic coding sequence
atgcctgtgcccccacctcctcctccacccctgcccccacctcctccacccctgggcgcccctcctcctcctcctccttctgcccctcctgtgtccacagacaccagcagcctgcggcgggctgaccccaagggccgcagcgccctgctggccgacatccagcagggcacccggctgaggaaggtgacccagatcaatgacagaagtgccccccagatcgagagcagcaagggcaccaacaaggagggcggcggcagcgccaacaccaggggggccagcaccccacccaccctgggggacctgtttgctgggggcttccctgtgctgcggcctgctggccagagagatgtggccggcggcaagacaggccagggccctggcagccgggcccccagcccccggctgcccaacaagaccatcagcggccccctcatccccccagccagcccccggctgggcaacaccagcgaggcccatggagctgccaggacagccccaccccggcccaacgtgcctgcccctcctccacccaccccacctcctcctcctccacccctgcccccacccctgcccagcagcagccccatcaagacccccctggtgtccccacctggccccctgaccaagggcaacctgcctgtggtggcccctcctgtgccctgtgcccctcctcctcctcctcctcctcctccacccaccccaccacccctgcccccagcctctgtgctgagtgacaaggctgtgaagccccagctggcccccctgcacctgccccccatccccccacccctgcccctgctgcccccctgtggctacccaggcctgaaggccgagcccgccagccctgcccaggatgcccaggagcccccagcccctcctccacccctgcccccctatgccagctgcagcccccgggccagcctgcctgccccacccctgcccggggtgaacagcagcagcgagaccccaccacccctgccccccaagagccccagcttccaggccccaccccagaaggccggggcccaggccctgcctgcccccccagcccctcctggcagccagcccttcctgcagaagaagagacatggccggcctggggccggcggcggcaagctgaaccccccaccagcccccccagcccggagccccaccacagagctgagcagcaagagccagcaggccacagcctggacccccacccagcagcccggcggccagctgagaaatggcagcctgcacatcattgatgactttgagagcaagttcaccttccacagcgtggaggacttccccccaccagatgagtacaagccctgccagaagatctaccccagcaagatccccaggagcaggaccccaggcccctggctgcaggccgaggccgtgggccagagcagtgatgacatcaagggcaggaacagccaggtgacccaggccagctgcctgtag

SEQ ID NO: 175982 - DNA, 1452 bp, Artificial Sequence; identical to SEQ ID NO: 175981
  Description of Artificial Sequence: Synthetic coding sequence

SEQ ID NO: 175983 - DNA, 930 bp, Artificial Sequence
  Description of Artificial Sequence: Synthetic coding sequence
atggctgtgaaccagagccacacagaaaatagaagaggagccctgatccccaacggggagagcctgctgaagaggagccccaacgtggagctgtccttcccccagaggtctgagggcagcaatgtgttcagcggcaggaagacaggcaccctcttcctgaccagctacagagtcatcttcatcaccagctgcagcatcagtgaccccatgctgtccttcatgatgccctttgacctgatgaccaacctgactgtggagcagcctgtgtttgctgccaacttcatcaagggcaccatccaggccgccccctacggcggctgggagggccaggccaccttcaagctggtgttcagaaatggagatgccattgaatttgcccagctgatggtgaaggccgccagcgctgctgcccggggcttccccctgcggaccctgaatgactggttcagctccatgggcatctacgtgatcaccggggagggcaacatgtgcaccccccagatgccctgcagcgtgattgtgtatggagcccccccagctggctacggggcccctcctcctggctatggagcccccccagctggctacggggcccagcctgtgggcaatgaaggcccccctgtgggctaccgggccagccctgtgcgctatggagccccacccctgggctacggggcccctcctgctggctatggagccccacccctgggctacggggccccacccctgggctacggcaccccacccctgggctacggggccccacccctgggctatggagcccccccagctggaaatgaaggacctcctgctggctaccgggccagccctgctggcagcggggcccggccccaggagagcacagctgcccaggccccagaaaatgaggccagcctgcccagcgccagcagcagccaggtgcacagctag

SEQ ID NO: 175984 - DNA, 930 bp, Artificial Sequence; identical to SEQ ID NO: 175983
  Description of Artificial Sequence: Synthetic coding sequence

SEQ ID NO: 175985 - DNA, 930 bp, Artificial Sequence; identical to SEQ ID NO: 175983
  Description of Artificial Sequence: Synthetic coding sequence

SEQ ID NO: 175986 - DNA, 708 bp, Artificial Sequence
  Description of Artificial Sequence: Synthetic coding sequence
atgccctttgacctgatgaccaacctgactgtggagcagcctgtgtttgctgccaacttcatcaagggcaccatccaggccgccccctacggcggctgggagggccaggccaccttcaagctggtgttcagaaatggagatgccattgaatttgcccagctgatggtgaaggccgccagcgctgctgcccggggcttccccctgcggaccctgaatgactggttcagctccatgggcatctacgtgatcaccggggagggcaacatgtgcaccccccagatgccctgcagcgtgattgtgtatggagcccccccagctggctacggggcccctcctcctggctatggagcccccccagctggctacggggcccagcctgtgggcaatgaaggcccccctgtgggctaccgggccagccctgtgcgctatggagccccacccctgggctacggggcccctcctgctggctatggagccccacccctgggctacggggccccacccctgggctacggcaccccacccctgggctacggggccccacccctgggctatggagcccccccagctggaaatgaaggacctcctgctggctaccgggccagccctgctggcagcggggcccggccccaggagagcacagctgcccaggccccagaaaatgaggccagcctgcccagcgccagcagcagccaggtgcacagctag

SEQ ID NO: 175987 - DNA, 1401 bp, Artificial Sequence
  Description of Artificial Sequence: Synthetic coding sequence
atgccctatgagatcaagaaggtgtttgccagcctgccccaggtggagcggggcgtgtccaagatcattggaggagaccccaagggcaacaacttcctgtacaccaacgggaaatgtgtgatcctgagaaatattgatgaccacagcagatttgtgaactgtgtgcgcttctccccagatggcaacagatttgccacagccagcgcagatggccagatctacatctatgatggcaagacaggagagaaggtgtgtgccctgggcggcagcaaggcccatgatggcggcatctatgccatctcctggagcccagacagcacccacctgctgagcgccagcggggacaagaccagcaagatctgggatgtgtctgtgaacagcgtggtgtccaccttccccatgggcagcacagtgctggaccagcagctgggctgcctgtggcagaaggaccacctgctgtctgtgtccctgagcggctacatcaactacctggacaggaacaaccccagcaagcccctgcacgtgatcaagggccacagcaagagcatccagtgcctgactgtgcacaagaatggaggcaagagctacatctacagcggcagccatgatggccacatcaactactgggacagcgagactggagaaaatgacagctttgctgggaagggccacaccaaccaggtgtccaggatgacagtggatgagagcggccagctgatcagctgcagcatggatgacacagtgcgctacaccagcctgatgctgcgggactacagcggccagggcgtggtgaagctggatgtgcagcccaagtgtgtggccgtgggccctgggggctatgctgtggtggtgtgcatcggccagatcgtgctgctgaaggaccagaggaagtgcttcagcattgacaaccctggctatgagcctgaggtggtggccgtgcaccctggaggagacacagtggccatcggcggcgtggatggaaatgtgcggctgtacagcatcctgggcaccaccctgaaggatgagggcaagctgctggaggccaagggccctgtgacagatgtggcctacagccatgatggagccttcctggccgtgtgtgatgccagcaaggtggtgaccgtcttctctgtggctgatggctacagcgagaacaacgtgttctacggccaccacgccaagatcgtgtgcctggcctggagcccagacaatgagcactttgccagcggcggcatggacatgatggtgtatgtgtggaccctgagtgaccctgagaccagggtgaagatccaggatgcccaccggctgcaccacgtgagcagcctggcctggctggatgagcacaccctggtgaccaccagccatgatgcctctgtgaaggagtggaccatcacctactag

SEQ ID NO: 175988 - DNA, 1821 bp, Artificial Sequence
  Description of Artificial Sequence: Synthetic coding sequence
atgccctatgagatcaagaaggtgtttgccagcctgccccaggtggagcggggcgtgtccaagatcattggaggagaccccaagggcaacaacttcctgtacaccaacgggaaatgtgtgatcctgagaaatattgacaacccagccctggccgacatctacacagaacatgcccaccaggtggtggtggccaagtatgcccccagcggcttctacatcgccagcggagatgtgtctgggaagctgcgcatctgggacaccacccagaaggagcacctgctgaagtatgagtaccagccctttgctgggaagatcaaggacatcgcctggacagaggacagcaagagaattgctgtggtgggggagggccgggagaagtttggagctgtgttcctgtgggacagcggcagctctgtgggggagatcaccggccacaacaaggtgatcaacagcgtggacatcaagcagagccggccctaccgcctggccaccggcagtgatgacaactgtgccgccttctttgagggcccccccttcaagttcaagttcaccatcggggaccacagcagatttgtgaactgtgtgcgcttctccccagatggcaacagatttgccacagccagcgcagatggccagatctacatctatgatggcaagacaggagagaaggtgtgtgccctgggcggcagcaaggcccatgatggcggcatctatgccatctcctggagcccagacagcacccacctgctgagcgccagcggggacaagaccagcaagatctgggatgtgtctgtgaacagcgtggtgtccaccttccccatgggcagcacagtgctggaccagcagctgggctgcctgtggcagaaggaccacctgctgtctgtgtccctgagcggctacatcaactacctggacaggaacaaccccagcaagcccctgcacgtgatcaagggccacagcaagagcatccagtgcctgactgtgcacaagaatggaggcaagagctacatctacagcggcagccatgatggccacatcaactactgggacagcgagactggagaaaatgacagctttgctgggaagggccacaccaaccaggtgtccaggatgacagtggatgagagcggccagctgatcagctgcagcatggatgacacagtgcgctacaccagcctgatgctgcgggactacagcggccagggcgtggtgaagctggatgtgcagcccaagtgtgtggccgtgggccctgggggctatgctgtggtggtgtgcatcggccagatcgtgctgctgaaggaccagaggaagtgcttcagcattgacaaccctggctatgagcctgaggtggtggccgtgcaccctggaggagacacagtggccatcggcggcgtggatggaaatgtgcggctgtacagcatcctgggcaccaccctgaaggatgagggcaagctgctggaggccaagggccctgtgacagatgtggcctacagccatgatggagccttcctggccgtgtgtgatgccagcaaggtggtgaccgtcttctctgtggctgatggctacagcgagaacaacgtgttctacggccaccacgccaagatcgtgtgcctggcctggagcccagacaatgagcactttgccagcggcggcatggacatgatggtgtatgtgtggaccctgagtgaccctgagaccagggtgaagatccaggatgcccaccggctgcaccacgtgagcagcctggcctggctggatgagcacaccctggtgaccaccagccatgatgcctctgtgaaggagtggaccatcacctactag

SEQ ID NO: 175989 - DNA, 1326 bp, Artificial Sequence
  Description of Artificial Sequence: Synthetic coding sequence
atgctgacctgggtgtggtacctgatcatgacctctgtgctgcaggcctctgtgtcctctgtggaccacagcagatttgtgaactgtgtgcgcttctccccagatggcaacagatttgccacagccagcgcagatggccagatctacatctatgatggcaagacaggagagaaggtgtgtgccctgggcggcagcaaggcccatgatggcggcatctatgccatctcctggagcccagacagcacccacctgctgagcgccagcggggacaagaccagcaagatctgggatgtgtctgtgaacagcgtggtgtccaccttccccatgggcagcacagtgctggaccagcagctgggctgcctgtggcagaaggaccacctgctgtctgtgtccctgagcggctacatcaactacctggacaggaacaaccccagcaagcccctgcacgtgatcaagggccacagcaagagcatccagtgcctgactgtgcacaagaatggaggcaagagctacatctacagcggcagccatgatggccacatcaactactgggacagcgagaccggggagaatgacagctttgctgggaagggccacaccaaccaggtgtccaggatgacagtggatgaaagtggccagctgatcagctgcagcatggatgacacagtgcgctacaccagcctgatgctgcgggactacagcggccagggcgtggtgaagctggatgtgcagcccaagtgtgtggccgtgggccctgggggctatgctgtggtggtgtgcatcggccagatcgtgctgctgaaggaccagaggaagtgcttcagcattgacaaccctggctatgagcctgaggtggtggccgtgcaccctggaggagacacagtggccatcggcggcgtggatggaaatgtgcggctgtacagcatcctgggcaccaccctgaaggatgagggcaagctgctggaggccaagggccctgtgacagatgtggcctacagccatgatggagccttcctggccgtgtgtgatgccagcaaggtggtgacagtgttttctgtggctgatggctacagtgaaaataatgtgttctacggccaccacgccaagatcgtgtgcctggcctggagcccagacaatgagcactttgccagcggcggcatggacatgatggtgtatgtgtggaccctgagtgaccctgagaccagggtgaagatccaggatgcccaccggctgcaccacgtgagcagcctggcctggctggatgagcacaccctggtgaccaccagccatgatgcctctgtgaaggagtggaccatcacctactag

SEQ ID NO: 175990 - DNA, 531 bp, Artificial Sequence
  Description of Artificial Sequence: Synthetic coding sequence
ccagctgagacagagaaggtgtttgccagcctgccccaggtggagcggggcgtgtccaagatcatcggcggggaccccaagggcaacaacttcctgtacaccaatggaaaatgtgtgatcctgaggaacattgatgaccacagcagatttgtgaactgtgtgcgcttctccccagatggcaacagatttgccacagccagcgcagatggccagtgcctgcctgcccctgtgacagcccagagccggcggctgcccaatgccagcccagacatgcagaacctggacatcgccctgcccaccagcgctgacagcagcagcgagcccaagccccagagcatggagaagctgcccccctggagcgcccacttcccctgggccccccgcttctggaccagctcctgggccgcctatggaagaaggaccacctgcagcgtgagcccctgccccggcaccagcaccatctggacagagaccaccccagccagcccctgcaccagcagccgggtgacagtgaacagaagctctgtgtag

SEQ ID NO: 175991 - DNA, 1821 bp, Artificial Sequence; identical to SEQ ID NO: 175988
  Description of Artificial Sequence: Synthetic coding sequence

SEQ ID NO: 175992 - DNA, 1401 bp, Artificial Sequence; identical to SEQ ID NO: 175987
  Description of Artificial Sequence: Synthetic coding sequence

SEQ ID NO: 175993 - DNA, 3675 bp, Artificial Sequence
  Description of Artificial Sequence: Synthetic coding sequence
atgctgccctacacagtgaacttcaaggtgtctgcccggaccctgaccggggccctgaatgcccacaacaaggctgctgtggactggggctggcagggcctgattgcctacggctgccacagcctggtggtggtgattgacagcatcacagcccagaccctgcaggtgctggagaagcacaaggcagatgtggtgaaggtgaagtgggcccgggagaactaccaccacaacatcggcagcccctactgcctgcggctggccagcgcagatgtgaatggcaagatcatcgtgtgggatgtggccgccggcgtggcccagtgtgagatccaggagcacgccaagcccatccaggatgtgcagtggctgtggaaccaggatgccagccgggacctgctgctggccatccacccccccaactacatcgtgctgtggaatgctgacaccggcaccaagctgtggaagaagagctatgctgacaacatcctgtccttctcctttgacccctttgaccccagccacctgaccctgctgaccagcgagggcatcgtgttcatcagtgacttcagccccagcaagcccccatctggccctgggaagaaggtgtacatcagcagcccccacagcagccctgcccacaacaagctggccacagccactggagccaagaaggccctgaacaaggtgaagatcctgatcacccaggagaagcccagcgctgagttcatcaccctgaatgactgcctgcagctggcctacctgcccagcaagaggaaccacatgctgctgctgtacccccgggagatcctgatcctggacctggaggtgaaccagacagtgggcgtcatcgccatcgagaggactggagtgcccttcctgcaggtgatcccctgcttccagagagatggcctcttctgcctgcatgaaaatggctgcatcaccctgcgggtgagaagaagctacaacaacatcttcaccaccagcaatgaggagccagaccctgaccctgtgcaggagctgacctatgacctgcggagccagtgtgatgccatccgggtgaccaagacagtgcggcccttctccatggtgtgctgccctgtgaatgaaaatgctgctgccctggtggtgtctgatggccgggtgatgatctgggagctgaagtctgctgtgtgcaacagaaacagcaggaacagcagcagtggagtgagccccctgtacagccctgtgtccttctgtggcatccctgtgggcgtgctgcagaacaagctgcctgacctgagcctggacaacatgattggccagagcgccatcgccggggaggagcacccccggggcagcatcctgcgggaggtgcacctgaagttcctgctgaccggcctgctgagcggcctgcctgccccccagtttgccatccgcatgtgcccccccctgaccaccaagaacatcaagatgtaccagcccctgctggccgtgggcaccagcaatggatctgtgctggtgtaccacctgaccagcggcctgctgcacaaggagctgagcatccacagctgtgaggtgaagggcatcgagtggaccagcctgaccagcttcctgagctttgccaccagcacccccaacaacatgggcctggtgagaaatgagctgcagctggtggacctgcccaccggccgcagcatcgccttccggggggagagaggaaatgatgaaagtgccatcgagatgatcaaggtgagccacctgaagcagtacctggccgtggtgttccgggacaagcccctggagctgtgggatgtgaggacctgcaccctgctgcgggagatgagcaagaacttccccaccatcacagccctggagtggagccccagccacaacctgaagagcctgaggaagaagcagctggccacccgggaggccatggcccggcagacagtggtgtctgacacagagctgagcatcgtggagagcagcgtcatcagcctgctgcaggaggccgagagcaagtctgagctgagccagaacatcagcgcccgggagcactttgtgttcacagacattgatggccaggtgtaccacctgactgtggagggcaacagcgtgaaggacagcgcccgcatccccccagatggctccatgggcagcatcacctgcatcgcctggaagggggacaccctggtgctgggggacatggatggcaacctgaacttctgggacctgaagggccgggtgtcccggggcatccccacccaccgctcctgggtgaggaagatccgctttgcccctggaaaaggaaaccagaagctgattgccatgtacaatgatggagctgaggtgtgggacaccaaggaggtgcagatggtgagcagcctgcggagcggcagaaatgtgaccttccgcatcctggatgtggactggtgcaccagtgacaaggtgatcctggccagtgatgatggctgcatccgggtgctggagatgtccatgaagagcgcctgcttcaggatggatgagcaggagctgacagagcctgtgtggtgcccctacctgctggtgccccgggccagcctggccctgaaggccttcctgctgcaccagccctggaatggccagtacagcctggacatcagccacgtggactacccagaaaatgaggagatcaagaacctgctgcaggagcagctgaacagcctgagcaatgacatcaagaagctgctgctggaccctgagttcaccctgctgcagcgctgcctgctggtgtcccggctgtatggagatgagagcgagctgcacttctggacagtggccgcccactacctgcacagcctgagccaggagaagagcgccagcaccacagcccccaaggaggccgccccccgggacaagctgagcaaccccctggacatctgctatgatgtgctgtgtgaaaatgcctacttccagaagttccagctggagcgggtgaacctgcaggaggtgaagaggagcacctatgaccacaccaggaaatgtacagaccagctgctgctgctgggccagacagacagagctgtgcagctgctgctggagaccagcgctgacaaccagcactactactgtgacagcctgaaggcctgcctggtgaccaccgtgaccagcagcggccccagccagagcaccatcaagctggtggccaccaacatgattgccaacgggaagctggccgagggcgtgcagctgctgtgcctgattgacaaggctgctgatgcctgccgctacctgcagacctacggggagtggaacagagctgcctggctggccaaggtgcggctgaaccctgaggagtgtgctgatgtgctgcggcgctgggtggaccacctgtgcagcccccaggtgaaccagaagagcaaggccctgctggtgctgctgagcctgggctgcttcttctctgtggccgagaccctgcacagcatgagatactttgacagagctgccctgtttgtggaggcctgcctgaagtatggagcctttgaggtgacagaggacacagagaagctgatcacagccatctatgctgactatgcccggagcctgaagaacctgggcttcaagcagggcgctgtgctgtttgccagcaaggccggggccgccggcaaggacctgctgaatgagctggagagccccaaggaggagcccatcgaggagtag

SEQ ID NO: 175994 - DNA, 1371 bp, Artificial Sequence; identical to SEQ ID NO: 147473
  Description of Artificial Sequence: Synthetic coding sequence

SEQ ID NO: 175995 - DNA, 1458 bp, Artificial Sequence; identical to SEQ ID NO: 163030
  Description of Artificial Sequence: Synthetic coding sequence

SEQ ID NO: 175996 - DNA, 1893 bp, Artificial Sequence
  Description of Artificial Sequence: Synthetic coding sequence
atggaggccgtggtgctgccctggcagatctttggagtgcgggagctgcctgtggagcggggcgtgaccatgaagggccccaggctcttccgggcccctggccacgtgcccaccggcctgaagtgccacccagaccaggagcacatgatctaccccctgggctgcaccgtgctgatccaggccatcaacaccaaggagcagaacttcctgcagggccacggcaacaacgtgtcctgcctggccatcagccgctctggagagtacatcgccagcggccaggtgaccttcatgggcttcaaggctgacatcatcctgtgggactacaagaaccgggagctgctggcccggctgagcctgcacaagggcaagattgaggccctggccttcagccccaatgacctgtacctggtgtccctgggcggcccagatgatggctctgtggtggtgtggagcatcgccaagagagatgccatctgtggcagccctgctgctggcctgaatgtgggcaatgccaccaacgtcatcttcagccgctgcagagatgagatgttcatgacagctggaaatggcaccatccgggtgtgggagctggacctgcccaacaggaagatctggcccacagagtgccagacaggccagctgaagagaattgtgatgagcattggagtggatgatgatgacagcttcttctacctgggcaccaccaccggggacatcctgaagatgaaccccaggaccaagctgctgacagatgtgggccctgccaaggacaagttcagcctgggcgtgtctgccatccgctgcctgaagatgggcggcctgctggtgggcagcggggccggcctgctggtgttctgcaagagccctggctacaagcccatcaagaagatccagctgcagggcggcatcaccagcatcaccctgcggggggagggccaccagttcctggtgggcacagaggagagccacatctacagagtgtccttcacagacttcaaggagaccctgattgccacctgccactttgatgctgtggaggacatcgtgttccccttcggcacagctgagctgtttgccacctgtgccaagaaggacatccgggtgtggcacaccagcagcaaccgggagctgctgcgcatcaccgtgcccaacatgacctgccacggcatcgacttcatgagagatggcaagagcatcatcagcgcctggaatgatggcaagatccgggcctttgcccctgagaccggccgcctgatgtatgtgatcaacaatgcccaccgcatcggcgtgacagccatcgccaccaccagtgactgcaagagggtcatcagcggcggcggggagggggaggtgcgggtgtggcagatcggctgccagacccagaagctggaggaggccctgaaggagcacaagagctctgtgtcctgcatccgggtgaagagaaataatgaagaatgtgtgacagccagcacagatggcacctgcatcatctgggacctggtgcggctgcggaggaaccagatgatcctggccaacaccctcttccagtgtgtgtgctaccaccctgaggagttccagatcatcaccagcggcacagacaggaagatcgcctactgggaggtgtttgatggcaccgtcatccgggagctggagggcagcctgagcggcagcatcaatggcatggacatcacccaggagggcgtgcactttgtgactggaggaaatgaccacctggtgaaggtgtgggactacaatgaaggagaggtgacccacgtgggcgtgggccacagcggcaacatcacccgcatccgcatcagccctggcaaccagtacatcgtgtctgtgtctgcagatggagccatcctgcgctggaagtacccctacaccagctag

SEQ ID NO: 175997 - DNA, 1863 bp, Artificial Sequence
  Description of Artificial Sequence: Synthetic coding sequence
atggacaacaagatcagccctgaggcccaggtggccgagctggagctggatgctgtgattggcttcaatggacatgtgcccaccggcctgaagtgccacccagaccaggagcacatgatctaccccctgggctgcaccgtgctgatccaggccatcaacaccaaggagcagaacttcctgcagggccacggcaacaacgtgtcctgcctggccatcagccgctctggagagtacatcgccagcggccaggtgaccttcatgggcttcaaggctgacatcatcctgtgggactacaagaaccgggagctgctggcccggctgagcctgcacaagggcaagattgaggccctggccttcagccccaatgacctgtacctggtgtccctgggcggcccagatgatggctctgtggtggtgtggagcatcgccaagagagatgccatctgtggcagccctgctgctggcctgaatgtgggcaatgccaccaacgtcatcttcagccgctgcagagatgagatgttcatgacagctggaaatggcaccatccgggtgtgggagctggacctgcccaacaggaagatctggcccacagagtgccagacaggccagctgaagagaattgtgatgagcattggagtggatgatgatgacagcttcttctacctgggcaccaccaccggggacatcctgaagatgaaccccaggaccaagctgctgacagatgtgggccctgccaaggacaagttcagcctgggcgtgtctgccatccgctgcctgaagatgggcggcctgctggtgggcagcggggccggcctgctggtgttctgcaagagccctggctacaagcccatcaagaagatccagctgcagggcggcatcaccagcatcaccctgcggggggagggccaccagttcctggtgggcacagaggagagccacatctacagagtgtccttcacagacttcaaggagaccctgattgccacctgccactttgatgctgtggaggacatcgtgttccccttcggcacagctgagctgtttgccacctgtgccaagaaggacatccgggtgtggcacaccagcagcaaccgggagctgctgcgcatcaccgtgcccaacatgacctgccacggcatcgacttcatgagagatggcaagagcatcatcagcgcctggaatgatggcaagatccgggcctttgcccctgagaccggccgcctgatgtatgtgatcaacaatgcccaccgcatcggcgtgacagccatcgccaccaccagtgactgcaagagggtcatcagcggcggcggggagggggaggtgcgggtgtggcagatcggctgccagacccagaagctggaggaggccctgaaggagcacaagagctctgtgtcctgcatccgggtgaagagaaataatgaagaatgtgtgacagccagcacagatggcacctgcatcatctgggacctggtgcggctgcggaggaaccagatgatcctggccaacaccctcttccagtgtgtgtgctaccaccctgaggagttccagatcatcaccagcggcacagacaggaagatcgcctactgggaggtgtttgatggcaccgtcatccgggagctggagggcagcctgagcggcagcatcaatggcatggacatcacccaggagggcgtgcactttgtgactggaggaaatgaccacctggtgaaggtgtgggactacaatgaaggagaggtgacccacgtgggcgtgggccacagcggcaacatcacccgcatccgcatcagccctggcaaccagtacatcgtgtctgtgtctgcagatggagccatcctgcgctggaagtacccctacaccagctag

SEQ ID NO: 175998 - DNA, 1659 bp, Artificial Sequence
  Description of Artificial Sequence: Synthetic coding sequence
atggacaacaagatcagccctgaggcccaggtggccgagctggagctggatgctgtgattggcttcaatgacatcatcctgtgggactacaagaaccgggagctgctggcccggctgagcctgcacaagggcaagattgaggccctggccttcagccccaatgacctgtacctggtgtccctgggcggcccagatgatggctctgtggtggtgtggagcatcgccaagagagatgccatctgtggcagccctgctgctggcctgaatgtgggcaatgccaccaacgtcatcttcagccgctgcagagatgagatgttcatgacagctggaaatggcaccatccgggtgtgggagctggacctgcccaacaggaagatctggcccacagagtgccagacaggccagctgaagagaattgtgatgagcattggagtggatgatgatgacagcttcttctacctgggcaccaccaccggggacatcctgaagatgaaccccaggaccaagctgctgacagatgtgggccctgccaaggacaagttcagcctgggcgtgtctgccatccgctgcctgaagatgggcggcctgctggtgggcagcggggccggcctgctggtgttctgcaagagccctggctacaagcccatcaagaagatccagctgcagggcggcatcaccagcatcaccctgcggggggagggccaccagttcctggtgggcacagaggagagccacatctacagagtgtccttcacagacttcaaggagaccctgattgccacctgccactttgatgctgtggaggacatcgtgttccccttcggcacagctgagctgtttgccacctgtgccaagaaggacatccgggtgtggcacaccagcagcaaccgggagctgctgcgcatcaccgtgcccaacatgacctgccacggcatcgacttcatgagagatggcaagagcatcatcagcgcctggaatgatggcaagatccgggcctttgcccctgagaccggccgcctgatgtatgtgatcaacaatgcccaccgcatcggcgtgacagccatcgccaccaccagtgactgcaagagggtcatcagcggcggcggggagggggaggtgcgggtgtggcagatcggctgccagacccagaagctggaggaggccctgaaggagcacaagagctctgtgtcctgcatccgggtgaagagaaataatgaagaatgtgtgacagccagcacagatggcacctgcatcatctgggacctggtgcggctgcggaggaaccagatgatcctggccaacaccctcttccagtgtgtgtgctaccaccctgaggagttccagatcatcaccagcggcacagacaggaagatcgcctactgggaggtgtttgatggcaccgtcatccgggagctggagggcagcctgagcggcagcatcaatggcatggacatcacccaggagggcgtgcactttgtgactggaggaaatgaccacctggtgaaggtgtgggactacaatgaaggagaggtgacccacgtgggcgtgggccacagcggcaacatcacccgcatccgcatcagccctggcaaccagtacatcgtgtctgtgtctgcagatggagccatcctgcgctggaagtacccctacaccagctag

SEQ ID NO: 175999 - DNA, 3969 bp, Artificial Sequence
  Description of Artificial Sequence: Synthetic coding sequence
atggcctggatgacctacatcagcaactggtttgagcaggatgactggtatgagggcctgcagagggccaacatgagccaggtgcggcaggtgggcctgctggccgccggctgccagccctggaacaaggatgtgtgtgccgccagcggggacagatttgcctactgtgccaccctggccatctacatctaccagctggaccaccgctacaatgagttcaagctgcacgccatcatgtctgagcacaagaagaccatcacagccatctcctggtgcccccacaacccagacctgtttgccagcggcagcacagacaacctggtgatcatctggaatgtggccgagcagaaggtgattgccaagctggacagcaccaagggcatcccagccagcctgtcctggtgctggaatgcagaagatgtggtggcctttgtgagccaccggggccccctcttcatctggaccatcagcggcccagattctggagtcatcgtgcacaaggatgcccacagcttcctgagtgacatctgcatgttccgctggcacacccaccagaagggcaaggtggtgtttggccacattgatggcagcctgagcatcttccaccctggcaacaagaaccagaagcacgtgctgcggcctgagagcctggagggcacagatgaagaagatcctgtgacagccctggagtgggaccccctgagcacagactacctgctggtggtgaacctgcactacggcatccggctggtggacagcgagagcctgagctgcatcaccaccttcaacctgcccagcgctgctgcctctgtgcagtgcctggcctgggtgcccagcgcccctggcatgttcatcaccggggacagccaggtgggcgtgctgcgcatctggaatgtgtccaggaccacccccatcgacaacctgaagctgaagaagacaggcttccactgcctgcacgtgctgaacagcccccccaggaagaagttctctgtgcagagccccaccaagaaccactacaccagcagcaccagcgaggccgtgcccccacccaccctgacccagaaccaggccttcagcctgcccccaggccatgctgtgtgctgcttcctggatggaggagtgggcctgtatgacatgggcgccaagaagtgggacttcctgcgggacctgggccacgtggagaccatctttgactgcaagttcaagccagatgaccccaacctgctggccacagccagctttgatggcaccatcaaggtgtgggacatcaacaccctgacagctgtgtacaccagccctggaaatgaaggagtcatctacagcctgtcctgggcccctgggggcctgaactgcatcgccggcggcaccagcagaaatggagccttcatctggaatgtgcagaagggcaagatcatccagcgcttcaatgagcacggcaccaacggcatcttctgcatcgcctggagccacaaggacagcaagagaattgccacctgcagcagtgatggcttctgcatcatccgcaccattgatggcaaggtgctgcacaagtacaagcaccctgctgctgtgtttggctgtgactggagccagaacaacaaggacatgattgccaccggctgtgaggacaccaacgtgcgggtgtactacgtggccaccagcagtgaccagcccctgaaggtgttttctggccacacagccaaggtgttccacgtgaagtggagccccctgcgggagggcatcctgtgcagcggcagtgatgatggcaccgtgcgcatctgggactacacccaggatgcctgcatcaacatcctgaatggccacacagcccctgtgcggggcctgatgtggaacacagagatcccctacctgctgatcagcggctcctgggactacaccatcaaggtgtgggacacccgggagggcacctgtgtggacacagtgtatgaccatggagcagatgtgtatggcctgacctgccaccccagccggcccttcaccatggccagctgcagccgggacagcacagtgcggctgtggagcctgacagccctggtgacccctgtgcagatcaacatcctggccgaccgctcctgggaggagatcatcggcaacacagattatgccatcgagcccggcaccccacccctgctgtgtgggaaggtgtcccgggacatccggcaggagattgagaagctgacagccaacagccaggtgaagaagctgcgctggttctctgaatgtctgagccccccaggcggcagtgacaacctgtggaacctggtggccgtcatcaagggccaggatgacagcctgctgccccagaactactgcaagggcatcatgcacctgaagcacctgatcaagttccgcaccagcgaggcccaggagctgaccaccgtgaagatgagcaagtttggaggcggcatcggcgtgcctgccaaggaggagcggctgaaggaggccgctgagatccacctgcggctgggccagatccagcgctactgtgagctgatggtggagctgggggagtgggacaaggccctgagcatcgcccctggggtgtctgtgaagtactggaagaagctgatgcagaggagagctgaccagctgatccaggaggacaaggatgatgtgatcccctactgcatcgccatcggagatgtgaagaagctggtgcacttcttcatgagccggggccagctgaaggaggccctgctggtggcccaggccgcctgtgagggcaacatgcagcccctgcacgtgtctgtgcccaagggggccagctacagtgatgacatctacaaggaggacttcaatgagctgctgcacaaggtgtccaaggagctggccgagtggtacttccaggacggccgggctgtgctggccgcctgctgccacctggccatcgacaacatcgagctggccatggcctacctgatcagaggaaatgagctggagctggccgtgtgtgtgggcaccgtgctgggggagagcgctgccccagccacccactacgccctggagctgctggccaggaagtgcatgatgatctctgtgtgcttcccctgtgtgggctacagcgtgcccttctgctacgtgaacagaaacctggccgctgacctgctgctgatgatcccagacaatgagctgcacctgatcaagctgtgtgccttctacccaggctgcacagaggagatcaatgacctgcatgacaagtgcaagctgcccaccgtggaggagtgcatgcagctggccgagacagcccgggcagatgacaacatctttgagaccgtgaagtactacctgctgagccaggagcctgagaaggccctgcccatcggcatcagctttgtgaaggagtacatcagcagcagtgactggaccctggacaccatctaccctgtgctggacctgctgagctacatcagaacagagaagctgctgctgcacacctgcacagaggccagaaatgagctgctgatcctgtgtggctacatcggggccctgctggccatccggcggcagtaccagagcatcgtgcctgccctgtatgagtacaccagccagctgctgaagaggcgggaggtgtctgtgcccctgaagattgagtacctgtctgaggagctggatgcctggagggcctgcacccagagcaccaacagaagcctggaggacagcccctacaccccacccagcgacagccagaggatgatctatgccaccctgctgaagaggctgaaggaggagagcctgaagggcatcatcggccctgactatgtgacaggcagcaacctgcccagccacagcgacatccacatcagctgcctgaccggcctgaagatccagggccctgtgttcttcctggaggatggcaagagcgccatcagcctgaatgatgccctgatgtgggccaaggtgaaccccttcagccccctgggcaccggcatccggctgaaccccttctag

SEQ ID NO: 176000 - DNA, 393 bp, Artificial Sequence
  Description of Artificial Sequence: Synthetic coding sequence
atgagccaggtgcggcaggtgggcctgctggccgccggctgccagccctggaacaaggatgtgtgtgccgccagcggggacagatttgcctactgtgccaccctggccatctacatctaccagctggaccaccgctacaatgagttcaagctgcacgccatcatgtctgagcacaagaagaccatcacagccatctcctggtgcccccacaacccagacctgtttgccagcggcagcacagacaacctggtgatcatctggaatgtggccgagcagaaggtgattgccaagctggaccgggcccggccccccagccccaagatcatctacatcaagatcatcaacatcatcgaggagaacatccacaacagcgagatgcagtggatcatctag

SEQ ID NO: 176001 - DNA, 3897 bp, Artificial Sequence
  Description of Artificial Sequence: Synthetic coding sequence
atgagccaggtgcggcaggtgggcctgctggccgccggctgccagccctggaacaaggatgtgtgtgccgccagcggggacagatttgcctactgtgccaccctggccatctacatctaccagctggaccaccgctacaatgagttcaagctgcacgccatcatgtctgagcacaagaagaccatcacagccatctcctggtgcccccacaacccagacctgtttgccagcggcagcacagacaacctggtgatcatctggaatgtggccgagcagaaggtgattgccaagctggacagcaccaagggcatcccagccagcctgtcctggtgctggaatgcagaagatgtggtggcctttgtgagccaccggggccccctcttcatctggaccatcagcggcccagattctggagtcatcgtgcacaaggatgcccacagcttcctgagtgacatctgcatgttccgctggcacacccaccagaagggcaaggtggtgtttggccacattgatggcagcctgagcatcttccaccctggcaacaagaaccagaagcacgtgctgcggcctgagagcctggagggcacagatgaagaagatcctgtgacagccctggagtgggaccccctgagcacagactacctgctggtggtgaacctgcactacggcatccggctggtggacagcgagagcctgagctgcatcaccaccttcaacctgcccagcgctgctgcctctgtgcagtgcctggcctgggtgcccagcgcccctggcatgttcatcaccggggacagccaggtgggcgtgctgcgcatctggaatgtgtccaggaccacccccatcgacaacctgaagctgaagaagacaggcttccactgcctgcacgtgctgaacagcccccccaggaagaagttctctgtgcagagccccaccaagaaccactacaccagcagcaccagcgaggccgtgcccccacccaccctgacccagaaccaggccttcagcctgcccccaggccatgctgtgtgctgcttcctggatggaggagtgggcctgtatgacatgggcgccaagaagtgggacttcctgcgggacctgggccacgtggagaccatctttgactgcaagttcaagccagatgaccccaacctgctggccacagccagctttgatggcaccatcaaggtgtgggacatcaacaccctgacagctgtgtacaccagccctggaaatgaaggagtcatctacagcctgtcctgggcccctgggggcctgaactgcatcgccggcggcaccagcagaaatggagccttcatctggaatgtgcagaagggcaagatcatccagcgcttcaatgagcacggcaccaacggcatcttctgcatcgcctggagccacaaggacagcaagagaattgccacctgcagcagtgatggcttctgcatcatccgcaccattgatggcaaggtgctgcacaagtacaagcaccctgctgctgtgtttggctgtgactggagccagaacaacaaggacatgattgccaccggctgtgaggacaccaacgtgcgggtgtactacgtggccaccagcagtgaccagcccctgaaggtgttttctggccacacagccaaggtgttccacgtgaagtggagccccctgcgggagggcatcctgtgcagcggcagtgatgatggcaccgtgcgcatctgggactacacccaggatgcctgcatcaacatcctgaatggccacacagcccctgtgcggggcctgatgtggaacacagagatcccctacctgctgatcagcggctcctgggactacaccatcaaggtgtgggacacccgggagggcacctgtgtggacacagtgtatgaccatggagcagatgtgtatggcctgacctgccaccccagccggcccttcaccatggccagctgcagccgggacagcacagtgcggctgtggagcctgacagccctggtgacccctgtgcagatcaacatcctggccgaccgctcctgggaggagatcatcggcaacacagattatgccatcgagcccggcaccccacccctgctgtgtgggaaggtgtcccgggacatccggcaggagattgagaagctgacagccaacagccaggtgaagaagctgcgctggttctctgaatgtctgagccccccaggcggcagtgacaacctgtggaacctggtggccgtcatcaagggccaggatgacagcctgctgccccagaactactgcaagggcatcatgcacctgaagcacctgatcaagttccgcaccagcgaggcccaggagctgaccaccgtgaagatgagcaagtttggaggcggcatcggcgtgcctgccaaggaggagcggctgaaggaggccgctgagatccacctgcggctgggccagatccagcgctactgtgagctgatggtggagctgggggagtgggacaaggccctgagcatcgcccctggggtgtctgtgaagtactggaagaagctgatgcagaggagagctgaccagctgatccaggaggacaaggatgatgtgatcccctactgcatcgccatcggagatgtgaagaagctggtgcacttcttcatgagccggggccagctgaaggaggccctgctggtggcccaggccgcctgtgagggcaacatgcagcccctgcacgtgtctgtgcccaagggggccagctacagtgatgacatctacaaggaggacttcaatgagctgctgcacaaggtgtccaaggagctggccgagtggtacttccaggacggccgggctgtgctggccgcctgctgccacctggccatcgacaacatcgagctggccatggcctacctgatcagaggaaatgagctggagctggccgtgtgtgtgggcaccgtgctgggggagagcgctgccccagccacccactacgccctggagctgctggccaggaagtgcatgatgatctctgtgtgcttcccctgtgtgggctacagcgtgcccttctgctacgtgaacagaaacctggccgctgacctgctgctgatgatcccagacaatgagctgcacctgatcaagctgtgtgccttctacccaggctgcacagaggagatcaatgacctgcatgacaagtgcaagctgcccaccgtggaggagtgcatgcagctggccgagacagcccgggcagatgacaacatctttgagaccgtgaagtactacctgctgagccaggagcctgagaaggccctgcccatcggcatcagctttgtgaaggagtacatcagcagcagtgactggaccctggacaccatctaccctgtgctggacctgctgagctacatcagaacagagaagctgctgctgcacacctgcacagaggccagaaatgagctgctgatcctgtgtggctacatcggggccctgctggccatccggcggcagtaccagagcatcgtgcctgccctgtatgagtacaccagccagctgctgaagaggcgggaggtgtctgtgcccctgaagattgagtacctgtctgaggagctggatgcctggagggcctgcacccagagcaccaacagaagcctggaggacagcccctacaccccacccagcgacagccagaggatgatctatgccaccctgctgaagaggctgaaggaggagagcctgaagggcatcatcggccctgactatgtgacaggcagcaacctgcccagccacagcgacatccacatcagctgcctgaccggcctgaagatccagggccctgtgttcttcctggaggatggcaagagcgccatcagcctgaatgatgccctgatgtgggccaaggtgaaccccttcagccccctgggcaccggcatccggctgaaccccttctag

SEQ ID NO: 176002 - DNA, 3852 bp, Artificial Sequence
  Description of Artificial Sequence: Synthetic coding sequence
atgagccaggtgcggcaggtgggcctgctggccgccggctgccagccctggaacaaggatgtgtgtgccgccagcggggacagatttgcctactgtgccaccctggccatctacatctaccagctggaccaccgctacaatgagttcaagctgcacgccatcatgtctgagcacaagaagaccatcacagccatctcctggtgcccccacaacccagacctgtttgccagcggcagcacagacaacctggtgatcatctggaatgtggccgagcagaaggtgattgccaagctggacagcaccaagggcatcccagccagcctgtcctggtgctggaatgcagaagatgtggtggcctttgtgagccaccggggccccctcttcatctggaccatcagcggcccagattctggagtcatcgtgcacaaggatgcccacagcttcctgagtgacatctgcatgttccgctggcacacccaccagaagggcaaggtggtgtttggccacattgatggcagcctgagcatcttccaccctggcaacaagaaccagaagcacgtgctgcggcctgagagcctggagggcacagatgaagaagatcctgtgacagccctggagtgggaccccctgagcacagactacctgctggtggtgaacctgcactacggcatccggctggtggacagcgagagcctgagctgcatcaccaccttcaacctgcccagcgctgctgcctctgtgcagtgcctggcctgggtgcccagcgcccctggcatgttcatcaccggggacagccaggtgggcgtgctgcgcatctggaatgtgtccaggaccacccccatcgacaacctgaagctgaagaagacaggcttccactgcctgcacgtgctgaacagcccccccaggaagaagttctctgtgcagagccccaccaagaaccactacaccagcagcaccagcgaggccgtgcccccacccaccctgacccagaaccaggccttcagcctgcccccaggccatgctgtgtgctgcttcctggatggaggagtgggcctgtatgacatgggcgccaagaagtgggacttcctgcgggacctgggccacgtggagaccatctttgactgcaagttcaagccagatgaccccaacctgctggccacagccagctttgatggcaccatcaaggtgtgggacatcaacaccctgacagctgtgtacaccagccctggaaatgaaggagtcatctacagcctgtcctgggcccctgggggcctgaactgcatcgccggcggcaccagcagaaatggagccttcatctggaatgtgcagaagggcaagatcatccagcgcttcaatgagcacggcaccaacggcatcttctgcatcgcctggagccacaaggacagcaagagaattgccacctgcagcagtgatggcttctgcatcatccgcaccattgatggcaaggtgctgcacaagtacaagcaccctgctgctgtgtttggctgtgactggagccagaacaacaaggacatgattgccaccggctgtgaggacaccaacgtgcgggtgtactacgtggccaccagcagtgaccagcccctgaaggtgttttctggccacacagccaaggtgttccacgtgaagtggagccccctgcgggagggcatcctgtgcagcggcagtgatgatggcaccgtgcgcatctgggactacacccaggatgcctgcatcaacatcctgaatggccacacagcccctgtgcggggcctgatgtggaacacagagatcccctacctgctgatcagcggctcctgggactacaccatcaaggtgtgggacacccgggagggcacctgtgtggacacagtgtatgaccatggagcagatgtgtatggcctgacctgccaccccagccggcccttcaccatggccagctgcagccgggacagcacagtgcggctgtggagcctgacagccctggtgacccctgtgcagatcaacatcctggccgaccgctcctgggaggagatcatcggcaacacagattatgccatcgagcccggcaccccacccctgctgtgtgggaaggtgtcccgggacatccggcaggagattgagaagctgacagccaacagccaggtgaagaagctgcgctggttctctgaatgtctgagccccccaggcggcagtgacaacctgtggaacctggtggccgtcatcaagggccaggatgacagcctgctgccccagaactactgcaagggcatcatgcacctgaagcacctgatcaagttccgcaccagcgaggcccaggagctgaccaccgtgaagatgagcaagtttggaggcggcatcggcgtgcctgccaaggaggagcggctgaaggaggccgctgagatccacctgcggctgggccagatccagcgctactgtgagctgatggtggagctgggggagtgggacaaggccctgagcatcgcccctggggtgtctgtgaagtactggaagaagctgatgcagaggagagctgaccagctgatccaggaggacaaggatgatgtgatcccctactgcatcgccatcggagatgtgaagaagctggtgcacttcttcatgagccggggccagctgaaggaggccctgctggtggcccaggccgcctgtgagggcaacatgcagcccctgcacgtgtctgtgcccaagggggccagctacagtgatgacatctacaaggaggacttcaatgagctgctgcacaaggtgtccaaggagctggccgagtggtacttccaggacggccgggctgtgctggccgcctgctgccacctggccatcgacaacatcgagctggccatggcctacctgatcagaggaaatgagctggagctggccgtgtgtgtgggcaccgtgctgggggagagcgctgccccagccacccactacgccctggagctgctggccaggaagtgcatgatgatctctgtgtggaacctggccgctgacctgctgctgatgatcccagacaatgagctgcacctgatcaagctgtgtgccttctacccaggctgcacagaggagatcaatgacctgcatgacaagtgcaagctgcccaccgtggaggagtgcatgcagctggccgagacagcccgggcagatgacaacatctttgaaacagtgaagtactacctgctgagccaggagcctgagaaggccctgcccatcggcatcagctttgtgaaggagtacatcagcagcagtgactggaccctggacaccatctaccctgtgctggacctgctgagctacatcagaacagagaagctgctgctgcacacctgcacagaggccagaaatgagctgctgatcctgtgtggctacatcggggccctgctggccatccggcggcagtaccagagcatcgtgcctgccctgtatgagtacaccagccagctgctgaagagaagagaggtgtctgtgcccctgaagattgagtacctgtctgaggagctggatgcctggagggcctgcacccagagcaccaacagaagcctggaggacagcccctacaccccacccagcgacagccagaggatgatctatgccaccctgctgaagaggctgaaggaggagagcctgaagggcatcattggaccagactatgtgacaggcagcaacctgcccagccacagcgacatccacatcagctgcctgaccggcctgaagatccagggccctgtgttcttcctggaggatggcaagagcgccatcagcctgaatgatgccctgatgtgggccaaggtgaaccccttcagccccctgggcaccggcatccggctgaaccccttctag

SEQ ID NO: 176003 - DNA, 3549 bp, Artificial Sequence
  Description of Artificial Sequence: Synthetic coding sequence
atgatcaccgtgagcaaccaggagggggacaccatccggcagacccaggtgcgctctgagcccagcaacatgcagttcttcctgatgaagatggatgacaggaccagcgctgctgagagcatgatctctgtggtgctgggcaagaagaccctcttcttcctgaacctgaatgaaccagacaacccagctgacctggagttccagcaggactttggaaacatcgtgtgctacaactggtatggagatggccgcatcatgattggcttcagctgtggccactttgtggtgatcagcacccacactggagagctgggccaggagatcttccaggccaggaaccacaaggacaacctgaccagcattgctgtgtcccagaccctgaacaaggtggccacctgtggggacaactgcatcaagatccaggacctggtggacctgaaggacatgtatgtgatcctgaacctggatgaggagaacaagggcctgggcaccctgtcctggacagatgatggccagctgctggccctgagcacccagaggggcagcctgcacgtgttcctgaccaagctgcccatcctgggagatgcctgcagcaccagaattgcctacctgaccagcctgctggaggtgacagtggccaaccctgtggagggggagctgcccatcaccgtgtctgtggatgtggagcccaactttgtggccgtgggcctgtaccacctggccgtgggcatgaacaacagagcctggttctacgtgctgggagaaaatgctgtgaagaagctgaaggacatggagtacctgggcaccgtggccagcatctgcctgcacagcgactatgctgctgccctgtttgagggcaaggtgcagctgcacctgattgaaagtgagatcctggatgcccaggaggagcgggagaccaggctcttccctgctgtggatgacaagtgccgcatcctgtgccacgccctgaccagtgacttcctgatctacggcacagacaccggggtggtgcagtacttctacatcgaggactggcagtttgtgaatgactaccgccaccctgtgtctgtgaagaagatcttcccagaccccaacggcacccggctggtgttcattgatgagaagagtgatggctttgtgtactgccctgtgaatgatgccacctatgagatcccagacttcagccccaccatcaagggcgtgctgtgggagaactggcccatggacaagggcgtcttcatcgcctatgatgatgacaaggtgtacacctacgtgttccacaaggacaccatccagggcgccaaggtgatcctggccggcagcaccaaggtgccctttgcccacaagcccctgctgctgtacaatggagagctgacctgccagacccagagcggcaaggtgaacaacatctacctgagcacccacggcttcctgagcaacctgaaggacaccggcccagatgagctgcggcccatgctggcccagaacctgatgctgaagcgcttcagtgatgcctgggagatgtgccgcatcctgaatgatgaggccgcctggaatgagctggcccgggcctgcctgcaccacatggaggtggagtttgccatccgggtgtacagaagaattggaaatgtgggcatcgtgatgagcctggagcagatcaagggcatcgaggactacaacctgctggccggccacctggccatgttcaccaatgactacaacctggcccaggacctgtacctggccagcagctgccccatcgccgccctggagatgagaagagacctgcagcactgggacagcgccctgcagctggccaagcacctggccccagaccagatccccttcatcagcaaggagtatgccatccagctggagtttgctggggactatgtgaatgccctggcccactatgagaagggcatcactggagacaacaaggagcatgatgaggcctgcctggccggcgtggcccagatgagcatccgcatgggagacatccggcggggcgtgaaccaggccctgaagcaccccagccgggtgctgaagagggactgtggggccatcctggagaacatgaagcagttcagcgaggccgcccagctgtatgagaagggcctgtactatgacaaggccgcctctgtgtacatccgcagcaagaactgggccaaggtgggggacctgctgccccacgtgagcagccccaagatccacctgcagtatgccaaggccaaggaggctgatggccgctacaaggaggccgtggtggcctatgaaaatgccaagcagtggcagagcgtcatccgcatctacctggaccacctgaacaaccctgagaaggctgtgaacatcgtgcgggagacccagagcctggatggagccaagatggtggcccgcttcttcctgcagctgggggactatggcagcgccatccagttcctggtgatgagcaagtgcaacaatgaggccttcaccctggcccagcagcacaacaagatggagatctatgctgacatcatcggcagcgaggacaccaccaatgaagactaccagagcatcgccctgtactttgaaggagagaagcgctacctgcaggccggcaagttcttcctgctgtgtggccagtacagccgggccctgaagcacttcctgaagtgccccagcagcgaggacaacgtggccatcgagatggccattgaaacagtgggccaggccaaggatgagctgctgaccaaccagctgattgaccacctgctgggagaaaatgatggcatgcccaaggatgccaagtacctgttccggctgtacatggccctgaagcagtaccgggaggccgcccagacagccatcatcatcgcccgggaggagcagagcgctggcaactacagaaatgcccatgatgtgctcttctccatgtatgcagagctgaagagccagaagatcaagatccccagcgagatggccaccaacctgatgatcctgcacagctacatcctggtgaagatccacgtgaagaatggagaccacatgaagggggccaggatgctgatccgggtggccaacaacatcagcaagttccccagccacatcgtgcccatcctgaccagcacagtgattgagtgccaccgggccggcctgaagaacagcgccttctcctttgctgccatgctgatgaggcctgagtaccgcagcaagattgatgccaagtacaagaagaagattgagggcatggtgagaagaccagacatcagcgagattgaggaggccaccaccccctgccccttctgcaagttcctgctgcctgaatgtgagctgctgtgccccggctgcaagaacagcatcccctactgcatcgccaccggccgccacatgctgaaggatgactggacagtgtgcccccactgtgacttccctgccctgtacagcgagctgaagatcatgctgaacacagagagcacctgccccatgtgcagcgagcggctgaatgctgcccagctgaagaagatcagtgactgcacccagtacctgaggacagaggaggagctgtag

SEQ ID NO: 176004 - DNA, 4029 bp, Artificial Sequence
  Description of Artificial Sequence: Synthetic coding sequence
atgaagaggatcttcagcctgctggagaagacctggctgggcgcccccatccagtttgcctggcagaagaccagcggcaactacctggccgtgactggagctgactacatcgtgaagatctttgacagacatggccagaagaggtctgagatcaacctgcccggcaactgtgtggccatggactgggacaaggatggagatgtgctggccgtgattgctgagaagagcagctgcatctacctgtgggatgccaacaccaacaagaccagccagctggacaatggcatgagggaccagatgtccttcctgctgtggagcaaggtgggcagcttcctggccgtgggcaccgtgaagggcaacctgctgatctacaaccaccagaccagcaggaagatccctgtgctgggcaagcacaccaagaggatcacctgtggctgctggaatgctgagaacctgctggccctgggcggggaggacaagatgatcaccgtgagcaaccaggagggggacaccatccggcagacccaggtgcgctctgagcccagcaacatgcagttcttcctgatgaagatggatgacaggaccagcgctgctgagagcatgatctctgtggtgctgggcaagaagaccctcttcttcctgaacctgaatgaaccagacaacccagctgacctggagttccagcaggactttggaaacatcgtgtgctacaactggtatggagatggccgcatcatgattggcttcagctgtggccactttgtggtgatcagcacccacactggagagctgggccaggagatcttccaggccaggaaccacaaggacaacctgaccagcattgctgtgtcccagaccctgaacaaggtggccacctgtggggacaactgcatcaagatccaggacctggtggacctgaaggacatgtatgtgatcctgaacctggatgaggagaacaagggcctgggcaccctgtcctggacagatgatggccagctgctggccctgagcacccagaggggcagcctgcacgtgttcctgaccaagctgcccatcctgggagatgcctgcagcaccagaattgcctacctgaccagcctgctggaggtgacagtggccaaccctgtggagggggagctgcccatcaccgtgtctgtggatgtggagcccaactttgtggccgtgggcctgtaccacctggccgtgggcatgaacaacagagcctggttctacgtgctgggagaaaatgctgtgaagaagctgaaggacatggagtacctgggcaccgtggccagcatctgcctgcacagcgactatgctgctgccctgtttgagggcaaggtgcagctgcacctgattgaaagtgagatcctggatgcccaggaggagcgggagaccaggctcttccctgctgtggatgacaagtgccgcatcctgtgccacgccctgaccagtgacttcctgatctacggcacagacaccggggtggtgcagtacttctacatcgaggactggcagtttgtgaatgactaccgccaccctgtgtctgtgaagaagatcttcccagaccccaacggcacccggctggtgttcattgatgagaagagtgatggctttgtgtactgccctgtgaatgatgccacctatgagatcccagacttcagccccaccatcaagggcgtgctgtgggagaactggcccatggacaagggcgtcttcatcgcctatgatgatgacaaggtgtacacctacgtgttccacaaggacaccatccagggcgccaaggtgatcctggccggcagcaccaaggtgccctttgcccacaagcccctgctgctgtacaatggagagctgacctgccagacccagagcggcaaggtgaacaacatctacctgagcacccacggcttcctgagcaacctgaaggacaccggcccagatgagctgcggcccatgctggcccagaacctgatgctgaagcgcttcagtgatgcctgggagatgtgccgcatcctgaatgatgaggccgcctggaatgagctggcccgggcctgcctgcaccacatggaggtggagtttgccatccgggtgtacagaagaattggaaatgtgggcatcgtgatgagcctggagcagatcaagggcatcgaggactacaacctgctggccggccacctggccatgttcaccaatgactacaacctggcccaggacctgtacctggccagcagctgccccatcgccgccctggagatgagaagagacctgcagcactgggacagcgccctgcagctggccaagcacctggccccagaccagatccccttcatcagcaaggagtatgccatccagctggagtttgctggggactatgtgaatgccctggcccactatgagaagggcatcactggagacaacaaggagcatgatgaggcctgcctggccggcgtggcccagatgagcatccgcatgggagacatccggcggggcgtgaaccaggccctgaagcaccccagccgggtgctgaagagggactgtggggccatcctggagaacatgaagcagttcagcgaggccgcccagctgtatgagaagggcctgtactatgacaaggccgcctctgtgtacatccgcagcaagaactgggccaaggtgggggacctgctgccccacgtgagcagccccaagatccacctgcagtatgccaaggccaaggaggctgatggccgctacaaggaggccgtggtggcctatgaaaatgccaagcagtggcagagcgtcatccgcatctacctggaccacctgaacaaccctgagaaggctgtgaacatcgtgcgggagacccagagcctggatggagccaagatggtggcccgcttcttcctgcagctgggggactatggcagcgccatccagttcctggtgatgagcaagtgcaacaatgaggccttcaccctggcccagcagcacaacaagatggagatctatgctgacatcatcggcagcgaggacaccaccaatgaagactaccagagcatcgccctgtactttgaaggagagaagcgctacctgcaggccggcaagttcttcctgctgtgtggccagtacagccgggccctgaagcacttcctgaagtgccccagcagcgaggacaacgtggccatcgagatggccattgaaacagtgggccaggccaaggatgagctgctgaccaaccagctgattgaccacctgctgggagaaaatgatggcatgcccaaggatgccaagtacctgttccggctgtacatggccctgaagcagtaccgggaggccgcccagacagccatcatcatcgcccgggaggagcagagcgctggcaactacagaaatgcccatgatgtgctcttctccatgtatgcagagctgaagagccagaagatcaagatccccagcgagatggccaccaacctgatgatcctgcacagctacatcctggtgaagatccacgtgaagaatggagaccacatgaagggggccaggatgctgatccgggtggccaacaacatcagcaagttccccagccacatcgtgcccatcctgaccagcacagtgattgagtgccaccgggccggcctgaagaacagcgccttctcctttgctgccatgctgatgaggcctgagtaccgcagcaagattgatgccaagtacaagaagaagattgagggcatggtgagaagaccagacatcagcgagattgaggaggccaccaccccctgccccttctgcaagttcctgctgcctgaatgtgagctgctgtgccccggctgcaagaacagcatcccctactgcatcgccaccggccgccacatgctgaaggatgactggacagtgtgcccccactgtgacttccctgccctgtacagcgagctgaagatcatgctgaacacagagagcacctgccccatgtgcagcgagcggctgaatgctgcccagctgaagaagatcagtgactgcacccagtacctgaggacagaggaggagctgtag

SEQ ID NO: 176005 - DNA, 1443 bp, Artificial Sequence
  Description of Artificial Sequence: Synthetic coding sequence
aagaggatcttcagcctgctggagaagacctggctgggcgcccccatccagtttgcctggcagaagaccagcggcaactacctggccgtgactggagctgactacatcgtgaagatctttgacagacatggccagaagaggtctgagatcaacctgcccggcaactgtgtggccatggactgggacaaggatggagatgtgctggccgtgattgctgagaagagcagctgcatctacctgtgggatgccaacaccaacaagaccagccagctggacaatggcatgagggaccagatgtccttcctgctgtggagcaaggtgggcagcttcctggccgtgggcaccgtgaagggcaacctgctgatctacaaccaccagaccagcaggaagatccctgtgctgggcaagcacaccaagaggatcacctgtggctgctggaatgctgagaacctgctggccctgggcggggaggacaagatgatcaccgtgagcaaccaggagggggacaccatccggcagacccaggtgcgctctgagcccagcaacatgcagttcttcctgatgaagatggatgacaggaccagcgctgctgagagcatgatctctgtggtgctgggcaagaagaccctcttcttcctgaacctgaatgaaccagacaacccagctgacctggagttccagcaggactttggaaatattgtgtgctacaactggtatggagatggccgcatcatgattggcttcagctgtggccactttgtggtgatcagcacccacactggagagctgggccaggagatcttccaggccaggaaccacaaggacaacctgaccagcattgctgtgtcccagaccctgaacaaggtggccacctgtggggacaactgcatcaagatccaggacctggtggacctgaaggacatgtatgtgatcctgaacctggatgaagaaaataaaggcctgggcaccctgtcctggacagatgatggccagctgctggccctgagcacccagaggggcagcctgcacgtgttcctgaccaagctgcccatcctgggagatgcctgcagcacccgcatcgcctacctgaccagcctgctggaggtgacagtggccaaccctgtggagggggagctgcccatcaccgtgtctgtggatgtggagcccaactttgtggccgtgggcctgtaccacctggccgtgggcatgaacaacagagcctggttctacgtgctgggggagaatgctgtgaagaagctgaaggacatggagtacctgggcaccgtggccagcatctgcctgcacagcgactatgctgctgccctgtttgagggcaaggtgcagctgcacctgaaggccaagtcctggatgctgaagaagaatgtgcggctgggcttcagccagcagtggatgatctctgctgtgtcctatgccatgccctag

SEQ ID NO: 176006 - DNA, 1446 bp, Artificial Sequence
  Description of Artificial Sequence: Synthetic coding sequence
atgaagaggatcttcagcctgctggagaagacctggctgggcgcccccatccagtttgcctggcagaagaccagcggcaactacctggccgtgactggagctgactacatcgtgaagatctttgacagacatggccagaagaggtctgagatcaacctgcccggcaactgtgtggccatggactgggacaaggatggagatgtgctggccgtgattgctgagaagagcagctgcatctacctgtgggatgccaacaccaacaagaccagccagctggacaatggcatgagggaccagatgtccttcctgctgtggagcaaggtgggcagcttcctggccgtgggcaccgtgaagggcaacctgctgatctacaaccaccagaccagcaggaagatccctgtgctgggcaagcacaccaagaggatcacctgtggctgctggaatgctgagaacctgctggccctgggcggggaggacaagatgatcaccgtgagcaaccaggagggggacaccatccggcagacccaggtgcgctctgagcccagcaacatgcagttcttcctgatgaagatggatgacaggaccagcgctgctgagagcatgatctctgtggtgctgggcaagaagaccctcttcttcctgaacctgaatgaaccagacaacccagctgacctggagttccagcaggactttggaaacatcgtgtgctacaactggtatggagatggccgcatcatgattggcttcagctgtggccactttgtggtgatcagcacccacactggagagctgggccaggagatcttccaggccaggaaccacaaggacaacctgaccagcattgctgtgtcccagaccctgaacaaggtggccacctgtggggacaactgcatcaagatccaggacctggtggacctgaaggacatgtatgtgatcctgaacctggatgaggagaacaagggcctgggcaccctgtcctggacagatgatggccagctgctggccctgagcacccagaggggcagcctgcacgtgttcctgaccaagctgcccatcctgggagatgcctgcagcaccagaattgcctacctgaccagcctgctggaggtgacagtggccaaccctgtggagggggagctgcccatcaccgtgtctgtggatgtggagcccaactttgtggccgtgggcctgtaccacctggccgtgggcatgaacaacagagcctggttctacgtgctgggagaaaatgctgtgaagaagctgaaggacatggagtacctgggcaccgtggccagcatctgcctgcacagcgactatgctgctgccctgtttgagggcaaggtgcagctgcacctgaaggccaagtcctggatgctgaagaagaatgtgcggctgggcttcagccagcagtggatgatctctgctgtgtcctatgccatgccctag

SEQ ID NO: 176007 - DNA, 2832 bp, Artificial Sequence
  Description of Artificial Sequence: Synthetic coding sequence
atgggcctgaccaagcagtacctgcgctacgtggccagcgctgtgtttggagtgattggcagccagaagggcaacatcgtgtttgtgaccctgcggggggagaagggccgctacgtggccgtgcctgcctgtgagcacgtgttcatctgggacctgaggaagggggagaagatcctgatcctgcagggcctgaagcaggaggtgacctgcctgtgccccagcccagatggcctgcacctggccgtgggctatgaagatggcagcatccgcatcttcagcctgctgagcggggagggcaatgtgaccttcaacggccacaaggccgccatcaccaccctgaagtatgaccagctgggcggccgcctggccagcggcagcaaggacacagacatcatcgtgtgggatgtgatcaatgaaagtggcctgtaccgcctgaagggccacaaggatgccatcacccaggccctcttcctgcgggagaagaacctgctggtgaccagcggcaaggacaccatggtgaagtggtgggacctggacacccagcactgcttcaagaccatggtgggccacaggacagaggtgtggggcctggtgctgctgtctgaggagaagaggctcatcaccggggccagtgacagcgagctgcgggtgtgggacatcgcctacctgcaggagattgaagatcctgaggagccagaccccaagaagatcaagggcagcagccctggcatccaggacaccctggaggctgaagatggagcctttgaaacagatgaggcccctgaggaccgcatcctgagctgcaggaaggccggcagcatcatgagggagggccgggacagagtggtgaacctggccgtggacaagacaggccgcatcctggcctgccacggcacagattctgtgctggagctgttctgcatcctgagcaagaaggagatccagaagaagatggacaagaagatgaagaaggccaggaagaaggccaagctgcacagcagcaaaggagaggaggaggaccctgaggtgaatgtggagatgagcctgcaggatgagatccagagggtgaccaacatcaagaccagcgccaagatcaagagctttgacctgatccacagcccccatggagagctgaaggctgtgttcctgctgcagaacaacctggtggagctgtacagcctgaaccccagcctgcccaccccccagcctgtgaggaccagccgcatcaccatcggcggccacagaagtgatgtgaggaccctgtccttcagcagtgacaacattgctgtgctgtctgctgctgctgacagcatcaagatctggaacagaagcaccctgcagtgcatccgcaccatgacctgtgaatatgccctgtgcagcttctttgtgcctggggaccggcaggtggtgattggcaccaagacaggcaagctgcagctgtatgacctggccagcggcaacctgctggagaccattgatgcccatgatggagccctgtggagcatgagcctgagcccagaccagaggggctttgtgactggaggagctgacaagtctgtgaagttctgggactttgagctggtgaaggatgagaacagcacccagaagaggctgtctgtgaagcagaccaggaccctgcagctggatgaagatgtgctgtgtgtgtcctacagccccaaccagaagctgctggccgtgtccctgctggactgcaccgtgaagatcttctacgtggacaccctgaagttcttcctgagcctgtatggccacaagctgcctgtgatctgcatggacatcagccatgatggagccctgattgccaccggcagcgctgacagaaatgtgaagatctggggcctggactttggagactgccacaagagcctgtttgcccatgatgattctgtgatgtacctgcagtttgtgcccaagagccacctgttcttcaccgctgggaaggaccacaagatcaagcagtgggatgctgacaagtttgagcacatccagaccctggagggccaccaccaggagatctggtgcctggccgtgagccccagcggggactatgtggtgagcagcagccatgacaagagcctgcggctgtgggagaggacccgggagcccctcatcctggaggaggagcgggagatggagcgggaggccgagtatgaggagagcgtggccaaggaggaccagcctgctgtgcctggagagacccagggcgacagctacttcaccgggaagaagaccattgaaacagtgaaggctgctgagcgcatcatggaggccatcgagctgtaccgggaggagacagccaagatgaaggagcacaaggccatctgcaaggccgccggcaaggaggtgcccctgcccagcaaccccatcctgatggcctacggcagcatcagccccagcgcctacgtgctggagatcttcaagggcatcaagagcagcgagctggaggagagcctgctggtgctgcccttctcctatgtgcctgacatcctgaagctgttcaatgagttcatccagctgggcagtgatgtggagctgatctgccgctgcctcttcttcctgctgcgcatccacttcggccagatcaccagcaaccagatgctggtgcctgtgattgagaagctgcgggagaccaccatcagcaaggtgtcccaggtgagagatgtgattggcttcaacatggccggcctggactacctgaagcgggagtgtgaggccaagtctgaggtgatgttctttgctgatgccaccagccacctggaggagaagaagaggaagaggaagaagcgggagaagctgatcctgaccctgacctag

SEQ ID NO: 176008 - DNA, 123 bp, Artificial Sequence
  Description of Artificial Sequence: Synthetic coding sequence
atgggcctgaccaagcagtacctgcgctacgtggccagcgctgtgtttggagtgattggcagccagaagggcctggccagccaggccagcagcagctttgtgttctttgccacagagttctag

SEQ ID NO: 176009 - DNA, 1611 bp, Artificial Sequence
  Description of Artificial Sequence: Synthetic coding sequence
atggccacccgggcccagcccggccccctgagccaggccggcagcgctggggtggccgccctggccaccgtgggcgtggccagcggccctggccctggccggcccggccccctgcaggatgagaccctgggcgtggcctctgtgcccagccagtggagggctgtgcagggcatccgctgggagaccaagagctgccagacagccagcatcgccacagccagcgccagcgcccaggccaggaaccacgtggatgcccaggtgcagacagaggcccctgtgcctgtgtctgtgcagccccccagccagtatgacatcccccggctggccgccttcctgcggcgggtggaggccatggtgatccgggagctgaacaagaactggcagagccacgcctttgatggctttgaggtgaactggacagagcagcagcagatggtgtcctgcctgtacaccctgggctaccccccagcccaggcccagggcctgcacgtgaccagcatctcctggaacagcacaggctctgtggtggcctgtgcctacggccgcctggaccatggagactggagcaccctgaagagctttgtgtgtgcctggaacctggaccggcgggacctgcggccccagcagcccagcgctgtggtggaggtgcccagcgctgtgctgtgcctggccttccaccccacccagcccagccacgtggccggcggcctgtacagcggggaggtgctggtgtgggacctgagccggctggaggaccccctgctgtggaggacaggcctgacagatgacacccacacagatcctgtgtcccaggtggtgtggctgcctgagcccggccacagccaccgcttccaggtgctgtctgtggccacagatggcaaggtgctgctgtggcagggcattggagtgggccagctgcagctgacagagggctttgccctggtgatgcagcagctgcccaggagcaccaagctgaagaagcaccccagaggagaaacagaggtgggcgccacagctgtggccttcagcagctttgaccccaggctcttcatcctgggcacagagggcggcttccccctgaagtgcagcctggccgccggggaggccgccctgaccaggatgcccagctctgtgcccctgcgggccccagcccagttcaccttcagcccccatggaggccccatctacagcgtgtcctgcagccccttccacaggaacctcttcctgtctgctggaacagatggccacgtgcacctgtacagcatgctgcaggccccacccctgaccagcctgcagctgagcctgaagtacctgtttgctgtgcgctggagccctgtgcggcccctggtgtttgctgctgccagcgggaaaggagatgtgcagctgtttgacctgcagaagagcagccagaagcccaccgtgctgatcaagcagacccaggatgagagccctgtgtactgcctggagttcaacagccagcagacccagctgctggccgctggagatgcccagggcaccgtgaaggtgtggcagctgagcacagagttcacagagcagggcccccgggaggccgaggacctggactgcctggccgctgaggtggccgcctag

SEQ ID NO: 176010 - DNA, 420 bp, Artificial Sequence
  Description of Artificial Sequence: Synthetic coding sequence
gctggggtggccgccctggccaccgtgggcgtggccagcggccctggccctggccggcccggccccctgcaggatgagaccctgggcgtggcctctgtgcccagccagtggagggctgtgcagggcatccgctgggagaccaagagctgccagacagccagcatcgccacagccagcgccagcgcccaggccagaaatcatgtggatgcccaggtgcagacagaggcccctgtgcctgtgtctgtgcagccccccagccagtatgacatcccccggctggccgccttcctgcggcgggtggaggccatggtgatccgggagctgaacaagaactggcagagccacgcctttgatggctttgaggtgaactggacagagcagcagcagatggccggcccctggggcctggagcacgcctag

SEQ ID NO: 176011 - DNA, 819 bp, Artificial Sequence
  Description of Artificial Sequence: Synthetic coding sequence
ctgagccaggccggcagcgctggggtggccgccctggccaccgtgggcgtggccagcggccctggccctggccggcccggccccctgcaggatgagaccctgggcgtggcctctgtgcccagccagtggagggctgtgcagggcatccgctgggagaccaagagctgccagacagccagcatcgccacagccagcgccagcgcccaggccagaaatcatgtggatgcccaggtgcagacagaggcccctgtgcctgtgtctgtgcagccccccagccagtatgacatcccccggctggccgccttcctgcggcgggtggaggccatggtgatccgggagctgaacaagaactggcagagccacgcctttgatggctttgaggtgaactggacagagcagcagcagatggtgtcctgcctgtacaccctgggctaccccccagcccaggcccagggcctgcacgtgaccagcatctcctggaacagcactggatctgtggtggcctgtgcctacggccgcctggaccacggggactggagcaccctgaagagctttgtgtgtgcctggaacctggacagaagagacctgcggccccagcagcccagcgctgtggtggaggtgcccagcgctgtgctgtgcctggccttccaccccacccagcccagccacgtggccggggagctgcctgctgtgtctgccagcagccccctgcggacccagctgcctgccctgcagagggcccagggcagcttcccctgggccctgtggccaggggacaggaaggccggccctgaccccctgagcctggagcccaggtag

SEQ ID NO: 176012 - DNA, 3513 bp, Artificial Sequence
  Description of Artificial Sequence: Synthetic coding sequence
atgttcttctacctgagcaagaagatcagcatccccaacaacgtgaagctgcagtgtgtgtcctggaacaaggagcagggcttcatcgcctgtggcggggaggatggcctgctgaaggtgctgaagctggagacccagacagatgatgccaagctgcggggcctggccgcccccagcaacctgtccatgaaccagaccctggagggccacagcggctctgtgcaggtggtgacctggaatgagcagtaccagaagctgaccaccagtgatgaaaatggcctcatcatcgtgtggatgctgtacaagggctcctggattgaggagatgatcaacaacagaaacaagtctgtggtgcgctccatgtcctggaatgctgatggccagaagatctgcatcgtgtatgaagatggagctgtgattgtgggctctgtggatggcaaccgcatctggggcaaggacctgaagggcatccagctgagccacgtgacctggagcgctgacagcaaggtgctgctgtttggcatggccaatggagagatccacatctatgacaaccagggcaacttcatgatcaagatgaagctgagctgcctggtgaatgtgactggagccatcagcattgctggcatccactggtaccacggcacagagggctacgtggagccagactgcccctgcctggccgtgtgctttgacaatggccgctgccagatcatgagacatgaaaatgaccagaaccctgtgctgattgacaccggcatgtatgtggtgggcatccagtggaaccacatgggctctgtgctggccgtggccggcttccagaaggccgccatgcaggacaaggatgtgaacatcgtgcagttctacaccccatttggagagcacctgggcaccctgaaggtgcctgggaaggagatcagcgccctgtcctgggagggcggcggcctgaagatcgccctggccgtggacagcttcatctactttgccaacatccggcccaactacaagtggggctactgcagcaacacagtggtgtatgcctacaccaggccagacaggcctgagtactgtgtggtgttctgggacaccaagaacaatgagaagtatgtgaagtatgtgaagggcctcatcagcatcaccacctgtggggacttctgcatcctggccaccaaggcagatgagaaccacccccagtttgtgctggtgctgtgcaacagcatcggcacccccctggaccccaagtacatcgacatcgtgcccctgtttgtggccatgaccaagacccacgtgattgctgccagcaaggaggccttctacacctggcagtacagagtggccaagaagctgacagccctggagatcaaccagatcaccaggagcaggaaggagggccgggagcgcatctaccacgtggatgacacccccagcggctccatggatggagtgctggactacagcaagaccatccagggcacccgggaccccatctgtgccatcacagccagtgacaagatcctgattgtgggccgggagagcggcaccatccagcgctacagcctgcccaacgtgggcctcatccagaagtacagcctgaactgccgggcctaccagctgagcctgaactgcaacagcagccggctggccatcatcgacatctctggagtgctgaccttctttgacctggatgcccgggtgacagacagcacaggccagcaggtggtgggggagctgctgaagctggagaggagagatgtgtgggacatgaagtgggccaaggacaacccagacctgtttgccatgatggagaagaccaggatgtatgtgttcaggaacctggaccctgaggagcccatccagaccagcggctacatctgcaactttgaggacctggagatcaagtctgtgctgctggatgagatcctgaaggaccctgagcaccccaacaaggactacctgatcaactttgagatccgcagcctgcgggacagccgggccctgattgagaaggtgggcatcaaggatgccagccagttcatcgaggacaacccccacccccggctgtggaggctgctggccgaggccgccctgcagaagctggacctgtacacagctgagcaggcctttgtgcgctgcaaggactaccagggcatcaagtttgtgaagaggctgggcaagctgctgtctgagagcatgaagcaggccgaggtggtgggctacttcggccgctttgaggaggccgagaggacctacctggagatggacagaagagacctggccatcggcctgcggctgaagctgggggactggttccgggtgctgcagctgctgaagacaggcagcggagatgctgatgacagcctgctggagcaggccaacaatgccatcggggactactttgctgaccggcagaagtggctgaatgctgtgcagtactacgtgcagggcaggaaccaggagcggctggccgagtgctactacatgctggaggactatgagggcctggagaacctggccatcagcctgcctgagaaccacaagctgctgcctgagatcgcccagatgtttgtgcgggtgggcatgtgtgagcaggccgtgacagccttcctgaagtgcagccagcccaaggctgctgtggacacctgtgtgcacctgaaccagtggaacaaggctgtggagctggccaagaaccacagcatgaaggagatcggcagcctgctggcccgctatgccagccacctgctggagaagaacaagaccctggatgccatcgagctgtacaggaaggccaactacttctttgatgctgccaagctgatgttcaagattgctgatgaggaggccaagaagggcagcaagcccctgcgggtgaagaagctgtatgtgctgagcgccctgctgattgagcagtaccacgagcagatgaagaatgcccagaggggcaaggtgaagggcaagagcagcgaggccaccagcgccctggccggcctgctggaggaggaggtgctgagcaccacagaccgcttcacagacaatgcctggagaggagctgaggcctaccacttcttcatcctggcccagaggcagctgtatgagggctgtgtggacacagccctgaagacagccctgcacctgaaggactatgaggacatcatcccccctgtggagatctacagcctgctggccctgtgtgcctgtgccagccgggccttcggcacctgcagcaaggccttcatcaagctgaagagcctggagaccctgagcagcgagcagaagcagcagtatgaggacctggccctggagatcttcaccaagcacaccagcaaggacaacaggaagccagagctggacagcctgatggagggcggggagggcaagctgcccacctgtgtggccaccggcagccccatcacagagtaccagttctggatgtgcagcgtgtgcaagcatggagtgctggcccaggagatcagccactacagcttctgccccctgtgccacagccctgtgggctag

SEQ ID NO: 176013 - DNA, 3546 bp, Artificial Sequence
  Description of Artificial Sequence: Synthetic coding sequence
atgttcttctacctgagcaagaagatcagcatccccaacaacgtgaagctgcagtgtgtgtcctggaacaaggagcagggcttcatcgcctgtggcggggaggatggcctgctgaaggtgctgaagctggagacccagacagatgatgccaagctgcggggcctggccgcccccagcaacctgtccatgaaccagaccctggagggccacagcggctctgtgcaggtggtgacctggaatgagcagtaccagaagctgaccaccagtgatgaaaatggcctcatcatcgtgtggatgctgtacaagggctcctggattgaggagatgatcaacaacagaaacaagtctgtggtgcgctccatgtcctggaatgctgatggccagaagatctgcatcgtgtatgaagatggagctgtgattgtgggctctgtggatggcaaccgcatctggggcaaggacctgaagggcatccagctgagccacgtgacctggagcgctgacagcaaggtgctgctgtttggcatggccaatggagagatccacatctatgacaaccagggcaacttcatgatcaagatgaagctgagctgcctggtgaatgtgactggagccatcagcattgctggcatccactggtaccacggcacagagggctacgtggagccagactgcccctgcctggccgtgtgctttgacaatggccgctgccagatcatgagacatgaaaatgaccagaaccctgtgctgattgacaccggcatgtatgtggtgggcatccagtggaaccacatgggctctgtgctggccgtggccggcttccagaaggccgccatgcaggacaaggatgtgaacatcgtgcagttctacaccccatttggagagcacctgggcaccctgaaggtgcctgggaaggagatcagcgccctgtcctgggagggcggcggcctgaagatcgccctggccgtggacagcttcatctactttgccaacatccggcccaactacaagtggggctactgcagcaacacagtggtgtatgcctacaccaggccagacaggcctgagtactgtgtggtgttctgggacaccaagaacaatgagaagtatgtgaagtatgtgaagggcctcatcagcatcaccacctgtggggacttctgcatcctggccaccaaggcagatgagaaccacccccaggaggagaatgagatggagaccttcggggccacctttgtgctggtgctgtgcaacagcatcggcacccccctggaccccaagtacattgatattgtgcccctgtttgtggccatgaccaagacccacgtgattgctgccagcaaggaggccttctacacctggcagtacagagtggccaagaagctgacagccctggagatcaaccagatcaccaggagcaggaaggagggccgggagcgcatctaccacgtggatgacaccccatctggctccatggatggagtgctggactacagcaagaccatccagggcacccgggaccccatctgtgccatcacagccagtgacaagatcctgattgtgggccgggagagcggcaccatccagcgctacagcctgcccaacgtgggcctcatccagaagtacagcctgaactgccgggcctaccagctgagcctgaactgcaacagcagccggctggccatcatcgacatcagcggcgtgctgaccttctttgacctggatgcccgggtgacagacagcacaggccagcaggtggtgggggagctgctgaagctggagaggagagatgtgtgggacatgaagtgggccaaggacaacccagacctgtttgccatgatggagaagaccaggatgtatgtgttcaggaacctggaccctgaggagcccatccagaccagcggctacatctgcaactttgaggacctggagatcaagtctgtgctgctggatgagatcctgaaggaccctgagcaccccaacaaggactacctgatcaactttgagatccgcagcctgcgggacagccgggccctgattgagaaggtgggcatcaaggatgccagccagttcatcgaggacaacccccacccccggctgtggaggctgctggccgaggccgccctgcagaagctggacctgtacacagctgagcaggcctttgtgcgctgcaaggactaccagggcatcaagtttgtgaagaggctgggcaagctgctgtctgagagcatgaagcaggccgaggtggtgggctacttcggccgctttgaggaggccgagaggacctacctggagatggaccggcgggacctggccatcggcctgcggctgaagctgggggactggttccgggtgctgcagctgctgaagacaggcagcggagatgctgatgacagcctgctggagcaggccaacaatgccatcggggactactttgctgaccggcagaagtggctgaatgctgtgcagtactacgtgcagggcaggaaccaggagcggctggccgagtgctactacatgctggaggactatgagggcctggagaacctggccatcagcctgcctgagaaccacaagctgctgcctgagatcgcccagatgtttgtgcgggtgggcatgtgtgagcaggccgtgacagccttcctgaagtgcagccagcccaaggctgctgtggacacctgtgtgcacctgaaccagtggaacaaggctgtggagctggccaagaaccacagcatgaaggagatcggcagcctgctggcccgctatgccagccacctgctggagaagaacaagaccctggatgccatcgagctgtacaggaaggccaactacttctttgatgctgccaagctgatgttcaagattgctgatgaggaggccaagaagggcagcaagcccctgcgggtgaagaagctgtatgtgctgagcgccctgctgattgagcagtaccacgagcagatgaagaatgcccagaggggcaaggtgaagggcaagagcagcgaggccaccagcgccctggccggcctgctggaggaggaggtgctgagcaccacagaccgcttcacagacaatgcctggagaggagctgaggcctaccacttcttcatcctggcccagaggcagctgtatgagggctgtgtggacacagccctgaagacagccctgcacctgaaggactatgaggacatcatcccccctgtggagatctacagcctgctggccctgtgtgcctgtgccagccgggccttcggcacctgcagcaaggccttcatcaagctgaagagcctggagaccctgagcagcgagcagaagcagcagtatgaggacctggccctggagatcttcaccaagcacaccagcaaggacaacaggaagccagagctggacagcctgatggagggcggggagggcaagctgcccacctgtgtggccaccggcagccccatcacagagtaccagttctggatgtgcagcgtgtgcaagcacggcgtgctggcccaggagatcagccactacagcttctgccccctgtgccacagccctgtgggctag

SEQ ID NO: 176014 - DNA, 1680 bp, Artificial Sequence
  Description of Artificial Sequence: Synthetic coding sequence
atgaccaagacccacgtgattgctgccagcaaggaggccttctacacctggcagtacagagtggccaagaagctgacagccctggagatcaaccagatcaccaggagcaggaaggagggccgggagcgcatctaccacgtggatgacacccccagcggctccatggatggagtgctggactacagcaagaccatccagggcacccgggaccccatctgtgccatcacagccagtgacaagatcctgattgtgggccgggagagcggcaccatccagcgctacagcctgcccaacgtgggcctcatccagaagtacagcctgaactgccgggcctaccagctgagcctgaactgcaacagcagccggctggccatcatcgacatctctggagtgctgaccttctttgacctggatgcccgggtgacagacagcacaggccagcaggtggtgggggagctgctgaagctggagaggagagatgtgtgggacatgaagtgggccaaggacaacccagacctgtttgccatgatggagaagaccaggatgtatgtgttcaggaacctggaccctgaggagcccatccagaccagcggctacatctgcaactttgaggacctggagatcaagtctgtgctgctggatgagatcctgaaggaccctgagcaccccaacaaggactacctgatcaactttgagatccgcagcctgcgggacagccgggccctgattgagaaggtgggcatcaaggatgccagccagttcatcgaggacaacccccacccccggctgtggaggctgctggccgaggccgccctgcagaagctggacctgtacacagctgagcaggcctttgtgcgctgcaaggactaccagggcatcaagtttgtgaagaggctgggcaagctgctgtctgagagcatgaagcaggccgaggtggtgggctacttcggccgctttgaggaggccgagaggacctacctggagatggacagaagagacctggccatcggcctgcggctgaagctgggggactggttccgggtgctgcagctgctgaagacaggcagcggagatgctgatgacagcctgctggagcaggccaacaatgccatcggggactactttgctgaccggcagaagtggctgaatgctgtgcagtactacgtgcagggcaggaaccaggagcggctggccgagtgctactacatgctggaggactatgagggcctggagaacctggccatcagcctgcctgagaaccacaagctgctgcccatcgcagatgaggaggccaagaagggcagcaagcccctgcgggtgaagaagctgtatgtgctgagcgccctgctgattgagcagtaccacgagcagatgaagaatgcccagaggggcaaggtgaagggcaagagcagcgaggccaccagcgccctggccggcctgctggaggaggaggtgctgagcaccacagaccgcttcacagacaatgcctggagaggagctgaggcctaccacttcttcatcctggcccagaggcagctgtatgagggctgtgtggacacagccctgaagacagtggagaagggcaactgccagcacgccctgccccaggaggcccagagcctgagcatcaacagcggctgtgctgtgtatgccaacacagtgtccctgctgaggaagtag

SEQ ID NO: 176015 - DNA, 2856 bp, Artificial Sequence
  Description of Artificial Sequence: Synthetic coding sequence
atgtgctgcacagagggcagcctgaggaagagggacagccagagggcccctgaggccgtgctgtgcctgcagctgtggcagaggacagtgcccctggacaccctgaagggcctgggcacctgcttccccagcggccctgagctgcggggagctggcattgctgctgccatggagcgggccagcgagaggagaacagccagcgccctgtttgctggcttccgggccctgggcctcttcagcaatgacatcccccacgtggtgcgcttcagcgccctgaagaggcgcttctacgtgaccacctgtgtgggcaagagcttccacacctatgatgtgcagaagctgagcctggtggccgtgagcaacagcgtgccccaggacatctgctgcatggccgcagatggccgcctggtgtttgctgcctatggaaatgtgttcagcgcctttgccaggaacaaggagatcgtgcacaccttcaagggccacaaggccgagatccacttcctgcagccctttggagaccacatcatctctgtggacacagatggcatcctgatcatctggcacatctacagcgaggaggagtacctgcagctgacctttgacaagtctgtgttcaagatcagcgccatcctgcaccccagcacctacctgaacaagatcctgctgggcagcgagcagggcagcctgcagctgtggaatgtgaagagcaacaagctgctgtacaccttccctggctggaaggtgggcgtgacagccctgcagcaggccccagctgtggatgtggtggccatcggcctgatgagcggccaggtgatcatccacaacatcaagttcaatgagaccctgatgaagttccggcaggactggggccccatcaccagcatctccttcagaacagatggccaccctgtgatggctgctggcagcccctgtggccacatcggcctgtgggacctggaggacaagaagctgatcaaccagatgagaaatgcccacagcacagccatcgccggcctgaccttcctgcaccgggagcccctgctggtgaccaatggagctgacaatgccctgcgcatctggatctttgatggccccaccggggagggccgcctgctgcgcttcaggatgggccacagcgcccccctgaccaacatccgctactacggccagaatggccagcagatcctgagcgccagccaggacggcaccctgcagagcttcagcacagtgcatgagaagttcaacaagagcctgggccacggcctcatcaacaagaagagggtgaagaggaagggcctgcagaacaccatgtctgtgcggctgccccccatcaccaagtttgctgctgaggaggcccgggagagtgactgggatggcatcatcgcctgccaccagggcaagctgagctgcagcacctggaactaccagaagagcaccatcggggcctacttcctgaagcccaaggagctgaagaaggatgacatcacagccacagctgtggacatcaccagctgtggcaactttgctgtgattggcctgagcagcggcaccgtggatgtgtacaacatgcagagcggcatccaccggggcagctttgggaaggaccaggcccacaagggctctgtgcggggcgtggccgtggatggcctgaaccagctgactgtgaccactggaagtgagggcctgctgaagttctggaacttcaagaacaagatcctgatccacagcgtgtccctgagcagcagccccaacatcatgctgctgcaccgggacagcggcatcctgggcctggccctggatgacttcagcatctctgtgctggacatcgagaccaggaagatcgtgcgggagttcagcggccaccagggccagatcaatgacatggccttctccccagatggccgctggctgatctctgctgccatggactgcagcatccgcacctgggacctgcccagcggctgcctgattgactgcttcctgctggacagcgcccccctgaatgtgtccatgagccccaccggggacttcctggccaccagccacgtggaccacctgggcatctacctgtggagcaacatcagcctgtacagcgtggtgtccctgcggcccctgcctgctgactatgtgcccagcatcgtgatgctgcccggcacctgccagacccaggatgtggaggtgtctgaggagaccgtggagcccagtgatgagctgattgaatatgacagccctgagcagctgaatgagcagctggtgaccctgagcctgctgcctgagagccgctggaagaacctgctgaacctggatgtgatcaagaagaagaacaagcccaaggagccccccaaggtgcccaagagcgcccccttcttcatccccaccatccctggcctggtgcccaggtatgctgcccctgagcagaacaatgacccccagcagagcaaggtggtgaacctgggcgtgctggcccagaagagtgacttctgcctgaagctggaggagggcctggtgaacaacaagtatgacacagccctgaacctgctgaaggagagcggccccagcggcattgaaacagagctgcggagcctgagcccagactgtggcggcagcattgaggtgatgcagagcttcctgaagatgattggcatgatgctggacaggaagagggactttgagctggcccaggcctacctggccctcttcctgaagctgcacctgaagatgctgcccagcgagcctgtgctgctggaggagatcaccaacctgagcagccaggtggaggagaactggacccacctgcagagcctcttcaaccagagcatgtgcatcctgaactacctgaagagcgccctgctgtag

SEQ ID NO: 176016 - DNA, 2856 bp, Artificial Sequence; identical to SEQ ID NO: 176015
  Description of Artificial Sequence: Synthetic coding sequence

SEQ ID NO: 176017 - DNA, 1239 bp, Artificial Sequence
  Description of Artificial Sequence: Synthetic coding sequence
atggccggctctgtgggcctggccctgtgtggccagaccctggtggtgcggggcggcagccgcttcctggccaccagcatcgccagcagtgatgatgacagcctcttcatctatgactgcagcgctgctgagaagaagagccaggagaacaagggagaagatgcccccctggaccagggcagcggggccatcctggccagcaccttcagcaagagcggcagctactttgccctgacagatgacagcaagaggctcatcctcttccgcaccaagccctggcagtgcctgtctgtgaggacagtggcccggcgctgcacagccctgaccttcatcgccagcgaggagaaggtgctggtggccgacaagtctggagatgtgtacagcttctctgtgctggagccccacggctgcggccgcctggagctgggccacctgtccatgctgctggatgtggccgtgtccccagatgaccgcttcatcctgacagctgacagagatgagaagatccgggtgtcctgggccgccgccccccacagcattgagagcttctgcctgggccacacagaatttgtgagccgcatctctgtggtgcccacccagcccggcctgctgctgagcagcagtggagatggcaccctgcggctgtgggagtaccgcagcggccggcagctgcactgctgccacctggccagcctgcaggagctggtggacccccaggccccccagaagtttgctgccagcagaattgccttctggtgccaggagaactgtgtggccctgctgtgtgatggcacccctgtggtgtacatcttccagctggatgcccggcggcagcagctggtgtaccggcagcagctggccttccagcaccaggtgtgggatgtggcctttgaggagacccagggcctgtgggtgctgcaggactgccaggaggcccccctggtgctgtacagacctgtgggggaccagtggcagagcgtgcctgagagcacagtgctgaagaaggtgtctggagtgctgcggggcaactgggccatgctggagggcagcgctggagcagatgccagcttcagcagcctgtacaaggccacctttgacaacgtgaccagctacctgaagaagaaggaggagcggctgcagcagcagctggagaagaagcagaggagaagaagccccccacctggcccagatggccacgccaagaagatgaggcctggagaggccaccctgagctgctag

SEQ ID NO: 176018 - DNA, 1239 bp, Artificial Sequence; identical to SEQ ID NO: 176017
  Description of Artificial Sequence: Synthetic coding sequence

SEQ ID NO: 176019 - DNA, 2034 bp, Artificial Sequence
  Description of Artificial Sequence: Synthetic coding sequence
atggccgcccaccaccggcagaacacagctggccgcaggaaggtgcaggtgtcctatgtgatcagagatgaggtggagaagtacaacagaaatggagtgaatgccctgcagctggaccctgccctgaacagactcttcaccgctggccgggacagcatcatccgcatctggagcgtgaaccagcacaagcaggacccctacatcgcctccatggagcaccacacagactgggtgaatgacatcgtgctgtgctgcaatggcaagaccctcatcagcgccagcagtgacaccaccgtgaaggtgtggaatgcccacaagggcttctgcatgagcaccctgcggacccacaaggactatgtgaaggccctggcctatgccaaggacaaggagctggtggccagcgctggcctggaccggcagatcttcctgtgggatgtgaacaccctgacagccctgacagccagcaacaacacagtgaccaccagcagcctgagcggcaacaaggacagcatctacagcctggccatgaaccagctgggcaccatcatcgtgtctggcagcacagagaaggtgctgcgggtgtgggaccccaggacctgtgccaagctgatgaagctgaagggccacacagacaacgtgaaggccctgctgctgaacagagatggcacccagtgcctgagcggcagcagtgatggcaccatccggctgtggagcctgggccagcagcgctgcatcgccacctacagagtgcatgatgagggcgtgtgggccctgcaggtgaatgatgccttcacccacgtgtacagcggcggccgggacaggaagatctactgcacagacctgaggaacccagacatccgggtgctgatctgtgaggagaaggcccctgtgctgaagatggagctggacagatctgctgaccccccaccagccatctgggtggccaccaccaagagcacagtgaacaagtggaccctgaagggcatccacaacttccgggccagcggggactatgacaatgactgcaccaaccccatcacccccctgtgcacccagcctgaccaggtgatcaagggcggggccagcatcatccagtgccacatcctgaatgacaagaggcacatcctgaccaaggacaccaacaacaacgtggcctactgggatgtgctgaaggcctgcaaggtggaggacctgggcaaggtggactttgaagatgagatcaagaagcgcttcaagatggtgtatgtgcccaactggttctctgtggacctgaagacaggcatgctgaccatcaccctggatgaaagtgactgctttgctgcctgggtgtctgccaaggatgctggcttcagcagcccagatggcagtgaccccaagctgaacctgggcggcctgctgctgcaggccctgctggagtactggcccaggacccacgtgaaccccatggatgaggaggagaatgaggtgaaccacgtgaatggagagcaggagaacagagtgcagaagggaaatggctacttccaggtgcccccccacacccctgtgatctttggagaggccggcggccgcaccctcttccggctgctgtgccgggacagcggcggggagacagagagcatgctgctgaatgaaacagtgccccagtgggtgattgacatcaccgtggacaagaacatgcccaagttcaacaagatccccttctacctgcagccccacgccagcagcggggccaagaccctgaagaaggaccggctgagcgccagtgacatgctgcaggtgaggaaggtgatggagcacgtgtatgagaagatcatcaacctggacaatgaaagccagaccaccagcagcagcaacaatgagaagccaggagagcaggagaaggaggaggacattgctgtgctggccgaggagaagattgagctgctgtgccaggaccaggtgctggaccccaacatggacctgaggacagtgaagcacttcatctggaagagcggcggggacctgaccctgcactaccggcagaagagcacctag

SEQ ID NO: 176020 - DNA, 1788 bp, Artificial Sequence
  Description of Artificial Sequence: Synthetic coding sequence
atggagtgccagagcgcccaggtgatcagcgccagcagtgacaccaccgtgaaggtgtggaatgcccacaagggcttctgcatgagcaccctgcggacccacaaggactatgtgaaggccctggcctatgccaaggacaaggagctggtggccagcgctggcctggaccggcagatcttcctgtgggatgtgaacaccctgacagccctgacagccagcaacaacacagtgaccaccagcagcctgagcggcaacaaggacagcatctacagcctggccatgaaccagctgggcaccatcatcgtgtctggcagcacagagaaggtgctgcgggtgtgggaccccaggacctgtgccaagctgatgaagctgaagggccacacagacaacgtgaaggccctgctgctgaacagagatggcacccagtgcctgagcggcagcagtgatggcaccatccggctgtggagcctgggccagcagcgctgcatcgccacctacagagtgcatgatgagggcgtgtgggccctgcaggtgaatgatgccttcacccacgtgtacagcggcggccgggacaggaagatctactgcacagacctgaggaacccagacatccgggtgctgatctgtgaggagaaggcccctgtgctgaagatggagctggacagatctgctgaccccccaccagccatctgggtggccaccaccaagagcacagtgaacaagtggaccctgaagggcatccacaacttccgggccagcggggactatgacaatgactgcaccaaccccatcacccccctgtgcacccagcctgaccaggtgatcaagggcggggccagcatcatccagtgccacatcctgaatgacaagaggcacatcctgaccaaggacaccaacaacaacgtggcctactgggatgtgctgaaggcctgcaaggtggaggacctgggcaaggtggactttgaagatgagatcaagaagcgcttcaagatggtgtatgtgcccaactggttctctgtggacctgaagacaggcatgctgaccatcaccctggatgaaagtgactgctttgctgcctgggtgtctgccaaggatgctggcttcagcagcccagatggcagtgaccccaagctgaacctgggcggcctgctgctgcaggccctgctggagtactggcccaggacccacgtgaaccccatggatgaggaggagaatgaggtgaaccacgtgaatggagagcaggagaacagagtgcagaagggaaatggctacttccaggtgcccccccacacccctgtgatctttggagaggccggcggccgcaccctcttccggctgctgtgccgggacagcggcggggagacagagagcatgctgctgaatgaaacagtgccccagtgggtgattgacatcaccgtggacaagaacatgcccaagttcaacaagatccccttctacctgcagccccacgccagcagcggggccaagaccctgaagaaggaccggctgagcgccagtgacatgctgcaggtgaggaaggtgatggagcacgtgtatgagaagatcatcaacctggacaatgaaagccagaccaccagcagcagcaacaatgagaagccaggagagcaggagaaggaggaggacattgctgtgctggccgaggagaagattgagctgctgtgccaggaccaggtgctggaccccaacatggacctgaggacagtgaagcacttcatctggaagagcggcggggacctgaccctgcactaccggcagaagagcacctag

SEQ ID NO: 176021 - DNA, 366 bp, Artificial Sequence
  Description of Artificial Sequence: Synthetic coding sequence
atgcccaagttcaacaagatccccttctacctgcagccccacgccagcagcggggccaagaccctgaagaaggaccggctgagcgccagtgacatgctgcaggtgaggaaggtgatggagcacgtgtatgagaagatcatcaacctggacaatgaaagccagaccaccagcagcagcaacaatgagaagccaggagagcaggagaaggaggaggacattgctgtgctggccgaggagaagattgagctgctgtgccaggaccaggtgcgggtgctggaccccaacatggacctgaggacagtgaagcacttcatctggaagagcggcggggacctgaccctgcactaccggcagaagagcacctag

SEQ ID NO: 176022 - DNA, 1209 bp, Artificial Sequence
  Description of Artificial Sequence: Synthetic coding sequence
atggccgcccaccaccggcagaacacagctggccgcaggaaggtgcagtgcctgagcggcagcagtgatggcaccatccggctgtggagcctgggccagcagcgctgcatcgccacctacagagtgcatgatgagggcgtgtgggccctgcaggtgaatgatgccttcacccacgtgtacagcggcggccgggacaggaagatctactgcacagacctgaggaacccagacatccgggtgctgatctgtgaggagaaggcccctgtgctgaagatggagctggacagatctgctgaccccccaccagccatctgggtggccaccaccaagagcacagtgaacaagtgggcctgcaaggtggaggacctgggcaaggtggactttgaagatgagatcaagaagcgcttcaagatggtgtatgtgcccaactggttctctgtggacctgaagacaggcatgctgaccatcaccctggatgaaagtgactgctttgctgcctgggtgtctgccaaggatgctggcttcagcagcccagatggcagtgaccccaagctgaacctgggcggcctgctgctgcaggccctgctggagtactggcccaggacccacgtgaaccccatggatgaggaggagaatgaggtgaaccacgtgaatggagagcaggagaacagagtgcagaagggaaatggctacttccaggtgcccccccacacccctgtgatctttggagaggccggcggccgcaccctcttccggctgctgtgccgggacagcggcggggagacagagagcatgctgctgaatgagaccgtgccccagtgggtgattgacatcaccgtggacaagaacatgcccaagttcaacaagatccccttctacctgcagccccacgccagcagcggggccaagaccctgaagaaggaccggctgagcgccagtgacatgctgcaggtgaggaaggtgatggagcacgtgtatgagaagatcatcaacctggacaatgaaagccagaccaccagcagcagcaacaatgagaagccaggagagcaggagaaggaggaggacattgctgtgctggccgaggagaagattgagctgctgtgccaggaccaggtgctggaccccaacatggacctgaggacagtgaagcacttcatctggaagtctggaggagacctgaccctgcactaccggcagaagagcacctag

SEQ ID NO: 176023 - DNA, 651 bp, Artificial Sequence
  Description of Artificial Sequence: Synthetic coding sequence
atggatgccctggaggactatgtgtggccccgggccaccagcgagctgatcctgctgcctgtgacaggcctggagtgtgtgggggaccggctgctggccggggagggcccagatgtgctggtgtacagcctggactttggaggccacctgaggatgatcaagagggtgcagaacctgctgggccactacctgatccacggcttccgggtgcggcctgagcccaatggagacctggacctggaggccatggtggccgtgtttggcagcaagggcctgcgggtggtgaagatctcctggggccagggccacttctgggagctgtggaggagcggcctgtggaacatgtctgactggatctgggatgcccgctggctggagggcaacatcgccctggccctgggccacaacagcgtggtgctgtatgaccctgtggtgggctgcatcctgcaggaggtgccctgcacagaccgctgcaccctgagcagcgcctgcctgattggagatgcctggaaggagctgaccatcgtggccggggctgtgagcaaccagctgctggtgtggtacccagccacagccttcaccctgtacctgagcgcccggcccacccccttctgctgcgtgctgacccccaggatgtgcacccggctgtag

SEQ ID NO: 176024 - DNA, 3456 bp, Artificial Sequence
  Description of Artificial Sequence: Synthetic coding sequence
atgggcagcgctgcccgctgggagggcagcttcagccgggagttcagcagcctgctgagccggggctgcctgagcaccagcagaattgacatggatgccctggaggactatgtgtggccccgggccaccagcgagctgatcctgctgcctgtgacaggcctggagtgtgtgggggaccggctgctggccggggagggcccagatgtgctggtgtacagcctggactttggaggccacctgaggatgatcaagagggtgcagaacctgctgggccactacctgatccacggcttccgggtgcggcctgagcccaatggagacctggacctggaggccatggtggccgtgtttggcagcaagggcctgcgggtggtgaagatctcctggggccagggccacttctgggagctgtggaggagcggcctgtggaacatgtctgactggatctgggatgcccgctggctggagggcaacatcgccctggccctgggccacaacagcgtggtgctgtatgaccctgtggtgggctgcatcctgcaggaggtgccctgcacagaccgctgcaccctgagcagcgcctgcctgattggagatgcctggaaggagctgaccatcgtggccggggctgtgagcaaccagctgctggtgtggtacccagccacagccctggccgacaacaagcctgtggccccagaccggcgcatcagcggccacgtgggcatcatcttctccatgagctacctggagagcaagggcctgctggccacagcctctgaagatagatctgtgcgcatctggaaggtgggggacctgcgggtgcctgggggccgggtgcagaacatcggccactgcttcggccacagcgcccgggtgtggcaggtgaagctgctggagaactacctgatctctgctggggaggactgtgtgtgcctggtgtggagccatgaaggagagatcctgcaggccttccggggccaccagggccggggcatccgggccatcgccgcccacgagcggcaggcctgggtgatcactggaggagatgacagcggcatccggctgtggcacctggtgggccggggctaccggggcctgggcgtgtctgccctgtgcttcaagagccgcagccggcccggcaccctgaaggctgtgaccctggccggctcctggaggctgctggccgtgacagacaccggggccctgtacctgtatgatgtggaggtgaagtgctgggagcagctgctggaggacaagcacttccagagctactgcctgctggaggccgcccctggccctgagggcttcggcctgtgtgccatggccaacggggagggccgggtgaaggtggtgcccatcaacacccccacagctgctgtggaccagaccctcttccctgggaaggtgcacagcctgtcctgggccctgcggggctatgaggagctgctgctgctggccagcggccctgggggcgtggtggcctgcctggagatctctgctgcccccagcggcaaggccatctttgtgaaggagcgctgccgctacctgctgccccccagcaagcagcgctggcacacctgcagcgccttcctgcccccaggggacttcctggtgtgtggggacagaagaggctctgtgctgctcttccccagccggcccggcctgctgaaggaccccggggtgggcggcaaggcccgggccggggccggggcccctgtggtgggcagcggcagcagcggcggcggcaatgccttcaccggcctgggccctgtgtccaccctgcccagcctgcacggcaagcagggcgtgacctctgtgacctgccacggcggctacgtgtacaccaccggcagagatggagcctactaccagctgtttgtgagagatggccagctgcagcctgtgctgcggcagaagagctgccggggcatgaactggctggccggcctgagaattgtgcctgatggctccatggtgatcctgggcttccacgccaatgaatttgtggtgtggaaccccaggagccatgagaagctgcacatcgtgaactgtggcggcggccaccgctcctgggccttcagtgacacagaagctgccatggcctttgcctacctgaaggatggagatgtgatgctgtaccgggccctgggcggctgcacccggccccacgtgatcctgcgggagggcctgcacggccgggagatcacctgtgtgaagagggtgggcaccatcaccctgggcccagaatatggagtgcccagcttcatgcagccagatgacctggagcccggcagcgagggccctgacctgacagacatcgtcatcacctgcagcgaggacaccaccgtgtgtgtgctggccctgcccaccaccactggaagtgcccacgccctgacagctgtgtgcaaccacatcagctctgtgcgggctgtggccgtgtggggcatcggcacccctgggggcccccaggacccccagcccggcctgacagcccacgtggtgtctgctgggggccgggcagagatgcactgcttcagcatcatggtgaccccagaccccagcacccccagccggctggcctgccacgtgatgcacctgagcagccaccggctggatgagtactgggaccggcagaggaacagacacaggatggtgaaggtggaccctgagacccgctacatgagcctggccgtgtgtgagctggaccagcccggcctgggccccctggtggccgccgcctgcagtgatggagctgtgcggctcttcctgctgcaggacagcggccgcatcctgcagctgctggccgagaccttccaccacaagagatgtgtgctgaaggtgcacagcttcacccatgaggcccccaaccagaggcggcggctgctgctgtgcagcgctgccacagatggcagcctggccttctgggacctgaccaccatgctggaccatgacagcacagtgctggagccccctgtggaccccggcctgccctaccgcctgggcacccccagcctgaccctgcaggcccacagctgtggcatcaacagcctgcacaccctgcccacccgggagggccaccacctggtggccagcggctctgaagatggcagcctgcacgtgtttgtgctggccgtggagatgctgcagctggaggaggccgtgggggaggccggcctggtgccccagctgcgggtgctggaggagtacagcgtgccctgtgcccatgctgcccacgtgacaggcctgaagatcctgagccccagcatcatggtgtctgccagcattgaccagaggctgaccttctggaggctgggccatggagagcccaccttcatgaacagcaccgtcttccacgtgcctgatgtggccgacatggactgctggcctgtgtccccagagtttggccaccgctgtgccctgggcggccagggcctggaggtgtacaactggtatgactag

SEQ ID NO: 176025 - DNA, 3213 bp, Artificial Sequence
  Description of Artificial Sequence: Synthetic coding sequence
atgatcaagagggtgcagaacctgctgggccactacctgattcatggcttccgggtgcggcctgagcccaacggggacctggacctggaggccatggtggccgtgtttggcagcaagggcctgcgggtggtgaagatctcctggggccagggccacttctgggagctgtggaggagcggcctgtggaacatgtctgactggatctgggatgcccgctggctggagggcaacatcgccctggccctgggccacaacagcgtggtgctgtatgaccctgtggtgggctgcatcctgcaggaggtgccctgcacagaccgctgcaccctgagcagcgcctgcctgattggagatgcctggaaggagctgaccatcgtggccggggctgtgagcaaccagctgctggtgtggtacccagccacagccctggccgacaacaagcctgtggccccagaccggcgcatcagcggccacgtgggcatcatcttctccatgagctacctggagagcaagggcctgctggccacagccagcgaggacagatctgtgcgcatctggaaggtgggggacctgcgggtgcctgggggccgggtgcagaacatcggccactgcttcggccacagcgcccgggtgtggcaggtgaagctgctggagaactacctgatctctgctggggaggactgtgtgtgcctggtgtggagccatgaaggagagatcctgcaggccttccggggccaccagggccggggcatccgggccatcgccgcccacgagcggcaggcctgggtgatcactggaggagatgattctggcatccggctgtggcacctggtgggccggggctaccggggcctgggcgtgtctgccctgtgcttcaagagccgcagcaggcctggcaccctgaaggctgtgaccctggccggctcctggaggctgctggccgtgacagacacaggagccctgtacctgtatgatgtggaggtgaagtgctgggagcagctgctggaggacaagcacttccagagctactgcctgctggaggccgcccctggccctgagggcttcggcctgtgtgccatggccaatggagagggccgggtgaaggtggtgcccatcaacacccccacagctgctgtggaccagaccctcttccctgggaaggtgcacagcctgtcctgggccctgcggggctatgaggagctgctgctgctggccagcggccctggaggagtggtggcctgcctggagatctctgctgcccccagcggcaaggccatctttgtgaaggagcgctgccgctacctgctgccccccagcaagcagcgctggcacacctgcagcgccttcctgcccccaggggacttcctggtgtgtggggaccggcggggctctgtgctgctcttccccagcaggcctggcctgctgaaggaccccggggtgggcggcaaggcccgggccggggccggggcccctgtggtgggcagcggcagcagcggcggcggcaatgccttcaccggcctgggccctgtgtccaccctgcccagcctgcacggcaagcagggcgtgacctctgtgacctgccacggcggctacgtgtacaccaccggcagagatggagcctactaccagctgtttgtgagagatggccagctgcagcctgtgctgcggcagaagagctgccggggcatgaactggctggccggcctgcgcatcgtgcctgatggctccatggtgatcctgggcttccacgccaatgaatttgtggtgtggaaccccaggagccatgagaagctgcacatcgtgaactgtggcggcggccaccgctcctgggccttcagtgacacagaggccgccatggcctttgcctacctgaaggatggagatgtgatgctgtaccgggccctgggcggctgcacccggccccacgtgatcctgcgggagggcctgcacggccgggagatcacctgtgtgaagagggtgggcaccatcaccctgggcccagaatatggagtgcccagcttcatgcagccagatgacctggagcccggcagcgagggccctgacctgacagacatcgtcatcacctgcagcgaggacaccaccgtgtgtgtgctggccctgcccaccaccaccggcagcgcccacgccctgacagctgtgtgcaaccacatcagctctgtgcgggctgtggccgtgtggggcatcggcaccccaggcggcccccaggacccccagcccggcctgacagcccacgtggtgtctgctgggggccgggcagagatgcactgcttcagcatcatggtgaccccagaccccagcacccccagccggctggcctgccacgtgatgcacctgagcagccaccggctggatgagtactgggaccggcagaggaacagacacaggatggtgaaggtggaccctgagacccgctacatgagcctggccgtgtgtgagctggaccagcccggcctgggccccctggtggccgccgcctgcagtgatggagctgtgcggctcttcctgctgcaggacagcggccgcatcctgcagctgctggccgagaccttccaccacaagagatgtgtgctgaaggtgcacagcttcacccatgaggcccccaaccagaggcggcggctgctgctgtgcagcgctgccacagatggcagcctggccttctgggacctgaccaccatgctggaccatgacagcacagtgctggagccccctgtggaccccggcctgccctaccgcctgggcacccccagcctgaccctgcaggcccacagctgtggcatcaacagcctgcacaccctgcccacccgggagggccaccacctggtggccagcggctctgaagatggcagcctgcacgtgtttgtgctggccgtggagatgctgcagctggaggaggccgtgggggaggccggcctggtgccccagctgcgggtgctggaggagtacagcgtgccctgtgcccacgccgcccacgtgacaggcctgaagatcctgagccccagcatcatggtgtctgccagcattgaccagaggctgaccttctggaggctgggccacggggagcccaccttcatgaacagcacagtgttccacgtgcctgatgtggccgacatggactgctggcctgtgtccccagagtttggccaccgctgtgccctgggcggccagggcctggaggtgtacaactggtatgactag

SEQ ID NO: 176026 - DNA, 4557 bp, Artificial Sequence
  Description of Artificial Sequence: Synthetic coding sequence
atggctgctgtgggcagcggcggctacgccagaaatgatgctggggagaagctgcccagcgtgatggccggcgtgcctgcccggcggggccagagcagccccccaccagccccacccatctgcctgcggcggaggacccggctgagcacagccagcgaggagaccgtgcagaacagagtgtccctggagaaggtgctgggcatcacagcccagaacagcagcggcctgacctgtgaccccggcaccggccacgtggcctacctggccggctgtgtggtggtgatcctggaccccaaggagaacaagcagcagcacatcttcaacacagccaggaagagcctgagcgccctggccttctccccagatggcaagtacatcgtgactggagaaaatggccacaggcctgctgtgcgcatctgggatgtggaggagaagaaccaggtggccgagatgctgggccacaagtatggagtggcctgtgtggccttcagccccaacatgaagcacatcgtgtccatgggctaccagcacgacatggtgctgaatgtgtgggactggaagaaggacatcgtggtggccagcaacaaggtgtcctgcagggtcatcgccctgtccttcagcgaggacagcagctactttgtgacagtgggcaacagacatgtgcgcttctggttcctggaggtgtccacagagaccaaggtgaccagcacagtgcccctggtgggccgcagcggcatcctgggggagctgcacaacaacatcttctgtggggtggcctgtggccggggccgcatggccggcagcaccttctgtgtgtcctacagcggcctgctgtgccagttcaatgagaagagggtgctggagaagtggatcaacctgaaggtgtccctgagcagctgcctgtgtgtgtcccaggagctgatcttctgtggctgcacagatggcatcgtgcgcatcttccaggcccacagcctgcactacctggccaacctgcccaagccccactacctgggcgtggatgtggcccagggcctggagcccagcttcctgttccacaggaaggccgaggccgtgtacccagacacagtggccctgacctttgaccccatccaccagtggctgagctgtgtgtacaaggaccacagcatctacatctgggatgtgaaggacatcaacagagtgggcaaggtgtggagcgagctgttccacagcagctatgtgtggaatgtggaggtgtacccagagtttgaggaccagagggcctgcctgcccagcggcagcttcctgacctgcagcagtgacaacaccatccgcttctggaacctggacagcagcccagacagccactggcagaagaacatcttcagcaacaccctgctgaaggtggtgtatgtggagaatgacatccagcacctgcaggacatgagccacttcccagaccggggctctgaaaatggcacccccatggatgtgaaggccggcgtgcgggtgatgcaggtgtccccagatggccagcacctggccagcggggacagaagtggcaacctgcgcatccacgagctgcacttcatggatgagctggtgaaggtggaggcccatgatgctgaggtgctgtgcctggagtacagcaagccagagaccggcctgaccctgctggccagcgccagccgggacaggctcatccacgtgctgaatgtggagaagaactacaacctggagcagaccctggatgaccacagcagcagcatcacagccatcaagtttgctggcaacagagacatccagatgatcagctgtggggctgacaagagcatctacttccgcagcgcccagcagggcagtgatggcctgcactttgtgaggacccaccacgtggccgagaagaccaccctgtatgacatggacatcgacatcacccagaagtatgtggccgtggcctgccaggacagaaatgtgcgggtgtacaacacagtgaatggcaagcagaagaagtgctacaagggcagccagggagatgagggcagcctgctgaaggtgcacgtggaccccagcggcaccttcctggccaccagctgcagcgacaagagcatcagcgtcatcgacttctacagcggggagtgcatcgccaagatgtttggccacagcgagatcatcacctccatgaagttcacctatgactgccaccacctgatcaccgtgtctggggacagctgtgtgttcatctggcacctgggccctgagatcaccaactgcatgaagcagcacctgctggagattgaccaccggcagcagcagcagcacaccaatgacaagaagaggagcggccacccccggcaggacacctacgtgtccaccccatctgagatccacagcctgagccctggagagcagacagaagatgacctggaggaggagtgtgagcctgaggagatgctgaagacccccagcaaggacagcctggaccctgacccccgctgcctgctgaccaacgggaagctgcccctgtgggccaagaggctgctgggagatgatgatgtggctgatggcctggccttccacgccaagaggagctaccagccccacggccgctgggccgagcgggccggccaggagcccctgaagaccatcctggatgcccaggacctggactgctacttcacccccatgaagccagagagcctggagaacagcatcctggacagcctggagccccagagcctggccagcctgctgtctgagagcgagagcccccaggaggccggccggggccaccccagcttcctgccccagcagaaggagagcagcgaggccagcgagctgatcctgtacagcctggaggccgaggtgacagtgactggaacagacagccagtactgcaggaaggaggtggaggccggccctggggaccagcagggcgacagctacctgcgggtgtccagtgacagccccaaggaccagagccccccagaggacagcggggagagcgaggccgacctggagtgcagctttgctgccatccacagccctgcccctcctccagaccctgcccccaggtttgccaccagcctgccccacttccctggctgtgccggccccacagaagatgagctgagcctgcctgagggccccagcgtgcccagcagcagcctgccccagaccccagagcaggagaagttcctgcggcaccactttgagaccctgacagagagcccctgccgggccctgggagatgtggaggccagcgaggccgaggaccacttcttcaacccccggctgagcatcagcacccagttcctgagcagcctgcagaaggccagccgcttcacccacaccttccccccccgggccacccagtgcctggtgaagagccctgaggtgaagctgatggaccggggcggcagccagccccgggccggcaccggctacgccagcccagacaggacccacgtgctggccgccggcaaggccgaggagaccctggaggcctggaggcctcctccaccctgcctgaccagcctggccagctgtgtgcctgccagctctgtgctgcccacagacaggaacctgcccacccccaccagcgcccccaccccaggcctggcccagggcgtgcacgcccccagcacctgcagctacatggaggccacagccagcagccgggcccgcatcagccgcagcatcagcctgggggacagcgagggccccatcgtggccaccctggcccagcccctgcggcggcccagctctgtgggggagctggccagcctgggccaggagctgcaggccatcaccacagccaccacccccagcctggacagcgagggccaggagcccgccctgcgctcctggggcaaccacgaggcccgggccaacctgcggctgaccctgagcagcgcctgtgatggcctgctgcagccccctgtggacacccagcccggggtgacagtgcctgctgtgtccttccctgcccccagccctgtggaggagagcgccctgcggctgcacggcagcgccttccggcccagcctgcctgcccctgagagccctggcctgcctgcccaccccagcaacccccagctgcctgaggcccggcccggcatccctgggggcacagccagcctgctggagcccaccagcggggccctgggcctgctgcagggcagccctgcccgctggagcgagccctgggtgcctgtggaggccctgccccccagccccctggagctgagccgggtgggcaacatcctgcaccggctgcagaccaccttccaggaggccctggacctgtacagagtgctggtgagcagcggccaggtggacaccggccagcagcaggccaggacagagctggtgtccaccttcctgtggatccacagccagctggaggccgagtgcctggtgggcacctctgtggccccagcccaggccctgcccagccctggcccccccagcccccccaccctgtaccccctggccagcccagacctgcaggccctgctggagcactacagcgagctgctggtgcaggccgtgcggaggaaggcccggggccactag

SEQ ID NO: 176027 - DNA, 1245 bp, Artificial Sequence
  Description of Artificial Sequence: Synthetic coding sequence
atggctgctgtgggcagcggcggctacgccagaaatgatgctggggagaagctgcccagcgtgatggccggcgtgcctgcccggcggggccagagcagccccccaccagccccacccatctgcctgcggcggaggacccggctgagcacagccagcgaggagaccgtgcagaacagagtgtccctggagaaggtgctgggcatcacagcccagaacagcagcggcctgacctgtgaccccggcaccggccacgtggcctacctggccggctgtgtggtggtgatcctggaccccaaggagaacaagcagcagcacatcttcaacacagccaggaagagcctgagcgccctggccttctccccagatggcaagtacatcgtgactggagaaaatggccacaggcctgctgtgcgcatctgggatgtggaggagaagaaccaggtggccgagatgctgggccacaagtatggagtggcctgtgtggccttcagccccaacatgaagcacatcgtgtccatgggctaccagcacgacatggtgctgaatgtgtgggactggaagaaggacatcgtggtggccagcaacaaggtgtcctgcagggtcatcgccctgtccttcagcgaggacagcagctactttgtgacagtgggcaacagacatgtgcgcttctggttcctggaggtgtccacagagaccaaggtgaccagcacagtgcccctggtgggccgcagcggcatcctgggggagctgcacaacaacatcttctgtggggtggcctgtggccggggccgcatggccggcagcaccttctgtgtgtcctacagcggcctgctgtgccagttcaatgagaagagggtgctggagaagtggatcaacctgaaggtgtccctgagcagctgcctgtgtgtgtcccaggagctgatcttctgtggctgcacagatggcatcgtgcgcatcttccaggcccacagcctgcactacctggccaacctgcccaagccccactacctgggcgtggatgtggcccagggcctggagcccagcttcctgttccacaggaaggccgaggccgtgtacccagacacagtggccctgacctttgaccccatccaccagtggctgagctgtgtgtacaaggaccacagcatctacatctgggatgtgaaggacatcaacagagtgggcaaggtgtggagcgagctgttccacagcagctatgtgtggaatgtggaggccctgtcctag

SEQ ID NO: 176028 - DNA, 1452 bp, Artificial Sequence
  Description of Artificial Sequence: Synthetic coding sequence
atggctgctgtgggcagcggcggctacgccagaaatgatgctggggagaagctgcccagcgtgatggccggcgtgcctgcccggcggggccagagcagccccccaccagccccacccatctgcctgcggcggaggacccggctgagcacagccagcgaggagaccgtgcagaacagagtgtccctggagaaggtgctgggcatcacagcccagaacagcagcggcctgacctgtgaccccggcaccggccacgtggcctacctggccggctgtgtggtggtgatcctggaccccaaggagaacaagcagcagcacatcttcaacacagccaggaagagcctgagcgccctggccttctccccagatggcaagtacatcgtgactggagaaaatggccacaggcctgctgtgcgcatctgggatgtggaggagaagaaccaggtggccgagatgctgggccacaagtatggagtggcctgtgtggccttcagccccaacatgaagcacatcgtgtccatgggctaccagcacgacatggtgctgaatgtgtgggactggaagaaggacatcgtggtggccagcaacaaggtgtcctgcagggtcatcgccctgtccttcagcgaggacagcagctactttgtgacagtgggcaacagacatgtgcgcttctggttcctggaggtgtccacagagaccaaggtgaccagcacagtgcccctggtgggccgcagcggcatcctgggggagctgcacaacaacatcttctgtggggtggcctgtggccggggccgcatggccggcagcaccttctgtgtgtcctacagcggcctgctgtgccagttcaatgagaagagggtgctggagaagtggatcaacctgaaggtgtccctgagcagctgcctgtgtgtgtcccaggagctgatcttctgtggctgcacagatggcatcgtgcgcatcttccaggcccacagcctgcactacctggccaacctgcccaagccccactacctgggcgtggatgtggcccagggcctggagcccagcttcctgttccacaggaaggccgaggccgtgtacccagacacagtggccctgacctttgaccccatccaccagtggctgagctgtgtgtacaaggaccacagcatctacatctgggatgtgaaggacatcaacagagtgggcaaggtgtggagcgagctgttccacagcagctatgtgtggaatgtggaggtgtacccagagtttgaggaccagagggcctgcctgcccagcggcagcttcctgacctgcagcagtgacaacaccatccgcttctggaacctggacagcagcccagacagccactggcagaagaacatcttcagcaacctggccccagccctgcagatgtgtggccggggccacagccggcagcccaacacccccagccctggagaaattgccagctag

SEQ ID NO: 176029 - DNA, 4572 bp, Artificial Sequence
  Description of Artificial Sequence: Synthetic coding sequence
atggctgctgtgggcagcggcggctacgccagaaatgatgctggggagaagctgcccagcgtgatggccggcgtgcctgcccggcggggccagagcagccccccaccagccccacccatctgcctgcggcggaggacccggctgagcacagccagcgaggagaccgtgcagaacagagtgtccctggagaaggtgctgggcatcacagcccagaacagcagcggcctgacctgtgaccccggcaccggccacgtggcctacctggccggctgtgtggtggtgatcctggaccccaaggagaacaagcagcagcacatcttcaacacagccaggaagagcctgagcgccctggccttctccccagatggcaagtacatcgtgactggagaaaatggccacaggcctgctgtgcgcatctgggatgtggaggagaagaaccaggtggccgagatgctgggccacaagtatggagtggcctgtgtggccttcagccccaacatgaagcacatcgtgtccatgggctaccagcacgacatggtgctgaatgtgtgggactggaagaaggacatcgtggtggccagcaacaaggtgtcctgcagggtcatcgccctgtccttcagcgaggacagcagctactttgtgacagtgggcaacagacatgtgcgcttctggttcctggaggtgtccacagagaccaaggtgaccagcacagtgcccctggtgggccgcagcggcatcctgggggagctgcacaacaacatcttctgtggggtggcctgtggccggggccgcatggccggcagcaccttctgtgtgtcctacagcggcctgctgtgccagttcaatgagaagagggtgctggagaagtggatcaacctgaaggtgtccctgagcagctgcctgtgtgtgtcccaggagctgatcttctgtggctgcacagatggcatcgtgcgcatcttccaggcccacagcctgcactacctggccaacctgcccaagccccactacctgggcgtggatgtggcccagggcctggagcccagcttcctgttccacaggaaggccgaggccgtgtacccagacacagtggccctgacctttgaccccatccaccagtggctgagctgtgtgtacaaggaccacagcatctacatctgggatgtgaaggacatcaacagagtgggcaaggtgtggagcgagctgttccacagcagctatgtgtggaatgtggaggtgtacccagagtttgaggaccagagggcctgcctgcccagcggcagcttcctgacctgcagcagtgacaacaccatccgcttctggaacctggacagcagcccagacagccactggcagaagaacatcttcagcaacaccctgctgaaggtggtgtatgtggagaatgacatccagcacctgcaggacatgagccacttcccagaccggggctctgaaaatggcacccccatggatgtgaaggccggcgtgcgggtgatgcaggtgtccccagatggccagcacctggccagcggggacagaagtggcaacctgcgcatccacgagctgcacttcatggatgagctggtgaaggtggaggcccatgatgctgaggtgctgtgcctggagtacagcaagccagagaccggcctgaccctgctggccagcgccagccgggacaggctcatccacgtgctgaatgtggagaagaactacaacctggagcagaccctggatgaccacagcagcagcatcacagccatcaagtttgctggcaacagagacatccagatgatcagctgtggggctgacaagagcatctacttccgcagcgcccagcagggcagtgatggcctgcactttgtgaggacccaccacgtggccgagaagaccaccctgtatgacatggacatcgacatcacccagaagtatgtggccgtggcctgccaggacagaaatgtgcgggtgtacaacacagtgaatggcaagcagaagaagtgctacaagggcagccagggagatgagggcagcctgctgaaggtgcacgtggaccccagcggcaccttcctggccaccagctgcagcgacaagagcatcagcgtcatcgacttctacagcggggagtgcatcgccaagatgtttggccacagcgagatcatcacctccatgaagttcacctatgactgccaccacctgatcaccgtgtctggggacagctgtgtgttcatctggcacctgggccctgagatcaccaactgcatgaagcagcacctgctggagattgaccaccggcagcagcagcagcacaccaatgacaagaagaggagcggccacccccggcaggacacctacgtgtccaccccatctgagatccacagcctgagccctggagagcagacagaagatgacctggaggaggagtgtgagcctgaggagatgctgaagacccccagcaaggacagcctggaccctgacccccgctgcctgctgaccaacgggaagctgcccctgtgggccaagaggctgctgggagatgatgatgtggctgatggcctggccttccacgccaagaggagctaccagccccacggccgctgggccgagcgggccggccaggagcccctgaagaccatcctggatgcccaggacctggactgctacttcacccccatgaagccagagagcctggagaacagcatcctggacagcctggagccccagagcctggccagcctgctgtctgagagcgagagcccccaggaggccggccggggccaccccagcttcctgccccagcagaaggagagcagcgaggccagcgagctgatcctgtacagcctggaggccgaggtgacagtgactggaacagacagccagtactgcaggaaggaggtggaggccggccctggggaccagcagggcgacagctacctgcgggtgtccagtgacagccccaaggaccagagccccccagaggacagcggggagagcgaggccgacctggagtgcagctttgctgccatccacagccctgcccctcctccagaccctgcccccaggtttgccaccagcctgccccacttccctggctgtgccggccccacagaagatgagctgagcctgcctgagggccccagcgtgcccagcagcagcctgccccagaccccagagcaggagaagttcctgcggcaccactttgagaccctgacagagagcccctgccgggagctgtttcctgctgccctgggagatgtggaggccagcgaggccgaggaccacttcttcaacccccggctgagcatcagcacccagttcctgagcagcctgcagaaggccagccgcttcacccacaccttccccccccgggccacccagtgcctggtgaagagccctgaggtgaagctgatggacagaggaggcagccagcccagggctggcaccggctacgccagcccagacaggacccacgtgctggccgccggcaaggccgaggagaccctggaggcctggaggcctcctccaccctgcctgaccagcctggccagctgtgtgcctgccagctctgtgctgcccacagacaggaacctgcccacccccaccagcgcccccaccccaggcctggcccagggcgtgcacgcccccagcacctgcagctacatggaggccacagccagcagccgggcccgcatcagccgcagcatcagcctgggggacagcgagggccccatcgtggccaccctggcccagcccctgcggcggcccagctctgtgggggagctggccagcctgggccaggagctgcaggccatcaccacagccaccacccccagcctggacagcgagggccaggagcccgccctgcgctcctggggcaaccacgaggcccgggccaacctgcggctgaccctgagcagcgcctgtgatggcctgctgcagccccctgtggacacccagcccggggtgacagtgcctgctgtgtccttccctgcccccagccctgtggaggagagcgccctgcggctgcacggcagcgccttccggcccagcctgcctgcccctgagagccctggcctgcctgcccaccccagcaacccccagctgcctgaggcccggcccggcatccctgggggcacagccagcctgctggagcccaccagcggggccctgggcctgctgcagggcagccctgcccgctggagcgagccctgggtgcctgtggaggccctgccccccagccccctggagctgagccgggtgggcaacatcctgcaccggctgcagaccaccttccaggaggccctggacctgtacagagtgctggtgagcagcggccaggtggacaccggccagcagcaggccaggacagagctggtgtccaccttcctgtggatccacagccagctggaggctgaatgtctggtgggcacctctgtggccccagcccaggccctgcccagccctggcccccccagcccccccaccctgtaccccctggccagcccagacctgcaggccctgctggagcactacagcgagctgctggtgcaggccgtgcggaggaaggcccggggccactag

SEQ ID NO: 176030 - DNA, 1302 bp, Artificial Sequence
  Description of Artificial Sequence: Synthetic coding sequence
gggggctacgccagaaatgatgctggggagaagctgcccagcgtgatggccggcgtgcctgcccggcggggccagagcagccccccaccagccccacccatctgcctgcggcggaggacccggctgagcacagccagcgaggagaccgtgcagaacagagtgtccctggagaaggtgctgggcatcacagcccagaacagcagcggcctgacctgtgaccccggcaccggccacgtggcctacctggccggcatgtggaggatgggccctgccagcgagagctgtggagaagattccatcgcccccagcctgagcaggacagtgcccggcatgtactgtgtggtggtgatcctggaccccaaggagaacaagcagcagcacatcttcaacacagccaggaagagcctgagcgccctggccttctccccagatggcaagtacatcgtgactggagaaaatggccacaggcctgctgtgcgcatctgggatgtggaggagaagaaccaggtggccgagatgctgggccacaagtatggagtggcctgtgtggccttcagccccaacatgaagcacatcgtgtccatgggctaccagcacgacatggtgctgaatgtgtgggactggaagaaggacatcgtggtggccagcaacaaggtgtcctgcagggtcatcgccctgtccttcagcgaggacagcagctactttgtgacagtgggcaacagacatgtgcgcttctggttcctggaggtgtccacagagaccaaggtgaccagcacagtgcccctggtgggccgcagcggcatcctgggggagctgcacaacaacatcttctgtggggtggcctgtggccggggccgcatggccggcagcaccttctgtgtgtcctacagcggcctgctgtgccagttcaatgagaagagggtgctggagaagtggatcaacctgaaggtgtccctgagcagctgcctgtgtgtgtcccaggagctgatcttctgtggctgcacagatggcatcgtgcgcatcttccaggcccacagcctgcactacctggccaacctgcccaagccccactacctgggcgtggatgtggcccagggcctggagcccagcttcctgttccacaggaaggccgaggccgtgtacccagacacagtggccctgacctttgaccccatccaccagtggctgagctgtgtgtacaaggaccacagcatctacatctgggatgtgaaggacatcaacagagtgggcaaggtgtggagcgagctgttccacagcagctatgtgtggaatgtggagtag

SEQ ID NO: 176031 - DNA, 2097 bp, Artificial Sequence
  Description of Artificial Sequence: Synthetic coding sequence
atgtctgctgtggtggcccagaccctgcacgtgtttggcctgcggagccacgtggccaacaacatcttctactttgatgagcagatcatcatcttccccagcggcaaccactgtgtgaagtacaacgtggaccagaagtggcagaagttcatccctggcagcgagaagagccagggcatgctggccctgagcatcagccccaacagacgctacctggccatcagcgagaccgtgcaggagaagccagccatcaccatctatgagctgagcagcatcccctgcaggaagaggaaggtgctgaacaactttgacttccaggtgcagaagttcatctccatggccttctccccagacagcaagtacctgctggcccagaccagccccccagagagcaacctggtgtactggctgtgggagaagcagaaggtgatggccatcgtgagaattgacacccagaacaaccctgtgtaccaggtgtccttcagcccccaggacaacacccaggtgtgtgtgactggaaatggcatgttcaagctgctgcgctttgctgagggcaccctgaagcagaccagcttccagagaggagagccccagaactacctggcccacacctgggtggctgatgacaagatcgtggtgggcacagacaccgggaagctgttcctgtttgaaagtggggaccagcgctgggagaccagcatcatggtgaaggagcccaccaacggcagcaagagcctggatgtgatccaggagagcgagagcctcatcgagttcccccctgtgagcagccccctgcccagctatgagcagatggtggccgccagcagccacagccagatgtccatgccccaggtgtttgccatcgccgcctacagcaaaggatttgcctgcagcgctggccctggccgggtgctgctgtttgagaagatggaggagaaggacttctaccgggagagccgggagatccgcatccctgtggacccccagagcaatgaccccagccagagcgacaagcaggatgtgctgtgcctgtgcttcagccccagcgaggagaccctggtggccagcaccagcaagaaccagctgtacagcatcaccatgagcctgacagagatcagcaagggggagcccgcccactttgagtacctgatgtaccccctgcacagcgcccccatcaccggcctggccacctgcatcaggaagcccctcatcgccacctgcagcctggacaggagcatccggctgtggaactatgagaccaacaccctggagctgttcaaggagtaccaggaggaggcctacagcatcagcctgcaccccagcggccacttcatcgtggtgggctttgctgacaagctgcggctgatgaacctgctgattgatgacatccgctccttcaaggagtacagcgtgcggggctgtggggagtgcagcttcagcaatggaggccacctgtttgctgctgtgaatggaaatgtcatccacgtgtacaccaccaccagcctggagaacatcagcagcctgaagggccacacaggcaagatccgcagcatcgtgtggaatgctgatgacagcaagctgatcagcggcggcacagatggagctgtgtatgagtggaacctgagcacaggcaagcgggagacagaatgtgtgctgaagagctgcagctacaactgtgtgacagtgtccccagatgccaagatcatctttgctgtgggcagtgaccacaccctgaaggagattgctgacagcctcatcctgcgggagatcagcgcctttgatgtgacctacacagccatcgtcatcagccacagcggccgcatgatgtttgtgggcacctctgtgggcaccatccgggccatgaagtaccccctgcccctgcagaaggagttcaatgagtaccaggcccacgccggccccatcaccaaggtgtcccgggccctgagccctggcacccagagccacacctgcctgctgcgggccctcttcatccccagcaccagccagtgcctcttcagcctgctgctgctgagctacctgttcatccaccacagcctgaaccaccacctgctgaccatgaacatcctgtttgtgtag

SEQ ID NO: 176032 - DNA, 501 bp, Artificial Sequence
  Description of Artificial Sequence: Synthetic coding sequence
atgtctgctgtggtggcccagaccctgcacgtgtttggcctgcggagccacgtggccaacaacatcttctactttgatgagcagatcatcatcttccccagcggcaaccactgtgtgaagtacaacgtggaccagaagtggcagaagttcatccctggcagcgagaagagccagggcatgctggccctgagcatcagccccaacagacgctacctggccatcagcgagaccgtgcaggagaagccagccatcaccatctatgagctgagcagcatcccctgcaggaagaggaaggtgctgaacaactttgacttccaggtgcagaagttcatctccatggccttctccccagacagcaagtacctgctggcccagaccagccccccagagagcaacctggtgtactggctgtgggagaagcagaaggtgatggccatcgtgagaattgacacccagaacaaccctgtgtaccaggtgtccttcagcccccaggacaactag

SEQ ID NO: 176033 - DNA, 4473 bp, Artificial Sequence
  Description of Artificial Sequence: Synthetic coding sequence
atggccggcaacagcctggtgctgcccatcgtgctgtggggcaggaaggcccccacccactgcatctctgctgtgctgctgacagatgatggagccaccatcgtgacaggctgccatgatggccagatctgcctgtgggacctgtctgtggagctgcagatcaacccccgggccctgctgtttggccacacagccagcatcacctgcctgagcaaggcctgtgccagcagtgacaagcagtacatcgtgtctgccagcgagagcggggagatgtgcctgtgggatgtgtctgatggccgctgcatcgagttcaccaagctggcctgcacccacacaggcatccagttctaccagttctctgtgggcaaccagcgggagggccgcctgctgtgccacggccactacccagagatcctggtggtggatgccaccagcctggaggtgctgtacagcctggtgtccaagatcagcccagactggatcagctccatgagcatcatccgcagccacaggacccaggaggacacagtggtggccctgtctgtgacaggcatcctgaaggtgtggatcgtgaccagcgagatcagtgacatgcaggacacagagcccatctttgaggaggagagcaagcccatctactgccagaactgccagagcatctccttctgtgccttcacccagaggagcctgctggtggtgtgcagcaagtactggagggtgtttgatgctggggactacagcctgctgtgcagcggccccagtgaaaatggccagacctggacaggaggagactttgtgtccagtgacaaggtgatcatctggacagaaaatggccagagctacatctacaagctgcctgccagctgcctgcctgccagtgacagcttcagaagtgatgtgggcaaggctgtggagaacctgatcccccctgtgcagcacatcctgctggacaggaaggacaaggagctgctgatctgcccccctgtgacccgcttcttctacggctgccgggagtacttccacaagctgctgatccagggcgacagcagcggccgcctgaacatctggaacatcagtgacacagctgacaagcagggcagcgaggagggcctggccatgaccaccagcatcagcctgcaggaggcctttgacaagctgaacccctgcccagctggcatcatcgaccagctgagcgtcatccccaacagcaatgagcccctgaaggtgacagcctctgtgtacatcccagcccacggccgcctggtgtgtggccgggaggatggcagcatcgtcatcgtgcctgccacccagacagccatcgtgcagctgctgcagggcgagcacatgctgcggcggggctggccaccccacaggaccctgcggggccacaggaacaaggtgacctgcctgctgtacccccaccaggtgtctgcccgctatgaccagcgctacctgatctctggaggagtggacttcagcgtcatcatctgggacatcttctctggagagatgaagcacatcttctgtgtgcatggaggagagatcacccagctgctggtgcccccagagaactgcagcgcccgggtgcagcactgcatctgcagcgtggccagtgaccacagcgtgggcctgctgagcctgcgggagaagaagtgcatcatgctggccagccgccacctgttccccatccaggtgatcaagtggaggcccagtgatgactacctggtggtgggctgcagtgatggctctgtgtatgtgtggcagatggacacaggagccctggacagatgtgtgatgggcatcacagctgtggagatcctgaatgcctgtgatgaagctgtgcctgctgctgtggacagcctgagccaccctgctgtgaacctgaagcaggccatgacccggcgcagcctggccgccctgaagaacatggcccaccacaagctgcagaccctggccaccaacctgctggccagcgaggccagtgacaagggcaacctgcccaagtacagccacaacagcctgatggtgcaggccatcaagaccaacctgacagatcctgacatccacgtgctcttctttgatgtggaggccctgatcatccagctgctgacagaggaggccagccggcccaacacagccctgatcagccctgagaacctgcagaaggccagcggcagcagtgacaagggcggcagcttcctgaccgggaagagagctgctgtgctcttccagcaggtgaaggagaccatcaaggagaacatcaaggagcacctgctggatgatgaggaggaggatgaggagatcatgaggcagaggcgggaggagagtgaccctgagtaccgcagcagcaagagcaagcccctgaccctgctggagtacaacctgaccatggacacagccaagctgttcatgagctgcctgcacgcctggggcctgaatgaggtgctggatgaggtgtgcctggaccggctgggcatgctgaagccccactgcaccgtgtcctttggcctgctgagcagaggaggccacatgagcctgatgctgcccggctacaaccagcctgcctgcaagctgagccacggcaagacagaggtgggcaggaagctgcctgccagcgagggcgtgggcaagggcacctacggcgtgtccagagctgtgaccacccagcacctgctgagcatcatcagcctggccaacaccctgatgtccatgaccaatgccaccttcatcggggaccacatgaagaagggccccaccaggcctccccggcccagcaccccagacctgagcaaggcccggggcagcccccccaccagcagcaacatcgtgcagggccagatcaagcaggtggccgcccctgtggtgtctgcccggagtgatgctgaccacagcggcagtgacccccccagcgccccagccctgcacacctgcttcctggtgaatgaaggctggagccagctggccgccatgcactgtgtgatgctgcctgacctgctgggcctggacaagttccggccccccctgctggagatgctggcccggcgctggcaggaccgctgcctggaggtgcgggaggccgcccaggccctgctgctggccgagctgcggcgcatcgagcaggccggcaggaaggaggccattgatgcctgggccccctacctgccccagtacatcgaccacgtgatcagccctggggtgaccagcgaggccgcccagaccatcaccacagccccagatgccagcggccctgaggccaaggtgcaggaggaggagcatgacctggtggatgatgacatcaccaccggctgcctgagctctgtgccccagatgaagaagatcagcaccagctatgaggagaggaggaagcaggccacagccatcgtgctgctgggcgtgattggagctgagtttggagctgagattgagccccccaagctgctgacccggcccaggagcagcagccagatccctgagggcttcggcctgaccagcggcggcagcaactacagcctggcccggcacacctgcaaggccctgaccttcctgctgctgcagccccccagccccaagctgcccccccacagcaccatccggaggacagccatcgacctgattggccggggcttcaccgtgtgggagccctacatggatgtgtctgctgtgctgatgggcctgctggagctgtgtgctgatgctgagaagcagctggccaacatcaccatgggcctgcccctgagccctgctgctgacagcgcccggagcgcccggcatgccctgagcctcatcgccacagcccggcccccagccttcatcaccaccatcgccaaggaggtgcaccgccacacagccctggccgccaacacccagagccagcagaacatgcacaccaccaccctggcccgggccaagggggagatcctgcgggtcatcgagatcctgattgagaagatgcccacagatgtggtggacctgctggtggaggtgatggacatcatcatgtactgcctggagggcagcctggtgaagaagaagggcctgcaggagtgcttccctgccatctgccgcttctacatggtgtcctactatgaaagaaaccacagaattgctgtgggcgcccggcacggctctgtggccctgtatgacatcagaacaggcaagtgccagaccatccacggccacaagggccccatcacagctgtggcctttgccccagatggccgctacctggccacctacagcaacacagacagccacatctccttctggcagatgaacaccagcctgctgggcagcatcggcatgctgaacagcgccccccagctgcgctgcatcaagacctaccaggtgccccctgtgcagcctgccagccctggcagccacaatgccctgaagctggcccggctcatctggaccagcaacagaaatgtcatcctgatggcccatgatggcaaggagcaccgcttcatggtgtag

SEQ ID NO: 176034 - DNA, 4374 bp, Artificial Sequence
  Description of Artificial Sequence: Synthetic coding sequence
atggccggcaacagcctggtgctgcccatcgtgctgtggggcaggaaggcccccacccactgcatctctgctgtgctgctgacagatgatggagccaccatcgtgacaggctgccatgatggccagatctgcctgtgggacctgtctgtggagctgcagatcaacccccgggccctgctgtttggccacacagccagcatcacctgcctgagcaaggcctgtgccagcagtgacaagcagtacatcgtgtctgccagcgagagcggggagatgtgcctgtgggatgtgtctgatggccgctgcatcgagttcaccaagctggcctgcacccacacaggcatccagttctaccagttctctgtgggcaaccagcgggagggccgcctgctgtgccacggccactacccagagatcctggtggtggatgccaccagcctggaggtgctgtacagcctggtgtccaagatcagcccagactggatcagctccatgagcatcatccgcagccacaggacccaggaggacacagtggtggccctgtctgtgacaggcatcctgaaggtgtggatcgtgaccagcgagatcagtgacatgcaggacacagagcccatctttgaggaggagagcaagcccatctactgccagaactgccagagcatctccttctgtgccttcacccagaggagcctgctggtggtgtgcagcaagtactggagggtgtttgatgctggggactacagcctgctgtgcagcggccccagtgaaaatggccagacctggacaggaggagactttgtgtccagtgacaaggtgatcatctggacagaaaatggccagagctacatctacaagctgcctgccagctgcctgcctgccagtgacagcttcagaagtgatgtgggcaaggctgtggagaacctgatcccccctgtgcagcacatcctgctggacaggaaggacaaggagctgctgatctgcccccctgtgacccgcttcttctacggctgccgggagtacttccacaagctgctgatccagggcgacagcagcggccgcctgaacatctggaacatcagtgacacagctgacaagcagggcagcgaggagggcctggccatgaccaccagcatcagcctgcaggaggcctttgacaagctgaacccctgcccagctggcatcatcgaccagctgagcgtcatccccaacagcaatgagcccctgaaggtgacagcctctgtgtacatcccagcccacggccgcctggtgtgtggccgggaggatggcagcatcgtcatcgtgcctgccacccagacagccatcgtgcagctgctgcagggcgagcacatgctgcggcggggctggccaccccacaggaccctgcggggccacaggaacaaggtgacctgcctgctgtacccccaccaggtgtctgcccgctatgaccagcgctacctgatctctggaggagtggacttcagcgtcatcatctgggacatcttctctggagagatgaagcacatcttctgtgtgcatggaggagagatcacccagctgctggtgcccccagagaactgcagcgcccgggtgcagcactgcatctgcagcgtggccagtgaccacagcgtgggcctgctgagcctgcgggagaagaagtgcatcatgctggccagccgccacctgttccccatccaggtgatcaagtggaggcccagtgatgactacctggtggtgggctgcagtgatggctctgtgtatgtgtggcagatggacacaggagccctggacagatgtgtgatgggcatcacagctgtggagatcctgaatgcctgtgatgaagctgtgcctgctgctgtggacagcctgagccaccctgctgtgaacctgaagcaggccatgacccggcgcagcctggccgccctgaagaacatggcccaccacaagctgcagaccctggccaccaacctgctggccagcgaggccagtgacaagggcaacctgcccaagtacagccacaacagcctgatggtgcaggccatcaagaccaacctgacagatcctgacatccacgtgctcttctttgatgtggaggccctgatcatccagctgctgacagaggaggccagccggcccaacacagccctgatcagccctgagaacctgcagaaggccagcggcagcagtgacaagggcggcagcttcctgaccgggaagagagctgctgtgctcttccagcaggtgaaggagaccatcaaggagaacatcaaggagcacctgctggatgatgaggaggaggatgaggagatcatgaggcagaggcgggaggagagtgaccctgagtaccgcagcagcaagagcaagcccctgaccctgctggagtacaacctgaccatggacacagccaagctgttcatgagctgcctgcacgcctggggcctgaatgaggtgctggatgaggtgtgcctggaccggctgggcatgctgaagccccactgcaccgtgtcctttggcctgctgagcagaggaggccacatgagcctgatgctgcccggctacaaccagcctgcctgcaagctgagccacggcaagacagaggtgggcaggaagctgcctgccagcgagggcgtgggcaagggcacctacggcgtgtccagagctgtgaccacccagcacctgctgagcatcatcagcctggccaacaccctgatgtccatgaccaatgccaccttcatcggggaccacatgaagaagggccccaccaggcctccccggcccagcaccccagacctgagcaaggcccggggcagcccccccaccagcagcaacatcgtgcagggccagatcaagcagggctggagccagctggccgccatgcactgtgtgatgctgcctgacctgctgggcctggacaagttccggccccccctgctggagatgctggcccggcgctggcaggaccgctgcctggaggtgcgggaggccgcccaggccctgctgctggccgagctgcggagaattgagcaggccggcaggaaggaggccattgatgcctgggccccctacctgccccagtacatcgaccacgtgatcagccctggggtgaccagcgaggccgcccagaccatcaccacagccccagatgccagcggccctgaggccaaggtgcaggaggaggagcatgacctggtggatgatgacatcaccaccggctgcctgagctctgtgccccagatgaagaagatcagcaccagctatgaggagaggaggaagcaggccacagccatcgtgctgctgggcgtcatcggggctgagtttggagctgagattgagccccccaagctgctgacccggcccaggagcagcagccagatccctgagggcttcggcctgaccagcggcggcagcaactacagcctggcccggcacacctgcaaggccctgaccttcctgctgctgcagccccccagccccaagctgcccccccacagcaccatcagaagaacagccatcgacctgattggccggggcttcaccgtgtgggagccctacatggatgtgtctgctgtgctgatgggcctgctggagctgtgtgctgatgctgagaagcagctggccaacatcaccatgggcctgcccctgagccctgctgctgacagcgcccggagcgcccggcatgccctgagcctgattgccacagcccggcccccagccttcatcaccaccatcgccaaggaggtgcaccgccacacagccctggccgccaacacccagagccagcagaacatgcacaccaccaccctggcccgggccaagggggagatcctgcgggtgattgagatcctgattgagaagatgcccacagatgtggtggacctgctggtggaggtgatggacatcatcatgtactgcctggagggcagcctggtgaagaagaagggcctgcaggagtgcttccctgccatctgccgcttctacatggtgtcctactatgaaagaaaccacagaattgctgtgggcgcccggcacggctctgtggccctgtatgacatcagaacaggcaagtgccagaccatccacggccacaagggccccatcacagctgtggcctttgccccagatggccgctacctggccacctacagcaacacagacagccacatctccttctggcagatgaacaccagcctgctgggcagcatcggcatgctgaacagcgccccccagctgcgctgcatcaagacctaccaggtgccccctgtgcagcctgccagccctggcagccacaatgccctgaagctggcccggctcatctggaccagcaacagaaatgtcatcctgatggcccatgatggcaaggagcaccgcttcatggtgtag

SEQ ID NO: 176035 - DNA, 4374 bp, Artificial Sequence; identical to SEQ ID NO: 176034
  Description of Artificial Sequence: Synthetic coding sequence

SEQ ID NO: 176036 - DNA, 2448 bp, Artificial Sequence
  Description of Artificial Sequence: Synthetic coding sequence
atggccggcaacagcctggtgctgcccatcgtgctgtggggcaggaaggcccccacccactgcatctctgctgtgctgctgacagatgatggagccaccatcgtgacaggctgccatgatggccagatctgcctgtgggacctgtctgtggagctgcagatcaacccccgggccctgctgtttggccacacagctgtgctcttccagcaggtgaaggagaccatcaaggagaacatcaaggagcacctgctggatgatgaggaggaggatgaggagatcatgaggcagaggcgggaggagagtgaccctgagtaccgcagcagcaagagcaagcccctgaccctgctggagtacaacctgaccatggacacagccaagctgttcatgagctgcctgcacgcctggggcctgaatgaggtgctggatgaggtgtgcctggaccggctgggcatgctgaagccccactgcaccgtgtcctttggcctgctgagccggggcggccacatgagcctgatgctgcccggctacaaccagcctgcctgcaagctgagccacggcaagacagaggtgggcaggaagctgcctgccagcgagggcgtgggcaagggcacctatggagtgtccagagctgtgaccacccagcacctgctgagcatcatcagcctggccaacaccctgatgtccatgaccaatgccaccttcatcggggaccacatgaagaagggccccacccggcccccccggcccagcaccccagacctgagcaaggcccggggcagcccccccaccagcagcaacatcgtgcagggccagatcaagcaggtggccgcccctgtggtgtctgcccggagtgatgctgaccacagcggcagtgaccccccatctgccccagccctgcacacctgcttcctggtgaatgaaggctggagccagctggccgccatgcactgtgtgatgctgcctgacctgctgggcctggacaagttccggccccccctgctggagatgctggcccggcgctggcaggaccgctgcctggaggtgcgggaggccgcccaggccctgctgctggccgagctgcggagaattgagcaggccggcaggaaggaggccattgatgcctgggccccctacctgccccagtacatcgaccacgtgatcagccctggggtgaccagcgaggccgcccagaccatcaccacagccccagatgccagcggccctgaggccaaggtgcaggaggaggagcatgacctggtggatgatgacatcaccaccggctgcctgagctctgtgccccagatgaagaagatcagcaccagctatgaggagaggaggaagcaggccacagccatcgtgctgctgggcgtcatcggggctgagtttggagctgagattgagccccccaagctgctgacccggcccaggagcagcagccagatccctgagggcttcggcctgaccagcggcggcagcaactacagcctggcccggcacacctgcaaggccctgaccttcctgctgctgcagccccccagccccaagctgcccccccacagcaccatcagaagaacagccatcgacctgattggccggggcttcaccgtgtgggagccctacatggatgtgtctgctgtgctgatgggcctgctggagctgtgtgctgatgctgagaagcagctggccaacatcaccatgggcctgcccctgagccctgctgctgacagcgcccggagcgcccggcatgccctgagcctgattgccacagcccggcccccagccttcatcaccaccatcgccaaggaggtgcaccgccacacagccctggccgccaacacccagagccagcagaacatgcacaccaccaccctggcccgggccaagggggagatcctgcgggtgattgagatcctgattgagaagatgcccacagatgtggtggacctgctggtggaggtgatggacatcatcatgtactgcctggagggcagcctggtgaagaagaagggcctgcaggagtgcttccctgccatctgccgcttctacatggtgtcctactatgaaagaaaccacagaattgctgtgggcgcccggcacggctctgtggccctgtatgacatcagaacaggcaagtgccagaccatccacggccacaagggccccatcacagctgtggcctttgccccagatggccgctacctggccacctacagcaacacagacagccacatctccttctggcagatgaacaccagcctgctgggcagcatcggcatgctgaacagcgccccccagctgcgctgcatcaagacctaccaggtgccccctgtgcagcctgccagccctggcagccacaatgccctgaagctggcccggctcatctggaccagcaacagaaatgtcatcctgatggcccatgatggcaaggagcaccgcttcatggtgtag

SEQ ID NO: 176037 - DNA, 3309 bp, Artificial Sequence
  Description of Artificial Sequence: Synthetic coding sequence
atgaggaccagcctgcaggccgtggccctgtggggccagaaggccccaccccacagcatcacagccatcatgatcacagatgaccagaggaccatcgtgacaggcagccaggagggccagctgtgcctgtggaacctgagccatgagctgaagatcagcgccaaggagctgctgtttggccacagcgcctctgtgacctgcctggcccgggcccgggacttcagcaagcagccctacatcgtgtctgctgctgaaaatggagagatgtgtgtgtggaatgtgaccaacggccagtgcatggagaaggccaccctgccctaccgccacacagccatctgctactaccactgcagcttcaggatgaccggggagggctggctgctgtgctgcggggagtaccaggatgtgctgatcattgatgccaagaccctggccgtggtgcacagcttccgcagcagccagttcccagactggatcaactgcatgtgcatcgtgcacagcatgaggatccaggaggacagcctgctggtggtgtctgtggccggggagctgaaggtgtgggacctgagcagcagcatcaacagcatccaggagaagcaggatgtgtatgagaaggagagcaagttcctggagagcctgaactgccagaccatccgcttctgcacctacacagagcggctgctgctggtggtgttcagcaagtgctggaaggtgtatgactactgtgacttcagcctgctgctgacagaggtgtccagaaatggccagttctttgctggaggagaggtgattgctgcccaccgcatcctgatctggacagaagatggccacagctacatctaccagctgctgaacagcggcctgagcaagagcatctacccagcagatggccgggtgctgaaggagaccatctacccccacctgctgtgcagcacctctgtgcaggagaacaaggagcagagccggccctttgtgatgggctacatgaatgaaaggaaggagcccttctacaaggtgctcttcagcggggaggtgtctggccgcatcaccctgtggcacatcccagatgtgcctgtgtccaagtttgatggcagcccccgggagatccctgtgacagccacctggaccctgcaggacaactttgacaagcatgacaccatgagccagagcatcatcgactacttcagcggcctgaaggatggagctggaacagctgtggtgaccagcagcgagtacatccccagcctggacaagctgatctgtggctgtgaagatggcaccatcatcatcacccaggccctgaatgctgccaaggcccggctgctggagggcggcagcctggtgaaggacagccccccccacaaggtgctgaagggccaccaccagagcgtgaccagcctgctgtacccccacggcctgagcagcaagctggaccagagctggatgctgagcggggacctggacagctgtgtgatcctgtgggacatcttcacagaggagatcctgcacaagttcttcctggaggccggccctgtgaccagcctgctgatgagccctgagaagttcaagctgcggggggagcagatcatctgctgcgtgtgtggggaccacagcgtggccctgctgcacctggagggcaagagctgcctgctgcacgccaggaagcacctgtttcctgtgaggatgatcaagtggcaccctgtggagaacttcctgattgtgggctgtgctgatgacagcgtgtacatctgggagattgagaccggcaccctggagagacatgagaccggggagcgggcccgcatcatcctgaactgctgtgatgacagccagctggtgaagtctgtgctgcccatcgccagcgagaccctgaagcacaagagcattgagcagaggagcagcagcccctaccagctgggccccctgccctgccccggcctgcaggtggagagcagctgcaaggtgacagatgccaagttctgcccccggcccttcaacgtgctgcctgtgaagaccaagtggagcaatgtgggcttccacatcctgctgtttgacctggagaacctggtggagctgctgctgcccacccccctgagtgatgtggacagcagcagcagcttctacggcggggaggtgctgcggcgggccaagagcacagtggagaagaagaccctgaccctgaggaagagcaagacagcctgtggccccctgtctgctgaggccctggccaagcccatcacagagagcctggcccagggcgacaacaccatcaagttcagcgaggagaatgatggcatcaagaggcagaagaagatgaagatcagcaagaagatgcagcccaagcccagcaggaaggtggatgccagcctgaccatcgacacagccaagctgttcctgagctgcctgctgccctggggcgtggacaaggacctggactacctgtgcatcaagcacctgaacatcctgaagctgcagggccccatcagcctgggcatcagcctgaatgaagacaacttcagcctgatgctgcccggctgggacctgtgcaacagcggcatgatcaaggactacagcggcgtgaacctcttcagcaggaaggtgctggacctgagtgacaagtacacagccaccctgcccaaccaggtgggcatcccccggggcctggagaacaactgtgacagcctgcgggagagtgacaccatcgtgtacctgctgagccgcctcttcctggtgaacaagctggtgaacatgcccctggagctggcctgccgggtgggcagcagcttcaggatggagagcatccacaacaagatgagaggagctggaaatgacatcctgaacatgagcagcttctacagctgcctgagaaatggcaagaatgaaagccacgtgcctgaggccgacctgagcctgctgaagctgatcagctgctggagggaccagagcgtgcaggtgacagaggccatccaggccgtgctgctggccgaggtgcagcagcacatgaagagcctgggcaagatccctgtgaacagccagcctgtgtccatggccgagaatggaaactgtgagatgaagcagatgctgcccaagctggagtggacagaggagctggagctgcagtgtgtgaggaacaccctgcccctgcagacccctgtgtcccctgtgaagcatgacagcaacagcaacagcgccaacttccaggatgtggaggacatgccagacagatgtgccctggaggagagcgagagccctggagagcccaggcaccacagctggatcgccaaggtgtgcccctgcaaggtgtcctag

SEQ ID NO: 176038 - DNA, 3309 bp, Artificial Sequence; identical to SEQ ID NO: 176037
  Description of Artificial Sequence: Synthetic coding sequence

SEQ ID NO: 176039 - DNA, 3300 bp, Artificial Sequence
  Description of Artificial Sequence: Synthetic coding sequence
atgaggaccagcctgcaggccgtggccctgtggggccagaaggccccaccccacagcatcacagccatcatgatcacagatgaccagaggaccatcgtgacaggcagccaggagggccagctgtgcctgtggaacctgagccatgagctgaagatcagcgccaaggagctgctgtttggccacagcgcctctgtgacctgcctggcccgggcccgggacttcagcaagcagccctacatcgtgtctgctgctgaaaatggagagatgtgtgtgtggaatgtgaccaacggccagtgcatggagaaggccaccctgccctaccgccacacagccatctgctactaccactgcagcttcaggatgaccggggagggctggctgctgtgctgcggggagtaccaggatgtgctgatcattgatgccaagaccctggccgtggtgcacagcttccgcagcagccagttcccagactggatcaactgcatgtgcatcgtgcacagcatgaggatccaggacagcctgctggtggtgtctgtggccggggagctgaaggtgtgggacctgagcagcagcatcaacagcatccaggagaagcaggatgtgtatgagaaggagagcaagttcctggagagcctgaactgccagaccatccgcttctgcacctacacagagcggctgctgctggtggtgttcagcaagtgctggaaggtgtatgactactgtgacttcagcctgctgctgacagaggtgtccagaaatggccagttctttgctggaggagaggtgattgctgcccaccgcatcctgatctggacagaagatggccacagctacatctaccagctgctgaacagcggcctgagcaagagcatctacccagcagatggccgggtgctgaaggagaccatctacccccacctgctgtgcagcacctctgtgcaggagaacaagagccggccctttgtgatgggctacatgaatgaaaggaaggagcccttctacaaggtgctcttctctggagaggtgtctggccgcatcaccctgtggcacatcccagatgtgcctgtgtccaagtttgatggcagcccccgggagatccctgtgacagccacctggaccctgcaggacaactttgacaagcatgacaccatgagccagagcatcatcgactacttcagcggcctgaaggatggagctggaacagctgtggtgaccagcagcgagtacatccccagcctggacaagctgatctgtggctgtgaagatggcaccatcatcatcacccaggccctgaatgctgccaaggcccggctgctggagggcggcagcctggtgaaggacagccccccccacaaggtgctgaagggccaccaccagagcgtgaccagcctgctgtacccccacggcctgagcagcaagctggaccagagctggatgctgagcggggacctggacagctgtgtgatcctgtgggacatcttcacagaggagatcctgcacaagttcttcctggaggccggccctgtgaccagcctgctgatgagccctgagaagttcaagctgcggggggagcagatcatctgctgcgtgtgtggggaccacagcgtggccctgctgcacctggagggcaagagctgcctgctgcacgccaggaagcacctgtttcctgtgaggatgatcaagtggcaccctgtggagaacttcctgattgtgggctgtgctgatgattctgtgtacatctgggagattgaaacaggcaccctggagagacatgaaacaggagagcgggcccgcatcatcctgaactgctgtgatgacagccagctggtgaagtctgtgctgcccatcgccagcgagaccctgaagcacaagagcattgagcagaggagcagcagcccctaccagctgggccccctgccctgccccggcctgcaggtggagagcagctgcaaggtgacagatgccaagttctgcccccggcccttcaacgtgctgcctgtgaagaccaagtggagcaatgtgggcttccacatcctgctgtttgacctggagaacctggtggagctgctgctgcccacccccctgagtgatgtggacagcagcagcagcttctatggaggagaggtgctgcggcgggccaagagcacagtggagaagaagaccctgaccctgaggaagagcaagacagcctgtggccccctgtctgctgaggccctggccaagcccatcacagagagcctggcccagggcgacaacaccatcaagttctctgaagaaaatgatggcatcaagaggcagaagaagatgaagatcagcaagaagatgcagcccaagcccagcaggaaggtggatgccagcctgaccatcgacacagccaagctgttcctgagctgcctgctgccctggggcgtggacaaggacctggactacctgtgcatcaagcacctgaacatcctgaagctgcagggccccatcagcctgggcatcagcctgaatgaagacaacttcagcctgatgctgcccggctgggacctgtgcaacagcggcatgatcaaggactacagcggcgtgaacctcttcagcaggaaggtgctggacctgagtgacaagtacacagccaccctgcccaaccaggtgggcatcccccggggcctggagaacaactgtgacagcctgcgggagagtgacaccatcgtgtacctgctgagccgcctcttcctggtgaacaagctggtgaacatgcccctggagctggcctgccgggtgggcagcagcttcaggatggagagcatccacaacaagatgagaggagctggaaatgacatcctgaacatgagcagcttctacagctgcctgagaaatggcaagaatgaaagccacgtgcctgaggccgacctgagcctgctgaagctgatcagctgctggagggaccagagcgtgcaggtgacagaggccatccaggccgtgctgctggccgaggtgcagcagcacatgaagagcctgggcaagatccctgtgaacagccagcctgtgtccatggctgaaaatggaaactgtgagatgaagcagatgctgcccaagctggagtggacagaggagctggagctgcagtgtgtgaggaacaccctgcccctgcagacccctgtgtcccctgtgaagcatgacagcaacagcaacagcgccaacttccaggatgtggaggacatgccagacagatgtgccctggaggagagcgagagccctggagagcccaggcaccacagctggatcgccaaggtgtgcccctgcaaggtgtcctag

SEQ ID NO: 176040 - DNA, 2328 bp, Artificial Sequence
  Description of Artificial Sequence: Synthetic coding sequence
atgaggaccagcctgcaggccgtggccctgtggggccagaaggccccaccccacagcatcacagccatcatgatcacagatgaccagaggaccatcgtgacaggcagccaggagggccagctgtgcctgtggaacctgagccatgagctgaagatcagcgccaaggagctgctgtttggccacagcgcctctgtgacctgcctggcccgggcccgggacttcagcaagcagccctacatcgtgtctgctgctgaaaatggagagatgtgtgtgtggaatgtgaccaacggccagtgcatggagaaggccaccctgccctaccgccacacagccatctgctactaccactgcagcttcaggatgaccggggagggctggctgctgtgctgcggggagtaccaggatgtgctgatcattgatgccaagaccctggccgtggtgcacagcttccgcagcagccagttcccagactggatcaactgcatgtgcatcgtgcacagcatgaggatccaggaggacagcctgctggtggtgtctgtggccggggagctgaaggtgtgggacctgagcagcagcatcaacagcatccaggagaagcaggatgtgtatgagaaggagagcaagttcctggagagcctgaactgccagaccatccgcttctgcacctacacagagcggctgctgctggtggtgttcagcaagtgctggaaggtgtatgactactgtgacttcagcctgctgctgacagaggtgtccagaaatggccagttctttgctggaggagaggtgattgctgcccaccgcatcctgatctggacagaagatggccacagctacatctaccagctgctgaacagcggcctgagcaagagcatctacccagcagatggccgggtgctgaaggagaccatctacccccacctgctgtgcagcacctctgtgcaggagaacaaggagcagagccggccctttgtgatgggctacatgaatgaaaggaaggagcccttctacaaggtgctcttcagcggggaggtgtctggccgcatcaccctgtggcacatcccagatgtgcctgtgtccaagtttgatggcagcccccgggagatccctgtgacagccacctggaccctgcaggacaactttgacaagcatgacaccatgagccagagcatcatcgactacttcagcggcctgaaggatggagctggaacagctgtggtgaccagcagcgagtacatccccagcctggacaagctgatctgtggctgtgaagatggcaccatcatcatcacccaggccctgaatgctgccaaggcccggctgctggagggcggcagcctggtgaaggacagccccccccacaaggtgctgaagggccaccaccagagcgtgaccagcctgctgtacccccacggcctgagcagcaagctggaccagagctggatgctgagcggggacctggacagctgtgtgatcctgtgggacatcttcacagaggagatcctgcacaagttcttcctggaggccggccctgtgaccagcctgctgatgagccctgagaagttcaagctgcggggggagcagatcatctgctgcgtgtgtggggaccacagcgtggccctgctgcacctggagggcaagagctgcctgctgcacgccaggaagcacctgtttcctgtgaggatgatcaagtggcaccctgtggagaacttcctgattgtgggctgtgctgatgacagcgtgtacatctgggagattgagaccggcaccctggagagacatgagaccggggagcgggcccgcatcatcctgaactgctgtgatgacagccagctggtgaagtctgtgctgcccatcgccagcgagaccctgaagcacaagagcattgagcagaggagcagcagcccctaccagctgggccccctgccctgccccggcctgcaggtggagagcagctgcaaggtgacagatgccaagttctgcccccggcccttcaacgtgctgcctgtgaagaccaagtggagcaatgtgggcttccacatcctgctgtttgacctggagaacctggtggagctgctgctgcccacccccctgagtgatgtggacagcagcagcagcttctacggcggggaggtgctgcggcgggccaagagcacagtggagaagaagaccctgaccctgaggaagagcaagacagcctgtggccccctgtctgctgaggccctggccaagcccatcacagagagcctggcccagggcgacaacaccatcaagttcagcgaggagaatgatggcatcaagaggcagaagaagatgaagatctcctag

SEQ ID NO: 176041 - DNA, 1119 bp, Artificial Sequence
  Description of Artificial Sequence: Synthetic coding sequence
atggagcccgcccccagcgctggagctgagctgcagccccccctgtttgccaatgccagtgatgcctaccccagcgcctgccccagcgctggggccaatgccagcggccccccaggggcccggagcgccagcagcctggccctggccatcgccatcacagccctgtacagcgctgtgtgtgctgtgggcctgctgggcaatgtgctggtgatgtttggcatcgtgcgctacaccaagatgaagacagccaccaacatctacatcttcaacctggccctggctgatgccctggccaccagcaccctgcccttccagagcgccaagtacctgatggagacctggccctttggagagctgctgtgcaaggctgtgctgagcattgactactacaacatgttcaccagcatcttcaccctgaccatgatgtctgtggaccgctacatcgctgtgtgccaccctgtgaaggccctggacttccgcaccccagccaaggccaagctgatcaacatctgcatctgggtgctggccagcggcgtgggcgtgcccatcatggtgatggctgtgacccggcccagagatggagctgtggtgtgcatgctgcagttccccagccccagctggtactgggacacagtgaccaagatctgtgtgttcctgtttgcctttgtggtgcccatcctgatcatcaccgtgtgctacggcctgatgctgctgcggctgcggtctgtgcggctgctgagcggcagcaaggagaaggacaggagcctgcggcgcatcaccaggatggtgctggtggtggtgggcgcctttgtggtgtgctgggcccccatccacatcttcgtcatcgtgtggaccctggtggacatcgacagaagagaccccctggtggtggccgccctgcacctgtgcatcgccctgggctacgccaacagcagcctgaaccctgtgctgtatgccttcctggatgagaacttcaagcgctgcttccggcagctgtgcaggaagccctgtggccgcccagaccccagcagcttcagccgggcccgggaggccacagcccgggagcgggtgacagcctgcacccccagtgatggccctgggggcggcgctgctgcctag

SEQ ID NO: 176042 - DNA, 837 bp, Artificial Sequence
  Description of Artificial Sequence: Synthetic coding sequence
atgaggaaggagaccccaccacccctggtgcccccagctgcccgggagtggaacctgcccccaaatgccccagcctgcatggagcggcagctggaggccgcccgctacagaagtgatggagccctgctgctgggcgccagcagcctgagcggccgctgctgggccggcagcctgtggctgttcaaggacccctgtgccgccccaaatgaaggcttctgcagcgctggggtgcagacagaagctggggtggccgacctgacctgggtgggggagcggggcatcctggtggccagtgacagcgcccatgctgcccaggtgacctgtgtggccgccagcccccacaaggacagcgtcttcctgagctgcagcgaggacaaccgcatcctgctgtgggacacccgctgccccaagccagccagccagatcggctgcagcgcccctggctacctgcccaccagcctggcctggcacccccagcagagcgaggtgtttgtgtttggagatgaaaatggcaccgtgtccctggtggacaccaagagcaccagctgtgtgctgagcagcgctgtgcacagccagtgtgtgacaggcctggtgttcagcccccacagcgtgcccttcctggccagcctgtctgaggactgcagcctggccgtgctggacagcagcctgtctgagctgttccgcagccaggcccaccgggactttgtgagagatgccacctggagccccctgaaccacagcctgctgaccaccgtgggctgggaccaccaggtggtgcaccacgtggtgcccacagagcccctgcctgcccctggccctgcctctgtgacagaatag

SEQ ID NO: 176043 - DNA, 876 bp, Artificial Sequence
  Description of Artificial Sequence: Synthetic coding sequence
tgatgtgccgccccaaatgaaggcttctgcagcgctggggtgcagacagaggccggcgtggccgacctgacctgggtgggggagcggggcatcctggtggccagtgacagcggggctgtggagctgtgggagctggatgaaaatgagaccctcatcgtgtccaagttctgcaagtatgaacatgatgacatcgtgtccacagtgtctgtgctgagcagcggcacccaggccgtgtctggcagcaaggacatctgcatcaaggtgtgggacctggcccagcaggtggtgctgagcagctaccgggcccacgccgcccaggtgacctgtgtggccgccagcccccacaaggacagcgtcttcctgagctgcagcgaggacaaccgcatcctgctgtgggacacccgctgccccaagccagccagccagatcggctgcagcgcccctggctacctgcccaccagcctggcctggcacccccagcagagcgaggtgtttgtgtttggagatgaaaatggaacagtgtccctggtggacaccaagagcaccagctgtgtgctgagcagcgctgtgcacagccagtgtgtgacaggcctggtgttcagcccccaccggctggacctgagccagcccagcccccccagcgacagcgtgcccttcctggccagcctgtctgaggactgcagcctggccgtgctggacagcagcctgtctgagctgttccgcagccaggcccaccgggactttgtgagagatgccacctggagccccctgaaccacagcctgctgaccaccgtgggctgggaccaccaggtggtgcaccacgtggtgcccacagagcccctgcctgcccctggccctgcctctgtgacagaatag

SEQ ID NO: 176044 - DNA, 942 bp, Artificial Sequence
  Description of Artificial Sequence: Synthetic coding sequence
atgaagctgacagacagcgtgctgcggagcttccgggtggccaaggtgttcagagaaaattctgacaagatcaactgctttgacttcagccccaacggggagaccgtcatcagcagcagtgatgatgacagcatcgtgctgtatgactgccaggagggcaagcccaagaggaccctgtacagcaagaagtatggagtggacctgatccgctacacccacgccgccaacacagtggtgtacagcagcaacaagattgatgacaccatccgctacctgagcctgcatgacaacaagtacatccgctacttccctggccacagcaagagggtggtggccctgtccatgagccctgtggatgacaccttcatcagcggcagcctggacaagaccatccggctgtgggacctgcggagccccaactgccagggcctgatgcacctgcagggcaagcctgtgtgcagctttgatcctgagggcctcatctttgctgctggggtgaacagcgagatggtgaagctgtatgacctgcggagctttgataaaggcccctttgccaccttcaagatgcagtatgacaggacctgtgagtggacaggcctgaagttcagcaatgatggcaagctgatcctgatcagcaccaacggcagcttcatccggctgattgatgccttcaagggcgtggtgatgcacaccttcggcggctacgccaacagcaaggctgtgaccctggaggccagcttcaccccagacagccagttcatcatgattggctctgaagatggcaagatccacgtgtggaatggagagagcggcatcaaggtggccgtgctggatggcaagcacacaggccccatcacctgcctgcagttcaaccccaagttcatgacctttgccagcgcctgcagcaacatggccttctggctgcccaccattgatgactag

SEQ ID NO: 176045 - DNA, 1359 bp, Artificial Sequence
  Description of Artificial Sequence: Synthetic coding sequence
atgatgggctgctttgccctgcagacagtggacacagagctgacagctgacagcgtggagtggtgccccctgcagggctgccgccacctgctggcctgtggcacctaccagctgcggcggcctgaggacaggcctgctggcccccagaacaagggcggcatggaggtgaaggagccccaggtgcggctgggccgcctcttcctgtacagcttcaatgacaacaacagcatccaccccctggtggaggtgcagaggaaggacaccagcgccatcctggacatgaagtggtgccacatccctgtggccggccacgccctgctgggcctggctgatgccagcggcagcatccagctgctgcggctggtggagagcgagaagagccacgtgctggagcccctgagcagcctggccctggaggagcagtgcctggccctgagcctggactggagcacaggcaagacaggccgggccggggaccagcccctgaagatcatcagcagtgacagcacaggccagctgcacctgctgatggtgaatgagacccggccccggctgcagaaggtggcctcctggcaggcccaccagtttgaggcctggattgctgccttcaactactggcaccctgagatcgtgtacagcggaggagatgatggcctgctgcggggctgggacaccagggtgcctgggaagttcctgttcaccagcaagaggcacaccatgggcgtgtgcagcatccagagcagcccccaccgggagcacatcctggccaccggcagctatgatgagcacatcctgctgtgggacaccaggaacatgaagcagcccctggccgacacccctgtgcagggcggcgtgtggaggatcaagtggcaccccttccaccaccacctgctgctggccgcctgcatgcacagcggcttcaagatcctgaactgccagaaggccatggaggagcggcaggaggccaccgtgctgaccagccacaccctgcctgacagcctggtgtatggagctgactggagctggctgctcttccgcagcctgcagagggcccccagctggagcttccccagcaacctgggcaccaagacagctgacctgaagggggccagcgagctgcccaccccctgccatgaatgtcgggaggacaatgatggagagggccacgcccggccccagagcggcatgaagcccctgacagagggcatgaggaagaatggcacctggctgcaggccacagctgccaccacccgggactgtggggtgaaccctgaggaggccgacagcgccttcagcctgctggccacctgcagcttctatgaccacgccctgcacctgtgggagtgggagggcaactag

SEQ ID NO: 176046 - DNA, 1074 bp, Artificial Sequence
  Description of Artificial Sequence: Synthetic coding sequence
atgtctgcctttgagaagccccagatcatcgcccacatccagaagggcttcaactacacagtgtttgactgcaagtgggtgccctgcagcgccaagtttgtgaccatgggcaactttgcccggggcactggagtcatccagctgtatgagatccagcacggggacctgaagctgctgcgggagattgagaaggccaagcccatcaagtgtggcacctttggagccaccagcctgcagcagcgctacctggccactggagactttggaggcaacctgcacatctggaacctggaggcccctgagatgcctgtgtacagcgtgaagggccacaaggagatcatcaatgccattgatggcatcggcggcctgggcattggagagggcgcccctgagatcgtgacaggcagcagagatggcaccgtgaaggtgtgggacccccggcagaaggatgatcctgtggccaacatggagcctgtgcagggcgagaacaagagggactgctggacagtggcctttggaaatgcctacaaccaggaggagcgggtggtgtgtgccggctatgacaatggagacatcaagctgtttgacctgaggaacatggccctgcgctgggagaccaacatcaagaatggagtgtgcagcctggagtttgacaggaaggacatctccatgaacaagctggtggccaccagcctggagggcaagttccacgtgtttgacatgaggacccagcaccccaccaagggctttgcctctgtgtctgagaaggcccacaagagcacagtgtggcaggtgcgccacctgccccagaaccgggagctgttcctgacagctgggggcgccggcggcctgcacctgtggaagtatgagtaccccatccagaggagcaagaaggacagcgagggcatcgagatgggcgtggccggctctgtgtccctgctgcagaatgtgaccctgagcacccagcccatcagcagcctggactggagcccagacaagaggggcctgtgtgtgtgcagcagctttgaccagacagtgcgggtgctgattgtgaccaagctgaacaagatctag

SEQ ID NO: 176047 - DNA, 867 bp, Artificial Sequence
  Description of Artificial Sequence: Synthetic coding sequence
atgtctgcctttgagaagccccagatcatcgcccacatccagaagggcttcaactacacagtgtttgactgcaagtgggtgccctgcagcgccaagtttgtgaccatgggcaactttgcccggggcactggagtcatccagctgtatgagatccagcacggggacctgaagctgctgcgggagattgagaaggccaagcccatcaagtgtggcacctttggagccaccagcctgcagcagcgctacctggccactggagactttggaggcaacctgcacatctggaacctggaggcccctgagatgcctgtgtacagcgtgaagggccacaaggagatcatcaatgccattgatggcatcggcggcctgggcattggagagggcgcccctgagatcgtgacaggcagcagagatggcaccgtgaaggtgtgggacccccggcagaaggatgatcctgtggccaacatggagcctgtgcagggcgagaacaagagggactgctggacagtggcctttggaaatgcctacaaccaggaggagcgggtggtgtgtgccggctatgacaatggagacatcaagctgtttgacctgaggaacatggccctgcgctgggagaccaacatcaagaatggagtgtgcagcctggagtttgacaggaaggacatctccatgaacaagctggtggccaccagcctggagggcaagttccacgtgtttgacatgaggacccagcaccccaccaagggctttgcctctgtgtctgagaaggcccacaagagcacagtgtggcaggtgcgccacctgccccagaaccgggagctgttcctgacagctgggggcgccggcggcctgcacctgtggaagtag

SEQ ID NO: 176048 - DNA, 3816 bp, Artificial Sequence
  Description of Artificial Sequence: Synthetic coding sequence
tgaagagacttccagagcgaggtgctgctgagcgccatggagctgttccacatgaccagcggaggagatgctgccatgttcagagatggcaaggagccccagcccagcgctgaggccgctgctgcccccagcctggccaacatcagctgcttcacccagaagctggtggagaagctgtacagcggcatgttttctgctgaccccaggcacatcctgctcttcatcctggagcacatcatggtggtgattgaaacagccagcagccagagggacacagtgctgagcaccctgtacagcagcctgaacaaggtgatcctgtactgcctgagcaagccccagcagagcctgtctgagtgcctgggcctgctgagcatcctgggcttcctgcaggagcactgggatgtggtgtttgccacctacaacagcaacatctccttcctgctgtgcctgatgcactgcctgctgctgctgaatgaaagaagctacccagagggcttcggcctggagcccaagcccaggatgagcacctaccaccaggtgttcctgagccccaatgaagatgtgaaggagaagcgggaggacctgcccagcctgagtgatgtgcagcacaacatccagaagacagtgcagaccctgtggcagcagctggtggcccagaggcagcagaccctggaggatgccttcaagattgacctgtctgtgaagccaggagagcgggaggtgaagattgaggaggtgacccccctgtgggaggagaccatgctgaaggcctggcagcactacctggccagcgagaagaagagcctggccagccgcagcaatgtggcccaccacagcaaggtgaccctgtggagcggcagcctgagcagcgccatgaagctgatgcctggccggcaggccaaggaccctgagtgcaagacagaggactttgtgtcctgcatcgagaactacagaagaagaggccaggagctgtatgccagcctgtacaaggaccacgtgcagaggaggaaatgtggcaacatcaaggccgccaatgcctgggcccgcatccaggagcagctgtttggagagctgggcctgtggagccagggcgaggagaccaagccctgcagcccctgggagctggactggagggagggccctgccaggatgaggaagaggatcaagaggctgagccccctggaggccctgagcagcggccgccacaaggagagccaggacaagaatgaccacatcagccagaccaatgctgagaaccaggatgagctgaccctgcgggaggccgagggggagccagatgaggtgggcgtggactgcacccagctgaccttcttccctgccctgcacgagagcctgcacagcgaggacttcctggagctgtgccgggagcggcaggtgatcctgcaggagctgctggacaaggagaaggtgacccagaagttcagcctggtgattgtgcagggccacctggtgtctgagggcgtgctgctgtttggccaccagcacttctacatctgtgagaacttcaccctgagccccactggagatgtgtactgcaccaggcactgcctgagcaacatcagtgaccccttcatcttcaacctgtgcagcaaggacaggagcacagaccactacagctgccagtgccacagctatgctgacatgagggagctgcggcaggcccgcttcctgctgcaggacatcgccctggagatcttcttccacaacggctacagcaagttcctggtgttctacaacaatgacaggagcaaggccttcaagagcttctgcagcttccagcccagcctgaagggcaaggccaccagcgaggacaccctgagcctgcggcgctacccaggcagtgaccgcatcatgctgcagaagtggcagaagagggacatcagcaactttgagtacctgatgtacctgaacacagctgctggccgcacctgcaatgactacatgcagtaccctgtgttcccctgggtgctggccgactacaccagcgagaccctgaacctggccaaccccaagatcttccgggacctgagcaagcccatgggcgcccagaccaaggagaggaagctgaagttcatccagcgcttcaaggaggtggagaagacagaaggagacatgacagtgcagtgccactactacacccactacagcagcgccatcatcgtggccagctacctggtgaggatgccacccttcacccaggccttctgtgccctgcagggcggcagctttgatgtggccgacaggatgttccacagcgtgaagagcacctgggagagcgccagccgggagaacatgtctgatgtgcgggagctgaccccagagttcttctacctgcctgagttcctgaccaactgcaatggagtggagtttggctgcatgcaggacggcaccgtgctgggagatgtgcagctgcccccctgggcagatggagaccccaggaagttcatcagcctgcacaggaaggccctggagagtgactttgtgtctgccaacctgcaccactggattgacctgatcttcggctacaagcagcagggccctgctgctgtggatgctgtgaacatcttccacccctacttctacggggacaggatggacctgagcagcatcacagaccccctcatcaagagcaccatcctgggctttgtgagcaactttggccaggtgcccaagcagctgttcaccaagccccacccagccaggacagctgctgggaagcccctgcccgggaaggatgtgtccacccctgtgtccctgcccggccacccccagcccttcttctacagcctgcagagcctgcggcccagccaggtgacagtgaaggacatgtacctgttcagcctgggcagcgagagccccaagggggccatcggccacatcgtgtccacagagaagaccatcctggccgtggagaggaacaaggtgctgctgccccccctgtggaacagaaccttctcctggggctttgatgacttcagctgctgcctgggcagctatggcagtgacaaggtgctgatgacctttgagaacctggccgcctggggccgctgcctgtgtgctgtgtgccccagccccaccaccatcgtgaccagcggcaccagcacagtggtgtgtgtgtgggagctgtccatgaccaagggccggccccggggcctgcggctgcggcaggccctgtatggccacacccaggccgtgacctgcctggccgcctctgtgaccttcagcctgctggtgtctggcagccaggactgcacctgcatcctgtgggacctggaccacctgacccacgtgacccggctgcctgcccaccgggagggcatcagcgccatcaccatcagtgatgtgtctggcaccatcgtgtcctgtgccggggcccacctgagcctgtggaatgtgaatggccagcccctggccagcatcaccacagcctggggccctgagggcgccatcacctgctgctgcctgatggagggccctgcctgggacaccagccagatcatcatcaccggcagccaggacggcatggtgcgggtgtggaagacagaagatgtgaagatgtctgtgcccggccggcctgctggggaggagcccccagcccagccccccagcccccggggccacaagtgggagaagaacctggccctgagccgggagctggatgtgtccatcgccctgaccgggaagcccagcaagaccagccctgctgtgacagccctggccgtgtccaggaaccacaccaagctgctggtgggagatgagcggggccgcatcttctgctggagcgcagatggatag

SEQ ID NO: 176049 - DNA, 6804 bp, Artificial Sequence
  Description of Artificial Sequence: Synthetic coding sequence
tgaaagctggccagccaggccatcgagccagatgtgctgcggcagttcctgggcctgggcatccccagcagcctgagcgccaccaccaagatcctggacagcagccacacccaccggggcaaccctggctgcagcggcagccagacagcccagggcctggccgagggcccctggccagctgccccagatgctggcctgcaccctggggtgacccaggccccccagcccctgggggagagccaggacagcaccacagccctgcagacagccctgagcctcatctccatgaccagccccaggaacctgcagccccagagagctgccctggcccccagctttgtggagtttgacatgtctgtggagggctacggctgcctcttcatccccaccctgagcacagtgatgggcaccagcacagagtacagcgtgtctgggggcattggaactggagccacccggcccttccccccacctgggggcctgaccttcagctgctggttcctgatcagccgccacggggccgccacagagggccaccccctgcgcttcctgaccctggtgcgccacctggccaggacagagcagccctttgtgtgcttctctgtgtccctgtgcccagatgacctgagcctggtggtgtccacagaggagaaggagttccagcccctggatgtgatggagccagaagatgacagcgagcccagcgctggctgccagctgcaggtgcgctgtggccagctgctggcctgtggccagtggcaccacctggccgtggtggtgaccaaggagatgaagaggcactgcaccgtgtccacctgcctggatggccaggtgattggcagcgccaagatgctgtacatccaggccctgcccggccccttcctgtccatggaccccagcgcctttgtggatgtgtatggctacatcgccaccccccgggtgtggaagcagaagagcagcctcatctggaggctgggccccacctacctgtttgaggaggccatctccatggagaccctggaggtgatcaacaagctgggcccccgctactgcggcaacttccaggccgtgcacgtgcagggcgaggacctggacagcgaggccaccccatttgtggccgaggagcgggtgtcctttggcctgcacatcgccagcagcagcatcacctctgtggccgacatcagaaatgcctacaatgaggtggacagccgcctcatcgccaaggagatgaacatcagcagccgggacaatgccatgcctgtgttcctgctgaggaactgtgccggccacctgagcggcagcctgcggaccatcggggctgtggccgtgggccagctgggcgtgcgggtcttccacagcagccctgctgccagcagcctggacttcatcggcggccctgccatcctgctgggcctcatcagcctggccacagatgaccacaccatgtatgctgctgtgaaggtgctgcacagcgtgctgaccagcaatgccatgtgtgacttcctgatgcagcacatctgtggctaccagatcatggccttcctgctgaggaagaaggccagcctgctgaaccaccgcatcttccagctgatcctgtctgtggccggcaccgtggagctgggcttccgcagcagcgccatcaccaacacaggagtcttccagcacatcctgtgcaactttgagctgtggatgaacacagctgacaacctggagctgagcctcttcagccacctgctggagatcctgcagagcccccgggagggccccagaaatgctgaggccgcccaccaggcccagctgatccccaagctgatcttcctgttcaatgagcccagcctcatccccagcaagatcagcaccatcatcggcatcctggcctgccagctgcggggccacttcagcacccaggacctgctgagaattggcctgtttgtggtgtacaccctgaagcccagctctgtgaatgaaaggcagatctgcatggatggagccctggaccccagcctgcctgctggcagccagaccagcggcaagaccatctggctgaggaaccagctgctggagatgctgctgagcgtcatcagcagcccccagctgcacctgagcagcgagagcaaggaggagatgttcctgaagctgggccctgactggttcctgctgctgctgcagggccacctgcacgccagcaccaccgtgctggccctgaagctgctgctgtacttcctggccagccccagcctgcggacccgcttcagagatggcctgtgtgccggctcctgggtggagaggagcacagaaggagtggacatcgtgatggacaacctgaagagccagagccccctgcctgagcagagcccctgcctgctgcccggcttccgggtgctgaatgacttcctggcccaccacgtgcacatccctgaggtgtacctgattgtgtccaccttcttcctgcagacccccctgacagagctgatggatggccccaaggacagcctggatgccatgctgcagtggctgctgcagaggcaccaccaggaggaggtgctgcaggccggcctgtgcacagaaggagccctgctgctgctggagatgctgaaggccaccatgagccagcccctggccggctctgaagatggagcctgggcccagaccttccctgcctctgtgctgcagttcctgagcctggtgcacaggacctacccccaggaccctgcctggagggcccctgagttcctgcagaccctggccatcgccgccttccccctgggcgcccagaagggcgtgggcgctgagagcaccaggaacaccagcagccctgaggccgctgctgagggggacagcacagtggagggcctgcaggcccccaccaaggcccacccagcccggaggaagctgcgggagttcacccagctgctgctgcgggagctgctgctgggcgccagcagccccaagcagtggctgcccctggaggtgctgctggaggccagcccagaccacgccaccagccagcagaagagggacttccagagcgaggtgctgctgagcgccatggagctgttccacatgaccagcggaggagatgctgccatgttcagagatggcaaggagccccagcccagcgctgaggccgctgctgcccccagcctggccaacatcagctgcttcacccagaagctggtggagaagctgtacagcggcatgttttctgctgaccccaggcacatcctgctcttcatcctggagcacatcatggtggtgattgaaacagccagcagccagagggacacagtgctgagcaccctgtacagcagcctgaacaaggtgatcctgtactgcctgagcaagccccagcagagcctgtctgagtgcctgggcctgctgagcatcctgggcttcctgcaggagcactgggatgtggtgtttgccacctacaacagcaacatctccttcctgctgtgcctgatgcactgcctgctgctgctgaatgaaagaagctacccagagggcttcggcctggagcccaagcccaggatgagcacctaccaccaggtgttcctgagccccaatgaagatgtgaaggagaagcgggaggacctgcccagcctgagtgatgtgcagcacaacatccagaagacagtgcagaccctgtggcagcagctggtggcccagaggcagcagaccctggaggatgccttcaagattgacctgtctgtgaagccaggagagcgggaggtgaagattgaggaggtgacccccctgtgggaggagaccatgctgaaggcctggcagcactacctggccagcgagaagaagagcctggccagccgcagcaatgtggcccaccacagcaaggtgaccctgtggagcggcagcctgagcagcgccatgaagctgatgcctggccggcaggccaaggaccctgagtgcaagacagaggactttgtgtcctgcatcgagaactacagaagaagaggccaggagctgtatgccagcctgtacaaggaccacgtgcagaggaggaaatgtggcaacatcaaggccgccaatgcctgggcccgcatccaggagcagctgtttggagagctgggcctgtggagccagggcgaggagaccaagccctgcagcccctgggagctggactggagggagggccctgccaggatgaggaagaggatcaagaggctgagccccctggaggccctgagcagcggccgccacaaggagagccaggacaagaatgaccacatcagccagaccaatgctgagaaccaggatgagctgaccctgcgggaggccgagggggagccagatgaggtgggcgtggactgcacccagctgaccttcttccctgccctgcacgagagcctgcacagcgaggacttcctggagctgtgccgggagcggcaggtgatcctgcaggagctgctggacaaggagaaggtgacccagaagttcagcctggtgattgtgcagggccacctggtgtctgagggcgtgctgctgtttggccaccagcacttctacatctgtgagaacttcaccctgagccccactggagatgtgtactgcaccaggcactgcctgagcaacatcagtgaccccttcatcttcaacctgtgcagcaaggacaggagcacagaccactacagctgccagtgccacagctatgctgacatgagggagctgcggcaggcccgcttcctgctgcaggacatcgccctggagatcttcttccacaacggctacagcaagttcctggtgttctacaacaatgacaggagcaaggccttcaagagcttctgcagcttccagcccagcctgaagggcaaggccaccagcgaggacaccctgagcctgcggcgctacccaggcagtgaccgcatcatgctgcagaagtggcagaagagggacatcagcaactttgagtacctgatgtacctgaacacagctgctggccgcacctgcaatgactacatgcagtaccctgtgttcccctgggtgctggccgactacaccagcgagaccctgaacctggccaaccccaagatcttccgggacctgagcaagcccatgggcgcccagaccaaggagaggaagctgaagttcatccagcgcttcaaggaggtggagaagacagaaggagacatgacagtgcagtgccactactacacccactacagcagcgccatcatcgtggccagctacctggtgaggatgccacccttcacccaggccttctgtgccctgcagggcggcagctttgatgtggccgacaggatgttccacagcgtgaagagcacctgggagagcgccagccgggagaacatgtctgatgtgcgggagctgaccccagagttcttctacctgcctgagttcctgaccaactgcaatggagtggagtttggctgcatgcaggacggcaccgtgctgggagatgtgcagctgcccccctgggcagatggagaccccaggaagttcatcagcctgcacaggaaggccctggagagtgactttgtgtctgccaacctgcaccactggattgacctgatcttcggctacaagcagcagggccctgctgctgtggatgctgtgaacatcttccacccctacttctacggggacaggatggacctgagcagcatcacagaccccctcatcaagagcaccatcctgggctttgtgagcaactttggccaggtgcccaagcagctgttcaccaagccccacccagccaggacagctgctgggaagcccctgcccgggaaggatgtgtccacccctgtgtccctgcccggccacccccagcccttcttctacagcctgcagagcctgcggcccagccaggtgacagtgaaggacatgtacctgttcagcctgggcagcgagagccccaagggggccatcggccacatcgtgtccacagagaagaccatcctggccgtggagaggaacaaggtgctgctgccccccctgtggaacagaaccttctcctggggctttgatgacttcagctgctgcctgggcagctatggcagtgacaaggtgctgatgacctttgagaacctggccgcctggggccgctgcctgtgtgctgtgtgccccagccccaccaccatcgtgaccagcggcaccagcacagtggtgtgtgtgtgggagctgtccatgaccaagggccggccccggggcctgcggctgcggcaggccctgtatggccacacccaggccgtgacctgcctggccgcctctgtgaccttcagcctgctggtgtctggcagccaggactgcacctgcatcctgtgggacctggaccacctgacccacgtgacccggctgcctgcccaccgggagggcatcagcgccatcaccatcagtgatgtgtctggcaccatcgtgtcctgtgccggggcccacctgagcctgtggaatgtgaatggccagcccctggccagcatcaccacagcctggggccctgagggcgccatcacctgctgctgcctgatggagggccctgcctgggacaccagccagatcatcatcaccggcagccaggacggcatggtgcgggtgtggaagacagaagatgtgaagatgtctgtgcccggcctgcagatgggcaggaagcgggaggccgctgaggccctggcccagcagtgccaggccgagggcggccgcggggactggggcctgagcagcgcctacagaagaaacccccagggcctgctgccccacagcagccagggccgggccagcggcaaccacagcagcgctgcccagcccagcccctggcccatgggcctgctgtag

SEQ ID NO: 176050 - DNA, 9555 bp, Artificial Sequence
  Description of Artificial Sequence: Synthetic coding sequence
atggaggccgaggacctgagcaaggccgaggacagaaatgaagaccccggcagcaagaatgaaggccagctggccgctgtgcagccagatgtgccccatggaggccagagcagcagccccacagccctgtgggacatgctggagaggaagttcctggagtaccagcagctgacccacaagagccccatcgagcggcagaagagcctgctgagcctgctgcccctcttcctgaaggcctgggagcacagcgtgggcatcatctgcttccccagcctgcagaggctggctgaagatgtgtctgaccagctggcccagcagctgcagaaggccctggtgggcaagccagctgagcaggcccggctggccgccggccagctgctgtggtggaagggagatgtggaccaggacggctacctgctgctgaagtctgtgtatgtgctgaccggcacagacagcgagaccctgggccgggtggccgagagcggcctgcctgccctgctgctgcagtgcctgtacctgttctttgtgttccccctggacaaggatgagctgctggagagtgacctgcaggtgcagaagatgtttgtgcagatgctgctgaacatctgcagcgacagccagggcctggagggcctgctgagcggcagcgagctgcagagcctgctgattgccaccacctgcctgcgggagcacagctgctgcttctggaaggagcccaccttctgtgtgctgcgggccatcagcaaggcccagaacctgagcatcatccagtacctgcaggccacagactgtgtgcggctgagcctgcagaacctgagccggctgacagacaccctgcctgcccctgaggtgtctgaggccgtgtccctcatcctgggctttgtgaaggacagctaccctgtgtcctctgccctcttcctggagtttgagaacagcgagggctaccccctgctgctgaaggtgctgctgcgctatgatggcctgacccagagcgaggtggacccccacctggaggagctgctgggcctggtggtgtggctgaccacctgtggccgctctgagctgaaggtgtttgacagcatcacctacccccagctggagggcttcaagttccaccacgaggccagcggcgtgacagtgaagaacctgcaggccttccaggtgctgcagaatgtgttccacaaggccagtgacagcgtgctgtgcatccaggtgctgagcgtcatccgcaccatgtgggcctggaatgccaggaacttcttcctgctggagtggaccctgcagcccatcagccagtttgtggagatcatgcccctgaagccagcccctgtgcaggagcacttcttccagctgctggaggccctggtgtttgagctgcactacgtgccccatgagatcctgaggaaggtgcagcacctgatcaaggagagccctggccccagctgcaccctgatggccctgcagagcatcctgagcattgctggaggagaccccctcttcacagacatcttccgggacagcggcctgctgggcctgctgctggcccagctgaggaagcaggccaagatcatgaggaagagcggcaacaaggtgtccaccccaggagtgcaggaccctgagcgggagctgacctgtgtgatgctgcgcatcgtggtgaccctgctgaagggctctgtgagaaatgctgtggtgctgaaggaccacggcatggtgcccttcatcaagatcttcctggatgatgagtgctaccgggaggccagcctgagcatcctggagcagctgagcgccatcaatgctgaggagtacatgagcatcatcgtgggcgccctgtgcagcagcacccagggcgagctgcagctgaagctggacctgctgaagagcctgctgcgcatcctggtgacccccaagggccgggccgccttccgggtgagcagcggcttcaacggcctgctgagcctgctgagtgacctggagggcagcctgcaggagccccccctgcaggcctggggcgctgtgagcccccggcagaccctggagctggtgctgtacaccctgtgtgctgtgtctgctgccctgcactgggaccctgtgaatggctacttcttcagaagaaatggcctgtttgagaagctggccgaggacctgtgcctgctgggctgctttggagccctggaggaggagggcaacctgctgcgctcctgggtggacaccaaggcccggccctttgctgacctgctgggcacagccttcagcagcagcggcagcctgcccccacgcatccagagctgcctgcagatcctgggcttcctggacagcatggccagcggcaccctgcacctgcggggggacctgaaggagagcctgcggaccaagcagggccctgtggtggatgtgcagaagggggagactggaagtgacccccagaggaacttcaagcagtggccagacctggaggagaggatggatgaaggagatgctgccatcatgcaccctggggtggtgtgcatcatggtgcggctgctgccccggctgtaccacgaggaccacccccagctgtctgaggagatccagtgcagcctggccagccacatccagagcctggtgaagtctgagaagaaccggcaggtgatgtgtgaggccggcctgctgggcaccctgatggccagctgccaccgggccctggtgaccagcggcagccccctgcacagccgcctcatccgcatctttgagaagctggccagccaggccattgaaccagatgtgctgcggcagttcctgggcctgggcatccccagcagcctgagcgccaccaccaagatcctggacagcagccacacccaccggggcaaccctggctgcagcggcagccagacagcccagggcctggccgagggcccctggccagctgccccagatgctggcctgcaccctggggtgacccaggccccccagcccctgggggagagccaggacagcaccacagccctgcagacagccctgagcctcatctccatgaccagccccaggaacctgcagccccagagagctgccctggcccccagctttgtggagtttgacatgtctgtggagggctacggctgcctcttcatccccaccctgagcacagtgatgggcaccagcacagagtacagcgtgtctgggggcatcggcaccggggccacccggcccttccccccacctgggggcctgaccttcagctgctggttcctgatcagcagacatggagctgccacagagggccaccccctgcgcttcctgaccctggtgcgccacctggccaggacagagcagccctttgtgtgcttctctgtgtccctgtgcccagatgacctgagcctggtggtgtccacagaggagaaggagttccagcccctggatgtgatggagccagaagatgattctgagcccagcgctggctgccagctgcaggtgcgctgtggccagctgctggcctgtggccagtggcaccacctggccgtggtggtgaccaaggagatgaagaggcactgcaccgtgtccacctgcctggatggccaggtgattggcagcgccaagatgctgtacatccaggccctgcccggccccttcctgtccatggaccccagcgcctttgtggatgtgtatggctacatcgccaccccccgggtgtggaagcagaagagcagcctcatctggaggctgggccccacctacctgtttgaggaggccatctccatggagaccctggaggtgatcaacaagctgggcccccgctactgcggcaacttccaggccgtgcacgtgcagggcgaggacctggacagcgaggccaccccatttgtggccgaggagcgggtgtcctttggcctgcacatcgccagcagcagcatcacctctgtggccgacatcagaaatgcctacaatgaggtggacagccggctgattgccaaggagatgaacatcagcagccgggacaatgccatgcctgtgttcctgctgaggaactgtgccggccacctgagcggcagcctgcggaccatcggggctgtggccgtgggccagctgggcgtgcgggtcttccacagcagccctgctgccagcagcctggacttcatcggcggccctgccatcctgctgggcctcatcagcctggccacagatgaccacaccatgtatgctgctgtgaaggtgctgcacagcgtgctgaccagcaatgccatgtgtgacttcctgatgcagcacatctgtggctaccagatcatggccttcctgctgaggaagaaggccagcctgctgaaccaccgcatcttccagctgatcctgtctgtggccggcaccgtggagctgggcttccgcagcagcgccatcaccaacacaggagtcttccagcacatcctgtgcaactttgagctgtggatgaacacagctgacaacctggagctgagcctcttcagccacctgctggagatcctgcagagcccccgggagggccccagaaatgctgaggccgcccaccaggcccagctgatccccaagctgatcttcctgttcaatgagcccagcctcatccccagcaagatcagcaccatcatcggcatcctggcctgccagctgcggggccacttcagcacccaggacctgctgcgcatcggcctgtttgtggtgtacaccctgaagcccagctctgtgaatgaaaggcagatctgcatggatggagccctggaccccagcctgcctgctggcagccagaccagcggcaagaccatctggctgaggaaccagctgctggagatgctgctgagcgtcatcagcagcccccagctgcacctgagcagcgagagcaaggaggagatgttcctgaagctgggccctgactggttcctgctgctgctgcagggccacctgcacgccagcaccaccgtgctggccctgaagctgctgctgtacttcctggccagccccagcctgcggacccgcttcagagatggcctgtgtgccggctcctgggtggagaggagcacagagggcgtggacatcgtgatggacaacctgaagagccagagccccctgcctgagcagagcccctgcctgctgcccggcttccgggtgctgaatgacttcctggcccaccacgtgcacatccctgaggtgtacctgattgtgtccaccttcttcctgcagacccccctgacagagctgatggatggccccaaggacagcctggatgccatgctgcagtggctgctgcagaggcaccaccaggaggaggtgctgcaggccggcctgtgcacagagggcgccctgctgctgctggagatgctgaaggccaccatgagccagcccctggccggctctgaagatggagcctgggcccagaccttccctgcctctgtgctgcagttcctgagcctggtgcacaggacctacccccaggaccctgcctggagggcccctgagttcctgcagaccctggccatcgccgccttccccctgggcgcccagaagggcgtgggcgctgagagcaccaggaacaccagcagccctgaggccgctgctgagggggacagcacagtggagggcctgcaggcccccaccaaggcccacccagcccggaggaagctgcgggagttcacccagctgctgctgcgggagctgctgctgggcgccagcagccccaagcagtggctgcccctggaggtgctgctggaggccagcccagaccacgccaccagccagcagaagagggacttccagagcgaggtgctgctgagcgccatggagctgttccacatgaccagcggaggagatgctgccatgttcagagatggcaaggagccccagcccagcgctgaggccgccgccgcccccagcctggccaacatcagctgcttcacccagaagctggtggagaagctgtacagcggcatgttttctgctgaccccaggcacatcctgctcttcatcctggagcacatcatggtggtgattgaaacagccagcagccagagggacacagtgctgagcaccctgtacagcagcctgaacaaggtgatcctgtactgcctgagcaagccccagcagagcctgtctgaatgtctgggcctgctgagcatcctgggcttcctgcaggagcactgggatgtggtgtttgccacctacaacagcaacatctccttcctgctgtgcctgatgcactgcctgctgctgctgaatgaaagaagctacccagagggcttcggcctggagcccaagcccaggatgagcacctaccaccaggtgttcctgagccccaatgaagatgtgaaggagaagcgggaggacctgcccagcctgagtgatgtgcagcacaacatccagaagacagtgcagaccctgtggcagcagctggtggcccagaggcagcagaccctggaggatgccttcaagattgacctgtctgtgaagccaggagagcgggaggtgaagattgaggaggtgacccccctgtgggaggagaccatgctgaaggcctggcagcactacctggccagcgagaagaagagcctggccagccgcagcaatgtggcccaccacagcaaggtgaccctgtggagcggcagcctgagcagcgccatgaagctgatgcctggccggcaggccaaggaccctgagtgcaagacagaagattttgtgtcctgcatcgagaactacagaagaagaggccaggagctgtatgccagcctgtacaaggaccacgtgcagaggaggaaatgtggcaacatcaaggccgccaatgcctgggcccgcatccaggagcagctgtttggagagctgggcctgtggagccagggcgaggagaccaagccctgcagcccctgggagctggactggagggagggccctgccaggatgaggaagaggatcaagaggctgagccccctggaggccctgagcagcggccgccacaaggagagccaggacaagaatgaccacatcagccagaccaatgctgagaaccaggatgagctgaccctgcgggaggccgagggggagccagatgaggtgggcgtggactgcacccagctgaccttcttccctgccctgcacgagagcctgcacagcgaggacttcctggagctgtgccgggagcggcaggtgatcctgcaggagctgctggacaaggagaaggtgacccagaagttcagcctggtgattgtgcagggccacctggtgtctgaaggagtgctgctgtttggccaccagcacttctacatctgtgagaacttcaccctgagccccactggagatgtgtactgcaccaggcactgcctgagcaacatcagtgaccccttcatcttcaacctgtgcagcaaggacaggagcacagaccactacagctgccagtgccacagctatgctgacatgagggagctgcggcaggcccgcttcctgctgcaggacatcgccctggagatcttcttccacaacggctacagcaagttcctggtgttctacaacaatgacaggagcaaggccttcaagagcttctgcagcttccagcccagcctgaagggcaaggccaccagcgaggacaccctgagcctgcggcgctacccaggcagtgaccgcatcatgctgcagaagtggcagaagagggacatcagcaactttgagtacctgatgtacctgaacacagctgctggccgcacctgcaatgactacatgcagtaccctgtgttcccctgggtgctggccgactacaccagcgagaccctgaacctggccaaccccaagatcttccgggacctgagcaagcccatgggcgcccagaccaaggagaggaagctgaagttcatccagcgcttcaaggaggtggagaagacagaaggagacatgacagtgcagtgccactactacacccactacagcagcgccatcatcgtggccagctacctggtgaggatgccacccttcacccaggccttctgtgccctgcagggcggcagctttgatgtggccgacaggatgttccacagcgtgaagagcacctgggagagcgccagccgggagaacatgtctgatgtgcgggagctgaccccagagttcttctacctgcctgagttcctgaccaactgcaatggagtggagtttggctgcatgcaggacggcaccgtgctgggagatgtgcagctgcccccctgggcagatggagaccccaggaagttcatcagcctgcacaggaaggccctggagagtgactttgtgtctgccaacctgcaccactggattgacctgatcttcggctacaagcagcagggccctgctgctgtggatgctgtgaacatcttccacccctacttctatggagacaggatggacctgagcagcatcacagaccccctcatcaagagcaccatcctgggctttgtgagcaactttggccaggtgcccaagcagctgttcaccaagccccacccagccaggacagctgctgggaagcccctgcccgggaaggatgtgtccacccctgtgtccctgcccggccacccccagcccttcttctacagcctgcagagcctgcggcccagccaggtgacagtgaaggacatgtacctgttcagcctgggcagcgagagccccaagggggccatcggccacatcgtgtccacagagaagaccatcctggccgtggagaggaacaaggtgctgctgccccccctgtggaacagaaccttctcctggggctttgatgacttcagctgctgcctgggcagctatggcagtgacaaggtgctgatgacctttgagaacctggccgcctggggccgctgcctgtgtgctgtgtgccccagccccaccaccatcgtgaccagcggcaccagcacagtggtgtgtgtgtgggagctgtccatgaccaagggccggccccggggcctgcggctgcggcaggccctgtatggccacacccaggccgtgacctgcctggccgcctctgtgaccttcagcctgctggtgtctggcagccaggactgcacctgcatcctgtgggacctggaccacctgacccacgtgacccggctgcctgcccaccgggagggcatcagcgccatcaccatcagtgatgtgtctggcaccatcgtgtcctgtgccggggcccacctgagcctgtggaatgtgaatggccagcccctggccagcatcaccacagcctggggccctgagggcgccatcacctgctgctgcctgatggagggccctgcctgggacaccagccagatcatcatcaccggcagccaggacggcatggtgcgggtgtggaagacagaagatgtgaagatgtctgtgcccggccggcctgctggggaggagcccccagcccagccccccagcccccggggccacaagtgggagaagaacctggccctgagccgggagctggatgtgtccatcgccctgaccgggaagcccagcaagaccagccctgctgtgacagccctggccgtgtccaggaaccacaccaagctgctggtgggagatgagcggggccgcatcttctgctggagcgcagatggatag

SEQ ID NO: 176051 - DNA, 1965 bp, Artificial Sequence
  Description of Artificial Sequence: Synthetic coding sequence
atggaggccgaggacctgagcaaggccgaggacagaaatgaagaccccggcagcaagaatgaaggccagctggccgctgtgcagccagatgtgccccatggaggccagagcagcagccccacagccctgtgggacatgctggagaggaagttcctggagtaccagcagctgacccacaagagccccatcgagcggcagaagagcctgctgagcctgctgcccctcttcctgaaggcctgggagcacagcgtgggcatcatctgcttccccagcctgcagaggctggctgaagatgtgtctgaccagctggcccagcagctgcagaaggccctggtgggcaagccagctgagcaggcccggctggccgccggccagctgctgtggtggaagggagatgtggaccaggacggctacctgctgctgaagtctgtgtatgtgctgaccggcacagacagcgagaccctgggccgggtggccgagagcggcctgcctgccctgctgctgcagtgcctgtacctgttctttgtgttccccctggacaaggatgagctgctggagagtgacctgcaggtgcagaagatgtttgtgcagatgctgctgaacatctgcagcgacagccagggcctggagggcctgctgagcggcagcgagctgcagagcctgctgattgccaccacctgcctgcgggagcacagctgctgcttctggaaggagcccaccttctgtgtgctgcgggccatcagcaaggcccagaacctgagcatcatccagtacctgcaggccacagactgtgtgcggctgagcctgcagaacctgagccggctgacagacaccctgcctgcccctgaggtgtctgaggccgtgtccctcatcctgggctttgtgaaggacagctaccctgtgtcctctgccctcttcctggagtttgagaacagcgagggctaccccctgctgctgaaggtgctgctgcgctatgatggcctgacccagagcgaggtggacccccacctggaggagctgctgggcctggtggtgtggctgaccacctgtggccgctctgagctgaaggtgtttgacagcatcacctacccccagctggagggcttcaagttccaccacgaggccagcggcgtgacagtgaagaacctgcaggccttccaggtgctgcagaatgtgttccacaaggccagtgacagcgtgctgtgcatccaggtgctgagcgtcatccgcaccatgtgggcctggaatgccaggaacttcttcctgctggagtggaccctgcagcccatcagccagtttgtggagatcatgcccctgaagccagcccctgtgcaggagcacttcttccagctgctggaggccctggtgtttgagctgcactacgtgccccatgagatcctgaggaaggtgcagcacctgatcaaggagagccctggccccagctgcaccctgatggccctgcagagcatcctgagcattgctggaggagaccccctcttcacagacatcttccgggacagcggcctgctgggcctgctgctggcccagctgaggaagcaggccaagatcatgaggaagagcggcaacaaggtgtccaccccaggagtgcaggaccctgagcgggagctgacctgtgtgatgctgcgcatcgtggtgaccctgctgaagggctctgtgagaaatgctgtggtgctgaaggaccacggcatggtgcccttcatcaagatcttcctggatgatgagtgctaccgggaggccagcctgagcatcctggagcagctgagcgccatcaatgctgaggagtacatgagcatcatcgtgggcgccctgtgcagcagcacccagggcgagctgcagctgaagctggacctgctgaaggtgatcagcagcccccccctgcggctggccagcctgtggatctgcaccaagaggagcacctttgcccaggcctttgtgttcatgtag

SEQ ID NO: 176052 - DNA, 1659 bp, Artificial Sequence
  Description of Artificial Sequence: Synthetic coding sequence
tgagatgacacagtggtgtgggccgaggagtgtgtggcctgtgccaactggctgtggatgaacacagctgacaacctggagctgagcctcttcagccacctgctggagatcctgcagagcccccgggagggccccagaaatgctgaggccgcccaccaggcccagctgatccccaagctgatcttcctgttcaatgagcccagcctcatccccagcaagatcagcaccatcatcggcatcctggcctgccagctgcggggccacttcagcacccaggacctgctgagaattggcctgtttgtggtgtacaccctgaagcccagctctgtgaatgaaaggcagatctgcatggatggagccctggaccccagcctgcctgctggcagccagaccagcggcaagaccatctggctgaggaaccagctgctggagatgctgctgagcgtcatcagcagcccccagctgcacctgagcagcgagagcaaggaggagatgttcctgaagctgggccctgactggttcctgctgctgctgcagggccacctgcacgccagcaccaccgtgctggccctgaagctgctgctgtacttcctggccagccccagcctgcggacccgcttcagagatggcctgtgtgccggctcctgggtggagaggagcacagaaggagtggacatcgtgatggacaacctgaagagccagagccccctgcctgagcagagcccctgcctgctgcccggcttccgggtgctgaatgacttcctggcccaccacgtgcacatccctgaggtgtacctgattgtgtccaccttcttcctgcagacccccctgacagagctgatggatggccccaaggacagcctggatgccatgctgcagtggctgctgcagaggcaccaccaggaggaggtgctgcaggccggcctgtgcacagaaggagccctgctgctgctggagatgctgaaggccaccatgagccagcccctggccggctctgaagatggagcctgggcccagaccttccctgcctctgtgctgcagttcctgagcctggtgcacaggacctacccccaggaccctgcctggagggcccctgagttcctgcagaccctggccatcgccgccttccccctgggcgcccagaagggcgtgggcgctgagagcaccaggaacaccagcagccctgaggccgctgctgagggggacagcacagtggagggcctgcaggcccccaccaaggcccacccagcccggaggaagctgcgggagttcacccagctgctgctgcgggagctgctgctgggcgccagcagccccaagcagtggctgcccctggaggtgctgctggaggccagcccagaccacgccaccagccagcagaagagggacttccagagcgaggtgctgctgagcgccatggagctgttccacatgaccagcggaggagatgctgccatgttcagagatggcaaggagccccagcccagcgctgaggccgctgctgcccccagcctggccaacatcagctgcttcacccagaagctggtggagaagctgtacagcggcatgttttctgctgaccccaggcacatcctgctcttcatcctggagcacatcatggtgatcagcgcccccctgcaggcccgggacttctcctag

SEQ ID NO: 176053 - DNA, 3129 bp, Artificial Sequence
  Description of Artificial Sequence: Synthetic coding sequence
atggaggccgaggacctgagcaaggccgaggacagaaatgaagaccccggcagcaagaatgaaggccagctggccgctgtgcagccagatgtgccccatggaggccagagcagcagccccacagccctgtgggacatgctggagaggaagttcctggagtaccagcagctgacccacaagagccccatcgagcggcagaagagcctgctgagcctgctgcccctcttcctgaaggcctgggagcacagcgtgggcatcatctgcttccccagcctgcagaggctggctgaagatgtgtctgaccagctggcccagcagctgcagaaggccctggtgggcaagccagctgagcaggcccggctggccgccggccagctgctgtggtggaagggagatgtggaccaggacggctacctgctgctgaagtctgtgtatgtgctgaccggcacagacagcgagaccctgggccgggtggccgagagcggcctgcctgccctgctgctgcagtgcctgtacctgttctttgtgttccccctggacaaggatgagctgctggagagtgacctgcaggtgcagaagatgtttgtgcagatgctgctgaacatctgcagcgacagccagggcctggagggcctgctgagcggcagcgagctgcagagcctgctgattgccaccacctgcctgcgggagcacagctgctgcttctggaaggagcccaccttctgtgtgctgcgggccatcagcaaggcccagaacctgagcatcatccagtacctgcaggccacagactgtgtgcggctgagcctgcagaacctgagccggctgacagacaccctgcctgcccctgaggtgtctgaggccgtgtccctcatcctgggctttgtgaaggacagctaccctgtgtcctctgccctcttcctggagtttgagaacagcgagggctaccccctgctgctgaaggtgctgctgcgctatgatggcctgacccagagcgaggtggacccccacctggaggagctgctgggcctggtggtgtggctgaccacctgtggccgctctgagctgaaggtgtttgacagcatcacctacccccagctggagggcttcaagttccaccacgaggccagcggcgtgacagtgaagaacctgcaggccttccaggtgctgcagaatgtgttccacaaggccagtgacagcgtgctgtgcatccaggtgctgagcgtcatccgcaccatgtgggcctggaatgccaggaacttcttcctgctggagtggaccctgcagcccatcagccagtttgtggagatcatgcccctgaagccagcccctgtgcaggagcacttcttccagctgctggaggccctggtgtttgagctgcactacgtgccccatgagatcctgaggaaggtgcagcacctgatcaaggagagccctggccccagctgcaccctgatggccctgcagagcatcctgagcattgctggaggagaccccctcttcacagacatcttccgggacagcggcctgctgggcctgctgctggcccagctgaggaagcaggccaagatcatgaggaagagcggcaacaaggtgtccaccccaggagtgcaggaccctgagcgggagctgacctgtgtgatgctgcgcatcgtggtgaccctgctgaagggctctgtgagaaatgctgtggtgctgaaggaccacggcatggtgcccttcatcaagatcttcctggatgatgagtgctaccgggaggccagcctgagcatcctggagcagctgagcgccatcaatgctgaggagtacatgagcatcatcgtgggcgccctgtgcagcagcacccagggcgagctgcagctgaagctggacctgctgaagagcctgctgcgcatcctggtgacccccaagggccgggccgccttccgggtgagcagcggcttcaacggcctgctgagcctgctgagtgacctggagggcagcctgcaggagccccccctgcaggcctggggcgctgtgagcccccggcagaccctggagctggtgctgtacaccctgtgtgctgtgtctgctgccctgcactgggaccctgtgaatggctacttcttcagaagaaatggcctgtttgagaagctggccgaggacctgtgcctgctgggctgctttggagccctggaggaggagggcaacctgctgcgctcctgggtggacaccaaggcccggccctttgctgacctgctgggcacagccttcagcagcagcggcagcctgcccccacgcatccagagctgcctgcagatcctgggcttcctggacagcatggccagcggcaccctgcacctgcggggggacctgaaggagagcctgcggaccaagcagggccctgtggtggatgtgcagaagggggagactggaagtgacccccagaggaacttcaagcagtggccagacctggaggagaggatggatgaaggagatgctgccatcatgcaccctggggtggtgtgcatcatggtgcggctgctgccccggctgtaccacgaggaccacccccagctgtctgaggagatccagtgcagcctggccagccacatccagagcctggtgaagtctgagaagaaccggcaggtgatgtgtgaggccggcctgctgggcaccctgatggccagctgccaccgggccctggtgaccagcggcagccccctgcacagccgcctcatccgcatctttgagaagctggccagccaggccattgaaccagatgtgctgcggcagttcctgggcctgggcatccccagcagcctgagcgccaccaccaagatcctggacagcagccacacccaccggggcaaccctggctgcagcggcagccagacagcccagggcctggccgagggcccctggccagctgccccagatgctggcctgcaccctggggtgacccaggccccccagcccctgggggagagccaggacagcaccacagccctgcagacagccctgagcctcatctccatgaccagcccccacatctggaagcccaacatctggaaggacaacctggcccagaagcctgtggccggagatgctgcccagtgcaacatcttccccccagccagctctgtgctgtag

SEQ ID NO: 176054 - DNA, 9531 bp, Artificial Sequence
  Description of Artificial Sequence: Synthetic coding sequence
atggaggccgaggacctgagcaaggccgaggacagaaatgaagaccccggcagcaagaatgaaggccagctggccgctgtgcagccagatgtgccccatggaggccagagcagcagccccacagccctgtgggacatgctggagaggaagttcctggagtaccagcagctgacccacaagagccccatcgagcggcagaagagcctgctgagcctgctgcccctcttcctgaaggcctgggagcacagcgtgggcatcatctgcttccccagcctgcagaggctggctgaagatgtgtctgaccagctggcccagcagctgcagaaggccctggtgggcaagccagctgagcaggcccggctggccgccggccagctgctgtggtggaagggagatgtggaccaggacggctacctgctgctgaagtctgtgtatgtgctgaccggcacagacagcgagaccctgggccgggtggccgagagcggcctgcctgccctgctgctgcagtgcctgtacctgttctttgtgttccccctggacaaggatgagctgctggagagtgacctgcaggtgcagaagatgtttgtgcagatgctgctgaacatctgcagcgacagccagggcctggagggcctgctgagcggcagcgagctgcagagcctgctgattgccaccacctgcctgcgggagcacagctgctgcttctggaaggagcccaccttctgtgtgctgcgggccatcagcaaggcccagaacctgagcatcatccagtacctgcaggccacagactgtgtgcggctgagcctgcagaacctgagccggctgacagacaccctgcctgcccctgaggtgtctgaggccgtgtccctcatcctgggctttgtgaaggacagctaccctgtgtcctctgccctcttcctggagtttgagaacagcgagggctaccccctgctgctgaaggtgctgctgcgctatgatggcctgacccagagcgaggtggacccccacctggaggagctgctgggcctggtggtgtggctgaccacctgtggccgctctgagctgaaggtgtttgacagcatcacctacccccagctggagggcttcaagttccaccacgaggccagcggcgtgacagtgaagaacctgcaggccttccaggtgctgcagaatgtgttccacaaggccagtgacagcgtgctgtgcatccaggtgctgagcgtcatccgcaccatgtgggcctggaatgccaggaacttcttcctgctggagtggaccctgcagcccatcagccagtttgtggagatcatgcccctgaagccagcccctgtgcaggagcacttcttccagctgctggaggccctggtgtttgagctgcactacgtgccccatgagatcctgaggaaggtgcagcacctgatcaaggagagccctggccccagctgcaccctgatggccctgcagagcatcctgagcattgctggaggagaccccctcttcacagacatcttccgggacagcggcctgctgggcctgctgctggcccagctgaggaagcaggccaagatcatgaggaagagcggcaacaaggtgtccaccccaggagtgcaggaccctgagcgggagctgacctgtgtgatgctgcgcatcgtggtgaccctgctgaagggctctgtgagaaatgctgtggtgctgaaggaccacggcatggtgcccttcatcaagatcttcctggatgatgagtgctaccgggaggccagcctgagcatcctggagcagctgagcgccatcaatgctgaggagtacatgagcatcatcgtgggcgccctgtgcagcagcacccagggcgagctgcagctgaagctggacctgctgaagagcctgctgcgcatcctggtgacccccaagggccgggccgccttccgggtgagcagcggcttcaacggcctgctgagcctgctgagtgacctggagggcagcctgcaggagccccccctgcaggcctggggcgctgtgagcccccggcagaccctggagctggtgctgtacaccctgtgtgctgtgtctgctgccctgcactgggaccctgtgaatggctacttcttcagaagaaatggcctgtttgagaagctggccgaggacctgtgcctgctgggctgctttggagccctggaggaggagggcaacctgctgcgctcctgggtggacaccaaggcccggccctttgctgacctgctgggcacagccttcagcagcagcggcagcctgcccccacgcatccagagctgcctgcagatcctgggcttcctggacagcatggccagcggcaccctgcacctgcggggggacctgaaggagagcctgcggaccaagcagggccctgtggtggatgtgcagaagggggagactggaagtgacccccagaggaacttcaagcagtggccagacctggaggagaggatggatgaaggagatgctgccatcatgcaccctggggtggtgtgcatcatggtgcggctgctgccccggctgtaccacgaggaccacccccagctgtctgaggagatccagtgcagcctggccagccacatccagagcctggtgaagtctgagaagaaccggcaggtgatgtgtgaggccggcctgctgggcaccctgatggccagctgccaccgggccctggtgaccagcggcagccccctgcacagccgcctcatccgcatctttgagaagctggccagccaggccattgaaccagatgtgctgcggcagttcctgggcctgggcatccccagcagcctgagcgccaccaccaagatcctggacagcagccacacccaccggggcaaccctggctgcagcggcagccagacagcccagggcctggccgagggcccctggccagctgccccagatgctggcctgcaccctggggtgacccaggccccccagcccctgggggagagccaggacagcaccacagccctgcagacagccctgagcctcatctccatgaccagccccaggaacctgcagccccagagagctgccctggcccccagctttgtggagtttgacatgtctgtggagggctacggctgcctcttcatccccaccctgagcacagtgatgggcaccagcacagagtacagcgtgtctgggggcatcggcaccggggccacccggcccttccccccacctgggggcctgaccttcagctgctggttcctgatcagcagacatggagctgccacagagggccaccccctgcgcttcctgaccctggtgcgccacctggccaggacagagcagccctttgtgtgcttctctgtgtccctgtgcccagatgacctgagcctggtggtgtccacagaggagaaggagttccagcccctggatgtgatggagccagaagatgattctgagcccagcgctggctgccagctgcaggtgcgctgtggccagctgctggcctgtggccagtggcaccacctggccgtggtggtgaccaaggagatgaagaggcactgcaccgtgtccacctgcctggatggccaggtgattggcagcgccaagatgctgtacatccaggccctgcccggccccttcctgtccatggaccccagcgcctttgtggatgtgtatggctacatcgccaccccccgggtgtggaagcagaagagcagcctcatctggaggctgggccccacctacctgtttgaggaggccatctccatggagaccctggaggtgatcaacaagctgggcccccgctactgcggcaacttccaggccgtgcacgtgcagggcgaggacctggacagcgaggccaccccatttgtggccgaggagcgggtgtcctttggcctgcacatcgccagcagcagcatcacctctgtggccgacatcagaaatgcctacaatgaggtggacagccggctgattgccaaggagatgaacatcagcagccgggacaatgccatgcctgtgttcctgctgaggaactgtgccggccacctgagcggcagcctgcggaccatcggggctgtggccgtgggccagctgggcgtgcgggtcttccacagcagccctgctgccagcagcctggacttcatcggcggccctgccatcctgctgggcctcatcagcctggccacagatgaccacaccatgtatgctgctgtgaaggtgctgcacagcgtgctgaccagcaatgccatgtgtgacttcctgatgcagcacatctgtggctaccagatcatggccttcctgctgaggaagaaggccagcctgctgaaccaccgcatcttccagctgatcctgtctgtggccggcaccgtggagctgggcttccgcagcagcgccatcaccaacacaggagtcttccagcacatcctgtgcaactttgagctgtggatgaacacagctgacaacctggagctgagcctcttcagccacctgctggagatcctgcagagcccccgggagggccccagaaatgctgaggccgcccaccaggcccagctgatccccaagctgatcttcctgttcaatgagcccagcctcatccccagcaagatcagcaccatcatcggcatcctggcctgccagctgcggggccacttcagcacccaggacctgctgcgcatcggcctgtttgtggtgtacaccctgaagcccagctctgtgaatgaaaggcagatctgcatggatggagccctggaccccagcctgcctgctggcagccagaccagcggcaagaccatctggctgaggaaccagctgctggagatgctgctgagcgtcatcagcagcccccagctgcacctgagcagcgagagcaaggaggagatgttcctgaagctgggccctgactggttcctgctgctgctgcagggccacctgcacgccagcaccaccgtgctggccctgaagctgctgctgtacttcctggccagccccagcctgcggacccgcttcagagatggcctgtgtgccggctcctgggtggagaggagcacagagggcgtggacatcgtgatggacaacctgaagagccagagccccctgcctgagcagagcccctgcctgctgcccggcttccgggtgctgaatgacttcctggcccaccacgtgcacatccctgaggtgtacctgattgtgtccaccttcttcctgcagacccccctgacagagctgatggatggccccaaggacagcctggatgccatgctgcagtggctgctgcagaggcaccaccaggaggaggtgctgcaggccggcctgtgcacagagggcgccctgctgctgctggagatgctgaaggccaccatgagccagcccctggccggctctgaagatggagcctgggcccagaccttccctgcctctgtgctgcagttcctgagcctggtgcacaggacctacccccaggaccctgcctggagggcccctgagttcctgcagaccctggccatcgccgccttccccctgggcgcccagaagggcgtgggcgctgagagcaccaggaacaccagcagccctgaggccgctgctgagggggacagcacagtggagggcctgcaggcccccaccaaggcccacccagcccggaggaagctgcgggagttcacccagctgctgctgcgggagctgctgctgggcgccagcagccccaagcagtggctgcccctggaggtgctgctggaggccagcccagaccacgccaccagccagcagaagagggacttccagagcgaggtgctgctgagcgccatggagctgttccacatgaccagcggaggagatgctgccatgttcagagatggcaaggagccccagcccagcgctgaggccgccgccgcccccagcctggccaacatcagctgcttcacccagaagctggtggagaagctgtacagcggcatgttttctgctgaccccaggcacatcctgctcttcatcctggagcacatcatggtggtgattgaaacagccagcagccagagggacacagtgctgagcaccctgtacagcagcctgaacaaggtgatcctgtactgcctgagcaagccccagcagagcctgtctgaatgtctgggcctgctgagcatcctgggcttcctgcaggagcactgggatgtggtgtttgccacctacaacagcaacatctccttcctgctgtgcctgatgcactgcctgctgctgctgaatgaaagaagctacccagagggcttcggcctggagcccaagcccaggatgagcacctaccaccaggtgttcctgagccccaatgaagatgtgaaggagaagcgggaggacctgcccagcctgagtgatgtgcagcacaacatccagaagacagtgcagaccctgtggcagcagctggtggcccagaggcagcagaccctggaggatgccttcaagattgacctgtctgtgaagccaggagagcgggaggtgaagattgaggaggtgacccccctgtgggaggagaccatgctgaaggcctggcagcactacctggccagcgagaagaagagcctggccagccgcagcaatgtggcccaccacagcaaggtgaccctgtggagcggcagcctgagcagcgccatgaagctgatgcctggccggcaggccaaggaccctgagtgcaagacagaagattttgtgtcctgcatcgagaactacagaagaagaggccaggagctgtatgccagcctgtacaaggaccacgtgcagaggaggaaatgtggcaacatcaaggccgccaatgcctgggcccgcatccaggagcagctgtttggagagctgggcctgtggagccagggcgaggagaccaagccctgcagcccctgggagctggactggagggagggccctgccaggatgaggaagaggatcaagaggctgagccccctggaggccctgagcagcggccgccacaaggagagccaggacaagaatgaccacatcagccagaccaatgctgagaaccaggatgagctgaccctgcgggaggccgagggggagccagatgaggtgggcgtggactgcacccagctgaccttcttccctgccctgcacgagagcctgcacagcgaggacttcctggagctgtgccgggagcggcaggtgatcctgcaggagctgctggacaaggagaaggtgacccagaagttcagcctggtgattgtgcagggccacctggtgtctgaaggagtgctgctgtttggccaccagcacttctacatctgtgagaacttcaccctgagccccactggagatgtgtactgcaccaggcactgcctgagcaacatcagtgaccccttcatcttcaacctgtgcagcaaggacaggagcacagaccactacagctgccagtgccacagctatgctgacatgagggagctgcggcaggcccgcttcctgctgcaggacatcgccctggagatcttcttccacaacggctacagcaagttcctggtgttctacaacaatgacaggagcaaggccttcaagagcttctgcagcttccagcccagcctgaagggcaaggccaccagcgaggacaccctgagcctgcggcgctacccaggcagtgaccgcatcatgctgcagaagtggcagaagagggacatcagcaactttgagtacctgatgtacctgaacacagctgctggccgcacctgcaatgactacatgcagtaccctgtgttcccctgggtgctggccgactacaccagcgagaccctgaacctggccaaccccaagatcttccgggacctgagcaagcccatgggcgcccagaccaaggagaggaagctgaagttcatccagcgcttcaaggaggtggagaagacagaaggagacatgacagtgcagtgccactactacacccactacagcagcgccatcatcgtggccagctacctggtgaggatgccacccttcacccaggccttctgtgccctgcagggcggcagctttgatgtggccgacaggatgttccacagcgtgaagagcacctgggagagcgccagccgggagaacatgtctgatgtgcgggagctgaccccagagttcttctacctgcctgagttcctgaccaactgcaatggagtggagtttggctgcatgcaggacggcaccgtgctgggagatgtgcagctgcccccctgggcagatggagaccccaggaagttcatcagcctgcacaggaaggccctggagagtgactttgtgtctgccaacctgcaccactggattgacctgatcttcggctacaagcagcagggccctgctgctgtggatgctgtgaacatcttccacccctacttctatggagacaggatggacctgagcagcatcacagaccccctcatcaagagcaccatcctgggctttgtgagcaactttggccaggtgcccaagcagctgttcaccaagccccacccagccaggacagctgctgggaagcccctgcccgggaaggatgtgtccacccctgtgtccctgcccggccacccccagcccttcttctacagcctgcagagcctgcggcccagccaggtgacagtgaaggacatgtacctgttcagcctgggcagcgagagccccaagggggccatcggccacatcgtgtccacagagaagaccatcctggccgtggagaggaacaaggtgctgctgccccccctgtggaacagaaccttctcctggggctttgatgacttcagctgctgcctgggcagctatggcagtgacaaggtgctgatgacctttgagaacctggccgcctggggccgctgcctgtgtgctgtgtgccccagccccaccaccatcgtgaccagcggcaccagcacagtggtgtgtgtgtgggagctgtccatgaccaagggccggccccggggcctgcggctgcggcaggccctgtatggccacacccaggccgtgacctgcctggccgcctctgtgaccttcagcctgctggtgtctggcagccaggactgcacctgcatcctgtgggacctggaccacctgacccacgtgacccggctgcctgcccaccgggagggcatcagcgccatcaccatcagtgatgtgtctggcaccatcgtgtcctgtgccggggcccacctgagcctgtggaatgtgaatggccagcccctggccagcatcaccacagcctggggccctgagggcgccatcacctgctgctgcctgatggagggccctgcctgggacaccagccagatcatcatcaccggcagccaggacggcatggtgcgggtgtggaagacagaagatgtgaagatgtctgtgcccggcctgcagatgggcaggaagcgggaggccgctgaggccctggcccagcagtgccaggccgagggcggccgcggggactggggcctgagcagcgcctacagaagaaacccccagggcctgctgccccacagcagccagggccgggccagcggcaaccacagcagcgctgcccagcccagcccctggcccatgggcctgctgtag

SEQ ID NO: 176055 - DNA, 3159 bp, Artificial Sequence
  Description of Artificial Sequence: Synthetic coding sequence
ctcaacagcgacctgctgtgccacggcatggaggccgaggacctgagcaaggcagaagatagaaatgaagatcctggcagcaagaatgaaggccagctggccgctgtgcagccagatgtgccccacggcggccagagcagcagccccacagccctgtgggacatgctggagaggaagttcctggagtaccagcagctgacccacaagagccccatcgagcggcagaagagcctgctgagcctgctgcccctcttcctgaaggcctgggagcacagcgtgggcatcatctgcttccccagcctgcagaggctggccgaggatgtgtctgaccagctggcccagcagctgcagaaggccctggtgggcaagccagctgagcaggcccggctggccgccggccagctgctgtggtggaagggagatgtggaccaggacggctacctgctgctgaagtctgtgtatgtgctgactggaacagattctgagaccctgggccgggtggccgagagcggcctgcctgccctgctgctgcagtgcctgtacctgttctttgtgttccccctggacaaggatgagctgctggagagtgacctgcaggtgcagaagatgtttgtgcagatgctgctgaacatctgcagcgacagccagggcctggagggcctgctgagcggcagcgagctgcagagcctgctgattgccaccacctgcctgcgggagcacagctgctgcttctggaaggagcccaccttctgtgtgctgcgggccatcagcaaggcccagaacctgagcatcatccagtacctgcaggccacagactgtgtgcggctgagcctgcagaacctgagccggctgacagacaccctgcctgcccctgaggtgtctgaggccgtgtccctcatcctgggctttgtgaaggacagctaccctgtgagcagcgccctcttcctggagtttgaaaattctgagggctaccccctgctgctgaaggtgctgctgcgctatgatggcctgacccagagcgaggtggacccccacctggaggagctgctgggcctggtggtgtggctgaccacctgtggccgctctgagctgaaggtgtttgacagcatcacctacccccagctggagggcttcaagttccaccacgaggccagcggcgtgacagtgaagaacctgcaggccttccaggtgctgcagaatgtgttccacaaggccagtgacagcgtgctgtgcatccaggtgctgagcgtcatccgcaccatgtgggcctggaatgccaggaacttcttcctgctggagtggaccctgcagcccatcagccagtttgtggagatcatgcccctgaagccagcccctgtgcaggagcacttcttccagctgctggaggccctggtgtttgagctgcactacgtgccccatgagatcctgaggaaggtgcagcacctgatcaaggagagccctggccccagctgcaccctgatggccctgcagagcatcctgagcattgctggaggagaccccctcttcacagacatcttccgggacagcggcctgctgggcctgctgctggcccagctgaggaagcaggccaagatcatgaggaagagcggcaacaaggtgtccaccccaggagtgcaggaccctgagcgggagctgacctgtgtgatgctgagaattgtggtgaccctgctgaagggctctgtgagaaatgctgtggtgctgaaggaccacggcatggtgcccttcatcaagatcttcctggatgatgagtgctaccgggaggccagcctgagcatcctggagcagctgagcgccatcaatgctgaggagtacatgagcatcatcgtgggcgccctgtgcagcagcacccagggcgagctgcagctgaagctggacctgctgaagagcctgctgcgcatcctggtgacccccaagggccgggccgccttccgggtgagcagcggcttcaacggcctgctgagcctgctgagtgacctggagggcagcctgcaggagccccccctgcaggcctggggcgctgtgagcccccggcagaccctggagctggtgctgtacaccctgtgtgctgtgtctgctgccctgcactgggaccctgtgaatggctacttcttcagaagaaatggcctgtttgagaagctggccgaggacctgtgcctgctgggctgcttcggggccctggaggaggagggcaacctgctgcgctcctgggtggacaccaaggcccggccctttgctgacctgctgggcacagccttcagcagcagcggcagcctgcccccacgcatccagagctgcctgcagatcctgggcttcctggacagcatggccagcggcaccctgcacctgcggggggacctgaaggagagcctgcggaccaagcagggccctgtggtggatgtgcagaagggggagaccggcagtgacccccagaggaacttcaagcagtggccagacctggaggagaggatggatgaaggagatgctgccatcatgcaccctggggtggtgtgcatcatggtgcggctgctgccccggctgtaccacgaggaccacccccagctgtctgaggagatccagtgcagcctggccagccacatccagagcctggtgaagtctgagaagaaccggcaggtgatgtgtgaggccggcctgctgggcaccctgatggccagctgccaccgggccctggtgaccagcggcagccccctgcacagccgcctcatccgcatctttgagaagctggccagccaggccatcgagccagatgtgctgcggcagttcctgggcctgggcatccccagcagcctgagcgccaccaccaagatcctggacagcagccacacccaccggggcaaccctggctgcagcggcagccagacagcccagggcctggccgagggcccctggccagctgccccagatgctggcctgcaccctggggtgacccaggccccccagcccctgggggagagccaggacagcaccacagccctgcagacagccctgagcctcatctccatgaccagccctgtggccggcagccagaccagcggcaagaccatctggctgaggaaccagctgctggagatgctgctgagcgtcatcagcagcccccagctgcacctgagcagcgagtag

SEQ ID NO: 176056 - DNA, 1875 bp, Artificial Sequence
  Description of Artificial Sequence: Synthetic coding sequence
atgctgcagaagtggcagaagagggacatcagcaactttgagtacctgatgtacctgaacacagctgctggccgcacctgcaatgactacatgcagtaccctgtgttcccctgggtgctggccgactacaccagcgagaccctgaacctggccaaccccaagatcttccgggacctgagcaagcccatgggcgcccagaccaaggagaggaagctgaagttcatccagcgcttcaaggaggtggagaagacagaaggagacatgacagtgcagtgccactactacacccactacagcagcgccatcatcgtggccagctacctggtgaggatgccacccttcacccaggccttctgtgccctgcagggcggcagctttgatgtggccgacaggatgttccacagcgtgaagagcacctgggagagcgccagccgggagaacatgtctgatgtgcgggagctgaccccagagttcttctacctgcctgagttcctgaccaactgcaatggagtggagtttggctgcatgcaggacggcaccgtgctgggagatgtgcagctgcccccctgggcagatggagaccccaggaagttcatcagcctgcacaggaaggccctggagagtgactttgtgtctgccaacctgcaccactggattgacctgatcttcggctacaagcagcagggccctgctgctgtggatgctgtgaacatcttccacccctacttctacggggacaggatggacctgagcagcatcacagaccccctcatcaagagcaccatcctgggctttgtgagcaactttggccaggtgcccaagcagctgttcaccaagccccacccagccaggacagctgctgggaagcccctgcccgggaaggatgtgtccacccctgtgtccctgcccggccacccccagcccttcttctacagcctgcagagcctgcggcccagccaggtgacagtgaaggacatgtacctgttcagcctgggcagcgagagccccaagggggccatcggccacatcgtgtccacagagaagaccatcctggccgtggagaggaacaaggtgctgctgccccccctgtggaacagaaccttctcctggggctttgatgacttcagctgctgcctgggcagctatggcagtgacaaggtgctgatgacctttgagaacctggccgcctggggccgctgcctgtgtgctgtgtgccccagccccaccaccatcgtgaccagcggcaccagcacagtggtgtgtgtgtgggagctgtccatgaccaagggccggccccggggcctgcggctgcggcaggccctgtatggccacacccaggccgtgacctgcctggccgcctctgtgaccttcagcctgctggtgtctggcagccaggactgcacctgcatcctgtgggacctggaccacctgacccacgtgacccggctgcctgcccaccgggagggcatcagcgccatcaccatcagtgatgtgtctggcaccatcgtgtcctgtgccggggcccacctgagcctgtggaatgtgaatggccagcccctggccagcatcaccacagcctggggccctgagggcgccatcacctgctgctgcctgatggagggccctgcctgggacaccagccagatcatcatcaccggcagccaggacggcatggtgcgggtgtggaagacagaagatgtgaagatgtctgtgcccggccggcctgctggggaggagcccccagcccagccccccaccctgtccatggctgatggcacctccatgaagaggatgagcacccacaccaggagagctgagcagcacgccggcaactgtgacctggtgatgcccagctgcaccaggaactacacctag

SEQ ID NO: 176057 - DNA, 1704 bp, Artificial Sequence
  Description of Artificial Sequence: Synthetic coding sequence
atggatgacaaggacatcgacaaggagctgcggcagaagctgaacttctcctactgtgaggagacagaaattgagggccagaagaaggtggaggagagccgggaggccagcagccagaccccagagaagggggaggtgcaggacagcgaggccaagggcaccccaccctggacccccctgagcaatgtgcatgagctggacaccagcagcgagaaggacaaggagagcccagaccagatcctgcggacccctgtgagccaccccctgaagtgcccagagaccccagcccagcctgacagccgcagcaagctgctgcccagcgacagccccagcacccccaagaccatgctgagccggctggtgatcagccccaccgggaagctgcccagccggggccccaagcacctgaagctgaccccagcccccctgaaggatgagatgaccagcctggccctggtgaacatcaaccccttcaccccagagagctacaagaagctgttcctgcagagcggcggcaagaggaagatccggggggacctggaggaggccggccctgaggagggcaaaggaggcctgcctgccaagagatgtgtgctgcgggagaccaacatggccagccgctatgagaaggagttcctggaggtggagaagattggagtgggggagtttggaacagtgtacaagtgcatcaagaggctggatggctgtgtgtatgccatcaagaggtccatgaagaccttcacagagctgagcaatgaaaattctgccctgcacgaggtgtatgcccatgctgtgctgggccaccacccccacgtggtgcgctactacagctcctgggccgaggatgaccacatgatcatccagaatgagtactgcaatggaggcagcctgcaggccgccatcagcgagaacaccaagagcggcaaccactttgaggagcccaagctgaaggacatcctgctgcagatcagcctgggcctgaactacatccacaacagctccatggtgcacctggacatcaagcccagcaacatcttcatctgccacaagatgcagagcgagagcagcggcgtgattgaggaggtggagaatgaggccgactggttcctgagcgccaacgtgatgtacaagatcggggacctgggccacgccaccagcatcaacaagcccaaggtggaggagggggacagccgcttcctggccaatgagatcctgcaggaggactaccgccacctgcccaaggctgacatctttgccctgggcctgaccatcgctgtggccgccggggctgagagcctgcccaccaacggggccgcctggcaccacatcagaaaaggaaacttcccagatgtgccccaggagctgtctgagagcttcagcagcctgctgaagaacatgatccagccagatgctgagcagaggcccagcgctgctgccctggccaggaacacagtgctgcggcccagcctgggcaagacagaggagctgcagcagcagctgaacctggagaagttcaagacagccaccctggagcgggagctgcgggaggcccagcaggcccagagcccccagggctacacccaccacggggacaccggggtgtctggcacccacacaggcagccgcagcaccaagaggctggtgggcggcaagagcgcccggagcagcagcttcaccagcggggagcgggagcccctgcactag

SEQ ID NO: 176058 - DNA, 846 bp, Artificial Sequence
  Description of Artificial Sequence: Synthetic coding sequence
atggtgaccatcctgatgagggccatcaacagcctgggcatccacgtgctggacagcagccggcccacagaccccctgagccacagcagcaacagcagcagcgagcccgccatgtttattgaggacaaggctgtggacaccctggcctacctgagtgatggagatgcccgggccggcctgaatggcctgcagctggccgtgctggcccggctgagcagcaggaagatgttctgcaagaagagcggccagagctacagccccagccgggtgctgatcacagaaaatgatgtgaaggagggcctgcagaggagccacatcctgtatgacagagctggggaggagcactacaactgcatcagcgccctgcacaagtccatgaggggcagtgaccagaatgccagcctgtactggctggccaggatgctggagggcggggaggaccccctgtatgtggcccggcggctggtgcgctttgcctctgaagatattggcctggccgaccccagcgccctgacccaggccgtggccgcctaccagggctgccacttcatcggcatgccagaatgtgaggtgctgctggcccagtgtgtggtgtactttgcccgggcccccaagagcattgaggtgtacagcgcctacaacaacgtgaaggcctgcctgaggaaccaccagggccccctgccccctgtgcccctgcacctgagaaatgcccccacccggctgatgaaggacctgggctacggcaagggctacaagtacaaccccatgtacagcgagcctgtggaccaggagtacctgcctgaggagctgcggggcgtggacttcttcaagcagaggcgctgctag

SEQ ID NO: 176059 - DNA, 1338 bp, Artificial Sequence
  Description of Artificial Sequence: Synthetic coding sequence
atgctgcagggcaagcccctggccgacaccatgaggccagacaccctgcaggactacttcggccagagcaaggctgtgggccaggacaccctgctgcggagcctgctggagaccaatgagatccccagcctcatcctgtggggccccccaggctgtgggaagaccaccctggcccacatcatcgccagcaacagcaagaagcacagcatccgctttgtgaccctgagcgccaccaatgccaagaccaatgatgtgagagatgtgatcaagcaggcccagaatgagaagagcttcttcaagaggaagaccatcctcttcattgatgagatccaccgcttcaacaagagccagcaggacaccttcctgccccacgtggagtgtggcaccatcaccctgattggagccaccacagagaaccccagcttccaggtgaatgctgccctgctgagccgctgccgggtgattgtgctggagaagctgcctgtggaggccatggtgaccatcctgatgagggccatcaacagcctgggcatccacgtgctggacagcagccggcccacagaccccctgagccacagcagcaacagcagcagcgagcccgccatgtttattgaggacaaggctgtggacaccctggcctacctgagtgatggagatgcccgggccggcctgaatggcctgcagctggccgtgctggcccggctgagcagcaggaagatgttctgcaagaagagcggccagagctacagccccagccgggtgctgatcacagaaaatgatgtgaaggagggcctgcagaggagccacatcctgtatgacagagctggggaggagcactacaactgcatcagcgccctgcacaagtccatgaggggcagtgaccagaatgccagcctgtactggctggccaggatgctggagggcggggaggaccccctgtatgtggcccggcggctggtgcgctttgcctctgaagatattggcctggccgaccccagcgccctgacccaggccgtggccgcctaccagggctgccacttcatcggcatgccagaatgtgaggtgctgctggcccagtgtgtggtgtactttgcccgggcccccaagagcattgaggtgtacagcgcctacaacaacgtgaaggcctgcctgaggaaccaccagggccccctgccccctgtgcccctgcacctgagaaatgcccccacccggctgatgaaggacctgggctacggcaagggctacaagtacaaccccatgtacagcgagcctgtggaccaggagtacctgcctgaggagctgcggggcgtggacttcttcaagcagaggcgctgctag

SEQ ID NO: 176060 - DNA, 1923 bp, Artificial Sequence
  Description of Artificial Sequence: Synthetic coding sequence
atggaggtgtctggcccagaagatgaccccttcctgagccagctgcaccaggtgcagtgccctgtgtgccagcagatgatgcctgctgcccacatcaacagccacctggaccgctgcctgctgctgcaccctgctggccacgccgagcctgctgctggcagccacagagctggggagcgggccaagggccccagccccccaggggccaagagaagaaggctgtctgagagcagcgccctgaagcagcctgccacccccacagctgctgagagcagcgagggggagggggaggagggagatgatggaggagaaacagagagccgggagagctatgatgccccacccacccccagcggggcccggctcatcccagacttccctgtggcccggagcagcagccctggcaggaaaggaagtggcaagaggcctgctgctgctgctgctgctggcagcgccagccccaggtcctgggatgaggccgaggcccaggaggaggaggaggccgtgggagatggagatggagatggagatgctgatgctgatggagaagatgaccccggccactgggatgctgatgctgctgaggccgccacagccttcggggccagcggcggcggccggccccacccccgggccctggccgctgaggagatccggcagatgctgcagggcaagcccctggccgacaccatgaggccagacaccctgcaggactacttcggccagagcaaggctgtgggccaggacaccctgctgcggagcctgctggagaccaatgagatccccagcctcatcctgtggggccccccaggctgtgggaagaccaccctggcccacatcatcgccagcaacagcaagaagcacagcatccgctttgtgaccctgagcgccaccaatgccaagaccaatgatgtgagagatgtgatcaagcaggcccagaatgagaagagcttcttcaagaggaagaccatcctcttcattgatgagatccaccgcttcaacaagagccagcaggtgaatgctgccctgctgagccgctgcagggtcatcgtgctggagaagctgcctgtggaggccatggtgaccatcctgatgagggccatcaacagcctgggcatccacgtgctggacagcagccggcccacagaccccctgagccacagcagcaacagcagcagcgagcccgccatgtttattgaggacaaggctgtggacaccctggcctacctgagtgatggagatgcccgggccggcctgaatggcctgcagctggccgtgctggcccggctgagcagcaggaagatgttctgcaagaagagcggccagagctacagccccagccgggtgctgatcacagaaaatgatgtgaaggagggcctgcagaggagccacatcctgtatgaccgggccggggaggagcactacaactgcatcagcgccctgcacaagtccatgaggggcagtgaccagaatgccagcctgtactggctggccaggatgctggagggcggggaggaccccctgtatgtggcccggcggctggtgcgctttgccagcgaggacatcggcctggccgaccccagcgccctgacccaggccgtggccgcctaccagggctgccacttcatcggcatgccagaatgtgaggtgctgctggcccagtgtgtggtgtactttgcccgggcccccaagagcattgaggtgtacagcgcctacaacaacgtgaaggcctgcctgaggaaccaccagggccccctgccccctgtgcccctgcacctgagaaatgcccccacccggctgatgaaggacctgggctacggcaagggctacaagtacaaccccatgtacagcgagcctgtggaccaggagtacctgcctgaggagctgcggggcgtggacttcttcaagcagaggcgctgctag

SEQ ID NO: 176061 - DNA, 1998 bp, Artificial Sequence
  Description of Artificial Sequence: Synthetic coding sequence
atggaggtgtctggcccagaagatgaccccttcctgagccagctgcaccaggtgcagtgccctgtgtgccagcagatgatgcctgctgcccacatcaacagccacctggaccgctgcctgctgctgcaccctgctggccacgccgagcctgctgctggcagccacagagctggggagcgggccaagggccccagccccccaggggccaagagaagaaggctgtctgagagcagcgccctgaagcagcctgccacccccacagctgctgagagcagcgagggggagggggaggagggagatgatggaggagaaacagagagccgggagagctatgatgccccacccacccccagcggggcccggctcatcccagacttccctgtggcccggagcagcagccctggcaggaaaggaagtggcaagaggcctgctgctgctgctgctgctggcagcgccagccccaggtcctgggatgaggccgaggcccaggaggaggaggaggccgtgggagatggagatggagatggagatgctgatgctgatggagaagatgaccccggccactgggatgctgatgctgctgaggccgccacagccttcggggccagcggcggcggccggccccacccccgggccctggccgctgaggagatccggcagatgctgcagggcaagcccctggccgacaccatgaggccagacaccctgcaggactacttcggccagagcaaggctgtgggccaggacaccctgctgcggagcctgctggagaccaatgagatccccagcctcatcctgtggggccccccaggctgtgggaagaccaccctggcccacatcatcgccagcaacagcaagaagcacagcatccgctttgtgaccctgagcgccaccaatgccaagaccaatgatgtgagagatgtgatcaagcaggcccagaatgagaagagcttcttcaagaggaagaccatcctcttcattgatgagatccaccgcttcaacaagagccagcaggacaccttcctgccccacgtggagtgtggcaccatcaccctgattggagccaccacagagaaccccagcttccaggtgaatgctgccctgctgagccgctgccgggtgattgtgctggagaagctgcctgtggaggccatggtgaccatcctgatgagggccatcaacagcctgggcatccacgtgctggacagcagccggcccacagaccccctgagccacagcagcaacagcagcagcgagcccgccatgtttattgaggacaaggctgtggacaccctggcctacctgagtgatggagatgcccgggccggcctgaatggcctgcagctggccgtgctggcccggctgagcagcaggaagatgttctgcaagaagagcggccagagctacagccccagccgggtgctgatcacagaaaatgatgtgaaggagggcctgcagaggagccacatcctgtatgacagagctggggaggagcactacaactgcatcagcgccctgcacaagtccatgaggggcagtgaccagaatgccagcctgtactggctggccaggatgctggagggcggggaggaccccctgtatgtggcccggcggctggtgcgctttgcctctgaagatattggcctggccgaccccagcgccctgacccaggccgtggccgcctaccagggctgccacttcatcggcatgccagaatgtgaggtgctgctggcccagtgtgtggtgtactttgcccgggcccccaagagcattgaggtgtacagcgcctacaacaacgtgaaggcctgcctgaggaaccaccagggccccctgccccctgtgcccctgcacctgagaaatgcccccacccggctgatgaaggacctgggctacggcaagggctacaagtacaaccccatgtacagcgagcctgtggaccaggagtacctgcctgaggagctgcggggcgtggacttcttcaagcagaggcgctgctag

SEQ ID NO: 176062 - DNA, 4299 bp, Artificial Sequence
  Description of Artificial Sequence: Synthetic coding sequence
atgtctgagaagaagctggagaccacagcccagcagaggaagtgcccagagtggatgaatgtgcagaacaagagatgtgctgtggaggagaggaaggcctgtgtgaggaagtctgtgtttgaagatgacctgcccttcctggagttcaccggcagcatcgtgtacagctatgatgccagtgactgcagcttcctgtctgaggacatctccatgagcctgagtgatggagatgtggtgggctttgacatggagtggccacccctgtacaacagaggcaagctgggcaaggtggccctgatccagctgtgtgtgtctgagagcaagtgctacctgttccacgtgtcctccatgtctgtgttcccccagggcctgaagatgctgctggagaacaaggctgtgaagaaggccggcgtgggcatcgagggggaccagtggaagctgctgcgggactttgacatcaagctgaagaactttgtggagctgacagatgtggccaacaagaagctgaagtgcacagagacctggagcctgaacagcctggtgaagcacctgctgggcaagcagctgctgaaggacaagagcatccgctgcagcaactggagcaagttccccctgacagaggaccagaagctgtatgctgccacagatgcctatgccggcttcatcatctacagaaacctggagatcctggatgacacagtgcagagatttgccatcaacaaggaggaggagatcctgctgagtgacatgaacaagcagctgaccagcatcagcgaggaggtgatggacctggccaagcacctgccccacgccttcagcaagctggagaaccccaggagagtgtccatcctgctgaaggacatcagcgagaacctgtacagcctgcggaggatgatcatcggcagcaccaacattgaaacagagctgcggcccagcaacaacctgaacctgctgagctttgaggacagcaccactggaggagtgcagcagaagcagatccgggagcacgaggtgctgattcatgtggaggatgagacctgggaccccaccctggaccacctggccaagcatgatggagaagatgtgctgggcaacaaggtggagaggaaagaagatggctttgaagatggagtggaggacaacaagctgaaggagaacatggagcgggcctgcctgatgagcctggacatcacagagcacgagctgcagatcctggagcagcagagccaggaggagtacctgagtgacatcgcctacaagagcacagagcacctgagccccaatgacaatgaaaatgacaccagctatgtgattgaaagtgatgaggacctggagatggagatgctgaagcacctgagccccaatgacaatgaaaatgacaccagctatgtgattgaaagtgatgaggacctggagatggagatgctgaagagcctggagaacctgaacagcggcaccgtggagcccacccacagcaagtgcctgaagatggagaggaacctgggcctgcccaccaaggaggaggaggaggatgatgaaaatgaggccaatgaaggagaagaagatgatgacaaggacttcctgtggccagccccaaatgaggagcaggtgacctgcctgaagatgtacttcggccacagcagcttcaagcctgtgcagtggaaggtgatccacagcgtgctggaggagcggcgggacaacgtggccgtgatggccaccggctacggcaagagcctgtgcttccagtacccacctgtgtatgtgggcaagattggcctggtgatcagccccctcatcagcctgatggaggaccaggtgctgcagctgaagatgagcaacatcccagcctgcttcctgggcagcgcccagagtgaaaatgtgctgacagacatcaagctgggcaagtaccgcatcgtgtatgtgaccccagagtactgcagcggcaacatgggcctgctgcagcagctggaggccgacatcggcatcaccctgattgctgtggatgaggcccactgcatcagcgagtggggccatgacttccgggacagcttcaggaagctgggcagcctgaagacagccctgcccatggtgcccatcgtggccctgacagccacagccagcagcagcatccgggaggacatcgtgcgctgcctgaacctgaggaacccccagatcacctgcaccggctttgaccggcccaacctgtacctggaggtgcggaggaagacaggcaacatcctgcaggacctgcagcccttcctggtgaagaccagcagccactgggagtttgagggccccaccatcatctactgccccagcaggaagatgacccagcaggtgactggagagctgaggaagctgaacctgagctgtggcacctaccacgccggcatgtccttcagcaccaggaaggacatccaccacagatttgtgagagatgagatccagtgtgtgattgccaccatcgccttcggcatgggcatcaacaaggctgacatccggcaggtgatccactatggagcccccaaggacatggagagctactaccaggagatcggccgggccggcagagatggcctgcagagcagctgccacgtgctgtgggccccagctgacatcaacctgaacagacacctgctgacagagatcagaaatgagaagttccggctgtacaagctgaagatgatggccaagatggagaagtacctgcacagcagccgctgccggcggcagatcatcctgagccactttgaggacaagcaggtgcagaaggccagcctgggcatcatgggcacagagaagtgctgtgacaactgccgcagccggctggaccactgctacagcatggatgacagcgaggacacctcctgggactttggcccccaggccttcaagctgctgtctgctgtggacatcctgggggagaagtttggaattggcctgcccatcctcttcctgcggggcagcaacagccagaggctggccgaccagtacagaagacacagcctgtttggcaccgggaaggaccagacagagagctggtggaaggccttcagccggcagctgatcacagagggcttcctggtggaggtgagccgctacaacaagttcatgaagatctgtgccctgaccaagaagggcaggaactggctgcacaaggccaacacagagagccagagcctcatcctgcaggccaatgaggagctgtgccccaagaagctgctgctgcccagcagcaagacagtgagcagcggcaccaaggagcactgctacaaccaggtgcctgtggagctgagcacagagaagaagagcaacctggagaagctgtacagctacaagccctgtgacaagatcagcagcggcagcaacatcagcaagaagagcatcatggtgcagagccctgagaaggcctacagcagcagccagcctgtgatcagcgcccaggagcaggagacccagatcgtgctgtatggcaagctggtggaggcccggcagaagcacgccaacaagatggatgtgcccccagccatcctggccaccaacaagatcctggtggacatggccaagatgaggcccaccaccgtggagaatgtgaagagaattgatggagtgtctgagggcaaggccgccatgctggcccccctgctggaggtgatcaagcacttctgccagaccaacagcgtgcagacagacctcttcagcagcaccaagccccaggaggagcagaagaccagcctggtggccaagaacaagatctgcaccctgagccagagcatggccatcacctacagcctcttccaggagaagaagatgcccctgaagagcattgctgagagccgcatcctgcccctgatgaccatcggcatgcacctgagccaggccgtgaaggccggctgccccctggacctggagcgggccggcctgaccccagaggtgcagaagatcatcgcagatgtgatcagaaatcctcctgtgaacagcgacatgagcaagatcagcctcatccgcatgctggtgcctgaaaatattgacacctacctgatccacatggccatcgagatcctgaagcacggcccagattctggcctgcagcccagctgtgatgtgaacaagaggcgctgcttccctggcagcgaggagatctgcagcagcagcaagaggagcaaggaggaggtgggcatcaacacagagaccagcagcgctgagaggaagaggcggctgcctgtgtggtttgccaagggcagtgacaccagcaagaagctgatggacaagaccaagaggggcggcctcttctcctag

SEQ ID NO: 176063 - DNA, 738 bp, Artificial Sequence
  Description of Artificial Sequence: Synthetic coding sequence
atggcccaggaggagggcggcagcctgcctgaggtgcgggcccgggtgcgggccgcccacggcatcccagacctggcccagaagctgcacttctatgaccgctgggccccagactatgaccaggatgtggccaccctgctgtaccgggccccccggctggccgtggactgcctgacccaggccctgcccggccccccccacagcgccctgatcctggatgtggcctgtggcaccggcctggtggccgctgagctgcgggcccctggcttcctgcagctgcacggcgtggatggcagccctggcatgctggagcaggcccaggcccctggcctgtaccagaggctgagcctgtgcaccctgggccaggagcccctgcccagccctgagggcacctttgatgctgtgctgattgtgggcgccctgagtgatggccaggtgccctgcaatgccatccctgagctgcacgtgaccaagccaggcggcctggtgtgcctgaccaccaggaccaacagcagcaacctgcagtacaaggaggccctggaggccaccctggaccggctggagcaggccggcatgtgggagggcctggtggcctggcctgtggaccggctgtggacagctggctcctggctgccccccagctggcgctggtacccagccagcctgcccaggatggccagcagccctgccctgagcacctgcacagaaagtggaagaagaccccggctgaggaagtag

SEQ ID NO: 176064 - DNA, 798 bp, Artificial Sequence
  Description of Artificial Sequence: Synthetic coding sequence
atggaggccctgccccctgtgcgcagcagcctgctgggcatcctgctgcaggtgacccggctgtctgtgctgctggtgcagaacagagaccacctgtacaacttcctgctgctgaagatcaacctcttcaaccactgggtgtctggcctggcccaggaggcccggggcagctgcaactggcaggcccacctgcccctgggcgctgctgcctgccccctgggccaggccctgtgggccggcctggccctgatccaggtgcctgtgtggctggtgctgcagggcccccggctgatgtgggccggcatgtggggcagcaccaagggcctgggcctggccctgctgagcgcctgggagcagctgggcctgtctgtggccatctggacagacctcttcctgagctgcctgcacggcctgatgctggtggccctgctgctggtggtggtgacctggagggtgtgccagaagagccactgcttccggctgggccggcagctgagcaaggccctgcaggtgaactgtgtggtgaggaagctgctggtgcagctgcggcggctgtactggtgggtggagaccatgacagccctgacctcctggcacctggcctacctgatcacctggaccacctgcctggccagccacctgctgcaggccgcctttgagcacaccacccagctggccgaggcccaggaggtggagccccaggaggtgtctggcagcagcctgctgcccagcctgagcgccagcagtgacagcgagagcggcaccgtgctgcctgagcaggagaccccccgggagtag

SEQ ID NO: 176065 - DNA, 456 bp, Artificial Sequence
  Description of Artificial Sequence: Synthetic coding sequence
atgaccaatgaggagcccctgcccaagaaggtgcggctgtctgaaacagacttcaaggtgatggccagagatgagctgatcctgcgctggaagcagtatgaggcctacgtgcaggccctggagggcaagtacacagacctgaacagcaatgatgtgacaggcctgcgggagagcgaggagaagctgaagcagcagcagcaggagagcgcccggcgggagaacatcctggtgatgaggctggccaccaaggagcaggagatgcaggagtgcaccacccagatccagtacctgaagcaggtgcagcagcccagcgtggcccagctgcggagcaccatggtggaccctgccatcaacctcttcttcctgaagatgaagggggagctggagcagaccaaggacaagctggagcaggcccagaatgagctgagcgcctggaagttcaccccagacagatag

SEQ ID NO: 176066 - DNA, 1191 bp, Artificial Sequence
  Description of Artificial Sequence: Synthetic coding sequence
atgaccaatgaggagcccctgcccaagaaggtgcggctgtctgaaacagacttcaaggtgatggccagagatgagctgatcctgcgctggaagcagtatgaggcctacgtgcaggccctggagggcaagtacacagacctgaacagcaatgatgtgacaggcctgcgggagagcgaggagaagctgaagcagcagcagcaggagagcgcccggcgggagaacatcctggtgatgaggctggccaccaaggagcaggagatgcaggagtgcaccacccagatccagtacctgaagcaggtgcagcagcccagcgtggcccagctgcggagcaccatggtggaccctgccatcaacctcttcttcctgaagatgaagggggagctggagcagaccaaggacaagctggagcaggcccagaatgagctgagcgcctggaagttcaccccagacagccagacaggcaagaagctgatggccaagtgcaggatgctgatccaggagaaccaggagctgggccggcagctgagccagggccgcatcgcccagctggaggccgagctggccctgcagaagaagtacagcgaggagctgaagagcagccaggatgagctgaatgacttcatcatccagctggatgaggaggtggagggcatgcagagcaccatcctggtgctgcagcagcagctgaaggagacccggcagcagctggcccagtaccagcagcagcagagccaggccagcgcccccagcaccagcaggaccacagccagcgagcctgtggagcagagcgaggccaccagcaaggactgcagccggctgaccaacggccccagcaatggcagcagcagccggcagaggaccagcggcagcggcttccaccgggagggcaacaccacagaagatgacttccccagcagccctggaaatggaaacaagagcagcaacagcagcgaggagaggacaggccggggcggcagcggctacgtgaaccagctgtctgctggctatgagagcgtggacagccccactggaagtgagaacagcctgacccaccagagcaatgacacagacagcagccatgacccccaggaggagaaggctgtgtctggaaaaggaaacagaacagtgggcagccgccacgtgcagaatggcctggacagctctgtgaatgtgcagggctctgtgctgtag

SEQ ID NO: 176067 - DNA, 1083 bp, Artificial Sequence
  Description of Artificial Sequence: Synthetic coding sequence
atgaatgcccccctgggcggcatctggctgtggctgcccctgctgctgacctggctgaccccagaggtgaacagctcctggtggtacatgagggccactggaggcagcagccgggtgatgtgtgacaacgtgcccggcctggtgagcagccagaggcagctgtgccaccgccacccagatgtgatgagggccatcagccagggcgtggccgagtggacagctgagtgccagcaccagttccggcagcaccgctggaactgcaacaccctggaccgggaccacagcctgtttggccgggtgctgctgcggagcagccgggagagcgcctttgtgtatgccatcagcagcgctggggtggtgtttgccatcacccgggcctgcagccagggcgaggtgaagagctgcagctgtgaccccaagaagatgggcagcgccaaggacagcaagggcatctttgactggggcggctgcagcgacaacattgattatggcatcaagtttgcccgggcctttgtggatgccaaggagaggaagggcaaggatgcccgggccctgatgaacctgcacaacaacagagctggcaggaaggctgtgaagcgcttcctgaagcaggagtgcaagtgccacggcgtgtctggcagctgcaccctgcggacctgctggctggccatggctgacttcaggaagacaggagactacctgtggaggaagtacaatggagccatccaggtggtgatgaaccaggacggcaccggcttcaccgtggccaatgaacgcttcaagaagcccaccaagaatgacctggtgtactttgagaacagcccagactactgcatccgggaccgggaggccggcagcctgggcacagctggccgggtgtgcaacctgaccagccggggcatggacagctgtgaggtgatgtgctgcggccggggctatgacaccagccacgtgaccaggatgaccaagtgtggctgcaagttccactggtgctgtgctgtgcgctgccaggactgcctggaggccctggatgtgcacacctgcaaggcccccaagaatgctgactggaccacagccacctag

SEQ ID NO: 176068 - DNA, 1113 bp, Artificial Sequence
  Description of Artificial Sequence: Synthetic coding sequence
atgggcctgtgggccctgctgcccggctgggtgtctgccaccctgctgctggccctggccgccctgcctgctgccctggccgccaacagcagcggccgctggtggggcatcgtgaatgtggccagcagcaccaacctgctgacagacagcaagagcctgcagctggtgctggagcccagcctgcagctgctgagcaggaagcagaggaggctcatccggcagaaccctggcatcctgcacagcgtgtctgggggcctgcagagcgctgtgcgggagtgcaagtggcagttcaggaacagacgctggaactgccccacagcccctggcccccacctgtttgggaagatcgtgaacagaggctgccgggagacagccttcatctttgccatcaccagcgctggggtgacccacagcgtggcccggagctgcagcgagggcagcattgagagctgcacctgtgactacagaagaagaggccctgggggccctgactggcactggggcggctgcagcgacaacatcgactttggccgcctgtttggccgggagtttgtggacagcggggagaagggccgggacctgcgcttcctgatgaacctgcacaacaatgaagctggccgcaccaccgtcttcagcgagatgaggcaggagtgcaagtgccacggcatgagcggcagctgcaccgtgaggacctgctggatgaggctgcccaccctgcgggctgtgggagatgtgctgcgggacagatttgatggagccagccgggtgctgtatggcaacagaggcagcaacagagccagcagagctgagctgctgcggctggagccagaagatcctgcccacaagccacccagcccccatgacctggtgtactttgagaagagccccaacttctgcacctacagcggccgcctgggcacagctggaacagctggccgggcctgcaacagcagcagccctgccctggatggctgtgagctgctgtgctgcggccggggccacaggaccaggacccagagggtgacagagcgctgcaactgcaccttccactggtgctgccacgtgtcctgcaggaactgcacccacaccagggtgctgcacgagtgcctgtag

SEQ ID NO: 176069 - DNA, 588 bp, Artificial Sequence
  Description of Artificial Sequence: Synthetic coding sequence
tggcactggggcggctgcagcgacaacatcgactttggccgcctgtttggccgggagtttgtggacagcggggagaagggccgggacctgcgcttcctgatgaacctgcacaacaatgaagctggccgcaccaccgtcttcagcgagatgaggcaggagtgcaagtgccacggcatgagcggcagctgcaccgtgaggacctgctggatgaggctgcccaccctgcgggctgtgggagatgtgctgcgggacagatttgatggagccagccgggtgctgtatggcaacagaggcagcaacagagccagcagagctgagctgctgcggctggagccagacctggtgtactttgagaagagccccaacttctgcacctacagcggccgcctgggcacagctggaacagctggccgggcctgcaacagcagcagccctgccctggatggctgtgagctgctgtgctgcggccggggccacaggaccaggacccagagggtgacagagcgctgcaactgcaccttccactggtgctgccacgtgtcctgcaggaactgcacccacaccagggtgctgcatgaatgtctgtag

SEQ ID NO: 176070 - DNA, 1254 bp, Artificial Sequence
  Description of Artificial Sequence: Synthetic coding sequence
atgggcagcgcccacccccggccctggctgcggctgcggccccagccccagcccaggcctgccctgtgggtgctgctcttcttcctgctgctgctggccgccgccatgcccaggtctgccccaaatgacatcctggacctgcggctgcccccagagcctgtgctgaatgccaacacagtgtgcctgaccctgcccggcctgagccggcggcagatggaggtgtgtgtgcgccacccagatgtggccgccagcgccatccagggcatccagatcgccatccacgagtgccagcaccagttccgggaccagcgctggaactgcagcagcctggagaccaggaacaagatcccctatgagagccccatcttcagccggggcttccgggagagcgcctttgcctatgccatcgctgctgctggggtggtgcatgctgtgtccaatgcctgtgccctgggcaagctgaaggcctgtggctgtgatgccagcagaagaggagatgaggaggccttccggaggaagctgcaccggctgcagctggatgccctgcagaggggcaagggcctgagccacggcgtgcctgagcacccagccctgcccacagccagccctggcctgcaggacagctgggagtggggcggctgcagcccagacatgggctttggagagcgcttcagcaaggacttcctggacagccgggagccccaccgggacatccacgccaggatgaggctgcacaacaacagagtgggccggcaggccgtgatggagaacatgagaagaaaatgtaaatgtcatggcaccagcggcagctgccagctgaagacctgctggcaggtgaccccagagttcagaacagtgggcgccctgctgcggagccgcttccaccgggccaccctcatccggccccacaacagaaatggaggccagctggagcccggccctgctggggcccccagccctgcccctggggcccctggccccaggagaagagccagccctgctgacctggtgtactttgagaagagcccagacttctgtgagcgggagccccggctggacagcgctggcaccgtgggccgcctgtgcaacaagagcagcgctggcagtgatggctgcggctccatgtgctgcggccggggccacaacatcctgcggcagaccaggtctgagcgctgccactgccgcttccactggtgctgctttgtggtgtgtgaggagtgccgcatcacagagtgggtgtctgtgtgcaagtag

SEQ ID NO: 176071 - DNA, 1170 bp, Artificial Sequence
  Description of Artificial Sequence: Synthetic coding sequence
atgctggaggagccccggccccggcccccacccagcggcctggccggcctgctcttcctggccctgtgcagccgggccctgagcaatgagatcctgggcctgaagctgcctggagagccccccctgacagccaacacagtgtgcctgaccctgagcggcctgagcaagaggcagctgggcctgtgcctgaggaacccagatgtgacagccagcgccctgcagggcctgcacatcgctgtgcatgagtgccagcaccagctgcgggaccagcgctggaactgcagcgccctggagggcggcggccgcctgccccaccacagcgccatcctgaagaggggcttccgggagagcgccttctccttctccatgctggccgccggcgtgatgcatgctgtggccacagcctgcagcctgggcaagctggtgtcctgtggctgcggctggaagggcagcggggagcaggaccggctgcgggccaagctgctgcagctgcaggccctgagccggggcaagagcttcccccacagcctgcccagccctggccctggcagcagccccagccctggcccccaggacacctgggagtggggcggctgcaaccacgacatggactttggagagaagttcagccgggacttcctggacagccgggaggccccccgggacatccaggccaggatgaggatccacaacaacagagtgggccggcaggtggtgacagagaacctgaagaggaagtgcaagtgccacggcaccagcggcagctgccagttcaagacctgctggagggctgcccctgagttccgggctgtgggcgccgccctgcgggagcggctgggccgggccatcttcatcgacacccacaacagaaacagcggggccttccagccccggctgcggccccggcggctgtctggagagctggtgtactttgagaagagcccagacttctgtgagcgggaccccaccatgggcagccctggcacccggggccgggcctgcaacaagaccagccggctgctggatggctgcggcagcctgtgctgcggccggggccacaacgtgctgcggcagaccagggtggagcgctgccactgccgcttccactggtgctgctacgtgctgtgtgatgagtgcaaggtgacagagtgggtgaatgtgtgcaagtag

SEQ ID NO: 176072 - DNA, 576 bp, Artificial Sequence
  Description of Artificial Sequence: Synthetic coding sequence
atgctggaggagccccggccccggcccccacccagcggcctggccggcctgctcttcctggccctgtgcagccgggccctgagcaatgagatcctgggcctgaagctgcctggagagccccccctgacagccaacacagtgtgcctgaccctgagcggcctgagcaagaggcagctgggcctgtgcctgaggaacccagatgtgacagccagcgccctgcagggcctgcacatcgctgtgcatgagtgccagcaccagctgcgggaccagcgctggaactgcagcgccctggagggcggcggccgcctgccccaccacagcgccatcctgaagaggggcttccgggagagcgccttctccttctccatgctggccgccggcgtgatgcatgctgtggccacagcctgcagcctgggcaagctggtgtcctgtggctgcggctggaagggcagcggggagcaggaccggctgcgggccaagctgctgcagctgcaggccctgagccggggcaagctgcccggcaccagcagacatgaatgtgagagcaccaccaccggctggggcgcccgctggtag

SEQ ID NO: 176073 - DNA, 309 bp, Artificial Sequence
  Description of Artificial Sequence: Synthetic coding sequence
atgctggaggagccccggccccggcccccacccagcggcctggccggcctgctcttcctggccctgtgcagccgggccctgagcaatgagatcctgggcctgaagctgcctggagagccccccctgacagccaacacagtgtgcctgaccctgagcggcctgagcaagaggcagctgggcctgtgcctgaggaacccagatgtgacagccagcgccctgcagggcctgcacatcgctgtgcatgagtgccagcaccagctgcgggaccagcgctggaactgcagcgccctggagggcggcggccgctag

SEQ ID NO: 176074 - DNA, 354 bp, Artificial Sequence
  Description of Artificial Sequence: Synthetic coding sequence
atggccctggagaccgtgcccaaggacctgcggcacctgcgggcctgcctgctgtgcagcctggtgaagaccatcgaccagtttgaatatgatggctgtgacaactgtgatgcctacctgcagatgaagggcaaccgggagatggtgtatgactgcaccagcagcagctttgatggcatcatcgccatgatgagcccagaagattcctgggtgtccaagtggcagagggtgagcaacttcaagccaggagtgtatgctgtgtctgtgacaggccgcctgccccagggcatcgtgcgggagctgaagagcagaggagtggcctacaagagccgggacacagccatcaagacctag

SEQ ID NO: 176075 - DNA, 1059 bp, Artificial Sequence
  Description of Artificial Sequence: Synthetic coding sequence
atggcccccctgggctacttcctgctgctgtgcagcctgaagcaggccctgggcagctaccccatctggtggagcctggccgtgggcccccagtacagcagcctgggcagccagcccatcctgtgtgccagcatccctggcctggtgcccaagcagctgcgcttctgcagaaattatgtggagatcatgcccagcgtggccgagggcatcaagattggcatccaggagtgccagcaccagttccggggccgccgctggaactgcaccaccgtgcatgacagcctggccatcttcggccctgtgctggacaaggccacccgggagagcgcctttgtgcacgccatcgccagcgctggggtggcctttgctgtgaccaggagctgtgccgagggcacagctgccatctgtggctgcagcagccgccaccagggcagccctgggaagggctggaagtggggcggctgcagtgaagatattgaatttggaggcatggtgtcccgggagtttgctgatgcccgggagaacagaccagatgcccggagcgccatgaacagacacaacaatgaggccggccggcaggccatcgccagccacatgcacctgaagtgcaagtgccacggcctgagcggcagctgtgaggtgaagacctgctggtggagccagcctgacttccgggccatcggggacttcctgaaggacaagtatgattctgccagcgagatggtggtggagaagcaccgggagagccggggctgggtggagaccctgcggccccgctacacctacttcaaggtgcccacagagcgggacctggtgtactatgaggccagccccaacttctgtgagcccaaccctgagaccggcagctttggcacccgggacaggacctgcaatgtgagcagccacggcattgatggctgtgacctgctgtgctgcggccggggccacaatgcccgggcagagaggagaagagagaagtgccgctgtgtgttccactggtgctgctacgtgtcctgccaggagtgcaccagggtgtatgatgtgcacacctgcaagtag

SEQ ID NO: 176076 - DNA, 1158 bp, Artificial Sequence
  Description of Artificial Sequence: Synthetic coding sequence
atggcccccctgggctacttcctgctgctgtgcagcctgaagcaggccctgggcagctaccccatctggtggagcctggccgtgggcccccagtacagcagcctgggcagccagcccatcctgtgtgccagcatccctggcctggtgcccaagcagctgcgcttctgcagaaattatgtggagatcatgcccagcgtggccgagggcatcaagattggcatccaggagtgccagcaccagttccggggccgccgctggaactgcaccaccgtgcatgacagcctggccatcttcggccctgtgctggacaaggccacccgggagagcgcctttgtgcacgccatcgccagcgctggggtggcctttgctgtgaccaggagctgtgccgagggcacagctgccatctgtggctgcagcagccgccaccagggcagccctgggaagggctggaagtggggcggctgcagtgaagatattgaatttggaggcatggtgtcccgggagtttgctgatgcccgggagaacagaccagatgcccggagcgccatgaacagacacaacaatgaggccggccggcaggccatcgccagccacatgcacctgaagtgcaagtgccacggcctgagcggcagctgtgaggtgaagacctgctggtggagccagcctgacttccgggccatcggggacttcctgaaggacaagtatgattctgccagcgagatggtggtggagaagcaccgggagagccggggctgggtggagaccctgcggccccgctacacctacttcaaggtgcccacagagcgggacctggtgtactatgaggccagccccaacttctgtgagcccaaccctgagaccggcagctttggcacccgggacaggacctgcaatgtgagcagccacggcattgatggctgtgacctgctgtgctgcggccggggccacaatgcccgggcagagaggagaagagagaagtgccgctgtgtgttccactggtgctgctacgtgtcctgccaggagtgcaccagggtgtatgatgtgcacacctgcaagaaccctggcagccgggccggcaacagcgcccaccagcccccccacccccagccccctgtgcgcttccacccccccctgcggcgggccggcaaggtgccctag

SEQ ID NO: 176077 - DNA, 1056 bp, Artificial Sequence
  Description of Artificial Sequence: Synthetic coding sequence
atgagccccaggagctgcctgcggagcctgcggctgctggtgtttgctgtgttttctgctgctgccagcaactggctgtacctggccaagctgagctctgtgggcagcatcagcgaggaggagacctgtgagaagctgaagggcctcatccagaggcaggtgcagatgtgcaagaggaacctggaggtgatggacagcgtgcggcggggggcccagctggccatcgaggagtgccagtaccagttcaggaacagacgctggaactgcagcaccctggacagcctgcctgtgtttgggaaggtggtgacccagggcacccgggaggccgcctttgtgtatgccatcagcagcgctggggtggcctttgctgtgacccgggcctgcagcagcggggagctggagaagtgtggctgtgacagaacagtgcatggagtgagcccccagggcttccagtggagcggctgcagcgacaacatcgcctatggagtggccttcagccagagctttgtggatgtgcgggagaggagcaaaggagccagcagcagccgggccctgatgaacctgcacaacaatgaagctggcaggaaggccatcctgacccacatgagggtggagtgcaagtgccacggcgtgtctggcagctgtgaggtgaagacctgctggagggctgtgccccccttccggcaggtgggccacgccctgaaggagaagtttgatggagccacagaggtggagcccaggagagtgggcagcagccgggccctggtgcccagaaatgcccagttcaagccccacacagatgaggacctggtgtacctggagcccagcccagacttctgtgagcaggacatgagaagtggagtgctgggcacccggggccgcacctgcaacaagaccagcaaggccattgatggctgtgagctgctgtgctgcggccggggcttccacacagcccaggtggagctggccgagcgctgcagctgcaagttccactggtgctgctttgtgaagtgccggcagtgccagaggctggtggagctgcacacctgcaggtag

SEQ ID NO: 176078 - DNA, 528 bp, Artificial Sequence
  Description of Artificial Sequence: Synthetic coding sequence
atgagccccaggagctgcctgcggagcctgcggctgctggtgtttgctgtgttttctgctgctgccagcaactggctgtacctggccaagctgagctctgtgggcagcatcagcgaggaggagacctgtgagaagctgaagggcctcatccagaggcaggtgcagatgtgcaagaggaacctggaggtgatggacagcgtgcggcggggggcccagctggccatcgaggagtgccagtaccagttcaggaacagacgctggaactgcagcaccctggacagcctgcctgtgtttgggaaggtggtgacccagggcggcaaggcctggcacggcggggacagcggctgccacctgctgacagagagccgcagcggggagaggacccagaggaggaaggagggcggcagcctgggccagtgctggccagaggccatcgtgggcacccaggaccccatgaggagccccccctacctgtggggcaggaaccagggcggcacccacacaggcagcgccagcgagggccactag

SEQ ID NO: 176079 - DNA, 453 bp, Artificial Sequence
  Description of Artificial Sequence: Synthetic coding sequence
tgatacctggccaagctgagctctgtgggcagcatcagcgaggaggagacctgtgagaagctgaagggcctcatccagaggcaggtgcagatgtgcaagaggaacctggaggtgatggattctgtgagaagaggagcccagctggccatcgaggagtgccagtaccagttcaggaacagacgctggaactgcagcaccctggacagcctgcctgtgtttgggaaggtggtgacccagggcggcaaggcctggcatggaggagacagcggctgccacctgctgacagagagccgctctggagagaggacccagaggaggaaggagggcggcagcctgggccagtgctggccagaggccatcgtgggcacccaggaccccatgaggagccccccctacctgtggggcaggaaccagggcggcacccacactggaagtgccagcgagggccactag

SEQ ID NO: 176080 - DNA, 159 bp, Artificial Sequence
  Description of Artificial Sequence: Synthetic coding sequence
atgtgcaagaggaacctggaggtgatggattctgtgagaagaggagcccagctggccatcgaggagtgccagtaccagttcaggaacagacgctggaactgcagcaccctggacagcctgcctgtgtttgggaaggtggtgacccagggcggcaagtag

SEQ ID NO: 176081 - DNA, 891 bp, Artificial Sequence
  Description of Artificial Sequence: Synthetic coding sequence
atgtgcaagaggaacctggaggtgatggattctgtgagaagaggagcccagctggccatcgaggagtgccagtaccagttcaggaacagacgctggaactgcagcaccctggacagcctgcctgtgtttgggaaggtggtgacccagggcacccgggaggccgcctttgtgtatgccatcagcagcgctggggtggcctttgctgtgacccgggcctgcagcagtggagagctggagaagtgtggctgtgacagaacagtgcacggcgtgagcccccagggcttccagtggagcggctgcagcgacaacatcgcctacggcgtggccttcagccagagctttgtggatgtgcgggagaggagcaagggggccagcagcagccgggccctgatgaacctgcacaacaatgaggccggcaggaaggccatcctgacccacatgagggtggagtgcaagtgccacggcgtgtctggcagctgtgaggtgaagacctgctggagggctgtgccccccttccggcaggtgggccacgccctgaaggagaagtttgatggagccacagaggtggagccccggcgggtgggcagcagccgggccctggtgcccagaaatgcccagttcaagccccacacagatgaggacctggtgtacctggagcccagcccagacttctgtgagcaggacatgaggtctggagtgctgggcacccggggccgcacctgcaacaagaccagcaaggccattgatggctgtgagctgctgtgctgcggccggggcttccacacagcccaggtggagctggccgagcgctgcagctgcaagttccactggtgctgctttgtgaagtgccggcagtgccagaggctggtggagctgcacacctgcaggtag

SEQ ID NO: 176082 - DNA, 1710 bp, Artificial Sequence
  Description of Artificial Sequence: Synthetic coding sequence
atgaaggtgctgctgcggctcatctgcttcatcgccctgctgatcagcagcctggaggccgacaagtgcaaggagcgggaggagaagatcatcctggtgtcctctgccaatgaaattgatgtgcggccctgccccctgaaccccaatgagcacaagggcaccatcacctggtacaaggatgacagcaagacccctgtgtccacagagcaggccagccgcatccaccagcacaaggagaagctgtggtttgtgcctgccaaggtggaggacagcggccactactactgtgtggtgaggaacagcagctactgcctgcgcatcaagatcagcgccaagtttgtggagaatgagcccaacctgtgctacaatgcccaggccatcttcaagcagaagctgcctgtggccggagatggcggcctggtgtgcccctacatggagttcttcaagaatgaaaataatgagctgcccaagctgcagtggtacaaggactgcaagcccctgctgctggacaacatccacttctctggagtgaaggacaggctcatcgtgatgaatgtggccgagaagcaccggggcaactacacctgccacgccagctacacctacctgggcaagcagtaccccatcaccagggtgattgagttcatcaccctggaggagaacaagcccaccaggcctgtgattgtgtccccagccaatgagaccatggaggtggacctgggcagccagatccagctgatctgcaatgtgacaggccagctgagtgacatcgcctactggaagtggaatggatctgtgattgatgaagatgatcctgtgctgggggaggactactacagcgtggagaacccagccaacaagaggaggagcaccctcatcaccgtgctgaacatcagcgagattgagagccgcttctacaagcaccccttcacctgctttgccaagaacacccacggcattgatgctgcctacatccagctgatctaccctgtgaccaacttccagaagcacatgattggcatctgtgtgaccctgaccgtcatcatcgtgtgcagcgtcttcatctacaagatcttcaagattgatattgtgctgtggtacagagacagctgctatgacttcctgcccatcaaggccagtgatggcaagacctatgatgcctacatcctgtaccccaagacagtgggggagggcagcaccagtgactgtgacatctttgtgttcaaggtgctgcctgaggtgctggagaagcagtgtggctacaagctgttcatctacggcagagatgattatgtgggggaggacatcgtggaggtgatcaatgaaaatgtgaagaagagccggcggctcatcatcatcctggtgcgggagaccagcggcttctcctggctgggcggcagcagcgaggagcagatcgccatgtacaatgccctggtgcaggacggcatcaaggtggtgctgctggagctggagaagatccaggactatgagaagatgcctgagagcatcaagttcatcaagcagaagcacggggccatccgctggagcggggacttcacccagggcccccagagcgccaagacccgcttctggaagaatgtgcgctaccacatgcctgtgcagaggaggagccccagcagcaagcaccagctgctgagccctgccaccaaggagaagctgcagcgggaggcccacgtgcccctgggctag

SEQ ID NO: 176083 - DNA, 1050 bp, Artificial Sequence
  Description of Artificial Sequence: Synthetic coding sequence
atgaacaggaaggcccggcgctgcctgggccacctgttcctgagcctgggcatggtgtacctgagaattggaggcttcagctctgtggtggccctgggcgccagcatcatctgcaacaagatccctggcctggccccccggcagagggccatctgccagagcaggccagatgccatcatcgtcatcggggagggcagccagatgggcctggatgagtgccagttccagttcagaaatggccgctggaactgcagcgccctgggggagaggacagtgtttgggaaggagctgaaggtgggcagccgggaggccgccttcacctacgccatcatcgctgctggggtggcccacgccatcacagctgcctgcacccagggcaacctgagtgactgtggctgtgacaaggagaagcagggccagtaccacagagatgagggctggaagtggggcggctgcagcgctgacatccgctatggcatcggctttgccaaggtgtttgtggatgcccgggagatcaagcagaatgcccggaccctgatgaacctgcacaacaatgaagctggcaggaagatcctggaggagaacatgaagctggagtgcaagtgccacggcgtgtctggcagctgcaccaccaagacctgctggaccaccctgccccagttccgggagctgggctacgtgctgaaggacaagtacaatgaagctgtgcacgtggagcctgtgcgggccagcaggaacaagaggcccaccttcctgaagatcaagaagcccctgagctacaggaagcccatggacacagacctggtgtacatcgagaagagccccaactactgtgaggaggaccctgtgacaggctctgtgggcacccagggccgggcctgcaacaagacagccccccaggccagcggctgtgacctgatgtgctgcggccggggctacaacacccaccagtatgcccgggtgtggcagtgcaactgcaagttccactggtgctgctacgtgaagtgcaacacctgcagcgagaggacagagatgtacacctgcaagtag

SEQ ID NO: 176084 - DNA, 1050 bp, Artificial Sequence
  Description of Artificial Sequence: Synthetic coding sequence
atgcacaggaacttcaggaagtggatcttctacgtgttcctgtgcttcggcgtgctgtatgtgaagctgggcgccctgagctctgtggtggccctgggcgccaacatcatctgcaacaagatccctggcctggccccccggcagagggccatctgccagagcaggccagatgccatcatcgtcatcggggagggcgcccagatgggcatcaatgaatgccagtaccagttccgcttcggccgctggaactgcagcgccctgggggagaagacagtgtttggccaggagctgcgggtgggcagccgggaggccgccttcacctacgccatcacagctgctggggtggcccatgctgtgacagctgcctgcagccagggcaacctgagcaactgtggctgtgaccgggagaagcagggctactacaaccaggccgagggctggaagtggggcggctgcagcgcagatgtgcgctatggcatcgacttcagccgccgctttgtggatgcccgggagatcaagaagaatgcccggcggctgatgaacctgcacaacaatgaagctggcaggaaggtgctggaggacaggatgcagctggagtgcaagtgccacggcgtgtctggcagctgcaccaccaagacctgctggaccaccctgcccaagttccgggaggtgggccacctgctgaaggagaagtacaatgctgctgtgcaggtggaggtggtgcgggccagccggctgcggcagcccaccttcctgcgcatcaagcagctgcggagctaccagaagcccatggagacagacctggtgtacatcgagaagagccccaactactgtgaggaggatgctgccaccggctctgtgggcacccagggccgcctgtgcaacagaaccagccctggagcagatggctgtgacaccatgtgctgcggccggggctacaacacccaccagtacaccaaggtgtggcagtgcaactgcaagttccactggtgctgctttgtgaagtgcaacacctgcagcgagaggacagaggtgttcacctgcaagtag

SEQ ID NO: 176085 - DNA, 1062 bp, Artificial Sequence
  Description of Artificial Sequence: Synthetic coding sequence
atgctgctgctgagccccaggtctgccctggtgtctgtgtactgcccccagatcttcctgctgctgagcagcggcagctacctggccctgagctctgtggtggccctgggcgccaacatcatctgcaacaagatccctggcctggccccccggcagagggccatctgccagagcaggccagatgccatcatcgtcatcggggagggcgcccagatgggcatcaatgaatgccagtaccagttccgcttcggccgctggaactgcagcgccctgggggagaagacagtgtttggccaggagctgcgggtgggcagccgggaggccgccttcacctacgccatcacagctgctggggtggcccatgctgtgacagctgcctgcagccagggcaacctgagcaactgtggctgtgaccgggagaagcagggctactacaaccaggccgagggctggaagtggggcggctgcagcgcagatgtgcgctatggcatcgacttcagccgccgctttgtggatgcccgggagatcaagaagaatgcccggcggctgatgaacctgcacaacaatgaagctggcaggaaggtgctggaggacaggatgcagctggagtgcaagtgccacggcgtgtctggcagctgcaccaccaagacctgctggaccaccctgcccaagttccgggaggtgggccacctgctgaaggagaagtacaatgctgctgtgcaggtggaggtggtgcgggccagccggctgcggcagcccaccttcctgcgcatcaagcagctgcggagctaccagaagcccatggagacagacctggtgtacatcgagaagagccccaactactgtgaggaggatgctgccaccggctctgtgggcacccagggccgcctgtgcaacagaaccagccctggagcagatggctgtgacaccatgtgctgcggccggggctacaacacccaccagtacaccaaggtgtggcagtgcaactgcaagttccactggtgctgctttgtgaagtgcaacacctgcagcgagaggacagaggtgttcacctgcaagtag

SEQ ID NO: 176086 - DNA, 618 bp, Artificial Sequence
  Description of Artificial Sequence: Synthetic coding sequence
atgcacaggaacttcaggaagtggatcttctacgtgttcctgtgcttcggcgtgctgtatgtgaagctgggcgccctgagctctgtggtggccctgggcgccaacatcatctgcaacaagatccctggcctggccccccggcagagggccatctgccagagcaggccagatgccatcatcgtcatcggggagggcgcccagatgggcatcaatgaatgccagtaccagttccgcttcggccgctggaactgcagcgccctgggggagaagacagtgtttggccaggagctgcgggtgggcagccgggaggccgccttcacctacgccatcacagctgctggggtggcccatgctgtgacagctgcctgcagccagggcaacctgagcaactgtggctgtgaccgggagaagcagggctactacaaccaggccgagggctggaagtggggcggctgcagcgcagatgtgcgctatggcatcgacttcagccgccgctttgtggatgcccgggagatcaagaagaatgcccggcggctgatgaacctgcacaacaatgaagctggcaggaagggcctgctgggccagccccgggtgaccagcagccccctcttcccctag

SEQ ID NO: 176087 - DNA, 1002 bp, Artificial Sequence
  Description of Artificial Sequence: Synthetic coding sequence
atgtctgccccacccttctaccgggccctgagctctgtggtggccctgggcgccaacatcatctgcaacaagatccctggcctggccccccggcagagggccatctgccagagcaggccagatgccatcatcgtcatcggggagggcgcccagatgggcatcaatgaatgccagtaccagttccgcttcggccgctggaactgcagcgccctgggggagaagacagtgtttggccaggagctgcgggtgggcagccgggaggccgccttcacctacgccatcacagctgctggggtggcccatgctgtgacagctgcctgcagccagggcaacctgagcaactgtggctgtgaccgggagaagcagggctactacaaccaggccgagggctggaagtggggcggctgcagcgcagatgtgcgctatggcatcgacttcagccgccgctttgtggatgcccgggagatcaagaagaatgcccggcggctgatgaacctgcacaacaatgaagctggcaggaaggtgctggaggacaggatgcagctggagtgcaagtgccacggcgtgtctggcagctgcaccaccaagacctgctggaccaccctgcccaagttccgggaggtgggccacctgctgaaggagaagtacaatgctgctgtgcaggtggaggtggtgcgggccagccggctgcggcagcccaccttcctgcgcatcaagcagctgcggagctaccagaagcccatggagacagacctggtgtacatcgagaagagccccaactactgtgaggaggatgctgccaccggctctgtgggcacccagggccgcctgtgcaacagaaccagccctggagcagatggctgtgacaccatgtgctgcggccggggctacaacacccaccagtacaccaaggtgtggcagtgcaactgcaagttccactggtgctgctttgtgaagtgcaacacctgcagcgagaggacagaggtgttcacctgcaagtag

SEQ ID NO: 176088 - DNA, 174 bp, Artificial Sequence
  Description of Artificial Sequence: Synthetic coding sequence
atgggcatcaatgaatgccagtaccagttccgcttcggccgctggaactgcagcgccctgggggagaagacagtgtttggccaggagctgcgggtgggcagccgggaggccgccttcacctacgccatcacagctgctggggtggcccatgctgtgacagctgcctgcagctag

SEQ ID NO: 176089 - DNA, 1056 bp, Artificial Sequence
  Description of Artificial Sequence: Synthetic coding sequence
atgttcctgagcaagcccagcgtgtacatctgcctcttcacctgtgtgctgcagctgagccacagctggagcgtgaacaacttcctgatgacaggccccaaggcctacctgatctacagcagctctgtggccgccggggcccagagcggcatcgaggagtgcaagtaccagtttgcctgggaccgctggaactgcccagagcgggccctgcagctgagcagccatggaggcctgcggagcgccaaccgggagacagcctttgtgcacgccatcagcagcgctggggtgatgtacaccctgaccaggaactgcagcctgggggactttgacaactgtggctgtgatgacagcagaaatggccagctgggcggccagggctggctgtggggcggctgcagcgacaacgtgggctttggagaggccatcagcaagcagtttgtggatgccctggagaccggccaggatgcccgggccgccatgaacctgcacaacaatgaagctggcaggaaggctgtgaagggcaccatgaagaggacctgcaagtgccacggcgtgtctggcagctgcaccacccagacctgctggctgcagctgcctgagttccgggaggtgggcgcccacctgaaggagaagtaccacgccgccctgaaggtggacctgctgcagggcgccggcaacagcgctgctggccgcggggccatcgctgacaccttccgcagcatcagcacccgggagctggtgcacctggaggacagcccagactactgcctggagaacaagaccctgggcctgctgggcacagagggcagagaatgtctgcggcggggccgggccctgggccgctgggagcggcgcagctgccggcggctgtgtggggactgtggcctggccgtggaggagaggagagctgagaccgtgagcagctgcaactgcaagttccactggtgctgtgctgtgcgctgtgagcagtgcagaagaagagtgaccaagtacttctgcagcagagctgagcggccccggggcggggccgcccacaagccaggcaggaagccctag

SEQ ID NO: 176090 - DNA, 1209 bp, Artificial Sequence
  Description of Artificial Sequence: Synthetic coding sequence
atggacctggaccgggccagcctggacctgatgatccggctgctggagctggagcaggatgccagcagcgccaagctgctgaatgagaaggacatgaacaagatcaaggagaagatccggcggctgtgtgaaacagtgcacaacaagcacctggacctggagaacatcaccaccggccacctggccatggagaccctgctgagcctgaccagcaagagagctggggactggttcaaggaggagctgcggctgctgggcggcctggaccacatcgtggacaaggtgaaggaatgtgtggaccacctgagcagagatgaagatgaggagaagctggtggccagcctgtggggcgctgagcgctgcctgcgggtgctggagagcgtgacagtgcacaaccctgagaaccagagctacctgattgcctacaaggacagccagctgattgtgtcctctgccaaggccctgcagcactgtgaggagctgatccagcagtacaacagagcagaagattccatctgcctggccgacagcaagcccctgccccaccagaatgtgaccaaccacgtgggcaaggctgtggaggactgcatgagggccatcattggagtgctgctgaacctgaccaatgacaatgagtggggcagcaccaagacaggagagcaggacggcctgattggaacagccctgaactgtgtgctgcaggtgcccaagtacctgccccaggagcagagatttgacatccgggtgctgctcttcctggagcgggagcgggccgcccagctggccgagagcaagacagatgagctgatcaaggatgcccccaccacccagcacgacaagtctggagagtggcaggagaccagcggggagatccagtgggtgtccacagagaagacagatggaacagaggagaagcacaagaaggaggaggaggatgaggagctggacctgaacaaggccctgcagcacgccggcaagcacatggaggactgcatcgtggccagctacacagccctgctgctgggctgcctgtgccaggagagccccatcaacgtgaccaccgtgcgggagtacctgcctgagggggacttcagcatcatgacagagatgctgaagaagttcctgtccttcatgaacctgacctgtgctgtgggcaccaccggccagaagagcatcagcagggtcatcgagtacctggagcactgctag

SEQ ID NO: 176091 - DNA, 3573 bp, Artificial Sequence
  Description of Artificial Sequence: Synthetic coding sequence
atgaccagcagatttgggaagacctacagcaggaagggcggcaatggcagcagcaagtttgatgaggtgttcagcaacaagaggaccaccctgagcaccaagtggggcgagaccaccttcatggccaagctgggccagaagaggcccaacttcaagccagacatccaggagatccccaagaagcccaaggtggaggaggagagcactggagacccctttggatttgacagtgatgatgagagcctgcctgtgagcagcaagaacctggcccaggtgaagtgcagcagctacagcgagagcagcgaggccgcccagctggaggaggtgacctctgtgctggaggccaacagcaagatcagccacgtggtggtggaggacacagtggtgtctgacaagtgcttccccctggaggacaccctgctgggcaaggagaagagcaccaaccgcatcgtggaggatgatgccagcatcagcagctgcaacaagctgatcaccagtgacaaggtggagaacttccacgaggagcacgagaagaacagccaccacatccacaagaatgctgatgacagcaccaagaagcccaatgctgagaccaccgtggccagcgagatcaaggagaccaatgacacctggaacagccagtttgggaagaggcctgagagccccagcgagatcagccccatcaagggctctgtgaggacaggcctgtttgagtgggacaatgactttgaggacatccgctctgaggactgcatcctgagcctggacagcgaccccctgctggagatgaaggatgatgacttcaagaaccggctggagaacctgaatgaggccattgaagaagatattgtgcagagcgtgctgcggcccaccaactgcaggacctactgccgggccaacaagaccaagagcagccagggcgccagcaactttgacaagctgatggatggcaccagccaggccctggccaaggccaacagcgagagcagcaaggatggcctgaaccaggccaagaagggcggcgtgtcctgtggcaccagcttccggggcaccgtgggccgcacccgggactacacagtgctgcaccccagctgcctgtctgtgtgcaatgtgaccatccaggacaccatggagaggtccatggatgagttcaccgccagcaccccagctgacctgggggaggccggccgcctgaggaagaaggctgacatcgccaccagcaagaccaccacccgcttccggcccagcaacaccaagagcaagaaggatgtgaagctggagttctttggatttgaggaccacgagactggaggagatgaaggaggcagcggcagcagcaactacaagatcaagtactttggatttgatgacctgtctgagagtgaagatgatgaagatgatgactgccaggtggagaggaagaccagcaagaagaggaccaagacagcccccagccccagcctgcagcccccacctgagagcaatgacaacagccaggacagccagagcggcaccaacaatgctgagaacctggacttcacagaggacctgcccggggtgcctgagagcgtgaagaagcccatcaacaagcagggcgacaagagcaaagaaaacaccaggaagatcttcagcggccccaagaggagccccaccaaggctgtgtacaatgcccggcactggaaccacccagattctgaggagctgcccggcccccctgtggtgaagccccagagcgtgacagtgcggctgagcagcaaggagcccaaccagaaggatgatggagtcttcaaggccccagccccacccagcaaggtgatcaagacagtgaccatccccacccagccctaccaggacatcgtgacagccctgaagtgccggcgggaggacaaggagctgtacacagtggtgcagcacgtgaagcacttcaatgatgtggtggagtttggagagaaccaggagttcacagatgacatcgagtacctgctgagcggcctgaagagcacccagcccctgaacacccgctgcctgagcgtcatcagcctggccaccaagtgtgccatgcccagcttcaggatgcacctgcgggcccacggcatggtggccatggtgttcaagaccctggatgacagccagcaccaccagaacctgagcctgtgcacagctgccctgatgtacatcctgagccgggaccggctgaacatggacctggaccgggccagcctggacctgatgatccggctgctggagctggagcaggatgccagcagcgccaagctgctgaatgagaaggacatgaacaagatcaaggagaagatccggcggctgtgtgagaccgtgcacaacaagcacctggacctggagaacatcaccaccggccacctggccatggagaccctgctgagcctgaccagcaagagagctggggactggttcaaggaggagctgcggctgctgggcggcctggaccacatcgtggacaaggtgaaggaatgtgtggaccacctgagcagagatgaagatgaggagaagctggtggccagcctgtggggcgctgagcgctgcctgcgggtgctggagagcgtgacagtgcacaaccctgagaaccagagctacctgattgcctacaaggacagccagctgattgtgagcagcgccaaggccctgcagcactgtgaggagctgatccagcagtacaacagagctgaggacagcatctgcctggccgacagcaagcccctgccccaccagaatgtgaccaaccacgtgggcaaggctgtggaggactgcatgagggccatcatcggcgtgctgctgaacctgaccaatgacaatgagtggggcagcaccaagacaggagagcaggacggcctcatcggcacagccctgaactgtgtgctgcaggtgcccaagtacctgccccaggagcagagatttgacatccgggtgctgggcctgggcctgctgatcaacctggtggagtacagcgccaggaacagacactgcctggtgaacatggagaccagctgcagctttgacagcagcatctgcagcggggagggagatgacagcctgcgcatcggcggccaggtgcatgctgtgcaggccctggtgcagctgttcctggagcgggagcgggccgcccagctggccgagagcaagacagatgagctgatcaaggatgcccccaccacccagcacgacaagtctggagagtggcaggagaccagcggggagatccagtgggtgtccacagagaagacagatggaacagaggagaagcacaagaaggaggaggaggatgaggagctggacctgaacaaggccctgcagcacgccggcaagcacatggaggactgcatcgtggccagctacacagccctgctgctgggctgcctgtgccaggagagccccatcaacgtgaccaccgtgcgggagtacctgcctgagggggacttcagcatcatgacagagatgctgaagaagttcctgtccttcatgaacctgacctgtgctgtgggcaccaccggccagaagagcatcagcagggtcatcgagtacctggagcactgctag

SEQ ID NO: 176092 - DNA, 3828 bp, Artificial Sequence
  Description of Artificial Sequence: Synthetic coding sequence
atggtgcagggccctgtgcagaccccagccctgaccatccacaggaggaagagaagaagaagctgcccccccaacagagccagctacctgcccaaggccgagagcctggccagcctgggcagccacctgcctgccctgctgagccgggcccgggtgcccaggcctcctgctggaagaagagagcgggagaggagaagaagacctgtggccaaggccccagcccggctgcggggggagtatgagaccggggtgaagatgaccagcagatttgggaagacctacagcaggaaaggaggaaatggcagcagcaagtttgatgaggtgttcagcaacaagaggaccaccctgagcaccaagtggggcgagaccaccttcatggccaagctgggccagaagaggcccaacttcaagccagacatccaggagatccccaagaagcccaaggtggaggaggagagcactggagaccccttcggctttgacagtgatgatgagagcctgcctgtgagcagcaagaacctggcccaggtgaagtgcagcagctacagcgagagcagcgaggccgcccagctggaggaggtgacctctgtgctggaggccaacagcaagatcagccacgtggtggtggaggacacagtggtgtctgacaagtgcttccccctggaggacaccctgctgggcaaggagaagagcaccaacagaattgtggaggatgatgccagcatcagcagctgcaacaagctgatcaccagtgacaaggtggagaacttccacgaggagcacgagaagaacagccaccacatccacaagaatgctgatgacagcaccaagaagcccaatgctgagaccaccgtggccagcgagatcaaggagaccaatgacacctggaacagccagtttgggaagaggcctgagagccccagcgagatcagccccatcaagggctctgtgaggacaggcctgtttgagtgggacaatgactttgaggacatccgctctgaggactgcatcctgagcctggacagcgaccccctgctggagatgaaggatgatgacttcaagaaccggctggagaacctgaatgaggccatcgaggaggacatcgtgcagagcgtgctgcggcccaccaactgcaggacctactgccgggccaacaagaccaagagcagccagggcgccagcaactttgacaagctgatggatggcaccagccaggccctggccaaggccaacagcgagagcagcaaggatggcctgaaccaggccaagaagggcggcgtgtcctgtggcaccagcttccggggcaccgtgggccgcacccgggactacacagtgctgcaccccagctgcctgtctgtgtgcaatgtgaccatccaggacaccatggagaggtccatggatgagttcaccgccagcaccccagctgacctgggggaggccggccgcctgaggaagaaggctgacatcgccaccagcaagaccaccacccgcttccggcccagcaacaccaagagcaagaaggatgtgaagctggagttcttcggctttgaagatcatgaaacaggaggagatgagggcggcagcggcagcagcaactacaagatcaagtacttcggctttgatgacctgtctgagagtgaagatgatgaagatgatgactgccaggtggagaggaagaccagcaagaagaggaccaagacagcccccagccccagcctgcagcccccacctgagagcaatgacaacagccaggacagccagagcggcaccaacaatgctgagaacctggacttcacagaggacctgcccggggtgcctgagagcgtgaagaagcccatcaacaagcagggcgacaagagcaaggagaacaccaggaagatcttcagcggccccaagaggagccccaccaaggctgtgtacaatgcccggcactggaaccacccagacagcgaggagctgcccggcccccctgtggtgaagccccagagcgtgacagtgcggctgagcagcaaggagcccaaccagaaggatgatggagtcttcaaggccccagccccacccagcaaggtgatcaagacagtgaccatccccacccagccctaccaggacatcgtgacagccctgaagtgcagaagagaggacaaggagctgtacacagtggtgcagcacgtgaagcacttcaatgatgtggtggagtttggagagaaccaggagttcacagatgacatcgagtacctgctgagcggcctgaagagcacccagcccctgaacacccgctgcctgagcgtcatcagcctggccaccaagtgtgccatgcccagcttcaggatgcacctgcgggcccacggcatggtggccatggtgttcaagaccctggatgacagccagcaccaccagaacctgagcctgtgcacagctgccctgatgtacatcctgagccgggaccggctgaacatggacctggaccgggccagcctggacctgatgatccggctgctggagctggagcaggatgccagcagcgccaagctgctgaatgagaaggacatgaacaagatcaaggagaagatccggcggctgtgtgaaacagtgcacaacaagcacctggacctggagaacatcaccaccggccacctggccatggagaccctgctgagcctgaccagcaagagagctggggactggttcaaggaggagctgcggctgctgggcggcctggaccacatcgtggacaaggtgaaggaatgtgtggaccacctgagcagagatgaagatgaggagaagctggtggccagcctgtggggcgctgagcgctgcctgcgggtgctggagagcgtgacagtgcacaaccctgagaaccagagctacctgattgcctacaaggacagccagctgattgtgtcctctgccaaggccctgcagcactgtgaggagctgatccagcagtacaacagagcagaagattccatctgcctggccgacagcaagcccctgccccaccagaatgtgaccaaccacgtgggcaaggctgtggaggactgcatgagggccatcattggagtgctgctgaacctgaccaatgacaatgagtggggcagcaccaagacaggagagcaggacggcctgattggaacagccctgaactgtgtgctgcaggtgcccaagtacctgccccaggagcagagatttgacatccgggtgctgggcctgggcctgctgatcaacctggtggagtacagcgccaggaacagacactgcctggtgaacatggagaccagctgcagctttgacagcagcatctgcagcggggagggagatgacagcctgagaattggaggccaggtgcatgctgtgcaggccctggtgcagctgttcctggagcgggagagagctgcccagctggccgagagcaagacagatgagctgatcaaggatgcccccaccacccagcacgacaagagcggggagtggcaggagaccagcggggagatccagtgggtgtccacagagaagacagatggaacagaggagaagcacaagaaggaggaggaggatgaggagctggacctgaacaaggccctgcagcacgccggcaagcacatggaggactgcatcgtggccagctacacagccctgctgctgggctgcctgtgccaggagagccccatcaacgtgaccaccgtgcgggagtacctgcctgagggggacttcagcatcatgacagagatgctgaagaagttcctgtccttcatgaacctgacctgtgctgtgggcaccaccggccagaagagcatcagccgggtgattgagtacctggagcactgctag

SEQ ID NO: 176093 - DNA, 1209 bp, Artificial Sequence; identical to SEQ ID NO: 176090
  Description of Artificial Sequence: Synthetic coding sequence

SEQ ID NO: 176094 - DNA, 3828 bp, Artificial Sequence; identical to SEQ ID NO: 176092
  Description of Artificial Sequence: Synthetic coding sequence

SEQ ID NO: 176095 - DNA, 1509 bp, Artificial Sequence
  Description of Artificial Sequence: Synthetic coding sequence
atgtctgggggccccatgggcggccggcctgggggccgcggggccccagctgtgcagcagaacatccccagcaccctgctgcaggaccacgagaaccagaggctgtttgagatgctgggcaggaagtgcctgaccctggccacagctgtggtgcagctgtacctggccctgcccccaggagctgagcactggaccaaggagcactgtggggctgtgtgctttgtgaaggacaacccccagaagagctacttcatccggctgtatggcctgcaggccggccgcctgctgtgggagcaggagctgtacagccagctggtgtacagcacccccacccccttcttccacacctttgctggagatgactgccaggccggcctgaactttgctgatgaagatgaggcccaggccttccgggccctggtgcaggagaagatccagaagaggaaccagaggcagagcggggaccggcggcagctgcccccaccacccaccccagccaatgaggagcggcggggcggcctgccccccctgcccctgcaccctggaggagaccagggcggcccccctgtgggccccctgagcctgggcctggccaccgtggacatccagaacccagacatcaccagcagccgctaccggggcctgcctgcccctggccccagccctgctgacaagaagaggtctgggaagaagaagatcagcaaggctgacatcggggcccccagcggcttcaagcacgtgagccacgtgggctgggacccccagaatggatttgatgtgaacaacctggaccctgacctgcggagcctcttcagccgggccggcatcagcgaggcccagctgacagatgctgagaccagcaagctgatctatgacttcatcgaggaccagggcggcctggaggccgtgcggcaggagatgaggcggcaggagcccctgcccccacctcctccacccagccggggcggcaaccagctgcccaggcctcccatcgtgggcggcaacaagggccgcagcggccccctgccccctgtgcccctgggcatcgcccctcctccacccaccccccggggccccccacctcctggccggggcggccccccacctcctcctcctccagccaccggccgcagcggccccctgcccccacctcctcctggggccggcggcccccccatgcctcctcctcctcctcctcctcctcctccacccagcagtggaaatggacctgcccccccacccctgcccccagccctggtgcctgctgggggcctggcccctgggggcggccgcggggccctgctggaccagatccggcagggcatccagctgaacaagacccctggggcccctgagagcagcgccctgcagcccccaccccagagcagcgagggcctggtgggcgccctgatgcacgtgatgcagaagaggagccgggccatccacagcagtgatgaaggagaggaccaggccggagatgaagatgaagatgatgagtgggatgactag

SEQ ID NO: 176096 - DNA, 654 bp, Artificial Sequence
  Description of Artificial Sequence: Synthetic coding sequence
atgtctgggggccccatgggcggccggcctgggggccgcggggccccagctgtgcagcagaacatccccagcaccctgctgcaggaccacgagaaccagaggctgtttgagatgctgggcaggaagtgcctgaccctggccacagctgtggtgcagctgtacctggccctgcccccaggagctgagcactggaccaaggagcactgtggggctgtgtgctttgtgaaggacaacccccagaagagctacttcatccggctgtatggcctgcaggccggccgcctgctgtgggagcaggagctgtacagccagctggtgtacagcacccccacccccttcttccacacctttgctggagatgactgccaggccggcctgaactttgctgatgaagatgaggcccaggccttccgggccctggtgcaggagaagatccagaagaggaaccagaggcagagcggggaccggcggcagctgcccccaccacccaccccagccaatgaggagcggcggggcggcctgccccccctgcccctgcaccctggaggagaccagggcggcccccctgtgggccccctgagcctgggcctggccaccgtggacatccagaacccagacatcaccagcagccgctaccggggcctgcctgcctag

SEQ ID NO: 176097 - DNA, 4668 bp, Artificial Sequence
  Description of Artificial Sequence: Synthetic coding sequence
atggccaaggccatcaaggacagagtgtccctcatcaagaggaagcgggagcagaggcagctggtgcgggaggagcaggagaagaagaagcaggaggagagcagcctgaagcagcaggtggagcagagcagcgccagccagacaggcatcaagcagctgcccagcgccagcacaggcatccccacagccagcaccaccagcgcctctgtgtccacccaggtggagcctgaggagcctgaggccgaccagcaccagcagctgcagtaccagcagcccagcatctctgtgctgagtgatggcaccgtggacagcggccagggcagctctgtgttcacagagagccgggtgagcagccagcagacagtgtcctatggcagccagcacgagcaggcccacagcacaggcaccgtgcccggccacatccccagcacagtgcaggcccagagccagccccacggcgtgtacccacccagctctgtgcagcagggcatccagcagacagccccaccccagcagacagtgcagtacagcctgagccagaccagcaccagcagcgaggccaccacagcccagcctgtgtcccagccccaggccccccaggtgctgccccaggtgtctgctgggaagcagagcacccagggcgtgtcccaggtggccccagctgagcctgtggccgtggcccagacccaggccacccagcccaccaccctggccagctctgtggacagcgcccacagtgatgtggccagcggcatgtctgatggaaatgaaaatgtgcccagcagcagcggcagacatgagggccgcaccaccaagaggcactacaggaagtctgtgcgcagccgcagcagacatgagaagaccagccggcccaagctgcgcatcctgaatgtgagcaacaagggggacagagtggtggagtgccagctggagacccacaacaggaagatggtgaccttcaagtttgacctggatggagacaaccctgaggagatcgccaccatcatggtgaacaatgacttcatcctggccatcgagcgggagagctttgtggaccaggtgcgggagatcatcgagaaggcagatgagatgctgtctgaagatgtgtctgtggagcctgagggggaccagggcctggagagcctgcagggcaaggatgattatggcttcagcggcagccagaagctggagggggagttcaagcagcccatcccagccagctccatgccccagcagatcggcatccccaccagcagcctgacccaggtggtgcacagcgctggaagacgcttcatcgtgtcccctgtgcctgagagccggctgcgggagagcaaggtgttccccagcgagatcacagacacagtggccgccagcacagcccagagccctggcatgaacctgagccacagcgccagcagcctgagcctgcagcaggccttcagcgagctgcggcgggcccagatgacagagggccccaacacagccccacccaacttcagccacacaggccccaccttccctgtggtgccccccttcctgagcagcattgctggggtgcccaccacagctgctgccacagcccctgtgcctgccaccagcagccccccaaatgacatcagcaccagcgtcatccagagcgaggtgacagtgcccacagaggagggcattgctggggtggccaccagcactggagtggtgaccagcggcggcctgcccatcccccctgtgtctgagagccctgtgctgagctctgtggtgagcagcatcaccatcccagctgtggtgtccatcagcaccaccagccccagcctgcaggtgcccaccagcaccagcgagatcgtggtgagcagcacagccctgtaccccagcgtgacagtgtctgccaccagcgccagcgctgggggcagcacagccaccccaggccccaagcccccagctgtggtgtcccagcaggccgccggcagcaccaccgtgggcgccaccctgacctctgtgtccaccaccaccagcttccccagcacagccagccagctgtgcatccagctgagcagcagcaccagcacccccaccctggccgagaccgtggtggtgtctgcccacagcctggacaagaccagccacagcagcaccaccggcctggccttcagcctgagcgcccccagcagcagcagcagccctggggccggcgtgagcagctacatcagccagcccggcggcctgcaccccctggtgatccccagcgtgattgccagcacccccatcctgccccaggccgccggccccaccagcacccccctgctgccccaggtgcccagcatcccccccctggtgcagcctgtggccaacgtgcctgctgtgcagcagaccctcatccacagccagccccagcctgccctgctgcccaaccagccccacacccactgcccagaggtggacagcgacacccagcccaaggcccctggcattgatgacatcaagaccctggaggagaagctgcggagcctcttcagcgagcacagcagcagcggggcccagcacgcctctgtgtccctggagaccagcctggtgattgagagcacagtgaccccaggcatccccaccacagctgtggcccccagcaagctgctgaccagcaccaccagcacctgcctgccccccaccaacctgcccctgggcaccgtggccctgcctgtgacccctgtggtgaccccaggccaggtgtccacccctgtgtccaccaccaccagcggcgtgaagccaggcacagcccccagcaagccacccctgaccaaggcccctgtgctgcctgtgggcacagagctgcctgctggcaccctgcccagcgagcagctgccccccttccctggccccagcctgacccagagccagcagcccctggaggacctggatgcccagctgcggaggaccctgagccctgagatgatcaccgtgaccagcgctgtgggccctgtgtccatggccgcccccacagccatcacagaggccggcacccagccccagaagggcgtgtcccaggtgaaggagggccctgtgctggccaccagcagtggagctggggtcttcaagatgggccgcttccaggtgtctgtggccgcagatggagcccagaaggagggcaagaacaagtcagaagatgccaagtctgtgcactttgagagcagcaccagcgagagctctgtgctgagcagcagcagccctgagagcaccctggtgaagccagagcccaacggcatcaccatccctggcatcagcagtgatgtgcctgagagcgcccacaagaccacagccagcgaggccaagagtgacaccggccagcccaccaaggtgggccgcttccaggtgaccaccacagccaacaaggtgggccgcttctctgtgtccaagacagaggacaagatcacagacaccaagaaggagggccctgtggccagcccccccttcatggacctggagcaggccgtgctgcctgctgtgatccccaagaaggagaagccagagctgtctgagcccagccacctgaatggccccagcagtgaccctgaggccgccttcctgagcagagatgtggatgatggcagcggcagcccccacagcccccaccagctgagcagcaagagcctgcccagccagaacctgagccagagcctgagcaacagcttcaacagcagctacatgagcagtgacaatgaaagtgacattgaagatgaggacctgaagctggagctgcggcggctgcgggacaagcacctgaaggagatccaggacctgcagagccggcagaagcatgaaattgagagcctgtacaccaagctgggcaaggtgcccccagctgtgatcatccccccagctgcccccctgagcggcagaagaagaagacccaccaagagcaagggcagcaagagcagccgcagcagcagcctgggcaacaagagcccccagctgagcggcaacctgagcggccagagcgctgcctctgtgctgcacccccagcagaccctgcaccccccaggcaacatccctgagagcggccagaaccagctgctgcagcccctgaagcccagccccagcagtgacaacctgtacagcgccttcaccagtgatggagccatctctgtgcccagcctgagcgcccctggccagggcaccagcagcaccaacacagtgggcgccaccgtgaacagccaggccgcccaggcccagcccccagccatgaccagcagcaggaagggcaccttcacagatgacctgcacaagctggtggacaactgggccagagatgccatgaacctgagcggccggcggggcagcaagggccacatgaactatgagggccctggcatggccaggaagttcagcgcccctggccagctgtgcatctccatgaccagcaacctgggcggcagcgcccccatctctgctgccagcgccaccagcctgggccacttcaccaagtccatgtgccccccccagcagtatggcttccctgccaccccatttggagcccagtggagcggcactggaggccctgccccccagcccctgggccagttccagcctgtgggcacagccagcctgcagaacttcaacatcagcaacctgcagaagagcatcagcaaccccccaggcagcaacctgcggaccacctag

SEQ ID NO: 176098 - DNA, 7149 bp, Artificial Sequence
  Description of Artificial Sequence: Synthetic coding sequence
atgtctgggggcgctgctgagaagcagagcagcaccccaggcagcctcttcctgagccccccagccccagcccccaagaatggcagcagcagtgacagctctgtgggggagaagctgggcgctgctgctgctgatgctgtgacaggccgcacagaggagtacagaagaagaagacacaccatggacaaggacagcagaggagctgctgccaccaccaccaccacagagcaccgcttcttcagaagaagtgtcatctgtgacagcaatgccacagccctggagctgcccggcctgcccctgagcctgccccagcccagcatcccagctgctgtgccccagagcgcccctcctgagccccaccgggaggagaccgtgacagccacagccaccagccaggtggcccagcagcccccagctgctgctgcccctggagagcaggccgtggccggccctgcccccagcacagtgcccagcagcaccagcaaggacaggcctgtgtcccagcccagcctggtgggcagcaaggaggagcccccaccagcccggagcggcagcggcggcggcagcgccaaggagccccaggaggagaggagccagcagcaggatgacatcgaggagctggagaccaaggctgtgggcatgagcaatgatggccgcttcctgaagtttgatattgaaattggccggggcagcttcaagacagtgtacaagggcctggacacagagaccaccgtggaggtggcctggtgtgagctgcaggacaggaagctgaccaagtctgagcggcagcgcttcaaggaggaggccgagatgctgaagggcctgcagcaccccaacatcgtgcgcttctatgacagctgggagagcacagtgaagggcaagaagtgcatcgtgctggtgacagagctgatgaccagcggcaccctgaagacctacctgaagcgcttcaaggtgatgaagatcaaggtgctgcgctcctggtgccggcagatcctgaagggcctgcagttcctgcacaccaggaccccacccatcatccaccgggacctgaagtgtgacaacatcttcatcaccggccccactggatctgtgaagatcggggacctgggcctggccaccctgaagagggccagctttgccaagagcgtcatcggcaccccagagttcatggcccctgagatgtatgaggagaagtatgatgagagcgtggatgtgtatgccttcggcatgtgcatgctggagatggccaccagcgagtacccctacagcgagtgccagaatgctgcccagatctacagaagagtgaccagcggcgtgaagccagccagctttgacaaggtggccatccctgaggtgaaggagatcatcgagggctgcatccggcagaacaaggatgagcgctacagcatcaaggacctgctgaaccacgccttcttccaggaggagactggagtgcgggtggagctggccgaggaggatgatggagagaagatcgccatcaagctgtggctgagaattgaggacatcaagaagctgaagggcaagtacaaggacaatgaggccatcgagttctcctttgacctggagagagatgtgcctgaagatgtggcccaggagatggtggagagcggctacgtgtgtgagggggaccacaagaccatggccaaggccatcaaggacagagtgtccctcatcaagaggaagcgggagcagaggcagctggtgcgggaggagcaggagaagaagaagcaggaggagagcagcctgaagcagcaggtggagcagagcagcgccagccagacaggcatcaagcagctgcccagcgccagcacaggcatccccacagccagcaccaccagcgcctctgtgtccacccaggtggagcctgaggagcctgaggccgaccagcaccagcagctgcagtaccagcagcccagcatctctgtgctgagtgatggcaccgtggacagcggccagggcagcagcgtcttcacagagagccgggtgagcagccagcagacagtgtcctatggcagccagcacgagcaggcccacagcactggaacagtgcccggccacatccccagcacagtgcaggcccagagccagccccatggagtgtacccacccagctctgtggcccagggccagagccagggccagcccagcagcagcagcctgactggagtgagcagcagccagcccatccagcacccccagcagcagcagggcatccagcagacagccccaccccagcagacagtgcagtacagcctgagccagaccagcaccagcagcgaggccaccacagcccagcctgtgtcccagccccaggccccccaggtgctgccccaggtgtctgctgggaagcagctgcctgtgtcccagcctgtgcccaccatccagggcgagccccagatccctgtggccacccagcccagcgtggtgcctgtgcacagcggggcccacttcctgcctgtgggccagcccctgcccacccccctgctgccccagtaccctgtgtcccagatccccatcagcaccccccacgtgtccacagcccagacaggcttcagcagcctgcccatcaccatggctgctggcatcacccagcccctgctgaccctggccagcagcgccaccacagctgccatccctggggtgtccacagtggtgcccagccagctgcccaccctgctgcagcctgtgacccagctgcccagccaggtgcacccccagctgctgcagcctgctgtgcagagcatgggcatcccagccaacctgggccaggccgctgaggtgcccctgagcagtggagatgtgctgtaccagggcttccccccccggctgcccccccagtacccaggggacagcaacatcgcccccagcagcaatgtggcctctgtgtgcatccacagcacagtgctgagcccccccatgcccacagaggtgctggccaccccaggctacttccccaccgtggtgcagccctacgtggagagcaacctgctggtgcccatgggcggcgtgggcggccaggtgcaggtgtcccagcccggcggcagcctggcccaggcccccaccaccagcagccagcaggccgtgctggagagcacccagggcgtgtcccaggtggccccagctgagcctgtggccgtggcccagacccaggccacccagcccaccaccctggccagctctgtggacagcgcccacagtgatgtggccagcggcatgtctgatggaaatgaaaatgtgcccagcagcagcggcagacatgagggccgcaccaccaagaggcactacaggaagtctgtgcgcagccgcagcagacatgagaagaccagccggcccaagctgcgcatcctgaatgtgagcaacaagggggacagagtggtggagtgccagctggagacccacaacaggaagatggtgaccttcaagtttgacctggatggagacaaccctgaggagatcgccaccatcatggtgaacaatgacttcatcctggccatcgagcgggagagctttgtggaccaggtgcgggagatcatcgagaaggcagatgagatgctgtctgaagatgtgtctgtggagcctgagggggaccagggcctggagagcctgcagggcaaggatgattatggcttcagcggcagccagaagctggagggggagttcaagcagcccatcccagccagctccatgccccagcagatcggcatccccaccagcagcctgacccaggtggtgcacagcgctggccgccgcttcatcgtgtcccctgtgcctgagagccggctgcgggagagcaaggtgttccccagcgagatcacagacacagtggccgccagcacagcccagagccctggcatgaacctgagccacagcgccagcagcctgagcctgcagcaggccttcagcgagctgcggcgggcccagatgacagagggccccaacacagccccacccaacttcagccacacaggccccaccttccctgtggtgccccccttcctgagcagcattgctggggtgcccaccacagctgctgccacagcccctgtgcctgccaccagcagccccccaaatgacatcagcaccagcgtcatccagagcgaggtgacagtgcccacagaggagggcattgctggggtggccaccagcactggagtggtgaccagcggcggcctgcccatcccccctgtgtctgagagccctgtgctgagctctgtggtgagcagcatcaccatcccagctgtggtgtccatcagcaccaccagccccagcctgcaggtgcccaccagcaccagcgagatcgtggtgagcagcacagccctgtaccccagcgtgacagtgtctgccaccagcgccagcgctgggggcagcacagccaccccaggccccaagcccccagctgtggtgtcccagcaggccgccggcagcaccaccgtgggcgccaccctgacctctgtgtccaccaccaccagcttccccagcacagccagccagctgtgcatccagctgagcagcagcaccagcacccccaccctggccgagaccgtggtggtgtctgcccacagcctggacaagaccagccacagcagcaccaccggcctggccttcagcctgagcgcccccagcagcagcagcagccctggagctggggtgtcctcctacatcagccagcccggcggcctgcaccccctggtgatccccagcgtcatcgccagcacccccatcctgccccaggccgccggccccaccagcacccccctgctgccccaggtgcccagcatcccccccctggtgcagcctgtggccaacgtgcctgctgtgcagcagaccctcatccacagccagccccagcctgccctgctgcccaaccagccccacacccactgcccagaggtggacagcgacacccagcccaaggcccctggcattgatgacatcaagaccctggaggagaagctgcggagcctcttcagcgagcacagcagcagcggggcccagcacgcctctgtgtccctggagaccagcctggtgattgagagcacagtgaccccaggcatccccaccacagctgtggcccccagcaagctgctgaccagcaccaccagcacctgcctgccccccaccaacctgcccctgggcaccgtggccctgcctgtgacccctgtggtgaccccaggccaggtgtccacccctgtgtccaccaccaccagcggcgtgaagccaggcacagcccccagcaagccacccctgaccaaggcccctgtgctgcctgtgggcacagagctgcctgctggcaccctgcccagcgagcagctgccccccttccctggccccagcctgacccagagccagcagcccctggaggacctggatgcccagctgcggaggaccctgagccctgagatgatcaccgtgaccagcgctgtgggccctgtgtccatggccgcccccacagccatcacagaagctggcacccagccccagaagggcgtgtcccaggtgaaggagggccctgtgctggccaccagcagcggggccggggtcttcaagatgggccgcttccaggtgtctgtggccgcagatggagcccagaaggagggcaagaacaagtcagaagatgccaagtctgtgcactttgagagcagcaccagcgagagctctgtgctgagcagcagcagccctgagagcaccctggtgaagccagagcccaacggcatcaccatccctggcatcagcagtgatgtgcctgagagcgcccacaagaccacagccagcgaggccaagagtgacaccggccagcccaccaaggtgggccgcttccaggtgaccaccacagccaacaaggtgggccgcttctctgtgtccaagacagaggacaagatcacagacaccaagaaggagggccctgtggccagcccccccttcatggacctggagcaggccgtgctgcctgctgtgatccccaagaaggagaagccagagctgtctgagcccagccacctgaatggccccagcagtgaccctgaggccgccttcctgagcagagatgtggatgatggcagcggcagcccccacagcccccaccagctgagcagcaagagcctgcccagccagaacctgagccagagcctgagcaacagcttcaacagcagctacatgagcagtgacaatgaaagtgacattgaagatgaggacctgaagctggagctgcggcggctgcgggacaagcacctgaaggagatccaggacctgcagagccggcagaagcatgaaattgagagcctgtacaccaagctgggcaaggtgcccccagctgtgatcatccccccagctgcccccctgtctggaagaagaagaagacccaccaagagcaagggcagcaagagcagccgcagcagcagcctgggcaacaagagcccccagctgagcggcaacctgagcggccagagcgctgcctctgtgctgcacccccagcagaccctgcaccccccaggcaacatccctgagagcggccagaaccagctgctgcagcccctgaagcccagccccagcagtgacaacctgtacagcgccttcaccagtgatggagccatctctgtgcccagcctgagcgcccctggccagggcaccagcagcaccaacacagtgggcgccaccgtgaacagccaggccgcccaggcccagcccccagccatgaccagcagcaggaagggcaccttcacagatgacctgcacaagctggtggacaactgggccagagatgccatgaacctgtctggaagaagaggcagcaagggccacatgaactatgagggccctggcatggccaggaagttcagcgcccctggccagctgtgcatctccatgaccagcaacctgggcggcagcgcccccatctctgctgccagcgccaccagcctgggccacttcaccaagtccatgtgccccccccagcagtatggcttccctgccaccccatttggagcccagtggagcggcaccggcggccctgccccccagcccctgggccagttccagcctgtgggcacagccagcctgcagaacttcaacatcagcaacctgcagaagagcatcagcaaccccccaggcagcaacctgcggaccacctag

SEQ ID NO: 176099 - DNA, 5928 bp, Artificial Sequence
  Description of Artificial Sequence: Synthetic coding sequence
atggacatcaagaagaaggacttctgcagcgtgtttgtgatcatcaacagccactgctgctgctgcccccagaaggactgcatcaatgaaggagtgaagccagccagctttgacaaggtggccatccctgaggtgaaggagatcatcgagggctgcatccggcagaacaaggatgagcgctacagcatcaaggacctgctgaaccacgccttcttccaggaggagaccggggtgcgggtggagctggccgaggaggatgatggagagaagatcgccatcaagctgtggctgagaattgaggacatcaagaagctgaagggcaagtacaaggacaatgaggccatcgagttctcctttgacctggagagagatgtgcctgaagatgtggcccaggagatggtggagagcggctacgtgtgtgagggggaccacaagaccatggccaaggccatcaaggacagagtgtccctcatcaagaggaagcgggagcagaggcagctggtgcgggaggagcaggagaagaagaagcaggaggagagcagcctgaagcagcaggtggagcagagcagcgccagccagacaggcatcaagcagctgcccagcgccagcacaggcatccccacagccagcaccaccagcgcctctgtgtccacccaggtggagcctgaggagcctgaggccgaccagcaccagcagctgcagtaccagcagcccagcatctctgtgctgagtgatggcaccgtggacagcggccagggcagctctgtgttcacagagagccgggtgagcagccagcagacagtgtcctatggcagccagcacgagcaggcccacagcacaggcaccgtgcccggccacatccccagcacagtgcaggcccagagccagccccacggcgtgtacccacccagctctgtggcccagggccagagccagggccagcccagcagcagcagcctgactggagtgagcagcagccagcccatccagcacccccagcagcagcagggcatccagcagacagccccaccccagcagacagtgcagtacagcctgagccagaccagcaccagcagcgaggccaccacagcccagcctgtgtcccagccccaggccccccaggtgctgccccaggtgtctgctgggaagcagctgcctgtgtcccagcctgtgcccaccatccagggcgagccccagatccctgtggccacccagcccagcgtggtgcctgtgcacagcggggcccacttcctgcctgtgggccagcccctgcccacccccctgctgccccagtaccctgtgtcccagatccccatcagcacccctcatgtgtccacagcccagacaggcttcagcagcctgcccatcaccatggccgccggcatcacccagcccctgctgaccctggccagcagcgccaccacagctgccatccctggggtgtccacagtggtgcccagccagctgcccaccctgctgcagcctgtgacccagctgcccagccaggtgcacccccagctgctgcagcctgctgtgcagagcatgggcatcccagccaacctgggccaggccgctgaggtgcccctgagcagtggagatgtgctgtaccagggcttccccccccggctgcccccccagtacccaggggacagcaacatcgcccccagcagcaatgtggcctctgtgtgcatccacagcacagtgctgagcccccccatgcccacagaggtgctggccaccccaggctacttccccaccgtggtgcagccctacgtggagagcaacctgctggtgcccatgggcggcgtgggcggccaggtgcaggtgtcccagcccggcggcagcctggcccaggcccccaccaccagcagccagcaggccgtgctggagagcacccagggcgtgtcccaggtggccccagctgagcctgtggccgtggcccagacccaggccacccagcccaccaccctggccagctctgtggacagcgcccacagtgatgtggccagcggcatgtctgatggaaatgaaaatgtgcccagcagcagcggcagacatgagggccgcaccaccaagaggcactacaggaagtctgtgcgcagccgcagcagacatgagaagaccagccggcccaagctgcgcatcctgaatgtgagcaacaagggggacagagtggtggagtgccagctggagacccacaacaggaagatggtgaccttcaagtttgacctggatggagacaaccctgaggagatcgccaccatcatggtgaacaatgacttcatcctggccatcgagcgggagagctttgtggaccaggtgcgggagatcatcgagaaggcagatgagatgctgtctgaagatgtgtctgtggagcctgagggggaccagggcctggagagcctgcagggcaaggatgattatggcttcagcggcagccagaagctggagggggagttcaagcagcccatcccagccagctccatgccccagcagatcggcatccccaccagcagcctgacccaggtggtgcacagcgctggaagacgcttcatcgtgtcccctgtgcctgagagccggctgcgggagagcaaggtgttccccagcgagatcacagacacagtggccgccagcacagcccagagccctggcatgaacctgagccacagcgccagcagcctgagcctgcagcaggccttcagcgagctgcggcgggcccagatgacagagggccccaacacagccccacccaacttcagccacacaggccccaccttccctgtggtgccccccttcctgagcagcattgctggggtgcccaccacagctgctgccacagcccctgtgcctgccaccagcagccccccaaatgacatcagcaccagcgtcatccagagcgaggtgacagtgcccacagaggagggcattgctggggtggccaccagcactggagtggtgaccagcggcggcctgcccatcccccctgtgtctgagagccctgtgctgagctctgtggtgagcagcatcaccatcccagctgtggtgtccatcagcaccaccagccccagcctgcaggtgcccaccagcaccagcgagatcgtggtgagcagcacagccctgtaccccagcgtgacagtgtctgccaccagcgccagcgctgggggcagcacagccaccccaggccccaagcccccagctgtggtgtcccagcaggccgccggcagcaccaccgtgggcgccaccctgacctctgtgtccaccaccaccagcttccccagcacagccagccagctgtgcatccagctgagcagcagcaccagcacccccaccctggccgagaccgtggtggtgtctgcccacagcctggacaagaccagccacagcagcaccaccggcctggccttcagcctgagcgcccccagcagcagcagcagccctggggccggcgtgagcagctacatcagccagcccggcggcctgcaccccctggtgatccccagcgtgattgccagcacccccatcctgccccaggccgccggccccaccagcacccccctgctgccccaggtgcccagcatcccccccctggtgcagcctgtggccaacgtgcctgctgtgcagcagaccctcatccacagccagccccagcctgccctgctgcccaaccagccccacacccactgcccagaggtggacagcgacacccagcccaaggcccctggcattgatgacatcaagaccctggaggagaagctgcggagcctcttcagcgagcacagcagcagcggggcccagcacgcctctgtgtccctggagaccagcctggtgattgagagcacagtgaccccaggcatccccaccacagctgtggcccccagcaagctgctgaccagcaccaccagcacctgcctgccccccaccaacctgcccctgggcaccgtggccctgcctgtgacccctgtggtgaccccaggccaggtgtccacccctgtgtccaccaccaccagcggcgtgaagccaggcacagcccccagcaagccacccctgaccaaggcccctgtgctgcctgtgggcacagagctgcctgctggcaccctgcccagcgagcagctgccccccttccctggccccagcctgacccagagccagcagcccctggaggacctggatgcccagctgcggaggaccctgagccctgagatgatcaccgtgaccagcgctgtgggccctgtgtccatggccgcccccacagccatcacagaggccggcacccagccccagaagggcgtgtcccaggtgaaggagggccctgtgctggccaccagcagtggagctggggtcttcaagatgggccgcttccaggtgtctgtggccgcagatggagcccagaaggagggcaagaacaagtcagaagatgccaagtctgtgcactttgagagcagcaccagcgagagctctgtgctgagcagcagcagccctgagagcaccctggtgaagccagagcccaacggcatcaccatccctggcatcagcagtgatgtgcctgagagcgcccacaagaccacagccagcgaggccaagagtgacaccggccagcccaccaaggtgggccgcttccaggtgaccaccacagccaacaaggtgggccgcttctctgtgtccaagacagaggacaagatcacagacaccaagaaggagggccctgtggccagcccccccttcatggacctggagcaggccgtgctgcctgctgtgatccccaagaaggagaagccagagctgtctgagcccagccacctgaatggccccagcagtgaccctgaggccgccttcctgagcagagatgtggatgatggcagcggcagcccccacagcccccaccagctgagcagcaagagcctgcccagccagaacctgagccagagcctgagcaacagcttcaacagcagctacatgagcagtgacaatgaaagtgacattgaagatgaggacctgaagctggagctgcggcggctgcgggacaagcacctgaaggagatccaggacctgcagagccggcagaagcatgaaattgagagcctgtacaccaagctgggcaaggtgcccccagctgtgatcatccccccagctgcccccctgagcggcagaagaagaagacccaccaagagcaagggcagcaagagcagccgcagcagcagcctgggcaacaagagcccccagctgagcggcaacctgagcggccagagcgctgcctctgtgctgcacccccagcagaccctgcaccccccaggcaacatccctgagagcggccagaaccagctgctgcagcccctgaagcccagccccagcagtgacaacctgtacagcgccttcaccagtgatggagccatctctgtgcccagcctgagcgcccctggccagggcaccagcagcaccaacacagtgggcgccaccgtgaacagccaggccgcccaggcccagcccccagccatgaccagcagcaggaagggcaccttcacagatgacctgcacaagctggtggacaactgggccagagatgccatgaacctgagcggccggcggggcagcaagggccacatgaactatgagggccctggcatggccaggaagttcagcgcccctggccagctgtgcatctccatgaccagcaacctgggcggcagcgcccccatctctgctgccagcgccaccagcctgggccacttcaccaagtccatgtgccccccccagcagtatggcttccctgccaccccatttggagcccagtggagcggcactggaggccctgccccccagcccctgggccagttccagcctgtgggcacagccagcctgcagaacttcaacatcagcaacctgcagaagagcatcagcaaccccccaggcagcaacctgcggaccacctag

SEQ ID NO: 176100 - DNA, 1182 bp, Artificial Sequence
  Description of Artificial Sequence: Synthetic coding sequence
atgtctgggggcgctgctgagaagcagagcagcaccccaggcagcctcttcctgagccccccagccccagcccccaagaatggcagcagcagtgacagctctgtgggggagaagctgggcgctgctgctgctgatgctgtgacaggccgcacagaggagtacagaagaagaagacacaccatggacaaggacagcagaggagctgctgccaccaccaccaccacagagcaccgcttcttcagaagaagtgtcatctgtgacagcaatgccacagccctggagctgcccggcctgcccctgagcctgccccagcccagcatcccagctgctgtgccccagagcgcccctcctgagccccaccgggaggagaccgtgacagccacagccaccagccaggtggcccagcagcccccagctgctgctgcccctggagagcaggccgtggccggccctgcccccagcacagtgcccagcagcaccagcaaggacaggcctgtgtcccagcccagcctggtgggcagcaaggaggagcccccaccagcccggagcggcagcggcggcggcagcgccaaggagccccaggaggagaggagccagcagcaggatgacatcgaggagctggagaccaaggctgtgggcatgagcaatgatggccgcttcctgaagtttgatattgaaattggccggggcagcttcaagacagtgtacaagggcctggacacagagaccaccgtggaggtggcctggtgtgagctgcaggacaggaagctgaccaagtctgagcggcagcgcttcaaggaggaggccgagatgctgaagggcctgcagcaccccaacatcgtgcgcttctatgacagctgggagagcacagtgaagggcaagaagtgcatcgtgctggtgacagagctgatgaccagcggcaccctgaagacctacctgaagcgcttcaaggtgatgaagatcaaggtgctgcgctcctggtgccggcagatcctgaagggcctgcagttcctgcacaccaggaccccacccatcatccaccgggacctgaagtgtgacaacatcttcatcaccggccccactggatctgtgaagatcggggacctgggcctggccaccctgaagagggccagctttgccaagagcgtcatcggcatgttccaggtgtacctgggcgcctag

SEQ ID NO: 176101 - DNA, 8643 bp, Artificial Sequence
  Description of Artificial Sequence: Synthetic coding sequence
atgtctgggggcgctgctgagaagcagagcagcaccccaggcagcctcttcctgagccccccagccccagcccccaagaatggcagcagcagtgacagctctgtgggggagaagctgggcgctgctgctgctgatgctgtgacaggccgcacagaggagtacagaagaagaagacacaccatggacaaggacagcagaggagctgctgccaccaccaccaccacagagcaccgcttcttcagaagaagtgtcatctgtgacagcaatgccacagccctggagctgcccggcctgcccctgagcctgccccagcccagcatcccagctgctgtgccccagagcgcccctcctgagccccaccgggaggagaccgtgacagccacagccaccagccaggtggcccagcagcccccagctgctgctgcccctggagagcaggccgtggccggccctgcccccagcacagtgcccagcagcaccagcaaggacaggcctgtgtcccagcccagcctggtgggcagcaaggaggagcccccaccagcccggagcggcagcggcggcggcagcgccaaggagccccaggaggagaggagccagcagcaggatgacatcgaggagctggagaccaaggctgtgggcatgagcaatgatggccgcttcctgaagtttgatattgaaattggccggggcagcttcaagacagtgtacaagggcctggacacagagaccaccgtggaggtggcctggtgtgagctgcaggacaggaagctgaccaagtctgagcggcagcgcttcaaggaggaggccgagatgctgaagggcctgcagcaccccaacatcgtgcgcttctatgacagctgggagagcacagtgaagggcaagaagtgcatcgtgctggtgacagagctgatgaccagcggcaccctgaagacctacctgaagcgcttcaaggtgatgaagatcaaggtgctgcgctcctggtgccggcagatcctgaagggcctgcagttcctgcacaccaggaccccacccatcatccaccgggacctgaagtgtgacaacatcttcatcaccggccccactggatctgtgaagatcggggacctgggcctggccaccctgaagagggccagctttgccaagagcgtcatcggcaccccagagttcatggcccctgagatgtatgaggagaagtatgatgagagcgtggatgtgtatgccttcggcatgtgcatgctggagatggccaccagcgagtacccctacagcgagtgccagaatgctgcccagatctacagaagagtgaccagcggcgtgaagccagccagctttgacaaggtggccatccctgaggtgaaggagatcatcgagggctgcatccggcagaacaaggatgagcgctacagcatcaaggacctgctgaaccacgccttcttccaggaggagactggagtgcgggtggagctggccgaggaggatgatggagagaagatcgccatcaagctgtggctgagaattgaggacatcaagaagctgaagggcaagtacaaggacaatgaggccatcgagttctcctttgacctggagagagatgtgcctgaagatgtggcccaggagatggtggagagcggctacgtgtgtgagggggaccacaagaccatggccaaggccatcaaggacagagtgtccctcatcaagaggaagcgggagcagaggcagctggtgcgggaggagcaggagaagaagaagcaggaggagagcagcctgaagcagcaggtggagcagagcagcgccagccagacaggcatcaagcagctgcccagcgccagcacaggcatccccacagccagcaccaccagcgcctctgtgtccacccaggtggagcctgaggagcctgaggccgaccagcaccagcagctgcagtaccagcagcccagcatctctgtgctgagtgatggcaccgtggacagcggccagggcagcagcgtcttcacagagagccgggtgagcagccagcagacagtgtcctatggcagccagcacgagcaggcccacagcactggaacagtgcccggccacatccccagcacagtgcaggcccagagccagccccatggagtgtacccacccagctctgtgccccggcggggccgctccatgtctgtgtgtgtgcccatcttcctgctgctgcccctgtgcccagccagcctgcctgtgctcttccaccccacagccagcacagtgtgcaccagcttctccttccccccaccagactgcccagaggagacctttgctgagaagctgagcaaggccctggagagcgtgctgcccatgcacagcgccagccagaggaagcacagaagaagcagcctgcccagcctgtttgtgtccaccccccagagcatggcccacccctgtggcggcacccccacctacccagagagccagatcttcttccccaccatccacgagaggcctgtgtccttcagccccccacccacctgcccccccaaggtggccatcagccagaggaggaagagcaccagcttcctggaggcccagacccaccacttccagcccctgctgaggacagtgggccagagcctgctgcccccaggcggcagccccaccaactggaccccagaggccgtggtgatgctgggcaccacagccagccgggtgactggagagagctgtgagatccaggtgcaccccatgtttgagcccagccaggtgtacagcgactaccggcccggcctggtgctgcctgaggaggcccactacttcatcccccaggaggccgtgtatgtggccggcgtgcactaccaggcccgggtggccgagcagtatgagggcatcccctacaacagctctgtgctgagcagccccatgaagcagatccctgagcagaagcctgtgcagggcggccccaccagcagctctgtgtttgagttccccagcggccaggccttcctggtgggccacctgcagaacctgcggctggacagcggcctgggccctggcagccccctgagcagcatcagcgcccccatcagcacagatgccacccggctgaagttccaccctgtgtttgtgccccacagcgccccagctgtgctgacccacaacaatgaaagccgcagcaactgtgtgtttgagttccacgtgcacacccccagcagcagcagtggagagggcggcggcatcctgccccagagggtgtacagaaaccggcaggtggccgtggacctgaaccaggaggagctgcccccccagagcgtgggcctgcacggctacctgcagcctgtgacagaggagaagcacaactaccacgcccctgagctgactgtgtctgtggtggagcccatcggccagaactggcccatcggcagccctgagtacagcagtgacagcagccagatcaccagcagtgaccccagcgacttccagagccccccacccactggaggagctgctgcccccttcggcagtgatgtgtccatgcccttcatccacctgccccagacagtgctgcaggagagccccctcttcttctgcttcccccagggcaccaccagccagcaggtgctgacagccagcttcagcagcggcggcagcgccctgcacccccaggcccagggccagagccagggccagcccagcagcagcagcctgactggagtgagcagcagccagcccatccagcacccccagcagcagcagggcatccagcagacagccccaccccagcagacagtgcagtacagcctgagccagaccagcaccagcagcgaggccaccacagcccagcctgtgtcccagccccaggccccccaggtgctgccccaggtgtctgctgggaagcagctgcctgtgtcccagcctgtgcccaccatccagggcgagccccagatccctgtggccacccagcccagcgtggtgcctgtgcacagcggggcccacttcctgcctgtgggccagcccctgcccacccccctgctgccccagtaccctgtgtcccagatccccatcagcaccccccacgtgtccacagcccagacaggcttcagcagcctgcccatcaccatggctgctggcatcacccagcccctgctgaccctggccagcagcgccaccacagctgccatccctggggtgtccacagtggtgcccagccagctgcccaccctgctgcagcctgtgacccagctgcccagccaggtgcacccccagctgctgcagcctgctgtgcagagcatgggcatcccagccaacctgggccaggccgctgaggtgcccctgagcagtggagatgtgctgtaccagggcttccccccccggctgcccccccagtacccaggggacagcaacatcgcccccagcagcaatgtggcctctgtgtgcatccacagcacagtgctgagcccccccatgcccacagaggtgctggccaccccaggctacttccccaccgtggtgcagccctacgtggagagcaacctgctggtgcccatgggcggcgtgggcggccaggtgcaggtgtcccagcccggcggcagcctggcccaggcccccaccaccagcagccagcaggccgtgctggagagcacccagggcgtgtcccaggtggccccagctgagcctgtggccgtggcccagacccaggccacccagcccaccaccctggccagctctgtggacagcgcccacagtgatgtggccagcggcatgtctgatggaaatgaaaatgtgcccagcagcagcggcagacatgagggccgcaccaccaagaggcactacaggaagtctgtgcgcagccgcagcagacatgagaagaccagccggcccaagctgcgcatcctgaatgtgagcaacaagggggacagagtggtggagtgccagctggagacccacaacaggaagatggtgaccttcaagtttgacctggatggagacaaccctgaggagatcgccaccatcatggtgaacaatgacttcatcctggccatcgagcgggagagctttgtggaccaggtgcgggagatcatcgagaaggcagatgagatgctgtctgaagatgtgtctgtggagcctgagggggaccagggcctggagagcctgcagggcaaggatgattatggcttcagcggcagccagaagctggagggggagttcaagcagcccatcccagccagctccatgccccagcagatcggcatccccaccagcagcctgacccaggtggtgcacagcgctggccgccgcttcatcgtgtcccctgtgcctgagagccggctgcgggagagcaaggtgttccccagcgagatcacagacacagtggccgccagcacagcccagagccctggcatgaacctgagccacagcgccagcagcctgagcctgcagcaggccttcagcgagctgcggcgggcccagatgacagagggccccaacacagccccacccaacttcagccacacaggccccaccttccctgtggtgccccccttcctgagcagcattgctggggtgcccaccacagctgctgccacagcccctgtgcctgccaccagcagccccccaaatgacatcagcaccagcgtcatccagagcgaggtgacagtgcccacagaggagggcattgctggggtggccaccagcactggagtggtgaccagcggcggcctgcccatcccccctgtgtctgagagccctgtgctgagctctgtggtgagcagcatcaccatcccagctgtggtgtccatcagcaccaccagccccagcctgcaggtgcccaccagcaccagcgagatcgtggtgagcagcacagccctgtaccccagcgtgacagtgtctgccaccagcgccagcgctgggggcagcacagccaccccaggccccaagcccccagctgtggtgtcccagcaggccgccggcagcaccaccgtgggcgccaccctgacctctgtgtccaccaccaccagcttccccagcacagccagccagctgtgcatccagctgagcagcagcaccagcacccccaccctggccgagaccgtggtggtgtctgcccacagcctggacaagaccagccacagcagcaccaccggcctggccttcagcctgagcgcccccagcagcagcagcagccctggagctggggtgtcctcctacatcagccagcccggcggcctgcaccccctggtgatccccagcgtcatcgccagcacccccatcctgccccaggccgccggccccaccagcacccccctgctgccccaggtgcccagcatcccccccctggtgcagcctgtggccaacgtgcctgctgtgcagcagaccctcatccacagccagccccagcctgccctgctgcccaaccagccccacacccactgcccagaggtggacagcgacacccagcccaaggcccctggcattgatgacatcaagaccctggaggagaagctgcggagcctcttcagcgagcacagcagcagcggggcccagcacgcctctgtgtccctggagaccagcctggtgattgagagcacagtgaccccaggcatccccaccacagctgtggcccccagcaagctgctgaccagcaccaccagcacctgcctgccccccaccaacctgcccctgggcaccgtggccctgcctgtgacccctgtggtgaccccaggccaggtgtccacccctgtgtccaccaccaccagcggcgtgaagccaggcacagcccccagcaagccacccctgaccaaggcccctgtgctgcctgtgggcacagagctgcctgctggcaccctgcccagcgagcagctgccccccttccctggccccagcctgacccagagccagcagcccctggaggacctggatgcccagctgcggaggaccctgagccctgagatgatcaccgtgaccagcgctgtgggccctgtgtccatggccgcccccacagccatcacagaagctggcacccagccccagaagggcgtgtcccaggtgaaggagggccctgtgctggccaccagcagcggggccggggtcttcaagatgggccgcttccaggtgtctgtggccgcagatggagcccagaaggagggcaagaacaagtcagaagatgccaagtctgtgcactttgagagcagcaccagcgagagctctgtgctgagcagcagcagccctgagagcaccctggtgaagccagagcccaacggcatcaccatccctggcatcagcagtgatgtgcctgagagcgcccacaagaccacagccagcgaggccaagagtgacaccggccagcccaccaaggtgggccgcttccaggtgaccaccacagccaacaaggtgggccgcttctctgtgtccaagacagaggacaagatcacagacaccaagaaggagggccctgtggccagcccccccttcatggacctggagcaggccgtgctgcctgctgtgatccccaagaaggagaagccagagctgtctgagcccagccacctgaatggccccagcagtgaccctgaggccgccttcctgagcagagatgtggatgatggcagcggcagcccccacagcccccaccagctgagcagcaagagcctgcccagccagaacctgagccagagcctgagcaacagcttcaacagcagctacatgagcagtgacaatgaaagtgacattgaagatgaggacctgaagctggagctgcggcggctgcgggacaagcacctgaaggagatccaggacctgcagagccggcagaagcatgaaattgagagcctgtacaccaagctgggcaaggtgcccccagctgtgatcatccccccagctgcccccctgtctggaagaagaagaagacccaccaagagcaagggcagcaagagcagccgcagcagcagcctgggcaacaagagcccccagctgagcggcaacctgagcggccagagcgctgcctctgtgctgcacccccagcagaccctgcaccccccaggcaacatccctgagagcggccagaaccagctgctgcagcccctgaagcccagccccagcagtgacaacctgtacagcgccttcaccagtgatggagccatctctgtgcccagcctgagcgcccctggccagggcaccagcagcaccaacacagtgggcgccaccgtgaacagccaggccgcccaggcccagcccccagccatgaccagcagcaggaagggcaccttcacagatgacctgcacaagctggtggacaactgggccagagatgccatgaacctgtctggaagaagaggcagcaagggccacatgaactatgagggccctggcatggccaggaagttcagcgcccctggccagctgtgcatctccatgaccagcaacctgggcggcagcgcccccatctctgctgccagcgccaccagcctgggccacttcaccaagtccatgtgccccccccagcagtatggcttccctgccaccccatttggagcccagtggagcggcaccggcggccctgccccccagcccctgggccagttccagcctgtgggcacagccagcctgcagaacttcaacatcagcaacctgcagaagagcatcagcaaccccccaggcagcaacctgcggaccacctag

SEQ ID NO: 176102 - DNA, 6405 bp, Artificial Sequence
  Description of Artificial Sequence: Synthetic coding sequence
atgtctgggggcgctgctgagaagcagagcagcaccccaggcagcctcttcctgagccccccagccccagcccccaagaatggcagcagcagtgacagctctgtgggggagaagctgggcgctgctgctgctgatgctgtgacaggccgcacagaggagtacagaagaagaagacacaccatggacaaggacagcagaggagctgctgccaccaccaccaccacagagcaccgcttcttcagaagaagtgtcatctgtgacagcaatgccacagccctggagctgcccggcctgcccctgagcctgccccagcccagcatcccagctgctgtgccccagagcgcccctcctgagccccaccgggaggagaccgtgacagccacagccaccagccaggtggcccagcagcccccagctgctgctgcccctggagagcaggccgtggccggccctgcccccagcacagtgcccagcagcaccagcaaggacaggcctgtgtcccagcccagcctggtgggcagcaaggaggagcccccaccagcccggagcggcagcggcggcggcagcgccaaggagccccaggaggagaggagccagcagcaggatgacatcgaggagctggagaccaaggctgtgggcatgagcaatgatggccgcttcctgaagtttgatattgaaattggccggggcagcttcaagacagtgtacaagggcctggacacagagaccaccgtggaggtggcctggtgtgagctgcaggacaggaagctgaccaagtctgagcggcagcgcttcaaggaggaggccgagatgctgaagggcctgcagcaccccaacatcgtgcgcttctatgacagctgggagagcacagtgaagggcaagaagtgcatcgtgctggtgacagagctgatgaccagcggcaccctgaagacctacctgaagcgcttcaaggtgatgaagatcaaggtgctgcgctcctggtgccggcagatcctgaagggcctgcagttcctgcacaccaggaccccacccatcatccaccgggacctgaagtgtgacaacatcttcatcaccggccccactggatctgtgaagatcggggacctgggcctggccaccctgaagagggccagctttgccaagagcgtcatcggcaccccagagttcatggcccctgagatgtatgaggagaagtatgatgagagcgtggatgtgtatgccttcggcatgtgcatgctggagatggccaccagcgagtacccctacagcgagtgccagaatgctgcccagatctacagaagagtgaccagcggcgtgaagccagccagctttgacaaggtggccatccctgaggtgaaggagatcatcgagggctgcatccggcagaacaaggatgagcgctacagcatcaaggacctgctgaaccacgccttcttccaggaggagactggagtgcgggtggagctggccgaggaggatgatggagagaagatcgccatcaagctgtggctgagaattgaggacatcaagaagctgaagggcaagtacaaggacaatgaggccatcgagttctcctttgacctggagagagatgtgcctgaagatgtggcccaggagatggtggagagcggctacgtgtgtgagggggaccacaagaccatggccaaggccatcaaggacagagtgtccctcatcaagaggaagcgggagcagaggcagctggtgcgggaggagcaggagaagaagaagcaggaggagagcagcctgaagcagcaggtggagcagagcagcgccagccagacaggcatcaagcagctgcccagcgccagcacaggcatccccacagccagcaccaccagcgcctctgtgtccacccaggtggagcctgaggagcctgaggccgaccagcaccagcagctgcagtaccagcagcccagcatctctgtgctgagtgatggcaccgtggacagcggccagggcagcagcgtcttcacagagagccgggtgagcagccagcagacagtgtcctatggcagccagcacgagcaggcccacagcactggaacagtgcccggccacatccccagcacagtgcaggcccagagccagccccatggagtgtacccacccagctctgtggcccagggccagagccagggccagcccagcagcagcagcctgactggagtgagcagcagccagcccatccagcacccccagcagcagggcatccagcagacagccccaccccagcagacagtgcagtacagcctgagccagaccagcaccagcagcgaggccaccacagcccagcctgtgtcccagccccaggccccccaggtgctgccccaggtgtctgctgggaagcagagcacccagggcgtgtcccaggtggccccagctgagcctgtggccgtggcccagacccaggccacccagcccaccaccctggccagctctgtggacagcgcccacagtgatgtggccagcggcatgtctgatggaaatgaaaatgtgcccagcagcagcggcagacatgagggccgcaccaccaagaggcactacaggaagtctgtgcgcagccgcagcagacatgagaagaccagccggcccaagctgcgcatcctgaatgtgagcaacaagggggacagagtggtggagtgccagctggagacccacaacaggaagatggtgaccttcaagtttgacctggatggagacaaccctgaggagatcgccaccatcatggtgaacaatgacttcatcctggccatcgagcgggagagctttgtggaccaggtgcgggagatcatcgagaaggcagatgagatgctgtctgaagatgtgtctgtggagcctgagggggaccagggcctggagagcctgcagggcaaggatgattatggcttcagcggcagccagaagctggagggggagttcaagcagcccatcccagccagctccatgccccagcagatcggcatccccaccagcagcctgacccaggtggtgcacagcgctggaagacgcttcatcgtgtcccctgtgcctgagagccggctgcgggagagcaaggtgttccccagcgagatcacagacacagtggccgccagcacagcccagagccctggcatgaacctgagccacagcgccagcagcctgagcctgcagcaggccttcagcgagctgcggcgggcccagatgacagagggccccaacacagccccacccaacttcagccacacaggccccaccttccctgtggtgccccccttcctgagcagcattgctggggtgcccaccacagctgctgccacagcccctgtgcctgccaccagcagccccccaaatgacatcagcaccagcgtcatccagagcgaggtgacagtgcccacagaggagggcattgctggggtggccaccagcactggagtggtgaccagcggcggcctgcccatcccccctgtgtctgagagccctgtgctgagctctgtggtgagcagcatcaccatcccagctgtggtgtccatcagcaccaccagccccagcctgcaggtgcccaccagcaccagcgagatcgtggtgagcagcacagccctgtaccccagcgtgacagtgtctgccaccagcgccagcgctgggggcagcacagccaccccaggccccaagcccccagctgtggtgtcccagcaggccgccggcagcaccaccgtgggcgccaccctgacctctgtgtccaccaccaccagcttccccagcacagccagccagctgtgcatccagctgagcagcagcaccagcacccccaccctggccgagaccgtggtggtgtctgcccacagcctggacaagaccagccacagcagcaccaccggcctggccttcagcctgagcgcccccagcagcagcagcagccctggggccggcgtgagcagctacatcagccagcccggcggcctgcaccccctggtgatccccagcgtgattgccagcacccccatcctgccccaggccgccggccccaccagcacccccctgctgccccaggtgcccagcatcccccccctggtgcagcctgtggccaacgtgcctgctgtgcagcagaccctcatccacagccagccccagcctgccctgctgcccaaccagccccacacccactgcccagaggtggacagcgacacccagcccaaggcccctggcattgatgacatcaagaccctggaggagaagctgcggagcctcttcagcgagcacagcagcagcggggcccagcacgcctctgtgtccctggagaccagcctggtgattgagagcacagtgaccccaggcatccccaccacagctgtggcccccagcaagctgctgaccagcaccaccagcacctgcctgccccccaccaacctgcccctgggcaccgtggccctgcctgtgacccctgtggtgaccccaggccaggtgtccacccctgtgtccaccaccaccagcggcgtgaagccaggcacagcccccagcaagccacccctgaccaaggcccctgtgctgcctgtgggcacagagctgcctgctggcaccctgcccagcgagcagctgccccccttccctggccccagcctgacccagagccagcagcccctggaggacctggatgcccagctgcggaggaccctgagccctgagatgatcaccgtgaccagcgctgtgggccctgtgtccatggccgcccccacagccatcacagaggccggcacccagccccagaaggtgtcccaggtgaaggagggccctgtgctggccaccagcagcggggccggggtcttcaagatgggccgcttccaggtgtctgtggccgcagatggagcccagaaggagggcaagaacaagtcagaagatgccaagtctgtgcactttgagagcagcaccagcgagagctctgtgctgagcagcagcagccctgagagcaccctggtgaagccagagcccaacggcatcaccatccctggcatcagcagtgatgtgcctgagagcgcccacaagaccacagccagcgaggccaagagtgacaccggccagcccaccaaggtgggccgcttccaggtgaccaccacagccaacaaggtgggccgcttctctgtgtccaagacagaggacaagatcacagacaccaagaaggagggccctgtggccagcccccccttcatggacctggagcaggccgtgctgcctgctgtgatccccaagaaggagaagccagagctgtctgagcccagccacctgaatggccccagcagtgaccctgaggccgccttcctgagcagagatgtggatgatggcagcggcagcccccacagcccccaccagctgagcagcaagagcctgcccagccagaacctgagccagagcctgagcaacagcttcaacagcagctacatgagcagtgacaatgaaagtgacattgaagatgaggacctgaagctggagctgcggcggctgcgggacaagcacctgaaggagatccaggacctgcagagccggcagaagcatgaaattgagagcctgtacaccaagctgggcaaggtgcccccagctgtgatcatccccccagctgcccccctgtctggaagaagaagaagacccaccaagagcaagggcagcaagagcagccgcagcagcagcctgggcaacaagagcccccagctgagcggcaacctgagcggccagagcgctgcctctgtgctgcacccccagcagaccctgcaccccccaggcaacatccctgagagcggccagaaccagctgctgcagcccctgaagcccagccccagcagtgacaacctgtacagcgccttcaccagtgatggagccatctctgtgcccagcctgagcgcccctggccagggcaccagcagcaccaacacagtgggcgccaccgtgaacagccaggccgcccaggcccagcccccagccatgaccagcagcaggaagggcaccttcacagatgacctgcacaagctggtggacaactgggccagagatgccatgaacctgtctggaagaagaggcagcaagggccacatgaactatgagggccctggcatggccaggaagttcagcgcccctggccagctgtgcatctccatgaccagcaacctgggcggcagcgcccccatctctgctgccagcgccaccagcctgggccacttcaccaagtccatgtgccccccccagcagtatggcttccctgccaccccatttggagcccagtggagcggcaccggcggccctgccccccagcccctgggccagttccagcctgtgggcacagccagcctgcagaacttcaacatcagcaacctgcagaagagcatcagcaaccccccaggcagcaacctgcggaccacctag

SEQ ID NO: 176103 - DNA, 975 bp, Artificial Sequence
  Description of Artificial Sequence: Synthetic coding sequence
atgagcagtgacaatgaaagtgacattgaagatgaggacctgaagctggagctgcggcggctgcgggacaagcacctgaaggagatccaggacctgcagagccggcagaagcatgaaattgagagcctgtacaccaagctgggcaaggtgcccccagctgtgatcatccccccagctgcccccctgtctggaagaagaagaagacccaccaagagcaagggcagcaagagcagccgcagcagcagcctgggcaacaagagcccccagctgagcggcaacctgagcggccagagcgctgcctctgtgctgcacccccagcagaccctgcaccccccaggcaacatccctgagagcggccagaaccagctgctgcagcccctgaagcccagccccagcagtgacaacctgtacagcgccttcaccagtgatggagccatctctgtgcccagcctgagcgcccctggccagggcaccagcagcaccaacacagtgggcgccaccgtgaacagccaggccgcccaggcccagcccccagccatgaccagcagcaggaagggcaccttcacagatgacctgcacaagctggtggacaactgggccagagatgccatgaacctgtctggaagaagaggcagcaagggccacatgaactatgagggccctggcatggccaggaagttcagcgcccctggccagctgtgcatctccatgaccagcaacctgggcggcagcgcccccatctctgctgccagcgccaccagcctgggccacttcaccaagtccatgtgccccccccagcagtatggcttccctgccaccccatttggagcccagtggagcggcaccggcggccctgccccccagcccctgggccagttccagcctgtgggcacagccagcctgcagaacttcaacatcagcaacctgcagaagagcatcagcaaccccccaggcagcaacctgcggaccacctag

SEQ ID NO: 176104 - DNA, 7929 bp, Artificial Sequence
  Description of Artificial Sequence: Synthetic coding sequence
atgtctgggggcgctgctgagaagcagagcagcaccccaggcagcctcttcctgagccccccagccccagcccccaagaatggcagcagcagtgacagctctgtgggggagaagctgggcgctgctgctgctgatgctgtgacaggccgcacagaggagtacagaagaagaagacacaccatggacaaggacagcagaggagctgctgccaccaccaccaccacagagcaccgcttcttcagaagaagtgtcatctgtgacagcaatgccacagccctggagctgcccggcctgcccctgagcctgccccagcccagcatcccagctgctgtgccccagagcgcccctcctgagccccaccgggaggagaccgtgacagccacagccaccagccaggtggcccagcagcccccagctgctgctgcccctggagagcaggccgtggccggccctgcccccagcacagtgcccagcagcaccagcaaggacaggcctgtgtcccagcccagcctggtgggcagcaaggaggagcccccaccagcccggagcggcagcggcggcggcagcgccaaggagccccaggaggagaggagccagcagcaggatgacatcgaggagctggagaccaaggctgtgggcatgagcaatgatggccgcttcctgaagtttgatattgaaattggccggggcagcttcaagacagtgtacaagggcctggacacagagaccaccgtggaggtggcctggtgtgagctgcaggacaggaagctgaccaagtctgagcggcagcgcttcaaggaggaggccgagatgctgaagggcctgcagcaccccaacatcgtgcgcttctatgacagctgggagagcacagtgaagggcaagaagtgcatcgtgctggtgacagagctgatgaccagcggcaccctgaagacctacctgaagcgcttcaaggtgatgaagatcaaggtgctgcgctcctggtgccggcagatcctgaagggcctgcagttcctgcacaccaggaccccacccatcatccaccgggacctgaagtgtgacaacatcttcatcaccggccccactggatctgtgaagatcggggacctgggcctggccaccctgaagagggccagctttgccaagagcgtcatcggcaccccagagttcatggcccctgagatgtatgaggagaagtatgatgagagcgtggatgtgtatgccttcggcatgtgcatgctggagatggccaccagcgagtacccctacagcgagtgccagaatgctgcccagatctacagaagagtgaccagcggcgtgaagccagccagctttgacaaggtggccatccctgaggtgaaggagatcatcgagggctgcatccggcagaacaaggatgagcgctacagcatcaaggacctgctgaaccacgccttcttccaggaggagactggagtgcgggtggagctggccgaggaggatgatggagagaagatcgccatcaagctgtggctgagaattgaggacatcaagaagctgaagggcaagtacaaggacaatgaggccatcgagttctcctttgacctggagagagatgtgcctgaagatgtggcccaggagatggtggagagcggctacgtgtgtgagggggaccacaagaccatggccaaggccatcaaggacagagtgtccctcatcaagaggaagcgggagcagaggcagctggtgcgggaggagcaggagaagaagaagcaggaggagagcagcctgaagcagcaggtggagcagagcagcgccagccagacaggcatcaagcagctgcccagcgccagcacaggcatccccacagccagcaccaccagcgcctctgtgtccacccaggtggagcctgaggagcctgaggccgaccagcaccagcagctgcagtaccagcagcccagcatctctgtgctgagtgatggcaccgtggacagcggccagggcagcagcgtcttcacagagagccgggtgagcagccagcagacagtgtcctatggcagccagcacgagcaggcccacagcactggaacagtgcccggccacatccccagcacagtgcaggcccagagccagccccatggagtgtacccacccagctctgtgccccagagcatggcccacccctgtggcggcacccccacctacccagagagccagatcttcttccccaccatccacgagaggcctgtgtccttcagccccccacccacctgcccccccaaggtggccatcagccagaggaggaagagcaccagcttcctggaggcccagacccaccacttccagcccctgctgaggacagtgggccagagcctgctgcccccaggcggcagccccaccaactggaccccagaggccgtggtgatgctgggcaccacagccagccgggtgactggagagagctgtgagatccaggtgcaccccatgtttgagcccagccaggtgtacagcgactacagacctggcctggtgctgcctgaggaggcccactacttcatcccccaggaggccgtgtatgtggccggcgtgcactaccaggcccgggtggccgagcagtatgagggcatcccctacaacagctctgtgctgagcagccccatgaagcagatccctgagcagaagcctgtgcagggcggccccaccagcagctctgtgtttgagttccccagcggccaggccttcctggtgggccacctgcagaacctgcggctggacagcggcctgggccctggcagccccctgagcagcatcagcgcccccatcagcacagatgccacccggctgaagttccaccctgtgtttgtgccccacagcgccccagctgtgctgacccacaacaatgaaagccgcagcaactgtgtgtttgagttccacgtgcacacccccagcagcagcagcggggagggcggcggcatcctgccccagagggtgtacagaaaccggcaggtggccgtggacctgaaccaggaggagctgcccccccagagcgtgggcctgcacggctacctgcagcctgtgacagaggagaagcacaactaccacgcccctgagctgactgtgtctgtggtggagcccatcggccagaactggcccatcggcagccctgagtacagcagtgacagcagccagatcaccagcagtgaccccagcgacttccagagccccccacccaccggcggggccgccgccccctttggaagtgatgtgtccatgcccttcatccacctgccccagacagtgctgcaggagagccccctcttcttctgcttcccccagggcaccaccagccagcaggtgctgacagccagcttcagcagcggcggcagcgccctgcacccccaggcccagggccagagccagggccagcccagcagcagcagcctgactggagtgagcagcagccagcccatccagcacccccagcagcagcagggcatccagcagacagccccaccccagcagacagtgcagtacagcctgagccagaccagcaccagcagcgaggccaccacagcccagcctgtgtcccagccccaggccccccaggtgctgccccaggtgtctgctgggaagcagggcttccccccccggctgcccccccagtacccaggggacagcaacatcgcccccagcagcaatgtggcctctgtgtgcatccacagcacagtgctgagcccccccatgcccacagaggtgctggccaccccaggctacttccccaccgtggtgcagccctacgtggagagcaacctgctggtgcccatgggcggcgtgggcggccaggtgcaggtgtcccagcccggcggcagcctggcccaggcccccaccaccagcagccagcaggccgtgctggagagcacccagggcgtgtcccaggtggccccagctgagcctgtggccgtggcccagacccaggccacccagcccaccaccctggccagctctgtggacagcgcccacagtgatgtggccagcggcatgtctgatggaaatgaaaatgtgcccagcagcagcggcagacatgagggccgcaccaccaagaggcactacaggaagtctgtgcgcagccgcagcagacatgagaagaccagccggcccaagctgcgcatcctgaatgtgagcaacaagggggacagagtggtggagtgccagctggagacccacaacaggaagatggtgaccttcaagtttgacctggatggagacaaccctgaggagatcgccaccatcatggtgaacaatgacttcatcctggccatcgagcgggagagctttgtggaccaggtgcgggagatcatcgagaaggcagatgagatgctgtctgaagatgtgtctgtggagcctgagggggaccagggcctggagagcctgcagggcaaggatgattatggcttcagcggcagccagaagctggagggggagttcaagcagcccatcccagccagctccatgccccagcagatcggcatccccaccagcagcctgacccaggtggtgcacagcgctggccgccgcttcatcgtgtcccctgtgcctgagagccggctgcgggagagcaaggtgttccccagcgagatcacagacacagtggccgccagcacagcccagagccctggcatgaacctgagccacagcgccagcagcctgagcctgcagcaggccttcagcgagctgcggcgggcccagatgacagagggccccaacacagccccacccaacttcagccacacaggccccaccttccctgtggtgccccccttcctgagcagcattgctggggtgcccaccacagctgctgccacagcccctgtgcctgccaccagcagccccccaaatgacatcagcaccagcgtcatccagagcgaggtgacagtgcccacagaggagggcattgctggggtggccaccagcactggagtggtgaccagcggcggcctgcccatcccccctgtgtctgagagccctgtgctgagctctgtggtgagcagcatcaccatcccagctgtggtgtccatcagcaccaccagccccagcctgcaggtgcccaccagcaccagcgagatcgtggtgagcagcacagccctgtaccccagcgtgacagtgtctgccaccagcgccagcgctgggggcagcacagccaccccaggccccaagcccccagctgtggtgtcccagcaggccgccggcagcaccaccgtgggcgccaccctgacctctgtgtccaccaccaccagcttccccagcacagccagccagctgtgcatccagctgagcagcagcaccagcacccccaccctggccgagaccgtggtggtgtctgcccacagcctggacaagaccagccacagcagcaccaccggcctggccttcagcctgagcgcccccagcagcagcagcagccctggagctggggtgtcctcctacatcagccagcccggcggcctgcaccccctggtgatccccagcgtcatcgccagcacccccatcctgccccaggccgccggccccaccagcacccccctgctgccccaggtgcccagcatcccccccctggtgcagcctgtggccaacgtgcctgctgtgcagcagaccctcatccacagccagccccagcctgccctgctgcccaaccagccccacacccactgcccagaggtggacagcgacacccagcccaaggcccctggcattgatgacatcaagaccctggaggagaagctgcggagcctcttcagcgagcacagcagcagcggggcccagcacgcctctgtgtccctggagaccagcctggtgattgagagcacagtgaccccaggcatccccaccacagctgtggcccccagcaagctgctgaccagcaccaccagcacctgcctgccccccaccaacctgcccctgggcaccgtggccctgcctgtgacccctgtggtgaccccaggccaggtgtccacccctgtgtccaccaccaccagcggcgtgaagccaggcacagcccccagcaagccacccctgaccaaggcccctgtgctgcctgtgggcacagagctgcctgctggcaccctgcccagcgagcagctgccccccttccctggccccagcctgacccagagccagcagcccctggaggacctggatgcccagctgcggaggaccctgagccctgagatgatcaccgtgaccagcgctgtgggccctgtgtccatggccgcccccacagccatcacagaagctggcacccagccccagaagggcgtgtcccaggtgaaggagggccctgtgctggccaccagcagcggggccggggtcttcaagatgggccgcttccaggtgtctgtggccgcagatggagcccagaaggagggcaagaacaagtcagaagatgccaagtctgtgcactttgagagcagcaccagcgagagctctgtgctgagcagcagcagccctgagagcaccctggtgaagccagagcccaacggcatcaccatccctggcatcagcagtgatgtgcctgagagcgcccacaagaccacagccagcgaggccaagagtgacaccggccagcccaccaaggtgggccgcttccaggtgaccaccacagccaacaaggtgggccgcttctctgtgtccaagacagaggacaagatcacagacaccaagaaggagggccctgtggccagcccccccttcatggacctggagcaggccgtgctgcctgctgtgatccccaagaaggagaagccagagctgtctgagcccagccacctgaatggccccagcagtgaccctgaggccgccttcctgagcagagatgtggatgatggcagcggcagcccccacagcccccaccagctgagcagcaagagcctgcccagccagaacctgagccagagcctgagcaacagcttcaacagcagctacatgagcagtgacaatgaaagtgacattgaagatgaggacctgaagctggagctgcggcggctgcgggacaagcacctgaaggagatccaggacctgcagagccggcagaagcatgaaattgagagcctgtacaccaagctgggcaaggtgcccccagctgtgatcatccccccagctgcccccctgtctggaagaagaagaagacccaccaagagcaagggcagcaagagcagccgcagcagcagcctgggcaacaagagcccccagctgagcggcaacctgagcggccagagcgctgcctctgtgctgcacccccagcagaccctgcaccccccaggcaacatccctgagagcggccagaaccagctgctgcagcccctgaagcccagccccagcagtgacaacctgtacagcgccttcaccagtgatggagccatctctgtgcccagcctgagcgcccctggccagggcaccagcagcaccaacacagtgggcgccaccgtgaacagccaggccgcccaggcccagcccccagccatgaccagcagcaggaagggcaccttcacagatgacctgcacaagctggtggacaactgggccagagatgccatgaacctgtctggaagaagaggcagcaagggccacatgaactatgagggccctggcatggccaggaagttcagcgcccctggccagctgtgcatctccatgaccagcaacctgggcggcagcgcccccatctctgctgccagcgccaccagcctgggccacttcaccaagtccatgtgccccccccagcagtatggcttccctgccaccccatttggagcccagtggagcggcaccggcggccctgccccccagcccctgggccagttccagcctgtgggcacagccagcctgcagaacttcaacatcagcaacctgcagaagagcatcagcaaccccccaggcagcaacctgcggaccacctag

SEQ ID NO: 176105 - DNA, 6894 bp, Artificial Sequence
  Description of Artificial Sequence: Synthetic coding sequence
atggatggagatggcggcagaagagatgtgcccggcaccctgatggagcccggcagaggagctggccctgctggcatggccgagccccgggccaaggccgcccggcccggcccccagcgcttcctgcggcgctctgtggtggagagtgaccaggaggagcccccaggcctggaggccgctgaggcccctggcccccagcccccccagcccctgcagaggagagtgctgctgctgtgcaagacccggcggctgattgctgagcgggcccggggccggcctgctgccccagccccagctgccctggtggcccagcccggggcccctggggccccagcagatgctggccctgagcctgtgggcacccaggagcccggccctgaccccatcgctgctgctgtggagacagccccagccccagatggcggcccccgggaggaggccgccgccaccgtgaggaaggaggatgaaggagctgctgaggccaagccagagcccggccgcaccaggagagatgagcctgaggaggaggaggatgatgaagatgacctgaaggctgtggccaccagcctggatggccgcttcctgaagtttgatattgagctgggccggggcagcttcaagacagtgtacaagggcctggacacagagacctgggtggaggtggcctggtgtgagctgcaggacaggaagctgaccaagctggagcggcagcgcttcaaggaggaggccgagatgctgaagggcctgcagcaccccaacatcgtgcgcttctatgacttctgggagagcagcgccaagggcaagcgctgcatcgtgctggtgacagagctgatgaccagcggcaccctgaagacctacctgaagcgcttcaaggtgatgaagcccaaggtgctgcgctcctggtgccggcagatcctgaagggcctgctcttcctgcacaccaggaccccacccatcatccaccgggacctgaagtgtgacaacatcttcatcaccggccccactggatctgtgaagatcggggacctgggcctggccaccctgaagagggccagctttgccaagagcgtcatcggcaccccagagttcatggcccctgagatgtatgaggagcactatgatgagagcgtggatgtgtatgccttcggcatgtgcatgctggagatggccaccagcgagtacccctacagcgagtgccagaatgctgcccagatctacaggaaggtgacctgtggcatcaagccagccagctttgagaaggtgcatgaccctgagatcaaggagatcatcggggagtgcatctgcaagaacaaggaggagagatatgagatcaaggacctgctgagccacgccttctttgctgaagatactggagtgcgggtggagctggccgaggaggaccacggcaggaagagcaccatcgccctgcggctgtgggtggaggaccccaagaagctgaagggcaagcccaaggacaatggagccatcgagttcacctttgacctggagaaggagaccccagatgaggtggcccaggagatgattgaaagtggcttcttccatgaaagtgatgtgaagatcgtggccaagagcatccgggacagagtggccctgatccagtggaggcgggagcgcatctggccagccctgcagcccaaggagcagcaggatgtgggcagcccagacaaggcccggggcccccctgtgcccctgcaggtgcaggtgacctaccacgcccaggccggccagcccggccccccagagcctgaggagcctgaggccgaccagcacctgctgccccccaccctgcccaccagcgccaccagcctggccagtgacagcacctttgacagcggccagggcagcacagtgtacagcgacagccagagcagccagcagagcgtgatgctgggcagcctggctgatgctgcccccagccctgcccagtgtgtgtgcagcccccctgtgtctgagggccctgtgctgccccagagcctgcccagcctgggcgcctaccagcagcccacagctgcccctggcctgcctgtgggctctgtgcctgccccagcctgcccccccagcctgcagcagcacttcccagaccctgccatgagctttgcccctgtgctgcccccacccagcacccccatgcccactggacctggccagcctgcccctcctggccagcagcccccacccctggcccagcccacccccctgccccaggtgctggccccccagcctgtggtgcccctgcagcctgtgcccccccacctgcccccctacctggccccagccagccaggtgggcgccccagcccagctgaagcccctgcagatgccccaggcccccctgcagcccctggcccaggtgcccccccagatgccacccatccctgtggtgccccccatcacccccctggccggcattgatggcctgcccccagccctgcctgacctgcccacagccaccgtgccccctgtgcccccaccccagtacttcagccctgctgtgatcctgcccagcctggccgcccccctgcccccagccagccctgccctgcccctgcaggccgtgaagctgccccaccccccaggggcccccctggccatgccctgcaggaccatcgtgcccaatgccccagccaccatccccctgctggccgtggcccctcctggggtggccgccctgagcatccacagcgctgtggcccagctgcccggccagcctgtgtacccagctgccttcccccagatggcccccacagatgtgccccccagcccccaccacacagtgcagaacatgagggccaccccaccccagcctgccctgcccccccagcccaccctgcccccccagcctgtgctgcccccccagcccaccctgcccccccagcctgtgctgcccccccagcccaccaggcctccccagcctgtgctgcccccccagcccatgctgcccccccagcctgtgctgcccccccagcctgccctgcctgtgcggcctgagcccctgcagccccacctgcctgagcaggccgccccagctgccaccccaggcagccagatcctgctgggccacccagccccctatgctgtggatgtggccgcccaggtgcccaccgtgcctgtgcccccagctgctgtgctgagcccccccctgcctgaggtgctgctgcctgctgcccctgagctgctgccccagttccccagcagcctggccaccgtgtctgcctctgtgcagagcgtgcccacccagacagccaccctgctgcccccagccaacccccccctgcccggcggccctggcatcgccagcccctgccccaccgtgcagctgactgtggagcctgtgcaggaggagcaggccagccaggacaagcccccaggcctgccccagagctgtgagagctatggaggcagtgatgtgaccagcggcaaggagctgagtgacagctgtgagggcgcctttggaggcggccgcctggagggccgggccgccaggaagcaccaccggcgcagcacccgggcccggagccggcaggagcgggccagccggccccggctgaccatcctgaatgtgtgcaacacaggagacaagatggtggagtgccagctggagacccacaaccacaagatggtgaccttcaagtttgacctggatggagatgccccagatgagatcgccacctacatggtggagcatgacttcatcctgcaggccgagcgggagaccttcatcgagcagatgaaggatgtgatggacaaggccgaggacatgctgtctgaggacacagatgctgaccggggcagtgaccccggcaccagccccccccacctgagcacctgtggcctgggcactggagaggagagccggcagagccaggccaatgcccctgtgtaccagcagaatgtgctgcacacaggcaagcgctggttcatcatctgccctgtggccgagcacccagcccctgaggcccctgagagcagcccccccctgcccctgagcagcctgcccccagaggccagccagggcccctgccggggcctgaccctgccctgcctgccctggaggcgggccgcctgtggggctgtgttcctgagcctcttctctgctgagagcgcccagagcaagcagcccccagattctgccccctacaaggaccagctgagcagcaaggagcagcccagcttcctggccagccagcagctgctgagccaggccggccccagcaaccccccaggggcccccccagcccccctggcccccagcagcccccctgtgacagccctgccccaggatggagctgccccagccaccagcaccatgcctgagcccgccagcggcacagccagccaggccggcggccctggcaccccccagggcctgaccagcgagctggagaccagccagcccctggccgagacccatgaggcccccctggccgtgcagcccctggtggtgggcctggccccctgcaccccagcccctgaggccgccagcaccagagatgccagcgccccccgggagcccctgcccccaccagcccctgagcccagcccccacagcggcaccccccagcctgccctgggccagcctgcccccctgctgcctgctgctgtgggcgctgtgtccctggccaccagccagctgcccagcccccccctgggccccaccgtgcccccccagccccccagcgccctggagagtgatggagagggccccccaccccgggtgggctttgtggacagcaccatcaagagcctggatgagaagctgcggaccctgctgtaccaggagcacgtgcccaccagcagcgccagcgctggcacccctgtggaggtgggggaccgggacttcaccctggagcccctgcggggggaccagcccaggtctgaggtgtgtggcggggacctggccctgccccctgtgcccaaggaggccgtgtctggccgggtgcagctgccccagcccctggtggagaagtctgagctggcccccaccagaggagctgtgatggagcagggcaccagcagctccatgacagctgagagcagccccaggtccatgctgggctatgacagagatggccggcaggtggccagtgacagccacgtggtgcccagcgtgccccaggatgtgcctgcctttgtgcggcctgcccgggtggagcccacagacagagatggaggagaggccggggagagcagcgctgagcccccacccagcgacatgggcaccgtgggcggccaggccagccacccccagaccctgggcgcccgggccctgggcagccccaggaagaggcctgagcagcaggatgtgagcagccctgccaagacagtgggccgcttctctgtggtgtccacccaggatgagtggaccctggccagcccccacagcctgcgctacagcgcccccccagatgtgtacctggatgaggcccccagcagcccagatgtgaagctggccgtgcggcgggcccagacagccagcagcattgaggtgggcgtgggggagcctgtgtccagtgacagcggagatgagggcccccgggcccggccccctgtgcagaagcaggccagcctgcctgtgtctggctctgtggccggggactttgtgaagaaggccacagccttcctgcagaggcccagcagagctggcagcctgggccctgagacccccagccgggtgggcatgaaggtgcccaccatctctgtgaccagcttccacagccagagcagctacatcagcagtgacaatgattctgagctggaggatgctgacatcaagaaggagctgcagagcctgcgggagaagcacctgaaggagatcagcgagctgcagagccagcagaagcaggagattgaggccctgtacagaaggctgggcaagcccctgccccccaacgtgggcttcttccacacagccccacccaccggcagaagaaggaagaccagcaagagcaagctgaaggccggcaagctgctgaaccccctggtgcggcagctgaaggtggtggccagcagcacaggccacctggccgacagcagccggggccccccagccaaggaccctgcccaggcctctgtgggcctgacagctgacagcacaggcctgagcggcaaggctgtgcagacccagcagccctgcagcgtgcgggccagcctgagcagtgacatctgcagcggcctggccagtgatggcggcggggcccggggccagggctggacagtgtaccaccccaccagcgagcgggtgacctacaagagcagcagcaagccccgggcccgcttcctgagcggccctgtgtctgtgtccatctggagcgccctgaagaggctgtgcctgggcaaggagcacagcagccgcagcagcaccagcagcctggcccctggccctgagcccggcccccagcctgccctgcacgtgcaggcccaggtgaacaacagcaacaacaagaagggcaccttcacagatgacctgcacaagctggtggatgagtggaccagcaagacagtgggcgccgcccagctgaagcccaccctgaaccagctgaagcagacccagaagctgcaggacatggaggcccaggccggctgggccgcccctggagaggcccgggccatgacagcccccagggctggggtgggcatgccccggctgcccccagcccctggccccctgagcaccaccgtcatccctggagctgcccccaccctgtctgtgcccaccccagatggagccctgggcacagcccggaggaaccaggtgtggtttggcctgcgggtgcccccaacagcctgctgcggccacagcacccagccccggggcggccagagggtgggcagcaagacagccagctttgctgccagtgaccctgtgcgctcctag

SEQ ID NO: 176106 - DNA, 5601 bp, Artificial Sequence
  Description of Artificial Sequence: Synthetic coding sequence
atggccaccagcgagtacccctacagcgagtgccagaatgctgcccagatctacaggaaggtgacctgtggcatcaagccagccagctttgagaaggtgcatgaccctgagatcaaggagatcatcggggagtgcatctgcaagaacaaggaggagagatatgagatcaaggacctgctgagccacgccttctttgctgaagatactggagtgcgggtggagctggccgaggaggaccacggcaggaagagcaccatcgccctgcggctgtgggtggaggaccccaagaagctgaagggcaagcccaaggacaatggagccatcgagttcacctttgacctggagaaggagaccccagatgaggtggcccaggagatgattgaaagtggcttcttccatgaaagtgatgtgaagatcgtggccaagagcatccgggacagagtggccctgatccagtggaggcgggagcgcatctggccagccctgcagcccaaggagcagcaggatgtgggcagcccagacaaggcccggggcccccctgtgcccctgcaggtgcaggtgacctaccacgcccaggccggccagcccggccccccagagcctgaggagcctgaggccgaccagcacctgctgccccccaccctgcccaccagcgccaccagcctggccagtgacagcacctttgacagcggccagggcagcacagtgtacagcgacagccagagcagccagcagagcgtgatgctgggcagcctggctgatgctgcccccagccctgcccagtgtgtgtgcagcccccctgtgtctgagggccctgtgctgccccagagcctgcccagcctgggcgcctaccagcagcccacagctgcccctggcctgcctgtgggctctgtgcctgccccagcctgcccccccagcctgcagcagcacttcccagaccctgccatgagctttgcccctgtgctgcccccacccagcacccccatgcccactggacctggccagcctgcccctcctggccagcagcccccacccctggcccagcccacccccctgccccaggtgctggccccccagcctgtggtgcccctgcagcctgtgcccccccacctgcccccctacctggccccagccagccaggtgggcgccccagcccagctgaagcccctgcagatgccccaggcccccctgcagcccctggcccaggtgcccccccagatgccacccatccctgtggtgccccccatcacccccctggccggcattgatggcctgcccccagccctgcctgacctgcccacagccaccgtgccccctgtgcccccaccccagtacttcagccctgctgtgatcctgcccagcctggccgcccccctgcccccagccagccctgccctgcccctgcaggccgtgaagctgccccaccccccaggggcccccctggccatgccctgcaggaccatcgtgcccaatgccccagccaccatccccctgctggccgtggcccctcctggggtggccgccctgagcatccacagcgctgtggcccagctgcccggccagcctgtgtacccagctgccttcccccagatggcccccacagatgtgccccccagcccccaccacacagtgcagaacatgagggccaccccaccccagcctgccctgcccccccagcccaccctgcccccccagcctgtgctgcccccccagcccaccctgcccccccagcctgtgctgcccccccagcccaccaggcctccccagcctgtgctgcccccccagcccatgctgcccccccagcctgtgctgcccccccagcctgccctgcctgtgcggcctgagcccctgcagccccacctgcctgagcaggccgccccagctgccaccccaggcagccagatcctgctgggccacccagccccctatgctgtggatgtggccgcccaggtgcccaccgtgcctgtgcccccagctgctgtgctgagcccccccctgcctgaggtgctgctgcctgctgcccctgagctgctgccccagttccccagcagcctggccaccgtgtctgcctctgtgcagagcgtgcccacccagacagccaccctgctgcccccagccaacccccccctgcccggcggccctggcatcgccagcccctgccccaccgtgcagctgactgtggagcctgtgcaggaggagcaggccagccaggacaagcccccaggcctgccccagagctgtgagagctatggaggcagtgatgtgaccagcggcaaggagctgagtgacagctgtgagggcgcctttggaggcggccgcctggagggccgggccgccaggaagcaccaccggcgcagcacccgggcccggagccggcaggagcgggccagccggccccggctgaccatcctgaatgtgtgcaacacaggagacaagatggtggagtgccagctggagacccacaaccacaagatggtgaccttcaagtttgacctggatggagatgccccagatgagatcgccacctacatggtggagcatgacttcatcctgcaggccgagcgggagaccttcatcgagcagatgaaggatgtgatggacaaggccgaggacatgctgtctgaggacacagatgctgaccggggcagtgaccccggcaccagccccccccacctgagcacctgtggcctgggcactggagaggagagccggcagagccaggccaatgcccctgtgtaccagcagaatgtgctgcacacaggcaagcgctggttcatcatctgccctgtggccgagcacccagcccctgaggcccctgagagcagcccccccctgcccctgagcagcctgcccccagaggccagccagggcccctgccggggcctgaccctgccctgcctgccctggaggcgggccgcctgtggggctgtgttcctgagcctcttctctgctgagagcgcccagagcaagcagcccccagattctgccccctacaaggaccagctgagcagcaaggagcagcccagcttcctggccagccagcagctgctgagccaggccggccccagcaaccccccaggggcccccccagcccccctggcccccagcagcccccctgtgacagccctgccccaggatggagctgccccagccaccagcaccatgcctgagcccgccagcggcacagccagccaggccggcggccctggcaccccccagggcctgaccagcgagctggagaccagccagcccctggccgagacccatgaggcccccctggccgtgcagcccctggtggtgggcctggccccctgcaccccagcccctgaggccgccagcaccagagatgccagcgccccccgggagcccctgcccccaccagcccctgagcccagcccccacagcggcaccccccagcctgccctgggccagcctgcccccctgctgcctgctgctgtgggcgctgtgtccctggccaccagccagctgcccagcccccccctgggccccaccgtgcccccccagccccccagcgccctggagagtgatggagagggccccccaccccgggtgggctttgtggacagcaccatcaagagcctggatgagaagctgcggaccctgctgtaccaggagcacgtgcccaccagcagcgccagcgctggcacccctgtggaggtgggggaccgggacttcaccctggagcccctgcggggggaccagcccaggtctgaggtgtgtggcggggacctggccctgccccctgtgcccaaggaggccgtgtctggccgggtgcagctgccccagcccctggtggagaagtctgagctggcccccaccagaggagctgtgatggagcagggcaccagcagctccatgacagctgagagcagccccaggtccatgctgggctatgacagagatggccggcaggtggccagtgacagccacgtggtgcccagcgtgccccaggatgtgcctgcctttgtgcggcctgcccgggtggagcccacagacagagatggaggagaggccggggagagcagcgctgagcccccacccagcgacatgggcaccgtgggcggccaggccagccacccccagaccctgggcgcccgggccctgggcagccccaggaagaggcctgagcagcaggatgtgagcagccctgccaagacagtgggccgcttctctgtggtgtccacccaggatgagtggaccctggccagcccccacagcctgcgctacagcgcccccccagatgtgtacctggatgaggcccccagcagcccagatgtgaagctggccgtgcggcgggcccagacagccagcagcattgaggtgggcgtgggggagcctgtgtccagtgacagcggagatgagggcccccgggcccggccccctgtgcagaagcaggccagcctgcctgtgtctggctctgtggccggggactttgtgaagaaggccacagccttcctgcagaggcccagcagagctggcagcctgggccctgagacccccagccgggtgggcatgaaggtgcccaccatctctgtgaccagcttccacagccagagcagctacatcagcagtgacaatgattctgagctggaggatgctgacatcaagaaggagctgcagagcctgcgggagaagcacctgaaggagatcagcgagctgcagagccagcagaagcaggagattgaggccctgtacagaaggctgggcaagcccctgccccccaacgtgggcttcttccacacagccccacccaccggcagaagaaggaagaccagcaagagcaagctgaaggccggcaagctgctgaaccccctggtgcggcagctgaaggtggtggccagcagcacaggccacctggccgacagcagccggggccccccagccaaggaccctgcccaggcctctgtgggcctgacagctgacagcacaggcctgagcggcaaggctgtgcagacccagcagccctgcagcgtgcgggccagcctgagcagtgacatctgcagcggcctggccagtgatggcggcggggcccggggccagggctggacagtgtaccaccccaccagcgagcgggtgacctacaagagcagcagcaagccccgggcccgcttcctgagcggccctgtgtctgtgtccatctggagcgccctgaagaggctgtgcctgggcaaggagcacagcagccgcagcagcaccagcagcctggcccctggccctgagcccggcccccagcctgccctgcacgtgcaggcccaggtgaacaacagcaacaacaagaagggcaccttcacagatgacctgcacaagctggtggatgagtggaccagcaagacagtgggcgccgcccagctgaagcccaccctgaaccagctgaagcagacccagaagctgcaggacatggaggcccaggccggctgggccgcccctggagaggcccgggccatgacagcccccagggctggggtgggcatgccccggctgcccccagcccctggccccctgagcaccaccgtcatccctggagctgcccccaccctgtctgtgcccaccccagaccctgagagcgagaagccagactag

SEQ ID NO: 176107 - DNA, 1092 bp, Artificial Sequence
  Description of Artificial Sequence: Synthetic coding sequence
atggagcagggcaccagcagctccatgacagagagcagccccaggtccatgctgggctatgacagagatggccggcaggtggccagtgacagccacgtggtgcccagcgtgccccaggatgtgcctgcctttgtgcggcctgcccgggtggagcccacagacagagatggaggagaggccggggagagcagcgctgagcccccacccagcgacatgggcaccgtgggcggccaggccagccacccccagaccctgggcgcccgggccctgggcagccccaggaagaggcctgagcagcaggatgtgagcagccctgccaagacagtgggccgcttctctgtggtgtccacccaggatgagtggaccctggccagcccccacagcctgcgctacagcgcccccccagatgtgtacctggatgaggcccccagcagcccagatgtgaagctggccgtgagaagagcccagacagccagcagcattgaggtgggcgtgggggagcctgtgtccagtgacagcggagatgagggcccccgggcccggccccctgtgcagaagcaggccagcctgcctgtgtctggctctgtggccggggactttgtgaagaaggccaccagctgccggggcctgctgggccccagcctgggccctgagacccccagccgggtgggcatgaaggtgcccaccatctctgtgaccagcttccacagccagagcagctacatcagcagtgacaatgacagcgagctggaggatgctgacatcaagaaggagctgcagagcctgcgggagaagcacctgaaggagatcagcgagctgcagagccagcagaagcaggagattgaggccctgtaccgccgcctgggcaagcccctgcccccaaatgtgggcttcttccacacagcccccccaactggaagaagaaggaagaccagcaagagcaagctgaaggccggcaagctgctgaaccccctggtgcggcagctgaaggtggtggccagcagcacaggccacctggccgacagcagccggggccccccagccaaggaccccaagcctgtgtggggcagcctgcagacagcccgggcctag

SEQ ID NO: 176108 - DNA, 2340 bp, Artificial Sequence
  Description of Artificial Sequence: Synthetic coding sequence
atggagcccggcagaggagctggccctgctggcatggccgagccccgggccaaggccgcccggcccggcccccagcgcttcctgcggcgctctgtggtggagagtgaccaggaggagcccccaggcctggaggccgctgaggcccctggcccccagcccccccagcccctgcagaggagagtgctgctgctgtgcaagacccggcggctgattgctgagcgggcccggggccggcctgctgccccagccccagctgccctggtggcccagcccggggcccctggggccccagcagatgctggccctgagcctgtgggcacccaggagcccggccctgaccccatcgctgctgctgtggagacagccccagccccagatggcggcccccgggaggaggccgccgccaccgtgaggaaggaggatgaaggagctgctgaggccaagccagagcccggccgcaccaggagagatgagcctgaggaggaggaggatgatgaagatgacctgaaggctgtggccaccagcctggatggccgcttcctgaagtttgatattgagctgggccggggcagcttcaagacagtgtacaagggcctggacacagagacctgggtggaggtggcctggtgtgagctgcaggacaggaagctgaccaagctggagcggcagcgcttcaaggaggaggccgagatgctgaagggcctgcagcaccccaacatcgtgcgcttctatgacttctgggagagcagcgccaagggcaagcgctgcatcgtgctggtgacagagctgatgaccagcggcaccctgaagacctacctgaagcgcttcaaggtgatgaagcccaaggtgctgcgctcctggtgccggcagatcctgaagggcctgctcttcctgcacaccaggaccccacccatcatccaccgggacctgaagtgtgacaacatcttcatcaccggccccactggatctgtgaagatcggggacctgggcctggccaccctgaagagggccagctttgccaagagcgtcatcggcaccccagagttcatggcccctgagatgtatgaggagcactatgatgagagcgtggatgtgtatgccttcggcatgtgcatgctggagatggccaccagcgagtacccctacagcgagtgccagaatgctgcccagatctacaggaaggtgacctgtggcatcaagccagccagctttgagaaggtgcatgaccctgagatcaaggagatcatcggggagtgcatctgcaagaacaaggaggagagatatgagatcaaggacctgctgagccacgccttctttgctgaagatactggagtgcgggtggagctggccgaggaggaccacggcaggaagagcaccatcgccctgcggctgtgggtggaggaccccaagaagctgaagggcaagcccaaggacaatggagccatcgagttcacctttgacctggagaaggagaccccagatgaggtggcccaggagatgattgaaagtggcttcttccatgaaagtgatgtgaagatcgtggccaagagcatccgggacagagtggccctgatccagtggaggcgggagcgcatctggccagccctgcagcccaaggagcagcaggatgtgggcagcccagacaaggcccggggcccccctgtgcccctgcaggtgcaggtgacctaccacgcccaggccggccagcccggccccccagagcctgaggagcctgaggccgaccagcacctgctgccccccaccctgcccaccagcgccaccagcctggccagtgacagcacctttgacagcggccagggcagcacagtgtacagcgacagccagagcagccagcagagcgtgatgctgggcagcctggctgatgctgcccccagccctgcccagtgtgtgtgcagcccccctgtgtctgagggccctgtgctgccccagagcctgcccagcctgggcgcctaccagcagcccacagctgcccccccacccctggcccagcccacccccctgccccaggtgctggccccccagcctgtggtgcccctgcagcctgtgcccccccacctgcccccctacctggccccagccagccaggtgggcgccccagcccagctgaagcccctgcagatgccccaggcccccctgcagcccctggcccaggtgcccccccagatgccacccatccctgtggtgccccccatcacccccctggccggcattgatggcctgcccccagccctgcctgacctgcccacagccaccgtgccccctgtgcccccaccccagtacttcagccctgctgtgatcctgcccagcctggccgcctag

SEQ ID NO: 176109 - DNA, 6654 bp, Artificial Sequence
  Description of Artificial Sequence: Synthetic coding sequence
atggatggagatggcggcagaagagatgtgcccggcaccctgatggagcccggcagaggagctggccctgctggcatggccgagccccgggccaaggccgcccggcccggcccccagcgcttcctgcggcgctctgtggtggagagtgaccaggaggagcccccaggcctggaggccgctgaggcccctggcccccagcccccccagcccctgcagaggagagtgctgctgctgtgcaagacccggcggctgattgctgagcgggcccggggccggcctgctgccccagccccagctgccctggtggcccagcccggggcccctggggccccagcagatgctggccctgagcctgtgggcacccaggagcccggccctgaccccatcgctgctgctgtggagacagccccagccccagatggcggcccccgggaggaggccgccgccaccgtgaggaaggaggatgaaggagctgctgaggccaagccagagcccggccgcaccaggagagatgagcctgaggaggaggaggatgatgaagatgacctgaaggctgtggccaccagcctggatggccgcttcctgaagtttgatattgagctgggccggggcagcttcaagacagtgtacaagggcctggacacagagacctgggtggaggtggcctggtgtgagctgcaggacaggaagctgaccaagctggagcggcagcgcttcaaggaggaggccgagatgctgaagggcctgcagcaccccaacatcgtgcgcttctatgacttctgggagagcagcgccaagggcaagcgctgcatcgtgctggtgacagagctgatgaccagcggcaccctgaagacctacctgaagcgcttcaaggtgatgaagcccaaggtgctgcgctcctggtgccggcagatcctgaagggcctgctcttcctgcacaccaggaccccacccatcatccaccgggacctgaagtgtgacaacatcttcatcaccggccccactggatctgtgaagatcggggacctgggcctggccaccctgaagagggccagctttgccaagagcgtcatcggcaccccagagttcatggcccctgagatgtatgaggagcactatgatgagagcgtggatgtgtatgccttcggcatgtgcatgctggagatggccaccagcgagtacccctacagcgagtgccagaatgctgcccagatctacaggaaggtgacctgtggcatcaagccagccagctttgagaaggtgcatgaccctgagatcaaggagatcatcggggagtgcatctgcaagaacaaggaggagagatatgagatcaaggacctgctgagccacgccttctttgctgaagatactggagtgcgggtggagctggccgaggaggaccacggcaggaagagcaccatcgccctgcggctgtgggtggaggaccccaagaagctgaagggcaagcccaaggacaatggagccatcgagttcacctttgacctggagaaggagaccccagatgaggtggcccaggagatgattgaaagtggcttcttccatgaaagtgatgtgaagatcgtggccaagagcatccgggacagagtggccctgatccagtggaggcgggagcgcatctggccagccctgcagcccaaggagcagcaggatgtgggcagcccagacaaggcccggggcccccctgtgcccctgcaggtgcaggtgacctaccacgcccaggccggccagcccggccccccagagcctgaggagcctgaggccgaccagcacctgctgccccccaccctgcccaccagcgccaccagcctggccagtgacagcacctttgacagcggccagggcagcacagtgtacagcgacagccagagcagccagcagagcgtgatgctgggcagcctggctgatgctgcccccagccctgcccagtgtgtgtgcagcccccctgtgtctgagggccctgtgctgccccagagcctgcccagcctgggcgcctaccagcagcccacagctgcccctggcctgcctgtgggctctgtgcctgccccagcctgcccccccagcctgcagcagcacttcccagaccctgccatgagctttgcccctgtgctgcccccacccagcacccccatgcccactggacctggccagcctgcccctcctggccagcagcccccacccctggcccagcccacccccctgccccaggtgctggccccccagcctgtggtgcccctgcagcctgtgcccccccacctgcccccctacctggccccagccagccaggtgggcgccccagcccagctgaagcccctgcagatgccccaggcccccctgcagcccctggcccaggtgcccccccagatgccacccatccctgtggtgccccccatcacccccctggccggcattgatggcctgcccccagccctgcctgacctgcccacagccaccgtgccccctgtgcccccaccccagtacttcagccctgctgtgatcctgcccagcctggccgcccccctgcccccagccagccctgccctgcccctgcaggccgtgaagctgccccaccccccaggggcccccctggccatgccctgcaggaccatcgtgcccaatgccccagccaccatccccctgctggccgtggcccctcctggggtggccgccctgagcatccacagcgctgtggcccagctgcccggccagcctgtgtacccagctgccttcccccagatggcccccacagatgtgccccccagcccccaccacacagtgcagaacatgagggccaccccaccccagcctgccctgcccccccagcccaccctgcccccccagcctgtgctgcccccccagcccaccctgcccccccagcctgtgctgcccccccagcccaccaggcctccccagcctgtgctgcccccccagcccatgctgcccccccagcctgtgctgcccccccagcctgccctgcctgtgcggcctgagcccctgcagccccacctgcctgagcaggccgccccagctgccaccccaggcagccagatcctgctgggccacccagccccctatgctgtggatgtggccgcccaggtgcccaccgtgcctgtgcccccagctgctgtgctgagcccccccctgcctgaggtgctgctgcctgctgcccctgagctgctgccccagttccccagcagcctggccaccgtgtctgcctctgtgcagagcgtgcccacccagacagccaccctgctgcccccagccaacccccccctgcccggcggccctggcatcgccagcccctgccccaccgtgcagctgactgtggagcctgtgcaggaggagcaggccagccaggacaagcccccaggcctgccccagagctgtgagagctatggaggcagtgatgtgaccagcggcaaggagctgagtgacagctgtgagggcgcctttggaggcggccgcctggagggccgggccgccaggaagcaccaccggcgcagcacccgggcccggagccggcaggagcgggccagccggccccggctgaccatcctgaatgtgtgcaacacaggagacaagatggtggagtgccagctggagacccacaaccacaagatggtgaccttcaagtttgacctggatggagatgccccagatgagatcgccacctacatggtggagcatgacttcatcctgcaggccgagcgggagaccttcatcgagcagatgaaggatgtgatggacaaggccgaggacatgctgtctgaggacacagatgctgaccggggcagtgaccccggcaccagccccccccacctgagcacctgtggcctgggcactggagaggagagccggcagagccaggccaatgcccctgtgtaccagcagaatgtgctgcacacaggcaagcgctggttcatcatctgccctgtggccgagcacccagcccctgaggcccctgagagcagcccccccctgcccctgagcagcctgcccccagaggccagccaggacagcgccccctacaaggaccagctgagcagcaaggagcagcccagcttcctggccagccagcagctgctgagccaggccggccccagcaaccccccaggggcccccccagcccccctggcccccagcagcccccctgtgacagccctgccccaggatggagctgccccagccaccagcaccatgcctgagcccgccagcggcacagccagccaggccggcggccctggcaccccccagggcctgaccagcgagctggagaccagccagcccctggccgagacccatgaggcccccctggccgtgcagcccctggtggtgggcctggccccctgcaccccagcccctgaggccgccagcaccagagatgccagcgccccccgggagcccctgcccccaccagcccctgagcccagcccccacagcggcaccccccagcctgccctgggccagcctgcccccctgctgcctgctgctgtgggcgctgtgtccctggccaccagccagctgcccagcccccccctgggccccaccgtgcccccccagcccccatctgccctggagagtgatggagagggccccccaccccgggtgggctttgtggacagcaccatcaagagcctggatgagaagctgcggaccctgctgtaccaggagcacgtgcccaccagcagcgccagcgctggcacccctgtggaggtgggggaccgggacttcaccctggagcccctgcggggggaccagcccaggtctgaggtgtgtggcggggacctggccctgccccctgtgcccaaggaggccgtgtctggccgggtgcagctgccccagcccctggtggagaagtctgagctggcccccaccagaggagctgtgatggagcagggcaccagcagctccatgacagctgagagcagccccaggtccatgctgggctatgacagagatggccggcaggtggccagtgacagccacgtggtgcccagcgtgccccaggatgtgcctgcctttgtgcggcctgcccgggtggagcccacagacagagatggaggagaggccggggagagcagcgctgagcccccacccagcgacatgggcaccgtgggcggccaggccagccacccccagaccctgggcgcccgggccctgggcagccccaggaagaggcctgagcagcaggatgtgagcagccctgccaagacagtgggccgcttctctgtggtgtccacccaggatgagtggaccctggccagcccccacagcctgcgctacagcgcccccccagatgtgtacctggatgaggcccccagcagcccagatgtgaagctggccgtgagaagagcccagacagccagcagcattgaggtgggcgtgggggagcctgtgtccagtgacagcggagatgagggcccccgggcccggccccctgtgcagaagcaggccagcctgcctgtgtctggctctgtggccggggactttgtgaagaaggccacagccttcctgcagaggcccagccgggccggcagcctgggccctgagacccccagccgggtgggcatgaaggtgcccaccatctctgtgaccagcttccacagccagagcagctacatcagcagtgacaatgacagcgagctggaggatgctgacatcaagaaggagctgcagagcctgcgggagaagcacctgaaggagatcagcgagctgcagagccagcagaagcaggagattgaggccctgtaccgccgcctgggcaagcccctgcccccaaatgtgggcttcttccacacagcccccccaactggaagaagaaggaagaccagcaagagcaagctgaaggccggcaagctgctgaaccccctggtgcggcagctgaaggtggtggccagcagcacaggccacctggccgacagcagccggggccccccagccaaggaccctgcccaggcctctgtgggcctgacagctgacagcacaggcctgagcggcaaggctgtgcagacccagcagccctgcagcgtgcgggccagcctgagcagtgacatctgcagcggcctggccagtgatggcggcggggcccggggccagggctggacagtgtaccaccccaccagcgagcgggtgacctacaagagcagcagcaagccccgggcccgcttcctgagcggccctgtgtctgtgtccatctggagcgccctgaagaggctgtgcctgggcaaggagcacagcagccgcagcagcaccagcagcctggcccctggccctgagcccggcccccagcctgccctgcacgtgcaggcccaggtgaacaacagcaacaacaagaagggcaccttcacagatgacctgcacaagctggtggatgagtggaccagcaagacagtgggcgccgcccagctgaagcccaccctgaaccagctgaagcagacccagaagctgcaggacatggaggcccaggccggctgggccgcccctggagaggcccgggccatgacagccccccgggccggcgtgggcatgccccggctgcccccagcccctggccccctgagcaccaccgtcatccctggggccgcccccaccctgtctgtgcccaccccagaccctgagagcgagaagccagactag

SEQ ID NO: 176110 - DNA, 5511 bp, Artificial Sequence
  Description of Artificial Sequence: Synthetic coding sequence
atggccaccagcgagtacccctacagcgagtgccagaatgctgcccagatctacaggaaggtgacctgtggcatcaagccagccagctttgagaaggtgcatgaccctgagatcaaggagatcatcggggagtgcatctgcaagaacaaggaggagagatatgagatcaaggacctgctgagccacgccttctttgctgaagatactggagtgcgggtggagctggccgaggaggaccacggcaggaagagcaccatcgccctgcggctgtgggtggaggaccccaagaagctgaagggcaagcccaaggacaatggagccatcgagttcacctttgacctggagaaggagaccccagatgaggtggcccaggagatgattgaaagtggcttcttccatgaaagtgatgtgaagatcgtggccaagagcatccgggacagagtggccctgatccagtggaggcgggagcgcatctggccagccctgcagcccaaggagcagcaggatgtgggcagcccagacaaggcccggggcccccctgtgcccctgcaggtgcaggtgacctaccacgcccaggccggccagcccggccccccagagcctgaggagcctgaggccgaccagcacctgctgccccccaccctgcccaccagcgccaccagcctggccagtgacagcacctttgacagcggccagggcagcacagtgtacagcgacagccagagcagccagcagagcgtgatgctgggcagcctggctgatgctgcccccagccctgcccagtgtgtgtgcagcccccctgtgtctgagggccctgtgctgccccagagcctgcccagcctgggcgcctaccagcagcccacagctgcccctggcctgcctgtgggctctgtgcctgccccagcctgcccccccagcctgcagcagcacttcccagaccctgccatgagctttgcccctgtgctgcccccacccagcacccccatgcccactggacctggccagcctgcccctcctggccagcagcccccacccctggcccagcccacccccctgccccaggtgctggccccccagcctgtggtgcccctgcagcctgtgcccccccacctgcccccctacctggccccagccagccaggtgggcgccccagcccagctgaagcccctgcagatgccccaggcccccctgcagcccctggcccaggtgcccccccagatgccacccatccctgtggtgccccccatcacccccctggccggcattgatggcctgcccccagccctgcctgacctgcccacagccaccgtgccccctgtgcccccaccccagtacttcagccctgctgtgatcctgcccagcctggccgcccccctgcccccagccagccctgccctgcccctgcaggccgtgaagctgccccaccccccaggggcccccctggccatgccctgcaggaccatcgtgcccaatgccccagccaccatccccctgctggccgtggcccctcctggggtggccgccctgagcatccacagcgctgtggcccagctgcccggccagcctgtgtacccagctgccttcccccagatggcccccacagatgtgccccccagcccccaccacacagtgcagaacatgagggccaccccaccccagcctgccctgcccccccagcccaccctgcccccccagcctgtgctgcccccccagcccaccctgcccccccagcctgtgctgcccccccagcccaccaggcctccccagcctgtgctgcccccccagcccatgctgcccccccagcctgtgctgcccccccagcctgccctgcctgtgcggcctgagcccctgcagccccacctgcctgagcaggccgccccagctgccaccccaggcagccagatcctgctgggccacccagccccctatgctgtggatgtggccgcccaggtgcccaccgtgcctgtgcccccagctgctgtgctgagcccccccctgcctgaggtgctgctgcctgctgcccctgagctgctgccccagttccccagcagcctggccaccgtgtctgcctctgtgcagagcgtgcccacccagacagccaccctgctgcccccagccaacccccccctgcccggcggccctggcatcgccagcccctgccccaccgtgcagctgactgtggagcctgtgcaggaggagcaggccagccaggacaagcccccaggcctgccccagagctgtgagagctatggaggcagtgatgtgaccagcggcaaggagctgagtgacagctgtgagggcgcctttggaggcggccgcctggagggccgggccgccaggaagcaccaccggcgcagcacccgggcccggagccggcaggagcgggccagccggccccggctgaccatcctgaatgtgtgcaacacaggagacaagatggtggagtgccagctggagacccacaaccacaagatggtgaccttcaagtttgacctggatggagatgccccagatgagatcgccacctacatggtggagcatgacttcatcctgcaggccgagcgggagaccttcatcgagcagatgaaggatgtgatggacaaggccgaggacatgctgtctgaggacacagatgctgaccggggcagtgaccccggcaccagccccccccacctgagcacctgtggcctgggcactggagaggagagccggcagagccaggccaatgcccctgtgtaccagcagaatgtgctgcacacaggcaagcgctggttcatcatctgccctgtggccgagcacccagcccctgaggcccctgagagcagcccccccctgcccctgagcagcctgcccccagaggccagccaggacagcgccccctacaaggaccagctgagcagcaaggagcagcccagcttcctggccagccagcagctgctgagccaggccggccccagcaaccccccaggggcccccccagcccccctggcccccagcagcccccctgtgacagccctgccccaggatggagctgccccagccaccagcaccatgcctgagcccgccagcggcacagccagccaggccggcggccctggcaccccccagggcctgaccagcgagctggagaccagccagcccctggccgagacccatgaggcccccctggccgtgcagcccctggtggtgggcctggccccctgcaccccagcccctgaggccgccagcaccagagatgccagcgccccccgggagcccctgcccccaccagcccctgagcccagcccccacagcggcaccccccagcctgccctgggccagcctgcccccctgctgcctgctgctgtgggcgctgtgtccctggccaccagccagctgcccagcccccccctgggccccaccgtgcccccccagcccccatctgccctggagagtgatggagagggccccccaccccgggtgggctttgtggacagcaccatcaagagcctggatgagaagctgcggaccctgctgtaccaggagcacgtgcccaccagcagcgccagcgctggcacccctgtggaggtgggggaccgggacttcaccctggagcccctgcggggggaccagcccaggtctgaggtgtgtggcggggacctggccctgccccctgtgcccaaggaggccgtgtctggccgggtgcagctgccccagcccctggtggagaagtctgagctggcccccaccagaggagctgtgatggagcagggcaccagcagctccatgacagctgagagcagccccaggtccatgctgggctatgacagagatggccggcaggtggccagtgacagccacgtggtgcccagcgtgccccaggatgtgcctgcctttgtgcggcctgcccgggtggagcccacagacagagatggaggagaggccggggagagcagcgctgagcccccacccagcgacatgggcaccgtgggcggccaggccagccacccccagaccctgggcgcccgggccctgggcagccccaggaagaggcctgagcagcaggatgtgagcagccctgccaagacagtgggccgcttctctgtggtgtccacccaggatgagtggaccctggccagcccccacagcctgcgctacagcgcccccccagatgtgtacctggatgaggcccccagcagcccagatgtgaagctggccgtgagaagagcccagacagccagcagcattgaggtgggcgtgggggagcctgtgtccagtgacagcggagatgagggcccccgggcccggccccctgtgcagaagcaggccagcctgcctgtgtctggctctgtggccggggactttgtgaagaaggccacagccttcctgcagaggcccagccgggccggcagcctgggccctgagacccccagccgggtgggcatgaaggtgcccaccatctctgtgaccagcttccacagccagagcagctacatcagcagtgacaatgacagcgagctggaggatgctgacatcaagaaggagctgcagagcctgcgggagaagcacctgaaggagatcagcgagctgcagagccagcagaagcaggagattgaggccctgtaccgccgcctgggcaagcccctgcccccaaatgtgggcttcttccacacagcccccccaactggaagaagaaggaagaccagcaagagcaagctgaaggccggcaagctgctgaaccccctggtgcggcagctgaaggtggtggccagcagcacaggccacctggccgacagcagccggggccccccagccaaggaccctgcccaggcctctgtgggcctgacagctgacagcacaggcctgagcggcaaggctgtgcagacccagcagccctgcagcgtgcgggccagcctgagcagtgacatctgcagcggcctggccagtgatggcggcggggcccggggccagggctggacagtgtaccaccccaccagcgagcgggtgacctacaagagcagcagcaagccccgggcccgcttcctgagcggccctgtgtctgtgtccatctggagcgccctgaagaggctgtgcctgggcaaggagcacagcagccgcagcagcaccagcagcctggcccctggccctgagcccggcccccagcctgccctgcacgtgcaggcccaggtgaacaacagcaacaacaagaagggcaccttcacagatgacctgcacaagctggtggatgagtggaccagcaagacagtgggcgccgcccagctgaagcccaccctgaaccagctgaagcagacccagaagctgcaggacatggaggcccaggccggctgggccgcccctggagaggcccgggccatgacagccccccgggccggcgtgggcatgccccggctgcccccagcccctggccccctgagcaccaccgtcatccctggggccgcccccaccctgtctgtgcccaccccaggcagctgtggccccagggctgtgtccacccccaccagctacacctag

SEQ ID NO: 176111 - DNA, 5403 bp, Artificial Sequence
  Description of Artificial Sequence: Synthetic coding sequence
atggccacagattctggggaccctgccagcacagaggacagcgagaagccagatggcatcagctttgaaaatagagtgccccaggtggccgccaccctgactgtggaggcccggctgaaggagaagaacagcaccttcagcgccagcggggagaccgtggagaggaagcgcttcttcaggaagtctgtggagatgacagaagatgacaaggtggccgagagcagccccaaggatgagcgcatcaaggccgccatgaacatcccccgggtggacaagctgcccagcaatgtgctgcggggcggccaggaggtgaagtatgagcagtgcagcaagagcaccagcgagatcagcaaggactgcttcaaggagaagaatgagaaggagatggaggaggaggccgagatgaaggctgtggccaccagccccagcggccgcttcctgaagtttgatattgagctgggccgcggggccttcaagacagtgtacaagggcctggacacagagacctgggtggaggtggcctggtgtgagctgcaggacaggaagctgaccaaggccgagcagcagcgcttcaaggaggaggccgagatgctgaagggcctgcagcaccccaacatcgtgcgcttctatgacagctgggagagcatcctgaagggcaagaagtgcatcgtgctggtgacagagctgatgaccagcggcaccctgaagacctacctgaagcgcttcaaggtgatgaagcccaaggtgctgcgctcctggtgccggcagatcctgaagggcctgcagttcctgcacaccaggaccccacccatcatccaccgggacctgaagtgtgacaacatcttcatcaccggccccactggatctgtgaagatcggggacctgggcctggccaccctgatgaggaccagctttgccaagagcgtcatcggcaccccagagttcatggcccctgagatgtatgaggagcactatgatgagagcgtggatgtgtatgccttcggcatgtgcatgctggagatggccaccagcgagtacccctacagcgagtgccagaatgctgcccagatctacaggaaggtgaccagcggcatcaagccagccagcttcaacaaggtgacagatcctgaggtgaaggagatcatcgagggctgcatccggcagaacaagtctgagcggctgagcatccgggacctgctgaaccacgccttctttgctgaggacaccggcctgcgggtggagctggccgaggaggatgactgcagcaacagcagcctggccctgcggctgtgggtggaggaccccaagaagctgaagggcaagcacaaggacaatgaggccatcgagttctccttcaacctggagacagacaccccagaggaggtggcctatgagatggtgaagagcggcttcttccatgaaagtgacagcaaggctgtggccaagagcatccgggacagagtgacccccatcaagaagacccgggagaagaagccagctggctgcctggaggagcggcgggacagccagtgcaagtccatgggaaatgtgttcccccagccccagaacaccaccctgcccctggccccagcccagcagacaggagcagaatgtgaggagacagaggtggaccagcacgtgcggcagcagctgctgcagaggaagccccagcagcactgcagctctgtgactggagacaacctgtctgaggccggggccgccagcgtcatccacagcgacaccagcagccagcccagcgtggcctacagcagcaaccagaccatgggcagccagatggtgagcaacatcccccaggccgaggtgaatgtgcccggccagatctacagcagccagcagctggtgggccactaccagcaggtgtctggcctgcagaagcacagcaagctgacccagccccagatcctgcccctggtgcagggccagagcacagtgctgcctgtgcacgtgctgggccccaccgtggtgtcccagccccaggtgagccccctgactgtgcagaaggtgccccagatcaagcctgtgtcccagcctgtgggcgctgagcagcaggccgccctgctgaagccagacctggtgcgcagcctgaaccaggatgtggccaccaccaaggaaaatgtgagcagcccagacaaccccagcggaaatggcaagcaggaccgcatcaagcagaggcgggccagctgccccaggcctgagaagggcaccaagttccagctgactgtgctgcaggtgtccaccagcggggacaacatggtggagtgccagctggagacccacaacaacaagatggtgaccttcaagtttgatgtggatggagatgccccagaagatattgctgactacatggtggaggacaactttgtgctggagagcgagaaggagaagtttgtggaggagctgcgggccatcgtgggccaggcccaggagatcctgcacgtgcactttgccacagagcgggccaccggggtggacagcatcaccgtggacagcaacagcagccagacaggcagcagcgagcaggtgcagatcaacagcaccagcacccagaccagcaatgaaagtgccccccagagcagccctgtgggccgctggaggttctgcatcaaccagaccatccggaaccgggagacccagagcccccccagcctgcagcacagcatgtctgctgtgcccggccgccaccccctgcccagccccaagaacaccagcaacaaggagatcagccgggacaccctgctgaccatcgagaacaacccctgccaccgggccctcttcaccagcaagtctgagcacaaggatgtggtggatggcaagatcagtgaatgtgcctctgtggagaccaagcagcctgccatcctgtaccaggtggaggacaaccggcagatcatggcccctgtgaccaacagcagcagctacagcaccacctctgtgcgggctgtgcctgcagaatgtgagggcctgaccaagcaggccagcatcttcatccctgtgtacccctgccaccagacagccagccaggctgatgccctgatgagccaccctggagagagcacccagaccagcggcaacagcctgaccaccctggcctttgaccagaagccccagaccctgtctgtgcagcagcctgccatggatgctgagttcatcagccaggagggggagaccaccgtgaacacagaggccagcagccccaagacagtcatccccacccagaccccaggcctggagcccaccaccctgcagcccaccaccgtgctggagagtgatggagagcggccccccaagctggagtttgctgacaaccgcatcaagaccctggatgagaagctgaggaacctgctgtaccaggagcacagcatcagcagcatctacccagagagccagaaggacacccagagcattgacagccccttcagcagcagcgctgaggacaccctgagctgccctgtgacagaggtgattgccatcagccactgcggcatcaaggacagccctgtgcagagccccaacttccagcagacaggcagcaagctgctgagcaatgtggccgccagccagcctgccaacatcagcgtcttcaagagggacctgaatgtcatcacctctgtgcccagcgagctgtgcctgcacgagatgagcagtgatgccagcctgcccggggaccctgaggcctacccagctgctgtgagcagcggcggggccatccacctgcagacaggaggcggctacttcggcctgtccttcacctgccccagcctgaagaaccccatcagcaagaagtcctggaccaggaagctgaagtcctgggcctaccgcctgcggcagagcaccagcttcttcaagaggagcaaggtgcggcaggtggagacagaggagatgaggtctgccatcgccccagaccccatccccctgacccgggagagcacagctgacacccgggccctgaaccgctgcaaggccatgagcggcagcttccagaggggccgcttccaggtgatcaccatcccccagcagcagagcgccaagatgaccagctttggaattgagcacatctctgtgttcagcgagaccaaccacagcagcgaggaggccttcatcaagacagccaagagccagctggtggagattgaaccagccacccagaaccccaagaccagcttctcctatgagaagctgcaggccctgcaggagacctgcaaggagaacaagggcgtgcccaagcagggcgacaacttcctgtccttctctgctgcctgtgaaacagatgtgtcctctgtgaccccagagaaggagtttgaggagaccagcgccaccggcagctccatgcagagcggcagcgagctgctgctgaaggagcgggagatcctgacagctgggaagcagcccagcagtgacagcgagttcagcgccagcctggccggcagcggcaagtctgtggccaagacaggccctgagagcaaccagtgcctgccccaccacgaggagcaggcctatgcccagacccagagcagcctcttctacagccccagcagccccatgagcagtgatgatgagagcgagattgaagatgaggacctgaaggtggagctgcagaggctgcgggagaagcacatccaggaggtggtgaacctgcagacccagcagaacaaggagctgcaggagctgtatgagcggctgcggagcatcaaggacagcaagacccagagcacagagatccccctgcccccagccagcccccggcggcccaggagcttcaagagcaagctgcggagccggccccagagcctgacccacgtggacaatggcatcgtggccaccgggaagagctgcctgatcaatgagctggagaaccccctgtgtgtggagagcaatgctgccagctgccagcagagccctgccagcaagaagggcatgttcacagatgacctgcacaagctggtggatgactggaccaaggaggccgtgggcaacagcctcatcaagcccagcctgaaccagctgaagcagagccagcacaagctggagacagagaactggaacaaggtgtctgagaacacccccagcaccatgggctacaccagcacctggatcagcagcctgagccagatcagaggagctgtgcccaccagcctgccccagggcctgagcctgcccagcttccctggccccctgagcagctatggcatgccccacgtgtgccagtacaatgctgtggccggggccggctaccctgtgcagtgggtgggcatcagcggcaccacccagcagagcgtggtgatcccagcccagagcggcggccccttccagcccggcatgaacatgcaggccttccccaccagctctgtgcagaacccagccaccatccccccaggccccaagtag

SEQ ID NO: 176112 - DNA, 5403 bp, Artificial Sequence; identical to SEQ ID NO: 176111
  Description of Artificial Sequence: Synthetic coding sequence

SEQ ID NO: 176113 - DNA, 5232 bp, Artificial Sequence
  Description of Artificial Sequence: Synthetic coding sequence
atggccacagattctggggaccctgccagcacagaggacagcgagaagccagatggcatcagctttgaaaatagagtgccccaggtggccgccaccctgactgtggaggcccggctgaaggagaagaacagcaccttcagcgccagcggggagaccgtggagaggaagcgcttcttcaggaagtctgtggagatgacagaagatgacaaggtggccgagagcagccccaaggatgagcgcatcaaggccgccatgaacatcccccgggtggacaagctgcccagcaatgtgctgcggggcggccaggaggtgaagtatgagcagtgcagcaagagcaccagcgagatcagcaaggactgcttcaaggagaagaatgagaaggagatggaggaggaggccgagatgaaggctgtggccaccagccccagcggccgcttcctgaagtttgatattgagctgggccgcggggccttcaagacagtgtacaagggcctggacacagagacctgggtggaggtggcctggtgtgagctgcaggacaggaagctgaccaaggccgagcagcagcgcttcaaggaggaggccgagatgctgaagggcctgcagcaccccaacatcgtgcgcttctatgacagctgggagagcatcctgaagggcaagaagtgcatcgtgctggtgacagagctgatgaccagcggcaccctgaagacctacctgaagcgcttcaaggtgatgaagcccaaggtgctgcgctcctggtgccggcagatcctgaagggcctgcagttcctgcacaccaggaccccacccatcatccaccgggacctgaagtgtgacaacatcttcatcaccggccccactggatctgtgaagatcggggacctgggcctggccaccctgatgaggaccagctttgccaagagcgtcatcggcaccccagagttcatggcccctgagatgtatgaggagcactatgatgagagcgtggatgtgtatgccttcggcatgtgcatgctggagatggccaccagcgagtacccctacagcgagtgccagaatgctgcccagatctacaggaaggtgaccagcggcatcaagccagccagcttcaacaaggtgacagatcctgaggtgaaggagatcatcgagggctgcatccggcagaacaagtctgagcggctgagcatccgggacctgctgaaccacgccttctttgctgaggacaccggcctgcgggtggagctggccgaggaggatgactgcagcaacagcagcctggccctgcggctgtgggtggaggaccccaagaagctgaagggcaagcacaaggacaatgaggccatcgagttctccttcaacctggagacagacaccccagaggaggtggcctatgagatggtgaagagcggcttcttccatgaaagtgacagcaaggctgtggccaagagcatccgggacagagtgacccccatcaagaagacccgggagaagaagccagctggctgcctggaggagcggcgggacagccagtgcaagtccatgggaaatgtgttcccccagccccagaacaccaccctgcccctggccccagcccagcagacaggagcagaatgtgaggagacagaggtggaccagcacgtgcggcagcagctgctgcagaggaagccccagcagcactgcagctctgtgactggagacaacctgtctgaggccggggccgccagcgtcatccacagcgacaccagcagccagcccagcgtggcctacagcagcaaccagaccatgggcagccagatggtgagcaacatcccccaggccgaggtgaatgtgcccggccagatctacagcagccagcagctggtgggccactaccagcaggtgtctggcctgcagaagcacagcaagctgacccagccccagatcctgcccctggtgcagggccagagcacagtgctgcctgtgcacgtgctgggccccaccgtggtgtcccagccccaggtgagccccctgactgtgcagaaggtgccccagatcaagcctgtgtcccagcctgtgggcgctgagcagcaggccgccctgctgaagccagacctggtgcgcagcctgaaccaggatgtggccaccaccaaggaaaatgtgagcagcccagacaaccccagcggaaatggcaagcaggaccgcatcaagcagaggcgggccagctgccccaggcctgagaagggcaccaagttccagctgactgtgctgcaggtgtccaccagcggggacaacatggtggagtgccagctggagacccacaacaacaagatggtgaccttcaagtttgatgtggatggagatgccccagaagatattgctgactacatggtggaggacaactttgtgctggagagcgagaaggagaagtttgtggaggagctgcgggccatcgtgggccaggcccaggagatcctgcacgtgcactttgccacagagcgggccaccggggtggacagcatcaccgtggacagcaacagcagccagacaggcagcagcgagcaggtgcagatcaacagcaccagcacccagaccagcaatgaaagtgccccccagagcagccctgtgggccgctggaggttctgcatcaaccagaccatccggaaccgggagacccagagcccccccagcctgcagcacagcatgtctgctgtgcccggccgccaccccctgcccagccccaagaacaccagcaacaaggagatcagccgggacaccctgctgaccatcgagaacaacccctgccaccgggccctcttcaccagcaagtctgagcacaaggatgtggtggatggcaagatcagtgaatgtgcctctgtggagaccaagcagcctgccatcctgtaccaggtggaggacaaccggcagatcatggcccctgtgaccaacagcagcagctacagcaccacctctgtgcgggctgtgcctgcagaatgtgagggcctgaccaagcaggccagcatcttcatccctgtgtacccctgccaccagacagccagccaggctgatgccctgatgagccaccctggagagagcacccagaccagcggcaacagcctgaccaccctggcctttgaccagaagccccagaccctgtctgtgcagcagcctgccatggatgctgagttcatcagccaggagggggagaccaccgtgaacacagaggccagcagccccaagacagtcatccccacccagaccccaggcctggagcccaccaccctgcagcccaccaccgtgctggagagtgatggagagcggccccccaagctggagtttgctgacaaccgcatcaagaccctggatgagaagctgaggaacctgctgtaccaggagcacagcatcagcagcatctacccagagagccagaaggacacccagagcattgacagccccttcagcagcagcgctgaggacaccctgagctgccctgtgacagaggtgattgccatcagccactgcggcatcaaggacagccctgtgcagagccccaacttccagcagacaggcagcaagctgctgagcaatgtggccgccagccagcctgccaacatcagcgtcttcaagagggacctgaatgtcatcacctctgtgcccagcgagctgtgcctgcacgagatgagcagtgatgccagcctgcccggggaccctgaggcctacccagctgctgtgagcagcggcggggccatccacctgcagacaggagtggagacagaggagatgaggtctgccatcgccccagaccccatccccctgacccgggagagcacagctgacacccgggccctgaaccgctgcaaggccatgagcggcagcttccagaggggccgcttccaggtgatcaccatcccccagcagcagagcgccaagatgaccagctttggcatcgagcacatcagcgtcttcagcgagaccaaccacagcagcgaggaggccttcatcaagacagccaagagccagctggtggagattgagcccgccacccagaaccccaagaccagcttctcctatgagaagctgcaggccctgcaggagacctgcaaggaaaataaaggagtgcccaagcagggcgacaacttcctgtccttctctgctgcctgtgaaacagatgtgtcctctgtgaccccagagaaggagtttgaggagaccagcgccaccggcagctccatgcagagcggcagcgagctgctgctgaaggagcgggagatcctgacagctgggaagcagcccagcagtgacagcgagttcagcgccagcctggccggcagcggcaagtctgtggccaagacaggccctgagagcaaccagtgcctgccccaccacgaggagcaggcctatgcccagacccagagcagcctcttctacagccccagcagccccatgagcagtgatgatgaaagtgaaattgaagatgaggacctgaaggtggagctgcagaggctgcgggagaagcacatccaggaggtggtgaacctgcagacccagcagaacaaggagctgcaggagctgtatgaaaggctgcggagcatcaaggacagcaagacccagagcacagagatccccctgcccccagccagcccccggcggcccaggagcttcaagagcaagctgcggagccggccccagagcctgacccacgtggacaatggaattgtggccacagaccccctgtgtgtggagagcaatgctgccagctgccagcagagccctgccagcaagaagggcatgttcacagatgacctgcacaagctggtggatgactggaccaaggaggccgtgggcaacagcctcatcaagcccagcctgaaccagctgaagcagagccagcacaagctggagacagagaactggaacaaggtgtctgagaacacccccagcaccatgggctacaccagcacctggatcagcagcctgagccagatcagaggagctgtgcccaccagcctgccccagggcctgagcctgcccagcttccctggccccctgagcagctatggcatgcctcatgtgtgccagtacaatgctgtggccggggccggctaccctgtgcagtgggtgggcatcagcggcaccacccagcagagcgtggtgatcccagcccagagcggcggccccttccagcccggcatgaacatgcaggccttccccaccagctctgtgcagaacccagccaccatccccccaggccccaagtag

SEQ ID NO: 176114 - DNA, 498 bp, Artificial Sequence
  Description of Artificial Sequence: Synthetic coding sequence
atggccacagattctggggaccctgccagcacagaggacagcgagaagccagatggcatcagctttgaaaatagagtgccccaggtggccgccaccctgactgtggaggcccggctgaaggagaagaacagcaccttcagcgccagcggggagaccgtggagaggaagcgcttcttcaggaagtctgtggagatgacagaagatgacaaggtggccgagagcagccccaaggatgagcgcatcaaggccgccatgaacatcccccgggtggacaagctgcccagcaatgtgctgcggggcggccaggaggtgaagtatgagcagtgcagcaagagcaccagcgagatcagcaaggactgcttcaaggagaagaatgagaaggagatggaggaggaggccgagatgaaggctgtggccaccagccccagcggccgcttcctgaagtttgatattgagctgggccgcggggccttcaagacagtgtacaagggcctgtag

SEQ ID NO: 176115 - DNA, 3732 bp, Artificial Sequence
  Description of Artificial Sequence: Synthetic coding sequence
atgctggccagccctgccacagagaccaccgtgctgatgagccagacagaggccgacctggccctgcggcccccaccacccctgggcacagctggccagccccggctgggccccccaccaagaagagcccggcgcttcagcggcaaggccgagccccggcccaggagcagccggctgagcagaagaagctctgtggacctgggcctgctgagctcctggagcctgcctgccagccctgccccagaccccccagaccccccagattctgctggccctggccctgcccggagccccccacccagcagcaaggagcccccagagggcacctggacagaaggagcccctgtgaaggctgctgaggacagcgcccggcctgagctgcctgacagcgctgtgggccctggcagccgggagcccctgcgggtgcctgaggccgtggccctggagaggagaagagagcaggaggagaaggaggacatggagacccaggccgtggccaccagcccagatggccgctacctgaagtttgacatcgagatcggccggggcagcttcaagacagtgtaccggggcctggacacagacaccaccgtggaggtggcctggtgtgagctgcagaccaggaagctgagcagagctgagcggcagcgcttcagcgaggaggtggagatgctgaagggcctgcagcaccccaacatcgtgcgcttctatgacagctggaagtctgtgctgcggggccaggtgtgcatcgtgctggtgacagagctgatgaccagcggcaccctgaagacctacctgcggcgcttccgggagatgaagccccgggtgctgcagcgctggagccggcagatcctgcggggcctgcacttcctgcacagccgggtgccccccatcctgcaccgggacctgaagtgtgacaacgtgttcatcaccggccccaccggctctgtgaagattggagacctgggcctggccaccctgaagagggccagctttgccaagtctgtgattggcaccccagagttcatggcccctgagatgtatgaggagaagtatgatgaagctgtggatgtgtatgccttcggcatgtgcatgctggagatggccaccagcgagtacccctacagcgagtgccagaatgctgcccagatctacaggaaggtgaccagcggcaggaagcccaacagcttccacaaggtgaagatccctgaggtgaaggagatcatcgagggctgcatcagaacagacaagaatgaacgcttcaccatccaggacctgctggcccacgccttcttccgggaggagcggggcgtgcacgtggagctggccgaggaggatgatggagagaagccaggcctgaagctgtggctgaggatggaggatgccaggagaggaggccggccccgggacaaccaggccatcgagttcctgttccagctgggcagagatgctgctgaggaggtggcccaggagatggtggccctgggcctggtgtgtgaggccgactaccagcctgtggcccgggctgtgcgggagcgggtggccgccatccagaggaagcgggagaagctgaggaaggcccgggagctggaggccctgcccccagagcccggccccccaccagccaccgtgcccatggcccctggcccccccagcgtcttccccccagagcctgaggagcctgaggccgaccagcaccagcccttcctgttcagacatgccagctacagcagcaccaccagtgactgtgaaacagatggctacctgagcagcagcggcttcctggatgccagtgaccctgccctgcagcccccaggaggagtgcccagcagcctggccgagagccacctgtgcctgcccagcgcctttgccctgagcatccccaggagcggccctggcagtgacttcagccctggggacagctatgccagtgatgctgccagcggcctgagtgatgtgggggagggcatgggccagatgagaagacctcctggcaggaacctgcggcggcggcccaggagccggctgcgggtgacctctgtgtctgaccagaatgacagagtggtggagtgccagctgcagacccacaacagcaagatggtgaccttccgctttgacctggatggagacagccctgaggagattgctgctgccatggtgtacaatgagttcatcctgcccagcgagagagatggcttcctgcggcgcatccgggagatcatccagagggtggagaccctgctgaagagggacaccggccccatggaggccgctgaggacaccctgagcccccaggaggagcccgcccccctgcctgccctgcctgtgcccctgcctgaccccagcaatgaggagctgcagagcagcaccagcctggagcaccgctcctggacagccttcagcaccagcagcagcagccctggcacccccctgagccctggcaaccccttcagccctggcacccccatcagccctggccccatcttccccatcaccagccccccctgccaccccagccccagccccttcagccccatcagcagccaggtgagcagcaaccccagcccccaccccaccagcagccccctgcccttcagcagcagcaccccagagttccctgtgcccctgagccagtgcccctggagcagcctgcccaccaccagcccccccaccttcagccccacctgcagccaggtgaccctgagcagccccttcttccccccctgccccagcaccagcagcttccccagcaccacagctgcccccctgctgagcctggccagcgccttcagcctggccgtgatgacagtggcccagagcctgctgagccccagccctggcctgctgagccagagccccccagccccacccagccccctgcccagcctgcccctgcccccacctgtggcccctgggggccaggagagccccagcccccacacagctgaggtggagagcgaggccagccccccaccagcccggcccctgcctggagaggcccggctggcccccatcagcgaggagggcaagccccagctggtgggccgcttccaggtgaccagcagcaaggagcctgctgagcccctgcccctgcagcccaccagccccaccctgagcggcagccccaagcccagcaccccccagctgaccagcgagagcagtgacacagaagattctgctgggggcggccctgagacccgggaggccctggccgagagtgacagagctgctgagggcctgggcgctggggtggaggaggagggagatgatggcaaggagccccaggtgggcggcagcccccagcccctgagccaccccagccctgtgtggatgaactacagctacagcagcctgtgcctgagcagcgaggagagcgagagcagcggggaggatgaggagttctgggccgagctgcagagcctgcggcagaagcacctgtctgaggtggagaccctgcagaccctgcagaagaaggagattgaagatctctacagccggctgggcaagcagcccccacctggcatcgtggccccagctgccatgctgagcagccggcagaggcggctgagcaagggcagcttccccaccagcagaagaaacagcctgcagaggtctgagcccccaggccctggcatcatgagaagaaacagcctgagcggcagcagcacaggcagccaggagcagagggccagcaagggcgtgacctttgctggagatgtgggccgcatgtag

SEQ ID NO: 176116 - DNA, 1992 bp, Artificial Sequence
  Description of Artificial Sequence: Synthetic coding sequence
atgagaagacggcagcagggcgctgctgggggcaacttccctgtgggcggcagcttcccagaagatgtgagcccccaccaggacagcggctacgcccccagcccccgctacctgcggcgcttccgggagatgaagccccgggtgctgcagcgctggagccggcagatcctgcggggcctgcacttcctgcacagccgggtgccccccatcctgcaccgggacctgaagtgtgacaacgtgttcatcaccggccccaccggctctgtgaagattggagacctgggcctggccaccctgaagagggccagctttgccaagtctgtgattggcaccccagagttcatggcccctgagatgtatgaggagaagtatgatgaagctgtggatgtgtatgccttcggcatgtgcatgctggagatggccaccagcgagtacccctacagcgagtgccagaatgctgcccagatctacaggaaggtgaccagcggcaggaagcccaacagcttccacaaggtgaagatccctgaggtgaaggagatcatcgagggctgcatcagaacagacaagaatgaacgcttcaccatccaggacctgctggcccacgccttcttccgggaggagcggggcgtgcacgtggagctggccgaggaggatgatggagagaagccaggcctgaagctgtggctgaggatggaggatgccaggagaggaggccggccccgggacaaccaggccatcgagttcctgttccagctgggcagagatgctgctgaggaggtggcccaggagatggtggccctgggcctggtgtgtgaggccgactaccagcctgtggcccgggctgtgcgggagcgggtggccgccatccagaggaagcgggagaagctgaggaaggcccgggagctggaggccctgcccccagagcccggccccccaccagccaccgtgcccatggcccctggcccccccagcgtcttccccccagagcctgaggagcctgaggccgaccagcaccagcccttcctgttcagacatgccagctacagcagcaccaccagtgactgtgaaacagatggctacctgagcagcagcggcttcctggatgccagtgaccctgccctgcagcccccaggaggagtgcccagcagcctggccgagagccacctgtgcctgcccagcgcctttgccctgagcatccccaggagcggccctggcagtgacttcagccctggggacagctatgccagtgatgctgccagcggcctgagtgatgtgggggagggcatgggccagatgagaagacctcctggcaggaacctgcggcggcggcccaggagccggctgcgggtgacctctgtgtctgaccagaatgacagagtggtggagtgccagctgcagacccacaacagcaagatggtgaccttccgctttgacctggatggagacagccctgaggagattgctgctgccatggtgtacaatgagttcatcctgcccagcgagagagatggcttcctgcggcgcatccgggagatcatccagagggtggagaccctgctgaagagggacaccggccccatggaggccgctgaggacaccctgagcccccaggaggagcccgcccccctgcctgccctgcctgtgcccctgcctgaccccagcaatgaggagctgcagagcagcaccagcctggagcaccgctcctggacagccttcagcaccagcagcagcagccctggcacccccctgagccctggcaaccccttcagccctggcacccccatcagccctggccccatcgccctgcagcgggagagccgctccttcagcctgcagagggcccagatccagaggacagtgctggaggccggccagaggcctgggaagctgtggctgcgggccaccgtgcagctgcgggtgtggggcctggagctgcggaggaaggagatgatgggcaggaaccccaagctgggcgccgcccccaacccctag

SEQ ID NO: 176117 - DNA, 471 bp, Artificial Sequence
  Description of Artificial Sequence: Synthetic coding sequence
atgggccagatgagaagacctcctggcaggaacctgcggcggcggcccaggagccggctgcgggtgacctctgtgtctgaccagaatgacagagtggtggagtgccagctgcagacccacaacagcaagatggtgaccttccgctttgacctggatggagacagccctgaggagattgctgctgccatggtgtacaatgagttcatcctgcccagcgagagagatggcttcctgcggcgcatccgggagatcatccagagggtggagaccctgctgaagagggacaccggccccatggaggccgctgaggacaccctgagcccccaggtgcggcccctgggcggccacttccagggcaagtggaccctgtgcagccgggtgtactacagcctgcccagcgctgtgcccctggacctgacccccctgcacctgtgggaccccaagacagtggccctcttcttcttcttctag

SEQ ID NO: 176118 - DNA, 894 bp, Artificial Sequence
  Description of Artificial Sequence: Synthetic coding sequence
atggccaaggtgtctgagctgtatgatgtgacctgggaggagatgagggacaagatgaggaagtggagggaggagaacagcaggaacagcgagcagatcgtggaggtgggggaggagctgatcaatgaatatgccagcaagctgggagatgacatctggatcatctatgagcaggtgatgattgctgccctggactatggaagagatgacctggccctcttctgcctgcaggagctgcggcggcagtttcctggcagccaccgggtgaagaggctgaccggcatgagatttgaggccatggagagatatgatgatgccatccagctgtatgaccgcatcctgcaggaggaccccaccaacacagctgccaggaagaggaagatcgccatcaggaaggcccagggcaagaatgtggaggccatccgggagctgaatgagtacctggagcagtttgtgggggaccaggaggcctggcatgagctggccgagctgtacatcaatgaacatgactatgccaaggccgccttctgcctggaggagctgatgatgaccaacccccacaaccacctgtactgccagcagtatgcagaggtgaagtacacccagggcggcctggagaacctggagctgagcaggaagtactttgcccaggccctgaagctgaacaacagaaacatgagggccctgtttggcctgtacatgtctgccagccacatcgccagcaaccccaaggccagcgccaagaccaagaaggacaacatgaagtatgcctcctgggccgccagccagatcaacagagcctaccagtttgctggccgcagcaagaaggagaccaagtacagcctgaaggctgtggaggacatgctggagaccctgcagatcacccagagctag

SEQ ID NO: 176119 - DNA, 1104 bp, Artificial Sequence
  Description of Artificial Sequence: Synthetic coding sequence
atgcgctggttcctgccctggaccctggccgctgtgacagctgctgctgccagcacagtgctggccacagccctgagccctgcccccaccaccatggacttcaccccagcccccctggaggacaccagcagccggccccagttctgcaagtggccctgtgagtgcccccccagccccccacgctgccccctgggcgtgtccctcatcacagatggctgtgagtgctgcaagatgtgtgcccagcagctgggggacaactgcacagaggccgccatctgtgacccccaccggggcctgtactgtgactacagcggggaccggcccaggtatgccatcggcgtgtgtgcccaggtggtgggcgtgggctgtgtgctggatggagtgcgctacaacaacggccagagcttccagcccaactgcaagtacaactgcacctgcattgatggagctgtgggctgcacccccctgtgcctgcgggtgcggcccccccggctgtggtgcccccaccccaggagagtgtccatccctggccactgctgtgagcagtgggtgtgtgaagatgatgccaagaggcccaggaagacagccccccgggacaccggggcctttgatgctgtgggggaggtggaggcctggcacaggaactgcatcgcctacaccagcccctggagcccctgcagcaccagctgtggcctgggcgtgtccacccgcatcagcaatgtgaatgcccagtgctggccagagcaggagagccggctgtgcaacctgcggccctgtgatgtggacatccacaccctcatcaaggccggcaagaagtgcctggccgtgtaccagcctgaggcctccatgaacttcaccctggccggctgcatcagcaccaggagctaccagcccaagtactgcggcgtgtgcatggacaaccgctgctgcatcccctacaagagcaagaccattgatgtgtccttccagtgcccagatggcctgggcttcagccggcaggtgctgtggatcaatgcctgcttctgcaacctgagctgcaggaaccccaatgacatctttgctgacctggagagctacccagacttcagcgagatcgccaactag

SEQ ID NO: 176120 - DNA, 588 bp, Artificial Sequence
  Description of Artificial Sequence: Synthetic coding sequence
atgcctgtgcccctgaccagcagacatgaggtggtgcctgccctggatgctggcagcagtgacagcagcagccggcagcacaggcctggccatgatgctgtgggggaggtggaggcctggcacaggaactgcatcgcctacaccagcccctggagcccctgcagcaccagctgtggcctgggcgtgtccacccgcatcagcaatgtgaatgcccagtgctggccagagcaggagagccggctgtgcaacctgcggccctgtgatgtggacatccacaccctcatcaaggccggcaagaagtgcctggccgtgtaccagcctgaggcctccatgaacttcaccctggccggctgcatcagcaccaggagctaccagcccaagtactgcggcgtgtgcatggacaaccgctgctgcatcccctacaagagcaagaccattgatgtgtccttccagtgcccagatggcctgggcttcagccggcaggtgctgtggatcaatgcctgcttctgcaacctgagctgcaggaaccccaatgacatctttgctgacctggagagctacccagacttcagcgagatcgccaactag

SEQ ID NO: 176121 - DNA, 468 bp, Artificial Sequence
  Description of Artificial Sequence: Synthetic coding sequence
atgcgctggttcctgccctggaccctggccgctgtgacagctgctgctgccagcacagtgctggccacagccctgagccctgcccccaccaccatggacttcaccccagcccccctggaggacaccagcagccggccccagttctgcaagtggccctgtgagtgcccccccagccccccacgctgccccctgggcgtgtccctcatcacagatggctgtgagtgctgcaagatgtgtgcccagcagctgggggacaactgcacagaggccgccatctgtgacccccaccggggcctgtactgtgactacagcggggaccggcccaggtatgccatcggcgtgtgtgcccggcgggaggaggtgtctggctgtgtgcctgcccggggcatccacgagctgcacacctgtggcctgcaccagcacaccctgctgagcacccaggtgctgtggagcctgcacggccagtag

SEQ ID NO: 176122 - DNA, 369 bp, Artificial Sequence
  Description of Artificial Sequence: Synthetic coding sequence
atgcgctggttcctgccctggaccctggccgctgtgacagctgctgctgccagcacagtgctggccacagctgggaagaagtgcctggccgtgtaccagcctgaggcctccatgaacttcaccctggccggctgcatcagcaccaggagctaccagcccaagtactgcggcgtgtgcatggacaaccgctgctgcatcccctacaagagcaagaccattgatgtgtccttccagtgcccagatggcctgggcttcagccggcaggtgctgtggatcaatgcctgcttctgcaacctgagctgcaggaaccccaatgacatctttgctgacctggagagctacccagacttcagcgagatcgccaactag

SEQ ID NO: 176123 - DNA, 753 bp, Artificial Sequence
  Description of Artificial Sequence: Synthetic coding sequence
atgaggggcacccccaagacccacctgctggccttcagcctgctgtgcctgctgagcaaggtgaggacccagctgtgccccaccccctgcacctgcccctggcccccaccccgctgccccctgggcgtgcccctggtgctggatggctgcggctgctgccgggtgtgtgcccggcggctgggggagccctgtgaccagctgcacgtgtgtgatgccagccagggcctggtgtgccagcccggggccggccctgggggccgcggggccctgtgcctgctggctgaagatgacagcagctgtgaggtgaatggccgcctgtaccgggagggggagaccttccagccccactgcagcatccgctgccgctgtgaagatggcggcttcacctgtgtgcccctgtgcagtgaagatgtgcggctgcccagctgggactgcccccaccccaggagagtggaggtgctgggcaagtgctgcccagagtgggtgtgtggccagggcggcggcctgggcacccagcccctgcctgcccagggcccccagttcagcggcctggtgagcagcctgcccccaggagtgccctgcccagagtggagcacagcctggggcccctgcagcaccacctgtggcctgggcatggccaccagggtgagcaaccagaaccgcttctgccgcctggagacccagaggcggctgtgcctgagccggccctgcccccccagccggggccgcagcccccagaacagcgccttctag

SEQ ID NO: 176124 - DNA, 657 bp, Artificial Sequence
  Description of Artificial Sequence: Synthetic coding sequence
atgaggggcacccccaagacccacctgctggccttcagcctgctgtgcctgctgagcaaggtgaggacccagctgtgccccaccccctgcacctgcccctggcccccaccccgctgccccctgggcgtgcccctggtgctggatggctgcggctgctgccgggtgtgtgcccggcggctgggggagccctgtgaccagctgcacgtgtgtgatgccagccagggcctggtgtgccagcccggggccggccctgggggccgcggggccctgtgcctgtgcaagcaggaccccagcttcctggccctgagcctgccctgccccctggtgtccccagcccagaatggagcccggcctggggaccctgcccggccccctgtgggctgggcctggcccccaggctgccccaccaggacagccagcgctgactggaggcccagcgctgcctgtgcctgccccggccctgcccaccccccaggagtggccgtgcacaagacagtgcccagccgggccggcctgggcatgggcacccgctgcccccccagccctgctgggggccctgtgcccggcccctgggcagatggccgctggagcgtgccccggcccctggccgccggcaacaccctggcctgggtgcaccacgccgagcaccagtactag

SEQ ID NO: 176125 - DNA, 753 bp, Artificial Sequence; identical to SEQ ID NO: 176123
  Description of Artificial Sequence: Synthetic coding sequence

SEQ ID NO: 176126 - DNA, 2571 bp, Artificial Sequence
  Description of Artificial Sequence: Synthetic coding sequence
atggagagcgaggacctgagcggccgggagctgaccatcgacagcatcatgaacaaggtgcgggacatcaagaacaagttcaagaatgaagacctgacagatgagctgagcctgaacaagatctctgctgacaccacagacaacagcggcaccgtgaaccagatcatgatgatggccaacaaccctgaggactggctgagcctgctgctgaagctggagaagaacagcgtgcccctgagtgatgccctgctgaacaagctgattggccgctacagccaggccatcgaggccctgcccccagacaagtatggccagaatgaaagctttgcccgcatccaggtgcgctttgctgagctgaaggccatccaggagccagatgatgcccgggactacttccagatggcccgggccaactgcaagaagtttgcctttgtgcacatcagctttgcccagtttgagctgagccagggcaatgtgaagaagagcaagcagctgctgcagaaggctgtggagagaggagctgtgcccctggagatgctggagatcgccctgaggaacctgaacctgcagaagaagcagctgctgtctgaggaggagaagaagaacctgagcgccagcacagtgctgacagcccaggagagcttcagcggcagcctgggccacctgcagaacagaaacaacagctgtgacagccggggccagaccaccaaggcccgcttcctgtatggagagaacatgccaccccaggatgctgagatcggctacagaaacagcctgcggcagaccaacaagaccaagcagagctgccccttcggccgggtgcctgtgaacctgctgaacagcccagactgtgatgtgaagacagatgattctgtggtgccctgcttcatgaagaggcagaccagccgctcagaatgtcgggacctggtggtgcccggcagcaagcccagcggaaatgacagctgtgagctgaggaacctgaagtctgtgcagaacagccacttcaaggagcccctggtgtctgatgagaagagcagcgagctgatcatcacagacagcatcaccctgaagaacaagacagagagcagcctgctggccaagctggaggagaccaaggagtaccaggagcctgaggtgcctgagagcaaccagaagcagtggcagagcaagaggaagtctgagtgcatcaaccagaacccagctgccagcagcaaccactggcagatccctgagctggccaggaaggtgaacacagagaagcacaccacctttgagcagcctgtgttttctgtgtccaagcagagcccccccatcagcaccagcaagtggtttgaccccaagagcatctgcaagacccccagcagcaacaccctggatgactacatgagctgcttccgcacccctgtggtgaagaatgacttccccccagcctgccagctgagcaccccctacggccagcctgcctgcttccagcagcagcagcaccagatcctggccacccccctgcagaacctgcaggtgctggccagcagcagcgccaatgaatgcatctctgtgaagggccgcatctacagcatcctgaagcagatcggcagcggcggcagcagcaaggtgttccaggtgctgaatgagaagaagcagatctatgccatcaagtatgtgaacctggaggaggccgacaaccagaccctggacagctacagaaatgaaattgcctacctgaacaagctgcagcagcacagcgacaagatcatccggctgtatgactatgagatcacagaccagtacatctacatggtgatggagtgtggcaacatcgacctgaacagctggctgaagaagaagaagagcattgacccctgggagaggaagagctactggaagaacatgctggaggccgtgcacaccatccaccagcacggcatcgtgcacagcgacctgaagccagccaacttcctgattgtggatggcatgctgaagctgattgactttggcatcgccaaccagatgcagcctgacaccacctctgtggtgaaggacagccaggtgggcaccgtgaactacatgcctcctgaggccatcaaggacatgagcagcagccgggagaatggcaagagcaagagcaagatcagccccaagagtgatgtgtggagcctgggctgcatcctgtactacatgacctacggcaagacccccttccagcagatcatcaaccagatcagcaagctgcacgccatcatcgaccccaaccatgaaattgagttcccagacatccctgagaaggacctgcaggatgtgctgaagtgctgcctgaagagggaccccaagcagaggatcagcatccctgagctgctggcccacccctacgtgcagatccagacccaccctgtgaaccagatggccaagggcaccacagaggagatgaagtatgtgctgggccagctggtgggcctgaacagccccaacagcatcctgaaggccgccaagaccctgtatgagcactacagcggcggggagagccacaacagcagcagcagcaagacctttgagaagaagaggggcaagaagtag

SEQ ID NO: 176127 - DNA, 1119 bp, Artificial Sequence
  Description of Artificial Sequence: Synthetic coding sequence
atgaacaagaggcggctgctgtaccccagcggctggctgcacggccccagcgacatgcagggcctgctcttcagcaccctgctgctggccggcctggcccagttctgctgccgggtgcagggcaccggccccctggacaccaccccagagggccggcctggagaggtgtctgatgccccccagaggaagcagttctgccactggccctgcaagtgcccccagcagaagccccgctgccccccaggagtgtccctggtgagagatggctgcggctgctgcaagatctgtgccaagcagcccggggagatctgcaatgaagctgacctgtgtgacccccacaagggcctgtactgtgactacagcgtggaccggcccaggtatgaaacaggagtgtgtgcctacctggtggccgtgggctgtgagttcaaccaggtgcactaccacaacggccaggtgttccagcccaaccccctcttcagctgcctgtgtgtgtctggggccatcggctgcacccccctcttcatccccaagctggccggcagccactgcagcggggccaagggcggcaagaagagtgaccagagcaactgcagcctggagcccctgctgcagcagctgagcaccagctacaagaccatgcctgcctacagaaacctgcccctcatctggaagaagaagtgcctggtgcaggccaccaagtggaccccctgcagcaggacctgtggcatgggcatcagcaacagagtgaccaatgaaaacagcaactgtgagatgaggaaggagaagaggctgtgctacatccagccctgtgacagcaacatcctgaagaccatcaagatccccaagggcaagacctgccagcccaccttccagctgagcaaggccgagaagtttgtgttttctggctgcagcagcacccagagctacaagcccaccttctgtggcatctgcctggacaagcgctgctgcatccccaacaagagcaagatgatcaccatccagtttgactgccccaatgaaggcagcttcaagtggaagatgctgtggatcaccagctgtgtgtgccagaggaactgccgggagcccggggacatcttcagcgagctgaagatcctgtag

SEQ ID NO: 176128 - DNA, 996 bp, Artificial Sequence
  Description of Artificial Sequence: Synthetic coding sequence
atgaagatcagccggggccgggtgtgcctggagagcgagaacaaggatgctggggtggccggcaggaagcagttctgccactggccctgcaagtgcccccagcagaagccccgctgccccccaggagtgtccctggtgagagatggctgcggctgctgcaagatctgtgccaagcagcccggggagatctgcaatgaagctgacctgtgtgacccccacaagggcctgtactgtgactacagcgtggaccggcccaggtatgaaacaggagtgtgtgcctgcaagtctgtgggctgtgagttcaaccaggtgcactaccacaacggccaggtgttccagcccaaccccctcttcagctgcctgtgtgtgtctggggccatcggctgcacccccctcttcatccccaagctggccggcagccactgcagcggggccaagggcggcaagaagagtgaccagagcaactgcagcctggagcccctgctgcagcagctgagcaccagctacaagaccatgcctgcctacagaaacctgcccctcatctggaagaagaagtgcctggtgcaggccaccaagtggaccccctgcagcaggacctgtggcatgggcatcagcaacagagtgaccaatgaaaacagcaactgtgagatgaggaaggagaagaggctgtgctacatccagccctgtgacagcaacatcctgaagaccatcaagatccccaagggcaagacctgccagcccaccttccagctgagcaaggccgagaagtttgtgttcagcggctgcagcagcacccagagctacaagcccaccttctgtggcatctgcctggacaagcgctgctgcatccccaacaagagcaagatgatcaccatccagtttgactgccccaatgaaggcagcttcaagtggaagatgctgtggatcaccagctgtgtgtgccagaggaactgccgggagcccggggacatcttcagcgagctgaagatcctgtag

SEQ ID NO: 176129 - DNA, 1065 bp, Artificial Sequence; identical to SEQ ID NO: 157286
  Description of Artificial Sequence: Synthetic coding sequence

SEQ ID NO: 176130 - DNA, 693 bp, Artificial Sequence
  Description of Artificial Sequence: Synthetic coding sequence
atgcagggcctgctcttcagcaccctgctgctggccggcctggcccagttctgctgccgggtgcagggcaccggccccctggacaccaccccagagggccggcctggagaggtgtctgatgccccccagaggaagcagttctgccactggccctgcaagtgcccccagcagaagccccgctgccccccaggagtgtccctggtgagagatggctgcggctgctgcaagatctgtgccaagcagcccggggagatctgcaatgaagctgacctgtgtgacccccacaagggcctgtactgtgactacagcgtggaccggcccaggtatgaaacaggagtgtgtgcctacctggtggccgtgggctgtgagttcaaccaggtgcactaccacaacggccaggtgttccagcccaaccccctcttcagctgcctgtgtgtgtctggggccatcggctgcacccccctcttcatccccaagctggccggcagccactgcagcggggccaagggcggcaagaagagtgaccagagcaactgcagcctggagcccctgctgcagcagctgagcaccagctacaagaccatgcctgcctacagaaacctgcccctcatctggaagaagaatgtgctgtgcaagcagcagaatggcctgcctgcccctgagcacgtgggctgggagtacctgactggatag

SEQ ID NO: 176131 - DNA, 393 bp, Artificial Sequence
  Description of Artificial Sequence: Synthetic coding sequence
atgggcatcagcaacagagtgaccaatgaaaacagcaactgtgagatgaggaaggagaagaggctgtgctacatccagccctgtgacagcaacatcctgaagaccatcaagatccccaagggcaagacctgccagcccaccttccagctgagcaaggccgagaagtttgtgttttctggctgcagcagcacccagagctacaagcccaccttctgtggcatctgcctggacaagcgctgctgcatccccaacaagagcaagatgatcaccatccagtttgactgccccaatgaaggcagcttcaagtggaagatgctgtggatcaccagctgtgtgtgccagaggaactgccgggagcccggggacatcttcagcgagctgaagatcctgtag

SEQ ID NO: 176132 - DNA, 1626 bp, Artificial Sequence
  Description of Artificial Sequence: Synthetic coding sequence
atggccggggccatcatcgagaacatgagcaccaagaagctgtgcatcgtgggcggcatcctgctggtgttccagatcatcgccttcctggtgggcggcctgattgcccctggccccaccacagctgtgtcctacatgtctgtgaagtgtgtggatgccaggaagaaccaccacaagaccaagtggtttgtgccctggggccccaaccactgtgacaagatccgggacatcgaggaggccatcccccgggagattgaggccaatgacatcgtgttttctgtgcacatccccctgccccacatggagatgagcccctggttccagttcatgctgttcatcctgcagctggacatcgccttcaagctgaacaaccagatccgggagaatgctgaggtgtccatggatgtgtccctggcctacagagatgatgcctttgctgagtggacagagatggcccacgagcgggtgcccaggaagctgaagtgcaccttcaccagccccaagaccccagagcacgagggccgctactatgaatgtgatgtgctgcccttcatggagatcggctctgtggcccacaagttctacctgctgaacatccggctgcctgtgaatgagaagaagaagatcaacgtgggcattggagagatcaaggacatccggctggtgggcatccaccagaatggaggcttcaccaaggtgtggtttgccatgaagaccttcctgacccccagcatcttcatcatcatggtgtggtactggaggcgcatcaccatgatgagccggccccctgtgctgctggagaaggtgatctttgccctgggcatctccatgaccttcatcaacatccctgtggagtggttcagcattggatttgactggacctggatgctgctgtttggagacatccggcagggcatcttctacgccatgctgctgtccttctggatcatcttctgtggggagcacatgatggaccagcatgaaagaaaccacatcgccggctactggaagcaggtgggccccatcgctgtgggcagcttctgcctcttcatctttgacatgtgtgagcggggcgtgcagctgaccaaccccttctacagcatctggaccacagacattggaacagagctggccatggccttcatcatcgtggccggcatctgcctgtgcctgtacttcctgttcctgtgcttcatggtgttccaggtgttcaggaacatcagcggcaagcagagcagcctgcctgccatgagcaaggtgcggcggctgcactatgagggcctcatcttccgcttcaagttcctgatgctgatcaccctggcctgtgccgccatgaccgtcatcttcttcatcgtgtcccaggtgacagagggccactggaagtggggcggcgtgacagtgcaggtgaacagcgccttcttcaccggcatctacggcatgtggaacctgtatgtgtttgccctgatgttcctgtatgcccccagccacaagaactatggagaggaccagagcaatggagacctgggcgtgcacagcggggaggagctgcagctgaccaccaccatcacccacgtggatggccccacagagatctacaagctgaccaggaaggaggcccaggagtag

SEQ ID NO: 176133 - DNA, 1632 bp, Artificial Sequence
  Description of Artificial Sequence: Synthetic coding sequence
atggccggggccatcatcgagaacatgagcaccaagaagctgtgcatcgtgggcggcatcctgctggtgttccagatcatcgccttcctggtgggcggcctgattggccccaccacagctgtgtcctacatgtctgtgaagtgtgtggatgccaggaagaaccaccacaagaccaagtggtttgtgccctggggccccaaccactgtgacaagatccgggacatcgaggaggccatcccccgggagattgaggccaatgacatcgtgttttctgtgcacatccccctgccccacatggagatgagcccctggttccagttcatgctgttcatcctgcagctggacatcgccttcaagctgaacaaccagatccgggagaatgctgaggtgtccatggatgtgtccctggcctacagagatgatgcctttgctgagtggacagagatggcccacgagcgggtgcccaggaagctgaagtgcaccttcaccagccccaagaccccagagcacgagggccgctactatgaatgtgatgtgctgcccttcatggagatcggctctgtggcccacaagttctacctgctgaacatccggctgcctgtgaatgagaagaagaagatcaacgtgggcattggagagatcaaggacatccggctggtgggcatccaccagaatggaggcttcaccaaggtgtggtttgccatgaagaccttcctgacccccagcatcttcatcatcatggtgtggtactggaggcgcatcaccatgatgagccggccccctgtgctgctggagaaggtgatctttgccctgggcatctccatgaccttcatcaacatccctgtggagtggttcagcattggatttgactggacctggatgctgctgtttggagacatccggcagggcatcttctacgccatgctgctgtccttctggatcatcttctgtggggagcacatgatggaccagcatgaaagaaaccacatcgccggctactggaagcaggtgggccccatcgctgtgggcagcttctgcctcttcatctttgacatgtgtgagcggggcgtgcagctgaccaaccccttctacagcatctggaccacagacattggaacagagctggccatggccttcatcatcgtggccggcatctgcctgtgcctgtacttcctgttcctgtgcttcatggtgttccaggtgttcaggaacatcagcggcaagcagagcagcctgcctgccatgagcaaggtgcggcggctgcactatgagggcctcatcttccgcttcaagttcctgatgctgatcaccctggcctgtgccgccatgaccgtcatcttcttcatcgtgtcccaggtgacagagggccactggaagtggggcggcgtgacagtgcaggtgaacagcgccttcttcaccggcatctacggcatgtggaacctgtatgtgtttgccctgatgttcctgtatgcccccagccacaagaactatggagaggaccagagcaatggcatgcagctgccctgcaagagccgggaggactgtgccctgtttgtgtctgagctgtaccaggagctgttcagcgccagcaagtacagcttcatcaatgacaatgctgccagcggcatctag

SEQ ID NO: 176134 - DNA, 1353 bp, Artificial Sequence
  Description of Artificial Sequence: Synthetic coding sequence
atggccggggccatcatcgagaacatgagcaccaagaagctgtgcatcgtgggcggcatcctgctggtgttccagatcatcgccttcctggtgggcggcctgattggagaaaatgctgaggtgtccatggatgtgtccctggcctacagagatgatgcctttgctgagtggacagagatggcccacgagcgggtgcccaggaagctgaagtgcaccttcaccagccccaagaccccagagcacgagggccgctactatgaatgtgatgtgctgcccttcatggagatcggctctgtggcccacaagttctacctgctgaacatccggctgcctgtgaatgagaagaagaagatcaacgtgggcatcggggagatcaaggacatccggctggtgggcatccaccagaatggaggcttcaccaaggtgtggtttgccatgaagaccttcctgacccccagcatcttcatcatcatggtgtggtactggaggcgcatcaccatgatgagcaggcctcctgtgctgctggagaaggtgatctttgccctgggcatctccatgaccttcatcaacatccctgtggagtggttcagcatcggctttgactggacctggatgctgctgtttggagacatccggcagggcatcttctacgccatgctgctgtccttctggatcatcttctgtggggagcacatgatggaccagcacgagaggaaccacatcgccggctactggaagcaggtgggccccatcgctgtgggcagcttctgcctcttcatctttgacatgtgtgagcggggcgtgcagctgaccaaccccttctacagcatctggaccacagacatcggcacagagctggccatggccttcatcatcgtggccggcatctgcctgtgcctgtacttcctgttcctgtgcttcatggtgttccaggtgttcaggaacatcagcggcaagcagagcagcctgcctgccatgagcaaggtgcggcggctgcactatgagggcctcatcttccgcttcaagttcctgatgctgatcaccctggcctgtgccgccatgaccgtcatcttcttcatcgtgtcccaggtgacagagggccactggaagtggggcggcgtgacagtgcaggtgaacagcgccttcttcaccggcatctacggcatgtggaacctgtatgtgtttgccctgatgttcctgtatgcccccagccacaagaactacggggaggaccagagcaatggagacctgggcgtgcacagcggggaggagctgcagctgaccaccaccatcacccacgtggatggccccacagagatctacaagctgaccaggaaggaggcccaggagtag

SEQ ID NO: 176135 - DNA, 1638 bp, Artificial Sequence
  Description of Artificial Sequence: Synthetic coding sequence
atggccggggccatcatcgagaacatgagcaccaagaagctgtgcatcgtgggcggcatcctgctggtgttccagatcatcgccttcctggtgggcggcctgattgcccctggccccaccacagctgtgtcctacatgtctgtgaagtgtgtggatgccaggaagaaccaccacaagaccaagtggtttgtgccctggggccccaaccactgtgacaagatccgggacatcgaggaggccatcccccgggagattgaggccaatgacatcgtgttttctgtgcacatccccctgccccacatggagatgagcccctggttccagttcatgctgttcatcctgcagctggacatcgccttcaagctgaacaaccagatccgggagaatgctgaggtgtccatggatgtgtccctggcctacagagatgatgcctttgctgagtggacagagatggcccacgagcgggtgcccaggaagctgaagtgcaccttcaccagccccaagaccccagagcacgagggccgctactatgaatgtgatgtgctgcccttcatggagatcggctctgtggcccacaagttctacctgctgaacatccggctgcctgtgaatgagaagaagaagatcaacgtgggcattggagagatcaaggacatccggctggtgggcatccaccagaatggaggcttcaccaaggtgtggtttgccatgaagaccttcctgacccccagcatcttcatcatcatggtgtggtactggaggcgcatcaccatgatgagccggccccctgtgctgctggagaaggtgatctttgccctgggcatctccatgaccttcatcaacatccctgtggagtggttcagcattggatttgactggacctggatgctgctgtttggagacatccggcagggcatcttctacgccatgctgctgtccttctggatcatcttctgtggggagcacatgatggaccagcatgaaagaaaccacatcgccggctactggaagcaggtgggccccatcgctgtgggcagcttctgcctcttcatctttgacatgtgtgagcggggcgtgcagctgaccaaccccttctacagcatctggaccacagacattggaacagagctggccatggccttcatcatcgtggccggcatctgcctgtgcctgtacttcctgttcctgtgcttcatggtgttccaggtgttcaggaacatcagcggcaagcagagcagcctgcctgccatgagcaaggtgcggcggctgcactatgagggcctcatcttccgcttcaagttcctgatgctgatcaccctggcctgtgccgccatgaccgtcatcttcttcatcgtgtcccaggtgacagagggccactggaagtggggcggcgtgacagtgcaggtgaacagcgccttcttcaccggcatctacggcatgtggaacctgtatgtgtttgccctgatgttcctgtatgcccccagccacaagaactatggagaggaccagagcaatggcatgcagctgccctgcaagagccgggaggactgtgccctgtttgtgtctgagctgtaccaggagctgttcagcgccagcaagtacagcttcatcaatgacaatgctgccagcggcatctag

SEQ ID NO: 176136 - DNA, 2142 bp, Artificial Sequence
  Description of Artificial Sequence: Synthetic coding sequence
atggccggcagcttctgctggaggatgctgggcctggtgtccaaggtgggcaacagagcccgctgcttcagctccatggccgccagcgaggaggagctgctggacttcagcggcagcgagctgcagttcaacagctgcagcctgcacctgagcctgcaccccttcttcaacttcctgctgggcatccacagctgctttgtgtgcaaggagagcaagacagatgtgaagagatgtgtggtgacccagtgtgggaagttctaccacgaggcctgtgtgaagaagtaccccctgactgtgtttgagagccggggcttccgctgccccctgcacagctgtgtgtcctgccacgccagcaaccccagcaacccccggcccagcaagggcaagatgatgagatgtgtgcgctgccctgtggcctaccacagcggagatgcctgcctggccgccggctgcagcgtcatcgccagcaacagcatcatctgcacagcccacttcaccgccaggaagggcaagaggcaccacgcccacgtgaatgtgtcctggtgctttgtgtgcagcaaaggaggcagcctgctgtgctgtgagagctgcccagctgccttccacccagactgcctgaacatcgagatgccagatggctcctggttctgcaatgactgccgggccggcaagaagctgcacttccaggacatcatctgggtgaagctgggcaactaccgctggtggccagctgaggtgtgccaccccaagaatgtgccccccaacatccagaagatgaagcatgaaattggagagttccctgtgttcttcttcggcagcaaggactactactggacccaccaggcccgggtcttcccctacatggagggggaccggggcagccgctaccagggcgtgcggggcatcggccgggtcttcaagaatgccctgcaggaggccgaggcccgcttccgggagatcaagctgcagcgggaggcccgggagacccaggagagcgagaggaagcccccaccctacaagcacatcaaggtgaacaagccctacggcaaggtgcagatctacacagctgacatcagcgagatccccaagtgcaactgcaagcccacagatgagaacccctgtggctttgacagtgaatgtctgaacaggatgctgatgtttgagtgccacccccaggtgtgcccagctggggagttctgccagaaccagtgcttcaccaagaggcagtacccagagaccaagatcatcaagacagatggcaagggctggggcctggtggccaagagggacatcagaaaaggagaatttgtgaatgaatatgtgggggagctgattgatgaggaggagtgcatggcccgcatcaagcacgcccatgaaaatgacatcacccacttctacatgctgaccatcgacaaggaccgcatcattgatgctggccccaagggcaactacagccgcttcatgaaccacagctgccagcccaactgtgagaccctgaagtggacagtgaatggagacaccagggtgggcctgtttgctgtgtgtgacatcccagctggaacagagctgaccttcaactacaacctggactgcctgggcaatgagaagacagtgtgccgctgtggggccagcaactgcagcggcttcctgggggaccggcccaagaccagcaccaccctgagcagcgaggagaagggcaagaagaccaagaagaagaccaggagaagaagagccaagggggagggcaagaggcagagtgaagatgagtgcttccgctgtggagatggcggccagctggtgctgtgtgacaggaagttctgcaccaaggcctaccacctgagctgcctgggcctgggcaagaggccctttgggaagtgggagtgcccctggcaccactgtgatgtgtgtgggaagcccagcaccagcttctgccacctgtgccccaacagcttctgcaaggagcaccaggatggaacagccttcagctgcaccccagatggccgcagctactgctgtgaacatgacctgggcgccgcctctgtgcgcagcaccaagacagagaagcccccacctgagcccgggaagcccaagggcaagagaagaagaagaagaggctggaggagagtgacagagggcaagtag

SEQ ID NO: 176137 - DNA, 4098 bp, Artificial Sequence
  Description of Artificial Sequence: Synthetic coding sequence
atggagttcagcatcaagcagagccccctgtctgtgcagagcgtggtgaagtgcatcaagatgaagcaggcccctgagatcctgggcagcgccaacgggaagacccccagctgtgaggtgaacagagaatgttctgtgttcctgagcaaggcccagctgagcagcagcctgcaggagggcgtgatgcagaagttcaacggccatgatgccctgcccttcatcccagctgacaagctgaaggacctgaccagcagggtcttcaacggggagcccggggcccatgatgccaagctgcgctttgagagccaggagatgaagggcatcggcaccccacccaacaccacccccatcaagaatggcagccctgagatcaagctgaagatcaccaagacctacatgaatggcaagcccctgtttgagagcagcatctgtggggacagcgctgctgatgtgtcccagagcgaggagaatggccagaagccagagaacaaggcccggaggaacaggaagaggagcatcaagtatgacagcctgctggagcagggcctggtggaggccgccctggtgtccaagatcagcagccccagcgacaagaagatcccagccaagaaggagagctgccccaacacaggccgggacaaggaccacctgctgaagtacaacgtgggggacctggtgtggagcaaggtgtctggctacccctggtggccctgcatggtgtctgctgaccccctgctgcacagctacaccaagctgaagggccagaagaagagcgcccggcagtaccacgtgcagttctttggagatgcccctgagcgggcctggatctttgagaagagcctggtggcctttgaaggagagggccagtttgagaagctgtgccaggagagcgccaagcaggcccccaccaaggccgagaagatcaagctgctgaagcccatcagcggcaagctgcgggcccagtgggagatgggcatcgtgcaggccgaggaggccgcctccatgtctgtggaggagaggaaggccaagttcaccttcctgtatgtgggggaccagctgcacctgaacccccaggtggccaaggaggccggcattgctgctgagagcctgggggagatggccgagagcagtggagtgtctgaggaggccgctgagaaccccaagtctgtgcgggaggagtgcatccccatgaagagaagaagaagagccaagctgtgcagcagcgctgagaccctggagagccacccagacatcggcaagagcaccccccagaagacagctgaggccgacccccggcggggcgtgggcagccccccaggcaggaagaagaccaccgtgtccatgcccaggagcaggaaaggagatgctgccagccagttcctggtgttctgccagaagcacagagatgaggtggtggccgagcacccagatgccagcggggaggagattgaggagctgctgcggagccagtggagcctgctgtctgagaagcagagggcccgctacaacaccaagtttgccctggtggcccctgtgcaggccgaggaggacagcggaaatgtgaatggcaagaagaggaaccacaccaagaggatccaggaccccacagaagatgctgaggccgaggacacccccaggaagaggctgaggacagacaagcacagcctgaggaagagggacaccatcacagacaagacagcccggaccagcagctacaaggccatggaggccgccagcagcctgaagagccaggccgccaccaagaacctgagtgatgcctgcaagcccctgaagaagaggaacagagccagcacagctgccagcagcgccctgggcttcagcaagagcagcagccccagcgccagcctgacagaaaatgaggtgtctgacagccctggagatgagcccagcgagagcccctatgaatctgcagatgagacccagacagaggtgtctgtgagcagcaagaagtctgagcggggcgtgacagccaagaaggagtatgtgtgccagctgtgtgagaagccaggcagcctgctgctgtgtgagggcccctgctgcggggccttccacctggcctgcctgggcctgagcagaagacctgagggccgcttcacctgcagtgaatgtgccagcggcatccacagctgctttgtgtgcaaggagagcaagacagatgtgaagagatgtgtggtgacccagtgtgggaagttctaccacgaggcctgtgtgaagaagtaccccctgactgtgtttgagagccggggcttccgctgccccctgcacagctgtgtgtcctgccacgccagcaaccccagcaacccccggcccagcaagggcaagatgatgagatgtgtgcgctgccctgtggcctaccacagcggagatgcctgcctggccgccggctgcagcgtcatcgccagcaacagcatcatctgcacagcccacttcaccgccaggaagggcaagaggcaccacgcccacgtgaatgtgtcctggtgctttgtgtgcagcaaaggaggcagcctgctgtgctgtgagagctgcccagctgccttccacccagactgcctgaacatcgagatgccagatggctcctggttctgcaatgactgccgggccggcaagaagctgcacttccaggacatcatctgggtgaagctgggcaactaccgctggtggccagctgaggtgtgccaccccaagaatgtgccccccaacatccagaagatgaagcatgaaattggagagttccctgtgttcttcttcggcagcaaggactactactggacccaccaggcccgggtcttcccctacatggagggggaccggggcagccgctaccagggcgtgcggggcatcggccgggtcttcaagaatgccctgcaggaggccgaggcccgcttccgggagatcaagctgcagcgggaggcccgggagacccaggagagcgagaggaagcccccaccctacaagcacatcaaggtgaacaagccctacggcaaggtgcagatctacacagctgacatcagcgagatccccaagtgcaactgcaagcccacagatgagaacccctgtggctttgacagtgaatgtctgaacaggatgctgatgtttgagtgccacccccaggtgtgcccagctggggagttctgccagaaccagtgcttcaccaagaggcagtacccagagaccaagatcatcaagacagatggcaagggctggggcctggtggccaagagggacatcagaaaaggagaatttgtgaatgaatatgtgggggagctgattgatgaggaggagtgcatggcccgcatcaagcacgcccatgaaaatgacatcacccacttctacatgctgaccatcgacaaggaccgcatcattgatgctggccccaagggcaactacagccgcttcatgaaccacagctgccagcccaactgtgagaccctgaagtggacagtgaatggagacaccagggtgggcctgtttgctgtgtgtgacatcccagctggaacagagctgaccttcaactacaacctggactgcctgggcaatgagaagacagtgtgccgctgtggggccagcaactgcagcggcttcctgggggaccggcccaagaccagcaccaccctgagcagcgaggagaagggcaagaagaccaagaagaagaccaggagaagaagagccaagggggagggcaagaggcagagtgaagatgagtgcttccgctgtggagatggcggccagctggtgctgtgtgacaggaagttctgcaccaaggcctaccacctgagctgcctgggcctgggcaagaggccctttgggaagtgggagtgcccctggcaccactgtgatgtgtgtgggaagcccagcaccagcttctgccacctgtgccccaacagcttctgcaaggagcaccaggatggaacagccttcagctgcaccccagatggccgcagctactgctgtgaacatgacctgggcgccgcctctgtgcgcagcaccaagacagagaagcccccacctgagcccgggaagcccaagggcaagagaagaagaagaagaggctggaggagagtgacagagggcaagtag

SEQ ID NO: 176138 - DNA, 4098 bp, Artificial Sequence; identical to SEQ ID NO: 176137
  Description of Artificial Sequence: Synthetic coding sequence

SEQ ID NO: 176139 - DNA, 4098 bp, Artificial Sequence; identical to SEQ ID NO: 176137
  Description of Artificial Sequence: Synthetic coding sequence

SEQ ID NO: 176140 - DNA, 1944 bp, Artificial Sequence
  Description of Artificial Sequence: Synthetic coding sequence
atggagttcagcatcaagcagagccccctgtctgtgcagagcgtggtgaagtgcatcaagatgaagcaggcccctgagatcctgggcagcgccaacgggaagacccccagctgtgaggtgaacagagaatgttctgtgttcctgagcaaggcccagctgagcagcagcctgcaggagggcgtgatgcagaagttcaacggccatgatgccctgcccttcatcccagctgacaagctgaaggacctgaccagcagggtcttcaacggggagcccggggcccatgatgccaagctgcgctttgagagccaggagatgaagggcatcggcaccccacccaacaccacccccatcaagaatggcagccctgagatcaagctgaagatcaccaagacctacatgaatggcaagcccctgtttgagagcagcatctgtggggacagcgctgctgatgtgtcccagagcgaggagaatggccagaagccagagaacaaggcccggaggaacaggaagaggagcatcaagtatgacagcctgctggagcagggcctggtggaggccgccctggtgtccaagatcagcagccccagcgacaagaagatcccagccaagaaggagagctgccccaacacaggccgggacaaggaccacctgctgaagtacaacgtgggggacctggtgtggagcaaggtgtctggctacccctggtggccctgcatggtgtctgctgaccccctgctgcacagctacaccaagctgaagggccagaagaagagcgcccggcagtaccacgtgcagttctttggagatgcccctgagcgggcctggatctttgagaagagcctggtggcctttgaaggagagggccagtttgagaagctgtgccaggagagcgccaagcaggcccccaccaaggccgagaagatcaagctgctgaagcccatcagcggcaagctgcgggcccagtgggagatgggcatcgtgcaggccgaggaggccgcctccatgtctgtggaggagaggaaggccaagttcaccttcctgtatgtgggggaccagctgcacctgaacccccaggtggccaaggaggccggcattgctgctgagagcctgggggagatggccgagagcagtggagtgtctgaggaggccgctgagaaccccaagtctgtgcgggaggagtgcatccccatgaagagaagaagaagagccaagctgtgcagcagcgctgagaccctggagagccacccagacatcggcaagagcaccccccagaagacagctgaggccgacccccggcggggcgtgggcagccccccaggcaggaagaagaccaccgtgtccatgcccaggagcaggaaaggagatgctgccagccagttcctggtgttctgccagaagcacagagatgaggtggtggccgagcacccagatgccagcggggaggagattgaggagctgctgcggagccagtggagcctgctgtctgagaagcagagggcccgctacaacaccaagtttgccctggtggcccctgtgcaggccgaggaggacagcggaaatgtgaatggcaagaagaggaaccacaccaagaggatccaggaccccacagaagatgctgaggccgaggacacccccaggaagaggctgaggacagacaagcacagcctgaggaagagggacaccatcacagacaagacagcccggaccagcagctacaaggccatggaggccgccagcagcctgaagagccaggccgccaccaagaacctgagtgatgcctgcaagcccctgaagaagaggaacagagccagcacagctgccagcagcgccctgggcttcagcaagagcagcagccccagcgccagcctgacagaaaatgagctgctgtgggagcccacccctgtgaagctggacctgaacccagctgccctgtactgcacctag

SEQ ID NO: 176141 - DNA, 1890 bp, Artificial Sequence
  Description of Artificial Sequence: Synthetic coding sequence
atggagttcagcatcaagcagagccccctgtctgtgcagagcgtggtgaagtgcatcaagatgaagcaggcccctgagatcctgggcagcgccaacgggaagacccccagctgtgaggtgaacagagaatgttctgtgttcctgagcaaggcccagctgagcagcagcctgcaggagggcgtgatgcagaagttcaacggccatgatgccctgcccttcatcccagctgacaagctgaaggacctgaccagcagggtcttcaacggggagcccggggcccatgatgccaagctgcgctttgagagccaggagatgaagggcatcggcaccccacccaacaccacccccatcaagaatggcagccctgagatcaagctgaagatcaccaagacctacatgaatggcaagcccctgtttgagagcagcatctgtggggacagcgctgctgatgtgtcccagagcgaggagaatggccagaagccagagaacaaggcccggaggaacaggaagaggagcatcaagtatgacagcctgctggagcagggcctggtggaggccgccctggtgtccaagatcagcagccccagcgacaagaagatcccagccaagaaggagagctgccccaacacaggccgggacaaggaccacctgctgaagtacaacgtgggggacctggtgtggagcaaggtgtctggctacccctggtggccctgcatggtgtctgctgaccccctgctgcacagctacaccaagctgaagggccagaagaagagcgcccggcagtaccacgtgcagttctttggagatgcccctgagcgggcctggatctttgagaagagcctggtggcctttgaaggagagggccagtttgagaagctgtgccaggagagcgccaagcaggcccccaccaaggccgagaagatcaagctgctgaagcccatcagcggcaagctgcgggcccagtgggagatgggcatcgtgcaggccgaggaggccgcctccatgtctgtggaggagaggaaggccaagttcaccttcctgtatgtgggggaccagctgcacctgaacccccaggtggccaaggaggccggcattgctgctgagagcctgggggagatggccgagagcagtggagtgtctgaggaggccgctgagaaccccaagtctgtgcgggaggagtgcatccccatgaagagaagaagaagagccaagctgtgcagcagcgctgagaccctggagagccacccagacatcggcaagagcaccccccagaagacagctgaggccgacccccggcggggcgtgggcagccccccaggcaggaagaagaccaccgtgtccatgcccaggagcaggaaaggagatgctgccagccagttcctggtgttctgccagaagcacagagatgaggtggtggccgagcacccagatgccagcggggaggagattgaggagctgctgcggagccagtggagcctgctgtctgagaagcagagggcccgctacaacaccaagtttgccctggtggcccctgtgcaggccgaggaggacagcggaaatgtgaatggcaagaagaggaaccacaccaagaggatccaggaccccacagaagatgctgaggccgaggacacccccaggaagaggctgaggacagacaagcacagcctgaggaagagggacaccatcacagacaagacagcccggaccagcagctacaaggccatggaggccgccagcagcctgaagagccaggccgccaccaagaacctgagtgatgcctgcaagcccctgaagaagaggaacagagccagcacagctgccagcagcgccctgggcttcagcaagagcagcagccccagcgccagcctgacagaaaatgaggtgaagtag

SEQ ID NO: 176142 - DNA, 822 bp, Artificial Sequence
  Description of Artificial Sequence: Synthetic coding sequence
atggagttcagcatcaagcagagccccctgtctgtgcagagcgtggtgaagtgcatcaagatgaagcaggcccctgagatcctgggcagcgccaacgggaagacccccagctgtgaggtgaacagagaatgttctgtgttcctgagcaaggcccagctgagcagcagcctgcaggagggcgtgatgcagaagttcaacggccatgatgccctgcccttcatcccagctgacaagctgaaggacctgaccagcagggtcttcaacggggagcccggggcccatgatgccaagctgcgctttgagagccaggagatgaagggcatcggcaccccacccaacaccacccccatcaagaatggcagccctgagatcaagctgaagatcaccaagacctacatgaatggcaagcccctgtttgagagcagcatctgtggggacagcgctgctgatgtgtcccagagcgaggagaatggccagaagccagagaacaaggcccggaggaacaggaagaggagcatcaagtatgacagcctgctggagcagggcctggtggaggccgccctggtgtccaagatcagcagccccagcgacaagaagatcccagccaagaaggagagctgccccaacacaggccgggacaaggaccacctgctgaagtacaacgtgggggacctggtgtggagcaaggtgtctggctacccctggtggccctgcatggtgtctgctgaccccctgctgcacagctacaccaagctgaagggcatcttcaagagcaagaagtttgagcacctgaagaccagccagatcgtgctgaaggactag

SEQ ID NO: 176143 - DNA, 1944 bp, Artificial Sequence; identical to SEQ ID NO: 176140
  Description of Artificial Sequence: Synthetic coding sequence

SEQ ID NO: 176144 - DNA, 114 bp, Artificial Sequence
  Description of Artificial Sequence: Synthetic coding sequence
atggagttcagcatcaagcagagccccctgtctgtgcagagcgtggtgaagtgcatcaagatgaagcaggcccctgagatcctgggcagcgccaacgggaagacccccagctag

SEQ ID NO: 176145 - DNA, 4098 bp, Artificial Sequence; identical to SEQ ID NO: 176137
  Description of Artificial Sequence: Synthetic coding sequence

SEQ ID NO: 176146 - DNA, 1179 bp, Artificial Sequence
  Description of Artificial Sequence: Synthetic coding sequence
atggagttcagcatcaagcagagccccctgtctgtgcagagcgtggtgaagtgcatcaagatgaagcaggcccctgagatcctgggcagcgccaacgggaagacccccagctgtgaggtgaacagagaatgttctgtgttcctgagcaaggcccagctgagcagcagcctgcaggagggcgtgatgcagaagttcaacggccatgatgccctgcccttcatcccagctgacaagctgaaggacctgaccagcagggtcttcaacggggagcccggggcccatgatgccaagctgcgctttgagagccaggagatgaagggcatcggcaccccacccaacaccacccccatcaagaatggcagccctgagatcaagctgaagatcaccaagacctacatgaatggcaagcccctgtttgagagcagcatctgtggggacagcgctgctgatgtgtcccagagcgaggagaatggccagaagccagagaacaaggcccggaggaacaggaagaggagcatcaagtatgacagcctgctggagcagggcctggtggaggccgccctggtgtccaagatcagcagccccagcgacaagaagatcccagccaagaaggagagctgccccaacacaggccgggacaaggaccacctgctgaagtacaacgtgggggacctggtgtggagcaaggtgtctggctacccctggtggccctgcatggtgtctgctgaccccctgctgcacagctacaccaagctgaagggccagaagaagagcgcccggcagtaccacgtgcagttctttggagatgcccctgagcgggcctggatctttgagaagagcctggtggcctttgaaggagagggccagtttgagaagctgtgccaggagagcgccaagcaggcccccaccaaggccgagaagatcaagctgctgaagcccatcagcggcaagctgcgggcccagtgggagatgggcatcgtgcaggccgaggaggccgcctccatgtctgtggaggagaggaaggccaagttcaccttcctgtatgtgggggaccagctgcacctgaacccccaggtggccaaggaggccggcattgctgctgagagcctgggggagatggccgagagcagtggagtgtctgaggaggccgctgagaaccccaagtctgtgcgggagtag

SEQ ID NO: 176147 - DNA, 1890 bp, Artificial Sequence; identical to SEQ ID NO: 176141
  Description of Artificial Sequence: Synthetic coding sequence

SEQ ID NO: 176148 - DNA, 600 bp, Artificial Sequence
  Description of Artificial Sequence: Synthetic coding sequence
atggagttcagcatcaagcagagccccctgtctgtgcagagcgtggtgaagtgcatcaagatgaagcaggcccctgagatcctgggcagcgccaacgggaagacccccagctgtgaggtgaacagagaatgttctgtgttcctgagcaaggcccagctgagcagcagcctgcaggagggcgtgatgcagaagttcaacggccatgatgccctgcccttcatcccagctgacaagctgaaggacctgaccagcagggtcttcaacggggagcccggggcccatgatgccaagctgcgctttgagagccaggagatgaagggcatcggcaccccacccaacaccacccccatcaagaatggcagccctgagatcaagctgaagatcaccaagacctacatgaatggcaagcccctgtttgagagcagcatctgtggggacagcgctgctgatgtgtcccagagcgaggagaatggccagaagccagagaacaaggcccggaggaacaggaagaggagcatcaagtatgacagcctgctggagcagggcctggtggaggccgccctggtgtccaagatcagcagccccagcgacaagaagtag

SEQ ID NO: 176149 - DNA, 1938 bp, Artificial Sequence
  Description of Artificial Sequence: Synthetic coding sequence
atggacttctccttctccttcatgcagggcatcatgggcaacaccatccagcagcccccccagctgattgattctgccaacatccggcaggaggatgcctttgacaacaacagcgacattgctgaagatggcggccagaccccctatgaggccaccctgcagcagggcttccagtacccagccaccacagaggacctgccccccctgaccaacggctaccccagcagcatctctgtgtatgagacccagaccaagtaccagagctacaaccagtaccccaacggcagcgccaacggctttggagctgtgaggaacttcagccccacagactactaccacagcgagatccccaacacccggccccatgagatcctggagaagcccagccccccccagcccccacctccacccagcgtgccccagaccgtcatccccaagaagacaggcagccctgagatcaagctgaagatcaccaagaccatccagaatggccgggagctgtttgagagcagcctgtgtggggacctgctgaatgaggtgcaggccagcgagcacaccaagagcaagcatgagagcaggaaggagaagaggaagaagagcaacaagcatgacagcagccgctctgaggagaggaagagccacaagatccccaagctggagcctgaggagcagaaccggcccaatgaaagagtggacacagtgtctgagaagccccgggaggagcctgtgctgaaggaggaggcccctgtgcagcccatcctgagctctgtgcccaccacagaggtgtccactggagtgaagttccaggtgggggacctggtgtggagcaaggtgggcacctacccctggtggccctgcatggtgtccagtgacccccagctggaggtgcacaccaagatcaacaccaggggggcccgggagtaccacgtgcagttcttcagcaaccagcctgagcgggcctgggtgcatgagaagagggtgcgggagtacaagggccacaagcagtatgaggagctgctggccgaggccaccaagcaggccagcaaccacagcgagaagcagaagatcaggaagccccggccccagcgggagcgggcccagtgggacatcggcatcgcccatgctgagaaggccctgaagatgacccgggaggagagaattgagcagtacaccttcatctacatcgacaagcagcctgaggaggccctgagccaggccaagaagtctgtggccagcaagacagaggtgaagaagacccggcggcccaggtctgtgctgaacacccagcctgagcagaccaatgctggggaggtggccagcagcctgagcagcacagagatccgccgccacagccagaggaggcacaccagcgctgaggaggaggagcccccacctgtgaagatcgcctggaagacagctgctgccaggaagagcctgcctgccagcatcaccatgcacaagggcagcctggacctgcagaagtgcaacatgagccctgtggtgaagattgagcaggtgtttgccctgcagaatgccactggagatggcaagttcatcgaccagtttgtgtacagcaccaagggcatcggcaacaagacagagatctctgtgcggggccaggacaggctcatcatcagcacccccaaccagagaaatgagaagcccacccagagcgtgagcagccctgaggccaccagcggcagcactggatctgtggagaagaagcagcagaggaggagcatccgcaccaggtctgagagcgagaagagcacagaggtggtgcccaagaagaagatcaagaaggagcaggtggagaccgtgccccaggccaccgtgaagacaggcctgcagaagggcagcgctgaccggggcgtgcagggctctgtgcgcttcagtgacagctctgtgtctgctgccatcgaggagaccgtggactag

SEQ ID NO: 176150 - DNA, 4314 bp, Artificial Sequence
  Description of Artificial Sequence: Synthetic coding sequence
atggacttctccttctccttcatgcagggcatcatgggcaacaccatccagcagcccccccagctgattgattctgccaacatccggcaggaggatgcctttgacaacaacagcgacattgctgaagatggcggccagaccccctatgaggccaccctgcagcagggcttccagtacccagccaccacagaggacctgccccccctgaccaacggctaccccagcagcatctctgtgtatgagacccagaccaagtaccagagctacaaccagtaccccaacggcagcgccaacggctttggagctgtgaggaacttcagccccacagactactaccacagcgagatccccaacacccggccccatgagatcctggagaagcccagccccccccagcccccacctccacccagcgtgccccagaccgtcatccccaagaagacaggcagccctgagatcaagctgaagatcaccaagaccatccagaatggccgggagctgtttgagagcagcctgtgtggggacctgctgaatgaggtgcaggccagcgagcacaccaagagcaagcatgagagcaggaaggagaagaggaagaagagcaacaagcatgacagcagccgctctgaggagaggaagagccacaagatccccaagctggagcctgaggagcagaaccggcccaatgaaagagtggacacagtgtctgagaagccccgggaggagcctgtgctgaaggaggaggcccctgtgcagcccatcctgagctctgtgcccaccacagaggtgtccactggagtgaagttccaggtgggggacctggtgtggagcaaggtgggcacctacccctggtggccctgcatggtgtccagtgacccccagctggaggtgcacaccaagatcaacaccaggggggcccgggagtaccacgtgcagttcttcagcaaccagcctgagcgggcctgggtgcatgagaagagggtgcgggagtacaagggccacaagcagtatgaggagctgctggccgaggccaccaagcaggccagcaaccacagcgagaagcagaagatcaggaagccccggccccagcgggagcgggcccagtgggacatcggcatcgcccatgctgagaaggccctgaagatgacccgggaggagagaattgagcagtacaccttcatctacatcgacaagcagcctgaggaggccctgagccaggccaagaagtctgtggccagcaagacagaggtgaagaagacccggcggcccaggtctgtgctgaacacccagcctgagcagaccaatgctggggaggtggccagcagcctgagcagcacagagatccgccgccacagccagaggaggcacaccagcgctgaggaggaggagcccccacctgtgaagatcgcctggaagacagctgctgccaggaagagcctgcctgccagcatcaccatgcacaagggcagcctggacctgcagaagtgcaacatgagccctgtggtgaagattgagcaggtgtttgccctgcagaatgccactggagatggcaagttcatcgaccagtttgtgtacagcaccaagggcatcggcaacaagacagagatctctgtgcggggccaggacaggctcatcatcagcacccccaaccagagaaatgagaagcccacccagagcgtgagcagccctgaggccaccagcggcagcactggatctgtggagaagaagcagcagaggaggagcatccgcaccaggtctgagagcgagaagagcacagaggtggtgcccaagaagaagatcaagaaggagcaggtggagaccgtgccccaggccaccgtgaagacaggcctgcagaagggggccagcgagatcagtgacagctgcaagcccctgaagaagaggagccgggccagcacagatgtggagatgaccagcagcgcctacagagacaccagtgacagcgacagccggggcctgagtgacctgcaggtgggctttgggaagcaggtggacagccccagcgccacagcagatgctgatgtgtctgatgtgcagagcatggacagcagcctgagccggcggggcaccggcatgagcaagaaggacacagtgtgccagatctgtgagagcagcggggacagcctcatcccctgtgagggggagtgctgcaagcacttccacctggagtgcctgggcctggccagcctgcctgacagcaagttcatctgcatggagtgcaagacaggccagcacccctgcttcagctgcaaggtgtctgggaaggatgtgaagcgctgcagcgtgggcgcctgtgggaagttctaccacgaggcctgtgtgaggaagttccccacagccatctttgagagcaagggcttccgctgcccccagcactgctgcagcgcctgcagcatggagaaggacatccacaaggccagcaaaggaaggatgatgcgctgcctgcgctgccctgtggcctaccacagcggagatgcctgcatcgctgctggctccatgctggtgagcagctacatcctgatctgcagcaaccacagcaagaggagcagcaacagcagcgctgtgaatgtgggcttctgctttgtgtgtgcccggggcctgattgtgcaggaccacagcgaccccatgttcagcagctatgcctacaagagccactacctgctgaatgaaagcaacagagctgagctgatgaagctgcccatgatccccagcagcagcgccagcaagaagaagtgtgagaagggcggccgcctgctgtgctgtgagagctgcccagccagcttccaccctgagtgcctgagcattgagatgcctgagggctgctggaactgcaatgactgcaaggccggcaagaagctgcactacaagcagatcgtgtgggtgaagctgggcaactaccgctggtggccagctgagatctgcaaccccaggtctgtgcccctgaacatccagggcctgaagcatgacctgggggacttccctgtgttcttcttcggcagccatgactactactgggtgcaccagggccgggtcttcccctacgtggagggggacaagagctttgctgagggccagaccagcatcaacaagaccttcaagaaggccctggaggaggccgccaagcgcttccaggagctgaaggcccagcgggagagcaaggaggccctggagattgagaagaacagcaggaagcccccaccctacaagcacatcaaggccaacaaggtgattggcaaggtgcagatccaggtggccgacctgtctgagatcccccgctgcaactgcaagccagcagatgagaacccctgtggcctggagagtgaatgtctgaacaggatgctgcagtatgagtgccacccccaggtgtgcccagctggggaccgctgccagaaccagtgcttcaccaagaggctgtacccagatgctgagatcatcaagacagagcggcggggctggggcctgcggaccaagaggagcatcaagaagggggagtttgtgaatgaatatgtgggggagctgattgatgaggaggagtgccgcctgcgcatcaagagggcccatgaaaattctgtgaccaacttctacatgctgactgtgaccaaggaccgcatcattgatgctggccccaagggcaactacagccgcttcatgaaccacagctgcaaccccaactgtgagacccagaagtggacagtgaatggagatgtgcgggtgggcctgtttgccctgtgtgacatcccagctggcatggagctgaccttcaactacaacctggactgcctgggcaatggccgcacagagtgccactgtggggctgacaactgcagcggcttcctgggcgtgcggcccaagagcgcctgtgccagcaccaatgaggagaaggccaagaatgccaagctgaagcagaagaggaggaagatcaagacagagcccaagcagatgcatgaggactactgcttccagtgtggagatggaggagagctggtgatgtgtgacaagaaggactgccccaaggcctaccacctgctgtgcctgaacctgacccagcccccctacggcaagtgggagtgcccctggcaccagtgtgatgaatgtagcagcgctgctgtgtccttctgtgagttctgcccccacagcttctgcaaggaccacgagaagggggccctggtgcccagcgccctggagggccgcctgtgctgcagcgagcatgaccccatggcccctgtgtccccagagtactggagcaagatcaagtgcaagtgggagagccaggaccatggagaggaggtgaaggagtag

SEQ ID NO: 176151 - DNA, 4167 bp, Artificial Sequence
  Description of Artificial Sequence: Synthetic coding sequence
atggacttctccttctccttcatgcagggcatcatgggcaacaccatccagcagcccccccagctgattgattctgccaacatccggcaggaggatgcctttgacaacaacagcgacattgctgaagatggcggccagaccccctatgaggccaccctgcagcagggcttccagtacccagccaccacagaggacctgccccccctgaccaacggctaccccagcagcatctctgtgtatgagacccagaccaagtaccagagctacaaccagtaccccaacggcagcgccaacggctttggagctgtgaggaacttcagccccacagactactaccacagcgagatccccaacacccggccccatgagatcctggagaagcccagccccccccagcccccacctccacccagcgtgccccagaccgtcatccccaagaagacaggcagccctgagatcaagctgaagatcaccaagaccatccagaatggccgggagctgtttgagagcagcctgtgtggggacctgctgaatgaggtgcaggccagcgagcacaccaagagcaagcatgagagcaggaaggagaagaggaagaagagcaacaagcatgacagcagccgctctgaggagaggaagagccacaagatccccaagctggagcctgaggagcagaaccggcccaatgaaagagtggacacagtgtctgagaagccccgggaggagcctgtgctgaaggaggaggcccctgtgcagcccatcctgagctctgtgcccaccacagaggtgtccactggagtgaagttccaggtgggggacctggtgtggagcaaggtgggcacctacccctggtggccctgcatggtgtccagtgacccccagctggaggtgcacaccaagatcaacaccaggggggcccgggagtaccacgtgcagttcttcagcaaccagcctgagcgggcctgggtgcatgagaagagggtgcgggagtacaagggccacaagcagtatgaggagctgctggccgaggccaccaagcaggccagcaaccacagcgagaagcagaagatcaggaagccccggccccagcgggagcgggcccagtgggacatcggcatcgcccatgctgagaaggccctgaagatgacccgggaggagagaattgagcagtacaccttcatctacatcgacaagcagcctgaggaggccctgagccaggccaagaagtctgtggccagcaagacagaggtgaagaagacccggcggcccaggtctgtgctgaacacccagcctgagcagaccaatgctggggaggtggccagcagcctgagcagcacagagatccgccgccacagccagaggaggcacaccagcgctgaggaggaggagcccccacctgtgaagatcgcctggaagacagctgctgccaggaagagcctgcctgccagcatcaccatgcacaagggcagcctggacctgcagaagtgcaacatgagccctgtggtgaagattgagcaggtgtttgccctgcagaatgccactggagatggcaagttcatcgaccagtttgtgtacagcaccaagggcatcggcaacaagacagagatctctgtgcggggccaggacaggctcatcatcagcacccccaaccagagaaatgagaagcccacccagagcgtgagcagccctgaggccaccagcggcagcactggatctgtggagaagaagcagcagaggaggagcatccgcaccaggtctgagagcgagaagagcacagaggtggtgcccaagaagaagatcaagaaggagcaggtggagaccgtgccccaggccaccgtgaagacaggcctgcagaagggggccagcgagatcagtgacagctgcaagcccctgaagaagaggagccgggccagcacagatgtggagatgaccagcagcgcctacagagacaccagtgacagcgacagccggggcctgagtgacctgcaggtgggctttgggaagcaggtggacagccccagcgccacagcagatgctgatgtgtctgatgtgcagagcatggacagcagcctgagccggcggggcaccggcatgagcaagaaggacacagtgtgccagatctgtgagagcagcggggacagcctcatcccctgtgagggggagtgctgcaagcacttccacctggagtgcctgggcctggccagcctgcctgacagcaagttcatctgcatggagtgcaagacaggccagcacccctgcttcagctgcaaggtgtctgggaaggatgtgaagcgctgcagcgtgggcgcctgtgggaagttctaccacgaggcctgtgtgaggaagttccccacagccatctttgagagcaagggcttccgctgcccccagcactgctgcagcgcctgcagcatggagaaggacatccacaaggccagcaaaggaaggatgatgcgctgcctgcgctgccctgtggcctaccacagcggagatgcctgcatcgctgctggctccatgctggtgagcagctacatcctgatctgcagcaaccacagcaagaggagcagcaacagcagcgctgtgaatgtgggcttctgctttgtgtgtgcccggggcggccgcctgctgtgctgtgagagctgcccagccagcttccacccagaatgtctgagcattgagatgcctgagggctgctggaactgcaatgactgcaaggccggcaagaagctgcactacaagcagatcgtgtgggtgaagctgggcaactaccgctggtggccagctgagatctgcaaccccaggtctgtgcccctgaacatccagggcctgaagcatgacctgggggacttccctgtgttcttcttcggcagccatgactactactgggtgcaccagggccgggtcttcccctacgtggagggggacaagagctttgctgagggccagaccagcatcaacaagaccttcaagaaggccctggaggaggccgccaagcgcttccaggagctgaaggcccagcgggagagcaaggaggccctggagattgagaagaacagcaggaagcccccaccctacaagcacatcaaggccaacaaggtgattggcaaggtgcagatccaggtggccgacctgtctgagatcccccgctgcaactgcaagccagcagatgagaacccctgtggcctggagagcgagtgcctgaacaggatgctgcagtatgagtgccacccccaggtgtgcccagctggggaccgctgccagaaccagtgcttcaccaagaggctgtacccagatgctgagatcatcaagacagaaagaagaggctggggcctgcggaccaagaggagcatcaagaagggggagtttgtgaatgaatatgtgggggagctgattgatgaggaggagtgccgcctgcgcatcaagagggcccacgagaacagcgtgaccaacttctacatgctgactgtgaccaaggaccgcatcattgatgctggccccaagggcaactacagccgcttcatgaaccacagctgcaaccccaactgtgagacccagaagtggacagtgaatggagatgtgcgggtgggcctgtttgccctgtgtgacatcccagctggcatggagctgaccttcaactacaacctggactgcctgggcaatggaagaacagagtgccactgtggggctgacaactgcagcggcttcctgggcgtgcggcccaagagcgcctgtgccagcaccaatgaggagaaggccaagaatgccaagctgaagcagaagaggaggaagatcaagacagagcccaagcagatgcatgaggactactgcttccagtgtggagatggaggagagctggtgatgtgtgacaagaaggactgccccaaggcctaccacctgctgtgcctgaacctgacccagcccccctacggcaagtgggagtgcccctggcaccagtgtgatgagtgcagcagcgctgctgtgtccttctgtgagttctgcccccacagcttctgcaaggaccacgagaagggggccctggtgcccagcgccctggagggccgcctgtgctgcagcgagcatgaccccatggcccctgtgtccccagagtactggagcaagatcaagtgcaagtgggagagccaggaccacggggaggaggtgaaggagtag

SEQ ID NO: 176152 - DNA, 4125 bp, Artificial Sequence
  Description of Artificial Sequence: Synthetic coding sequence
atggacttctccttctccttcatgcagggcatcatgggcaacaccatccagcagcccccccagctgattgattctgccaacatccggcaggaggatgcctttgacaacaacagcgacattgctgaagatggcggccagaccccctatgaggccaccctgcagcagggcttccagtacccagccaccacagaggacctgccccccctgcccccacctcctccttctgtgccccagaccgtcatccccaagaagacaggcagccctgagatcaagctgaagatcaccaagaccatccagaatggccgggagctgtttgagagcagcctgtgtggggacctgctgaatgaggtgcaggccagcgagcacaccaagagcaagcatgagagcaggaaggagaagaggaagaagagcaacaagcatgacagcagccgctctgaggagaggaagagccacaagatccccaagctggagcctgaggagcagaaccggcccaatgaaagagtggacacagtgtctgagaagccccgggaggagcctgtgctgaaggaggaggcccctgtgcagcccatcctgagctctgtgcccaccacagaggtgtccactggagtgaagttccaggtgggggacctggtgtggagcaaggtgggcacctacccctggtggccctgcatggtgtccagtgacccccagctggaggtgcacaccaagatcaacaccaggggggcccgggagtaccacgtgcagttcttcagcaaccagcctgagcgggcctgggtgcatgagaagagggtgcgggagtacaagggccacaagcagtatgaggagctgctggccgaggccaccaagcaggccagcaaccacagcgagaagcagaagatcaggaagccccggccccagcgggagcgggcccagtgggacattggaattgcccacgccgagaaggccctgaagatgacccgggaggagcgcatcgagcagtacaccttcatctacatcgacaagcagcctgaggaggccctgagccaggccaagaagtctgtggccagcaagacagaggtgaagaagacccggcggcccaggtctgtgctgaacacccagcctgagcagaccaatgctggggaggtggccagcagcctgagcagcacagagatcagaagacacagccagaggaggcacaccagcgctgaggaggaggagcccccacctgtgaagatcgcctggaagacagctgctgccaggaagagcctgcctgccagcatcaccatgcacaagggcagcctggacctgcagaagtgcaacatgagccctgtggtgaagattgagcaggtgtttgccctgcagaatgccactggagatggcaagttcatcgaccagtttgtgtacagcaccaagggcatcggcaacaagacagagatctctgtgcggggccaggacaggctcatcatcagcacccccaaccagagaaatgagaagcccacccagagcgtgagcagccctgaggccaccagcggcagcacaggctctgtggagaagaagcagcagaggaggagcatccgcaccaggtctgagagcgagaagagcacagaggtggtgcccaagaagaagatcaagaaggagcaggtggagaccgtgccccaggccaccgtgaagacaggcctgcagaagggggccagcgagatcagtgacagctgcaagcccctgaagaagaggagccgggccagcacagatgtggagatgaccagcagcgcctacagagacaccagtgacagcgacagccggggcctgagtgacctgcaggtgggctttgggaagcaggtggacagccccagcgccacagcagatgctgatgtgtctgatgtgcagagcatggacagcagcctgagcagaagaggcaccggcatgagcaagaaggacacagtgtgccagatctgtgagagcagcggggacagcctcatcccctgtgaaggagagtgctgcaagcacttccacctggagtgcctgggcctggccagcctgcctgacagcaagttcatctgcatggagtgcaagacaggccagcacccctgcttcagctgcaaggtgtctgggaaggatgtgaagcgctgcagcgtgggcgcctgtgggaagttctaccacgaggcctgtgtgaggaagttccccacagccatctttgagagcaagggcttccgctgcccccagcactgctgcagcgcctgcagcatggagaaggacatccacaaggccagcaagggccgcatgatgcgctgcctgcgctgccctgtggcctaccacagcggagatgcctgcatcgccgccggctccatgctggtgtcctcctacatcctgatctgcagcaaccacagcaagaggagcagcaacagcagcgctgtgaatgtgggcttctgctttgtgtgtgcccggggcctcatcgtgcaggaccacagcgaccccatgttcagcagctatgcctacaagagccactacctgctgaatgaaagcaacagagctgagctgatgaagctgcccatgatccccagcagcagcgccagcaagaagaagtgtgagaagggcggccgcctgctgtgctgtgagagctgcccagccagcttccacccagaatgtctgagcattgagatgcctgagggctgctggaactgcaatgactgcaaggccggcaagaagctgcactacaagcagatcgtgtgggtgaagctgggcaactaccgctggtggccagctgagatctgcaaccccaggtctgtgcccctgaacatccagggcctgaagcatgacctgggggacttccctgtgttcttcttcggcagccatgactactactgggtgcaccagggccgggtcttcccctacgtggagggggacaagagctttgctgagggccagaccagcatcaacaagaccttcaagaaggccctggaggaggccgccaagcgcttccaggagctgaaggcccagcgggagagcaaggaggccctggagattgagaagaacagcaggaagcccccaccctacaagcacatcaaggccaacaaggtgattggcaaggtgcagatccaggtggccgacctgtctgagatcccccgctgcaactgcaagccagcagatgagaacccctgtggcctggagagcgagtgcctgaacaggatgctgcagtatgagtgccacccccaggtgtgcccagctggggaccgctgccagaaccagtgcttcaccaagaggctgtacccagatgctgagatcatcaagacagaaagaagaggctggggcctgcggaccaagaggagcatcaagaagggggagtttgtgaatgaatatgtgggggagctgattgatgaggaggagtgccgcctgcgcatcaagagggcccacgagaacagcgtgaccaacttctacatgctgactgtgaccaaggaccgcatcattgatgctggccccaagggcaactacagccgcttcatgaaccacagctgcaaccccaactgtgagacccagaagtggacagtgaatggagatgtgcgggtgggcctgtttgccctgtgtgacatcccagctggcatggagctgaccttcaactacaacctggactgcctgggcaatggaagaacagagtgccactgtggggctgacaactgcagcggcttcctgggcgtgcggcccaagagcgcctgtgccagcaccaatgaggagaaggccaagaatgccaagctgaagcagaagaggaggaagatcaagacagagcccaagcagatgcatgaggactactgcttccagtgtggagatggaggagagctggtgatgtgtgacaagaaggactgccccaaggcctaccacctgctgtgcctgaacctgacccagcccccctacggcaagtgggagtgcccctggcaccagtgtgatgagtgcagcagcgctgctgtgtccttctgtgagttctgcccccacagcttctgcaaggaccacgagaagggggccctggtgcccagcgccctggagggccgcctgtgctgcagcgagcatgaccccatggcccctgtgtccccagagtactggagcaagatcaagtgcaagtgggagagccaggaccacggggaggaggtgaaggagtag

SEQ ID NO: 176153 - DNA, 4281 bp, Artificial Sequence
  Description of Artificial Sequence: Synthetic coding sequence
atggacttctccttctccttcatgcagggcatcatgggcaacaccatccagcagcccccccagctgattgattctgccaacatccggcaggaggatgcctttgacaacaacagcgacattgctgaagatggcggccagaccccctatgaggccaccctgcagcagggcttccagtacccagccaccacagaggacctgccccccctgaccaacggctaccccagcagcatctctgtgtatgagacccagaccaagtaccagagctacaaccagtaccccaacggcagcgccaacggctttggagctgtgaggaacttcagccccacagactactaccacagcgagatccccaacacccggccccatgagatcctggagaagcccagccccccccagcccccacctccacccagcgtgccccagaccgtcatccccaagaagacaggcagccctgagatcaagctgaagatcaccaagaccatccagaatggccgggagctgtttgagagcagcctgtgtggggacctgctgaatgaggtgcaggccagcgagcacaccaagagcaagcatgagagcaggaaggagaagaggaagaagagcaacaagcatgacagcagccgctctgaggagaggaagagccacaagatccccaagctggagcctgaggagcagaaccggcccaatgaaagagtggacacagtgtctgagaagccccgggaggagcctgtgctgaaggaggaggcccctgtgcagcccatcctgagctctgtgcccaccacagaggtgtccactggagtgaagttccaggtgggggacctggtgtggagcaaggtgggcacctacccctggtggccctgcatggtgtccagtgacccccagctggaggtgcacaccaagatcaacaccaggggggcccgggagtaccacgtgcagttcttcagcaaccagcctgagcgggcctgggtgcatgagaagagggtgcgggagtacaagggccacaagcagtatgaggagctgctggccgaggccaccaagcaggccagcaaccacagcgagaagcagaagatcaggaagccccggccccagcgggagcgggcccagtgggacatcggcatcgcccatgctgagaaggccctgaagatgacccgggaggagagaattgagcagtacaccttcatctacatcgacaagcagcctgaggaggccctgagccaggccaagaagtctgtggccagcaagacagaggtgaagaagacccggcggcccaggtctgtgctgaacacccagcctgagcagaccaatgctggggaggtggccagcagcctgagcagcacagagatccgccgccacagccagaggaggcacaccagcgctgaggaggaggagcccccacctgtgaagatcgcctggaagacagctgctgccaggaagagcctgcctgccagcatcaccatgcacaagggcagcctggacctgcagaagtgcaacatgagccctgtggtgaagattgagcaggtgtttgccctgcagaatgccactggagatggcaagttcatcgaccagtttgtgtacagcaccaagggcatcggcaacaagacagagatctctgtgcggggccaggacaggctcatcatcagcacccccaaccagagaaatgagaagcccacccagagcgtgagcagccctgaggccaccagcggcagcactggatctgtggagaagaagcagcagaggaggagcatccgcaccaggtctgagagcgagaagagcacagaggtggtgcccaagaagaagatcaagaaggagcaggtggagaccgtgccccaggccaccgtgaagacaggcctgcagaagggggccagcgagatcagtgacagctgcaagcccctgaagaagaggagccgggccagcacagatgtggagatgaccagcagcgcctacagagacaccagtgacagcgacagccggggcctgagtgacctgcaggtgggctttgggaagcaggtggacagccccagcgccacagcagatgctgatgtgtctgatgtgcagagcatggacagcagcctgagccggcggggcaccggcatgagcaagaaggacacagtgtgccagatctgtgagagcagcggggacagcctcatcccctgtgagggggagtgctgcaagcacttccacctggagtgcctgggcctggccagcctgcctgacagcaagttcatctgcatggagtgcaagacaggccagcacccctgcttcagctgcaaggtgtctgggaaggatgtgaagcgctgcagcgtgggcgcctgtgggaagttctaccacgaggcctgtgtgaggaagttccccacagccatctttgagagcaagggcttccgctgcccccagcactgctgcagcgcctgcagcatggagaaggacatccacaaggccagcaaaggaaggatgatgcgctgcctgcgctgccctgtggcctaccacagcggagatgcctgcatcgctgctggctccatgctggtgagcagctacatcctgatctgcagcaaccacagcaagaggagcagcaacagcagcgctgtgaatgtgggcttctgctttgtgtgtgcccggggcctgattgtgcaggaccacagcgaccccatgttcagcagctatgcctacaagagccactacctgctgaatgaaagcaacagagctgagctgatgaagctgcccatgatccccagcagcagcgccagcaagaagaagtgtgagaagggcggccgcctgctgtgctgtgagagctgcccagccagcttccaccctgagtgcctgagcattgagatgcctgagggctgctggaactgcaatgactgcaaggccggcaagaagctgcactacaagcagatcgtgtgggtgaagctgggcaactaccgctggtggccagctgagatctgcaaccccaggtctgtgcccctgaacatccagggcctgaagcatgacctgggggacttccctgtgttcttcttcggcagccatgactactactgggtgcaccagggccgggtcttcccctacgtggagggggacaagagctttgctgagggccagaccagcatcaacaagaccttcaagaaggccctggaggaggccgccaagcgcttccaggagctgaaggcccagcgggagagcaaggaggccctggagattgagaagaacagcaggaagcccccaccctacaagcacatcaaggccaacaaggtgattggcaaggtgcagatccaggtggccgacctgtctgagatcccccgctgcaactgcaagccagcagatgagaacccctgtggcctggagagtgaatgtctgaacaggatgctgcagtatgagtgccacccccaggtgtgcccagctggggaccgctgccagaaccagtgcttcaccaagaggctgtacccagatgctgagatcatcaagacagagcggcggggctggggcctgcggaccaagaggagcatcaagaagggggagtttgtgaatgaatatgtgggggagctgattgatgaggaggagtgccgcctgcgcatcaagagggcccatgaaaattctgaccgcatcattgatgctggccccaagggcaactacagccgcttcatgaaccacagctgcaaccccaactgtgagacccagaagtggacagtgaatggagatgtgcgggtgggcctgtttgccctgtgtgacatcccagctggcatggagctgaccttcaactacaacctggactgcctgggcaatggaagaacagagtgccactgtggggctgacaactgcagcggcttcctgggcgtgcggcccaagagcgcctgtgccagcaccaatgaggagaaggccaagaatgccaagctgaagcagaagaggaggaagatcaagacagagcccaagcagatgcatgaggactactgcttccagtgtggagatggaggagagctggtgatgtgtgacaagaaggactgccccaaggcctaccacctgctgtgcctgaacctgacccagcccccctacggcaagtgggagtgcccctggcaccagtgtgatgagtgcagcagcgctgctgtgtccttctgtgagttctgcccccacagcttctgcaaggaccacgagaagggggccctggtgcccagcgccctggagggccgcctgtgctgcagcgagcatgaccccatggcccctgtgtccccagagtactggagcaagatcaagtgcaagtgggagagccaggaccacggggaggaggtgaaggagtag

SEQ ID NO: 176154 - DNA, 849 bp, Artificial Sequence
  Description of Artificial Sequence: Synthetic coding sequence
atggacttctccttctccttcatgcagggcatcatgggcaacaccatccagcagcccccccagctgattgattctgccaacatccggcaggaggatgcctttgacaacaacagcgacattgctgaagatggcggccagaccccctatgaggccaccctgcagcagggcttccagtacccagccaccacagaggacctgccccccctgaccaacggctaccccagcagcatctctgtgtatgagacccagaccaagtaccagagctacaaccagtaccccaacggcagcgccaacggctttggagctgtgaggaacttcagccccacagactactaccacagcgagatccccaacacccggccccatgagatcctggagaagcccagccccccccagcccccacctccacccagcgtgccccagaccgtcatccccaagaagacaggcagccctgagatcaagctgaagatcaccaagaccatccagaatggccgggagctgtttgagagcagcctgtgtggggacctgctgaatgaggtgcaggccagcgagcacaccaagagcaagcatgagagcaggaaggagaagaggaagaagagcaacaagcatgacagcagccgctctgaggagaggaagagccacaagatccccaagctggagcctgaggagcagaaccggcccaatgaaagagtggacacagtgtctgagaagccccgggaggagcctgtgctgaaggaggaggcccctgtgcagcccatcctgagctctgtgcccaccacagaggtgtccactggagtgaagttccaggtgggggacctggtgtggagcaaggtgggcacctacccctag

SEQ ID NO: 176155 - DNA, 78 bp, Artificial Sequence
  Description of Artificial Sequence: Synthetic coding sequence
atggacttctccttctccttcatgcagggcatcatgggcaacaccatccagcagcccccccagctgattgacagctag

SEQ ID NO: 176156 - DNA, 48 bp, Artificial Sequence
  Description of Artificial Sequence: Synthetic coding sequence
atggacttctccttctccttcatgcagggcatcatgggcaacacctag

SEQ ID NO: 176157 - DNA, 1620 bp, Artificial Sequence
  Description of Artificial Sequence: Synthetic coding sequence
atgcctggccagaggcgggccctgagccccaagatggcctccatgagggagagtgacaccggcctgtggctgcacaacaagctgggcgccacagatgagctgtgggcccctccttccatcgccagcctgctgacagctgctgtgattgacaacatccggctgtgcttccacggcctgagcagcgctgtgaagctgaagctgctgctgggcaccctgcacctgcccaggagaacagtggatgagatgaagggggccctgatggagatcatccagctggccagcctggacagcgacccctgggtgctgatggtggccgacatcctgaagagcttcccagacaccggcagcctgaacctggagctggaggagcagaaccccaacgtgcaggacatcctgggggagctgcgggagaaggtgggagaatgtgaggccagcgccatgctgcccctggagtgccagtacctgaacaagaatgccctgaccaccctggccggccccctgaccccacctgtgaagcacttccagctgaagaggaagcccaagagcgccaccctgcgggcagagctgctgcagaagagcacagaaacagcccagcagctgaagaggtctgctggggtgcccttccacgccaagggccggggcctgctgaggaagatggacaccaccacccccctgaagggcatccccaagcaggcccccttccgcagccccacagcccccagcgtcttcagccccaccggcaacagaacacccatcccccccagcaggaccctgctgaggaaggagcggggcgtgaagctgctggacatcagcgagctggacatggtgggcgccggccgggaggccaagagaagaaggaagaccctggatgctgaggtggtggagaagccagccaaggaggagaccgtggtggagaatgccaccccagactatgctgctggcctggtgtccacccagaagctgggcagcctgaacaatgagcccgccctgcccagcaccagctacctgcccagcaccccatctgtggtgcctgccagcagctacatccccagcagcgagaccccaccagcccccagcagccgggaggccagccggcccccagaggagcccagcgcccccagccccaccctgcctgcccagttcaagcagagggcccccatgtacaacagcggcctgagccctgccacccccaccccagctgcccccaccagccccctgacccccaccaccccacctgctgtggcccccaccacccagaccccacctgtggccatggtggccccccagacccaggccccagcccagcagcagcccaagaagaacctgagcctgacccgggagcagatgtttgctgcccaggagatgttcaagacagccaacaaggtgaccaggcctgagaaggccctgatcctgggcttcatggccggcagccgggagaacccctgccaggagcagggagatgtgatccagatcaagctgtctgagcacacagaggacctgcccaaggcagatggccagggcagcaccaccatgctggtggacacagtgtttgagatgaactatgccaccggccagtggacccgcttcaagaagtacaagcccatgaccaacgtgtcctag

SEQ ID NO: 176158 - DNA, 1587 bp, Artificial Sequence
  Description of Artificial Sequence: Synthetic coding sequence
atggcctccatgagggagagtgacaccggcctgtggctgcacaacaagctgggcgccacagatgagctgtgggccccacccagcatcgccagcctgctgacagctgctgtgattgacaacatccggctgtgcttccacggcctgagcagcgctgtgaagctgaagctgctgctgggcaccctgcacctgcccaggagaacagtggatgagatgaagggggccctgatggagatcatccagctggccagcctggacagcgacccctgggtgctgatggtggccgacatcctgaagagcttcccagacaccggcagcctgaacctggagctggaggagcagaaccccaacgtgcaggacatcctgggggagctgcgggagaaggtgggggagtgtgaggccagcgccatgctgcccctggagtgccagtacctgaacaagaatgccctgaccaccctggccggccccctgaccccacctgtgaagcacttccagctgaagaggaagcccaagagcgccaccctgcgggcagagctgctgcagaagagcacagaaacagcccagcagctgaagaggtctgctggggtgcccttccacgccaagggccggggcctgctgaggaagatggacaccaccacccccctgaagggcatccccaagcaggcccccttccgcagccccacagcccccagcgtcttcagccccactggaaacagaacacccatcccccccagcaggaccctgctgaggaaggagcggggcgtgaagctgctggacatcagcgagctggacatggtgggcgccggccgggaggccaagagaagaaggaagaccctggatgctgaggtggtggagaagccagccaaggaggagaccgtggtggagaatgccaccccagactatgctgctggcctggtgtccacccagaagctgggcagcctgaacaatgaaccagccctgcccagcaccagctacctgcccagcacccccagcgtggtgcctgccagcagctacatccccagcagcgagaccccaccagcccccagcagccgggaggccagcaggcctcctgaggagcccagcgcccccagccccaccctgcctgcccagttcaagcagagggcccccatgtacaacagcggcctgagccctgccacccccaccccagctgcccccaccagccccctgacccccaccaccccacctgctgtggcccccaccacccagaccccacctgtggccatggtggccccccagacccaggccccagcccagcagcagcccaagaagaacctgagcctgacccgggagcagatgtttgctgcccaggagatgttcaagacagccaacaaggtgaccaggcctgagaaggccctgatcctgggcttcatggccggcagccgggagaacccctgccaggagcagggagatgtgatccagatcaagctgtctgagcacacagaggacctgcccaaggcagatggccagggcagcaccaccatgctggtggacacagtgtttgagatgaactatgccaccggccagtggacccgcttcaagaagtacaagcccatgaccaacgtgtcctag

SEQ ID NO: 176159 - DNA, 1182 bp, Artificial Sequence
  Description of Artificial Sequence: Synthetic coding sequence
atgctgcccctggagtgccagtacctgaacaagaatgccctgaccaccctggccggccccctgaccccacctgtgaagcacttccagctgaagaggaagcccaagagcgccaccctgcgggcagagctgctgcagaagagcacagaaacagcccagcagctgaagaggtctgctggggtgcccttccacgccaagggccggggcctgctgaggaagatggacaccaccacccccctgaagggcatccccaagcaggcccccttccgcagccccacagcccccagcgtcttcagccccaccggcaacagaacacccatcccccccagcaggaccctgctgaggaaggagcggggcgtgaagctgctggacatcagcgagctggacatggtgggcgccggccgggaggccaagagaagaaggaagaccctggatgctgaggtggtggagaagccagccaaggaggagaccgtggtggagaatgccaccccagactatgctgctggcctggtgtccacccagaagctgggcagcctgaacaatgagcccgccctgcccagcaccagctacctgcccagcaccccatctgtggtgcctgccagcagctacatccccagcagcgagaccccaccagcccccagcagccgggaggccagccggcccccagaggagcccagcgcccccagccccaccctgcctgcccagttcaagcagagggcccccatgtacaacagcggcctgagccctgccacccccaccccagctgcccccaccagccccctgacccccaccaccccacctgctgtggcccccaccacccagaccccacctgtggccatggtggccccccagacccaggccccagcccagcagcagcccaagaagaacctgagcctgacccgggagcagatgtttgctgcccaggagatgttcaagacagccaacaaggtgaccaggcctgagaaggccctgatcctgggcttcatggccggcagccgggagaacccctgccaggagcagggagatgtgatccagatcaagctgtctgagcacacagaggacctgcccaaggcagatggccagggcagcaccaccatgctggtggacacagtgtttgagatgaactatgccaccggccagtggacccgcttcaagaagtacaagcccatgaccaacgtgtcctag

SEQ ID NO: 176160 - DNA, 462 bp, Artificial Sequence
  Description of Artificial Sequence: Synthetic coding sequence
atgtacaggatgcagctgctgagctgcatcgccctgagcctggccctggtgaccaacagcgcccccaccagcagcagcaccaagaagacccagctgcagctggagcacctgctgctggacctgcagatgatcctgaatggcatcaacaactacaagaaccccaagctgaccaggatgctgaccttcaagttctacatgcccaagaaggccacagagctgaagcacctgcagtgcctggaggaggagctgaagcccctggaggaggtgctgaacctggcccagagcaagaacttccacctgcggccccgggacctgatcagcaacatcaacgtcatcgtgctggagctgaagggcagcgagaccaccttcatgtgtgaatatgcagatgaaacagccaccatcgtggagttcctgaaccgctggatcaccttctgccagagcatcatcagcaccctgacctag

SEQ ID NO: 176161 - DNA, 2673 bp, Artificial Sequence
  Description of Artificial Sequence: Synthetic coding sequence
atggacagcaacacagcccccctgggccccagctgcccccagcccccaccagccccccagccccaggcccggagccggctgaatgccacagccagcctggagcaggagaggtctgagcggccccgggcccctggcccccaggccggccctggccctggggtgagagatgctgctgccccagctgagccccaggcccagcacaccaggagccgggagcgggcagatggcaccggccccaccaagggggacatggagatcccctttgaggaggtgctggagcgggccaaggccggggaccccaaggcccagacagaggtgggcaagcactacctgcagctggccggggacacagatgaggagctgaacagctgcacagctgtggactggctggtgctggccgccaagcagggccggcgggaggccgtgaagctgctgcggcgctgcctggccgaccggcggggcatcaccagtgaaaatgaaagagaggtgcggcagctgagcagcgagacagacctggagagagctgtgaggaaggccgccctggtgatgtactggaagctgaaccccaagaagaagaagcaggtggccgtggccgagctgctggagaatgtgggccaggtgaatgaacatgatggaggagcccagcccggccctgtgcccaagagcctgcagaagcagaggaggatgctggagcggctggtgagcagcgagagcaagaactacatcgccctggatgactttgtggagatcaccaagaagtatgccaagggcgtcatccccagcagcctcttcctgcaggatgatgaagatgatgatgagctggccggcaagagccctgaggacctgcccctgcggctgaaggtggtgaagtaccccctgcacgccatcatggagatcaaggagtacctgattgacatggccagccgggccggcatgcactggctgagcaccatcatccccacccaccacatcaatgccctgatcttcttcttcatcgtgagcaacctgaccatcgacttctttgccttcttcatccccctggtgatcttctacctgtccttcatctccatggtgatctgcaccctgaaggtgttccaggacagcaaggcctgggagaacttccgcaccctgacagacctgctgctgcgctttgagcccaacctggatgtggagcaggccgaggtgaactttggctggaaccacctggagccctatgcccacttcctgctgtctgtgttcttcgtcatcttctccttccccatcgccagcaaggactgcatcccctgcagcgagctggccgtcatcaccggcttcttcaccgtgaccagctacctgagcctgagcacccatgctgagccctacacccggcgggccctggccacagaggtgacagctggcctgctgagcctgctgcccagcatgcccctgaactggccctacctgaaggtgctgggccagaccttcatcaccgtgcctgtgggccacctggtggtgctgaatgtgtctgtgccctgcctgctgtatgtgtacctgctgtacctgttcttcaggatggcccagctgaggaacttcaagggcacctactgctacctggtgccctacctggtgtgcttcatgtggtgtgagctgtctgtggtgatcctgctggagagcacaggcctgggcctgctgcgggccagcatcggctacttcctgttcctgtttgccctgcccatcctggtggccggcctggccctggtgggcgtgctgcagtttgcccgctggttcaccagcctggagctgaccaagattgctgtgacagtggccgtgtgcagcgtgcccctgctgctgcgctggtggaccaaggccagcttctctgtggtgggcatggtgaagagcctgaccaggagctccatggtgaagctgatcctggtgtggctgacagccatcgtgctcttctgctggttctacgtgtacagaagtgagggcatgaaggtgtacaacagcaccctgacctggcagcagtatggagccctgtgtggcccccgggcctggaaggagaccaacatggcccggacccagatcctgtgcagccacctggagggccaccgggtgacctggacaggccgcttcaagtatgtgcgggtgacagacatcgacaacagcgctgagagcgccatcaacatgctgcccttcttcatcggggactggatgcgctgcctgtatggagaggcctacccagcctgcagccctggcaacaccagcacagctgaggaggagctgtgccgcctgaagctgctggccaagcacccctgccacatcaagaagtttgaccgctacaagtttgagatcaccgtgggcatgcccttcagcagtggagcagatggcagccgcagccgggaggaggatgatgtgaccaaggacatcgtgctgcgggccagcagcgagttcaagtctgtgctgctgagcctgcggcagggcagcctgattgagttcagcaccatcctggagggccgcctgggcagcaagtggcctgtgtttgagctgaaggccatcagctgcctgaactgcatggcccagctgagccccacccggcggcacgtgaagattgaacatgactggaggagcacagtgcacggggctgtgaagtttgcctttgacttcttcttcttccccttcctgtctgctgcctag

SEQ ID NO: 176162 - DNA, 807 bp, Artificial Sequence
  Description of Artificial Sequence: Synthetic coding sequence
atggtgaagagcctgaccaggagctccatggtgaagctgatcctggtgtggctgacagccatcgtgctcttctgctggttctacgtgtacagaagtgagggcatgaaggtgtacaacagcaccctgacctggcagcagtatggagccctgtgtggcccccgggcctggaaggagaccaacatggcccggacccagatcctgtgcagccacctggagggccaccgggtgacctggacaggccgcttcaagtatgtgcgggtgacagacatcgacaacagcgctgagagcgccatcaacatgctgcccttcttcatcggggactggatgcgctgcctgtatggagaggcctacccagcctgcagccctggcaacaccagcacagctgaggaggagctgtgccgcctgaagctgctggccaagcacccctgccacatcaagaagtttgaccgctacaagtttgagatcaccgtgggcatgcccttcagcagtggagcagatggcagccgcagccgggaggaggatgatgtgaccaaggacatcgtgctgcgggccagcagcgagttcaagtctgtgctgctgagcctgcggcagggcagcctgattgagttcagcaccatcctggagggccgcctgggcagcaagtggcctgtgtttgagctgaaggccatcagctgcctgaactgcatggcccagctgagccccacccggcggcacgtgaagattgaacatgactggaggagcacagtgcacggggctgtgaagtttgcctttgacttcttcttcttccccttcctgtctgctgcctag

SEQ ID NO: 176163 - DNA, 3342 bp, Artificial Sequence
  Description of Artificial Sequence: Synthetic coding sequence
atgcccaggcctgagctgcccctgcctgagggctgggaggaggcccgggactttgatggcaaggtgtactacatcgaccacaccaacagaaccacctcctggattgacccccgggaccgctacaccaagcccctgacctttgctgactgcatcagtgatgagctgcccctgggctgggaggaggcctatgacccccaggtgggggactacttcatcgaccacaacaccaagaccacccagatcgaggacccccgggtgcagtggaggcgggagcaggagcacatgctgaaggactacctggtggtggcccaggaggccctgagcgcccagaaggagatctaccaggtgaagcagcagaggctggagctggcccagcaggagtaccagcagctgcatgctgtgtgggagcacaagctgggcagccaggtgtccctggtgtctggcagcagcagcagcagcaaatatgaccctgagatcctgaaggccgagatcgccacagccaagagccgggtgaacaagctgaagcgggagatggtgcacctgcagcacgagctgcagttcaaggagcggggcttccagaccctgaagaagattgacaagaagatgtctgatgcccagggcagctacaagctggatgaggcccaggccgtgctgcgggagaccaaggccatcaagaaggccatcacctgtggggagaaggagaagcaggacctgatcaagagcctggccatgctgaaggatggcttcagaacagaccggggcagccacagcgacctgtggagcagcagcagcagcctggagagcagcagcttccccctgcccaagcagtacctggatgtgagcagccagacagacatcagcggcagctttggcatcaacagcaacaaccagctggccgagaaggtgcggctgcggctgcgctatgaggaggccaagagaagaattgccaacctgaagatccagctggccaagctggacagcgaggcctggccaggagtgctggacagcgagcgggacaggctcatcctgatcaatgagaaggaggagctgctgaaggagatgaggttcatcagccccaggaagtggacccagggcgaggtggagcagctggagatggccaggaagaggctggagaaggacctgcaggccgcccgggacacccagagcaaggccctgacagagcggctgaagctgaacagcaagaggaaccagctggtgcgggagctggaggaggccacccggcaggtggccaccctgcacagccagctgaagagcctgagcagctccatgcagagcctgagcagcggcagcagccctggcagcctgaccagcagccggggcagcctggtggccagcagcctggacagcagcaccagcgccagcttcacagacctgtactatgacccctttgagcagctggacagcgagctgcagagcaaggtggagttcctgctgctggagggcgccaccggcttccggcccagcggctgcatcaccaccatccatgaagatgaggtggccaagacccagaaggccgagggcggcggccgcctgcaggccctgcggagcctgagcggcacccccaagtccatgaccagcctgagccccaggagcagcctgagcagccccagccccccctgcagccccctgatggctgaccccctgctggccggagatgccttcctgaacagcctggagtttgaggaccctgagctgagcgccaccctgtgtgagctgagcctgggcaacagcgcccaggagcgctaccgcctggaggagcccggcacagagggcaagcagctgggccaggccgtgaacacagcccagggctgcggcctgaaggtggcctgtgtgtctgctgctgtgtctgatgagagcgtggccggggacagcggcgtgtatgaggcctctgtgcagaggctgggcgccagcgaggccgccgcctttgacagtgatgagagcgaggccgtgggcgccacccgcatccagatcgccctgaagtatgatgagaagaacaagcagtttgccatcctgatcatccagctgagcaacctgagcgccctgctgcagcagcaggaccagaaggtgaacatccgggtggccgtgctgccctgcagcgagagcaccacctgcctcttccgcacccggcccctggatgccagtgacaccctggtgttcaatgaggtgttctgggtgtccatgagctacccagccctgcaccagaagaccctgcgggtggatgtgtgcaccacagacaggagccacctggaggagtgcctgggcggggcccagatcagcctggccgaggtgtgccgctctggagagaggagcacccgctggtacaacctgctgagctacaagtacctgaagaagcagagccgggagctgaagcctgtgggcgtgatggccccagccagcggccctgccagcacagatgctgtgtctgccctgctggagcagacagctgtggagctggagaagaggcaggagggccgcagcagcacccagaccctggaggacagctggaggtatgaggagaccagtgaaaatgaggccgtggccgaggaggaggaggaggaggtggaggaggaggagggggaggaggatgtgttcacagagaaggccagcccagacatggatggctacccagccctgaaggtggacaaggagaccaacacagagaccccagcccccagccccaccgtggtgcggcccaaggaccggcgggtgggcacccccagccagggccccttcctgcggggcagcaccatcatccgcagcaagaccttcagccctggcccccagagccagtatgtgtgccgcctgaacagaagtgacagcgacagcagcaccctgagcaagaagcccccatttgtgaggaacagcctggagaggagatctgtgaggatgaagaggcccagctctgtgaagagcctgcggtctgagcggctcatccgcaccagcctggacctggagctggacctgcaggccaccaggacctggcacagccagctgacccaggagatctctgtgctgaaggagctgaaggagcagctggagcaggccaagagccatggagagaaggagctgccccagtggctgcgggaggatgagcgcttccggctgctgctgaggatgctggagaagaggcagatggacagagctgagcacaagggggagctgcagacagacaagatgatgagagctgctgccaaggatgtgcaccggctgcggggccagagctgcaaggagcccccagaggtgcagagcttccgggagaagatggccttcttcacccggcccaggatgaacatcccagccctgtctgcagatgatgtgtag

SEQ ID NO: 176164 - DNA, 3360 bp, Artificial Sequence
  Description of Artificial Sequence: Synthetic coding sequence
atgcccaggcctgagctgcccctgcctgagggctgggaggaggcccgggactttgatggcaaggtgtactacatcgaccacaccaacagaaccacctcctggattgacccccgggaccgctacaccaagcccctgacctttgctgactgcatcagtgatgagctgcccctgggctgggaggaggcctatgacccccaggtgggggactacttcatcgaccacaacaccaagaccacccagatcgaggacccccgggtgcagtggaggcgggagcaggagcacatgctgaaggactacctggtggtggcccaggaggccctgagcgcccagaaggagatctaccaggtgaagcagcagaggctggagctggcccagcaggagtaccagcagctgcatgctgtgtgggagcacaagctgggcagccaggtgtccctggtgtctggcagcagcagcagcagcaaatatgaccctgagatcctgaaggccgagatcgccacagccaagagccgggtgaacaagctgaagcgggagatggtgcacctgcagcacgagctgcagttcaaggagcggggcttccagaccctgaagaagattgacaagaagatgtctgatgcccagggcagctacaagctggatgaggcccaggccgtgctgcgggagaccaaggccatcaagaaggccatcacctgtggggagaaggagaagcaggacctgatcaagagcctggccatgctgaaggatggcttcagaacagaccggggcagccacagcgacctgtggagcagcagcagcagcctggagagcagcagcttccccctgcccaagcagtacctggatgtgagcagccagacagacatcagcggcagctttggcatcaacagcaacaaccagctggccgagaaggtgcggctgcggctgcgctatgaggaggccaagagaagaattgccaacctgaagatccagctggccaagctggacagcgaggcctggccaggagtgctggacagcgagcgggacaggctcatcctgatcaatgagaaggaggagctgctgaaggagatgaggttcatcagccccaggaagtggacccagggcgaggtggagcagctggagatggccaggaagaggctggagaaggacctgcaggccgcccgggacacccagagcaaggccctgacagagcggctgaagctgaacagcaagaggaaccagctggtgcgggagctggaggaggccacccggcaggtggccaccctgcacagccagctgaagagcctgagcagctccatgcagagcctgagcagcggcagcagccctggcagcctgaccagcagccggggcagcctggtggccagcagcctggacagcagcaccagcgccagcttcacagacctgtactatgacccctttgagcagctggacagcgagctgcagagcaaggtggagttcctgctgctggagggcgccaccggcttccggcccagcggctgcatcaccaccatccatgaagatgaggtggccaagacccagaaggccgagggcggcggccgcctgcaggccctgcggagcctgagcggcacccccaagtccatgaccagcctgagccccaggagcagcctgagcagccccagccccccctgcagccccctgatggctgaccccctgctggccggagatgccttcctgaacagcctggagtttgaggaccctgagctgagcgccaccctgtgtgagctgagcctgggcaacagcgcccaggagcgctaccgcctggaggagcccggcacagagggcaagcagctgggccaggccgtgaacacagcccagggctgcggcctgaaggtggcctgtgtgtctgctgctgtgtctgatgagagcgtggccggggacagcggcgtgtatgaggcctctgtgcagaggctgggcgccagcgaggccgccgcctttgacagtgatgagagcgaggccgtgggcgccacccgcatccagatcgccctgaagtatgatgagaagaacaagcagtttgccatcctgatcatccagctgagcaacctgagcgccctgctgcagcagcaggaccagaaggtgaacatccgggtggccgtgctgccctgcagcgagagcaccacctgcctcttccgcacccggcccctggatgccagtgacaccctggtgttcaatgaggtgttctgggtgtccatgagctacccagccctgcaccagaagaccctgcgggtggatgtgtgcaccacagacaggagccacctggaggagtgcctgggcggggcccagatcagcctggccgaggtgtgccgctctggagagaggagcacccgctggtacaacctgctgagctacaagtacctgaagaagcagagccgggagctgaagcctgtgggcgtgatggccccagccagcggccctgccagcacagatgctgtgtctgccctgctggagcagacagctgtggagctggagaagaggcaggagggccgcagcagcacccagaccctggaggacagctggaggtatgaggagaccagtgaaaatgaggccgtggccgaggaggaggaggaggaggtggaggaggaggagggggaggaggatgtgttcacagagaaggccagcccagacatggatggctacccagccctgaaggtggacaaggagaccaacacagagaccccagcccccagccccaccgtggtgcggcccaaggaccggcgggtgggcacccccagccagggccccttcctgcggggcagcaccatcatccgcagcaagaccttcagccctggcccccagagccagtatgtgtgccgcctgaacagaagtgacagcgacagcagcaccctgagcaagaagcccccatttgtgaggaacagcctggagaggagatctgtgaggatgaagaggcccagccccccaccccagcccagctctgtgaagagcctgcggtctgagcggctcatccgcaccagcctggacctggagctggacctgcaggccaccaggacctggcacagccagctgacccaggagatctctgtgctgaaggagctgaaggagcagctggagcaggccaagagccatggagagaaggagctgccccagtggctgcgggaggatgagcgcttccggctgctgctgaggatgctggagaagaggcagatggacagagctgagcacaagggggagctgcagacagacaagatgatgagagctgctgccaaggatgtgcaccggctgcggggccagagctgcaaggagcccccagaggtgcagagcttccgggagaagatggccttcttcacccggcccaggatgaacatcccagccctgtctgcagatgatgtgtag

SEQ ID NO: 176165 - DNA, 438 bp, Artificial Sequence; identical to SEQ ID NO: 168282
  Description of Artificial Sequence: Synthetic coding sequence

SEQ ID NO: 176166 - DNA, 786 bp, Artificial Sequence
  Description of Artificial Sequence: Synthetic coding sequence
atggccctgaacaagaaccacagcgagggcggcggcgtcatcgtgaacaacacagagagcatcctgatgtcctatgaccacgtggagctgaccttcaatgacatgaagaatgtgcctgaggccttcaagggcaccaagaagggcaccgtgtacctgaccccctacagagtcatcttcctgagcaagggcaaggatgccatgcagagcttcatgatgcccttctacctgatgaaggactgtgagatcaagcagcctgtgtttggagccaactacatcaagggcaccgtgaaggccgaggccggcggcggctgggagggcagcgccagctacaagctgaccttcaccgctgggggcgccatcgagtttggccagaggatgctgcaggtggccagccaggccagcagaggagaggtgcccagcggggcctacggctacagctacatgcccagcggggcctacgtgtacccacctcctgtggccaacggcatgtacccctgccccccaggctacccctacccacctcctcctcctgagttctacccaggcccccccatgatggatggagccatgggctacgtgcagcccccacctccaccctacccaggccccatggagccccctgtgtctggcccagatgtgcccagcaccccagctgctgaggccaaggctgctgaggccgccgccagcgcctactacaaccctggcaacccccacaacgtgtacatgcccaccagccagcccccacctccaccctactacccacctgaggacaagaagacccagtag

SEQ ID NO: 176167 - DNA, 720 bp, Artificial Sequence
  Description of Artificial Sequence: Synthetic coding sequence
atgtcctatgaccacgtggagctgaccttcaatgacatgaagaatgtgcctgaggccttcaagggcaccaagaagggcaccgtgtacctgaccccctacagagtcatcttcctgagcaagggcaaggatgccatgcagagcttcatgatgcccttctacctgatgaaggactgtgagatcaagcagcctgtgtttggagccaactacatcaagggcaccgtgaaggccgaggccggcggcggctgggagggcagcgccagctacaagctgaccttcaccgctgggggcgccatcgagtttggccagaggatgctgcaggtggccagccaggccagcagaggagaggtgcccagcggggcctacggctacagctacatgcccagcggggcctacgtgtacccacctcctgtggccaacggcatgtacccctgccccccaggctacccctacccacctcctcctcctgagttctacccaggcccccccatgatggatggagccatgggctacgtgcagcccccacctccaccctacccaggccccatggagccccctgtgtctggcccagatgtgcccagcaccccagctgctgaggccaaggctgctgaggccgccgccagcgcctactacaaccctggcaacccccacaacgtgtacatgcccaccagccagcccccacctccaccctactacccacctgaggacaagaagacccagtag

SEQ ID NO: 176168 - DNA, 654 bp, Artificial Sequence
  Description of Artificial Sequence: Synthetic coding sequence
atggccctgaacaagaaccacagcgagggcggcggcgtcatcgtgaacaacacagagagcatcctgatgtcctatgaccacgtggagctgaccttcaatgacatgaagaatgtgcctgaggccttcaagggcaccaagaagggcaccgtgtacctgaccccctacagagtcatcttcctgagcaagggcaaggatgccatgcagagcttcatgatgcccttctacctgatgaaggactgtgagatcaagcagcctgtgtttggagccaactacatcaagggcaccgtgaaggccgaggccggggccagcagaggagaggtgcccagcggggcctacggctacagctacatgcccagcggggcctacgtgtacccacctcctgtggccaacggcatgtacccctgccccccaggctacccctacccacctcctcctcctgagttctacccaggcccccccatgatggatggagccatgggctacgtgcagcccccacctccaccctacccaggccccatggagccccctgtgtctggcccagatgtgcccagcaccccagctggggagggcccctgggtgctggccgccctgcgggaccagcccagccccccacgctgcaggacagagagcctgaggatggcccgggactgctag

SEQ ID NO: 176169 - DNA, 630 bp, Artificial Sequence
  Description of Artificial Sequence: Synthetic coding sequence
atggccctgaacaagaaccacagcgagggcggcggcgtcatcgtgaacaacacagagagcatcctgatgtcctatgaccacgtggagctgaccttcaatgacatgaagaatgtgcctgaggccttcaagggcaccaagaagggcaccgtgtacctgaccccctacagagtcatcttcctgagcaagggcaaggatgccatgcagagcttcatgatgcccttctacctgatgaaggactgtgagatcaagcagcctgtgtttggagccaactacatcaagggcaccgtgaaggccgaggccggcggcggctgggagggcagcgccagctacaagctgaccttcaccgcccccatgagcccccccctgctgcagcccaagccccggccccagaagcagcccccagcccccatcaccacccaggccatcgccagcagaagacacctgcccaccacccacaggaagattgaggaccctgtgggccccccagccagcctgccccccaccctcatcagcctgccctaccccagccaccggggctgtgccggggcctggggcggggagggcgccccctgcagccccagcagaagtgaccacaagcagctgcccggcaccagcatcgtgggccactag

SEQ ID NO: 176170 - DNA, 651 bp, Artificial Sequence
  Description of Artificial Sequence: Synthetic coding sequence
atggccctgaacaagaaccacagcgagggcggcggcgtcatcgtgaacaacacagagagcatcctgatgtcctatgaccacgtggagctgaccttcaatgacatgaagaatgtgcctgaggccttcaagggcaccaagaagggcaccgtgtacctgaccccctacagagtcatcttcctgagcaagggcaaggatgccatgcagagcttcatgatgcccttctacctgatgaaggactgtgagatcaagcagcctgtgtttggagccaactacatcaagggcaccgtgaaggccgaggccggcggcggctgggagggcagcgccagctacaagctgaccttcaccgctgggggcgccatcgagtttggccagaggatgctgcaggtggccagccaggagttctacccaggcccccccatgatggatggagccatgggctacgtgcagcccccacctccaccctacccaggccccatggagccccctgtgtctggcccagatgtgcccagcaccccagctgctgaggccaaggctgctgaggccgccgccagcgcctactacaaccctggcaacccccacaacgtgtacatgcccaccagccagcccccacctccaccctactaccccccagaggacaagaagacccagtag

SEQ ID NO: 176171 - DNA, 2769 bp, Artificial Sequence
  Description of Artificial Sequence: Synthetic coding sequence
atggccacagccagccccaggagtgacaccagcaacaaccacagcggccgcctgcagctgcaggtgacagtgagcagcgccaagctgaagaggaagaagaactggtttggaacagccatctacacagaggtggtggtggatggagagatcaccaagacagccaagagcagcagcagcagcaaccccaagtgggatgagcagctgactgtgaatgtgaccccccagaccaccctggagttccaggtgtggagccacaggaccctgaaggcagatgccctgctgggcaaggccaccatcgacctgaagcaggccctgctgatccacaacaggaagctggagcgggtgaaggagcagctgaagctgagcctggagaacaagaatggaattgcccagacaggagagctgactgtggtgctggatggcctggtgattgagcaggagaacatcaccaactgcagcagcagccccaccatcgagatccaggagaatggagatgccctgcatgaaaatggagagcccagcgcccggaccacagcccggctggccgtggagggcaccaatggaattgacaaccacgtgcccaccagcaccctggtgcagaacagctgctgcagctatgtggtgaatggagacaacacccccagcagccccagccaggtggccgcccggcccaagaacaccccagcccccaagcccctggccagcgagccagcagatgacacagtgaatggagagagcagcagctttgcccccacagacaatgcctctgtgacaggcacccctgtggtgtctgaggagaatgccctgagccccaactgcaccagcaccaccgtggaggacccccctgtgcaggagatcctgaccagcagtgaaaataatgaatgcatccccagcaccagcgctgagctggagagcgaggcccggagcatcctggagccagacaccagcaacagccgcagcagcagcgcctttgaggccgccaagagccggcagccagatggctgcatggaccctgtgcggcagcagagcggaaatgccaacacagagaccctgcccagcggctgggagcagaggaaggacccccacggccgcacctactacgtggaccacaacaccaggaccaccacctgggagcggccccagcccctgcccccaggctgggagaggagagtggatgacagaagaagagtgtactacgtggaccacaacaccaggaccaccacctggcagaggcccaccatggagagcgtgaggaactttgagcagtggcagagccagaggaaccagctgcagggcgccatgcagcagttcaaccagcgctacctgtacagcgcctccatgctggccgcagaaaatgacccctacggccccctgcccccaggctgggagaagagggtggacagcacagacagagtgtactttgtgaaccacaacaccaagaccacccagtgggaggaccccaggacccagggcctgcagaatgaggagcccctgcctgagggctgggagatccgctacacccgggagggcgtgcgctactttgtggaccacaacaccaggaccaccaccttcaaggaccccagaaatggcaagagctctgtgaccaagggcggcccccagatcgcctatgagcggggcttccgctggaagctggcccacttccgctacctgtgccagagcaatgccctgcccagccacgtgaagatcaacgtgtcccggcagaccctgtttgaggacagcttccagcagatcatggccctgaagccctatgacctgcggcggcggctgtatgtgatcttccggggggaggagggcctggactatggaggcctggcccgggagtggttcttcctgctgagccatgaggtgctgaaccccatgtactgcctgtttgaatatgctgggaagaacaactactgcctgcagatcaacccagccagcaccatcaacccagaccacctgagctacttctgcttcatcggccgcttcatcgccatggccctcttccacggcaagttcatcgacaccggcttcagcctgcccttctacaagaggatgctgagcaagaagctgaccatcaaggacctggagagcattgacacagagttctacaacagcctcatctggatccgggacaacaacattgaagaatgtggcctggagatgtacttctctgtggacatggagatcctgggcaaggtgaccagccatgacctgaagctgggcggcagcaacatcctggtgacagaggagaacaaggatgagtacatcggcctgatgacagagtggaggttcagccggggcgtgcaggagcagaccaaggccttcctggatggcttcaatgaggtggtgcccctgcagtggctgcagtactttgatgagaaggagctggaggtgatgctgtgtggcatgcaggaggtggacctggccgactggcagaggaacacagtgtaccgccactacaccaggaacagcaagcagatcatctggttctggcagtttgtgaaggagacagacaatgaggtgaggatgaggctgctgcagtttgtgacaggcacctgccgcctgcccctgggcggctttgctgagctgatgggcagcaatggcccccagaagttctgcatcgagaaggtgggcaaggacacctggctgcccaggagccacacctgcttcaaccggctggacctgcccccctacaagagctatgagcagctgaaggagaagctgctgtttgccatcgaggagacagagggcttcggccaggagtag

SEQ ID NO: 176172 - DNA, 2379 bp, Artificial Sequence
  Description of Artificial Sequence: Synthetic coding sequence
atggccacagccagccccaggagtgacaccagcaacaaccacagcggccgcctgcagctgcaggtgacagtgagcagcgccaagctgaagaggaagaagaactggtttggaacagccatctacacagaggtggtggtggatggagagatcaccaagacagccaagagcagcagcagcagcaaccccaagtgggatgagcagctgactgtgaatgtgaccccccagaccaccctggagttccaggtgtggagccacaggaccctgaaggcagatgccctgctgggcaaggccaccatcgacctgaagcaggccctgctgatccacaacaggaagttcaatggagagagcagcagctttgcccccacagacaatgcctctgtgacaggcacccctgtggtgtctgaggagaatgccctgagccccaactgcaccagcaccaccgtggaggacccccctgtgcaggagatcctgaccagcagtgaaaataatgaatgcatccccagcaccagcgctgagctggagagcgaggcccggagcatcctggagccagacaccagcaacagccgcagcagcagcgcctttgaggccgccaagagccggcagccagatggctgcatggaccctgtgcggcagcagagcggaaatgccaacacagagaccctgcccagcggctgggagcagaggaaggacccccacggccgcacctactacgtggaccacaacaccaggaccaccacctgggagcggccccagcccctgcccccaggctgggagaggagagtggatgacagaagaagagtgtactacgtggaccacaacaccaggaccaccacctggcagaggcccaccatggagagcgtgaggaactttgagcagtggcagagccagaggaaccagctgcagggcgccatgcagcagttcaaccagcgctacctgtacagcgcctccatgctggccgcagaaaatgacccctacggccccctgcccccaggctgggagaagagggtggacagcacagacagagtgtactttgtgaaccacaacaccaagaccacccagtgggaggaccccaggacccagggcctgcagaatgaggagcccctgcctgagggctgggagatccgctacacccgggagggcgtgcgctactttgtggaccacaacaccaggaccaccaccttcaaggaccccagaaatggcaagagctctgtgaccaagggcggcccccagatcgcctatgagcggggcttccgctggaagctggcccacttccgctacctgtgccagagcaatgccctgcccagccacgtgaagatcaacgtgtcccggcagaccctgtttgaggacagcttccagcagatcatggccctgaagccctatgacctgcggcggcggctgtatgtgatcttccggggggaggagggcctggactatggaggcctggcccgggagtggttcttcctgctgagccatgaggtgctgaaccccatgtactgcctgtttgaatatgctgggaagaacaactactgcctgcagatcaacccagccagcaccatcaacccagaccacctgagctacttctgcttcatcggccgcttcatcgccatggccctcttccacggcaagttcatcgacaccggcttcagcctgcccttctacaagaggatgctgagcaagaagctgaccatcaaggacctggagagcattgacacagagttctacaacagcctcatctggatccgggacaacaacattgaagaatgtggcctggagatgtacttctctgtggacatggagatcctgggcaaggtgaccagccatgacctgaagctgggcggcagcaacatcctggtgacagaggagaacaaggatgagtacatcggcctgatgacagagtggaggttcagccggggcgtgcaggagcagaccaaggccttcctggatggcttcaatgaggtggtgcccctgcagtggctgcagtactttgatgagaaggagctggaggtgatgctgtgtggcatgcaggaggtggacctggccgactggcagaggaacacagtgtaccgccactacaccaggaacagcaagcagatcatctggttctggcagtttgtgaaggagacagacaatgaggtgaggatgaggctgctgcagtttgtgacaggcacctgccgcctgcccctgggcggctttgctgagctgatgggcagcaatggcccccagaagttctgcatcgagaaggtgggcaaggacacctggctgcccaggagccacacctgcttcaaccggctggacctgcccccctacaagagctatgagcagctgaaggagaagctgctgtttgccatcgaggagacagagggcttcggccaggagtag

SEQ ID NO: 176173 - DNA, 2115 bp, Artificial Sequence
  Description of Artificial Sequence: Synthetic coding sequence
atggccacagccagccccaggagtgacaccagcaacaaccacagcggccgcctgcagctgcaggtgacagtgaatggagagagcagcagctttgcccccacagacaatgcctctgtgacaggcacccctgtggtgtctgaggagaatgccctgagccccaactgcaccagcaccaccgtggaggacccccctgtgcaggagatcctgaccagcagtgaaaataatgaatgcatccccagcaccagcgctgagctggagagcgaggcccggagcatcctggagccagacaccagcaacagccgcagcagcagcgcctttgaggccgccaagagccggcagccagatggctgcatggaccctgtgcggcagcagagcggaaatgccaacacagagaccctgcccagcggctgggagcagaggaaggacccccacggccgcacctactacgtggaccacaacaccaggaccaccacctgggagcggccccagcccctgcccccaggctgggagaggagagtggatgacagaagaagagtgtactacgtggaccacaacaccaggaccaccacctggcagaggcccaccatggagagcgtgaggaactttgagcagtggcagagccagaggaaccagctgcagggcgccatgcagcagttcaaccagcgctacctgtacagcgcctccatgctggccgcagaaaatgacccctacggccccctgcccccaggctgggagaagagggtggacagcacagacagagtgtactttgtgaaccacaacaccaagaccacccagtgggaggaccccaggacccagggcctgcagaatgaggagcccctgcctgagggctgggagatccgctacacccgggagggcgtgcgctactttgtggaccacaacaccaggaccaccaccttcaaggaccccagaaatggcaagagctctgtgaccaagggcggcccccagatcgcctatgagcggggcttccgctggaagctggcccacttccgctacctgtgccagagcaatgccctgcccagccacgtgaagatcaacgtgtcccggcagaccctgtttgaggacagcttccagcagatcatggccctgaagccctatgacctgcggcggcggctgtatgtgatcttccggggggaggagggcctggactatggaggcctggcccgggagtggttcttcctgctgagccatgaggtgctgaaccccatgtactgcctgtttgaatatgctgggaagaacaactactgcctgcagatcaacccagccagcaccatcaacccagaccacctgagctacttctgcttcatcggccgcttcatcgccatggccctcttccacggcaagttcatcgacaccggcttcagcctgcccttctacaagaggatgctgagcaagaagctgaccatcaaggacctggagagcattgacacagagttctacaacagcctcatctggatccgggacaacaacattgaagaatgtggcctggagatgtacttctctgtggacatggagatcctgggcaaggtgaccagccatgacctgaagctgggcggcagcaacatcctggtgacagaggagaacaaggatgagtacatcggcctgatgacagagtggaggttcagccggggcgtgcaggagcagaccaaggccttcctggatggcttcaatgaggtggtgcccctgcagtggctgcagtactttgatgagaaggagctggaggtgatgctgtgtggcatgcaggaggtggacctggccgactggcagaggaacacagtgtaccgccactacaccaggaacagcaagcagatcatctggttctggcagtttgtgaaggagacagacaatgaggtgaggatgaggctgctgcagtttgtgacaggcacctgccgcctgcccctgggcggctttgctgagctgatgggcagcaatggcccccagaagttctgcatcgagaaggtgggcaaggacacctggctgcccaggagccacacctgcttcaaccggctggacctgcccccctacaagagctatgagcagctgaaggagaagctgctgtttgccatcgaggagacagagggcttcggccaggagtag

SEQ ID NO: 176174 - DNA, 336 bp, Artificial Sequence
  Description of Artificial Sequence: Synthetic coding sequence
atggccacagccagccccaggagtgacaccagcaacaaccacagcggccgcctgcagctgcaggtgacagtgagcagcgccaagctgaagaggaagaagaactggtttggaacagccatctacacagaggtggtggtggatggagagatcaccaagacagccaagagcagcagcagcagcaaccccaagtgggatgagcagctgactgtgaatgtgaccccccagaccaccctggagttccaggtgtggagccacaggaccctgaaggcagatgccctgctgggcaaggccaccatcgacctgaagcaggccctgctgatccacaacaggaagtag

SEQ ID NO: 176175 - DNA, 2769 bp, Artificial Sequence; identical to SEQ ID NO: 176171
  Description of Artificial Sequence: Synthetic coding sequence

SEQ ID NO: 176176 - DNA, 2613 bp, Artificial Sequence
  Description of Artificial Sequence: Synthetic coding sequence
atggccagcgccagcagcagcagagctggggtggccctgccctttgagaagagccagctgaccctgaaggtggtgtctgccaagcccaaggtgcacaaccggcagccccgcatcaacagctatgtggaggtggccgtggatggcctgcccagcgagaccaagaagacaggcaagagaattggcagcagcgagctgctgtggaatgagatcatcatcctgaatgtgacagcccagagccacctggacctgaaggtgtggagctgccacaccctgagaaatgagctgctgggcacagcctctgtgaacctgagcaatgtgctgaagaacaacggcggcaagatggagaacatgcagctgaccctgaacctgcagacagagaacaagggctctgtggtgtctggaggagagctgaccatcttcctggatggccccaccgtggacctgggcaatgtgcccaatggaagtgccctgacagatggcagccagctgcccagccgggacagcagcggcacagctgtggcccctgagaacagacaccagccccccagcaccaactgctttggaggccgcagcaggacccaccgccacagcggggccagcgcccggaccaccccagccactggagagcagagccctggggcccggagccgccaccggcagcctgtgaagaacagcggccacagcggcctggccaacggcaccgtgaatgatgagcccaccacagccacagatcctgaggagcccagcgtggtgggcgtgaccagccccccagctgcccccctgtctgtgacccccaaccccaacaccaccagcctgcctgccccagccaccccagctgagggggaggagcccagcaccagcggcacccagcagctgcctgctgctgcccaggccccagatgccctgcctgctggctgggagcagcgggagctgcccaacggccgggtgtactacgtggaccacaacaccaagaccaccacctgggagcggcccctgcccccaggctgggagaagaggacagacccccggggccgcttctactacgtggaccacaacaccaggaccaccacctggcagaggcccacagcagaatatgtgagaaattatgagcagtggcagagccagaggaaccagctgcagggcgccatgcagcacttcagccagcgcttcctgtaccagagcagcagcgccagcacagaccatgaccccctgggccccctgcccccaggctgggagaagaggcaggacaatggccgggtgtactacgtgaaccacaacaccaggaccacccagtgggaggaccccaggacccagggcatgatccaggagcccgccctgcccccaggctgggagatgaagtacaccagcgagggcgtgcgctactttgtggaccacaacaccaggaccaccaccttcaaggaccccaggcctggctttgaaagtggcaccaagcagggcagccctggggcctatgacaggagcttccgctggaagtaccaccagttccgcttcctgtgccacagcaatgccctgcccagccacgtgaagatctctgtgtcccggcagaccctgtttgaggacagcttccagcagatcatgaacatgaagccctatgacctgcggcggcggctgtacatcatcatgagaggagaggagggcctggactatggaggcatcgcccgggagtggttcttcctgctgagccatgaggtgctgaaccccatgtactgcctgtttgaatatgctgggaagaacaactactgcctgcagatcaacccagccagcagcatcaacccagaccacctgacctacttccgcttcatcggccgcttcatcgccatggccctgtaccacggcaagttcatcgacaccggcttcaccctgcccttctacaagaggatgctgaacaagaggcccaccctgaaggacctggagagcattgatcctgagttctacaacagcatcgtgtggatcaaggagaacaacctggaggagtgtggcctggagctgtacttcatccaggacatggagatcctgggcaaggtgaccacccatgagctgaaggagggcggggagagcatccgggtgacagaggagaacaaggaggagtacatcatgctgctgacagactggaggttcacccggggcgtggaggagcagaccaaggccttcctggatggcttcaatgaggtggcccccctggagtggctgcgctactttgatgagaaggagctggagctgatgctgtgtggcatgcaggagattgacatgtctgactggcagaagagcaccatctaccgccactacaccaagaacagcaagcagatccagtggttctggcaggtggtgaaggagatggacaatgagaagaggatccggctgctgcagtttgtgacaggcacctgccgcctgcctgtgggcggctttgctgagctgattggcagcaatggcccccagaagttctgcatcgacaaggtgggcaaggagacctggctgcccaggagccacacctgcttcaaccggctggacctgcccccctacaagagctatgagcagctgcgggagaagctgctgtatgccatcgaggagacagagggcttcggccaggagtag

SEQ ID NO: 176177 - DNA, 2613 bp, Artificial Sequence; identical to SEQ ID NO: 176176
  Description of Artificial Sequence: Synthetic coding sequence

SEQ ID NO: 176178 - DNA, 2613 bp, Artificial Sequence; identical to SEQ ID NO: 176176
  Description of Artificial Sequence: Synthetic coding sequence

SEQ ID NO: 176179 - DNA, 2265 bp, Artificial Sequence
  Description of Artificial Sequence: Synthetic coding sequence
atgcagctgaccctgaacctgcagacagagaacaagggctctgtggtgtctggaggagagctgaccatcttcctggatggccccaccgtggacctgggcaatgtgcccaatggaagtgccctgacagatggcagccagctgcccagccgggacagcagcggcacagctgtggcccctgagaacagacaccagccccccagcaccaactgctttggaggccgcagcaggacccaccgccacagcggggccagcgcccggaccaccccagccactggagagcagagccctggggcccggagccgccaccggcagcctgtgaagaacagcggccacagcggcctggccaacggcaccgtgaatgatgagcccaccacagccacagatcctgaggagcccagcgtggtgggcgtgaccagccccccagctgcccccctgtctgtgacccccaaccccaacaccaccagcctgcctgccccagccaccccagctgagggggaggagcccagcaccagcggcacccagcagctgcctgctgctgcccaggccccagatgccctgcctgctggctgggagcagcgggagctgcccaacggccgggtgtactacgtggaccacaacaccaagaccaccacctgggagcggcccctgcccccaggctgggagaagaggacagacccccggggccgcttctactacgtggaccacaacaccaggaccaccacctggcagaggcccacagcagaatatgtgagaaattatgagcagtggcagagccagaggaaccagctgcagggcgccatgcagcacttcagccagcgcttcctgtaccagagcagcagcgccagcacagaccatgaccccctgggccccctgcccccaggctgggagaagaggcaggacaatggccgggtgtactacgtgaaccacaacaccaggaccacccagtgggaggaccccaggacccagggcatgatccaggagcccgccctgcccccaggctgggagatgaagtacaccagcgagggcgtgcgctactttgtggaccacaacaccaggaccaccaccttcaaggaccccaggcctggctttgaaagtggcaccaagcagggcagccctggggcctatgacaggagcttccgctggaagtaccaccagttccgcttcctgtgccacagcaatgccctgcccagccacgtgaagatctctgtgtcccggcagaccctgtttgaggacagcttccagcagatcatgaacatgaagccctatgacctgcggcggcggctgtacatcatcatgagaggagaggagggcctggactatggaggcatcgcccgggagtggttcttcctgctgagccatgaggtgctgaaccccatgtactgcctgtttgaatatgctgggaagaacaactactgcctgcagatcaacccagccagcagcatcaacccagaccacctgacctacttccgcttcatcggccgcttcatcgccatggccctgtaccacggcaagttcatcgacaccggcttcaccctgcccttctacaagaggatgctgaacaagaggcccaccctgaaggacctggagagcattgatcctgagttctacaacagcatcgtgtggatcaaggagaacaacctggaggagtgtggcctggagctgtacttcatccaggacatggagatcctgggcaaggtgaccacccatgagctgaaggagggcggggagagcatccgggtgacagaggagaacaaggaggagtacatcatgctgctgacagactggaggttcacccggggcgtggaggagcagaccaaggccttcctggatggcttcaatgaggtggcccccctggagtggctgcgctactttgatgagaaggagctggagctgatgctgtgtggcatgcaggagattgacatgtctgactggcagaagagcaccatctaccgccactacaccaagaacagcaagcagatccagtggttctggcaggtggtgaaggagatggacaatgagaagaggatccggctgctgcagtttgtgacaggcacctgccgcctgcctgtgggcggctttgctgagctgattggcagcaatggcccccagaagttctgcatcgacaaggtgggcaaggagacctggctgcccaggagccacacctgcttcaaccggctggacctgcccccctacaagagctatgagcagctgcgggagaagctgctgtatgccatcgaggagacagagggcttcggccaggagtag

SEQ ID NO: 176180 - DNA, 2274 bp, Artificial Sequence
  Description of Artificial Sequence: Synthetic coding sequence
atggagaacatgcagctgaccctgaacctgcagacagaaaataaaggatctgtggtgtctggaggagagctgaccatcttcctggatggccccaccgtggacctgggcaatgtgcccaacggcagcgccctgacagatggcagccagctgcccagccgggacagcagcggcacagctgtggccccagaaaatagacaccagccccccagcaccaactgcttcggcggccgcagcaggacccaccgccacagcggggccagcgcccggaccaccccagccaccggggagcagagccctggggcccggagccgccaccggcagcctgtgaagaacagcggccacagcggcctggccaatggaacagtgaatgatgagcccaccacagccacagatcctgaggagcccagcgtggtgggcgtgaccagccccccagctgcccccctgtctgtgacccccaaccccaacaccaccagcctgcctgccccagccaccccagctgagggggaggagcccagcaccagcggcacccagcagctgcctgctgctgcccaggccccagatgccctgcctgctggctgggagcagcgggagctgcccaacggccgggtgtactacgtggaccacaacaccaagaccaccacctgggagcggcccctgcccccaggctgggagaagaggacagacccccggggccgcttctactacgtggaccacaacaccaggaccaccacctggcagaggcccacagcagaatatgtgaggaactatgagcagtggcagagccagaggaaccagctgcagggcgccatgcagcacttcagccagcgcttcctgtaccagagcagcagcgccagcacagaccatgaccccctgggccccctgcccccaggctgggagaagaggcaggacaatggccgggtgtactacgtgaaccacaacaccaggaccacccagtgggaggaccccaggacccagggcatgatccaggagcccgccctgcccccaggctgggagatgaagtacaccagcgagggcgtgcgctactttgtggaccacaacaccaggaccaccaccttcaaggacccccggcccggctttgagagcggcaccaagcagggcagccctggggcctatgaccgctccttccgctggaagtaccaccagttccgcttcctgtgccacagcaatgccctgcccagccacgtgaagatctctgtgtcccggcagaccctgtttgaagattccttccagcagatcatgaacatgaagccctatgacctgcggcggcggctgtacatcatcatgagaggagaggagggcctggactatggaggcatcgcccgggagtggttcttcctgctgagccatgaggtgctgaaccccatgtactgcctgtttgaatatgccggcaagaacaactactgcctgcagatcaacccagccagcagcatcaacccagaccacctgacctacttccgcttcatcggccgcttcatcgccatggccctgtaccacggcaagttcatcgacaccggcttcaccctgcccttctacaagaggatgctgaacaagaggcccaccctgaaggacctggagagcattgatcctgagttctacaacagcatcgtgtggatcaaggagaacaacctggaggagtgtggcctggagctgtacttcatccaggacatggagatcctgggcaaggtgaccacccatgagctgaaggagggcggggagagcatccgggtgacagaggagaacaaggaggagtacatcatgctgctgacagactggaggttcacccggggcgtggaggagcagaccaaggccttcctggatggcttcaatgaggtggcccccctggagtggctgcgctactttgatgagaaggagctggagctgatgctgtgtggcatgcaggagattgacatgtctgactggcagaagagcaccatctaccgccactacaccaagaacagcaagcagatccagtggttctggcaggtggtgaaggagatggacaatgagaagaggatccggctgctgcagtttgtgacaggcacctgccgcctgcctgtgggcggctttgctgagctgattggcagcaatggcccccagaagttctgcatcgacaaggtgggcaaggagacctggctgcccaggagccacacctgcttcaaccggctggacctgcccccctacaagagctatgagcagctgcgggagaagctgctgtatgccatcgaggagacagagggcttcggccaggagtag

SEQ ID NO: 176181 - DNA, 1029 bp, Artificial Sequence
  Description of Artificial Sequence: Synthetic coding sequence
atgatccaggagcccgccctgcccccaggctgggagatgaagtacaccagcgagggcgtgcgctactttgtggaccacaacaccaggaccaccaccttcaaggacccccggcccggctttgagagcggcaccaagcagggcagccctggggcctatgaccgctccttccgctggaagtaccaccagttccgcttcctgtgccacagcaatgccctgcccagccacgtgaagatctctgtgtcccggcagaccctgtttgaagattccttccagcagatcatgaacatgaagccctatgacctgcggcggcggctgtacatcatcatgagaggagaggagggcctggactatggaggcatcgcccgggagtggttcttcctgctgagccatgaggtgctgaaccccatgtactgcctgtttgaatatgccggcaagaacaactactgcctgcagatcaacccagccagcagcatcaacccagaccacctgacctacttccgcttcatcggccgcttcatcgccatggccctgtaccacggcaagttcatcgacaccggcttcaccctgcccttctacaagaggatgctgaacaagaggcccaccctgaaggacctggagagcattgatcctgagttctacaacagcatcgtgtggatcaaggagaacaacctggaggagtgtggcctggagctgtacttcatccaggacatggagatcctgggcaaggtgaccacccatgagctgaaggagggcggggagagcatccgggtgacagaggagaacaaggaggagtacatcatgctgctgacagactggaggttcacccggggcgtggaggagcagaccaaggccttcctggatggcttcaatgaggtggcccccctggagtggctgcgctactttgatgagaaggagctggagctgatgctgtgtggcatgcaggagattgatgccactggaagaagagcccccagcacaggcaccacccccaggacagccagccgcagcagcggcagcggccgctggtag

SEQ ID NO: 176182 - DNA, 1296 bp, Artificial Sequence
  Description of Artificial Sequence: Synthetic coding sequence
atgatccaggagcccgccctgcccccaggctgggagatgaagtacaccagcgagggcgtgcgctactttgtggaccacaacaccaggaccaccaccttcaaggacccccggcccggctttgagagcggcaccaagcagggcagccctggggcctatgaccgctccttccgctggaagtaccaccagttccgcttcctgtgccacagcaatgccctgcccagccacgtgaagatctctgtgtcccggcagaccctgtttgaagattccttccagcagatcatgaacatgaagccctatgacctgcggcggcggctgtacatcatcatgagaggagaggagggcctggactatggaggcatcgcccgggagtggttcttcctgctgagccatgaggtgctgaaccccatgtactgcctgtttgaatatgccggcaagaacaactactgcctgcagatcaacccagccagcagcatcaacccagaccacctgacctacttccgcttcatcggccgcttcatcgccatggccctgtaccacggcaagttcatcgacaccggcttcaccctgcccttctacaagaggatgctgaacaagaggcccaccctgaaggacctggagagcattgatcctgagttctacaacagcatcgtgtggatcaaggagaacaacctggaggagtgtggcctggagctgtacttcatccaggacatggagatcctgggcaaggtgaccacccatgagctgaaggagggcggggagagcatccgggtgacagaggagaacaaggaggagtacatcatgctgctgacagactggaggttcacccggggcgtggaggagcagaccaaggccttcctggatggcttcaatgaggtggcccccctggagtggctgcgctactttgatgagaaggagctggagctgatgctgtgtggcatgcaggagattgacatgtctgactggcagaagagcaccatctaccgccactacaccaagaacagcaagcagatccagtggttctggcaggtggtgaaggagatggacaatgagaagaggatccggctgctgcagtttgtgacaggcacctgccgcctgcctgtgggcggctttgctgagctgattggcagcaatggcccccagaagttctgcatcgacaaggtgggcaaggagacctggctgcccaggagccacacctgcttcaaccggctggacctgcccccctacaagagctatgagcagctgcgggagaagctgctgtatgccatcgaggagacagagggcttcggccaggagtag

SEQ ID NO: 176183 - DNA, 1008 bp, Artificial Sequence
  Description of Artificial Sequence: Synthetic coding sequence
atggccagcgccagcagcagcagagctggggtggccctgccctttgagaagagccagctgaccctgaaggtggtgtctgccaagcccaaggtgcacaaccggcagccccgcatcaacagctatgtggaggtggccgtggatggcctgcccagcgagaccaagaagacaggcaagagaattggcagcagcgagctgctgtggaatgagatcatcatcctgaatgtgacagcccagagccacctggacctgaaggtgtggagctgccacaccctgagaaatgagctgctgggcacagcctctgtgaacctgagcaatgtgctgaagaacaacggcggcaagatggagaacatgcagctgaccctgaacctgcagacagagaacaagggctctgtggtgtctggaggagagctgaccatcttcctggatggccccaccgtggacctgggcaatgtgcccaatggaagtgccctgacagatggcagccagctgcccagccgggacagcagcggcacagctgtggcccctgagaacagacaccagccccccagcaccaactgctttggaggccgcagcaggacccaccgccacagcggggccagcgcccggaccaccccagccactggagagcagagccctggggcccggagccgccaccggcagcctgtgaagaacagcggccacagcggcctggccaacggcaccgtgaatgatgagcccaccacagccacagatcctgaggagcccagcgtggtgggcgtgaccagccccccagctgcccccctgtctgtgacccccaaccccaacaccaccagcctgcctgccccagccaccccagctgagggggaggagcccagcaccagcggcacccagcagctgcctgctgctgcccaggccccagatgccctgcctgctggctgggagcagcgggagctgcccaacggccgggtgtactacgtggaccacaacaccaagaccaccacctgggagcggcccctgcccccaggatag

SEQ ID NO: 176184 - DNA, 210 bp, Artificial Sequence
  Description of Artificial Sequence: Synthetic coding sequence
atggagagccccaagaagaagaaccagcagctgaaggtgggcatcctgcacctgggcagccggcagaagaagatccgcatccagctgcggagccaggtgctgggccgggagatgagggacatggagggggacctgcaggagctgcaccagagcaacacaggagacaagagcggcttcggcttccggcggcagggcgaggacaacacctag

SEQ ID NO: 176185 - DNA, 246 bp, Artificial Sequence
  Description of Artificial Sequence: Synthetic coding sequence
atggagagccccaagaagaagaaccagcagctgaaggtgggcatcctgcacctgggcagccggcagaagaagatccgcatccagctgcggagccagtgtgccacctggaaggtgatctgcaagagctgcatcagccagaccccaggcatcaacctggacctgggcagcggcgtgaaggtgaagatcatccccaaggaggagcactgcaagatgcctgaggccggggaggagcagccccaggtgtag

SEQ ID NO: 176186 - DNA, 441 bp, Artificial Sequence
  Description of Artificial Sequence: Synthetic coding sequence
atgctgctgtggtgccccccccagtgtgcctgcagcctgggcgtcttccccagcgcccccagccctgtgtggggcaccaggaggagctgtgagcccgccaccagggtgcctgaggtgtggatcctgagccccctgctgcggcacggcggccacacccagacccagaaccacacagccagccccaggagccctgtgatggagagccccaagaagaagaaccagcagctgaaggtgggcatcctgcacctgggcagccggcagaagaagatccgcatccagctgcggagccagtgtgccacctggaaggtgatctgcaagagctgcatcagccagaccccaggcatcaacctggacctgggcagcggcgtgaaggtgaagatcatccccaaggaggagcactgcaagatgcctgaggccggggaggagcagccccaggtgtag

SEQ ID NO: 176187 - DNA, 210 bp, Artificial Sequence; identical to SEQ ID NO: 176184
  Description of Artificial Sequence: Synthetic coding sequence

SEQ ID NO: 176188 - DNA, 210 bp, Artificial Sequence; identical to SEQ ID NO: 176184
  Description of Artificial Sequence: Synthetic coding sequence

SEQ ID NO: 176189 - DNA, 246 bp, Artificial Sequence; identical to SEQ ID NO: 176185
  Description of Artificial Sequence: Synthetic coding sequence

SEQ ID NO: 176190 - DNA, 210 bp, Artificial Sequence; identical to SEQ ID NO: 176184
  Description of Artificial Sequence: Synthetic coding sequence

SEQ ID NO: 176191 - DNA, 441 bp, Artificial Sequence; identical to SEQ ID NO: 176186
  Description of Artificial Sequence: Synthetic coding sequence

SEQ ID NO: 176192 - DNA, 246 bp, Artificial Sequence; identical to SEQ ID NO: 176185
  Description of Artificial Sequence: Synthetic coding sequence

SEQ ID NO: 176193 - DNA, 210 bp, Artificial Sequence; identical to SEQ ID NO: 176184
  Description of Artificial Sequence: Synthetic coding sequence

SEQ ID NO: 176194 - DNA, 246 bp, Artificial Sequence; identical to SEQ ID NO: 176185
  Description of Artificial Sequence: Synthetic coding sequence

SEQ ID NO: 176195 - DNA, 441 bp, Artificial Sequence; identical to SEQ ID NO: 176186
  Description of Artificial Sequence: Synthetic coding sequence

SEQ ID NO: 176196 - DNA, 210 bp, Artificial Sequence; identical to SEQ ID NO: 176184
  Description of Artificial Sequence: Synthetic coding sequence

SEQ ID NO: 176197 - DNA, 210 bp, Artificial Sequence; identical to SEQ ID NO: 176184
  Description of Artificial Sequence: Synthetic coding sequence

SEQ ID NO: 176198 - DNA, 246 bp, Artificial Sequence; identical to SEQ ID NO: 176185
  Description of Artificial Sequence: Synthetic coding sequence

SEQ ID NO: 176199 - DNA, 441 bp, Artificial Sequence; identical to SEQ ID NO: 176186
  Description of Artificial Sequence: Synthetic coding sequence

SEQ ID NO: 176200 - DNA, 336 bp, Artificial Sequence
  Description of Artificial Sequence: Synthetic coding sequence
atgatctggaggggccgcagcacctaccggccccggccccggcgctctgtgcccccacctgagctgattggccccatgctggagcctggagatgaggagccccagcaggaggagcccccaacagagagccgggaccctgcccctggccaggagcgggaggaggaccagggcgctgctgagacccaggtgcctgacctggaggccgacctgcaggagctgagccagagcaagacaggaggagaatgtggaaatggaccagatgaccagggcaagatcctgcccaagtctgagcagttcaagatgcctgagggcggggaccggcagccccaggtgtag

SEQ ID NO: 176201 - DNA, 336 bp, Artificial Sequence; identical to SEQ ID NO: 176200
  Description of Artificial Sequence: Synthetic coding sequence

SEQ ID NO: 176202 - DNA, 4002 bp, Artificial Sequence
  Description of Artificial Sequence: Synthetic coding sequence
atgacagctgacaagctggtgttctttgtgaatggaaggaaggtggtggagaagaatgctgaccctgagaccaccctgctggcctacctgcggaggaagctgggcctgagcggcaccaagctgggctgtggggagggcggctgtggggcctgcaccgtgatgctgagcaaatatgaccggctgcagaacaagatcgtgcacttcagcgccaatgcctgcctggcccccatctgcagcctgcaccacgtggccgtgaccaccgtggagggcatcggcagcaccaagacccggctgcaccctgtgcaggagagaattgccaagagccacggcagccagtgtggcttctgcaccccaggcatcgtgatgtccatgtacaccctgctgaggaaccagcctgagcccaccatggaggagattgaaaatgccttccagggcaacctgtgccgctgcaccggctaccggcccatcctgcagggcttccgcacctttgccagagatggcggctgctgcggaggagatggcaacaaccccaactgctgcatgaaccagaagaaggaccacagcgtgtccctgagccccagcctcttcaagccagaggagttcacccccctggaccccacccaggagcccatcttccccccagagctgctgcggctgaaggacacccccaggaagcagctgcgctttgaaggagagcgggtgacctggatccaggccagcaccctgaaggagctgctggacctgaaggcccagcacccagatgccaagctggtggtgggcaacacagagatcggcatcgagatgaagttcaagaacatgctgttccccatgattgtgtgcccagcctggatccctgagctgaacagcgtggagcacggcccagatggcatcagctttggagctgcctgccccctgagcatcgtggagaagaccctggtggatgctgtggccaagctgcctgcccagaagacagaggtgttccggggcgtgctggagcagctgcgctggtttgctgggaagcaggtgaagtctgtggcctctgtgggcggcaacatcatcacagccagccccatcagtgacctgaaccctgtgttcatggccagcggggccaagctgaccctggtgtcccggggcaccaggagaacagtgcagatggaccacaccttcttccctggctacaggaagaccctgctgagccctgaggagatcctgctgagcattgagatcccctacagccgggagggggagtacttcagcgccttcaagcaggccagccggcgggaggatgacatcgccaaggtgaccagcggcatgagggtgctcttcaagccaggcaccacagaggtgcaggagctggccctgtgctacggcggcatggccaacagaaccatcagcgccctgaagaccacccagaggcagctgagcaagctgtggaaggaggagctgctgcaggatgtgtgtgccggcctggccgaggagctgcacctgcccccagatgcccctgggggcatggtggacttccgctgcaccctgaccctgtccttcttcttcaagttctacctgactgtgctgcagaagctgggccaggagaacctggaggacaagtgtgggaagctggaccccacctttgccagcgccaccctgctcttccagaaggaccccccagcagatgtgcagctgttccaggaggtgcccaagggccagagcgaggaggacatggtgggccggcccctgccccacctggccgctgacatgcaggccagcggggaggccgtgtactgtgatgacatccccaggtatgaaaatgagctgagcctgcggctggtgaccagcacccgggcccacgccaagatcaagagcattgacaccagcgaggccaagaaggtgcccggctttgtgtgcttcatctctgcagatgatgtgcccggcagcaacatcaccggcatctgcaatgatgagaccgtgtttgccaaggacaaggtgacctgtgtgggccacatcatcggggctgtggtggccgacaccccagagcacacccagagagctgcccagggcgtgaagatcacctatgaggagctgcctgccatcatcaccattgaagatgccatcaagaacaacagcttctacggccctgagctgaagattgaaaaaggagacctgaagaagggcttcagcgaggccgacaacgtggtgtctggagagatctacatcggcggccaggagcacttctacctggagacccactgcaccatcgctgtgcccaagggggaggccggggagatggagctgtttgtgtccacccagaacaccatgaagacccagagctttgtggccaagatgctgggcgtgcctgccaaccgcatcgtggtgcgggtgaagaggatgggcggcggctttggaggcaaggagaccaggagcacagtggtgtccacagctgtggccctggccgcctacaagacaggccggcctgtgcgctgcatgctggacagagatgaggacatgctgatcactggaggccgccaccccttcctggcccgctacaaggtgggcttcatgaagacaggcaccgtggtggccctggaggtggaccacttcagcaatgtgggcaacacccaggacctgagccagagcatcatggagcgggccctcttccacatggacaactgctacaagatccccaacatccggggcaccggccgcctgtgcaagaccaacctgcccagcaacacagccttccggggctttggaggcccccagggcatgctgattgctgagtgctggatgtctgaggtggccgtgacctgtggcatgcctgctgaggaggtgcggaggaagaacctgtacaaggagggggacctgacccacttcaaccagaagctggagggcttcaccctgccccgctgctgggaggagtgcctggccagcagccagtaccacgccaggaagtctgaggtggacaagttcaacaaggagaactgctggaagaagaggggcctgtgcatcatccccaccaagtttggcatctccttcaccgtgcccttcctgaaccaggccggggccctgctgcacgtgtacacagatggctctgtgctgctgacccacggcggcacagagatgggccagggcctgcacaccaagatggtgcaggtggccagccgggccctgaagatccccaccagcaagatctacatcagcgagaccagcaccaacacagtgcccaacaccagccccacagctgcctctgtgtctgctgacctgaatggccaggccgtgtatgctgcctgccagaccatcctgaagaggctggagccctacaagaagaagaaccccagcggctcctgggaggactgggtgacagctgcctacatggacacagtgtccctgagcgccaccggcttctaccgcacccccaacctgggctacagctttgagaccaacagcggcaaccccttccactacttctcctatggagtggcctgcagcgaggtggagattgactgcctgactggagaccacaagaacctgaggacagacatcgtgatggatgtgggcagcagcctgaacccagccattgatattggccaggtggagggcgcctttgtgcagggcctgggcctcttcaccctggaggagctgcactacagccctgagggcagcctgcacacccggggccccagcacctacaagatcccagccttcggcagcatccccatcgagttccgggtgtccctgctgcgggactgccccaacaagaaggccatctatgccagcaaggctgtgggggagcccccactcttcctggccgccagcatcttctttgccatcaaggatgccatccgggccgcccgggcccagcacactggaaacaacgtgaaggagctgttccggctggacagccctgccaccccagagaagatcagaaatgcctgtgtggacaagttcaccaccctgtgtgtgactggagtgcctgagaactgcaagccctggagcgtgcgggtgtag

SEQ ID NO: 176203 - DNA, 1896 bp, Artificial Sequence
  Description of Artificial Sequence: Synthetic coding sequence
atgaagtttgctgagcacctgagcgcccacatcaccccagagtggaggaagcagtacatccagtatgaggccttcaaggacatgctgtacagcgcccaggaccaggcccccagcgtggaggtgacagatgaggacacagtgaagcgctactttgccaagtttgaggagaagttcttccagacctgtgagaaggagctggccaagatcaacaccttctacagcgagaagctggccgaggcccagaggagatttgccaccctgcagaatgagctgcagagcagcctggatgcccagaaggagagcactggagtgaccaccctgcggcagaggaggaagcctgtgttccacctgagccatgaggagcgggtgcagcacaggaacatcaaggacctgaagctggccttcagcgagttctacctgagcctcatcctgctgcagaactaccagaacctgaacttcaccggcttcaggaagatcctgaagaagcatgacaagatcctggagaccagcagaggagctgactggagggtggcccacgtggaggtggcccccttctacacctgcaagaagatcaaccagctgatcagcgagacagaggccgtggtgaccaatgagctggaggatggagaccggcagaaggccatgaagaggctgcgggtgccccccctgggcgccgcccagcctgccccagcctggaccaccttccgggtgggcctcttctgtggcatcttcatcgtgctgaacatcaccctggtgctggccgctgtgttcaagctggagacagacaggagcatctggcccctcatccgcatctaccggggcggcttcctgctgattgagttcctgttcctgctgggcatcaacacctacggctggaggcaggccggcgtgaaccacgtgctgatctttgagctgaaccccaggagcaacctgagccaccagcacctgtttgaaattgctggcttcctgggcatcctgtggtgcctgagcctgctggcctgcttctttgcccccatcagcgtcatccccacctacgtgtaccccctggccctgtatggcttcatggtgttcttcctgatcaaccccaccaagaccttctactacaagagccgcttctggctgctgaagctgctcttccgggtcttcaccgcccccttccacaaggtgggctttgctgacttctggctggccgaccagctgaacagcctgagcgtcatcctgatggacctggagtacatgatctgcttctacagcctggagctgaagtgggatgagagcaagggcctgctgcccaacaacagcgaggagcggggccacagcgacaccatggtgttcttctacctgtggatcgtgttctacatcatcagcagctgctacaccctcatctgggacctgaagatggactggggcctgtttgacaagaatgctggggagaacaccttcctgcgggaggagatcgtgtacccccagaaggcctactactactgtgccatcattgaagatgtgatcctgcgctttgcctggaccatccagatcagcatcaccagcaccaccctgctgccccacagcggggacatcatcgccaccgtgtttgcccccctggaggtgttccgccgctttgtgtggaacttcttccggctggagaatgagcacctgaacaactgtggggagttccgggctgtgcgggacatctctgtggcccccctgaatgctgatgaccagaccctgctggagcagatgatggaccaggatgatggagtgaggaaccggcagaagaacagatcctggaagtacaaccagagcatcagcctgcggcggccccggctggccagccagagcaaggcccgggacaccaaggtgctgattgaggacacagatgatgaggccaacacctag

SEQ ID NO: 176204 - DNA, 2091 bp, Artificial Sequence
  Description of Artificial Sequence: Synthetic coding sequence
atgaagtttgctgagcacctgagcgcccacatcaccccagagtggaggaagcagtacatccagtatgaggccttcaaggacatgctgtacagcgcccaggaccaggcccccagcgtggaggtgacagatgaggacacagtgaagcgctactttgccaagtttgaggagaagttcttccagacctgtgagaaggagctggccaagatcaacaccttctacagcgagaagctggccgaggcccagaggagatttgccaccctgcagaatgagctgcagagcagcctggatgcccagaaggagagcactggagtgaccaccctgcggcagaggaggaagcctgtgttccacctgagccatgaggagcgggtgcagcacaggaacatcaaggacctgaagctggccttcagcgagttctacctgagcctcatcctgctgcagaactaccagaacctgaacttcaccggcttcaggaagatcctgaagaagcatgacaagatcctggagaccagcagaggagctgactggagggtggcccacgtggaggtggcccccttctacacctgcaagaagatcaaccagctgatcagcgagacagaggccgtggtgaccaatgagctggaggatggagaccggcagaaggccatgaagaggctgcgggtgccccccctgggcgccgcccagcctgccccagcctggaccaccttccgggtgggcctcttctgtggcatcttcatcgtgctgaacatcaccctggtgctggccgctgtgttcaagctggagacagacaggagcatctggcccctcatccgcatctaccggggcggcttcctgctgattgagttcctgttcctgctgggcatcaacacctacggctggaggcaggccggcgtgaaccacgtgctgatctttgagctgaaccccaggagcaacctgagccaccagcacctgtttgaaattgctggcttcctgggcatcctgtggtgcctgagcctgctggcctgcttctttgcccccatcagcgtcatccccacctacgtgtaccccctggccctgtatggcttcatggtgttcttcctgatcaaccccaccaagaccttctactacaagagccgcttctggctgctgaagctgctcttccgggtcttcaccgcccccttccacaaggtgggctttgctgacttctggctggccgaccagctgaacagcctgagcgtcatcctgatggacctggagtacatgatctgcttctacagcctggagctgaagtgggatgagagcaagggcctgctgcccaacaacagcgaggagagcggcatctgccacaagtacacctatggagtgcgggccatcgtgcagtgcatcccagcctggctgcgcttcatccagtgcctgcggcgctacagagacaccaagagggccttcccccacctggtgaatgctgggaagtacagcaccaccttcttcatggtgacctttgctgccctgtacagcacccacaaggagcggggccacagcgacaccatggtgttcttctacctgtggatcgtgttctacatcatcagcagctgctacaccctcatctgggacctgaagatggactggggcctgtttgacaagaatgctggggagaacaccttcctgcgggaggagatcgtgtacccccagaaggcctactactactgtgccatcattgaagatgtgatcctgcgctttgcctggaccatccagatcagcatcaccagcaccaccctgctgccccacagcggggacatcatcgccaccgtgtttgcccccctggaggtgttcagaagatttgtgtggaacttcttccggctggagaatgagcacctgaacaactgtggggagttccgggctgtgcgggacatctctgtggcccccctgaatgctgatgaccagaccctgctggagcagatgatggaccaggatgatggagtgaggaaccggcagaagaacagatcctggaagtacaaccagagcatcagcctgcggcggccccggctggccagccagagcaaggcccgggacaccaaggtgctgattgaggacacagatgatgaggccaacacctag

SEQ ID NO: 176205 - DNA, 543 bp, Artificial Sequence
  Description of Artificial Sequence: Synthetic coding sequence
atggagagctggtggggcctgccctgcctggccttcctgtgcttcctgatgcacgcccggggccagagggactttgacctggctgatgccctggatgatcctgagcccaccaagaagcccaacagcgacatctaccccaagcccaagccaccctactacccccagccagaaaatccagattctgggggcaacatctacccccggcccaagccccggccccagccccagcccggcaacagcggcaacagcggcggctacttcaatgatgtggacagagatgatggccgctacccaccccggccccggcccaggcctcctgctgggggcggcggcggcggctacagcagctatggcaacagcgacaacacccacggcggggaccaccacagcacctacggcaaccctgagggcaacatggtggccaagatcgtgagccccatcgtgtctgtggtggtggtgaccctgctgggcgctgctgccagctacttcaagctgaacaacagaagaaactgcttccgcacccatgagccagaaaatgtgtag

SEQ ID NO: 176206 - DNA, 588 bp, Artificial Sequence
  Description of Artificial Sequence: Synthetic coding sequence
atggagagctggtggggcctgccctgcctggccttcctgtgcttcctgatgcacgcccggggccagagggactttgacctggctgatgccctggatgatcctgagcccaccaagaagcccaacagcgacatctaccccaagcccaagccaccctactacccccagccagaaaatccagattctgggggcaacatctacccccggcccaagccccggccccagccccagcccggcaacagcggcaacagcggcggctacttcaatgatgtggacagagatgatggccgctacccaccccggccccggcccaggcctcctgctgggggcggcggcggcggctacagcagctatggcaacagcgacaacacccacggccggggcggctaccgcctgaacagccgctatggcaacacctatggaggagaccaccacagcacctacggcaaccctgagggcaacatggtggccaagatcgtgagccccatcgtgtctgtggtggtggtgaccctgctgggcgccgccgccagctacttcaagctgaacaacagaagaaactgcttccgcacccatgagccagaaaatgtgtag

SEQ ID NO: 176207 - DNA, 546 bp, Artificial Sequence
  Description of Artificial Sequence: Synthetic coding sequence
atggagagctggtggggcctgccctgcctggccttcctgtgcttcctgatgcacgcccggggccagagggactttgacctggctgatgccctggatgatcctgagcccaccaagaagcccaacagcgacatctaccccaagcccaagccaccctactacccccagccagaaaatccagattctgggggcaacatctacccccggcccaagccccggccccagccccagcccggcaacagcggcaacagcggcggcagctacttcaatgatgtggacagagatgatggccgctacccaccccggccccggccccggcccccagctgggggcggcggcggcggctacagcagctatggcaacagcgacaacacccatggaggagaccaccacagcacctacggcaaccctgagggcaacatggtggccaagatcgtgagccccatcgtgtctgtggtggtggtgaccctgctgggcgccgccgccagctacttcaagctgaacaacagaagaaactgcttccgcacccatgagccagaaaatgtgtag

SEQ ID NO: 176208 - DNA, 129 bp, Artificial Sequence
  Description of Artificial Sequence: Synthetic coding sequence
atggtggccaagatcgtgagccccatcgtgtctgtggtggtggtgaccctgctgggcgctgctgccagctacttcaagctgaacaacagaagaaactgcttccgcacccatgagccagaaaatgtgtag

SEQ ID NO: 176209 - DNA, 10650 bp, Artificial Sequence
  Description of Artificial Sequence: Synthetic coding sequence
atgttccccatgcagaagggcagcctgaacctgctgcggcagaagtgggagagctgtgactaccagaggtctgagtgccacccccgggacagccactgcaccatcttccagccccaggagagcaagctgctggcccctgagggggaggtggtgtctgccccccagagcctggaccccaccagcctgccctacagcactggagaggagatgtggagcagcaagccagaggagaaggacagcgtggacaagagcaacaacacccgggagtatggccggcctgaggtgctgaaggaggacagcctgagcagcagaagaagaattgagcgcttcagcatcgccctggatgagctgcggtctgtgtttgaggcccccaagagcggcaacaagccagcagaatatggaggcaaggaggtggagattgaaagaagcctgtgcagccctgccttcaagagccaccctggcagccagctggaggacagcgtgaaggacagcgacaagaagggcaaggagaccagctttgacaagatgagccctgagagcggccacagccgcatctttgaggccacagctggccccaacaagccagagagcggctttgctgaagattctgctgcccggggggagggcgtgtctgacctgcacgaggtggtgtccctgaaggagaggatggcccgctaccaggccgctgtgtccagaggagactgccgctccttcagcgccaacatgatggaggagagcgagatgtgtgctgtgcctgggggcctggccaaggtgaagaagcagtttgaagatgagatcaccagcagcaggaacacctttgcccagtaccagtaccagcaccagaacagaagtgagcaggaggccatccacagcagccaggtgggcaccagccgcagcagccaggagatggccagaaatgagcaggagggcagcaaggtgcagaagattgatgtgcatggaacagagatggtgagccacctggagaagcacacagaggaggtgaaccaggccagccagttccaccagtatgtgcaggagaccgtgattgacaccccagaagatgaggagatccccaaggtgtccaccaagctgctgaaggagcagtttgagaagagcgcccaggagaagatcctgtacagcgacaaggagatgaccaccccagccaagcagatcaagacagaaagtgaatatgaggagaccttcaagcccagctctgtggtgtccaccagcagcaccagctgtgtgtccaccagccagaggaaggagaccagcaccacccgctacagcgaccacagcgtgaccagcagcaccctggcccagatcaatgccaccagcagcggcatgacagaggagttccccccacctcctccagatgtgctgcagacctctgtggatgtgacagccttcagccagagccctgagctgcccagccccccccggcggctgcctgtgcccaaggatgtgtacagcaagcagaggaacctgtatgagctgaacagactctacaagcacatccaccctgagctgaggaagaacctggagaaggactacatcagcgaggtgtctgagatcgtgagcagccagatgaacagcggcagctctgtgtctgcagatgtgcagcaggcccgctacgtgtttgagaacaccaatgacagcagccagaaggacctgaacagcgagcgggagtacctggagtgggatgagatcctgaagggggaggtgcagagcatccgctggatctttgagaaccagcccctggacagcatcaacaacggcagcccagatgaaggagacatcagccggggcattgctgaccaggagatcatcgctggaggagatgtgaagtacaccacctggatgtttgagacccagcccatcgacaccctgggcgcctacagcagtgacacagtggagaatgctgagaagatccctgagctggcccggggagatgtgtgcacagcccgctggatgtttgagacccggcccctggacagcatgaacaagatgcaccagagccaggaggagagcgctgtgaccatcagcaaggacatcactggaggagatgtgaagacagtgcgctacatgtttgagacccagcacctggaccagctgggccagctgcacagcgtggatgaggtgcacctgctgcagctgcggtctgagctgaaggagatcaagggaaatgtgaagaggagcatcaagtgctttgagacccagcccctgtatgtgatcagagatggcagcggccagatgctggagatcaagacagtgcaccgggaggatgtggagaagggagatgtgaggacagcccgctggatgtttgagacccagcccctggacaccatcaacaaggacatcacagagatcaaggtggtgcggggcatctccatggaggagaatgtgaagggcggcgtgtccaaggccaagtggctgtttgagacccagcccctggagaagatcaaggagagcgaggaggtgatcatcgagaaggagaagatcatcggcacagatgtgtccaggaagtgctggatgtttgagacccagcccctggacatcctgaaggaggtgcctgatgctgacagcctgcagcgggaggagatcattggaggagatgtgcagaccaccaagcacctgtttgagaccctgcccatcgaggccctgaaggacagcccagacatcggcaagctgcagaagatcacagccagcgaggaggagaagggagatgtgcgccaccagaagtggatctttgagacccagcccctggaggacatcaggaaggacaagaaggagtacaccaggacagtgaagctggaggaggtggacagaggagatgtgaagaactacacccacatctttgagagcaacaacctgatcaagtttgatgccagccacaagattgaggtggagggcgtgaccagaggagctgtggagctgaacaagagcctgtttgagaccacccccctgtatgccatccaggaccccctgggcaagtaccaccaggtgaagacagtgcagcaggaggagatcgtgagaggagatgtgcgcagctgccgctggctgtttgagacccggcccatcgaccagtttgatgagagcatccacaagttccagatcatccggggcatcagcgcccaggagatccagacaggaaatgtgaagagcgccaagtggctgtttgagacccagcccctggacagcatcaagtacttcagtgatgtggaggagacagagagcaagacagagcagacccgggacatcgtgaagggagatgtgaagacctgcaagtggctgtttgagacccagcccatggagagcctgtatgagaaggtgtccctgatgaccagcagcgaggagatccacaagggagatgtgaagacctgcacctggctgtttgagacccagcccctggacaccatcaaggatgattctgaaacagctgtgaagctgcagacagtgaagcaggaggagatccagggcggagatgtgaggacagcctgcttcctgtttgaaacagagaacctggacagcatccagggcgaggaggtgaaggagatcaagcctgtggagatggacatccaggccggagatgtgtcctccatgagatacaagtttgagaaccagagcctggacagcatcagcagcagcagcgaggaggtgctgaagaagatcaagaccctgaagacagaggacatccagaagggaaatgtgctgaactgccgctggctgtttgagaaccagcccatcgacaagatcaaggagagccaggagggagatgaatgtgtgaagacagtgacagacatccagggcggagatgtgaggaagggctgcttcatctttgagaccttcagcctggatgagatcaaggaggagagtgactacatcagcaccaagaagaccatcacagaggaggtgatccagggagatgtgaagagctacaggatgctgtttgagacccagcccctgtatgccatccaggaccgggagggcagctaccacgaggtgaccaccgtgaagaaggaggaggtgattcatggagatgtgcggggcacccgctggctgtttgagaccaagcccctggacagcatcaacaagtcagaaacagtgtatgtgatcaagtctgtgacccaggaggacatccagaagggagatgtgtcctctgtgcgctacagatttgagacccagcccctggaccagatcagcgaggagagccacaacatcatgcccagcattgaccacatccagggcggcaatgtgaagaccagccggcagttctttgaaagtgagaactttgacaagaacaactacatcagaacagtgtctgtgaatgagatccagaagggaaatgtgaagaccagcacctggctgtttgagacccacaccatggatgagctgcggggggagggcctggagtatgagaacatcaagacagtgacccaggaggatgtgcagaagggagatgtgaagcaggccgtgtggctgtttgaaaatagaacatttgacagcatcatggaggcccacaagggcatcaccaagatgaccaaggaggagatccccccatctgatgtgaagaccaccacctggctgtttgagaccacccccctgcacgagttcaatgagaccagggtggagaagattgagatcatcggcaagagcatcaaggagaccctggaggacctgtacagccagaaggtgatccaggcccctggcatcatcatcgaggctgatgaaattggagatgtgaggatggccaagtacaagctgatgaaccaggccagccctgagatccagaaggaggagatcatccgggctgacctgaggaacatcatggtgaacctgctgagcaagagggactgcacagagcgggagatcctgatcagcgaggaggagaagggaaatgtgaacctgaccaagacccagctgctgaacagaagcacagagttccacgccgagaaggaggagatcgtgaagggagatgtgcagcaggccatcaagaacctcttcagcgaggagaggtctgtgaagaagggcatcctgatccaggaggatgagaagggggacatcaacatgaccatctactgcctgctgcatgaaaatgatggagacaccatcgagcgggaggaggtgattggaggagatgtgaagaggaccatccacaacctgctgagcagcaccagcaacaacaagatcagcgagcgggccaagattgatgccagcgagagaggaaatgtgcagttcttcaccacctgcatcgaggccggggccctggactacctgaagcagctgcacacagagagcaatgagaccctgacagccaagaagcaggagggggagaaggagatcattggaggagatgtggagggcaccaagctgctgctgaagaagaggcagagcctggtggagaggacagtgtctgaaacagacatcatccctggagatgtgcacaacacagtgaaggtgttcatgacagagccccagagcaccttcggcaagatccccaaggaggagatcatcaagggggacctgaccagcaccctgaacagcctgagccaggccgtgaaccagaagacagtgaccaagacagaggagatcatcaagggcaacatgctggccaccctgaagagcctgaaggagagcagccaccgctggaaggagagcaagcagccagatgccatccctggggacatcgagaaggccatcgagtgcctggagaaggccaccaacaccaagacagagatcctgaagaaggagctgctgaaggatgacctggagaccagcctgcggagcctgaaggaggcccagaggagcttcaaggaggtgcacaaggagggcgtcatcaagaaggatgccaaggctgtgatggccggcagcagtggagagcagaagacagacatccaccaggtggccgtgcagaggaacaagaacagcctgctgcagcccaagccaggcccctttgagcctgctgccaagtggcagggcggcgctgacaccctgagccagaccatgggcaagagctgccacggcaacctggtggaggagaggacagaggtgaacctgcccaaggcccccaagggcaccgtgaagatcgtcatcgaccgggagcagaacaatgatgccctggagaagagcctgcggcggctgagcaacagccaccacaagagcaatgtgctggagagcggggacaagacaggagtgtggacagacaccactggagagcagcacctgagagatgagtacatgagccggcagctgaccagcacagtgtctgtgaagaacaacctgaccaccaaggagagtgacagagctgtgcgggagctgaagaaggatgatgtgttcaacagcatccagagcgctgggaagacagtgggcaagcagcagacctatgagctgagaaatgaccaccagaagatggagggcttccacatcaagagccccaagaagaccaagaacatcaagatcctgacagacacccagagcagcaagcccagccccacccagcaccctgtgtccatgcctgtgggcggcacctatgacctgagcggggacttccagaagcagaccctgctgaagcaggagaccaagtacagcaacaaggacatcaagaagaagaacatcaacctgcagcccatgtggcagctgctgcctgtggagcaggacaccagcaatgtgacagagatgaaggtgtctgagaagagccacaacaccttcaaggccaccaacaagaagcgggagacagatgtgcacctgaagagccaggacttcctgatgaagaccaacaccagcacaggcctgaagatggccatggagaggagcctgaaccccatcaacttcaacccagaaaataatgtgaaggagagcgagtgccccctgcccccacccagccccccacctcctccacccagcaatgccagcagcgagattgagttccccctgcccccacctccacccctgatgatgtttcctgagaagaatggcttcctgcccagcctgagcacagagaagatcaaggccgagtttgagagcttccctggcctgcccctgcccccacctcctgtggatgagaagtctgagcgggagagcagctccatgttcctgcccccacctcctccacccacccccagccagaagccagcccacctgctgagcagcagcgcccctgagaagcacagcggggacttcatgcagcagtacagccagaaggaggccagcaacagccagaacagccaggccaagatcatcaccgggaagacaggagtgctgcccccacccaccctgcccaagcccaagctgcccaagcacatcaaggacaacaagaatgacttcagccccaaggtggagctggccaccagcctgagtgacatggagtgcaagatcaccaccagcaaggaccagaagaaggtgatggtgatgaccagcagcgagcacacagagaccaagcagaatgtcatcagcaagagcctggatgagaggaagcagctgagcattgacagcgccaactgcctgagccacacagtgcccggcaccagcgcccccaggaagaagcagatcgcccccctcatcaagagccacagcttccctgagagcagcggccagcagaaccccaagccctacatgaggaagttcaagacccccctgatgattgctgaggagaagtaccggcagcagaaggaggagattgagaagcagaagcaggagagcagctactacaacatcgtgaagacccagagccagaaccagcacatcacagaggtggagaaggagatgcccctgcagaagaccaatgaggaggtgtccctgtctggaattgattctgagtgcaccgtggtgcagcccagccctggcagccagagcaatgcccgcatcctgggcgtgtgcagcgacaaccagctgagcaccaccagccctgagaccgtggccgccaagaggctgcaccacgtgctggccgccagcgaggacaaggacaagatgaagaaggaggtgctgcagagcagccgggacatcatgcagagcaagagcgcctgtgagatcaagcagagccaccaggagtgcagcacccagcagacccagcagaagaagtacctggagcagctgcacctgccccagagcaagcccatcagccccaacttcaaggtgaagaccatcaagctgcccaccctggaccacaccctgaatgaaacagaccacagctatgagagccacaagcagcagagcgagattgatgtgcagaccttcaccaagaagcagtacctgaagaccaagaagacagaggccagcacagaatgtagccacaagcagagcctggccgagcggcactaccagctgcccaagaaggagaagagggtgacagtgcagctgcccacagagagcatccagaagaaccaggaggacaagctgaagatggtgcccaggaagcagcgggagttcagcggcagtgaccggggcaagctgcccggcagcgaggagaagaaccagggccccagcatgattggaaggaaggaggagcggctcatcacagagaggaagcatgagcacctgaagaacaagagcgcccccaaggtggtgaagcagaaggtgattgatgcccacctggacagccagacccagaacttccagcagacccagatccagacagctgagagcaaggccgagcacaagaagctgccccagccctacaacagcctgcaggaggagaagtgcctggaggtgaagggcatccaggagaagcaggtgttcagcaacaccaaggacagcaagcaggagatcacccagaacaagagcttcttcagctctgtgaaggagagccagagagatgatggaaaaggagccctgaacatcgtggagttcctgaggaagcgggaggagctgcagcagatcctgagccgggtgaagcagtttgaggccgagcccaacaagagcggcctgaagaccttccagaccctgctgaacaccatccctggctggctgatcagcgaggacaagcgggagtatgctgtgcacatcgccatggagaacaacctggagaaggtgaaggaggagatcacccacatcaagacccaggccgaggacatgctggtgtcctatgagaacatcatccagacagccatgatgagcagcaagacaggcaagccaggcaacaagcccaccagcctggatgagaccagcagcaaggtgtccaatgtgcacgtgagcaacaacaagaacagcgagcagaaggagaacaagatcgccaaggagaagacagtgcagcaccaggtggccgcccaccacgaggccaccgtgcgcagccacgtgaagacccaccaggagatcaagctggatgacagcaacatccccccacccagcctgaagacccggccccccagccccaccttcatcaccatcgagagcacagccaggagaacagagaaccccaccaagaatgagctgagccagagccccaagaaggacagctatgtggagcccccaccccggcggcccatgagccagaagtctgagatccaccgggccaacaccagccccagcccccccaggagccgctctgagcagctggtgcggctgaaggacaccacagccaagctgagcaagggggccatcccctgcccagctgccacccctgtgcccatcgtggagaagaggtctgagatcatcatgagccctgccaccctgcggcggcagatcaagattgagacccggggccgggacagcccccccaccatcaccatccctgtgaacatcaaccacgccgccagcggcagcttccgggagagcgtggatgcccaggaggagatcaggaaggtggagaagagggccacctacgtgcacaaggatggcctgaacagcacagaccacatggtgcctgacacagagagctatgatgctgtggagatcatcaggaaggtggccgtgcccccccggctgtctgagcacacccagagatatgaggccgccaacagaacagtgcagatggctgaaaattttgtgaatgaccctgaaaatgagatcaaccgctggttccgggagtttgagcacggccctgtgtctgaggccaagagcaacagaagagtgtatgccaagggggagaccaaccacaacatccagcaggagagcaggaccttctgcaaggaggagtttggcctgaccagcctgggcaacaccagcttcacagacttcagctgcaagcacccccgggagctgcgggagaagatccctgtgaagcagccccgcatctgcagcgagaccaggagcctgtctgagcacttcagcggcatggatgcctttgagagccagatcgtggagagcaagatgaagaccagcagcagccacagcagcgaggccggcaagagcggctgtgacttcaagcacgccccacccacctatgaagatgtgattgctggccacatcctggacatcagtgacagccccaaggaggtgaggaagaacttccagaagacctggcaggagagcggccgggtcttcaagggcctgggctacgccacagcagatgccagcgccacagagatgaggaccaccttccaggaggagagcgccttcatcagcgaggccgccgccccccggcagggcaacatgtacaccctgagcaaggacagcctgagcaatggagtgcccagcggccggcaggccgagttctcctag

SEQ ID NO: 176210 - DNA, 2817 bp, Artificial Sequence
  Description of Artificial Sequence: Synthetic coding sequence
atgttccccatgcagaagggcagcctgaacctgctgcggcagaagtgggagagctgtgactaccagaggtctgagtgccacccccgggacagccactgcaccatcttccagccccaggagagcaagctgctggcccctgagggggaggtggtgtctgccccccagagcctggaccccaccagcctgccctacagcactggagaggagatgtggagcagcaagccagaggagaaggacagcgtggacaagagcaacaacacccgggagtatggccggcctgaggtgctgaaggaggacagcctgagcagcagaagaagaattgagcgcttcagcatcgccctggatgagctgcggtctgtgtttgaggcccccaagagcggcaacaagccagcagaatatggaggcaaggaggtggagattgaaagaagcctgtgcagccctgccttcaagagccaccctggcagccagctggaggacagcgtgaaggacagcgacaagaagggcaaggagaccagctttgacaagatgagccctgagagcggccacagccgcatctttgaggccacagctggccccaacaagccagagagcggctttgctgaagattctgctgcccggggggagggcgtgtctgacctgcacgaggtggtgtccctgaaggagaggatggcccgctaccaggccgctgtgtccagaggagactgccgctccttcagcgccaacatgatggaggagagcgagatgtgtgctgtgcctgggggcctggccaaggtgaagaagcagtttgaagatgagatcaccagcagcaggaacacctttgcccagtaccagtaccagcaccagaacagaagtgagcaggaggccatccacagcagccaggtgggcaccagccgcagcagccaggagatggccagaaatgagcaggagggcagcaaggtgcagaagattgatgtgcatggaacagagatggtgagccacctggagaagcacacagaggaggtgaaccaggccagccagttccaccagtatgtgcaggagaccgtgattgacaccccagaagatgaggagatccccaaggtgtccaccaagctgctgaaggagcagtttgagaagagcgcccaggagaagatcctgtacagcgacaaggagatgaccaccccagccaagcagatcaagaagctgctgctgcaggacaaggagatctgcatcctgtgccagaagacagtgtaccccatggagtgcctggtggccgacaagcagaacttccacaagagctgcttccgctgccaccactgcaacagcaagctgagcctgggcaactatgccagcctgcacggccagatctactgcaagccccacttcaagcagctgttcaagagcaaaggaaattatgatgagggcttcggccacaagcagcacaaggaccgctggaactgcaagaaccagagccgctctgtggacttcatccccaatgaggagcccaacatgtgcaagaacattgctgagaacaccctggtgcctggggacagaaatgagcacctggatgctggcaacagcgagggccagagaaatgacctgaggaagctgggggagcggggcaagctgaaggtgatctggccacccagcaaggagatccccaagaagaccctgccctttgaggaggagctgaagatgagcaagcccaagtggcccccagagatgaccaccctgctgagccctgagttcaagtctgagagcctgctggaggatgtgaggaccccagagaacaagggccagaggcaggaccacttccccttcctgcagccctacctgcagagcacccacgtgtgccagaaggaggatgtgattggcatcaaggagatgaagatgcctgagggcaggaaggatgagaagaaggagggcaggaagaatgtgcaggaccggcccagcgaggccgaggacaccaagagcaacaggaagagcgccatggacctgaatgacaacaacaacgtgattgtgcagagcgctgagaaggagaagaatgagaagaccaaccagaccaatggagctgaggtgctgcaggtgaccaacacagatgatgagatgatgcctgagaaccacaaggagaacctgaacaagaacaacaacaacaactacgtggccgtgtcctacctgaacaactgccggcagaagaccagcatcctggagttcctggacctgctgcccctgagcagcgaggccaatgacacagccaatgaatatgaaattgagaagctggagaacaccagccgcatcagcgagctgctgggcatctttgaaagtgagaagacctacagcagaaatgtgctggccatggccctgaagaagcagacagacagagctgctgctggcagccctgtgcagcctgcccccaagcccagcctgagccggggcctgatggtgaagggcggcagcagcatcatcagcccagacaccaacctgctgaacatcaagggcagccacagcaagagcaagaacctgcacttcttcttcagcaacacagtgaagatcacagccttcagcaagaagaatgaaaacatcttcaactgtgacctgattgattctgtggaccagatcaagaacatgccctgcctggacctgcgggagtttgggaaggatgtgaagccctggcacgtggagaccacagaggccgccaggaacaatgaaaatactggatttgatgccctgagccatgaatgtacagccaagcccctcttcccccgggtggaggtgcagagcgagcagctgactgtggaggagcagatcaagaggaaccgctgctacagcgacacagaatag

SEQ ID NO: 176211 - DNA, 10650 bp, Artificial Sequence; identical to SEQ ID NO: 176209
  Description of Artificial Sequence: Synthetic coding sequence

SEQ ID NO: 176212 - DNA, 9984 bp, Artificial Sequence
  Description of Artificial Sequence: Synthetic coding sequence
atggcccgctaccaggccgctgtgtccagaggagactgccgctccttcagcgccaacatgatggaggagagcgagatgtgtgctgtgcctgggggcctggccaaggtgaagaagcagtttgaagatgagatcaccagcagcaggaacacctttgcccagtaccagtaccagcaccagaacagaagtgagcaggaggccatccacagcagccaggtgggcaccagccgcagcagccaggagatggccagaaatgagcaggagggcagcaaggtgcagaagattgatgtgcatggaacagagatggtgagccacctggagaagcacacagaggaggtgaaccaggccagccagttccaccagtatgtgcaggagaccgtgattgacaccccagaagatgaggagatccccaaggtgtccaccaagctgctgaaggagcagtttgagaagagcgcccaggagaagatcctgtacagcgacaaggagatgaccaccccagccaagcagatcaagacagaaagtgaatatgaggagaccttcaagcccagctctgtggtgtccaccagcagcaccagctgtgtgtccaccagccagaggaaggagaccagcaccacccgctacagcgaccacagcgtgaccagcagcaccctggcccagatcaatgccaccagcagcggcatgacagaggagttccccccacctcctccagatgtgctgcagacctctgtggatgtgacagccttcagccagagccctgagctgcccagccccccccggcggctgcctgtgcccaaggatgtgtacagcaagcagaggaacctgtatgagctgaacagactctacaagcacatccaccctgagctgaggaagaacctggagaaggactacatcagcgaggtgtctgagatcgtgagcagccagatgaacagcggcagctctgtgtctgcagatgtgcagcaggcccgctacgtgtttgagaacaccaatgacagcagccagaaggacctgaacagcgagcgggagtacctggagtgggatgagatcctgaagggggaggtgcagagcatccgctggatctttgagaaccagcccctggacagcatcaacaacggcagcccagatgaaggagacatcagccggggcattgctgaccaggagatcatcgctggaggagatgtgaagtacaccacctggatgtttgagacccagcccatcgacaccctgggcgcctacagcagtgacacagtggagaatgctgagaagatccctgagctggcccggggagatgtgtgcacagcccgctggatgtttgagacccggcccctggacagcatgaacaagatgcaccagagccaggaggagagcgctgtgaccatcagcaaggacatcactggaggagatgtgaagacagtgcgctacatgtttgagacccagcacctggaccagctgggccagctgcacagcgtggatgaggtgcacctgctgcagctgcggtctgagctgaaggagatcaagggaaatgtgaagaggagcatcaagtgctttgagacccagcccctgtatgtgatcagagatggcagcggccagatgctggagatcaagacagtgcaccgggaggatgtggagaagggagatgtgaggacagcccgctggatgtttgagacccagcccctggacaccatcaacaaggacatcacagagatcaaggtggtgcggggcatctccatggaggagaatgtgaagggcggcgtgtccaaggccaagtggctgtttgagacccagcccctggagaagatcaaggagagcgaggaggtgatcatcgagaaggagaagatcatcggcacagatgtgtccaggaagtgctggatgtttgagacccagcccctggacatcctgaaggaggtgcctgatgctgacagcctgcagcgggaggagatcattggaggagatgtgcagaccaccaagcacctgtttgagaccctgcccatcgaggccctgaaggacagcccagacatcggcaagctgcagaagatcacagccagcgaggaggagaagggagatgtgcgccaccagaagtggatctttgagacccagcccctggaggacatcaggaaggacaagaaggagtacaccaggacagtgaagctggaggaggtggacagaggagatgtgaagaactacacccacatctttgagagcaacaacctgatcaagtttgatgccagccacaagattgaggtggagggcgtgaccagaggagctgtggagctgaacaagagcctgtttgagaccacccccctgtatgccatccaggaccccctgggcaagtaccaccaggtgaagacagtgcagcaggaggagatcgtgagaggagatgtgcgcagctgccgctggctgtttgagacccggcccatcgaccagtttgatgagagcatccacaagttccagatcatccggggcatcagcgcccaggagatccagacaggaaatgtgaagagcgccaagtggctgtttgagacccagcccctggacagcatcaagtacttcagtgatgtggaggagacagagagcaagacagagcagacccgggacatcgtgaagggagatgtgaagacctgcaagtggctgtttgagacccagcccatggagagcctgtatgagaaggtgtccctgatgaccagcagcgaggagatccacaagggagatgtgaagacctgcacctggctgtttgagacccagcccctggacaccatcaaggatgattctgaaacagctgtgaagctgcagacagtgaagcaggaggagatccagggcggagatgtgaggacagcctgcttcctgtttgaaacagagaacctggacagcatccagggcgaggaggtgaaggagatcaagcctgtggagatggacatccaggccggagatgtgtcctccatgagatacaagtttgagaaccagagcctggacagcatcagcagcagcagcgaggaggtgctgaagaagatcaagaccctgaagacagaggacatccagaagggaaatgtgctgaactgccgctggctgtttgagaaccagcccatcgacaagatcaaggagagccaggagggagatgaatgtgtgaagacagtgacagacatccagggcggagatgtgaggaagggctgcttcatctttgagaccttcagcctggatgagatcaaggaggagagtgactacatcagcaccaagaagaccatcacagaggaggtgatccagggagatgtgaagagctacaggatgctgtttgagacccagcccctgtatgccatccaggaccgggagggcagctaccacgaggtgaccaccgtgaagaaggaggaggtgattcatggagatgtgcggggcacccgctggctgtttgagaccaagcccctggacagcatcaacaagtcagaaacagtgtatgtgatcaagtctgtgacccaggaggacatccagaagggagatgtgtcctctgtgcgctacagatttgagacccagcccctggaccagatcagcgaggagagccacaacatcatgcccagcattgaccacatccagggcggcaatgtgaagaccagccggcagttctttgaaagtgagaactttgacaagaacaactacatcagaacagtgtctgtgaatgagatccagaagggaaatgtgaagaccagcacctggctgtttgagacccacaccatggatgagctgcggggggagggcctggagtatgagaacatcaagacagtgacccaggaggatgtgcagaagggagatgtgaagcaggccgtgtggctgtttgaaaatagaacatttgacagcatcatggaggcccacaagggcatcaccaagatgaccaaggaggagatccccccatctgatgtgaagaccaccacctggctgtttgagaccacccccctgcacgagttcaatgagaccagggtggagaagattgagatcatcggcaagagcatcaaggagaccctggaggacctgtacagccagaaggtgatccaggcccctggcatcatcatcgaggctgatgaaattggagatgtgaggatggccaagtacaagctgatgaaccaggccagccctgagatccagaaggaggagatcatccgggctgacctgaggaacatcatggtgaacctgctgagcaagagggactgcacagagcgggagatcctgatcagcgaggaggagaagggaaatgtgaacctgaccaagacccagctgctgaacagaagcacagagttccacgccgagaaggaggagatcgtgaagggagatgtgcagcaggccatcaagaacctcttcagcgaggagaggtctgtgaagaagggcatcctgatccaggaggatgagaagggggacatcaacatgaccatctactgcctgctgcatgaaaatgatggagacaccatcgagcgggaggaggtgattggaggagatgtgaagaggaccatccacaacctgctgagcagcaccagcaacaacaagatcagcgagcgggccaagattgatgccagcgagagaggaaatgtgcagttcttcaccacctgcatcgaggccggggccctggactacctgaagcagctgcacacagagagcaatgagaccctgacagccaagaagcaggagggggagaaggagatcattggaggagatgtggagggcaccaagctgctgctgaagaagaggcagagcctggtggagaggacagtgtctgaaacagacatcatccctggagatgtgcacaacacagtgaaggtgttcatgacagagccccagagcaccttcggcaagatccccaaggaggagatcatcaagggggacctgaccagcaccctgaacagcctgagccaggccgtgaaccagaagacagtgaccaagacagaggagatcatcaagggcaacatgctggccaccctgaagagcctgaaggagagcagccaccgctggaaggagagcaagcagccagatgccatccctggggacatcgagaaggccatcgagtgcctggagaaggccaccaacaccaagacagagatcctgaagaaggagctgctgaaggatgacctggagaccagcctgcggagcctgaaggaggcccagaggagcttcaaggaggtgcacaaggagggcgtcatcaagaaggatgccaaggctgtgatggccggcagcagtggagagcagaagacagacatccaccaggtggccgtgcagaggaacaagaacagcctgctgcagcccaagccaggcccctttgagcctgctgccaagtggcagggcggcgctgacaccctgagccagaccatgggcaagagctgccacggcaacctggtggaggagaggacagaggtgaacctgcccaaggcccccaagggcaccgtgaagatcgtcatcgaccgggagcagaacaatgatgccctggagaagagcctgcggcggctgagcaacagccaccacaagagcaatgtgctggagagcggggacaagacaggagtgtggacagacaccactggagagcagcacctgagagatgagtacatgagccggcagctgaccagcacagtgtctgtgaagaacaacctgaccaccaaggagagtgacagagctgtgcgggagctgaagaaggatgatgtgttcaacagcatccagagcgctgggaagacagtgggcaagcagcagacctatgagctgagaaatgaccaccagaagatggagggcttccacatcaagagccccaagaagaccaagaacatcaagatcctgacagacacccagagcagcaagcccagccccacccagcaccctgtgtccatgcctgtgggcggcacctatgacctgagcggggacttccagaagcagaccctgctgaagcaggagaccaagtacagcaacaaggacatcaagaagaagaacatcaacctgcagcccatgtggcagctgctgcctgtggagcaggacaccagcaatgtgacagagatgaaggtgtctgagaagagccacaacaccttcaaggccaccaacaagaagcgggagacagatgtgcacctgaagagccaggacttcctgatgaagaccaacaccagcacaggcctgaagatggccatggagaggagcctgaaccccatcaacttcaacccagaaaataatgtgaaggagagcgagtgccccctgcccccacccagccccccacctcctccacccagcaatgccagcagcgagattgagttccccctgcccccacctccacccctgatgatgtttcctgagaagaatggcttcctgcccagcctgagcacagagaagatcaaggccgagtttgagagcttccctggcctgcccctgcccccacctcctgtggatgagaagtctgagcgggagagcagctccatgttcctgcccccacctcctccacccacccccagccagaagccagcccacctgctgagcagcagcgcccctgagaagcacagcggggacttcatgcagcagtacagccagaaggaggccagcaacagccagaacagccaggccaagatcatcaccgggaagacaggagtgctgcccccacccaccctgcccaagcccaagctgcccaagcacatcaaggacaacaagaatgacttcagccccaaggtggagctggccaccagcctgagtgacatggagtgcaagatcaccaccagcaaggaccagaagaaggtgatggtgatgaccagcagcgagcacacagagaccaagcagaatgtcatcagcaagagcctggatgagaggaagcagctgagcattgacagcgccaactgcctgagccacacagtgcccggcaccagcgcccccaggaagaagcagatcgcccccctcatcaagagccacagcttccctgagagcagcggccagcagaaccccaagccctacatgaggaagttcaagacccccctgatgattgctgaggagaagtaccggcagcagaaggaggagattgagaagcagaagcaggagagcagctactacaacatcgtgaagacccagagccagaaccagcacatcacagaggtggagaaggagatgcccctgcagaagaccaatgaggaggtgtccctgtctggaattgattctgagtgcaccgtggtgcagcccagccctggcagccagagcaatgcccgcatcctgggcgtgtgcagcgacaaccagctgagcaccaccagccctgagaccgtggccgccaagaggctgcaccacgtgctggccgccagcgaggacaaggacaagatgaagaaggaggtgctgcagagcagccgggacatcatgcagagcaagagcgcctgtgagatcaagcagagccaccaggagtgcagcacccagcagacccagcagaagaagtacctggagcagctgcacctgccccagagcaagcccatcagccccaacttcaaggtgaagaccatcaagctgcccaccctggaccacaccctgaatgaaacagaccacagctatgagagccacaagcagcagagcgagattgatgtgcagaccttcaccaagaagcagtacctgaagaccaagaagacagaggccagcacagaatgtagccacaagcagagcctggccgagcggcactaccagctgcccaagaaggagaagagggtgacagtgcagctgcccacagagagcatccagaagaaccaggaggacaagctgaagatggtgcccaggaagcagcgggagttcagcggcagtgaccggggcaagctgcccggcagcgaggagaagaaccagggccccagcatgattggaaggaaggaggagcggctcatcacagagaggaagcatgagcacctgaagaacaagagcgcccccaaggtggtgaagcagaaggtgattgatgcccacctggacagccagacccagaacttccagcagacccagatccagacagctgagagcaaggccgagcacaagaagctgccccagccctacaacagcctgcaggaggagaagtgcctggaggtgaagggcatccaggagaagcaggtgttcagcaacaccaaggacagcaagcaggagatcacccagaacaagagcttcttcagctctgtgaaggagagccagagagatgatggaaaaggagccctgaacatcgtggagttcctgaggaagcgggaggagctgcagcagatcctgagccgggtgaagcagtttgaggccgagcccaacaagagcggcctgaagaccttccagaccctgctgaacaccatccctggctggctgatcagcgaggacaagcgggagtatgctgtgcacatcgccatggagaacaacctggagaaggtgaaggaggagatcacccacatcaagacccaggccgaggacatgctggtgtcctatgagaacatcatccagacagccatgatgagcagcaagacaggcaagccaggcaacaagcccaccagcctggatgagaccagcagcaaggtgtccaatgtgcacgtgagcaacaacaagaacagcgagcagaaggagaacaagatcgccaaggagaagacagtgcagcaccaggtggccgcccaccacgaggccaccgtgcgcagccacgtgaagacccaccaggagatcaagctggatgacagcaacatccccccacccagcctgaagacccggccccccagccccaccttcatcaccatcgagagcacagccaggagaacagagaaccccaccaagaatgagctgagccagagccccaagaaggacagctatgtggagcccccaccccggcggcccatgagccagaagtctgagatccaccgggccaacaccagccccagcccccccaggagccgctctgagcagctggtgcggctgaaggacaccacagccaagctgagcaagggggccatcccctgcccagctgccacccctgtgcccatcgtggagaagaggtctgagatcatcatgagccctgccaccctgcggcggcagatcaagattgagacccggggccgggacagcccccccaccatcaccatccctgtgaacatcaaccacgccgccagcggcagcttccgggagagcgtggatgcccaggaggagatcaggaaggtggagaagagggccacctacgtgcacaaggatggcctgaacagcacagaccacatggtgcctgacacagagagctatgatgctgtggagatcatcaggaaggtggccgtgcccccccggctgtctgagcacacccagagatatgaggccgccaacagaacagtgcagatggctgaaaattttgtgaatgaccctgaaaatgagatcaaccgctggttccgggagtttgagcacggccctgtgtctgaggccaagagcaacagaagagtgtatgccaagggggagaccaaccacaacatccagcaggagagcaggaccttctgcaaggaggagtttggcctgaccagcctgggcaacaccagcttcacagacttcagctgcaagcacccccgggagctgcgggagaagatccctgtgaagcagccccgcatctgcagcgagaccaggagcctgtctgagcacttcagcggcatggatgcctttgagagccagatcgtggagagcaagatgaagaccagcagcagccacagcagcgaggccggcaagagcggctgtgacttcaagcacgccccacccacctatgaagatgtgattgctggccacatcctggacatcagtgacagccccaaggaggtgaggaagaacttccagaagacctggcaggagagcggccgggtcttcaagggcctgggctacgccacagcagatgccagcgccacagagatgaggaccaccttccaggaggagagcgccttcatcagcgaggccgccgccccccggcagggcaacatgtacaccctgagcaaggacagcctgagcaatggagtgcccagcggccggcaggccgagttctcctag

SEQ ID NO: 176213 - DNA, 2151 bp, Artificial Sequence
  Description of Artificial Sequence: Synthetic coding sequence
atggcccgctaccaggccgctgtgtccagaggagactgccgctccttcagcgccaacatgatggaggagagcgagatgtgtgctgtgcctgggggcctggccaaggtgaagaagcagtttgaagatgagatcaccagcagcaggaacacctttgcccagtaccagtaccagcaccagaacagaagtgagcaggaggccatccacagcagccaggtgggcaccagccgcagcagccaggagatggccagaaatgagcaggagggcagcaaggtgcagaagattgatgtgcatggaacagagatggtgagccacctggagaagcacacagaggaggtgaaccaggccagccagttccaccagtatgtgcaggagaccgtgattgacaccccagaagatgaggagatccccaaggtgtccaccaagctgctgaaggagcagtttgagaagagcgcccaggagaagatcctgtacagcgacaaggagatgaccaccccagccaagcagatcaagaagctgctgctgcaggacaaggagatctgcatcctgtgccagaagacagtgtaccccatggagtgcctggtggccgacaagcagaacttccacaagagctgcttccgctgccaccactgcaacagcaagctgagcctgggcaactatgccagcctgcacggccagatctactgcaagccccacttcaagcagctgttcaagagcaaaggaaattatgatgagggcttcggccacaagcagcacaaggaccgctggaactgcaagaaccagagccgctctgtggacttcatccccaatgaggagcccaacatgtgcaagaacattgctgagaacaccctggtgcctggggacagaaatgagcacctggatgctggcaacagcgagggccagagaaatgacctgaggaagctgggggagcggggcaagctgaaggtgatctggccacccagcaaggagatccccaagaagaccctgccctttgaggaggagctgaagatgagcaagcccaagtggcccccagagatgaccaccctgctgagccctgagttcaagtctgagagcctgctggaggatgtgaggaccccagagaacaagggccagaggcaggaccacttccccttcctgcagccctacctgcagagcacccacgtgtgccagaaggaggatgtgattggcatcaaggagatgaagatgcctgagggcaggaaggatgagaagaaggagggcaggaagaatgtgcaggaccggcccagcgaggccgaggacaccaagagcaacaggaagagcgccatggacctgaatgacaacaacaacgtgattgtgcagagcgctgagaaggagaagaatgagaagaccaaccagaccaatggagctgaggtgctgcaggtgaccaacacagatgatgagatgatgcctgagaaccacaaggagaacctgaacaagaacaacaacaacaactacgtggccgtgtcctacctgaacaactgccggcagaagaccagcatcctggagttcctggacctgctgcccctgagcagcgaggccaatgacacagccaatgaatatgaaattgagaagctggagaacaccagccgcatcagcgagctgctgggcatctttgaaagtgagaagacctacagcagaaatgtgctggccatggccctgaagaagcagacagacagagctgctgctggcagccctgtgcagcctgcccccaagcccagcctgagccggggcctgatggtgaagggcggcagcagcatcatcagcccagacaccaacctgctgaacatcaagggcagccacagcaagagcaagaacctgcacttcttcttcagcaacacagtgaagatcacagccttcagcaagaagaatgaaaacatcttcaactgtgacctgattgattctgtggaccagatcaagaacatgccctgcctggacctgcgggagtttgggaaggatgtgaagccctggcacgtggagaccacagaggccgccaggaacaatgaaaatactggatttgatgccctgagccatgaatgtacagccaagcccctcttcccccgggtggaggtgcagagcgagcagctgactgtggaggagcagatcaagaggaaccgctgctacagcgacacagaatag

SEQ ID NO: 176214 - DNA, 2817 bp, Artificial Sequence; identical to SEQ ID NO: 176210
  Description of Artificial Sequence: Synthetic coding sequence

SEQ ID NO: 176215 - DNA, 2892 bp, Artificial Sequence
  Description of Artificial Sequence: Synthetic coding sequence
atgcccctgcagaagaccaatgaggaggtgtccctgtctggaattgattctgagtgcaccgtggtgcagcccagccctggcagccagagcaatgcccgcatcctgggcgtgtgcagcgacaaccagctgagcaccaccagccctgagaccgtggccgccaagaggctgcaccacgtgctggccgccagcgaggacaaggacaagatgaagaaggaggtgctgcagagcagccgggacatcatgcagagcaagagcgcctgtgagatcaagcagagccaccaggagtgcagcacccagcagacccagcagaagaagtacctggagcagctgcacctgccccagagcaagcccatcagccccaacttcaaggtgaagaccatcaagctgcccaccctggaccacaccctgaatgaaacagaccacagctatgagagccacaagcagcagagcgagattgatgtgcagaccttcaccaagaagcagtacctgaagaccaagaagacagaggccagcacagaatgtagccacaagcagagcctggccgagcggcactaccagctgcccaagaaggagaagagggtgacagtgcagctgcccacagagagcatccagaagaaccaggaggacaagctgaagatggtgcccaggaagcagcgggagttcagcggcagtgaccggggcaagctgcccggcagcgaggagaagaaccagggccccagcatgattggaaggaaggaggagcggctcatcacagagaggaagcatgagcacctgaagaacaagagcgcccccaaggtggtgaagcagaaggtgattgatgcccacctggacagccagacccagaacttccagcagacccagatccagacagctgagagcaaggccgagcacaagaagctgccccagccctacaacagcctgcaggaggagaagtgcctggaggtgaagggcatccaggagaagcaggtgttcagcaacaccaaggacagcaagcaggagatcacccagaacaagagcttcttcagctctgtgaaggagagccagagagatgatggaaaaggagccctgaacatcgtggagttcctgaggaagcgggaggagctgcagcagatcctgagccgggtgaagcagtttgaggccgagcccaacaagagcggcctgaagaccttccagaccctgctgaacaccatccctggctggctgatcagcgaggacaagcgggagtatgctgtgcacatcgccatggagaacaacctggagaaggtgaaggaggagatcacccacatcaagacccaggccgaggacatgctggtgtcctatgagaacatcatccagacagccatgatgagcagcaagacaggcaagccaggcaacaagcccaccagcctggatgagaccagcagcaaggtgtccaatgtgcacgtgagcaacaacaagaacagcgagcagaaggagaacaagatcgccaaggagaagacagtgcagcaccaggtggccgcccaccacgaggccaccgtgcgcagccacgtgaagacccaccaggagatcaagctggatgacagcaacatccccccacccagcctgaagacccggccccccagccccaccttcatcaccatcgagagcacagccaggagaacagagaaccccaccaagaatgagctgagccagagccccaagaaggacagctatgtggagcccccaccccggcggcccatgagccagaagtctgagatccaccgggccaacaccagccccagcccccccaggagccgctctgagcagctggtgcggctgaaggacaccacagccaagctgagcaagggggccatcccctgcccagctgccacccctgtgcccatcgtggagaagaggtctgagatcatcatgagccctgccaccctgcggcggcagatcaagattgagacccggggccgggacagcccccccaccatcaccatccctgtgaacatcaaccacgccgccagcggcagcttccgggagagcgtggatgcccaggaggagatcaggaaggtggagaagagggccacctacgtgcacaaggatggcctgaacagcacagaccacatggtgcctgacacagagagctatgatgctgtggagatcatcaggaaggtggccgtgcccccccggctgtctgagcacacccagagatatgaggccgccaacagaacagtgcagatggctgaaaattttgtgaatgaccctgaaaatgagatcaaccgctggttccgggagtttgagcacggccctgtgtctgaggccaagagcaacagaagagtgtatgccaagggggagaccaaccacaacatccagcaggagagcaggaccttctgcaaggaggagtttggcctgaccagcctgggcaacaccagcttcacagacttcagctgcaagcacccccgggagctgcgggagaagatccctgtgaagcagccccgcatctgcagcgagaccaggagcctgtctgagcacttcagcggcatggatgcctttgagagccagatcgtggagagcaagatgaagaccagcagcagccacagcagcgaggccggcaagagcggctgtgacttcaagcacgccccacccacctatgaagatgtgattgctggccacatcctggacatcagtgacagccccaaggaggtgaggaagaacttccagaagacctggcaggagagcggccgggtcttcaagggcctgggctacgccacagcagatgccagcgccacagagatgaggaccaccttccaggaggagagcgccttcatcagcgaggccgccgccccccggcagggcaacatgtacaccctgagcaaggacagcctgagcaatggagtgcccagcggccggcaggccgagttctcctag

SEQ ID NO: 176216 - DNA, 2916 bp, Artificial Sequence
  Description of Artificial Sequence: Synthetic coding sequence
atgttccccatgcagaagggcagcctgaacctgctgcggcagaagtgggagagctgtgactaccagaggtctgagtgccacccccgggacagccactgcaccatcttccagccccaggagagcaagctgctggcccctgagggggaggtggtgtctgccccccagagcctggaccccaccagcctgccctacagcactggagaggagatgtggagcagcaagccagaggagaaggacagcgtggacaagagcaacaacacccgggagtatggccggcctgaggtgctgaaggaggacagcctgagcagcagaagaagaattgagcgcttcagcatcgccctggatgagctgcggtctgtgtttgaggcccccaagagcggcaacaagccagcagaatatggaggcaaggaggtggagattgaaagaagcctgtgcagccctgccttcaagagccaccctggcagccagctggaggacagcgtgaaggacagcgacaagaagggcaaggagaccagctttgacaagatgagccctgagagcggccacagccgcatctttgaggccgtgttcagcacagaccaggcccagatcctgcggctgcacctgcaccccaagctgaccaagacccccaagaacagcctgaagagcagcacctacatcagcacagctggccccaacaagccagagagcggctttgctgaggacagcgctgcccggggggagggcgtgtctgacctgcacgaggtggtgtccctgaaggagaggatggcccgctaccaggccgctgtgtccagaggagactgccgctccttcagcgccaacatgatggaggagagcgagatgtgtgctgtgcctgggggcctggccaaggtgaagaagcagtttgaagatgagatcaccagcagcaggaacacctttgcccagtaccagtaccagcaccagaacagaagtgagcaggaggccatccacagcagccaggtgggcaccagccgcagcagccaggagatggccagaaatgagcaggagggcagcaaggtgcagaagattgatgtgcacggcacagagatggtgagccacctggagaagcacacagaggaggtgaaccaggccagccagttccaccagtatgtgcaggagaccgtcatcgacaccccagaagatgaggagatccccaaggtgtccaccaagctgctgaaggagcagtttgagaagagcgcccaggagaagatcctgtacagcgacaaggagatgaccaccccagccaagcagatcaagaagctgctgctgcaggacaaggagatctgcatcctgtgccagaagacagtgtaccccatggagtgcctggtggccgacaagcagaacttccacaagagctgcttccgctgccaccactgcaacagcaagctgagcctgggcaactatgccagcctgcacggccagatctactgcaagccccacttcaagcagctgttcaagagcaagggcaactatgatgagggcttcggccacaagcagcacaaggaccgctggaactgcaagaaccagagccgctctgtggacttcatccccaatgaggagcccaacatgtgcaagaacattgctgagaacaccctggtgcctggggacagaaatgagcacctggatgctggcaacagcgagggccagagaaatgacctgaggaagctgggggagcggggcaagctgaaggtgatctggccacccagcaaggagatccccaagaagaccctgccctttgaggaggagctgaagatgagcaagcccaagtggcccccagagatgaccaccctgctgagccctgagttcaagtctgagagcctgctggaggatgtgaggaccccagaaaataaaggccagaggcaggaccacttccccttcctgcagccctacctgcagagcacccacgtgtgccagaaggaggatgtgattggcatcaaggagatgaagatgcctgagggcaggaaggatgagaagaaggagggcaggaagaatgtgcaggaccggcccagcgaggccgaggacaccaagagcaacaggaagagcgccatggacctgaatgacaacaacaacgtcatcgtgcagagcgctgagaaggagaagaatgagaagaccaaccagaccaacggggctgaggtgctgcaggtgaccaacacagatgatgagatgatgcctgagaaccacaaggagaacctgaacaagaacaacaacaacaactacgtggccgtgtcctacctgaacaactgccggcagaagaccagcatcctggagttcctggacctgctgcccctgagcagcgaggccaatgacacagccaatgaatatgaaattgagaagctggagaacaccagccgcatcagcgagctgctgggcatctttgagagcgagaagacctacagcagaaatgtgctggccatggccctgaagaagcagacagacagagctgctgctggcagccctgtgcagcctgcccccaagcccagcctgagccggggcctgatggtgaagggcggcagcagcatcatcagcccagacaccaacctgctgaacatcaagggcagccacagcaagagcaagaacctgcacttcttcttcagcaacacagtgaagatcacagccttcagcaagaagaatgaaaacatcttcaactgtgacctgattgacagcgtggaccagatcaagaacatgccctgcctggacctgcgggagtttgggaaggatgtgaagccctggcacgtggagaccacagaagctgccagaaataatgaaaatacaggctttgatgccctgagccatgagtgcacagccaagcccctcttcccccgggtggaggtgcagagcgagcagctgactgtggaggagcagatcaagaggaaccgctgctacagcgacacagaatag

SEQ ID NO: 176217 - DNA, 2916 bp, Artificial Sequence; identical to SEQ ID NO: 176216
  Description of Artificial Sequence: Synthetic coding sequence

SEQ ID NO: 176218 - DNA, 1380 bp, Artificial Sequence
  Description of Artificial Sequence: Synthetic coding sequence
atggagaccgtgtttgaggagatggatgaggagagcactggaggagtgagcagcagcaaggaggagatcgtgctgggccagaggctgcacctgtccttccccttcagcatcatcttcagcacagtgctgtactgtggggaggtggccttcggcctgtacatgtttgagatctacaggaaggccaatgacaccttctggatgtccttcaccatctccttcatcatcgtgggcgccatcctggaccagatcatcctgatgttcttcaacaaggacctgcggaggaacaaggccgccctgctcttctggcacatcctgctgctgggccccatcgtgcgctgcctgcacaccatccggaactaccacaagtggctgaagaacctgaagcaggagaaggaggagacccaggtgtccatcaccaagaggaacaccatgctggagcgggagatcgccttcagcatccgggacaacttcatgcagcagaaggccttcaagtacatgtctgtcatccaggccttcctgggctctgtgccccagctgatcctgcagatgtacatcagcctgaccatccgggagtggcccctgaacagagccctgctgatgaccttcagcctgctgtctgtgacctatggagccatccgctgcaacatcctggccatccagatcagcaatgatgacaccaccatcaagctgccccccatcgagttcttctgtgtggtgatgtggaggttcctggaggtgatcagccgggtggtgaccctggccttcttcatcgccagcctgaagctgaagagcctgcctgtgctgctgatcatctactttgtgtccctgctggccccctggctggagttctggaagagcggggcccacctgcccggcaacaaggagaacaacagcaacatggtgggcaccgtgctgatgctgttcctgatcaccctgctgtatgctgccatcaacttcagctgctggagcgctgtgaagctgcagctgagtgatgacaagatcattgatggccggcagcgctggggccaccgcatcctgcactacagcttccagttcctggagaatgtcatcatgatcctggtgttccgcttctttggaggcaagaccctgctgaactgctgtgacagcctgattgctgtgcagctgatcatctcctacctgctggccaccggcttcatgctgctcttctaccagtacctgtacccctggcagagcggcaaggtgctgcccggccgcacagagaaccagcctgaggccccctactactacgtgaacatcgagaagacagagaagaacaagaacaagcagctgaggaactactgccacagctgcaacagagtgggctacttcagcatcaggaagtccatgacctgcagctag

SEQ ID NO: 176219 - DNA, 1389 bp, Artificial Sequence
  Description of Artificial Sequence: Synthetic coding sequence
atgaacacccggccccagcacagcgagaggaccagcaccatggacagagtgtatgagatccctgaggagcccaacgtggaccctgtgagcagcctggaggaggatgtgatccggggggccaacccccgcttcaccttccccttcagcatcctcttcagcaccttcctgtactgtggggaggccgccagcgccctgtacatggtgcgcatctacaggaagaacagcgagacctactggatgacctacaccttctccttcttcatgttcagcagcatcatggtgcagctgaccctcatctttgtgcaccgggacctggccaaggacaagcccctgagcctcttcatgcacctgatcctgctgggccctgtgatccgctgcctggaggccatgatcaagtacctgaccctgtggaagaaggaggagcaggaggagccctacgtgtccctgaccaggaagaagatgctgattgatggagaggaggtgctgattgagtgggaggtgggccacagcatccgcaccctggccatgcacagaaatgcctacaagaggatgagccagatccaggccttcctgggctctgtgccccagctgacctaccagctgtatgtgtccctcatctctgctgaggtgcccctgggccgggtggtgctgatggtgttcagcctggtgtctgtgacctatggagccaccctgtgcaacatgctggccatccagatcaagtatgatgactacaagatccggctgggccccctggaggtgctgtgcatcaccatctggaggaccctggagatcaccagccggctgctgatcctggtgctcttcagcgccaccctgaagctgaaggctgtgcccttcctggtgctgaacttcctgatcatcctgtttgagccctggatcaagttctggaggtctggggcccagatgcccaacaacatcgagaagaacttcagccgggtgggcaccctggtggtgctgatctctgtgaccatcctgtatgccggcatcaacttcagctgctggagcgccctgcagctgcggctggccgaccgggacctggtggacaagggccagaactggggccacatgggcctgcactacagcgtgcggctggtggagaatgtcatcatggtgctggtgttcaagttctttggagtgaaggtgctgctgaactactgccacagcctcatcgccctgcagctgatcatcgcctacctgatcagcatcggcttcatgctgctcttcttccagtacctgcaccccctgcggagcctcttcacccacaacgtggtggactacctgcactgtgtgtgctgccaccagcaccccaggaccagggtggagaacagcgagcccccatttgaaacagaggcccggcagagcgtggtgtag

SEQ ID NO: 176220 - DNA, 1350 bp, Artificial Sequence
  Description of Artificial Sequence: Synthetic coding sequence
atggacagagtgtatgagatccctgaggagcccaacgtggaccctgtgagcagcctggaggaggatgtgatccggggggccaacccccgcttcaccttccccttcagcatcctcttcagcaccttcctgtactgtggggaggccgccagcgccctgtacatggtgcgcatctacaggaagaacagcgagacctactggatgacctacaccttctccttcttcatgttcagcagcatcatggtgcagctgaccctcatctttgtgcaccgggacctggccaaggacaagcccctgagcctcttcatgcacctgatcctgctgggccctgtgatccgctgcctggaggccatgatcaagtacctgaccctgtggaagaaggaggagcaggaggagccctacgtgtccctgaccaggaagaagatgctgattgatggagaggaggtgctgattgagtgggaggtgggccacagcatccgcaccctggccatgcacagaaatgcctacaagaggatgagccagatccaggccttcctgggctctgtgccccagctgacctaccagctgtatgtgtccctcatctctgctgaggtgcccctgggccgggtggtgctgatggtgttcagcctggtgtctgtgacctacggggccaccctgtgcaacatgctggccatccagatcaagtatgatgactacaagatccggctgggccccctggaggtgctgtgcatcaccatctggaggaccctggagatcaccagccggctgctgatcctggtgctcttcagcgccaccctgaagctgaaggctgtgcccttcctggtgctgaacttcctgatcatcctgtttgagccctggatcaagttctggaggtctggggcccagatgcccaacaacatcgagaagaacttcagccgggtgggcaccctggtggtgctgatctctgtgaccatcctgtatgccggcatcaacttcagctgctggagcgccctgcagctgcggctggccgaccgggacctggtggacaagggccagaactggggccacatgggcctgcactacagcgtgcggctggtggagaatgtcatcatggtgctggtgttcaagttcttcggcgtgaaggtgctgctgaactactgccacagcctgattgccctgcagctgatcatcgcctacctgatcagcatcggcttcatgctgctcttcttccagtacctgcaccccctgcggagcctcttcacccacaacgtggtggactacctgcactgtgtgtgctgccaccagcaccccaggaccagggtggagaacagcgagcccccatttgaaacagaggcccggcagagcgtggtgtag

SEQ ID NO: 176221 - DNA, 1335 bp, Artificial Sequence
  Description of Artificial Sequence: Synthetic coding sequence
atgaagtttcctgcctctgtgctggccagcgtcttcctgtttgtggccgagaccacagctgccctgagcctgagcagcacctaccgcagcggcggggacaggatgtggcaggccctgaccctgctcttcagcctgctgccctgtgccctggtgcagctgaccctgctgtttgtgcaccgggacctgagccgggaccggcccctggtgctgctgctgcacctgctgcagctgggccccctcttccgctgctttgaggtgttctgcatctacttccagagcggcaacaatgaggagccctacgtgtccatcaccaagaagaggcagatgcccaagaatggcctgtctgaggagattgagaaggaggtgggccaggccgagggcaagctgatcacccacaggtctgccttcagccgggccagcgtcatccaggccttcctgggcagcgccccccagctgaccctgcagctgtacatctctgtgatgcagcaggatgtgacagtgggccgcagcctgctgatgaccatcagcctgctgagcatcgtgtatggagccctgcgctgcaacatcctggccatcaagatcaagtatgatgaatatgaggtgaaggtgaagcccctggcctacgtgtgcatcttcctgtggaggagctttgaaattgccaccagggtggtggtgctggtgctcttcacctctgtgctgaagacctgggtggtggtgatcatcctgatcaacttcttctccttcttcctgtacccctggatcctcttctggtgcagcggcagccccttcccagaaaatattgagaaggccctgagccgggtgggcaccaccatcgtgctgtgcttcctgaccctgctgtacacaggcatcaacatgttctgctggagcgctgtgcagctgaagattgacagcccagacctgatcagcaagagccacaactggtaccagctgctggtgtactacatgatccgcttcattgaaaatgccatcctgctgctgctgtggtacctgttcaagacagacatctacatgtatgtgtgtgcccccctgctggtgctgcagctgctgattggctactgcacagccatcctcttcatgctggtgttctaccagttcttccacccctgcaagaagctgttcagcagctctgtgtctgagggcttccagcgctggctgcgctgcttctgctgggcctgccggcagcagaagccctgtgagcccatcggcaaggaggacctgcagagcagccgggacagagatgagacccccagcagcagcaagaccagccctgagcccggccagttcctgaatgctgaggacctgtgcagcgcctag

SEQ ID NO: 176222 - DNA, 1929 bp, Artificial Sequence
  Description of Artificial Sequence: Synthetic coding sequence
atggccgccagcaggaagccaccccgggtgcgggtgaaccaccaggacttccagctgaggaacctgcgcatcatcgagcccaatgaggtgacccacagcggggacaccggggtggagacagatggccgcatgccacccaaggtgaccagcgagctgctgcggcagctgcggcaggccatgagaaattctgaatatgtgacagagcccatccaggcctacatcatccccagcggagatgcccaccagagcgagtacatcgccccctgtgactgccggcgggcctttgtgtctggctttgatggcagcgctggaacagccatcatcacagaggagcacgccgccatgtggacagatggccgctacttcctgcaggccgccaagcagatggacagcaactggaccctgatgaagatgggcctgaaggacacccccacccaggaggactggctggtgtctgtgctgcctgagggcagccgggtgggcgtggaccccctcatcatccccacagactactggaagaagatggccaaggtgctgcggtctgctggccaccacctgatccctgtgaaggagaacctggtggacaagatctggacagacaggcctgagcggccctgcaagcccctgctgaccctgggcctggactacacaggcatctcctggaaggacaaggtggccgacctgcggctgaagatggccgagagaaatgtgatgtggtttgtggtgacagccctggatgagatcgcctggctgttcaacctgcggggcagtgatgtggagcacaaccctgtgttcttctcctatgccatcatcggcctggagaccatcatgctgttcattgatggagacagaattgatgcccccagcgtgaaggagcacctgctgctggacctgggcctggaggccgagtaccgcatccaggtgcacccctacaagagcatcctgtctgagctgaaggccctgtgtgccgacctgagcccccgggagaaggtgtgggtgtctgacaaggccagctatgctgtgtctgagaccatccccaaggaccaccgctgctgcatgccctacacccccatctgcatcgccaaggctgtgaagaacagcgctgagagcgagggcatgaggcgggcccacatcaaggatgctgtggccctgtgtgagctgttcaactggctggagaaggaggtgcccaagggcggcgtgacagagatctctgctgctgacaaggccgaggagttccggcggcagcaggccgactttgtggacctgtccttccccaccatcagcagcacaggccccaatggagccatcatccactatgcagatggcaccacagatgtgaccaggaccatgcacttcggcacccccacagcctatgagaaggagtgcttcacctacgtgctgaagggccacatcgctgtgtctgctgctgtgttccccaccggcaccaagggccacctgctggacagctttgcccggagcgccctgtgggacagcggcctggactacctgcacggcaccggccacggcgtgggcagcttcctgaatgtgcatgagggcccctgtggcatctcctacaagaccttcagtgatgagcccctggaggccggcatgattgtgacagatgagcccggctactatgaagatggagccttcggcatcagaattgaaaatgtggtgctggtggtgcctgtgaagaccaagtacaacttcaacaacagaggcagcctgacctttgagcccctgaccctggtgcccatccagaccaagatgattgatgtggacagcctgacagacaaggaatgtgactggctgaacaactaccacctgacctgcagagatgtgattggcaaggagctgcagaagcagggccggcaggaggccctggagtggctgatccgggagacccagcccatcagcaagcagcactag

SEQ ID NO: 176223 - DNA, 1872 bp, Artificial Sequence
  Description of Artificial Sequence: Synthetic coding sequence
atgccacccaaggtgaccagcgagctgctgcggcagctgcggcaggccatgaggaacagtgaatatgtgacagagcccatccaggcctacatcatccccagcggagatgcccaccagagcgagtacatcgccccctgtgactgcagaagagcctttgtgtctggctttgatggcagcgctggaacagccatcatcacagaggagcacgccgccatgtggacagatggccgctacttcctgcaggccgccaagcagatggacagcaactggaccctgatgaagatgggcctgaaggacacccccacccaggaggactggctggtgtctgtgctgcctgagggcagccgggtgggcgtggaccccctcatcatccccacagactactggaagaagatggccaaggtgctgcggtctgctggccaccacctgatccctgtgaaggagaacctggtggacaagatctggacagacaggcctgagcggccctgcaagcccctgctgaccctgggcctggactacacaggcatctcctggaaggacaaggtggccgacctgcggctgaagatggccgagagaaatgtgatgtggtttgtggtgacagccctggatgaaattgcctggctgttcaacctgcggggcagtgatgtggagcacaaccctgtgttcttctcctatgccatcatcggcctggagaccatcatgctgttcattgatggagacagaattgatgcccccagcgtgaaggagcacctgctgctggacctgggcctggaggccgagtaccgcatccaggtgcacccctacaagagcatcctgtctgagctgaaggccctgtgtgccgacctgagcccccgggagaaggtgtgggtgtctgacaaggccagctatgctgtgtctgagaccatccccaaggaccaccgctgctgcatgccctacacccccatctgcatcgccaaggctgtgaagaacagcgctgagagcgagggcatgagaagagcccacatcaaggatgctgtggccctgtgtgagctgttcaactggctggagaaggaggtgcccaagggcggcgtgacagagatctctgctgctgacaaggccgaggagttccggcggcagcaggccgactttgtggacctgtccttccccaccatcagcagcacaggccccaacggggccatcatccactacgcccctgtgcctgagaccaacagaaccctgagcctggatgaggtgtacctgattgacagcggggcccagtacaaggatggcaccacagatgtgaccaggaccatgcacttcggcacccccacagcctatgagaaggagtgcttcacctacgtgctgaagggccacatcgctgtgtctgctgctgtgttccccaccggcaccaagggccacctgctggacagctttgcccggagcgccctgtgggacagcggcctggactacctgcatggaactggacatggagtgggcagcttcctgaatgtgcatgagggcccctgtggcatctcctacaagaccttcagtgatgagcccctggaggccggcatgattgtgacagatgagcccggctactatgaagatggagccttcggcatcagaattgaaaatgtggtgctggtggtgcctgtgaagaccaagtacaacttcaacaacagaggcagcctgacctttgagcccctgaccctggtgcccatccagaccaagatgattgatgtggacagcctgacagacaaggaatgtgactggctgaacaactaccacctgacctgcagagatgtgattggcaaggagctgcagaagcagggccggcaggaggccctggagtggctgatccgggagacccagcccatcagcaagcagcactag

SEQ ID NO: 176224 - DNA, 1659 bp, Artificial Sequence
  Description of Artificial Sequence: Synthetic coding sequence
atgtggacagatggccgctacttcctgcaggccgccaagcagatggacagcaactggaccctgatgaagatgggcctgaaggacacccccacccaggaggactggctggtgtctgtgctgcctgagggcagccgggtgggcgtggaccccctcatcatccccacagactactggaagaagatggccaaggtgctgcggtctgctggccaccacctgatccctgtgaaggagaacctggtggacaagatctggacagacaggcctgagcggccctgcaagcccctgctgaccctgggcctggactacacaggcatctcctggaaggacaaggtggccgacctgcggctgaagatggccgagagaaatgtgatgtggtttgtggtgacagccctggatgagatcgcctggctgttcaacctgcggggcagtgatgtggagcacaaccctgtgttcttctcctatgccatcatcggcctggagaccatcatgctgttcattgatggagacagaattgatgcccccagcgtgaaggagcacctgctgctggacctgggcctggaggccgagtaccgcatccaggtgcacccctacaagagcatcctgtctgagctgaaggccctgtgtgccgacctgagcccccgggagaaggtgtgggtgtctgacaaggccagctatgctgtgtctgagaccatccccaaggaccaccgctgctgcatgccctacacccccatctgcatcgccaaggctgtgaagaacagcgctgagagcgagggcatgaggcgggcccacatcaaggatgctgtggccctgtgtgagctgttcaactggctggagaaggaggtgcccaagggcggcgtgacagagatctctgctgctgacaaggccgaggagttccggcggcagcaggccgactttgtggacctgtccttccccaccatcagcagcacaggccccaatggagccatcatccactacgcccctgtgcctgagaccaacagaaccctgagcctggatgaggtgtacctgattgattctggggcccagtacaaggatggcaccacagatgtgaccaggaccatgcacttcggcacccccacagcctatgagaaggagtgcttcacctacgtgctgaagggccacatcgctgtgtctgctgctgtgttccccaccggcaccaagggccacctgctggacagctttgcccggagcgccctgtgggacagcggcctggactacctgcacggcaccggccacggcgtgggcagcttcctgaatgtgcatgagggcccctgtggcatctcctacaagaccttcagtgatgagcccctggaggccggcatgattgtgacagatgagcccggctactatgaagatggagccttcggcatcagaattgaaaatgtggtgctggtggtgcctgtgaagaccaagtacaacttcaacaacagaggcagcctgacctttgagcccctgaccctggtgcccatccagaccaagatgattgatgtggacagcctgacagacaaggaatgtgactggctgaacaactaccacctgacctgcagagatgtgattggcaaggagctgcagaagcagggccggcaggaggccctggagtggctgatccgggagacccagcccatcagcaagcagcactag

SEQ ID NO: 176225 - DNA, 912 bp, Artificial Sequence
  Description of Artificial Sequence: Synthetic coding sequence
atgccacccaaggtgaccagcgagctgctgcggcagctgcggcaggccatgaggaacagtgaatatgtgacagagcccatccaggcctacatcatccccagcggagatgcccaccagagcgagtacatcgccccctgtgactgcagaagagcctttgtgtctggctttgatggcagcgctggaacagccatcatcacagaggagcacgccgccatgtggacagatggccgctacttcctgcaggccgccaagcagatggacagcaactggaccctgatgaagatgggcctgaaggacacccccacccaggaggactggctggtgtctgtgctgcctgagggcagccgggtgggcgtggaccccctcatcatccccacagactactggaagaagatggccaaggtgctgcggtctgctggccaccacctgatccctgtgaaggagaacctggtggacaagatctggacagacaggcctgagcggccctgcaagcccctgctgaccctgggcctggactacacaggcatctcctggaaggacaaggtggccgacctgcggctgaagatggccgagagaaatgtgatgtggtttgtggtgacagccctggatgaaattgcctggctgttcaacctgcggggcagtgatgtggagcacaaccctgtgttcttctcctatgccatcatcggcctggagaccatcatgctgttcattgatggagacagaattgatgcccccagcgtgaaggagcacctgctgctggacctgggcctggaggccgagtaccgcatccaggtgcacccctacaagagcatcctgtctgagctgaaggccctgtgtgccgacctgagcccccgggagaaggtgtgggtgtctgacaaggccagctatgctgtgtctgagaccatcccctag

SEQ ID NO: 176226 - DNA, 2001 bp, Artificial Sequence
  Description of Artificial Sequence: Synthetic coding sequence
atggccgccagcaggaagccaccccgggtgcgggtgaaccaccaggacttccagctgaggaacctgcgcatcatcgagcccaatgaggtgacccacagcggggacaccggggtggagacagatggccgcatgccacccaaggtgaccagcgagctgctgcggcagctgcggcaggccatgagaaattctgaatatgtgacagagcccatccaggcctacatcatccccagcggagatgcccaccagagcgagtacatcgccccctgtgactgccggcgggcctttgtgtctggctttgatggcagcgctggaacagccatcatcacagaggagcacgccgccatgtggacagatggccgctacttcctgcaggccgccaagcagatggacagcaactggaccctgatgaagatgggcctgaaggacacccccacccaggaggactggctggtgtctgtgctgcctgagggcagccgggtgggcgtggaccccctcatcatccccacagactactggaagaagatggccaaggtgctgcggtctgctggccaccacctgatccctgtgaaggagaacctggtggacaagatctggacagacaggcctgagcggccctgcaagcccctgctgaccctgggcctggactacacaggcatctcctggaaggacaaggtggccgacctgcggctgaagatggccgagagaaatgtgatgtggtttgtggtgacagccctggatgagatcgcctggctgttcaacctgcggggcagtgatgtggagcacaaccctgtgttcttctcctatgccatcatcggcctggagaccatcatgctgttcattgatggagacagaattgatgcccccagcgtgaaggagcacctgctgctggacctgggcctggaggccgagtaccgcatccaggtgcacccctacaagagcatcctgtctgagctgaaggccctgtgtgccgacctgagcccccgggagaaggtgtgggtgtctgacaaggccagctatgctgtgtctgagaccatccccaaggaccaccgctgctgcatgccctacacccccatctgcatcgccaaggctgtgaagaacagcgctgagagcgagggcatgaggcgggcccacatcaaggatgctgtggccctgtgtgagctgttcaactggctggagaaggaggtgcccaagggcggcgtgacagagatctctgctgctgacaaggccgaggagttccggcggcagcaggccgactttgtggacctgtccttccccaccatcagcagcacaggccccaatggagccatcatccactacgcccctgtgcctgagaccaacagaaccctgagcctggatgaggtgtacctgattgattctggggcccagtacaaggatggcaccacagatgtgaccaggaccatgcacttcggcacccccacagcctatgagaaggagtgcttcacctacgtgctgaagggccacatcgctgtgtctgctgctgtgttccccaccggcaccaagggccacctgctggacagctttgcccggagcgccctgtgggacagcggcctggactacctgcacggcaccggccacggcgtgggcagcttcctgaatgtgcatgagggcccctgtggcatctcctacaagaccttcagtgatgagcccctggaggccggcatgattgtgacagatgagcccggctactatgaagatggagccttcggcatcagaattgaaaatgtggtgctggtggtgcctgtgaagaccaagtacaacttcaacaacagaggcagcctgacctttgagcccctgaccctggtgcccatccagaccaagatgattgatgtggacagcctgacagacaaggaatgtgactggctgaacaactaccacctgacctgcagagatgtgattggcaaggagctgcagaagcagggccggcaggaggccctggagtggctgatccgggagacccagcccatcagcaagcagcactag

SEQ ID NO: 176227 - DNA, 552 bp, Artificial Sequence
  Description of Artificial Sequence: Synthetic coding sequence
atggcccgggcccactggggctgctgcccctggctggtgctgctgtgtgcctgtgcctggggccacaccaagcctgtggacctgggcggccaggatgtgaggaactgcagcaccaaccccccctacctgcctgtgacagtggtgaacaccaccatgagcctgacagccctgcggcagcagatgcagacccagaacctgagcgcctacatcatccctggaacagatgcccacatgaatgagtacatcggccagcatgatgagcggcgggcctggatcaccggcttcaccggcagcgctggaacagctgtggtgaccatgaagaaggctgctgtgtggacagacagccgctactggacccaggccgagcggcagatggactgcaactgggagctgcacaaggaggtgggcaccacccccatcgtgacctggctgctgacagagatcccagctgggggccgggtgggctttgaccccttcctgctgagcatcggcatgctgttcctgcagagcctgaacctgtccatgctgaccagggtgacccagctgccctag

SEQ ID NO: 176228 - DNA, 2025 bp, Artificial Sequence
  Description of Artificial Sequence: Synthetic coding sequence
atggcccgggcccactggggctgctgcccctggctggtgctgctgtgtgcctgtgcctggggccacaccaagcctgtggacctgggcggccaggatgtgaggaactgcagcaccaaccccccctacctgcctgtgacagtggtgaacaccaccatgagcctgacagccctgcggcagcagatgcagacccagaacctgagcgcctacatcatccctggaacagatgcccacatgaatgagtacatcggccagcatgatgagcggcgggcctggatcaccggcttcaccggcagcgctggaacagctgtggtgaccatgaagaaggctgctgtgtggacagacagccgctactggacccaggccgagcggcagatggactgcaactgggagctgcacaaggaggtgggcaccacccccatcgtgacctggctgctgacagagatcccagctgggggccgggtgggctttgaccccttcctgctgagcattgacacctgggagagctatgacctggccctgcagggcagcaaccggcagctggtgtccatcaccaccaacctggtggacctggtgtggggcagcgagaggcctcctgtgcccaaccagcccatctatgccctgcaggaggccttcaccggcagcacctggcaggagaaggtgtctggagtgcgcagccagatgcagaagcaccagaaggtgcccacagctgtgctgctgagcgccctggaggagacagcctggctgttcaacctgcgggccagtgacatcccctacaaccccttcttctacagctacaccctgctgacagacagcagcatccggctgtttgccaacaagagccgcttcagcagcgagaccctgagctacctgaacagcagctgcaccggccccatgtgtgtgcagatcgaggactacagccaggtgcgggacagcatccaggcctacagcctgggagatgtgcgcatctggattggcaccagctacaccatgtatggcatctatgagatgatccccaaggagaagctggtgacagacacctacagccctgtgatgatgaccaaggctgtgaagaacagcaaggagcaggccctgctgaaggccagccacgtgagagatgctgtggccgtcatccgctacctggtgtggctggagaagaatgtgcccaagggcaccgtggatgagttcagcggggctgagatcgtggacaagttccggggggaggagcagttcagcagcggccccagctttgagaccatcagcgccagcggcctgaatgctgccctggcccactacagccccaccaaggagctgaacaggaagctgagcagtgatgagatgtacctgctggacagcggcggccagtactgggatggcaccacagacatcaccaggacagtgcactggggcacccccagcgccttccagaaggaggcctacaccagggtgctgattggcaacatcgacctgagccgcctcatcttccctgctgccaccagcggccgcatggtggaggcctttgcccggcgggccctgtgggatgctggcctgaactacggccacggcaccggccacggcatcggcaacttcctgtgtgtgcatgagtggcctgtgggcttccagagcaacaacatcgccatggccaagggcatgttcaccagcattgagcccggctactacaaggatggagaatttggcatccggctggaggatgtggccctggtggtggaggccaagaccaagtacccaggcagctacctgacctttgaggtggtgtcctttgtgccctatgacaggaacctgattgatgtgtccctgctgagccctgagcacctgcagtacctgaaccgctactaccagaccatccgggagaaggtgggccctgagctgcagaggcggcagctgctggaggagtttgagtggctgcagcagcacacagagcccctggccgcccgggccccagacacagcctcctgggcctctgtgctggtggtgtccaccctggccatcctgggctggagcgtgtag

SEQ ID NO: 176229 - DNA, 1524 bp, Artificial Sequence
  Description of Artificial Sequence: Synthetic coding sequence
atgccctggctgctgagcgcccccaagctggtgcctgctgtggccaacgtgcggggcctgagcggctgcatgctgtgcagccagaggcgctacagcctgcagcctgtgcctgagcggcgcatccccaaccgctacctgggccagcccagccccttcacccacccccacctgctgcggcctggagaggtgaccccaggcctgagccaggtggagtatgccctgcggcggcacaagctgatgagcctcatccagaaggaggcccagggccagagcggcacagaccagacagtggtggtgctgagcaaccccacctactacatgagcaatgacatcccctacaccttccaccaggacaacaacttcctgtacctgtgtggcttccaggagccagacagcatcctggtgctgcagagcctgcccgggaagcagctgcccagccacaaggccatcctgtttgtgccccggcgggaccccagccgggagctgtgggatggccccaggagcggcacagatggagccatcgccctgactggagtggatgaggcctacaccctggaggagttccagcacctgctgcccaagatgaaggccgagaccaacatggtgtggtatgactggatgaggcccagccacgcccagctgcacagcgactacatgcagcccctgacagaggccaaggccaagagcaagaacaaggtgcggggcgtgcagcagctgatccagaggctgcggctcatcaagagccctgctgagattgaaagaatgcagattgctgggaagctgaccagccaggccttcatcgagaccatgttcaccagcaaggcccctgtggaggaggccttcctgtatgccaagtttgaatttgaatgtcgggcccggggagctgacatcctggcctacccacctgtggtggccggcggcaacagaagcaacaccctgcactacgtgaagaacaaccagctgatcaaggatggagagatggtgctgctggatggcggctgtgagagcagctgctacgtgtctgacatcaccaggacctggcctgtgaatggccgcttcaccgccccccaggccgagctgtatgaagctgtgctggagatccagagggactgcctggccctgtgcttccctggcaccagcctggagaacatctacagcatgatgctgaccctcatcggccagaagctgaaggacctgggcatcatgaagaacatcaaggaaaataatgccttcaaggccgccaggaagtactgcccccaccacgtgggccactacctgggcatggatgtgcatgacaccccagacatgcccaggagcctgcccctgcagcccggcatggtgatcaccatcgagcccggcatctacatcccagaagatgacaaggatgcccctgagaagttccggggcctgggcgtgagaattgaagatgatgtggtggtgacccaggacagccccctcatcctgtctgctgactgccccaaggagatgaatgacatcgagcagatctgcagccaggccagctag

SEQ ID NO: 176230 - DNA, 837 bp, Artificial Sequence
  Description of Artificial Sequence: Synthetic coding sequence
atgccctggctgctgagcgcccccaagctggtgcctgctgtggccaacgtgcggggcctgagcggctgcatgctgtgcagccagaggcgctacagcctgcagcctgtgcctgagcggcgcatccccaaccgctacctgggccagcccagccccttcacccacccccacctgctgcggcctggagaggtgaccccaggcctgagccaggtggagtatgccctgcggcggcacaagctgatgagcctcatccagaaggaggcccagggccagagcggcacagaccagacagtggtggtgctgagcaaccccacctactacatgagcaatgacatcccctacaccttccaccaggacaacaacttcctgtacctgtgtggcttccaggagccagacagcatcctggtgctgcagagcctgcccgggaagcagctgcccagccacaaggccatcctgtttgtgccccggcgggaccccagccgggagctgtgggatggccccaggagcggcacagatggagccatcgccctgactggagtggatgaggcctacaccctggaggagttccagcacctgctgcccaagatgaaggccgagaccaacatggtgtggtatgactggatgaggcccagccacgcccagctgcacagcgactacatgcagcccctgacagaggccaaggccaagagcaagaacaaggtgcggggcgtgcagcagctgatccagaggctgcggctcatcaagagccctgctgagattgaaagaatgcagattgctgggaagctgaccagccagaggcagggcttctctgtgctgagccggctggtgagcaacagctag

SEQ ID NO: 176231 - DNA, 867 bp, Artificial Sequence
  Description of Artificial Sequence: Synthetic coding sequence
atgccctggctgctgagcgcccccaagctggtgcctgctgtggccaacgtgcggggcctgagcggctgcatgctgtgcagccagaggcgctacagcctgcagcctgtgcctgagcggcgcatccccaaccgctacctgggccagcccagccccttcacccacccccacctgctgcggcctggagaggtgaccccaggcctgagccaggtggagtatgccctgcggcggcacaagctgatgagcctcatccagaaggaggcccagggccagagcggcacagaccagacagtggtggtgctgagcaaccccacctactacatgagcaatgacatcccctacaccttccaccaggacaacaacttcctgtacctgtgtggcttccaggagccagacagcatcctggtgctgcagagcctgcccgggaagcagctgcccagccacaaggccatcctgtttgtgccccggcgggaccccagccgggagctgtgggatggccccaggagcggcacagatggagccatcgccctgactggagtggatgaggcctacaccctggaggagttccagcacctgctgcccaagatgaaggccgagaccaacatggtgtggtatgactggatgaggcccagccacgcccagctgcacagcgactacatgcagcccctgacagaggccaaggccaagagcaagaacaaggtgcggggcgtgcagcagctgatccagaggctgcggctcatcaagagccctgctgagattgaaagaatgcagattgctgggaagctgaccagccagaagtctgtgctgctggcccggcacggcggcagccggctgtacagccaccacttcggccggccccggctgtcctag

SEQ ID NO: 176232 - DNA, 1455 bp, Artificial Sequence
  Description of Artificial Sequence: Synthetic coding sequence
atgctgtgcagccagaggcgctacagcctgcagcctgtgcctgagcggcgcatccccaaccgctacctgggccagcccagccccttcacccacccccacctgctgcggcctggagaggtgaccccaggcctgagccaggtggagtatgccctgcggcggcacaagctgatgagcctcatccagaaggaggcccagggccagagcggcacagaccagacagtggtggtgctgagcaaccccacctactacatgagcaatgacatcccctacaccttccaccaggacaacaacttcctgtacctgtgtggcttccaggagccagacagcatcctggtgctgcagagcctgcccgggaagcagctgcccagccacaaggccatcctgtttgtgccccggcgggaccccagccgggagctgtgggatggccccaggtctggaacagatggagccatcgccctgactggagtggatgaggcctacaccctggaggagttccagcacctgctgcccaagatgaaggccgagaccaacatggtgtggtatgactggatgaggcccagccacgcccagctgcacagcgactacatgcagcccctgacagaggccaaggccaagagcaagaacaaggtgcggggcgtgcagcagctgatccagaggctgcggctcatcaagagccctgctgagattgaaagaatgcagattgctgggaagctgaccagccaggccttcatcgagaccatgttcaccagcaaggcccctgtggaggaggccttcctgtatgccaagtttgaatttgagtgccgggcccggggagctgacatcctggcctacccacctgtggtggccggcggcaacagaagcaacaccctgcactacgtgaagaacaaccagctgatcaaggatggagagatggtgctgctggatggcggctgtgagagcagctgctacgtgtctgacatcaccaggacctggcctgtgaatggccgcttcaccgccccccaggccgagctgtatgaggccgtgctggagatccagagggactgcctggccctgtgcttccctggcaccagcctggagaacatctacagcatgatgctgaccctgattggccagaagctgaaggacctgggcatcatgaagaacatcaaggagaacaatgccttcaaggccgccaggaagtactgcccccaccacgtgggccactacctgggcatggatgtgcatgacaccccagacatgcccaggagcctgcccctgcagcccggcatggtgatcaccatcgagcccggcatctacatcccagaagatgacaaggatgcccctgagaagttccggggcctgggcgtgagaattgaagatgatgtggtggtgacccaggacagccccctcatcctgtctgctgactgccccaaggagatgaatgacatcgagcagatctgcagccaggccagctag

SEQ ID NO: 176233 - DNA, 2379 bp, Artificial Sequence
  Description of Artificial Sequence: Synthetic coding sequence
atggccttcagcggcatctacaagctggatgatggcaagccctacctgaacaactgcttccctgccaggaacctgctgcgggtgcctgaggagggccagggccactggctggtggtgcagaagggcaacctgaagaagaagcccaagggcctggtgggcgcccaggccgagcggcgggagagcctgaaggccaccagctttgagttcaagggcaagaaggagagccggcgggagaaccaggtggacctgcccggccacatcctggaccaggccttcctgctgaagcaccactgtgtgaggaagcccagcgacctgtgcaccatcaatgccaaggaaaatgacttcaagcacttccacagcgtcatctacatcaatgccagcgagaacctgctgcccctggaggccttccacaccttccctgccctgaaggagctggacctggccttcaacggcatcaagaccatctacgtgaagtatggagacttcaagctgctggagttcctggacctgtccttcaacagcctgactgtggaggccatctgtgacctgggcatcctgccccacctgcgggtgctgctgctgactggaaatggcctgaccagcctgccccccaacctggccgtggccgagcaggaggcctctgtgaccagcctgaccagcaagcgctacatcctgcgcttccctgccctggagaccctgatgctggatgacaaccggctgagcaaccccagctgctttgccagcctggccggcctgcggcggctgaagaagctgagcctggatgagaaccgcatcatccgcatcccctacctgcagcaggtgcagctgtatgatgagagcgtggactggaatggaggccggggcagcccccacaaggagccccagttcatgctgcagagcaagcccaggatgctggaggacagtgatgagcagctggactacacagtgctgcccatgaagaaggatgtggacagaacagaggtggtgttcagcagctacccaggcttcagcaccagcgagaccaccaagatctgcagcctgccccccatctttgagatcctgcctgtgaagagcctgaaggccaggaaccagaccctggccccacccttccctgagctgcgctacctgagcctggcctacaacaagatcgccaaggaggatgctgtgctgcctgtggccctcttccccagcctgtgtgaatttgtgttccacaacaaccccctggtggcccacacccggggcgtgccccccctgctgaagagcttcctgcaggagcggctgggcatccacctgatccggaggaagatcgtgaagcccaagcaccacgtgctgatgagcaggaaggagagctggaaggtgaagtctgagatccccaaggtgcccaagcagcccctggtgctgcaccaccccaggatgaccaccaccaagagccccagcaaggacatgctggagcctgaggccgagctggccgaggacctgcccaccaccaagagcacctctgtggagagcgagatgcccacagagaacctggagggccacagccccagctgcaggacctttgtgcccctgccccccatctgcagcaacagcacagtgcacagcgaggagaccctgagccacctgagtgacaccaccgtgcggctgagccctgagcggcccagtgatgaggacagcaagagcacagagagcatcttcctgacccaggtgtctgagctgcccagcagcgtcatccacaaggatgacctggagctgaaggagaaggaccagaagaagccacccacagccccccgggaggtgaagggcaccaggaggaagctgcccacagccttcctgcccagcaagtaccacggctatgaggagctgctgacagccaagccagaccctgccttcatcgagcccaagggcatccagaagaatgcccaggccctgcagcagatgctgaagcaccccctgctgtgccacagcagcaagcccaagctggacaccctgcagaagccctacgtgcacaaggagaagagggcccagaggatccccatccccccacccaagaagacccgggcccagctgctggatgacatcttcatccggctgcgggaccccaggaacatcacagaggcccccctgggcgctgtgctgcaccagtggacagagcggcggctggtgaaccacaagcagtacctggaggccaagaggctgctgaaggagttccaggcccgctaccggcagctggtgtctggcagcctgaggacagtgtttggcaccacccccctgcccatggcctgcccagccctgtctgagagccagcccaagtttggccacttcctggagttcatggatgagttctgccaggagcccacagccagtgacagccagggctag

SEQ ID NO: 176234 - DNA, 2337 bp, Artificial Sequence
  Description of Artificial Sequence: Synthetic coding sequence
atggccttcagcggcatctacaagctggatgatggcaagccctacctgaacaactgcttccctgccaggaacctgctgcgggtgcctgaggagggccagggccactggctggtggtgcagaagggcaacctgaagaagaagcccaagggcctggtgggcgcccaggccgagcggcgggagagcctgaaggccaccagctttgagttcaagggcaagaaggagagccggcgggagaaccaggtggacctgcccggccacatcctggaccaggccttcctgctgaagcaccactgtgtgaggaagcccagcgacctgtgcaccatcaatgccaaggaaaatgacttcaagcacttccacagcgtcatctacatcaatgccagcgagaacctgctgcccctggaggccttccacaccttccctgccctgaaggagctggacctggccttcaacggcatcaagaccatctacgtgaagtatggagacttcaagctgctggagttcctggacctgtccttcaacagcctgactgtggaggccatctgtgacctgggcatcctgccccacctgcgggtgctgctgctgactggaaatggcctgaccagcctgccccccaacctggccgtggccgagcaggaggcctctgtgaccagcctgaccagcaagcgctacatcctgcgcttccctgccctggagaccctgatgctggatgacaaccggctgagcaaccccagctgctttgccagcctggccggcctgcggcggctgaagaagctgagcctggatgagaaccgcatcatccgcatcccctacctgcagcaggtgcagctgtatgatgagagcgtggactggaatggaggccggggcagcccccacaaggagccccagttcatgctgcagagcaagcccaggatgctggaggacagtgatgagcagctggactacacagtgctgcccatgaagaaggatgtggacaggaccaccaccaagatctgcagcctgccccccatctttgagatcctgcctgtgaagagcctgaaggccaggaaccagaccctggccccacccttccctgagctgcgctacctgagcctggcctacaacaagatcgccaaggaggatgctgtgctgcctgtggccctcttccccagcctgtgtgaatttgtgttccacaacaaccccctggtggcccacacccggggcgtgccccccctgctgaagagcttcctgcaggagcggctgggcatccacctgatccggaggaagatcgtgaagcccaagcaccacgtgctgatgagcaggaaggagagctggaaggtgaagtctgagatccccaaggtgcccaagcagcccctggtgctgcaccaccccaggatgaccaccaccaagagccccagcaaggacatgctggagcctgaggccgagctggccgaggacctgcccaccaccaagagcacctctgtggagagcgagatgcccacagagaacctggagggccacagccccagctgcaggacctttgtgcccctgccccccatctgcagcaacagcacagtgcacagcgaggagaccctgagccacctgagtgacaccaccgtgcggctgagccctgagcggcccagtgatgaggacagcaagagcacagagagcatcttcctgacccaggtgtctgagctgcccagcagcgtcatccacaaggatgacctggagctgaaggagaaggaccagaagaagccacccacagccccccgggaggtgaagggcaccaggaggaagctgcccacagccttcctgcccagcaagtaccacggctatgaggagctgctgacagccaagccagaccctgccttcatcgagcccaagggcatccagaagaatgcccaggccctgcagcagatgctgaagcaccccctgctgtgccacagcagcaagcccaagctggacaccctgcagaagccctacgtgcacaaggagaagagggcccagaggatccccatccccccacccaagaagacccgggcccagctgctggatgacatcttcatccggctgcgggaccccaggaacatcacagaggcccccctgggcgctgtgctgcaccagtggacagagcggcggctggtgaaccacaagcagtacctggaggccaagaggctgctgaaggagttccaggcccgctaccggcagctggtgtctggcagcctgaggacagtgtttggcaccacccccctgcccatggcctgcccagccctgtctgagagccagcccaagtttggccacttcctggagttcatggatgagttctgccaggagcccacagccagtgacagccagggctag

SEQ ID NO: 176235 - DNA, 2211 bp, Artificial Sequence
  Description of Artificial Sequence: Synthetic coding sequence
atggccttcagcggcatctacaagctggatgatggcaagccctacctgaacaactgcttccctgccaggaacctgctgcgggtgcctgaggagggccagggccactggctggtggtgcagaagggcaacctgaagaagaagcccaagggcctggtgggcgcccaggccgagcggcgggagagcctgaaggccaccagctttgagttcaagggcaagaaggagagccggcgggagaaccaggtggacctgcccggccacatcctggaccaggccttcctgctgaagcaccactgtgtgaggaagcccagcgacctgtgcaccatcaatgccaaggaaaatgacttcaagcacttccacagcgtcatctacatcaatgccagcgagaacctgctgcccctggaggccttccacaccttccctgccctgaaggagctggacctggccttcaacggcatcaagaccatctacgtgaagtatggagacttcaagctgctggagttcctggacctgtccttcaacagcctgactgtggaggccatctgtgacctgggcatcctgccccacctgcgggtgctgctgctgactggaaatggcctgaccagcctgccccccaacctggccgtggccgagcaggaggcctctgtgaccagcctgaccagcaagcgctacatcctgcgcttccctgccctggagaccctgatgctggatgacaaccggctgagcaaccccagctgctttgccagcctggccggcctgcggcggctgaagaagctgagcctggatgagaaccgcatcatccgcatcccctacctgcagcaggtgcagctgtatgatgagagcgtggactggaatggaggccggggcagcccccacaaggagccccagttcatgctgcagagcaagcccaggatgctggaggacagtgatgagcagctggactacacagtgctgcccatgaagaaggatgtggacaggaccatcgccaaggaggatgctgtgctgcctgtggccctcttccccagcctgtgtgaatttgtgttccacaacaaccccctggtggcccacacccggggcgtgccccccctgctgaagagcttcctgcaggagcggctgggcatccacctgatccggaggaagatcgtgaagcccaagcaccacgtgctgatgagcaggaaggagagctggaaggtgaagtctgagatccccaaggtgcccaagcagcccctggtgctgcaccaccccaggatgaccaccaccaagagccccagcaaggacatgctggagcctgaggccgagctggccgaggacctgcccaccaccaagagcacctctgtggagagcgagatgcccacagagaacctggagggccacagccccagctgcaggacctttgtgcccctgccccccatctgcagcaacagcacagtgcacagcgaggagaccctgagccacctgagtgacaccaccgtgcggctgagccctgagcggcccagtgatgaggacagcaagagcacagagagcatcttcctgacccaggtgtctgagctgcccagcagcgtcatccacaaggatgacctggagctgaaggagaaggaccagaagaagccacccacagccccccgggaggtgaagggcaccaggaggaagctgcccacagccttcctgcccagcaagtaccacggctatgaggagctgctgacagccaagccagaccctgccttcatcgagcccaagggcatccagaagaatgcccaggccctgcagcagatgctgaagcaccccctgctgtgccacagcagcaagcccaagctggacaccctgcagaagccctacgtgcacaaggagaagagggcccagaggatccccatccccccacccaagaagacccgggcccagctgctggatgacatcttcatccggctgcgggaccccaggaacatcacagaggcccccctgggcgctgtgctgcaccagtggacagagcggcggctggtgaaccacaagcagtacctggaggccaagaggctgctgaaggagttccaggcccgctaccggcagctggtgtctggcagcctgaggacagtgtttggcaccacccccctgcccatggcctgcccagccctgtctgagagccagcccaagtttggccacttcctggagttcatggatgagttctgccaggagcccacagccagtgacagccagggctag

SEQ ID NO: 176236 - DNA, 891 bp, Artificial Sequence
  Description of Artificial Sequence: Synthetic coding sequence
atggccttcagcggcatctacaagctggatgatggcaagccctacctgaacaactgcttccctgccaggaacctgctgcgggtgcctgaggagggccagggccactggctggtggtgcagaagggcaacctgaagaagaagcccaagggcctggtgggcgcccaggccgagcggcgggagagcctgaaggccaccagctttgagttcaagggcaagaaggagagccggcgggagaaccaggtggacctgcccggccacatcctggaccaggccttcctgctgaagcaccactgtgtgaggaagcccagcgacctgtgcaccatcaacgtgtctggcctgaagttcagcaaggccaaggaaaatgacttcaagcacttccacagcgtcatctacatcaatgccagcgagaacctgctgcccctggaggccttccacaccttccctgccctgaaggagctggacctggccttcaacggcatcaagaccatctacgtgaagtatggagacttcaagctgctggagttcctggacctgtccttcaacagcctgactgtggaggccatctgtgacctgggcatcctgccccacctgcgggtgctgctgctgactggaaatggcctgaccagcctgccccccaacctggccgtggccgagcaggaggcctctgtgaccagcctgaccagcaagcgctacatcctgcgcttccctgccctggagaccctgatgctggatgacaaccggctgagcaaccccagctgctttgccagcctggccggcctgcggcggctgaagaagctgagcctggatgagaaccgcatcatccgcatcccctacctgcagcaggtgcagctgtatgatgagagcgtggactggaatggaggccggggctag

SEQ ID NO: 176237 - DNA, 1797 bp, Artificial Sequence
  Description of Artificial Sequence: Synthetic coding sequence
atggccttcagcggcatctacaagctggatgatggcaagccctacctgaacaactgcttccctgccaggaacctgctgcgggtgcctgaggagggccagggccactggctggtggtgcagaagggcaacctgaagaagaagcccaagggcctggtgggcgcccaggccgagcggcgggagagcctgaaggccaccagctttgagttcaagggcaagaaggagagccggcgggagaaccaggtggacctgcccggccacatcctggaccaggccttcctgctgaagcaccactgtgtgaggaagcccagcgacctgtgcaccatcaatgccaaggaaaatgacttcaagcacttccacagcgtcatctacatcaatgccagcgagaacctgctgcccctggaggccttccacaccttccctgccctgaaggagctggacctggccttcaacggcatcaagaccatctacgtgaagtatggagacttcaagctgctggagttcctggacctgtccttcaacagcctgactgtggaggccatctgtgacctgggcatcctgccccacctgcgggtgctgctgctgactggaaatggcctgaccagcctgccccccaacctggccgtggccgagcaggaggcctctgtgaccagcctgaccagcaagcgctacatcctgcgcttccctgccctggagaccctgatgctggatgacaaccggctgagcaaccccagctgctttgccagcctggccggcctgcggcggctgaagaagctgagcctggatgagaaccgcatcatccgcatcccctacctgcagcaggtgcagctgtatgatgagagcgtggactggaatggaggccggggcagcccccacaaggagccccagttcatgctgcagagcaagcccaggatgctggaggacagtgatgagcagctggactacacagtgctgcccatgaagaaggatgtggacagaactggagtgccccccctgctgaagagcttcctgcaggagcggctgggcatccacctgatccggaggaagatcgtgaagcccaagcaccacgtgctgatgagcaggaaggagagctggaaggtgaagtctgagatccccaaggtgcccaagcagcccctggtgctgcaccaccccaggatgaccaccaccaagagccccagcaaggacatgctggagcctgaggccgagctggccgaggacctgcccaccaccaagagcacctctgtggagagcgagatgcccacagagaacctggagggccacagccccagctgcaggacctttgtgcccctgccccccatctgcagcaacagcacagtgcacagcgaggagaccctgagccacctgagtgacaccaccgtgcggctgagccctgagcggcccagtgatgaggacagcaagagcacagagagcatcttcctgacccaggtgtctgagctgcccagcagcgtcatccacaaggatgacctggagctgaaggagaaggaccagaagaagcccccaacagccccccgggaggtgaagggcaccaggaggaagctgcccacagccttcctgcccagcaagtaccacggctatgaggagctgctgacagccaagccagaccctgccttcatcgagcccaagggcatccagaagaatgcccaggccctgcagcagatgctgaagcaccccctgctgtgccacagcagcaagcccaagctggacaccctgcagaagccctacgtgcacaaggagaagagggtgctgagctgcaccagcggccagaatggaggctggtag

SEQ ID NO: 176238 - DNA, 1554 bp, Artificial Sequence
  Description of Artificial Sequence: Synthetic coding sequence
atgctggatgacaaccggctgagcaaccccagctgctttgccagcctggccggcctgcggcggctgaagaagctgagcctggatgaaaatcgcatcatccgcatcccctacctgcagcaggtgcagctgtatgatgaatctgtggactggaatggaggccggggcagcccccacaaggagccccagttcatgctgcagagcaagcccaggatgctggaggacagtgatgagcagctggactacacagtgctgcccatgaagaaggatgtggacagaacagaggtggtgttcagcagctacccaggcttcagcaccagcgagatcgccaaggaggatgctgtgctgcctgtggccctcttccccagcctgtgtgaatttgtgttccacaacaaccccctggtggcccacacccggggcgtgccccccctgctgaagagcttcctgcaggagcggctgggcatccacctgatccggaggaagatcgtgaagcccaagcaccacgtgctgatgagcaggaaggagagctggaaggtgaagtctgagatccccaaggtgcccaagcagcccctggtgctgcaccaccccaggatgaccaccaccaagagccccagcaaggacatgctggagcctgaggccgagctggccgaggacctgcccaccaccaagagcacctctgtggagagcgagatgcccacagagaacctggagggccacagccccagctgcaggacctttgtgcccctgccccccatctgcagcaacagcacagtgcacagcgaggagaccctgagccacctgagtgacaccaccgtgcggctgagccctgagcggcccagtgatgaggacagcaagagcacagagagcatcttcctgacccaggtgtctgagctgcccagcagcgtcatccacaaggatgacctggagctgaaggagaaggaccagaagaagcccccaacagccccccgggaggtgaagggcaccaggaggaagctgcccacagccttcctgcccagcaagtaccacggctatgaggagctgctgacagccaagccagaccctgccttcatcgagcccaagggcatccagaagaatgcccaggccctgcagcagatgctgaagcaccccctgctgtgccacagcagcaagcccaagctggacaccctgcagaagccctacgtgcacaaggagaagagggcccagaggatccccatccccccacccaagaagacccgggcccagctgctggatgacatcttcatccggctgcgggaccccaggaacatcacagaggcccccctgggcgctgtgctgcaccagtggacagaaagaaggctggtgaaccacaagcagtacctggaggccaagaggctgctgaaggagttccaggcccgctaccggcagctggtgtctggcagcctgaggacagtgtttggcaccacccccctgcccatggcctgcccagccctgtctgagagccagcccaagtttggccacttcctggagttcatggatgagttctgccaggagcccacagccagtgacagccagggctag

SEQ ID NO: 176239 - DNA, 984 bp, Artificial Sequence
  Description of Artificial Sequence: Synthetic coding sequence
atgttccccagcaggaggaaggccgcccagctgccctgggaggatggccgcagcggcctgctgagcggcggcctgcccaggaagtgcagcgtcttccacctgtttgtggcctgcctgagcctgggcttcttcagcctgctgtggctgcagctgagctgcagcggagatgtggcccgggctgtgcggggccagggccaggagaccagcggccccccccgggcctgccccccagagcccccacctgagcactgggaggaggatgcctcctggggcccccaccggctggccgtgctggtgcccttccgggagagatttgaggagctgctggtgtttgtgccccacatgaggcgcttcctgagcaggaagaagatccgccaccacatctacgtgctgaaccaggtggaccacttccgcttcaacagagctgccctgatcaacgtgggcttcctggagagcagcaacagcacagactacatcgccatgcatgatgtggacctgctgcccctgaatgaggagctggactatggcttccctgaggccggccccttccacgtggccagccctgagctgcaccccctgtaccactacaagacctacgtgggcggcatcctgctgctgagcaagcagcactaccgcctgtgcaatggcatgagcaaccgcttctggggctggggcagagaagatgatgagttctaccgccgcatcaagggggccggcctgcagctgttccggcccagcggcatcaccaccggctacaagaccttccgccacctgcatgaccctgcctggaggaagagggaccagaagagaattgctgcccagaagcaggagcagttcaaggtggaccgggagggcggcctgaacacagtgaagtaccacgtggccagcaggacagccctgtctgtgggcggggccccctgcaccgtgctgaacatcatgctggactgtgacaagacagccaccccctggtgcaccttctcctag

SEQ ID NO: 176240 - DNA, 642 bp, Artificial Sequence
  Description of Artificial Sequence: Synthetic coding sequence
atgaggcgcttcctgagcaggaagaagatccgccaccacatctacgtgctgaaccaggtggaccacttccgcttcaacagagctgccctgatcaacgtgggcttcctggagagcagcaacagcacagactacatcgccatgcatgatgtggacctgctgcccctgaatgaggagctggactatggcttccctgaggccggccccttccacgtggccagccctgagctgcaccccctgtaccactacaagacctacgtgggcggcatcctgctgctgagcaagcagcactaccgcctgtgcaatggcatgagcaaccgcttctggggctggggcagagaagatgatgagttctaccgccgcatcaagggggccggcctgcagctgttccggcccagcggcatcaccaccggctacaagaccttccgccacctgcatgaccctgcctggaggaagagggaccagaagagaattgctgcccagaagcaggagcagttcaaggtggaccgggagggcggcctgaacacagtgaagtaccacgtggccagcaggacagccctgtctgtgggcggggccccctgcaccgtgctgaacatcatgctggactgtgacaagacagccaccccctggtgcaccttctcctag

SEQ ID NO: 176241 - DNA, 2880 bp, Artificial Sequence
  Description of Artificial Sequence: Synthetic coding sequence
atggtggccgccccctgtgcccggcggctggcccggcgcagccacagcgccctgctggccgccctgactgtgctgctgctgcagaccctggtggtgtggaacttcagcagcctggacagcggggccggggagaggagaggaggagctgctgtgggcggcggggagcagcccccaccagccccagccccccggcgggagcggcgggacctgcctgctgagcctgctgctgcccggggcggcggcggcggcggcggcggcggcggcggcggccggggcccccaggcccgggcccggggcggcggccctggagagccccggggccagcagcctgccagcagaggagccctgcctgcccgggccctggacccccaccccagccccctcatcaccctggagacccaggacggctacttcagccaccggcccaaggagaaggtgaggacagacagcaacaatgaaaattctgtgcccaaggactttgaaaatgtggacaacagcaactttgcccccaggacccagaagcagaagcaccagcctgagctggccaagaagccacccagccggcagaaggagctgctgaagaggaagctggagcagcaggagaagggcaagggccacaccttccctggaaaaggacctggagaggtgctgcccccaggggacagagctgctgccaacagcagccacggcaaggatgtgtcccggcccccccacgccaggaagacaggaggcagcagccctgagaccaagtatgaccagccccccaagtgtgacatcagcggcaaggaggccatcagcgccctgagccgggccaagagcaagcactgccggcaggagatcggggagacctactgccgccacaagctgggcctgctgatgcctgagaaggtgacccgcttctgccccctggagggcaaggccaacaagaatgtgcagtgggatgaagattctgtggagtacatgcctgccaaccctgtgcgcatcgcctttgtgctggtggtgcacggccgggccagccggcagctgcagaggatgttcaaggccatctaccacaaggaccacttctactacatccacgtggacaagaggagcaactacctgcaccggcaggtgctgcaggtgtcccggcagtacagcaatgtgcgggtgaccccctggaggatggccaccatctggggcggggccagcctgctgagcacctacctgcagagcatgagggacctgctggagatgacagactggccctgggacttcttcatcaacctgtctgctgctgactaccccatccgcaccaatgaccagctggtggccttcctgagccgctacagagacatgaacttcctgaagagccacggccgggacaatgcccgcttcatcaggaagcagggcctggacaggctcttcctggagtgtgatgcccacatgtggaggctgggggaccggcgcatccctgagggcattgctgtggatggcggcagtgactggttcctgctgaacagaagatttgtggagtatgtgaccttcagcacagatgacctggtgaccaagatgaagcagttctacagctacaccctgctgcctgctgagagcttcttccacacagtgctggagaacagcccccactgtgacaccatggtggacaacaacctgcgcatcaccaactggaacaggaagctgggctgcaagtgccagtacaagcacatcgtggactggtgtggctgcagccccaatgacttcaagccccaggacttccaccgcttccagcagacagcccggcccaccttctttgccaggaagtttgaggccgtggtgaaccaggagatcatcggccagctggactactacctgtatggcaactacccagctggcaccccaggcctgcggagctactgggagaatgtgtatgatgagccagatggcatccacagcctgagtgatgtgaccctgaccctgtaccacagctttgcccggctgggcctgcggcgggcagagaccagcctgcacacagatggagagaacagctgccgctactaccccatgggccacccagcctctgtgcacctgtacttcctggccgaccgcttccagggcttcctgatcaagcaccacgccaccaacctggccgtgtccaagctggagaccctggagacctgggtgatgcccaagaaggtgttcaagatcgccagcccccccagcgactttggccgcctgcagttcagcgaggtgggcacagactgggatgccaaggagcggctcttcaggaactttggaggcctgctgggccccatggatgagcctgtgggcatgcagaagtggggcaagggccccaacgtgacagtgaccgtcatctgggtggaccctgtgaatgtgattgctgccacctatgacatcctgattgagagcacagctgagttcacccactacaagccacccctgaacctgcccctgcggcctggggtgtggacagtgaagatcctgcaccactgggtgcctgtggccgagaccaagttcctggtggcccccctgaccttcagcaaccggcagcccatcaagccagaggaggccctgaagctgcacaacggccccctgagaaatgcctacatggagcagagcttccagagcctgaaccctgtgctgagcctgcccatcaacccagcccaggtggagcaggccaggagaaatgctgccagcactggaacagccctggagggctggctggacagcctggtgggcggcatgtggacagccatggacatctgtgccaccggccccacagcctgccctgtgatgcagacctgcagccagacagcctggagcagcttctccccagaccccaagtctgagctgggcgctgtgaagccagatggccgcctgaggtag

SEQ ID NO: 176242 - DNA, 2598 bp, Artificial Sequence
  Description of Artificial Sequence: Synthetic coding sequence
atggtggccagcgcccgggtgcagaagctggtgcggcgctacaagctggccatcgccacagccctggccatcctgctgctgcagggcctggtggtgtggagcttcagcggcctggaggaggatgaagctggggagaagggccggcagaggaagccccggcccctggaccctggagagggcagcaaggacacagacagcagcgctggccggcggggcagcacaggccgccgccacggccgctggaggggccgggcagagagccctggggtgcctgtggccaaggtggtgcgggctgtgaccagccggcagagggccagcagaagagtgcccccagcccctcctcctgaggcccctggccggcagaacctgagcggggctgctgctggggaggccctggtgggcgccgccggcttcccccctcatggagacaccggctctgtggagggcgccccccagcccacagacaatggcttcacccccaagtgtgagatcgtgggcaaggatgccctgagcgccctggcccgggccagcaccaagcagtgccagcaggagatcgccaacgtggtgtgcctgcaccaggccggcagcctgatgcccaaggctgtgcccaggcactgccagctgaccgggaagatgagccctggcatccagtgggatgagagccaggcccagcagcccatggatggcccccctgtgcgcatcgcctacatgctggtggtgcacggccgggccatccggcagctgaagaggctgctgaaggctgtgtaccacgagcagcacttcttctacatccacgtggacaagagaagtgactacctgcaccgggaggtggtggagctggcccagggctatgacaacgtgcgggtgaccccctggaggatggtgaccatctggggcggggccagcctgctgaggatgtacctgcgctccatgagggacctgctggaggtgcccggctgggcctgggacttcttcatcaacctgagcgccacagactaccccaccaggaccaatgaggagctggtggccttcctgagcaagaacagagacaagaacttcctgaagagccacggccgggacaacagccgcttcatcaagaagcagggcctggacaggctcttccatgaatgtgacagccacatgtggaggctgggggagcggcagatcccagctggcatcgtggtggatggcggcagtgactggtttgtgctgaccaggagctttgtggagtatgtggtgtacacagatgaccccctggtggcccagctgcggcagttctacacctacaccctgctgcctgctgagagcttcttccacacagtgctggagaacagcctggcctgtgagaccctggtggacaacaacctgcgggtgaccaactggaacaggaagctgggctgcaagtgccagtacaagcacatcgtggactggtgtggctgcagccccaatgacttcaagccccaggacttcctgcggctgcagcaggtgtcccggcccaccttctttgccaggaagtttgagagcacagtgaaccaggaggtgctggagatcctggacttccacctgtatggcagctacccacctggcaccccagccctgaaggcctactgggagaacacctatgatgctgctgatggccccagcggcctgagtgatgtgatgctgacagcctacacagcctttgcccggctgagcctgcaccacgccgccacagctgccccacccatgggcacccccctgtgccgctttgagccccggggcctgcccagctctgtgcacctgtacttctatgatgaccacttccagggctacctggtgacccaggccgtgcagcccagcgcccagggccctgctgagaccctggagatgtggctgatgccccagggcagcctgaagctgctgggccgcagtgaccaggccagccggctgcagagcctggaggtgggcacagactgggaccccaaggagcggctcttcaggaactttggaggcctgctgggccccctggatgagcctgtggccgtgcagcgctgggcccggggccccaacctgacagccaccgtggtgtggattgaccccacctacgtggtggccaccagctatgacatcaccgtggacacagaaacagaggtgacccagtacaagccacccctgagccggcccctgcggcccggcccctggacagtgcggctgctgcagttctgggagcccctgggggagacccgcttcctggtgctgcccctgaccttcaacaggaagctgcccctgaggaaggatgatgcctcctggctgcacgccggccccccccacaatgagtacatggagcagagcttccagggcctgagcagcatcctgaacctgccccagcctgagctggccgaggaggccgcccagaggcacacccagctgaccggccctgccctggaggcctggacagaccgggagctgagcagcttctggagcgtggccggcctgtgtgccatcggccccagcccctgccccagcctggagccctgccgcctgacctcctggagcagcctgagcccagaccccaagtctgagctgggccctgtgaaggcagatggccgcctgaggtag

SEQ ID NO: 176243 - DNA, 2031 bp, Artificial Sequence
  Description of Artificial Sequence: Synthetic coding sequence
atggtggccagcgcccgggtgcagaagctggtgcggcgctacaagctggccatcgccacagccctggccatcctgctgctgcagggcctggtggtgtggagcttcagcggcctggaggaggatgaagctggggagaagggccggcagaggaagccccggcccctggaccctggagagggcagcaaggacacagacagcagcgctggccggcggggcagcacaggccgccgccacggccgctggaggggccgggcagagagccctggggtgcctgtggccaaggtggtgcgggctgtgaccagccggcagagggccagcagaagagtgcccccagcccctcctcctgaggcccctggccggcagaacctgagcggggctgctgctggggaggccctggtgggcgccgccggcttcccccctcatggagacaccggctctgtggagggcgccccccagcccacagacaatggcttcacccccaagtgtgagatcgtgggcaaggatgccctgagcgccctggcccgggccagcaccaagcagtgccagcaggagatcgccaacgtggtgtgcctgcaccaggccggcagcctgatgcccaaggctgtgcccaggcactgccagctgaccgggaagatgagccctggcatccagtgggatgagagccaggcccagcagcccatggatggcccccctgtgcgcatcgcctacatgctggtggtgcacggccgggccatccggcagctgaagaggctgctgaaggctgtgtaccacgagcagcacttcttctacatccacgtggacaagagaagtgactacctgcaccgggaggtggtggagctggcccagggctatgacaacgtgcgggtgaccccctggaggatggtgaccatctggggcggggccagcctgctgaggatgtacctgcgctccatgagggacctgctggaggtgcccggctgggcctgggacttcttcatcaacctgagcgccacagactaccccaccaggaccaatgaggagctggtggccttcctgagcaagaacagagacaagaacttcctgaagagccacggccgggacaacagccgcttcatcaagaagcagggcctggacaggctcttccatgaatgtgacagccacatgtggaggctgggggagcggcagatcccagctggcatcgtggtggatggcggcagtgactggtttgtgctgaccaggagctttgtggagtatgtggtgtacacagatgaccccctggtggcccagctgcggcagttctacacctacaccctgctgcctgctgagagcttcttccacacagtgctggagaacagcctggcctgtgagaccctggtggacaacaacctgcgggtgaccaactggaacaggaagctgggctgcaagtgccagtacaagcacatcgtggactggtgtggctgcagccccaatgacttcaagccccaggacttcctgcggctgcagcaggtgtcccggcccaccttctttgccaggaagtttgagagcacagtgaaccaggaggtgctggagatcctggacttccacctgtatggcagctacccacctggcaccccagccctgaaggcctactgggagaacacctatgatgctgctgatggccccagcggcctgagtgatgtgatgctgacagcctacacagcctttgcccggctgagcctgcaccacgccgccacagctgccccacccatgggcacccccctgtgccgctttgagccccggggcctgcccagctctgtgcacctgtacttctatgatgaccacttccagggctacctggtgacccaggccgtgcagcccagcgcccagggccctgctgagaccctggagatgtggctgatgccccagggcagcctgaagctgctgggccgcagtgaccaggccagccggctgcagagcctggagaacagaggcctgtccatgctgccccggctggtgagcaacagctggccccaggccgtgctgcccctgcagccccccaaggccctgggctag

SEQ ID NO: 176244 - DNA, 1503 bp, Artificial Sequence
  Description of Artificial Sequence: Synthetic coding sequence
atgatcatcagccacttccccaagtgtgtggccgtgtttgccctgctggccctgtctgtgggcgccctggacaccttcatcgctgctgtgtatgaacatgctgtgatcctgcccaacagaacagagacccctgtgtccaaggaggaggccctgctgctgatgaacaagaacattgatgtgctggagaaggctgtgaagctggccgccaagcagggcgcccacatcatcgtgaccccagaagatggcatctacggctggatcttcacccgggagagcatctacccctacctggaggacatcccagaccccggggtgaactggatcccctgccgggacccctggaggtttggaaacacccctgtgcagcagaggctgagctgcctggccaaggacaacagcatctacgtggtggccaacatcggggacaagaagccctgcaatgccagtgacagccagtgccccccagatggccgctaccagtacaacacagatgtggtgtttgacagccagggcaagctgctggcccgctaccacaagtacaacctgtttgcccctgagatccagtttgacttccccaaggacagcgagctggtgacctttgacaccccatttgggaagtttggcatcttcacctgctttgacatcttcagccatgaccctgctgtggtggtggtggatgagagcattgacagcatcctgtaccccacagcctggtacaacaccctgcccctgctgtctgctgtgcccttccacagcgcctgggccaaggccatgggcgtgaacctgctggccgccaacacccacaacacctccatgcacatgactggaagtggcatctatgcccctgaggccgtgaaggtgtaccactatgacatggagacagagagcggccagctgctgctgtctgagctgaagagccggccccggcgggagcccacctacccagctgctgtggactggcacgcctatgccagctctgtgaagcccttcagcagcgagcagagcgacttcctgggcatgatctactttgatgagttcaccttcaccaagctgaagagaaatactggaaactacacagcctgccagaaggacctgtgctgccacctgacctacaagatgtctgagaagaggacagatgagatctatgccctgggcgcctttgatggcctgcacacagtggagggccagtactacctgcagatctgtgccctgctgaagtgccagaccacagacctggagacctgtggggagcctgtgggcagcgccttcaccaagtttgaggacttcagcctgagcggcaccttcggcaccaggtatgtgttcccccagatcatcctgagcggcagccagctggcccctgagcggcactatgagatcagcagagatggccgcctgcggagccgcagcggggcccccctgcctgtgctggtgatggccctgtatggccgggtgtttgagaaggaccccccccggctgggccagggcagcggcaagttccagtag

SEQ ID NO: 176245 - DNA, 1200 bp, Artificial Sequence
  Description of Artificial Sequence: Synthetic coding sequence
atggacagcagcaccacagcccagtgccggcagctggaggccgctgtgggcggggcccaggccctgagctgcctgaccggcagccgggcctatgagcgcttcaccggcaaccagatcgccaagatctaccagcagaaccctgaggcctacagccacacagagcgcatcagcctggtgtcctcctttgctgccagcctcttcctgggcagctacagccccatcgactacagtgatggcagcggcatgaacctgctgcagatccaggacaaggtgtggagccaggcctgcctgggcgcctgtgccccccacctggaggagaagctgagcccccctgtgcccagctgcagcgtggtgggcgccatcagcagctactacgtgcagagatatggcttccccccaggctgcaaggtggtggccttcaccggggacaacccagccagcctggccggcatgaggctggaggagggggacattgctgtgtccctgggcaccagtgacaccctcttcctgtggctgcaggagcccatgcctgccctggagggccacatcttctgcaaccctgtggacagccagcactacatggccctgctgtgcttcaagaatggcagcctgatgagggagaagatcagaaatgaatctgtgagccgctcctggagcgacttcagcaaggccctgcagagcacagagatgggaaatggaggcaacctgggcttctactttgatgtgatggagatcaccccagagatcatcggccgccaccgcttcaacacagagaaccacaaggtggccgccttccctggagatgtggaggtgcgggccctgattgagggccagttcatggccaagagaattcatgctgagggcctgggctacagagtgatgagcaagaccaagatcctggccaccggcggggccagccacaaccgggagatcctgcaggtgctggctgatgtgtttgatgcccctgtgtatgtgattgacacagccaacagcgcctgtgtgggcagcgcctaccgggccttccacggcctggccggcggcacagatgtgcccttcagcgaggtggtgaagctggcccccaacccccggctggccgccacccccagccctggggccagccaggtgtatgaggccctgctgccccagtatgccaagctggagcagaggatcctgagccagacccggggccccccagagtag

SEQ ID NO: 176246 - DNA, 4269 bp, Artificial Sequence
  Description of Artificial Sequence: Synthetic coding sequence
atgagcggcatcaagaggaccatcaaggagacagatcctgactatgaagatgtgtctgtggccctgcccaacaagaggcacaaggccattgaaaattctgccagagatgctgctgtgcagaagattgagaccatcatcaaggagcagtttgccctggagatgaagaacaaggagcatgaaattgaagtcatcgaccagaggctgattgaggcccggaggatgatggacaagctgcgggcctgcatcgtggccaactactatgccagcgctggcctgctgaaggtgtctgagggcagcaagacctgtgacaccatggtgttcaaccacccagccatcaagaagttcctggagagccccagccgcagcagcagccctgccaaccagagagctgagacccccagcgccaaccacagcgagagtgacagcctgagccagcacaatgacttcctgagtgacaaggacaacaacagcaacatggacatcgaggagcggctgagcaacaacatggagcagaggcccagcaggaacacaggccgggacaccagccgcatcaccggcagccacaagacagagcagagaaatgctgacctgacagatgagaccagccggctgtttgtgaagaagaccatcgtggtgggcaatgtgtccaagtacatccccccagacaagcgggaggagaatgaccagagcacccacaagtggatggtgtatgtgcggggcagccggcgggagcccagcatcaaccactttgtgaagaaggtgtggttcttcctgcaccccagctacaagcccaatgacctggtggaggtgcgggagccccccttccacctgacccggcggggctggggcgagttccctgtgcgggtgcaggtgcacttcaaggacagccagaacaagagaattgacatcatccacaacctgaagctggacaggacctacacaggcctgcagaccctgggcgctgagaccgtggtggatgtggagctgcaccgccacagcctgggggaggactgcatctacccccagagcagcgagagtgacatcagtgatgccccacccagcctgcccctgaccatcccagcccctgtgaaggccagcagccccatcaagcagagccatgagcctgtgcctgacacctctgtggagaagggcttccctgccagcacagaagctgagcggcacacccccttctacgccctgcccagcagcctggagaggacccccaccaagatgaccaccagccagaaggtgaccttctgcagccacggcaacagcgccttccagcccatcgccagcagctgcaagatcgtgccccagagccaggtgcccaaccctgagagccctgggaagagcttccagcccatcaccatgagctgcaagatcgtgtctggcagccccatcagcacccccagccccagccccctgcccaggacccccaccagcacccctgtgcacgtgaagcagggcacagctggcagcgtcatcaacaacccctacgtgatcatggacaagcagcccggccaggtgattggagccaccacccccagcacaggcagccccaccaacaagatcagcacagccagccaggtgtcccagggcaccggcagccctgtgcccaagatccacggcagcagctttgtgaccagcacagtgaagcaggaggacagcctgtttgcctccatgccacccctgtgccccatcggcagccaccccaaggtgcagagccccaagcccatcaccggcggcctgggcgccttcaccaaggtgatcatcaagcaggagcctggagaggccccccacgtgcctgccaccggggccgccagccagagccccctgccccagtatgtgacagtgaagggcggccacatgattgctgtgagcccccagaagcaggtgatcaccccaggagagggcatcgcccagagcgccaaggtgcagcccagcaaggtggtgggcgtgcctgtgggcagcgccctgcccagcacagtgaagcaggccgtggccatcagcggcggccagatcctggtggccaaggccagcagctctgtgtccaaggctgtgggccccaagcaggtggtgacccagggcgtggccaaggccatcgtgtctgggggcggcggcaccatcgtggcccagcctgtgcagaccctgaccaaggcccaggtgacagctgctggcccccagaagagcggcagccagggctctgtgatggccaccctgcagctgcctgccaccaacctggccaacctggccaacctgcccccaggcaccaagctgtacctgaccaccaacagcaagaaccccagcggcaagggcaagctgctgctgatcccccagggcgccatcctgcgggccaccaacaatgccaacctgcagagcggcagcgctgccagcggcggcagcggggccggcggcggcggcggcggcggcggcggcggcggcagcggcagcggcggcggcggcagcactggaggcggcggcggcacagctgggggcggcacccagagcacagctggccctgggggcatcagccagcacctgacctacaccagctacatcctgaagcagaccccccagggcaccttcctggtgggccagcccagcccccagaccagcggcaagcagctgaccaccggctctgtggtgcagggcaccctgggcgtgtccaccagcagcgcccagggccagcagaccctgaaggtgatcagcggccagaagaccaccctcttcacccaggccgcccatggaggccaggccagcctgatgaagatcagtgacagcaccctgaagacagtgcctgccaccagccagctgagcaagccaggcaccaccatgctgcgggtggccggcggcgtcatcaccacagccaccagccctgctgtggccctgagcgccaacggccctgcccagcagagcgagggcatggcccctgtgagcagcagcacagtgtcctctgtgaccaagaccagcggccagcagcaggtgtgtgtgtcccaggccaccgtgggcacctgcaaggccgccacccccaccgtggtgtctgccaccagcctggtgcccacccccaaccccatcagcggcaaggccaccgtgtctggcctgctgaagatccacagcagccagagcagcccccagcaggccgtgctgaccatccccagccagctgaagcccctgtctgtgaacaccagcggaggagtgcagaccatcctgatgcctgtgaacaaggtggtgcagagcttcagcaccagcaagcccccagccatcctgcctgtggccgcccccacccctgtggtgcccagcagcgccccagctgctgtggccaaggtgaagacagagcctgagaccccaggccccagctgcctgagccaggagggccagacagctgtgaagacagaggagagcagcgagctgggcaactacgtgatcaagattgaccacctggagaccatccagcagctgctgacagctgtggtgaagaagatccccctcatcacagccaagtcagaagatgccagctgcttcagcgccaagtctgtggagcagtactacggctggaacatcggcaagagaagagctgctgagtggcagagggccatgaccatgaggaaggtgctgcaggagatcctggagaagaacccccgcttccaccacctgacccccctgaagaccaagcacatcgcccactggtgccgctgccacggctacaccccaccagaccctgagagcctgagaaatgatggagacagcattgaagatgtgctgacccagattgattctgagcctgagtgccccagcagcttcagcagcgctgacaacctgtgcaggaagctggaggacctgcagcagttccagaagcgggagccagaaaatgaggaggaggtggacatcctgagcctgtctgagcctgtgaagatcaacatcaagaaggagcaggaggagaagcaggaggaggtgaagttctacctgccccccaccccaggcagcgagttcatcggagatgtgacccagaagattggcatcaccctgcagcctgtggccctgcacagaaatgtgtatgcctctgtggtggaggacatgatcctgaaggccacagagcagctggtgaatgacatcctgcggcaggccctggccgtgggctaccagacagccagccacaaccgcatccccaaggagatcaccgtgagcaacatccaccaggccatctgcaacatccccttcctggacttcctgaccaacaagcacatgggcatcctgaatgaagaccagtag

SEQ ID NO: 176247 - DNA, 4269 bp, Artificial Sequence; identical to SEQ ID NO: 176246
  Description of Artificial Sequence: Synthetic coding sequence

SEQ ID NO: 176248 - DNA, 684 bp, Artificial Sequence
  Description of Artificial Sequence: Synthetic coding sequence
atgttcaagaggatggccgagtttggaccagacagcggcggccgggtgaagggcgtgaccatcgtgaagcccatcgtgtatggaaatgtggcccgctactttgggaagaagcgggaggaggatggccacacccaccagtggacagtgtatgtgaagccctacagaaatgaagacatgtctgcctacgtgaagaagatccagttcaagctgcacgagagctatggcaaccccctgcgggtggtgaccaagccaccctatgagatcacagaaacaggctggggcgagtttgagatcatcatcaagatcttcttcatcgaccccaatgaaagacctgtgaccctgtaccacctgctgaagctgttccagagcgacaccaatgccatgctgggcaagaagacagtggtgtctgagttctatgatgagatgatcttccaggaccccacagccatgatgcagcagctgctgaccaccagccggcagctgaccctgggcgcctacaagcatgaaacagaatttgctgagctggaggtgaagacccgggagaagctggaggccgccaagaagaagaccagctttgaaattgctgagctgaaggagcggctgaaggccagccgggagaccatcaactgcctgaagaatgagatcaggaagctggaggaggatgaccaggccaaggacatctag

SEQ ID NO: 176249 - DNA, 1053 bp, Artificial Sequence
  Description of Artificial Sequence: Synthetic coding sequence
atggccaccacagctgccccagctgggggcgccagaaatggagctggccctgagtggggcggctttgaggagaacatccagggcggcggcagcgctgtgattgacatggagaacatggatgacaccagcggcagcagctttgaggacatgggagagctgcaccagaggctgcgggaggaggaggtggatgctgatgctgctgatgctgctgctgctgaggaggaggatggagagttcctgggcatgaagggcttcaagggccagctgagccggcaggtggccgaccagatgtggcaggccggcaagaggcaggccagccgggccttcagcctgtatgccaacatcgacatcctgcggccctactttgatgtggagcccgcccaggtgcgcagccggctgctggagagcatgatccccatcaagatggtgaacttcccccagaagattgctggggagctgtatggccccctgatgctggtgttcaccctggtggccatcctgctgcacggcatgaagaccagtgacaccatcatccgggagggcaccctgatgggcacagccatcggcacctgcttcggctactggctgggcgtgagcagcttcatctacttcctggcctacctgtgcaatgcccagatcaccatgctgcagatgctggccctgctgggctacggcctgtttggccactgcatcgtgctcttcatcacctacaacatccacctgcacgccctcttctacctgttctggctgctggtgggcggcctgagcaccctgaggatggtggccgtgctggtgtccaggacagtgggccccacccagaggctgctgctgtgtggcaccctggccgccctgcacatgctgttcctgctgtacctgcactttgcctaccacaaggtggtggagggcatcctggacaccctggagggccccaacatcccccccatccagagggtgccccgggacatcccagccatgctgcctgctgcccggctgcccaccaccgtgctgaatgccacagccaaggctgtggccgtgaccctgcagagccactag

SEQ ID NO: 176250 - DNA, 774 bp, Artificial Sequence
  Description of Artificial Sequence: Synthetic coding sequence
atgagcggctttgagaacctgaacacagacttctaccagaccagctacagcattgatgaccagagccagcagagctatgactatggaggcagcggcggcccctacagcaagcagtatgccggctatgactacagccagcagggccgctttgtgcccccagacatgatgcagccccagcagccctacacaggccagatctaccagcccacccaggcctacaccccagccagcccccagcccttctacggcaacaactttgaagatgagccccccctgctggaggagctgggcatcaactttgaccacatctggcagaagaccctgactgtgctgcaccccctgaaggtggctgatggcagcatcatgaatgaaacagacctggccggccccatggtgttctgcctggcctttggagccaccctgctgctggccggcaagatccagtttggctacgtgtatggcatcagcgccatcggctgcctgggcatgttctgcctgctgaacctgatgtccatgactggagtgtcctttggctgtgtggcctctgtgctgggctactgcctgctgcccatgatcctgctgagcagctttgctgtgatcttcagcctgcagggcatggtgggcatcatcctgacagctggcatcatcggctggtgcagcttcagcgccagcaagatcttcatcagcgccctggccatggagggccagcagctgctggtggcctacccctgtgccctgctgtatggagtgtttgccctgatctctgtgttctag

SEQ ID NO: 176251 - DNA, 798 bp, Artificial Sequence
  Description of Artificial Sequence: Synthetic coding sequence
atgagcggctttgagaacctgaacacagacttctaccagaccagctacagcattgatgaccagagccagcagagctatgactatggaggcagcggcggcccctacagcaagcagtatgccggctatgactacagccagcagggccgctttgtgcccccagacatgatgcagccccagcagccctacacaggccagatctaccagcccacccaggcctacaccccagccagcccccagcccttctacggcaacaactttgaagatgagccccccctgctggaggagctgggcatcaactttgaccacatctggcagaagaccctgactgtgctgcaccccctgaaggtggctgatggcagcatcatgaatgaaacagacctggccggccccatggtgttctgcctggcctttggagccaccctgctgctggccggcaagatccagtttggctacgtgtatggcatcagcgccatcggctgcctgggcatgttctgcctgctgaacctgatgtccatgactggagtgtcctttggctgtgtggcctctgtgctgggctactgcctgctgcccatgatcctgctgagcagctttgctgtgatcttcagcctgcagggcatggtgggcatcatcctgacagctggcatcatcggctggtgcagcttcagcgccagcaagatcttcatcagcgccctggccatggagggccagcagctgctggtggccctgcagcccaacatcacctacggcagcaactacttcctgttctgctgcctgccctacccccagcagcacttctag

SEQ ID NO: 176252 - DNA, 774 bp, Artificial Sequence; identical to SEQ ID NO: 176250
  Description of Artificial Sequence: Synthetic coding sequence

SEQ ID NO: 176253 - DNA, 612 bp, Artificial Sequence
  Description of Artificial Sequence: Synthetic coding sequence
atgatgcagccccagcagccctacacaggccagatctaccagcccacccaggcctacaccccagccagcccccagcccttctacggcaacaactttgaagatgagccccccctgctggaggagctgggcatcaactttgaccacatctggcagaagaccctgactgtgctgcaccccctgaaggtggctgatggcagcatcatgaatgaaacagacctggccggccccatggtgttctgcctggcctttggagccaccctgctgctggccggcaagatccagtttggctacgtgtatggcatcagcgccatcggctgcctgggcatgttctgcctgctgaacctgatgtccatgactggagtgtcctttggctgtgtggcctctgtgctgggctactgcctgctgcccatgatcctgctgagcagctttgctgtgatcttcagcctgcagggcatggtgggcatcatcctgacagctggcatcatcggctggtgcagcttcagcgccagcaagatcttcatcagcgccctggccatggagggccagcagctgctggtggcctacccctgtgccctgctgtatggagtgtttgccctgatctctgtgttctag

SEQ ID NO: 176254 - DNA, 534 bp, Artificial Sequence
  Description of Artificial Sequence: Synthetic coding sequence
atgatgcagccccagcagccctacacaggccagatctaccagcccacccaggcctacaccccagccagcccccagcccttctacggcaacaactttgaagatgagccccccctgctggaggagctgggcatcaactttgaccacatctggcagaagaccctgactgtgctgcaccccctgaaggtggctgatggcagcatcatgaatgaaacagacctggccggccccatggtgttctgcctggcctttggagccaccctgctgctggccggcaagatccagtttggctacgtgtatggcatcagcgccatcggctgcctgggcatgttctgcctgctgaacctgatgtccatgactggagtgtcctttggctgtgtggcctctgtgctgggctactgcctgctgcccatgatcctgctgagcagctttgctgtgatcttcagcctgcagggcatggtgggcatcatcctgacagctggcatcatcggctggtgcagcttcagcgccagcaagatcttcatcagcgccctgtag

SEQ ID NO: 176255 - DNA, 306 bp, Artificial Sequence
  Description of Artificial Sequence: Synthetic coding sequence
atgatgcagccccagcagccctacacaggccagatctaccagcccacccaggcctacaccccagccagcccccagcccttctacggcaacaactttgaagatgagccccccctgctggaggagctgggcatcaactttgaccacatctggcagaagaccctgactgtgctgcaccccctgaaggtggctgatggcagcatcatgaatgaaacagacctggccggccccatggtgttctgcctggcctttggagccaccctgctgctggccggcaagatccagtttggctacgtgtatggcatctag

SEQ ID NO: 176256 - DNA, 429 bp, Artificial Sequence
  Description of Artificial Sequence: Synthetic coding sequence
atgagcggctttgagaacctgaacacagacttctaccagaccagctacagcattgatgaccagagccagcagagctatgactatggaggcagcggcggcccctacagcaagcagtatgccggctatgactacagccagcagggccgctttgtgcccccagacatgatgcagccccagcagccctacacaggccagatctaccagcccacccaggcctacaccccagccagcccccagcccttctacggcaacaactttgaagatgagccccccctgctggaggagctgggcatcaactttgaccacatctggcagaagaccctgactgtgctgcaccccctgaaggtggctgatggcagcatcatgaatgaaacagacctggcccagtggttctttgccctgctgctggagccccactgctactggtag

SEQ ID NO: 176257 - DNA, 882 bp, Artificial Sequence
  Description of Artificial Sequence: Synthetic coding sequence
atggcctaccacagcggctatggagcccacggcagcaagcaccgggcccgggccgccccagaccccccacccctgtttgatgacaccagcggcggctacagcagccagcccggcggctacccagccactggagcagatgtggccttctctgtgaaccacctgctgggggaccccatggccaacgtggccatggcctacggcagcagcatcgccagccacggcaaggacatggtgcacaaggagctgcacagatttgtgtctgtgtccaagctgaagtacttctttgctgtggacacagcctacgtggccaagaagctgggcctgctggtgttcccctacacccaccagaactgggaggtgcagtacagcagagatgcccccctgcccccccggcaggacctgaatgccccagacctgtacatccccaccatggccttcatcacctacgtgctgctggccggcatggccctgggcatccagaagcgcttcagccctgaggtgctgggcctgtgtgccagcacagccctggtgtgggtggtgatggaggtgctggccctgctgctgggcctgtacctggccaccgtgcggagtgacctgagcaccttccacctgctggcctacagcggctacaagtatgtgggcatgatcctgtctgtgctgaccggcctgctgtttggaagtgatggctactacgtggccctggcctggaccagcagcgccctgatgtacttcatcgtgcgcagcctgaggacagctgccctgggccctgacagcatgggcggccctgtgccccggcagaggctgcagctgtacctgaccctgggcgctgctgccttccagcccctcatcatctactggctgaccttccacctggtgaggtag

SEQ ID NO: 176258 - DNA, 360 bp, Artificial Sequence
  Description of Artificial Sequence: Synthetic coding sequence
atggtgaagatgaccaagagcaagaccttccaggcctacctgcccaactgccacaggacctacagctgcatccactgccgggcccacctggccaaccatgatgagctgatcagcaagagcttccagggcagccagggccgggcctacctgttcaacagcgtggtgaatgtgggctgcggccctgctgaggagcgggtgctgctgaccggcctgcatgctgtggccgacatctactgtgagaactgcaagaccaccctgggctggaagtatgagcacgcctttgagagcagccagaagtacaaggagggcaagttcatcatcgagctggcccacatgatcaaggacaatggctgggagtag

SEQ ID NO: 176259 - DNA, 360 bp, Artificial Sequence
  Description of Artificial Sequence: Synthetic coding sequence
atggtgaagatgaccaggagcaagaccttccaggcctacctgcccagctgccacaggacctacagctgcatccactgccgggcccacctggccaaccatgatgagctgatcagcaagagcttccagggcagccagggccgggcctacctgttcaacagcgtggtgaatgtgggctgcggccctgctgaggagcgggtgctgctgaccggcctgcatgctgtggccgacatctactgtgagaactgcaagaccaccctgggctggaagtatgagcacgcctttgagagcagccagaagtacaaggagggcaagtacatcatcgagctggcccacatgatcaaggacaatggctgggactag

SEQ ID NO: 176260 - DNA, 360 bp, Artificial Sequence
  Description of Artificial Sequence: Synthetic coding sequence
atggtgcgcatcagcaagcccaagaccttccaggcctacctggatgactgccaccggcgctacagctgtgcccactgccgggcccacctggccaaccatgatgacctgatcagcaagagcttccagggcagccagggccgggcctacctgttcaacagcgtggtgaatgtgggctgcggccctgctgaggagcgggtgctgctgaccggcctgcatgctgtggccgacatccactgtgagaactgcaagaccaccctgggctggaagtatgagcaggcctttgagagcagccagaagtacaaggagggcaagtacatcatcgagctgaaccacatgatcaaggacaatggctgggactag

SEQ ID NO: 176261 - DNA, 474 bp, Artificial Sequence
  Description of Artificial Sequence: Synthetic coding sequence
atgtgtgtggcccaggtgctgacagcccacctgctgcccccccggcaggccctgggcagcctgtgcagcccctgggccgccccccgggtgggccccctgcccccagccccagccatggtgcgcatcagcaagcccaagaccttccaggcctacctggatgactgccaccggcgctacagctgtgcccactgccgggcccacctggccaaccatgatgacctgatcagcaagagcttccagggcagccagggccgggcctacctgttcaacagcgtggtgaatgtgggctgcggccctgctgaggagcgggtgctgctgaccggcctgcatgctgtggccgacatccactgtgagaactgcaagaccaccctgggctggaagtatgagcaggcctttgagagcagccagaagtacaaggagggcaagtacatcatcgagctgaaccacatgatcaaggacaatggctgggactag

SEQ ID NO: 176262 - DNA, 384 bp, Artificial Sequence
  Description of Artificial Sequence: Synthetic coding sequence
atgcccagctgtgaccccggccctggccctgcctgcctgcccaccaagaccttccgcagctacctgccccgctgccacaggacctacagctgtgtgcactgccgggcccacctggccaagcatgatgagctgatcagcaagagcttccagggcagccacggccgggcctacctgttcaacagcgtggtgaatgtgggctgcggccctgctgagcagaggctgctgctgaccggcctgcacagcgtggccgacatcttctgtgagagctgcaagaccaccctgggctggaagtatgagcaggcctttgagaccagccagaagtacaaggagggcaagtacatcatcgagatgagccacatggtgaaggacaatggctgggactag

SEQ ID NO: 176263 - DNA, 384 bp, Artificial Sequence; identical to SEQ ID NO: 176262
  Description of Artificial Sequence: Synthetic coding sequence

SEQ ID NO: 176264 - DNA, 384 bp, Artificial Sequence; identical to SEQ ID NO: 176262
  Description of Artificial Sequence: Synthetic coding sequence

SEQ ID NO: 176265 - DNA, 243 bp, Artificial Sequence
  Description of Artificial Sequence: Synthetic coding sequence
atgcccagctgtgaccccggccctggccctgcctgcctgcccaccaagaccttccgcagctacctgccccgctgccacaggacctacagctgtgtgcactgccgggcccacctggccaagcatgatgagctgatcagcaagagcttccagggcagccacggccgggcctacctgttcaacagcgtggtgaatgtgggctgcggccctgctgagcagaggctgctgctgaccggcctgcactag

SEQ ID NO: 176266 - DNA, 384 bp, Artificial Sequence; identical to SEQ ID NO: 176262
  Description of Artificial Sequence: Synthetic coding sequence

SEQ ID NO: 176267 - DNA, 366 bp, Artificial Sequence
  Description of Artificial Sequence: Synthetic coding sequence
atgggccgcatcttcctggaccacatcggcggcaccaggctcttcagctgtgccaactgtgacaccatcctgaccaacagaagtgagctgatcagcacccgcttcaccggggccaccggccgggccttcctgttcaacaaggtggtgaacctgcagtacagcgaggtgcaggacagagtgatgctgaccggccgccacatggtgagagatgtgtcctgcaagaactgcaacagcaagctgggctggatctatgaatttgccacagaggacagccagcgctacaaggagggccgggtcatcctggagcgggccctggtgcgggagagcgagggctttgaggagcacgtgcccagcgacaacagctag

SEQ ID NO: 176268 - DNA, 366 bp, Artificial Sequence; identical to SEQ ID NO: 176267
  Description of Artificial Sequence: Synthetic coding sequence

SEQ ID NO: 176269 - DNA, 366 bp, Artificial Sequence; identical to SEQ ID NO: 176267
  Description of Artificial Sequence: Synthetic coding sequence

SEQ ID NO: 176270 - DNA, 366 bp, Artificial Sequence; identical to SEQ ID NO: 176267
  Description of Artificial Sequence: Synthetic coding sequence

SEQ ID NO: 176271 - DNA, 366 bp, Artificial Sequence; identical to SEQ ID NO: 176267
  Description of Artificial Sequence: Synthetic coding sequence

SEQ ID NO: 176272 - DNA, 2322 bp, Artificial Sequence
  Description of Artificial Sequence: Synthetic coding sequence
atgttcagcctgagcagcacagtgcagccccaggtgacagtgcccctgagccacctgatcaatgccttccacacccccaagaacacctctgtgtccctgagcggcgtgtctgtgtcccagaaccagcacagagatgtggtgcctgagcacgaggcccccagcagcgagtgcatgttcagtgacttcctgaccaagctgaacatcgtgtccatcggcaagggcaagatctttgagggctaccgctccatgttcatggagcccgccaagaggatgaagaagagcctggacaccacagacaactggcacatccggcctgagcccttcagcctgagcatcccccccagcctgaacctgcgggacctgggcctgtctgagctgaagattggccagattgaccagctggtggagaacctgctgcccggcttctgcaagggcaagaacatcagcagccactggcacaccagccacgtgtctgcccagagcttctttgagaacaagtatggcaacctggacatcttcagcaccctgcggagcagctgcctgtaccgccaccacagccgggccctgcagagcatctgcagcgacctgcagtactggcctgtgttcatccagagccggggcttcaagaccctgaagagcaggacccggcggctgcagagcaccagcgagcggctggccgagacccagaacatcgcccccagctttgtgaagggcttcctgctgcgggaccggggcagtgatgtggagagcctggacaagctgatgaagaccaagaacatccctgaggcccaccaggatgccttcaagacaggctttgctgagggcttcctgaaggcccaggccctgacccagaagaccaatgacagcctgcggaggaccaggctcatcctgtttgtgctgctgctgtttggcatctacggcctgctgaagaaccccttcctgtctgtgcgcttccgcaccaccaccggcctggacagcgctgtggaccctgtgcagatgaagaatgtgacctttgagcacgtgaagggcgtggaggaggccaagcaggagctgcaggaggtggtggagttcctgaagaacccccagaagttcaccatcctgggcggcaagctgcccaagggcatcctgctggtgggccccccaggcaccgggaagaccctgctggcccgggctgtggccggggaggctgatgtgcccttctactatgccagcggcagcgagtttgatgagatgtttgtgggcgtgggcgccagccgcatccggaacctcttccgggaggccaaggccaatgccccctgtgtgatcttcattgatgagctggacagcgtgggcggcaagagaattgagagccccatgcacccctacagccggcagaccatcaaccagctgctggccgagatggatggcttcaagcccaatgaaggagtcatcatcattggagccaccaacttccctgaggccctggacaatgccctgatccggcccggccgctttgacatgcaggtgacagtgcccaggccagatgtgaagggccgcacagagatcctgaagtggtacctgaacaagatcaagtttgaccagagcgtggaccctgagatcatcgcccggggcaccgtgggcttcagcggggctgagctggagaacctggtgaaccaggccgccctgaaggctgctgtggatggcaaggagatggtgaccatgaaggagctggagttcagcaaggacaagatcctgatgggccctgagaggagatctgtggagattgacaacaagaacaagaccatcacagcctaccatgaaagtggccacgccatcatcgcctactacaccaaggatgccatgcccatcaacaaggccaccatcatgccccggggccccaccctgggccacgtgtccctgctgcctgaaaatgaccgctggaatgagacccgggcccagctgctggcccagatggatgtgtccatgggcggccgggtggccgaggagctgatctttggaacagaccacatcaccaccggggccagcagtgactttgacaatgccaccaagatcgccaagaggatggtgaccaagtttggcatgtctgagaagctgggcgtgatgacctacagcgacaccgggaagctgagccctgagacccagagcgccatcgagcaggagatccgcatcctgctgcgggacagctatgagcgggccaagcacatcctgaagacccacgccaaggagcacaagaacctggccgaggccctgctgacctatgagaccctggatgccaaggagatccagatcgtgctggagggcaagaagctggaggtgaggtag

SEQ ID NO: 176273 - DNA, 2223 bp, Artificial Sequence
  Description of Artificial Sequence: Synthetic coding sequence
atgttcagcctgagcagcacagtgcagccccaggtgacagtgcccctgagccacctgatcaatgccttccacacccccaagaacacctctgtgtccctgagcggcgtgtctgtgtcccagaaccagcacagagatgtggtgcctgagcacgaggcccccagcagcgagtgcatgttcagtgacttcctgaccaagctgaacatcgtgtccatcggcaagggcaagatctttgagggctaccgctccatgttcatggagcccgccaagaggatgaagaagagcctggacaccacagacaactggcacatccggcctgagcccttcagcctgagcatcccccccagcctgaacctgcgggacctgggcctgtctgagctgaagattggccagattgaccagctggtggagaacctgctgcccggcttctgcaagggcaagaacatcagcagccactggcacaccagccacgtgtctgcccagagcttctttgagaacaagtatggcaacctggacatcttcagcaccctgcggagcagctgcctgtaccgccaccacagccgggccctgcagagcatctgcagcgacctgcagtactggcctgtgttcatccagagccggggcttcaagaccctgaagagcaggacccggcggctgcagagcaccagcgagcggctggccgagacccagaacatcgcccccagctttgtgaagggcttcctgctgcgggaccggggcagtgatgtggagagcctggacaagctgatgaagaccaagaacatccctgaggcccaccaggatgccttcaagacaggctttgctgagggcttcctgaaggcccaggccctgacccagaagaccaatgacagcctgcggaggaccaggctcatcctgtttgtgctgctgctgtttggcatctacggcctgctgaagaaccccttcctgtctgtgcgcttccgcaccaccaccggcctggacagcgctgtggaccctgtgcagatgaagaatgtgacctttgagcacgtgaagggcgtggaggaggccaagcaggagctgcaggaggtggtggagttcctgaagaacccccagaagttcaccatcctgggcggcaagctgcccaagggcatcctgctggtgggccccccaggcaccgggaagaccctgctggcccgggctgtggccggggaggctgatgtgcccttctactatgccagcggcagcgagtttgatgagatgtttgtgggcgtgggcgccagccgcatccggaacctcttccgggaggccaaggccaatgccccctgtgtgatcttcattgatgagctggacagcgtgggcggcaagagaattgagagccccatgcacccctacagccggcagaccatcaaccagctgctggccgagatggatggcttcaagcccaatgaaggagtcatcatcattggagccaccaacttccctgaggccctggacaatgccctgatccggcccggccgctttgacatgcaggtgacagtgcccaggccagatgtgaagggccgcacagagatcctgaagtggtacctgaacaagatcaagtttgaccagagcgtggaccctgagatcatcgcccggggcaccgtgggcttcagcggggctgagctggagaacctggtgaaccaggccgccctgaaggctgctgtggatggcaaggagatggtgaccatgaaggagctggagttcagcaaggacaagatcctgatgggccctgagaggagatctgtggagattgacaacaagaacaagaccatcacagcctaccatgaaagtggccacgccatcatcgcctactacaccaaggatgccatgcccatcaacaaggccaccatcatgccccggggccccaccctgggccacgtgtccctgctgcctgaaaatgaccgctggaatgagacccgggcccagctgctggcccagatggatgtgtccatgggcggccgggtggccgaggagctgatctttggaacagaccacatcaccaccggggccagcagtgactttgacaatgccaccaagatcgccaagaggatggtgaccaagtttggcatgtctgagaagctgggcgtgatgacctacagcgacaccgggaagctgagccctgagacccagagcgccatcgagcaggagatccgcatcctgctgcgggacagctatgagcgggccaagcacatcctgaagacccacagctag

SEQ ID NO: 176274 - DNA, 2052 bp, Artificial Sequence
  Description of Artificial Sequence: Synthetic coding sequence
atgttcagcctgagcagcacagtgcagccccaggtgacagtgcccctgagccacctgatcaatgccttccacacccccaagaacacctctgtgtccctgagcggcgtgtctgtgtcccagaaccagcacagagatgtggtgcctgagcacgaggcccccagcagcgagcccagcctgaacctgcgggacctgggcctgtctgagctgaagattggccagattgaccagctggtggagaacctgctgcccggcttctgcaagggcaagaacatcagcagccactggcacaccagccacgtgtctgcccagagcttctttgagaacaagtatgtgttcatccagagccggggcttcaagaccctgaagagcaggacccggcggctgcagagcaccagcgagcggctggccgagacccagaacatcgcccccagctttgtgaagggcttcctgctgcgggaccggggcagtgatgtggagagcctggacaagctgatgaagaccaagaacatccctgaggcccaccaggatgccttcaagacaggctttgctgagggcttcctgaaggcccaggccctgacccagaagaccaatgacagcctgcggaggaccaggctcatcctgtttgtgctgctgctgtttggcatctacggcctgctgaagaaccccttcctgtctgtgcgcttccgcaccaccaccggcctggacagcgctgtggaccctgtgcagatgaagaatgtgacctttgagcacgtgaagggcgtggaggaggccaagcaggagctgcaggaggtggtggagttcctgaagaacccccagaagttcaccatcctgggcggcaagctgcccaagggcatcctgctggtgggccccccaggcaccgggaagaccctgctggcccgggctgtggccggggaggctgatgtgcccttctactatgccagcggcagcgagtttgatgagatgtttgtgggcgtgggcgccagccgcatccggaacctcttccgggaggccaaggccaatgccccctgtgtgatcttcattgatgagctggacagcgtgggcggcaagagaattgagagccccatgcacccctacagccggcagaccatcaaccagctgctggccgagatggatggcttcaagcccaatgaaggagtcatcatcattggagccaccaacttccctgaggccctggacaatgccctgatccggcccggccgctttgacatgcaggtgacagtgcccaggccagatgtgaagggccgcacagagatcctgaagtggtacctgaacaagatcaagtttgaccagagcgtggaccctgagatcatcgcccggggcaccgtgggcttcagcggggctgagctggagaacctggtgaaccaggccgccctgaaggctgctgtggatggcaaggagatggtgaccatgaaggagctggagttcagcaaggacaagatcctgatgggccctgagaggagatctgtggagattgacaacaagaacaagaccatcacagcctaccatgaaagtggccacgccatcatcgcctactacaccaaggatgccatgcccatcaacaaggccaccatcatgccccggggccccaccctgggccacgtgtccctgctgcctgaaaatgaccgctggaatgagacccgggcccagctgctggcccagatggatgtgtccatgggcggccgggtggccgaggagctgatctttggaacagaccacatcaccaccggggccagcagtgactttgacaatgccaccaagatcgccaagaggatggtgaccaagtttggcatgtctgagaagctgggcgtgatgacctacagcgacaccgggaagctgagccctgagacccagagcgccatcgagcaggagatccgcatcctgctgcgggacagctatgagcgggccaagcacatcctgaagacccacgccaaggagcacaagaacctggccgaggccctgctgacctatgagaccctggatgccaaggagatccagatcgtgctggagggcaagaagctggaggtgaggtag

SEQ ID NO: 176275 - DNA, 2151 bp, Artificial Sequence
  Description of Artificial Sequence: Synthetic coding sequence
atgttcagcctgagcagcacagtgcagccccaggtgacagtgcccctgagccacctgatcaatgccttccacacccccaagaacacctctgtgtccctgagcggcgtgtctgtgtcccagaaccagcacagagatgtggtgcctgagcacgaggcccccagcagcgagcccagcctgaacctgcgggacctgggcctgtctgagctgaagattggccagattgaccagctggtggagaacctgctgcccggcttctgcaagggcaagaacatcagcagccactggcacaccagccacgtgtctgcccagagcttctttgagaacaagtatggcaacctggacatcttcagcaccctgcggagcagctgcctgtaccgccaccacagccgggccctgcagagcatctgcagcgacctgcagtactggcctgtgttcatccagagccggggcttcaagaccctgaagagcaggacccggcggctgcagagcaccagcgagcggctggccgagacccagaacatcgcccccagctttgtgaagggcttcctgctgcgggaccggggcagtgatgtggagagcctggacaagctgatgaagaccaagaacatccctgaggcccaccaggatgccttcaagacaggctttgctgagggcttcctgaaggcccaggccctgacccagaagaccaatgacagcctgcggaggaccaggctcatcctgtttgtgctgctgctgtttggcatctacggcctgctgaagaaccccttcctgtctgtgcgcttccgcaccaccaccggcctggacagcgctgtggaccctgtgcagatgaagaatgtgacctttgaacatgtgaagggcgtggaggaggccaagcaggagctgcaggaggtggtggagttcctgaagaacccccagaagttcaccatcctgggcggcaagctgcccaagggcatcctgctggtgggccccccaggcaccgggaagaccctgctggcccgggctgtggccggggaggctgatgtgcccttctactatgccagcggcagcgagtttgatgagatgtttgtgggcgtgggcgccagccgcatccggaacctcttccgggaggccaaggccaatgccccctgcgtcatcttcattgatgagctggacagcgtgggcggcaagagaattgagagccccatgcacccctacagccggcagaccatcaaccagctgctggccgagatggatggcttcaagcccaatgaaggagtcatcatcatcggggccaccaacttccctgaggccctggacaatgccctgatccggcccggccgctttgacatgcaggtgacagtgcccaggccagatgtgaagggccgcacagagatcctgaagtggtacctgaacaagatcaagtttgaccagagcgtggaccctgagatcatcgcccggggcaccgtgggcttctctggagctgagctggagaacctggtgaaccaggccgccctgaaggctgctgtggatggcaaggagatggtgaccatgaaggagctggagttcagcaaggacaagatcctgatgggccctgagcggcgctctgtggagattgacaacaagaacaagaccatcacagcctaccacgagagcggccacgccatcatcgcctactacaccaaggatgccatgcccatcaacaaggccaccatcatgccccggggccccaccctgggccacgtgtccctgctgcctgaaaatgaccgctggaatgagacccgggcccagctgctggcccagatggatgtgtccatgggcggccgggtggccgaggagctgatcttcggcacagaccacatcaccactggagccagcagtgactttgacaatgccaccaagatcgccaagaggatggtgaccaagtttggcatgtctgagaagctgggcgtgatgacctacagcgacaccgggaagctgagccctgagacccagagcgccatcgagcaggagatccgcatcctgctgcgggacagctatgaaagagccaagcacatcctgaagacccacgccaaggagcacaagaacctggccgaggccctgctgacctatgagaccctggatgccaaggagatccagatcgtgctggagggcaagaagctggaggtgaggtag

SEQ ID NO: 176276 - DNA, 747 bp, Artificial Sequence
  Description of Artificial Sequence: Synthetic coding sequence
atgtaccaggtgacagtgcccctgagccacctgatcaatgccttccacacccccaagaacacctctgtgtccctgagcggcgtgtctgtgtcccagaaccagcacagagatgtggtgcctgagcacgaggcccccagcagcgagcccagcctgaacctgcgggacctgggcctgtctgagctgaagattggccagattgaccagctggtggagaacctgctgcccggcttctgcaagggcaagaacatcagcagccactggcacaccagccacgtgtctgcccagagcttctttgagaacaagtatggcaacctggacatcttcagcaccctgcggagcagctgcctgtaccgccaccacagccgggccctgcagagcatctgcagcgacctgcagtactggcctgtgttcatccagagccggggcttcaagaccctgaagagcaggacccggcggctgcagagcaccagcgagcggctggccgagacccagaacatcgcccccagctttgtgaagggcttcctgctgcgggaccggggcagtgatgtggagagcctggacaagctgatgaagaccaagaacatccctgaggcccaccaggatgccttcaagacaggctttgctgagggcttcctgaaggcccaggccctgacccagaagaccaatgacagcctgcggaggaccaggctcatcctgtttgtgctgctgctgtttggcatctacggcctgctgaagaaccccttctag

SEQ ID NO: 176277 - DNA, 762 bp, Artificial Sequence
  Description of Artificial Sequence: Synthetic coding sequence
atgttcagcctgagcagcacagtgcagccccaggtgacagtgcccctgagccacctgatcaatgccttccacacccccaagaacacctctgtgtccctgagcggcgtgtctgtgtcccagaaccagcacagagatgtggtgcctgagcacgaggcccccagcagcgagcccagcctgaacctgcgggacctgggcctgtctgagctgaagattggccagattgaccagctggtggagaacctgctgcccggcttctgcaagggcaagaacatcagcagccactggcacaccagccacgtgtctgcccagagcttctttgagaacaagtatgtgttcatccagagccggggcttcaagaccctgaagagcaggacccggcggctgcagagcaccagcgagcggctggccgagacccagaacatcgcccccagctttgtgaagggcttcctgctgcgggaccggggcagtgatgtggagagcctggacaagctgatgaagaccaagaacatccctgaggcccaccaggatgccttcaagacaggctttgctgagggcttcctgaaggcccaggccctgacccagaagaccaatgacagcctgcggaggaccaggctcatcctgtttgtgctgctgctgtttggcatctacggcctgctgaagaaccccttcctgtctgtgcgcttccgcaccaccaccggcctggacagcgctgtggaccctgtgcagatgaagaatgtgacctttgagcacgtgaagggctag

SEQ ID NO: 176278 - DNA, 1551 bp, Artificial Sequence
  Description of Artificial Sequence: Synthetic coding sequence
atgaagaccaagaacatccctgaggcccaccaggatgccttcaagacaggctttgctgagggcttcctgaaggcccaggccctgacccagaagaccaatgacagcctgcggaggaccaggctcatcctgtttgtgctgctgctgtttggcatctacggcctgctgaagaaccccttcctgtctgtgcgcttccgcaccaccaccggcctggacagcgctgtggaccctgtgcagatgaagaatgtgacctttgagcacgtgaagggcgtggaggaggccaagcaggagctgcaggaggtggtggagttcctgaagaacccccagaagttcaccatcctgggcggcaagctgcccaagggcatcctgctggtgggccccccaggcaccgggaagaccctgctggcccgggctgtggccggggaggctgatgtgcccttctactatgccagcggcagcgagtttgatgagatgtttgtgggcgtgggcgccagccgcatccggaacctcttccgggaggccaaggccaatgccccctgtgtgatcttcattgatgagctggacagcgtgggcggcaagagaattgagagccccatgcacccctacagccggcagaccatcaaccagctgctggccgagatggatggcttcaagcccaatgaaggagtcatcatcattggagccaccaacttccctgaggccctggacaatgccctgatccggcccggccgctttgacatgcaggtgacagtgcccaggccagatgtgaagggccgcacagagatcctgaagtggtacctgaacaagatcaagtttgaccagagcgtggaccctgagatcatcgcccggggcaccgtgggcttcagcggggctgagctggagaacctggtgaaccaggccgccctgaaggctgctgtggatggcaaggagatggtgaccatgaaggagctggagttcagcaaggacaagatcctgatgggccctgagaggagatctgtggagattgacaacaagaacaagaccatcacagcctaccatgaaagtggccacgccatcatcgcctactacaccaaggatgccatgcccatcaacaaggccaccatcatgccccggggccccaccctgggccacgtgtccctgctgcctgaaaatgaccgctggaatgagacccgggcccagctgctggcccagatggatgtgtccatgggcggccgggtggccgaggagctgatctttggaacagaccacatcaccaccggggccagcagtgactttgacaatgccaccaagatcgccaagaggatggtgaccaagtttggcatgtctgagaagctgggcgtgatgacctacagcgacaccgggaagctgagccctgagacccagagcgccatcgagcaggagatccgcatcctgctgcgggacagctatgagcgggccaagcacatcctgaagacccacgccaaggagcacaagaacctggccgaggccctgctgacctatgagaccatgcccaagcgcttcaagctgttcctgcggggcaagtcctggaagtag

SEQ ID NO: 176279 - DNA, 1047 bp, Artificial Sequence
  Description of Artificial Sequence: Synthetic coding sequence
atgtttggacctgccaagggccgccactttggagtgcacccagcccctggcttccctggaggagtgtcccagcaggccgccggcaccaaggccggccctgctggggcctggcctgtgggcagcaggacagacaccatgtggaggctgcgctgcaaggccaaggatggcacccacgtgctgcagggcctgagcagcaggaccagggtgcgggagctgcagggccagattgctgccatcaccggcatcgcccctgggggccagaggatcctggtgggctacccacctgagtgcctggacctgagcaatggagacaccatcctggaggacctgcccatccagagcggggacatgctgatcatcgaggaggaccagacccggcccaggagcagccctgccttcaccaagagaggagccagcagctatgtgcgggagaccctgcctgtgctgaccaggacagtggtgcctgctgacaacagctgcctcttcacctctgtgtactacgtggtggagggcggcgtgctgaacccagcctgtgcccctgagatgagaagactcatcgcccagatcgtggccagtgaccctgacttctacagcgaggccatcctgggcaagaccaaccaggagtactgtgactggatcaagagagatgacacctggggcggggccatcgagatcagcatcctgagcaagttctaccagtgtgagatctgtgtggtggacacccagacagtgagaattgacagatttggagaagatgctggctacaccaagagggtgctgctgatctatgatggcatccactatgaccccctgcagaggaacttcccagaccctgacaccccacccctgaccatcttcagcagcaatgatgacatcgtgctggtgcaggccctggagctggctgatgaggccaggagaagacggcagttcacagatgtgaaccgcttcaccctgcgctgcatggtgtgccagaagggcctgaccggccaggccgaggcccgggagcacgccaaggagaccggccacaccaactttggagaggtgtag

SEQ ID NO: 176280 - DNA, 915 bp, Artificial Sequence
  Description of Artificial Sequence: Synthetic coding sequence
atggagaccctgcacatcatctacagcgaggccaagagcttcaccgtggagggcctgagcagcaggaccagggtgcgggagctgcagggccagattgctgccatcaccggcatcgcccctgggggccagaggatcctggtgggctacccacctgagtgcctggacctgagcaatggagacaccatcctggaggacctgcccatccagagcggggacatgctgatcatcgaggaggaccagacccggcccaggagcagccctgccttcaccaagagaggagccagcagctatgtgcgggagaccctgcctgtgctgaccaggacagtggtgcctgctgacaacagctgcctcttcacctctgtgtactacgtggtggagggcggcgtgctgaacccagcctgtgcccctgagatgagaagactcatcgcccagatcgtggccagtgaccctgacttctacagcgaggccatcctgggcaagaccaaccaggagtactgtgactggatcaagagagatgacacctggggcggggccatcgagatcagcatcctgagcaagttctaccagtgtgagatctgtgtggtggacacccagacagtgagaattgacagatttggagaagatgctggctacaccaagagggtgctgctgatctatgatggcatccactatgaccccctgcagaggaacttcccagaccctgacaccccacccctgaccatcttcagcagcaatgatgacatcgtgctggtgcaggccctggagctggctgatgaggccaggagaagacggcagttcacagatgtgaaccgcttcaccctgcgctgcatggtgtgccagaagggcctgaccggccaggccgaggcccgggagcacgccaaggagaccggccacaccaactttggagaggtgtag

SEQ ID NO: 176281 - DNA, 915 bp, Artificial Sequence; identical to SEQ ID NO: 176280
  Description of Artificial Sequence: Synthetic coding sequence

SEQ ID NO: 176282 - DNA, 840 bp, Artificial Sequence
  Description of Artificial Sequence: Synthetic coding sequence
atgagccctgcccggcgctgccggggcatgagagctgctgtggccgcctctgtgggcctgtctgagggccctgctggcagccgcagcggccgcctcttccggccccccagccctgccccagctgcccctggggcccggctgctgcggctgcccggcagcggggctgtgcaggccgccagccctgagcgggccggctggacagaggccctgcgggctgctgtggccgagctgcgggccggggctgtggtggccgtgcccacagacaccctgtatggcctggcctgtgccgccagctgcagcgctgccctgcgggctgtgtaccgcctgaagggccgctctgaggccaagcccctggccgtgtgcctgggccgggtggctgatgtgtaccgctactgccgggtgcgggtgcctgagggcctgctgaaggacctgctgcccggccctgtgaccctggtgatggagaggtctgaggagctgaacaaggacctgaaccccttcacccccctggtgggcatccgcatcccagaccacgccttcatgcaggacctggcccagatgtttgagggccccctggccctgaccagcgccaacctgagcagccaggccagcagcctgaatgtggaggagttccaggacctgtggccccagctgagcctggtgattgatggcggccagattggagatggccagagcccagaatgtcggctgggcagcacagtggtggacctgtctgtgcctgggaagtttggcatcatccggcccggctgtgccctggagagcaccacagccatcctgcagcagaagtatggcctgctgcccagccacgccagctacctgtag

SEQ ID NO: 176283 - DNA, 1740 bp, Artificial Sequence
  Description of Artificial Sequence: Synthetic coding sequence
atgtctgccagcagcctgctggagcagaggcccaagggccagggcaacaaggtgcagaatggatctgtgcaccagaaggatggcctgaatgatgatgactttgagccctacctgagcccccaggcccggcccaacaatgcctacacagccatgtctgacagctacctgcccagctactacagccccagcatcggcttctcctacagcctgggggaggccgcctggagcactggaggagacacagccatgccctacctgaccagctatggccagctgagcaatggagagccccacttcctgcctgatgccatgtttggccagcccggggccctgggcagcacccccttcctgggccagcacggcttcaacttcttccccagcggcatcgacttcagcgcctggggcaacaacagcagccagggccagagcacccagagcagcggctacagcagcaactatgcctatgcccccagcagcctgggcggggccatgattgatggccagagcgcctttgccaatgagaccctgaacaaggcccctggcatgaacaccatcgaccagggcatggccgccctgaagctgggcagcacagaggtggccagcaatgtgcccaaggtggtgggcagcgctgtgggcagcggcagcatcaccagcaacatcgtggccagcaacagcctgcccccagccaccatcgccccacccaagccagcctcctgggccgacatcgccagcaagccagccaagcagcagcccaagctgaagaccaagaatggaattgctggcagcagcctgcccccaccacccatcaagcacaacatggacatcggcacctgggacaacaagggccctgtggccaaggcccccagccaggccctggtgcagaacatcggccagcccacccagggcagcccccagcctgtgggccagcaggccaacaacagcccccctgtggcccaggcctctgtgggccagcagacccagcccctgcccccacctccaccccagcctgcccagctgtctgtgcagcagcaggccgcccagcccacccgctgggtggcccccaggaacagaggcagcggcttcggccacaacggggtggatggaaatggagtgggccagagccaggccggcagcggcagcaccccatctgagccccaccctgtgctggagaagctgcggagcatcaacaactacaaccccaaggactttgactggaacctgaagcacggccgggtcttcatcatcaagagctacagtgaagatgacatccacaggagcatcaagtacaacatctggtgcagcacagaacatggcaacaagaggctggatgctgcctaccgctccatgaatggcaagggccctgtgtacctgctcttctctgtgaatggcagcggccacttctgtggggtggccgagatgaagtctgctgtggactacaacacctgtgccggcgtgtggagccaggacaagtggaagggccgctttgatgtgcgctggatctttgtgaaggatgtgcccaacagccagctgcggcacatccggctggagaacaatgaaaacaagcctgtgaccaacagccgggacacccaggaggtgcccctggagaaggccaagcaggtgctgaagatcatcgccagctacaagcacaccaccagcatctttgatgacttcagccactatgagaagaggcaggaggaggaggagagcgtgaagaaggagcggcagggccggggcaagtag

SEQ ID NO: 176284 - DNA, 1710 bp, Artificial Sequence
  Description of Artificial Sequence: Synthetic coding sequence
atgtctgccagcagcctgctggagcagaggcccaagggccagggcaacaaggtgcagaatggatctgtgcaccagaaggatggcctgaatgatgatgactttgagccctacctgagcccccaggcccggcccaacaatgcctacacagccatgtctgacagctacctgcccagctactacagccccagcatcggcttctcctacagcctgggggaggccgcctggagcactggaggagacacagccatgccctacctgaccagctatggccagctgagcaatggagagccccacttcctgcctgatgccatgtttggccagcccggggccctgggcagcacccccttcctgggccagcacggcttcaacttcttccccagcggcatcgacttcagcgcctggggcaacaacagcagccagggccagagcacccagagcagcggctacagcagcaactatgcctatgcccccagcagcctgggcggggccatgattgatggccagagcgcctttgccaatgagaccctgaacaaggcccctggcatgaacaccatcgaccagggcatggccgccctgaagctgggcagcacagaggtggccagcaatgtgcccaaggtggtgggcagcgctgtgggcagcggcagcatcaccagcaacatcgtggccagcaacagcctgcccccagccaccatcgccccacccaagccagcctcctgggccgacatcgccagcaagccagccaagcagcagcccaagctgaagaccaagaatggaattgctggcagcagcctgcccccaccacccatcaagcacaacatggacatcggcacctgggacaacaagggccctgtggccaaggcccccagccaggccctggtgcagaacatcggccagcccacccagggcagcccccagcctgtgggccagcaggccaacaacagcccccctgtggcccaggcctctgtgggccagcagacccagcccctgcccccacctccaccccagcctgcccagctgtctgtgcagcagcaggccgcccagcccacccgctgggtggcccccaggaacagaggcagcggcttcggccacaacggggtggatggaaatggagtgggccagagccaggccggcagcggcagcaccccatctgagccccaccctgtgctggagaagctgcggagcatcaacaactacaaccccaaggactttgactggaacctgaagcacggccgggtcttcatcatcaagagctacagtgaagatgacatccacaggagcatcaagtacaacatctggtgcagcacagaacatggcaacaagaggctggatgctgcctaccgctccatgaatggcaagggccctgtgtacctgctcttctctgtgaatggcagcggccacttctgtggggtggccgagatgaagtctgctgtggactacaacacctgtgccggcgtgtggagccaggacaagtggaagggccgctttgatgtgcgctggatctttgtgaaggatgtgcccaacagccagctgcggcacatccggctggagaacaatgaaaacaagcctgtgaccaacagccgggacacccaggaggtgcccctggagaaggccaagcaggtgctgaagatcatcgccagctacaagcacaccaccagcatctttgatgacttcagccactatgagaagaggcagggccgcaggaagtgctag

SEQ ID NO: 176285 - DNA, 1590 bp, Artificial Sequence
  Description of Artificial Sequence: Synthetic coding sequence
atgtctgacagctacctgcccagctactacagccccagcatcggcttctcctacagcctgggggaggccgcctggagcactggaggagacacagccatgccctacctgaccagctatggccagctgagcaatggagagccccacttcctgcctgatgccatgtttggccagcccggggccctgggcagcacccccttcctgggccagcacggcttcaacttcttccccagcggcatcgacttcagcgcctggggcaacaacagcagccagggccagagcacccagagcagcggctacagcagcaactatgcctatgcccccagcagcctgggcggggccatgattgatggccagagcgcctttgccaatgagaccctgaacaaggcccctggcatgaacaccatcgaccagggcatggccgccctgaagctgggcagcacagaggtggccagcaatgtgcccaaggtggtgggcagcgctgtgggcagcggcagcatcaccagcaacatcgtggccagcaacagcctgcccccagccaccatcgccccacccaagccagcctcctgggccgacatcgccagcaagccagccaagcagcagcccaagctgaagaccaagaatggaattgctggcagcagcctgcccccaccacccatcaagcacaacatggacatcggcacctgggacaacaagggccctgtggccaaggcccccagccaggccctggtgcagaacatcggccagcccacccagggcagcccccagcctgtgggccagcaggccaacaacagcccccctgtggcccaggcctctgtgggccagcagacccagcccctgcccccacctccaccccagcctgcccagctgtctgtgcagcagcaggccgcccagcccacccgctgggtggcccccaggaacagaggcagcggcttcggccacaacggggtggatggaaatggagtgggccagagccaggccggcagcggcagcaccccatctgagccccaccctgtgctggagaagctgcggagcatcaacaactacaaccccaaggactttgactggaacctgaagcacggccgggtcttcatcatcaagagctacagtgaagatgacatccacaggagcatcaagtacaacatctggtgcagcacagaacatggcaacaagaggctggatgctgcctaccgctccatgaatggcaagggccctgtgtacctgctcttctctgtgaatggcagcggccacttctgtggggtggccgagatgaagtctgctgtggactacaacacctgtgccggcgtgtggagccaggacaagtggaagggccgctttgatgtgcgctggatctttgtgaaggatgtgcccaacagccagctgcggcacatccggctggagaacaatgaaaacaagcctgtgaccaacagccgggacacccaggaggtgcccctggagaaggccaagcaggtgctgaagatcatcgccagctacaagcacaccaccagcatctttgatgacttcagccactatgagaagaggcaggaggaggaggagagcgtgaagaaggagcggcagggccggggcaagtag

SEQ ID NO: 176286 - DNA, 1740 bp, Artificial Sequence; identical to SEQ ID NO: 176283
  Description of Artificial Sequence: Synthetic coding sequence

SEQ ID NO: 176287 - DNA, 1245 bp, Artificial Sequence
  Description of Artificial Sequence: Synthetic coding sequence
atggccagcggggacaccctgtacatcgccacagatggcagcgagatgcctgctgagatcgtggagctgcacgagattgaggtggagaccatccctgtggagaccatcgagaccaccgtggtgggggaggaggaggaggaggatgatgatgatgaagatggcggcggcggggaccatggaggcggcggcggccacggccacgccggccaccaccaccaccaccaccaccaccaccaccacccccccatgattgccctgcagcccctggtgacagatgaccccacccaggtgcaccaccaccaggaggtgatcctggtgcagacccgggaggaggtggtgggcggagatgacagtgatggcctgcgggcagaagatggctttgaggaccagatcctgatccctgtgcctgccccagctggaggagatgatgactacatcgagcagaccctggtgacagtggccgccgccggcaagagcggcggcggcggcagcagcagcagcggcggcggccgggtgaagaagggcggcggcaagaagagcggcaagaagagctacctgtctggaggagctggagctgctgggggcggcggcgctgaccccggcaacaagaagtgggagcagaagcaggtgcagatcaagaccctggagggggagttctctgtgaccatgtggagcagtgatgagaagaaggacatcgaccacgagaccgtggtggaggagcagatcattggagagaacagccccccagactacagcgagtacatgaccgggaagaagctgcccccaggcggcatccctggcatcgacctgagtgaccccaagcagctggccgagtttgccaggatgaagcccaggaagatcaaggaggatgatgcccccaggaccatcgcctgcccccacaagggctgcaccaagatgttccgggacaacagcgccatgaggaagcacctgcacacccacggcccccgggtgcacgtgtgtgctgaatgtgggaaggcctttgtggagagcagcaagctgaagaggcaccagctggtgcacactggagagaagcccttccagtgcacctttgagggctgtgggaagcgcttcagcctggacttcaacctgcggacccacgtgcgcatccacactggagaccggccctacgtgtgcccctttgatggctgcaacaagaagtttgcccagagcaccaacctgaagagccacatcctgacccacgccaaggccaagaacaaccagtag

SEQ ID NO: 176288 - DNA, 105 bp, Artificial Sequence
  Description of Artificial Sequence: Synthetic coding sequence
atggccagcggggacaccctgtacatcgccacagatggcagcgagatgcctgctgagatcgtggagctgcacgagattgaggtggagaccatccctgtggagtag

SEQ ID NO: 176289 - DNA, 1221 bp, Artificial Sequence
  Description of Artificial Sequence: Synthetic coding sequence
atggcccaggccccagctgaccccggccgggagggccacctggagcagaggatcctgcaggtgctgacagaagctggcagccctgtgaagctggcccagctggtgaaggagtgccaggcccccaagcgggagctgaaccaggtgctgtacaggatgaagaaggagctgaaggtgtccctgaccagccctgccacctggtgcctgggcggcacagatcctgagggggagggccctgctgagctggccctgagcagccctgaggaggacatctaccgcttcctgaaggacaatggcccccagagggccctggtgattgcccaggccctgggcatgaggacagccaaggatgtgaacagagacctgtacaggatgaagagccgccacctgctggacatggatgagcagagcaaggcctggaccatctacagaccagaagattctggaagaagagccaagagcgccagcatcatctaccagcacaaccccatcaacatgatctgccagaatggccccaacagctggatcagcatcgccaacagcgaggccatccagattggacatggcaacatcatcacccggcagacagtgtccagagaagatggcagcgctggccccaggcacctgcccagcatggcccctggggacagcagcacctggggcaccctggtggacccctggggcccccaggacatccacatggagcagagcatcctgcggcgggtgcagctgggccacagcaatgagatgaggctgcacggcgtgcccagcgagggccctgcccacatccccccaggcagcccccctgtgtctgccacagctgctggccctgaggccagctttgaggcccgcatccccagccctggcacccaccctgagggggaggccgcccagaggatccacatgaagagctgcttcctggaggatgccaccatcggcaacagcaacaagatgagcatcagccctggggtggccggccctgggggcgtggccggcagcggggagggggagcctggagaagatgctggaagaagacctgctgacacccagagccgcagccacttcccccgggacatcggccagcccatcacccccagccacagcaagctgacccccaagctggagaccatgaccctgggcaacagaagccacaaggctgctgagggcagccactacgtggatgaggccagccatgagggctcctggtggggcggcggcatctag

SEQ ID NO: 176290 - DNA, 1341 bp, Artificial Sequence
  Description of Artificial Sequence: Synthetic coding sequence
atggcccaggccccagctgaccccggccgggagggccacctggagcagaggatcctgcaggtgctgacagaagctggcagccctgtgaagctggcccagctggtgaaggagtgccaggcccccaagcgggagctgaaccaggtgctgtacaggatgaagaaggagctgaaggtgtccctgaccagccctgccacctggtgcctgggcggcacagatcctgagggggagggccctgctgagctggccctgagcagccctgctgagcggccccagcagcacgccgccaccatccctgagaccccaggcccccagttcagccagcagcgggaggaggacatctaccgcttcctgaaggacaatggcccccagagggccctggtgattgcccaggccctgggcatgaggacagccaaggatgtgaacagagacctgtacaggatgaagagccgccacctgctggacatggatgagcagagcaaggcctggaccatctacagacctgaggacagcggccggcgggccaagagcgccagcatcatctaccagcacaaccccatcaacatgatctgccagaatggccccaacagctggatcagcatcgccaacagcgaggccatccagatcggccacggcaacatcatcacccggcagacagtgtcccgggaggatggcagcgctggccccaggcacctgcccagcatggcccctggggacagcagcacctggggcaccctggtggacccctggggcccccaggacatccacatggagcagagcatcctgcggcgggtgcagctgggccacagcaatgagatgaggctgcatggagtgcccagcgagggccctgcccacatccccccaggcagcccccctgtgtctgccacagctgctggccctgaggccagctttgaggcccgcatccccagccctggcacccaccctgagggggaggccgcccagaggatccacatgaagagctgcttcctggaggatgccaccatcggcaacagcaacaagatgagcatcagccctggggtggccggccctggaggagtggccggcagcggggagggggagcccggggaggatgctgtggccgccttcacagaggtgctgaaccccagcaagagcttcatgaagtttggcatcaacttcttccagacccctgtgaatgtggacagcctgaccagcagccatgagagccagatgttcctgacagcctgccgcctggtgatcttcagccgccgcttcagcacctactttgcccagatccacctgaggaaccacagcgtgctgcacctgtgcccccacaagatctacctgctgaagaacaagaagtag

SEQ ID NO: 176291 - DNA, 1143 bp, Artificial Sequence
  Description of Artificial Sequence: Synthetic coding sequence
atggcccaggccccagctgaccccggccgggagggccacctggagcagaggatcctgcaggtgctgacagaagctggcagccctgtgaagctggcccagctggtgaaggagtgccaggcccccaagcgggagctgaaccaggtgctgtacaggatgaagaaggagctgaaggtgtccctgaccagccctgccacctggtgcctgggcggcacagatcctgagggggagggccctgctgagctggccctgagcagccctgctgagcggccccagcagcacgccgccaccatccctgagaccccaggcccccagttcagccagcagcgggaggaggacatctaccgcttcctgaaggacaatggcccccagagggccctggtgattgcccaggccctgggcatgaggacagccaaggatgtgaacagagacctgtacaggatgaagagccgccacctgctggacatggatgagcagagcaaggcctggaccatctacagacctgaggacagcggccggcgggccaagagcgccagcatcatctaccagcacaaccccatcaacatgatctgccagaatggccccaacagctggatcagcatcgccaacagcgaggccatccagatcggccacggcaacatcatcacccggcagacagtgtcccgggaggatggcagcgctggccccaggcacctgcccagcatggcccctggggacagcagcacctggggcaccctggtggacccctggggcccccaggacatccacatggagcagagcatcctgcggcgggtgcagctgggccacagcaatgagatgaggctgcatggagtgcccagcgagggccctgcccacatccccccaggcagcccccctgtgtctgccacagctgctggccctgaggccagctttgaggcccgcatccccagccctggcacccaccctgagggggaggccgcccagaggatccacatgaagagctgcttcctggaggatgccaccatcggcaacagcaacaagatgagcatcagccctggggtggccggccctggaggagtggccggcagcggggagggggagcccggggaggatgctggccggcggcctgctgacacccaggcccggagctttgatggccaggagtag

SEQ ID NO: 176292 - DNA, 1290 bp, Artificial Sequence
  Description of Artificial Sequence: Synthetic coding sequence
atggcccaggccccagctgaccccggccgggagggccacctggagcagaggatcctgcaggtgctgacagaagctggcagccctgtgaagctggcccagctggtgaaggagtgccaggcccccaagcgggagctgaaccaggtgctgtacaggatgaagaaggagctgaaggtgtccctgaccagccctgccacctggtgcctgggcggcacagatcctgagggggagggccctgctgagctggccctgagcagccctgctgagcggccccagcagcacgccgccaccatccctgagaccccaggcccccagttcagccagcagcgggaggaggacatctaccgcttcctgaaggacaatggcccccagagggccctggtgattgcccaggccctgggcatgaggacagccaaggatgtgaacagagacctgtacaggatgaagagccgccacctgctggacatggatgagcagagcaaggcctggaccatctacagacctgaggacagcggccggcgggccaagagcgccagcatcatctaccagcacaaccccatcaacatgatctgccagaatggccccaacagctggatcagcatcgccaacagcgaggccatccagatcggccacggcaacatcatcacccggcagacagtgtcccgggaggatggcagcgctggccccaggcacctgcccagcatggcccctggggacagcagcacctggggcaccctggtggacccctggggcccccaggacatccacatggagcagagcatcctgcggcgggtgcagctgggccacagcaatgagatgaggctgcatggagtgcccagcgagggccctgcccacatccccccaggcagcccccctgtgtctgccacagctgctggccctgaggccagctttgaggcccgcatccccagccctggcacccaccctgagggggaggccgcccagaggatccacatgaagagctgcttcctggaggatgccaccatcggcaacagcaacaagatgagcatcagccctggggtggccggccctggaggagtggccggcagcggggagggggagcccggggaggatgctggccggcggcctgctgacacccagagccgcagccacttcccccgggacatcggccagcccatcacccccagccacagcaagctgacccccaagctggagaccatgaccctgggcaacagaagccacaaggctgctgagggcagccactacgtggatgaggccagccatgagggctcctggtggggcggcggcatctag

SEQ ID NO: 176293 - DNA, 747 bp, Artificial Sequence
  Description of Artificial Sequence: Synthetic coding sequence
atggcccaggccccagctgaccccggccgggagggccacctggagcagaggatcctgcaggtgctgacagaagctggcagccctgtgaagctggcccagctggtgaaggagtgccaggcccccaagcgggagctgaaccaggtgctgtacaggatgaagaaggagctgaaggtgtccctgaccagccctgccacctggtgcctgggcggcacagatcctgagggggagggccctgctgagctggccctgagcagccctgctgagcggccccagcagcacgccgccaccatccctgagaccccaggcccccagttcagccagcagcgggaggaggacatctaccgcttcctgaaggacaatggcccccagagggccctggtgattgcccaggccctgggcatgaggacagccaaggatgtgaacagagacctgtacaggatgaagagccgccacctgctggacatggatgagcagagcaaggcctggaccatctacagacctgaggacagcggccggcgggccaagagcgccagcatcatctaccagcacaaccccatcaacatgatctgccagaatggccccaacagctggatcagcatcgccaacagcgaggccatccagatcggccacggcaacatcatcacccggcagacagtgtcccgggaggatggcaagagccccaagagggcccagggcggggacctgggcggggagcccccagaccccctgggcggcggcaaaggatag

SEQ ID NO: 176294 - DNA, 1065 bp, Artificial Sequence
  Description of Artificial Sequence: Synthetic coding sequence
atggcccaggccccagctgaccccggccgggaggccgagcggccccagcagcacgccgccaccatccctgagaccccaggcccccagttcagccagcagcgggaggaggacatctaccgcttcctgaaggacaatggcccccagagggccctggtgattgcccaggccctgggcatgaggacagccaaggatgtgaacagagacctgtacaggatgaagagccgccacctgctggacatggatgagcagagcaaggcctggaccatctacagaccagaagattctggaagaagagccaagagcgccagcatcatctaccagcacaaccccatcaacatgatctgccagaatggccccaacagctggatcagcatcgccaacagcgaggccatccagattggacatggcaacatcatcacccggcagacagtgtccagagaagatggcagcgctggccccaggcacctgcccagcatggcccctggggacagcagcacctggggcaccctggtggacccctggggcccccaggacatccacatggagcagagcatcctgcggcgggtgcagctgggccacagcaatgagatgaggctgcacggcgtgcccagcgagggccctgcccacatccccccaggcagcccccctgtgtctgccacagctgctggccctgaggccagctttgaggcccgcatccccagccctggcacccaccctgagggggaggccgcccagaggatccacatgaagagctgcttcctggaggatgccaccatcggcaacagcaacaagatgagcatcagccctggggtggccggccctgggggcgtggccggcagcggggagggggagcctggagaagatgctggaagaagacctgctgacacccagagccgcagccacttcccccgggacatcggccagcccatcacccccagccacagcaagctgacccccaagctggagaccatgaccctgggcaacagaagccacaaggctgctgagggcagccactacgtggatgaggccagccatgagggctcctggtggggcggcggcatctag

SEQ ID NO: 176295 - DNA, 1860 bp, Artificial Sequence
  Description of Artificial Sequence: Synthetic coding sequence
atgccagaccctgctgcccacctgcccttcttctacggcagcatcagcagagctgaggccgaggagcacctgaagctggccggcatggctgatggcctcttcctgctgcggcagtgcctgcggagcctgggcggctacgtgctgagcctggtgcatgatgtgcgcttccaccacttccccatcgagcggcagctgaatggcacctacgccatcgccggcggcaaggcccactgcggccctgctgagctgtgtgagttctacagccgggaccctgatggcctgccctgcaacctgaggaagccctgcaaccggcccagcggcctggagccccagcccggggtgtttgactgcctgagagatgccatggtgcgggactatgtgcggcagacctggaagctggagggggaggccctggagcaggccatcatcagccaggccccccaggtggagaagctgattgccaccacagcccacgagaggatgccctggtaccacagcagcctgacccgggaggaggccgagaggaagctgtacagcggggcccagacagatggcaagttcctgctgcggcccaggaaggagcagggcacctacgccctgagcctcatctacggcaagacagtgtaccactacctgatcagccaggacaaggccggcaagtactgcatccctgagggcaccaagtttgacaccctgtggcagctggtggagtacctgaagctgaaggcagatggcctcatctactgcctgaaggaggcctgccccaacagcagcgccagcaatgccagcggggccgccgcccccaccctgcctgcccaccccagcaccctgacccacccccagaggagaattgacaccctgaacagtgatggctacaccccagagcccgcccgcatcaccagcccagacaagccccggcccatgcccatggacacctctgtgtatgagagcccctacagcgaccctgaggagctgaaggacaagaagctgttcctgaagagggacaacctgctgattgctgacatcgagctgggctgcggcaactttggatctgtgcggcagggcgtgtacaggatgaggaagaagcagattgatgtggccatcaaggtgctgaagcagggcacagagaaggctgacacagaggagatgatgagggaggcccagatcatgcaccagctggacaacccctacatcgtgcggctcatcggcgtgtgccaggccgaggccctgatgctggtgatggagatggccggcggcggccccctgcacaagttcctggtgggcaagcgggaggagatccctgtgtccaatgtggccgagctgctgcaccaggtgtccatgggcatgaagtacctggaggagaagaactttgtgcaccgggacctggccgccagaaatgtgctgctggtgaacagacactacgccaagatcagtgactttggcctgagcaaggccctgggcgcagatgacagctactacacagcccggtctgctgggaagtggcccctgaagtggtacgcccctgagtgcatcaacttcaggaagttcagcagcagaagtgatgtgtggagctatggagtgaccatgtgggaggccctgtcctatggccagaagccctacaagaagatgaagggccctgaggtgatggccttcatcgagcagggcaagaggatggagtgccccccagaatgtcctcctgagctgtatgccctgatgtctgactgctggatctacaagtgggaggacagaccagacttcctgactgtggagcagaggatgagggcctgctactacagcctggccagcaaggtggagggccccccaggcagcacccagaaggccgaggccgcctgtgcctag

SEQ ID NO: 176296 - DNA, 1482 bp, Artificial Sequence
  Description of Artificial Sequence: Synthetic coding sequence
atgaggctgggcccccgctggaagggggaggccctggagcaggccatcatcagccaggccccccaggtggagaagctgattgccaccacagcccacgagaggatgccctggtaccacagcagcctgacccgggaggaggccgagaggaagctgtacagcggggcccagacagatggcaagttcctgctgcggcccaggaaggagcagggcacctacgccctgagcctcatctacggcaagacagtgtaccactacctgatcagccaggacaaggccggcaagtactgcatccctgagggcaccaagtttgacaccctgtggcagctggtggagtacctgaagctgaaggcagatggcctcatctactgcctgaaggaggcctgccccaacagcagcgccagcaatgccagcggggccgccgcccccaccctgcctgcccaccccagcaccctgacccacccccagaggagaattgacaccctgaacagtgatggctacaccccagagcccgcccgcatcaccagcccagacaagccccggcccatgcccatggacacctctgtgtatgagagcccctacagcgaccctgaggagctgaaggacaagaagctgttcctgaagagggacaacctgctgattgctgacatcgagctgggctgcggcaactttggatctgtgcggcagggcgtgtacaggatgaggaagaagcagattgatgtggccatcaaggtgctgaagcagggcacagagaaggctgacacagaggagatgatgagggaggcccagatcatgcaccagctggacaacccctacatcgtgcggctcatcggcgtgtgccaggccgaggccctgatgctggtgatggagatggccggcggcggccccctgcacaagttcctggtgggcaagcgggaggagatccctgtgtccaatgtggccgagctgctgcaccaggtgtccatgggcatgaagtacctggaggagaagaactttgtgcaccgggacctggccgccagaaatgtgctgctggtgaacagacactacgccaagatcagtgactttggcctgagcaaggccctgggcgcagatgacagctactacacagcccggtctgctgggaagtggcccctgaagtggtacgcccctgagtgcatcaacttcaggaagttcagcagcagaagtgatgtgtggagctatggagtgaccatgtgggaggccctgtcctatggccagaagccctacaagaagatgaagggccctgaggtgatggccttcatcgagcagggcaagaggatggagtgccccccagaatgtcctcctgagctgtatgccctgatgtctgactgctggatctacaagtgggaggacagaccagacttcctgactgtggagcagaggatgagggcctgctactacagcctggccagcaaggtggagggccccccaggcagcacccagaaggccgaggccgcctgtgcctag

SEQ ID NO: 176297 - DNA, 939 bp, Artificial Sequence
  Description of Artificial Sequence: Synthetic coding sequence
atgcccatggacacctctgtgtatgagagcccctacagcgaccctgaggagctgaaggacaagaagctgttcctgaagagggacaacctgctgattgctgacatcgagctgggctgcggcaactttggatctgtgcggcagggcgtgtacaggatgaggaagaagcagattgatgtggccatcaaggtgctgaagcagggcacagagaaggctgacacagaggagatgatgagggaggcccagatcatgcaccagctggacaacccctacatcgtgcggctgattggagtgtgccaggccgaggccctgatgctggtgatggagatggccggcggcggccccctgcacaagttcctggtgggcaagcgggaggagatccctgtgtccaatgtggccgagctgctgcaccaggtgtccatgggcatgaagtacctggaggagaagaactttgtgcaccgggacctggccgccagaaatgtgctgctggtgaacagacactacgccaagatcagtgactttggcctgagcaaggccctgggcgcagatgacagctactacacagcccggtctgctgggaagtggcccctgaagtggtacgcccctgagtgcatcaacttcaggaagttcagcagcagaagtgatgtgtggagctatggagtgaccatgtgggaggccctgtcctatggccagaagccctacaagaagatgaagggccctgaggtgatggccttcatcgagcagggcaagaggatggagtgccccccagagtgccccccagagctgtatgccctgatgtctgactgctggatctacaagtgggaggacagaccagacttcctgactgtggagcagaggatgagggcctgctactacagcctggccagcaaggtggagggccccccaggcagcacccagaaggccgaggccgcctgtgcctag

SEQ ID NO: 176298 - DNA, 1344 bp, Artificial Sequence
  Description of Artificial Sequence: Synthetic coding sequence
atgctgctggatgctggcccccagtacccagccatcggcgtgaccacctttggagccagccgccaccacagcgctggagatgtggccgagagagatgtgggcctgggcatcaacccctttgctgatggcatgggcgccttcaagctgaaccccagcagccatgagctggccagcgctggccagacagccttcaccagccaggcccctggctacgccgctgctgctgccctgggccaccaccaccaccctggccacgtgggcagctacagcagcgctgccttcaacagcacccgggacttcctgttcaggaacagaggatttggagatgctgctgctgctgccagcgcccagcacagcctgtttgctgccagcgctgggggctttggaggcccccacggccacacagatgctgctggccacctgctcttccctggcctgcacgagcaggccgccggccacgccagccccaacgtggtgaatggccagatgaggctgggcttcagcggggacatgtaccccaggcctgagcagtatggccaggtgaccagccccaggtctgagcactacgccgccccccagctgcacggctacggccccatgaatgtgaacatggccgcccaccacggggccggggccttcttccgctacatgaggcagcccatcaagcaggagctgatctgcaagtggattgagcctgagcagctggccaaccccaagaagagctgcaacaagaccttcagcaccatgcatgagctggtgacccacgtgacagtggagcacgtgggcggccctgagcagagcaaccacatctgcttctgggaggagtgcccccgggagggcaagcccttcaaggccaagtacaagctggtgaaccacatccgggtgcacactggagagaagcccttcccctgccccttccctggctgcggcaaggtgtttgcccggtctgagaacctgaagatccacaagaggacccacactggagagaagcccttcaagtgtgaatttgagggctgtgacagaagatttgccaacagcagtgacaggaagaagcacatgcacgtgcacaccagtgacaagccctacctgtgcaagatgtgtgacaagagctacacccaccccagcagcctgaggaagcacatgaaggtgcatgagagcagcagccagggcagccagcccagccctgctgccagcagcggctatgagagcagcaccccacccaccatcgtgagccccagcacagacaaccccaccaccagcagcctgagccccagcagcagcgctgtgcaccacacagctggccacagcgccctgagcagcaacttcaatgagtggtacgtgtag

SEQ ID NO: 176299 - DNA, 1599 bp, Artificial Sequence
  Description of Artificial Sequence: Synthetic coding sequence
atgctgctggatgctggcccccagtttcctgccatcggcgtgggcagctttgcccggcaccaccaccacagcgctgctgctgctgctgctgctgctgctgagatgcaggaccgggagctgagcctggccgccgcccagaatggatttgtggacagcgctgctgcccacatgggcgccttcaagctgaaccctggggcccacgagctgagccctggccagagcagcgccttcaccagccagggccctggggcctacccaggcagcgctgctgctgctgctgctgctgctgccctgggcccccacgccgcccacgtgggcagctacagcggcccccccttcaacagcacccgggacttcctgttccgcagccggggctttggagacagcgcccctgggggcggccagcacggcctgtttggacctggagctgggggcctgcaccacgcccacagtgatgcccagggccacctgctcttccctggcctgcctgagcagcacggcccccacggcagccagaatgtgctgaatggccagatgaggctgggcctgcccggggaggtgtttggccgctctgagcagtaccggcaggtggccagccccaggacagacccctacagcgctgcccagctgcacaaccagtatggccccatgaacatgaacatgggcatgaacatggctgctgctgctgcccaccaccaccaccaccaccaccaccaccctggggccttcttccgctacatgaggcagcagtgcatcaagcaggagctgatctgcaagtggattgatcctgagcagctgagcaaccccaagaagagctgcaacaagaccttcagcaccatgcatgagctggtgacccacgtgtctgtggagcacgtgggcggccctgagcagagcaaccacgtgtgcttctgggaggagtgcccccgggagggcaagcccttcaaggccaagtacaagctggtgaaccacatccgggtgcacactggagagaagcccttcccctgccccttccctggctgtgggaaggtgtttgcccggtctgagaacctgaagatccacaagaggacccacactggagagaagcccttccagtgtgaatttgagggctgtgacagaagatttgccaacagcagtgacaggaagaagcacatgcacgtgcacaccagtgacaagccctacctgtgcaagatgtgtgacaagagctacacccaccccagcagcctgaggaagcacatgaaggtgcatgagagcagcccccagggcagcgagagcagccctgctgccagcagcggctatgagagcagcaccccacctggcctggtgagccccagcgctgagccccagagcagcagcaacctgagccctgctgctgctgctgctgctgctgctgctgctgctgctgctgctgctgtgtctgctgtgcacagaggaggcggcagcggcagcggcggggccggcggcggcagcggcggcggcagcggcagcggcggcggcggcggcggggccggcggcggcggcggcggcagcagcggcggcggcagcggcacagctgggggccacagcggcctgagcagcaacttcaatgagtggtacgtgtag

SEQ ID NO: 176300 - DNA, 489 bp, Artificial Sequence
  Description of Artificial Sequence: Synthetic coding sequence
cctcctcctcctcctcctcctccagcccctcctcctcctccacccctgaaccccaagaagagctgcaacaagaccttcagcaccatgcatgagctggtgacccacgtgtctgtggagcacgtgggcggccctgagcagagcaaccacgtgtgcttctgggaggagtgcccccgggagggcaagcccttcaaggccaagtacaagctggtgaaccacatccgggtgcacactggagagaagcccttcccctgccccttccctggctgcggcaaggtgtttgcccggtctgagaacctgaagatccacaagaggacccacactggagagaagcccttccagtgtgaatttgagggctgtgacagaagatttgccaacagcagtgacaggaagaagcacatgcacgtgcacaccagtgacaagccctacctgtgcaagatgtgtgacaagagctacacccaccccagcagcctgaggaagcacatgaagtag

SEQ ID NO: 176301 - DNA, 783 bp, Artificial Sequence
  Description of Artificial Sequence: Synthetic coding sequence
atgctgctggatgctggcccccagtttcctgccatcggcgtgggcagctttgcccggcaccaccaccacagcgctgctgctgctgctgctgctgctgctgagatgcaggaccgggagctgagcctggccgccgcccagaatggatttgtggacagcgctgctgcccacatgggcgccttcaagctgaaccctggggcccacgagctgagccctggccagagcagcgccttcaccagccagggccctggggcctacccaggcagcgctgctgctgctgctgctgctgctgccctgggcccccacgccgcccacgtgggcagctacagcggcccccccttcaacagcacccgggacttcctgttccgcagccggggctttggagacagcgcccctgggggcggccagcacggcctgtttggacctggagctgggggcctgcaccacgcccacagtgatgcccagggccacctgctcttccctggcctgcctgagcagcacggcccccacggcagccagaatgtgctgaatggccagatgaggctgggcctgcccggggaggtgtttggccgctctgagcagtaccggcaggtggccagccccaggacagacccctacagcgctgcccagctgcacaaccagtatggccccatgaacatgaacatgggcatgaacatggctgctgctgctgcccaccaccaccaccaccaccaccaccctgtgcccagcctgctgaccaactgtgtgcacagcggcctgctgctgagccccccacgctggttctag

SEQ ID NO: 176302 - DNA, 1404 bp, Artificial Sequence
  Description of Artificial Sequence: Synthetic coding sequence
atgaccatgctgctggatggcggcccccagtttcctggcctgggcgtgggcagctttggagcccccaggcaccacgagatgcccaaccgggagcctgctggcatgggcctgaacccctttggagacagcacccacgccgctgctgctgctgctgctgctgctgccttcaagctgagccctgctgctgcccatgacctgagcagcggccagagcagcgccttcaccccccagggcagcggctacgccaatgccctgggccaccaccaccaccaccaccaccaccaccaccacaccagccaggtgcccagctatggaggagctgccagcgctgccttcaacagcacccgggagttcctgttccggcagaggagcagcggcctgtctgaggccgccagcggcggcggccagcacggcctgtttgctggcagcgccagcagcctgcacgccccagctggcatccctgagccccccagctacctgctcttccctggcctgcacgagcagggcgccggccaccccagccccaccggccacgtggacaacaaccaggtgcacctgggcctgcggggggagctgtttggccgggctgacccctacagacctgtggccagccccaggacagacccctatgctgctggggcccagttccccaactacagccccatgaacatgaacatgggcgtgaatgtggccgcccaccacggccctggggccttcttccgctacatgaggcagcccatcaagcaggagctgagctgcaagtggattgatgaggcccagctgagccggcccaagaagagctgtgacaggaccttcagcaccatgcatgagctggtgacccacgtgaccatggagcacgtgggcggccctgagcagaacaaccacgtgtgctactgggaggagtgcccccgggagggcaagagcttcaaggccaagtacaagctggtgaaccacatccgggtgcacactggagagaagcccttcccctgccccttccctggctgcggcaagatctttgcccggtctgagaacctgaagatccacaagaggacccacactggagagaagcccttcaagtgtgaatttgagggctgtgacagaagatttgccaacagcagtgacaggaagaagcacatgcacgtgcacaccagtgacaagccctacatctgcaaggtgtgtgacaagagctacacccaccccagcagcctgaggaagcacatgaaggtgcatgagagccagggcagtgacagcagccctgctgccagcagcggctatgagagcagcaccccaccagccatcgccagcgccaacagcaaggacaccaccaagacccccagcgctgtgcagaccagcaccagccacaaccctggcctgccccccaacttcaatgagtggtacgtgtag

SEQ ID NO: 176303 - DNA, 1374 bp, Artificial Sequence
  Description of Artificial Sequence: Synthetic coding sequence
atgaccatgctgctggatggcggcccccagtttcctggcctgggcgtgggcagctttggagcccccaggcaccacgagatgcccaaccgggagcctgctggcatgggcctgaacccctttggagacagcacccacgccgctgctgctgctgctgctgctgctgccttcaagctgagccctgctgctgcccatgacctgagcagcggccagagcagcgccttcaccccccagggcagcggctacgccaatgccctgggccaccaccaccaccaccaccaccaccaccaccacaccagccaggtgcccagctatggaggagctgccagcgctgccttcaacagcacccgggagttcctgttccggcagaggagcagcggcctgtctgaggccgccagcggcggcggccagcacggcctgtttgctggcagcgccagcagcctgcacgccccagctggcatccctgagccccccagctacctgctcttccctggcctgcacgagcagggcgccggccaccccagccccaccggccacgtggacaacaaccaggtgcacctgggcctgcggggggagctgtttggccgggctgacccctacagacctgtggccagccccaggacagacccctatgctgctggggcccagttccccaactacagccccatgaacatgaacatgggcgtgaatgtggccgcccaccacggccctggggccttcttccgctacatgaggcagcccatcaagcaggagctgagctgcaagtggattgatgaggcccagctgagccggcccaagaagagctgtgacaggaccttcagcaccatgcatgagctggtgacccacgtgaccatggagcacgtgggcggccctgagcagaacaaccacgtgtgctactgggaggagtgcccccgggagggcaagagcttcaaggccaagtacaagctggtgaaccacatccgggtgcacactggagagaagcccttcccctgccccttccctggctgcggcaagatctttgcccggtctgagaacctgaagatccacaagaggacccacactggagagaagcccttcaagtgtgaatttgagggctgtgacagaagatttgccaacagcagtgacaggaagaagcacatgcacgtgcacaccagtgacaagccctacatctgcaaggtgtgtgacaagagctacacccaccccagcagcctgaggaagcacatgaagtgctgcccagcctggtacccaggccagagcctcatcccagatgaggagctggacacagatgtgggcatgcagcagcctgccctgcacaacaccacctaccccaagtgccgggtgaatgctgagcccaccgtgcaggagatgatctactag

SEQ ID NO: 176304 - DNA, 1005 bp, Artificial Sequence
  Description of Artificial Sequence: Synthetic coding sequence
atgagatacaagaccagcctggtgatgaggaagaggctgcggctgtacagaaacaccctgaaggagagcagcagcagcagcggccaccacggcccccagctgacagctgccagcagccccagcgtcttccctggcctgcacgaggagcccccccaggccagccccagccggcccctgaatggcctgctgcggctgggcctgcccggggacatgtatgcccggcctgagcccttccccccaggccctgctgcccggagtgatgccctggccgctgctgctgccctgcacggctacggcggcatgaacctgactgtgaacctggccgcccctcatggccctggggccttcttccgctacatgaggcagcccatcaagcaggagctgatctgcaagtggctggccgcagatggaacagccacccccagcctgtgcagcaagaccttcagcaccatgcatgagctggtgacccacgtgacagtggagcacgtgggcggccctgagcaggccaaccacatctgcttctgggaggagtgcccccggcagggcaagcccttcaaggccaagtacaagctggtgaaccacatccgggtgcacactggagagaagcccttcccctgccccttccctggctgcggcaaggtgtttgcccggtctgagaacctgaagatccacaagaggacccacactggagagaagcccttccgctgtgaatttgagggctgtgaaagaagatttgccaacagcagtgacaggaagaagcacagccacgtgcacaccagtgacaagccctacacctgcaaggtgcggggctgtgacaagtgctacacccaccccagcagcctgaggaagcacatgaaggtgcacggccgcagccccccacccagcagcggctatgacagcgccacccccagcgccctggtgagccccagcagtgactgtggccacaagagccaggtggccagcagcgctgctgtggccgccaggacagctgacctgtctgagtag

SEQ ID NO: 176305 - DNA, 1119 bp, Artificial Sequence
  Description of Artificial Sequence: Synthetic coding sequence
atgaatggcccctgccagagcctgaggaaggccgagggcctgctggagggctgcaccagcgctgtgacagtgttcaggaagctgcccctggacagcaaggcccagagccagaagatgagatacaagaccagcctggtgatgaggaagaggctgcggctgtacagaaacaccctgaaggagagcagcagcagcagcggccaccacggcccccagctgacagctgccagcagccccagcgtcttccctggcctgcacgaggagcccccccaggccagccccagccggcccctgaatggcctgctgcggctgggcctgcccggggacatgtatgcccggcctgagcccttccccccaggccctgctgcccggagtgatgccctggccgctgctgctgccctgcacggctacggcggcatgaacctgactgtgaacctggccgcccctcatggccctggggccttcttccgctacatgaggcagcccatcaagcaggagctgatctgcaagtggctggccgcagatggaacagccacccccagcctgtgcagcaagaccttcagcaccatgcatgagctggtgacccacgtgacagtggagcacgtgggcggccctgagcaggccaaccacatctgcttctgggaggagtgcccccggcagggcaagcccttcaaggccaagtacaagctggtgaaccacatccgggtgcacactggagagaagcccttcccctgccccttccctggctgcggcaaggtgtttgcccggtctgagaacctgaagatccacaagaggacccacactggagagaagcccttccgctgtgaatttgagggctgtgaaagaagatttgccaacagcagtgacaggaagaagcacagccacgtgcacaccagtgacaagccctacacctgcaaggtgcggggctgtgacaagtgctacacccaccccagcagcctgaggaagcacatgaaggtgcacggccgcagccccccacccagcagcggctatgacagcgccacccccagcgccctggtgagccccagcagtgactgtggccacaagagccaggtggccagcagcgctgctgtggccgccaggacagctgacctgtctgagtag

SEQ ID NO: 176306 - DNA, 690 bp, Artificial Sequence
  Description of Artificial Sequence: Synthetic coding sequence
atgagatacaagaccagcctggtgatgaggaagaggctgcggctgtacagaaacaccctgaaggagagcagcagcagcagcggccaccacggcccccagctgacagctgccagcagccccagcgtcttccctggcctgcacgaggagcccccccaggccagccccagccggcccctgaatggcctgctgcggctgggcctgcccggggacatgtatgcccggcctgagcccttccccccaggccctgctgcccggagtgatgccctggccgctgctgctgccctgcacggctacggcggcatgaacctgactgtgaacctggccgcccctcatggccctggggccttcttccgctacatgaggcagcccatcaagcaggagctgatctgcaagtggctggccgcagatggaacagccacccccagcctgtgcagcaagaccttcagcaccatgcatgagctggtgacccacgtgacagtggagcacgtgggcggccctgagcaggccaaccacatctgcttctgggaggagtgcccccggcagggcaagcccttcaaggccaagtacaagctggtgaaccacatccgggtgcacactggagagaagcccttcccctgccccttccctggctgcggcaaggtgtttgcccggtctgagaacctgaagatccacaagaggacccacacctag

SEQ ID NO: 176307 - DNA, 207 bp, Artificial Sequence
  Description of Artificial Sequence: Synthetic coding sequence
atgagatacaagaccagcctggtgatgaggaagaggctgcggctgtacagaaacaccctgaaggagagcagcagcagcagcggccaccacggcccccagctgacagctgccagcagccccagcgtcttccctggcctgcacgaggagcccccccaggccagccccagccggcccctgaatggcctgctgcggctgggcctgccctag

SEQ ID NO: 176308 - DNA, 1005 bp, Artificial Sequence; identical to SEQ ID NO: 176304
  Description of Artificial Sequence: Synthetic coding sequence

SEQ ID NO: 176309 - DNA, 1005 bp, Artificial Sequence; identical to SEQ ID NO: 176304
  Description of Artificial Sequence: Synthetic coding sequence

SEQ ID NO: 176310 - DNA, 234 bp, Artificial Sequence
  Description of Artificial Sequence: Synthetic coding sequence
atgagatacaagaccagcctggtgatgaggaagaggctgcggctgtacagaaacaccctgaaggagagcagcagcagcagcggccaccacggcccccagctgacagctgccagcagccccagcgtcttccctggcctgcacgaggagcccccccaggccagccccagccggcccctgaatggcctgctgcggctgggcctgcccggggacatgtatgcccggcctgagccctag

SEQ ID NO: 176311 - DNA, 1155 bp, Artificial Sequence
  Description of Artificial Sequence: Synthetic coding sequence
atgccacccttctgcagaaatgccaagctgggcctgctgtccttcctgatctgtgccggccgcagcctgctgcccctgggcaagaatgccttctggctggagagaattgagaacaacaacaccctgtgggagaaggcccagagccagaagatgagatacaagaccagcctggtgatgaggaagaggctgcggctgtacagaaacaccctgaaggagagcagcagcagcagcggccaccacggcccccagctgacagctgccagcagccccagcgtcttccctggcctgcacgaggagcccccccaggccagccccagccggcccctgaatggcctgctgcggctgggcctgcccggggacatgtatgcccggcctgagcccttccccccaggccctgctgcccggagtgatgccctggccgctgctgctgccctgcacggctacggcggcatgaacctgactgtgaacctggccgcccctcatggccctggggccttcttccgctacatgaggcagcccatcaagcaggagctgatctgcaagtggctggccgcagatggaacagccacccccagcctgtgcagcaagaccttcagcaccatgcatgagctggtgacccacgtgacagtggagcacgtgggcggccctgagcaggccaaccacatctgcttctgggaggagtgcccccggcagggcaagcccttcaaggccaagtacaagctggtgaaccacatccgggtgcacactggagagaagcccttcccctgccccttccctggctgcggcaaggtgtttgcccggtctgagaacctgaagatccacaagaggacccacactggagagaagcccttccgctgtgaatttgagggctgtgaaagaagatttgccaacagcagtgacaggaagaagcacagccacgtgcacaccagtgacaagccctacacctgcaaggtgcggggctgtgacaagtgctacacccaccccagcagcctgaggaagcacatgaaggtgcacggccgcagccccccacccagcagcggctatgacagcgccacccccagcgccctggtgagccccagcagtgactgtggccacaagagccaggtggccagcagcgctgctgtggccgccaggacagctgacctgtctgagtag

SEQ ID NO: 176312 - DNA, 684 bp, Artificial Sequence
  Description of Artificial Sequence: Synthetic coding sequence
atgggcggcaagcagagcacagctgcccggagccggggccccttccctggggtgtccacagatgattctgctgtgcccccacctgggggcgccccccacttcggccactacagaactggaggaggagccatgggcctgcggagccgctctgtgtcctctgtggccggcatgggcatggaccccagcacagctgggggcgtgcccttcggcctgtacaccccagccagccggggcactggagacagcgagcgggcccctgggggcggcggcagcgccagtgacagcacctacgcccatggaaatggctaccaggagaccggcggcggccaccacagagatggcatgctgtacctgggcagccgggccagcctggctgatgccctgcccctgcacatcgccccccgctggttcagcagccacagcggcttcaagtgccccatctgcagcaagtctgtggccagtgatgagatggagatgcacttcatcatgtgcctgagcaagccccggctgagctacaatgatgatgtgctgaccaaggatgctggagaatgtgtgatctgcctggaggagctgctgcagggcgacaccatcgcccggctgccctgcctgtgcatctaccacaagagctgcatcgacagctggtttgaggtgaacagaagctgcccagagcaccctgctgactag

SEQ ID NO: 176313 - DNA, 543 bp, Artificial Sequence
  Description of Artificial Sequence: Synthetic coding sequence
cagaggggcgtgcctgctgctggcacccccagcagcccccggctgctggtgagccgcagcctgggcggcgctgtgggctctgtggccagcggggcccgggccgcccagagccccttcagcatccccaacagcagcagcggcccctacggcagccaggacagcgtgcacagcagcccagaagatggcggcggcggccgggacaggcctgtgggcggcagccctgggggcccccggctggtgattggcagcctgcctgcccacctgagcccccacatgtttggaggcttcaagtgccctgtgtgcagcaagtttgtgtccagtgatgagatggacctgcacctggtgatgtgcctgaccaagccccgcatcacctacaatgaagatgtgctgagcaaggatgctggggagtgtgccatctgcctggaggagctgcagcagggcgacaccatcgcccggctgccctgcctgtgcatctaccacaagggctgcattgatgagtggtttgaggtgaacagaagctgcccagagcaccccagcgactag

SEQ ID NO: 176314 - DNA, 729 bp, Artificial Sequence
  Description of Artificial Sequence: Synthetic coding sequence
atgggcgccaagcagagcggccctgctgctgccaacggccgcacccgggcctacagcggcagtgacctgcccagcagcagcagcggcggggccaacggcacagctgggggcggcggcggggcccgggctgctgctgctggccgcttccctgcccaggtgcccagcgcccaccagcccagcgccagcggcggcgctgctgctgctgctgctgccccagctgccccagctgcccccaggagccgcagcctgggcggcgctgtgggctctgtggccagcggggcccgggccgcccagagccccttcagcatccccaacagcagcagcggcccctacggcagccaggacagcgtgcacagcagcccagaagatggcggcggcggccgggacaggcctgtgggcggcagccctgggggcccccggctggtgattggcagcctgcctgcccacctgagcccccacatgtttggaggcttcaagtgccctgtgtgcagcaagtttgtgtccagtgatgagatggacctgcacctggtgatgtgcctgaccaagccccgcatcacctacaatgaagatgtgctgagcaaggatgctggggagtgtgccatctgcctggaggagctgcagcagggcgacaccatcgcccggctgccctgcctgtgcatctaccacaagggctgcattgatgagtggtttgaggtgaacagaagctgcccagagcaccccagcgactag

SEQ ID NO: 176315 - DNA, 2511 bp, Artificial Sequence
  Description of Artificial Sequence: Synthetic coding sequence
atgcaccccctgggcctgtgcaacaacaatgatgaggaggacctgtatgaatatggctgggtgggcgtggtgaagctggagcagcctgagctggaccccaagccctgcctgactgtgctgggcaaggccaagagagctgtgcagagaggagccacagctgtgatctttgatgtgtctgagaaccctgaggccatcgaccagctgaaccagggcagcgaggaccccctgaagaggcctgtggtgtatgtgaagggagcagatgccatcaagctgatgaacatcgtgaacaagcagaaggtggcccgggcccgcatccagcacaggcctccccggcagcccacagagtactttgacatgggcatcttcctggccttctttgtggtggtgtccctggtgtgcctgatcctgctggtgaagatcaagctgaagcagaggaggagccagaacagcatgaaccggctggccgtgcaggccctggagaagatggagaccaggaagttcaacagcaagagcaagggccggcgggagggcagctgtggggccctggacaccctgagcagcagcagcaccagtgactgtgccatctgcctggagaagtacattgatggagaggagctgcgggtcatcccctgcacccaccgcttccacaggaaatgtgtggacccctggctgctgcagcaccacacctgcccccactgccgccacaacatcatcgagcagaagggcaaccccagcgctgtgtgtgtggagaccagcaacctgagccggggccggcagcagagggtgaccctgcctgtgcactacccaggccgggtgcacaggaccaatgccatcccagcctaccccaccaggacctccatggacagccacggcaaccctgtgaccctgctgaccatggacagacatggagagcagagcctgtacagcccccagaccccagcctacatccgcagctacccacccctgcacctggaccacagcctggccgcccaccgctgtggcctggagcaccgggcctacagccctgcccaccccttcagaagacccaagctgagcggccgctccttcagcaaggccgcctgcttcagccagtatgagaccatgtaccagcactactacttccagggcctgagctacccagagcaggagggccagagcccccccagcctggccccccggggccctgcccgggccttcccccccagcggcagcggcagcctgctcttccccaccgtggtgcacgtggccccacccagccacctggagagcggcagcaccagcagcttcagctgctaccacggccacaggtctgtgtgcagcggctacctggccgactgccccggcagtgacagcagcagcagcagcagcagcggccagtgccactgcagcagcagtgacagcgtggtggactgcacagaggtgagcaaccagggcgtgtatggcagctgcagcaccttccgcagcagcctgagcagtgactatgaccccttcatctaccgcagccgcagcccctgccgggccagcgaggccggcggcagcggcagcagcggccggggccctgccctgtgctttgagggcagccccccacctgaggagctgcctgctgtgcacagccatggagctggccgcggggagccctggccaggccctgccagccccagcggggaccaggtgtccacctgcagcctggagatgaactacagcagcaacagcagcctggagcaccggggccccaacagcagcaccagcgaggtgggcctggaggccagccctggagctgccccagacctgcggaggacctggaagggcggccacgagctgcccagctgtgcctgctgctgtgagccccagcccagccctgctggccccagcgctggagctgctggcagcagcaccctcttcctgggcccccacctgtatgagggcagcggccctgctggaggagagccccagagcggcagcagccagggcctgtatggcctgcacccagaccacctgcccaggacagatggagtgaagtatgagggcctgccctgctgcttctatgaggagaagcaggtggcccggggcggcggcggcggcagcggctgctacacagaggactacagcgtgtctgtgcagtacaccctgacagaggagcccccacctggctgctacccaggggcccgggacctgagccagaggatccccatcatcccagaagatgtggactgtgacctgggcctgcccagcgactgccagggcacccacagcctgggctcctggggcggcacccggggccctgacaccccccggccccaccggggcctgggcgccacccgggaggaggagcgggccctgtgctgccaggcccgggccctgctgcggcccggctgccccccagaggaggccggggctgtgcgggccaacttccccagcgccctgcaggacacccaggagagcagcaccacagccacagaagctgctggccccaggagccacagcgctgacagcagcagccctggggcctag

SEQ ID NO: 176316 - DNA, 2511 bp, Artificial Sequence; identical to SEQ ID NO: 176315
  Description of Artificial Sequence: Synthetic coding sequence

SEQ ID NO: 176317 - DNA, 2511 bp, Artificial Sequence; identical to SEQ ID NO: 176315
  Description of Artificial Sequence: Synthetic coding sequence

SEQ ID NO: 176318 - DNA, 1932 bp, Artificial Sequence
  Description of Artificial Sequence: Synthetic coding sequence
gtgcccagcgtgtggaggagcaccctgatggagaggagctgtggcagcagccctgtgctgaccggcttcaccggcagcgcctggacccccctgctgcagcaccacacctgcccccactgccgccacaacatcatcgagcagaagggcaaccccagcgctgtgtgtgtggagaccagcaacctgagccggggccggcagcagagggtgaccctgcctgtgcactacccaggccgggtgcacaggaccaatgccatcccagcctaccccaccaggacctccatggacagccacggcaaccctgtgaccctgctgaccatggacagacatggagagcagagcctgtacagcccccagaccccagcctacatccgcagctacccacccctgcacctggaccacagcctggccgcccaccgctgtggcctggagcaccgggcctacagccctgcccaccccttccggcggcccaagctgagcggccgctccttcagcaaggccgcctgcttcagccagtatgagaccatgtaccagcactactacttccagggcctgagctacccagagcaggagggccagagcccccccagcctggccccccggggccctgcccgggccttccccccatctggcagcggcagcctgctcttccccaccgtggtgcacgtggccccacccagccacctggagagcggcagcaccagcagcttcagctgctaccacggccacaggtctgtgtgcagcggctacctggccgactgccccggcagtgacagcagcagcagcagcagcagcggccagtgccactgcagcagcagtgacagcgtggtggactgcacagaggtgagcaaccagggcgtgtatggcagctgcagcaccttccgcagcagcctgagcagtgactatgaccccttcatctaccgcagccgcagcccctgccgggccagcgaggccggcggcagcggcagcagcggccggggccctgccctgtgctttgagggcagccccccacctgaggagctgcctgctgtgcacagccacggggccggccgcggggagccctggccaggccctgccagccccagcggggaccaggtgtccacctgcagcctggagatgaactacagcagcaacagcagcctggagcaccggggccccaacagcagcaccagcgaggtgggcctggaggccagccctggggccgccccagacctgcggaggacctggaagggcggccacgagctgcccagctgtgcctgctgctgtgagccccagcccagccctgctggccccagcgctggagctgctggcagcagcaccctcttcctgggcccccacctgtatgagggcagcggccctgctggaggagagccccagagcggcagcagccagggcctgtatggcctgcacccagaccacctgcccaggacagatggagtgaagtatgagggcctgccctgctgcttctatgaggagaagcaggtggcccggggcggcggcggcggcagcggctgctacacagaggactacagcgtgtctgtgcagtacaccctgacagaggagcccccacctggctgctacccaggggcccgggacctgagccagaggatccccatcatcccagaagatgtggactgtgacctgggcctgcccagcgactgccagggcacccacagcctgggctcctggggcggcacccggggccctgacaccccccggccccaccggggcctgggcgccacccgggaggaggagcgggccctgtgctgccaggcccgggccctgctgcggcccggctgccccccagaggaggccggggctgtgcgggccaacttccccagcgccctgcaggacacccaggagagcagcaccacagccacagaggccgccggccccaggagccacagcgctgacagcagcagccctggggcctag

SEQ ID NO: 176319 - DNA, 2811 bp, Artificial Sequence
  Description of Artificial Sequence: Synthetic coding sequence
atgaggcccaggtctgggggccggcctggggccaccggcagaagaagaagaaggctgcggcggcggccccggggcctgcgctgcagccggctgcccccacctccacccctgcccctgctgctgggcctgctgctggccgccgccggccctggggccgcccgggccaaggagacagcctttgtggaggtggtgctgtttgagagcagccccagcggggactacaccacctacaccaccggcctgaccggccgcttcagccgggccggggccaccctgtctgctgagggggagatcgtgcagatgcaccccctgggcctgtgcaacaacaatgatgaggaggacctgtatgaatatggctgggtgggcgtggtgaagctggagcagcctgagctggaccccaagccctgcctgactgtgctgggcaaggccaagagagctgtgcagagaggagccacagctgtgatctttgatgtgtctgagaaccctgaggccatcgaccagctgaaccagggcagcgaggaccccctgaagaggcctgtggtgtatgtgaagggagcagatgccatcaagctgatgaacatcgtgaacaagcagaaggtggcccgggcccgcatccagcacaggcctccccggcagcccacagagtactttgacatgggcatcttcctggccttctttgtggtggtgtccctggtgtgcctgatcctgctggtgaagatcaagctgaagcagaggaggagccagaacagcatgaaccggctggccgtgcaggccctggagaagatggagaccaggaagttcaacagcaagagcaagggccggcgggagggcagctgtggggccctggacaccctgagcagcagcagcaccagtgactgtgccatctgcctggagaagtacattgatggagaggagctgcgggtcatcccctgcacccaccgcttccacaggaaatgtgtggacccctggctgctgcagcaccacacctgcccccactgccgccacaacatcatcgagcagaagggcaaccccagcgctgtgtgtgtggagaccagcaacctgagccggggccggcagcagagggtgaccctgcctgtgcactacccaggccgggtgcacaggaccaatgccatcccagcctaccccaccaggacctccatggacagccacggcaaccctgtgaccctgctgaccatggacagacatggagagcagagcctgtacagcccccagaccccagcctacatccgcagctacccacccctgcacctggaccacagcctggccgcccaccgctgtggcctggagcaccgggcctacagccctgcccaccccttcagaagacccaagctgagcggccgctccttcagcaaggccgcctgcttcagccagtatgagaccatgtaccagcactactacttccagggcctgagctacccagagcaggagggccagagcccccccagcctggccccccggggccctgcccgggccttcccccccagcggcagcggcagcctgctcttccccaccgtggtgcacgtggccccacccagccacctggagagcggcagcaccagcagcttcagctgctaccacggccacaggtctgtgtgcagcggctacctggccgactgccccggcagtgacagcagcagcagcagcagcagcggccagtgccactgcagcagcagtgacagcgtggtggactgcacagaggtgagcaaccagggcgtgtatggcagctgcagcaccttccgcagcagcctgagcagtgactatgaccccttcatctaccgcagccgcagcccctgccgggccagcgaggccggcggcagcggcagcagcggccggggccctgccctgtgctttgagggcagccccccacctgaggagctgcctgctgtgcacagccatggagctggccgcggggagccctggccaggccctgccagccccagcggggaccaggtgtccacctgcagcctggagatgaactacagcagcaacagcagcctggagcaccggggccccaacagcagcaccagcgaggtgggcctggaggccagccctggagctgccccagacctgcggaggacctggaagggcggccacgagctgcccagctgtgcctgctgctgtgagccccagcccagccctgctggccccagcgctggagctgctggcagcagcaccctcttcctgggcccccacctgtatgagggcagcggccctgctggaggagagccccagagcggcagcagccagggcctgtatggcctgcacccagaccacctgcccaggacagatggagtgaagtatgagggcctgccctgctgcttctatgaggagaagcaggtggcccggggcggcggcggcggcagcggctgctacacagaggactacagcgtgtctgtgcagtacaccctgacagaggagcccccacctggctgctacccaggggcccgggacctgagccagaggatccccatcatcccagaagatgtggactgtgacctgggcctgcccagcgactgccagggcacccacagcctgggctcctggggcggcacccggggccctgacaccccccggccccaccggggcctgggcgccacccgggaggaggagcgggccctgtgctgccaggcccgggccctgctgcggcccggctgccccccagaggaggccggggctgtgcgggccaacttccccagcgccctgcaggacacccaggagagcagcaccacagccacagaagctgctggccccaggagccacagcgctgacagcagcagccctggggcctag

SEQ ID NO: 176320 - DNA, 339 bp, Artificial Sequence
  Description of Artificial Sequence: Synthetic coding sequence
atgagctaccctgtgaccagccagccccagtgtgccaccaccagctgctaccagacccagctgagtgactggcacacaggcctgacagactgctgcaatgacatgcctgtgtgcctgtgtggcacctttgcccccctgtgcctggcctgccgcatcagtgatgactttggagagtgctgctgtgccccctacctgcccggcggcctgcacagcatcagaacaggcatgagggagcgctaccacatccagggctctgtgggccatgactgggccgccctgaccttctgcctgccctgtgccctgtgccagatggcccgggagctgaagatccgggagtag

SEQ ID NO: 176321 - DNA, 1440 bp, Artificial Sequence
  Description of Artificial Sequence: Synthetic coding sequence
atggccgccctggagaagatgaccttccccaagaagatgaccttccctgagaagcccagccacaagaagtaccgggccgccctgaagaaggagaagaggaagaagaggcggcaggagctggcccggctgcgggacagcggcctgagccaggaggaggaggaggacaccttcatcgaggagcagcagctggaggaggagaagctgctggagcgggagcgggagcggctgcacgaggagtggctgctgcgggagcagaaggcccaggaggagttccgcatcaagaaggagaaggaggaggccgccaagaagtggctggaggagcaggagaggaagctgaaggagcagtggaaggagcagcagaggaaggagcgggaggaggaggagcagaagcagcaggagaagaaggagaaggaggaggccgtgcagaagatgctggaccaggctgaaaatgacctggagaacagcaccacctggcagaaccctgagccccctgtggacttccgggtgatggagaaggaccgggccaactgccccttctacagcaagacaggagcctgccgctttggagaccgctgcagcaggaagcacaacttccccaccagcagccccaccctgctgatcaagtccatgttcaccaccttcggcatggagcagtgcagaagagatgattatgaccctgatgccagcctggagtacagcgaggaggagacctaccagcagttcctggacttctatgaagatgtgctgcctgagttcaagaatgtgggcaaggtgatccagttcaaggtgtcctgcaacctggagccccacctgcggggaaatgtgtatgtgcagtaccagagcgaggaggagtgccaggccgccctgagcctcttcaacggccgctggtacgccggccggcagctgcagtgtgagttctgccctgtgacccgctggaagatggccatctgtggcctgtttgagatccagcagtgcccccggggcaagcactgcaacttcctgcacgtgttcaggaaccccaacaatgagttctgggaggccaacagagacatctacctgagcagtgaccagacaggcagcagctttgggaagaacagcgagcggcgggagaagatgggccaccacgaccactactacagccggcagagaggaagaagaaaccccagcccagaccacacctacaagagaaatggagagagcgagaggaagaagagcagccaccggggcaagaagagccacaagaggaccagcaagagccgggagcggcacaacagccccagccggggcaggaacagacaccgctcctgggaccagggccgccgcagccagagcagaagaagccacaggagccgcagccagagcagcagccgctgccgcagccggggccgcaggaagagcggcaacagagacagaacagtgcagagcccccagagcaagtag

SEQ ID NO: 176322 - DNA, 1449 bp, Artificial Sequence
  Description of Artificial Sequence: Synthetic coding sequence
atggccgcccctgagaagatgaccttccctgagaagcccagccacaagaagtaccgggccgccctgaagaaggagaagaggaagaagaggcggcaggagctggcccggctgcgggacagcggcctgagccagaaggaggaggaggaggacaccttcatcgaggagcagcagctggaggaggagaagctgctggagcgggagcggcagaggctgcacgaggagtggctgctgcgggagcagaaggcccaggaggagttccgcatcaagaaggagaaggaggaggccgccaagaagaggcaggaggagcaggagaggaagctgaaggagcagtgggaggagcagcagaggaaggagcgggaggaggaggagcagaagaggcaggagaagaaggagaaggaggaggccctgcagaagatgctggaccaggccgagaatgagctggagaatggcaccacctggcagaaccctgagccccctgtggacttccgggtgatggagaaggaccgggccaactgccccttctacagcaagacaggagcctgccgctttggagaccgctgcagcaggaagcacaacttccccaccagcagccccaccctgctgatcaagtccatgttcaccaccttcggcatggagcagtgcagaagagatgattatgaccctgatgccagcctggagtacagcgaggaggagacctaccagcagttcctggacttctatgaagatgtgctgcctgagttcaagaatgtgggcaaggtgatccagttcaaggtgtcctgcaacctggagccccacctgcggggaaatgtgtatgtgcagtaccagagcgaggaggagtgccaggccgccctgagcctcttcaacggccgctggtacgccggccggcagctgcagtgtgagttctgccctgtgacccgctggaagatggccatctgtggcctgtttgagatccagcagtgcccccggggcaagcactgcaacttcctgcacgtgttcaggaaccccaacaatgagttctgggaggccaacagagacatctacctgagcccagacagaacaggcagcagctttgggaagaacagcgagcggcgggagaggatgggccaccatgatgactactacagccggctgcggggcagaagaaaccccagcccagaccacagctacaagagaaatggagagagcgagaggaagagcagccgccaccggggcaagaagagccacaagaggaccagcaagagccgggagcggcacaacagccgcagccggggcaggaacagagacaggagccgggacaggagccggggccggggcagccgcagccgcagccgcagccgcagccgccgcagcagaagaagccgcagccagagcagcagccgcagccgcagccggggcagaagaagaagtggcaacagagacagaacagtgcagagccccaagagcaagtag

SEQ ID NO: 176323 - DNA, 444 bp, Artificial Sequence
  Description of Artificial Sequence: Synthetic coding sequence
atggccgcccctgagaagatgaccttccctgagaagcccagccacaagaagtaccgggccgccctgaagaaggagaagaggaagaagaggcggcaggagctggcccggctgcgggacagcggcctgagccagaaggaggaggaggaggacaccttcatcgaggagcagcagctggaggaggagaagctgctggagcgggagcggctggagtgcagcggggtcatcagcgcccacaggaacctgcacctgcccggcagccatgacagccctgccagcgccagccgggtggccggcatcaccggcacccaccgccacacccagctgatcttcttctgcaccttcagcagagatggagtgagcccctgctggccaggctggagccgcagcctggacctgatgatctgccccccccggccccacaaggtgctgcggctgcaggtgtag

SEQ ID NO: 176324 - DNA, 3438 bp, Artificial Sequence
  Description of Artificial Sequence: Synthetic coding sequence
atgtgcaagtgctgcaacctcttcagccccaaccagagcgagctgctgagccacgtgtctgagaagcacatggaggagggcgtgaatgtggatgagatcatcatccccctgcggcccctgagcaccccagagccccccaacagcagcaagacaggagatgagttcctggtgatgaagaggaagaggggccggcccaagggcagcaccaagaagagcagcacagaggaggagctggccgagaacatcgtgagccccacagaggacagccccctggcccctgaggagggcaacagcctgccccccagcagcctggagtgcagcaagtgctgcaggaagttcagcaacacccggcagctgaggaagcacatctgcatcatcgtgctgaacctgggggaggaggagggggaggccggaaatgaaagtgacctggagctggagaagaagtgcaaggaggatgaccgggagaaggccagcaagaggcccaggagccagaagacagagaaggtgcagaagatcagcggcaaggaggcccggcagctgagcggggccaagaagcccatcatctctgtggtgctgacagcccacgaggccatccctggggccaccaagatcgtgcctgtggaggccggccccccagagaccggggccaccaacagcgagaccaccagcgctgacctggtgccccggcggggctaccaggagtatgccatccagcagaccccctatgagcagcccatgaagagcagccggctgggccccacccagctgaagatcttcacctgtgagtactgcaacaaggtgttcaagttcaagcacagcctgcaggcccacctgcgcatccacaccaatgagaagccctacaagtgcccccagtgcagctatgccagcgccatcaaggccaacctgaatgtgcacctgaggaagcacactggagagaagtttgcctgtgactactgcagcttcacctgcctgagcaagggccacctgaaggtgcacatcgagcgggtgcacaagaagatcaagcagcactgccgcttctgcaagaagaagtacagtgatgtgaagaacctgatcaagcacatcagagatgcccatgacccccaggacaagaaggtgaaggaggccctggatgagctgtgcctgatgacccgggagggcaagaggcagctgctgtatgactgccacatctgtgagaggaagttcaagaatgagctggaccgggacagacacatgctggtgcacggggacaagtggccctttgcctgtgagctgtgtggccatggagccaccaagtaccaggccctggagctgcacgtgaggaagcacccctttgtgtatgtgtgtgctgtgtgcaggaagaagtttgtgagcagcatccggctgcggacccacatcaaggaggtgcatggagctgcccaggaggccctggtgttcaccagcagcatcaaccagagcttctgcctgctggagcctggaggagacatccagcaggaggccctgggggaccagctgcagctggtggaggaggagtttgccctgcagggcgtgaatgccctgaaggaggaggcctgccctggggacacccagctggaggagggcaggaaggagcctgaggcccctggagagatgcctgccccagctgtgcacctggccagcccccaggccgagagcacagccctgcccccctgtgagctggagaccaccgtggtgagcagcagtgacctgcacagccaggaggtggtgtctgatgacttcctgctgaagaatgacaccagcagcgctgaggcccacgccgcccctgagaagcccccagacatgcagcacaggagctctgtgcagacccagggcgaggtgatcaccctgctgctgagcaaggcccagagcgctggcagtgaccaggagagccacggggcccagagccccctgggggagggccagaacatggctgtgctgtctgctggggaccctgaccccagccgctgcctgcggagcaacccagctgaggccagtgacctgctgccccctgtggccggcggcggggacaccatcacccaccagcctgacagctgcaaggccgcccctgagcacaggagcggcatcacagccttcatgaaggtgctgaacagcctgcagaagaagcagatgaacaccagcctgtgtgagcgcatcaggaaggtgtatggagacctggagtgtgagtactgcggcaagctgttctggtaccaggtgcactttgacatgcacgtgaggacccacacccgggagcacctgtactactgcagccagtgccactacagcagcatcaccaagaactgcctgaagagacatgtgatccagaagcacagcaacatcctgctgaagtgccccacagatggctgtgactacagcaccccagacaagtacaagctgcaggcccacctgaaggtgcacacagccctggacaagaggagctacagctgccctgtgtgtgagaagagcttctctgaagatagactcatcaagagccacatcaagaccaaccaccctgaggtgtccatgagcaccatcagcgaggtgctgggcagaagagtgcagctgaagggcctgattggcaagagggccatgaagtgcccctactgtgacttctacttcatgaagaatggaagtgacctgcagaggcacatctgggcccatgaaggagtgaagcccttcaagtgcagcctgtgtgaatatgccaccaggagcaagagcaacctgaaggcccacatgaacagacacagcacagagaagacccacctgtgtgacatgtgtgggaagaagttcaagagcaagggcaccctgaagagccacaagctgctgcacacagcagatggcaagcagttcaagtgcaccgtgtgtgactacacagctgcccagaagccccagctgctgcggcacatggagcagcacgtgtccttcaagcccttccgctgtgcccactgccactacagctgcaacatcagcggcagcctgaagaggcactacaacaggaagcaccccaatgaggagtatgccaacgtgggcactggagagctggccgctgaggtgctgatccagcagggcggcctgaagtgccctgtgtgcagctttgtgtatggcaccaagtgggagttcaacagacacctgaagaacaagcacggcctgaaggtggtggagattgatggagaccccaagtgggaggtgacagaggaggagcccagcagcaaccacacagtgatgatccaggagaccgtgcagcaggcctctgtggagctggccgagcagcaccacctggtggtgtccagtgatgatgtggagggcattgaaacagtgacagtgtacacccagggcggggaggccagcgagttcatcgtgtatgtgcaggaggccatgcagcctgtggaggagcaggccgtggagcagcctgcccaggagctgtag

SEQ ID NO: 176325 - DNA, 3546 bp, Artificial Sequence
  Description of Artificial Sequence: Synthetic coding sequence
atggagaccagggctgctgaaaatacagccatcttcatgtgcaagtgctgcaacctcttcagccccaaccagagcgagctgctgagccacgtgtctgagaagcacatggaggagggcgtgaatgtggatgagatcatcatccccctgcggcccctgagcaccccagagccccccaacagcagcaagacaggagatgagttcctggtgatgaagaggaagaggggccggcccaagggcagcaccaagaagagcagcacagaggaggagctggccgagaacatcgtgagccccacagaggacagccccctggcccctgaggagggcaacagcctgccccccagcagcctggagtgcagcaagtgctgcaggaagttcagcaacacccggcagctgaggaagcacatctgcatcatcgtgctgaacctgggggaggaggagggggaggccggggccaccaagatcgtgcctgtggaggccggccccccagagaccggggccaccaacagcgagaccaccagcgctgacctggtgccccggcggggctaccaggagtatgccatccagcagaccccctatgagcagcccatgaagagcagccggctgggccccacccagctgaagatcttcacctgtgagtactgcaacaaggtgttcaagttcaagcacagcctgcaggcccacctgcgcatccacaccaatgagaagccctacaagtgcccccagtgcagctatgccagcgccatcaaggccaacctgaatgtgcacctgaggaagcacactggagagaagtttgcctgtgactactgcagcttcacctgcctgagcaagggccacctgaaggtgcacatcgagcgggtgcacaagaagatcaagcagcactgccgcttctgcaagaagaagtacagtgatgtgaagaacctgatcaagcacatcagagatgcccatgacccccaggacaagaaggtgaaggaggccctggatgagctgtgcctgatgacccgggagggcaagaggcagctgctgtatgactgccacatctgtgagaggaagttcaagaatgagctggaccgggacagacacatgctggtgcacggggacaagtggccctttgcctgtgagctgtgtggccatggagccaccaagtaccaggccctggagctgcacgtgaggaagcacccctttgtgtatgtgtgtgctgtgtgcaggaagaagtttgtgagcagcatccggctgcggacccacatcaaggaggtgcatggagctgcccaggaggccctggtgttcaccagcagcatcaaccagagcttctgcctgctggagcctggaggagacatccagcaggaggccctgggggaccagctgcagctggtggaggaggagtttgccctgcagggcgtgaatgccctgaaggaggaggcctgccctggggacacccagctggaggagggcaggaaggagcctgaggcccctggagagatgcctgccccagctgtgcacctggccagcccccaggccgagagcacagccctgcccccctgtgagctggagaccaccgtggtgagcagcagtgacctgcacagccaggaggtggtgtctgatgacttcctgctgaagaatgacaccagcagcgctgaggcccacgccgcccctgagaagcccccagacatgcagcacaggagctctgtgcagacccagggcgaggtgatcaccctgctgctgagcaaggcccagagcgctggcagtgaccaggagagccacggggcccagagccccctgggggagggccagaacatggctgtgctgtctgctggggaccctgaccccagccgctgcctgcggagcaacccagctgaggccagtgacctgctgccccctgtggccggcggcggggacaccatcacccaccagcctgacagctgcaaggccgcccctgagcacaggagcggcatcacagccttcatgaaggtgctgaacagcctgcagaagaagcagatgaacaccagcctgtgtgagcgcatcaggaaggtgtatggagacctggagtgtgagtactgcggcaagctgttctggtaccaggtgcactttgacatgcacgtgaggacccacacccgggagcacctgtactactgcagccagtgccactacagcagcatcaccaagaactgcctgaagagacatgtgatccagaagcacagcaacatcctgctgaagtgccccacagatggctgtgactacagcaccccagacaagtacaagctgcaggcccacctgaaggtgcacacagccctggacaagaggagctacagctgccctgtgtgtgagaagagcttctctgaagatagactcatcaagagccacatcaagaccaaccaccctgaggtgtccatgagcaccatcagcgaggtgctgggcagaagagtgcagctgaagggcctgattggcaagagggccatgaagtgcccctactgtgacttctacttcatgaagaatggaagtgacctgcagaggcacatctgggcccatgaaggagtgaagcccttcaagtgcagcctgtgtgaatatgccaccaggagcaagagcaacctgaaggcccacatgaacagacacagcacagagaagacccacctgtgtgacatgtgtgggaagaagttcaagagcaagggcaccctgaagagccacaagctgctgcacacagcagatggcaagcagttcaagtgcaccgtgtgtgactacacagctgcccagaagccccagctgctgcggcacatggagcagcacgtgtccttcaagcccttccgctgtgcccactgccactacagctgcaacatcagcggcagcctgaagaggcactacaacaggaagcaccccaatgaggagtatgccaacgtgggcactggagagctggccgctgaggtgctgatccagcagggcggcctgaagtgccctgtgtgcagctttgtgtatggcaccaagtgggagttcaacagacacctgaagaacaagcacggcctgaaggtggtggagattgatggagaccccaagtgggagacagccacagaggcccctgaggagcccagcacccagtacctgcacatcacagaagcagaagaagatgtgcagggcacccaggccgctgtggccgccctgcaggacctgcgctacaccagcgagagcggggaccggctggaccccacagctgtgaacatcctgcagcagatcatcgagctgggcgctgagacccatgatgccacagccctggcctctgtggtggccatggcccctggcaccgtgacagtggtgaagcaggtgacagaggaggagcccagcagcaaccacacagtgatgatccaggagaccgtgcagcaggcctctgtggagctggccgagcagcaccacctggtggtgtccagtgatgatgtggagggcattgaaacagtgacagtgtacacccagggcggggaggccagcgagttcatcgtgtatgtgcaggaggccatgcagcctgtggaggagcaggccgtggagcagcctgcccaggagctgtag

SEQ ID NO: 176326 - DNA, 177 bp, Artificial Sequence
  Description of Artificial Sequence: Synthetic coding sequence
atggagaccagggctgctggcctgctggagtttgctgggggccccctgcacaccctgtttgcctgggtgtcccctgtggaggccgctgagcagcagaggctgctgcctgtgcctgccagcggcagctttgtgcctgagggccacctgcctgatgccagccagagcagccctgtgtag

SEQ ID NO: 176327 - DNA, 1653 bp, Artificial Sequence
  Description of Artificial Sequence: Synthetic coding sequence
atggacctgaccaagatgggcatgatccagctgcagaaccccagccaccccaccggcctgctgtgcaaggccaaccagatgaggctggccggcaccctgtgtgatgtggtgatcatggtggacagccaggagttccacgcccacaggacagtgctggcctgcaccagcaagatgtttgagatcctcttccacaggaacagccagcactacaccctggacttcctgagccccaagaccttccagcagatcctggagtatgcctacacagccaccctgcaggccaaggccgaggacctggatgacctgctgtatgctgctgagatcctggagattgagtacctggaggagcagtgcctgaagatgctggagaccatccaggccagtgatgacaatgacacagaggccaccatggctgatggaggagctgaggaggaggaggacaggaaggcccgctacctgaagaacatcttcatcagcaagcacagcagcgaggagagcggctacgcctctgtggccggccagagcctgcccggccccatggtggaccagagccccagcgtgtccaccagctttggcctgagcgccatgagccccaccaaggctgctgtggacagcctgatgaccatcggccagagcctgctgcagggcaccctgcagcccccagctggccctgaggagcccaccctggccggcggcggccgccaccctggggtggccgaggtgaagacagagatgatgcaggtggatgaggtgcccagccagggcttcatccagcgggagctgttcagcaagctgggggagctggccgtgggcatgaagtctgagagcaggaccatcggggagcagtgcagcgtgtgtggggtggagctgcctgacaatgaagctgtggagcagcacaggaagctgcacagcggcatgaagacctacggctgtgagctgtgtgggaagcgcttcctggacagcctgcggctgaggatgcacctgctggcccacagcgctggggccaaggcctttgtgtgtgaccagtgtggggcccagttcagcaaggaggatgccctggagacccaccggcagacccacactggaacagacatggctgtgttctgcctgctgtgtgggaagcgcttccaggcccagagcgccctgcagcagcacatggaggtgcacgccggcgtgcgcagctacatctgcagcgagtgcaacagaaccttccccagccacacagccctgaagaggcacctgcggagccacactggagaccacccctatgaatgtgagttctgtggcagctgcttcagagatgagagcaccctgaagagccacaagaggatccacactggagagaagccctatgagtgcaatggctgtgggaagaagttcagcctgaagcaccagctggagacccactacagagtgcacactggagagaagccctttgagtgcaagctgtgccaccagaggagccgggactacagcgccatgatcaagcacctgcggacccacaacggggccagcccctaccagtgcaccatctgcacagagtactgccccagcctgagctccatgcagaagcacatgaagggccacaagccagaggagatccccccagactggagaattgagaagacctacctgtacctgtgctacgtgtag

SEQ ID NO: 176328 - DNA, 2022 bp, Artificial Sequence
  Description of Artificial Sequence: Synthetic coding sequence
atggacctgaccaagatgggcatgatccagctgcagaaccccagccaccccaccggcctgctgtgcaaggccaaccagatgaggctggccggcaccctgtgtgatgtggtgatcatggtggacagccaggagttccacgcccacaggacagtgctggcctgcaccagcaagatgtttgagatcctcttccacaggaacagccagcactacaccctggacttcctgagccccaagaccttccagcagatcctggagtatgcctacacagccaccctgcaggccaaggccgaggacctggatgacctgctgtatgctgctgagatcctggagattgagtacctggaggagcagtgcctgaagatgctggagaccatccaggccagtgatgacaatgacacagaggccaccatggctgatggaggagctgaggaggaggaggacaggaaggcccgctacctgaagaacatcttcatcagcaagcacagcagcgaggagagcggctacgcctctgtggccggccagagcctgcccggccccatggtggaccagagccccagcgtgtccaccagctttggcctgagcgccatgagccccaccaaggctgctgtggacagcctgatgaccatcggccagagcctgctgcagggcaccctgcagcccccagctggccctgaggagcccaccctggccggcggcggccgccaccctggggtggccgaggtgaagacagagatgatgcaggtggatgaggtgcccagccaggacagccctggagctgctgagagcagcatcagcggcggcatgggagacaaggtggaggagcggggcaaggagggccctggcacccccaccaggagcagcgtcatcaccagcgcccgggagctgcactacggccgggaggagagcgctgagcaggtgcccccacctgctgaggccggccaggcccccaccggccggcctgagcacccagcccctcctcctgagaagcacctgggcatctacagcgtgctgcccaaccacaaggcagatgctgtgctgtccatgcccagctctgtgaccagcggcctgcacgtgcagcctgccctggccgtgtccatggacttcagcacctatggaggcctgctgccccagggcttcatccagcgggagctgttcagcaagctgggggagctggccgtgggcatgaagtctgagagcaggaccatcggggagcagtgcagcgtgtgtggggtggagctgcctgacaatgaggccgtggagcagcacaggaagctgcacagcggcatgaagacctacggctgtgagctgtgtgggaagcgcttcctggacagcctgcggctgaggatgcacctgctggcccacagcgctggggccaaggcctttgtgtgtgaccagtgtggggcccagttcagcaaagaagatgccctggagacccaccggcagacccacactggaacagacatggctgtgttctgcctgctgtgtgggaagcgcttccaggcccagagcgccctgcagcagcacatggaggtgcatgctggggtgcgcagctacatctgcagcgagtgcaacagaaccttccccagccacacagccctgaagaggcacctgcggagccacactggagaccacccctatgaatgtgagttctgtggcagctgcttcagagatgagagcaccctgaagagccacaagaggatccacactggagagaagccctatgaatgtaatggctgcggcaagaagttcagcctgaagcaccagctggagacccactacagagtgcacactggagagaagccctttgagtgcaagctgtgccaccagaggagccgggactacagcgccatgatcaagcacctgcggacccacaatggagccagcccctaccagtgcaccatctgcacagagtactgccccagcctgagctccatgcagaagcacatgaagggccacaagccagaggagatccccccagactggagaattgagaagacctacctgtacctgtgctacgtgtag

SEQ ID NO: 176329 - DNA, 2022 bp, Artificial Sequence; identical to SEQ ID NO: 176328
  Description of Artificial Sequence: Synthetic coding sequence

SEQ ID NO: 176330 - DNA, 447 bp, Artificial Sequence
  Description of Artificial Sequence: Synthetic coding sequence
atggacctgaccaagatgggcatgatccagctgcagaaccccagccaccccaccggcctgctgtgcaaggccaaccagatgaggctggccggcaccctgtgtgatgtggtgatcatggtggacagccaggagttccacgcccacaggacagtgctggcctgcaccagcaagatgtttgagatcctcttccacaggaacagccagcactacaccctggacttcctgagccccaagaccttccagcagatcctggagtatgcctacacagccaccctgcaggccaaggccgaggacctggatgacctgctgtatgctgctgagatcctggagattgagtacctggaggagcagtgcctgaagatgctggagaccatccaggccagtgatgacaatgacacagaggccaccatggctgatggaggagctgaggaggaggaggacagatag

SEQ ID NO: 176331 - DNA, 348 bp, Artificial Sequence
  Description of Artificial Sequence: Synthetic coding sequence
atggacctgaccaagatgggcatgatccagctgcagaaccccagccaccccaccggcctgctgtgcaaggccaaccagatgaggctggccggcaccctgtgtgatgtggtgatcatggtggacagccaggagttccacgcccacaggacagtgctggcctgcaccagcaagatgtttgagatcctcttccacaggaacagccagcactacaccctggacttcctgagccccaagaccttccagcagatcctggagtatgcctacacagccaccctgcaggccaaggccgaggacctggatgacctgctgtatgctgctgagatcctggagattgagtacctggagtag

SEQ ID NO: 176332 - DNA, 723 bp, Artificial Sequence
  Description of Artificial Sequence: Synthetic coding sequence
gaggccctgcctgtgcggctgctgcggcccctgctgctgcggccccacttccaggatgcccctcctggggaccccaggcatggccagggcgcccaggtgcccaccctgcggcaggaggtgcagcccggcaacctgaagaggcacctgcgcatccacagcggggagaagccctacgtgtgcatccactgccagaggcagtttgctgaccccggggccctgcagagacatgtgcgcatccacactggagagaagccctgccagtgtgtgatgtgtgggaaggccttcacccaggccagcagcctcatcgcccacgtgcggcagcacactggagagaagccctacgtgtgtgagcgctgtgggaagagatttgtgcagagcagccagctggccaaccacatccgccaccacgacaacatccggccccacaagtgcagcgtgtgcagcaaggcctttgtgaatgtgggggacctgagcaagcacatcatcatccacactggagagaagccctacctgtgtgacaagtgtggccggggcttcaacagagtggacaacctgcggagccacgtgaagacagtgcaccagggcaaggccggcatcaagatcctggagcctgaggagggcagcgaggtgtctgtggtgacagtggatgacatggtgaccctggccacagaggccctggccgccacagctgtgacccagctgactgtggtgcctgtgggctag

SEQ ID NO: 176333 - DNA, 2433 bp, Artificial Sequence
  Description of Artificial Sequence: Synthetic coding sequence
atggacttcccccagcacagccagcacgtgctggagcagctgaaccagcagaggcagctgggcctgctgtgtgactgcacctttgtggtggatggagtgcacttcaaggcccacaaggctgtgctggccgcctgcagcgagtacttcaagatgctgtttgtggaccagaaggatgtggtgcacctggacatcagcaatgctgctggcctgggccaggtgctggagttcatgtacacagccaagctgagcctgagcccagaaaatgtggatgatgtgctggccgtggccaccttcctgcagatgcaggacatcatcacagcctgccacgccctgaagagcctggccgagcccgccaccagccctggaggaaatgctgaggccctggccacagagggcggggacaagagggccaaggaggagaaggtggccaccagcaccctgagccggctggagcaggccggccgcagcacccccatcggccccagccgggacctgaaggaggagcggggcggccaggcccagagcgctgccagcggggctgagcagacagagaaggcagatgccccccgggagcccccacctgtggagctgaagccagaccccaccagcggcatggctgctgctgaggccgaggccgccctgtctgagagcagcgagcaggagatggaggtggagcccgccaggaaaggagaggaggagcagaaggagcaggaggagcaggaggaggagggcgccggccctgctgaggtgaaggaggagggcagccagctggagaatggagaggccccagaagaaaatgaaaatgaggagagcgctggaacagacagcggccaggagctgggcagcgaggcccggggcctgcggagcggcacctacggggacagaacagagagcaaggcctacggcagcgtcatccacaagtgtgaggactgtgggaaggagttcacccacacaggcaacttcaagaggcacatccgcatccacactggagagaagcccttcagctgccgggagtgcagcaaggccttcagtgaccctgctgcctgcaaggcccacgagaagacccacagccccctgaagccctacggctgtgaggagtgtgggaagagctaccgcctcatcagcctgctgaacctgcacaagaagaggcacagcggggaggcccgctaccgctgtgaggactgtgggaagctgttcaccaccagcggcaacctgaagaggcaccagctggtgcacagcggggagaagccctaccagtgtgactactgcggccgctccttcagtgaccccaccagcaagatgaggcacctggagacccatgacacagacaaggagcacaagtgcccccactgtgacaagaagttcaaccaggtgggcaacctgaaggcccacctgaagatccacatcgcagatggccccctgaagtgccgggagtgtgggaagcagttcaccaccagcggcaacctgaagaggcacctgcgcatccacagcggggagaagccctacgtgtgcatccactgccagaggcagtttgctgaccccggggccctgcagagacatgtgcgcatccacactggagagaagccctgccagtgtgtgatgtgtgggaaggccttcacccaggccagcagcctcatcgcccacgtgcggcagcacactggagagaagccctacgtgtgtgagcgctgtgggaagagatttgtgcagagcagccagctggccaaccacatccgccaccacgacaacatccggccccacaagtgcagcgtgtgcagcaaggcctttgtgaatgtgggggacctgagcaagcacatcatcatccacactggagagaagccctacctgtgtgacaagtgtggccggggcttcaacagagtggacaacctgcggagccacgtgaagacagtgcaccagggcaaggccggcatcaagatcctggagcctgaggagggcagcgaggtgtctgtggtgacagtggatgacatggtgaccctggccacagaggccctggccgccacagctgtgacccagctgactggacctgccaccctgcctgctgtggtgcctgtgggcgctgctgtgacagcagatgaaacagaggtgctgaaggccgagatcagcaaggctgtgaagcaggtgcaggaggaggaccccaacacccacatcctgtatgcctgtgacagctgtggggacaagttcctggatgccaacagcctggcccagcacgtgcgcatccacacagcccaggccctggtgatgttccagacagatgctgacttctaccagcagtatggccctgggggcacctggccagctggccaggtgctgcaggccggggagctggtgttccggcccagagatggagctgagggccagcctgccctggccgagaccagccccacagcccctgagtgccccccacctgctgagtag

SEQ ID NO: 176334 - DNA, 2412 bp, Artificial Sequence
  Description of Artificial Sequence: Synthetic coding sequence
atggacttcccccagcacagccagcacgtgctggagcagctgaaccagcagaggcagctgggcctgctgtgtgactgcacctttgtggtggatggagtgcacttcaaggcccacaaggctgtgctggccgcctgcagcgagtacttcaagatgctgtttgtggaccagaaggatgtggtgcacctggacatcagcaatgctgctggcctgggccaggtgctggagttcatgtacacagccaagctgagcctgagcccagaaaatgtggatgatgtgctggccgtggccaccttcctgcagatgcaggacatcatcacagcctgccacgccctgaagagcctggccgagcccgccaccagccctggaggaaatgctgaggccctggccacagagggcggggacaagagggccaaggaggagaaggtggccaccagcaccctgagccggctggagcaggccggccgcagcacccccatcggccccagccgggacctgaaggaggagcggggcggccaggcccagagcgctgccagcggggctgagcagacagagaaggcagatgccccccgggagcccccacctgtggagctgaagccagaccccaccagcggcatggctgctgctgaggccgaggccgccctgtctgagagcagcgagcaggagatggaggtggagcccgccaggaaaggagaggaggagcagaaggagcaggaggagcaggaggaggagggcgccggccctgctgaggtgaaggaggagggcagccagctggagaatggagaggccccagaagaaaatgaaaatgaggagagcgctggaacagacagcggccaggagctgggcagcgaggcccggggcctgcggagcggcacctacggggacagaacagagagcaaggcctacggcagcgtcatccacaagtgtgaggactgtgggaaggagttcacccacacaggcaacttcaagaggcacatccgcatccacactggagagaagcccttcagctgccgggagtgcagcaaggccttcagtgaccctgctgcctgcaaggcccacgagaagacccacagccccctgaagccctacggctgtgaggagtgtgggaagagctaccgcctcatcagcctgctgaacctgcacaagaagaggcacagcggggaggcccgctaccgctgtgaggactgtgggaagctgttcaccaccagcggcaacctgaagaggcaccagctggtgcacagcggggagaagccctaccagtgtgactactgcggccgctccttcagtgaccccaccagcaagatgaggcacctggagacccatgacacagacaaggagcacaagtgcccccactgtgacaagaagttcaaccaggtgggcaacctgaaggcccacctgaagatccacatcgcagatggccccctgaagtgccgggagtgtgggaagcagttcaccaccagcggcaacctgaagaggcacctgcgcatccacagcggggagaagccctacgtgtgcatccactgccagaggcagtttgctgaccccggggccctgcagagacatgtgcgcatccacactggagagaagccctgccagtgtgtgatgtgtgggaaggccttcacccaggccagcagcctcatcgcccacgtgcggcagcacactggagagaagccctacgtgtgtgagcgctgtgggaagagatttgtgcagagcagccagctggccaaccacatccgccaccacgacaacatccggccccacaagtgcagcgtgtgcagcaaggcctttgtgaatgtgggggacctgagcaagcacatcatcatccacactggagagaagccctacctgtgtgacaagtgtggccggggcttcaacagagtggacaacctgcggagccacgtgaagacagtgcaccagggcaaggccggcatcaagatcctggagcctgaggagggcagcgaggtgtctgtggtgacagtggatgacatggtgaccctggccacagaggccctggccgccacagctgtgacccagctgactgtggtgcctgtgggcgctgctgtgacagcagatgaaacagaggtgctgaaggccgagatcagcaaggctgtgaagcaggtgcaggaggaggaccccaacacccacatcctgtatgcctgtgacagctgtggggacaagttcctggatgccaacagcctggcccagcacgtgcgcatccacacagcccaggccctggtgatgttccagacagatgctgacttctaccagcagtatggccctgggggcacctggccagctggccaggtgctgcaggccggggagctggtgttccggcccagagatggagctgagggccagcctgccctggccgagaccagccccacagccccagaatgtcctcctcctgctgagtag

SEQ ID NO: 176335 - DNA, 633 bp, Artificial Sequence
  Description of Artificial Sequence: Synthetic coding sequence
tgaagcaagcacatcatcatccacactggagagaagccctacctgtgtgacaagtgtggccggggcttcaacagagtggacaacctgcggagccacgtgaagacagtgcaccagggcaaggccggcatcaagatcctggagcctgaggagggcagcgaggtgtctgtggtgacagtggatgacatggtgaccctggccacagaggccctggccgccacagctgtgacccagctgactggacctgccaccctgcctgctgtggtgcctgtgggcgctgctgtgacagcagatgaaacagaggtgctgaaggccgagatcagcaaggctgtgaagcaggtgcaggaggaggaccccaacacccacatcctgtatgcctgtgacagctgtggggacaagttcctggatgccaacagcctggcccagcacgtgcgcatccacacagcccaggccctggtgatgttccagacagatgctgacttctaccagcagtatggccctgggggcacctggccagctggccaggtgctgcaggccggggagctggtgttccggcccagagatggagctgagggccagcctgccctggccgagaccagccccacagcccctgagtgccccccacctgctgagtag

SEQ ID NO: 176336 - DNA, 726 bp, Artificial Sequence
  Description of Artificial Sequence: Synthetic coding sequence
tgagaagccctgcctgtgcggctgctgcggcccctgctgctgcggccccacttccaggatgcccctcctggggaccccaggcatggccagggcgcccaggtgcccaccctgcggcaggaggtgcagcccggcaacctgaagaggcacctgcgcatccacagcggggagaagccctacgtgtgcatccactgccagaggcagtttgctgaccccggggccctgcagagacatgtgcgcatccacactggagagaagccctgccagtgtgtgatgtgtgggaaggccttcacccaggccagcagcctgattgcccacgtgcggcagcacactggagagaagccctacgtgtgtgagcgctgtgggaagagatttgtgcagagcagccagctggccaaccacatccgccaccacgacaacatccggccccacaagtgcagcgtgtgcagcaaggcctttgtgaatgtgggggacctgagcaagcacatcatcatccacactggagagaagccctacctgtgtgacaagtgtggccggggcttcaacagagtggacaacctgcggagccacgtgaagacagtgcaccagggcaaggccggcatcaagatcctggagcctgaggagggcagcgaggtgtctgtggtgacagtggatgacatggtgaccctggccacagaggccctggccgccacagctgtgacccagctgactgtggtgcctgtgggctag

SEQ ID NO: 176337 - DNA, 2169 bp, Artificial Sequence
  Description of Artificial Sequence: Synthetic coding sequence
atggacttcccccagcacagccagcacgtgctggagcagctgaaccagcagaggcagctgggcctgctgtgtgactgcacctttgtggtggatggagtgcacttcaaggcccacaaggctgtgctggccgcctgcagcgagtacttcaagatgctgtttgtggaccagaaggatgtggtgcacctggacatcagcaatgctgctggcctgggccaggtgctggagttcatgtacacagccaagctgagcctgagcccagaaaatgtggatgatgtgctggccgtggcccctggagctgagcagacagagaaggcagatgccccccgggagcccccacctgtggagctgaagccagaccccaccagcggcatggctgctgctgaggccgaggccgccctgtctgagagcagcgagcaggagatggaggtggagcccgccaggaagggggaggaggagcagaaggagcaggaggagcaggaggaggagggcgccggccctgctgaggtgaaggaggagggcagccagctggagaatggagaggcccctgaggagaatgaaaatgaggagagcgctggaacagattctggccaggagctgggcagcgaggcccggggcctgcggagcggcacctatggagacagaacagagagcaaggcctacggcagcgtcatccacaagtgtgaggactgtgggaaggagttcacccacactggaaacttcaagaggcacatccgcatccacactggagagaagcccttcagctgcagagaatgttccaaggccttcagtgaccctgctgcctgcaaggcccacgagaagacccacagccccctgaagccctacggctgtgaagaatgtgggaagagctaccgcctcatcagcctgctgaacctgcacaagaagaggcacagcggggaggcccgctaccgctgtgaggactgtgggaagctgttcaccaccagcggcaacctgaagaggcaccagctggtgcacagcggggagaagccctaccagtgtgactactgcggccgctccttcagtgaccccaccagcaagatgaggcacctggagacccatgacacagacaaggagcacaagtgcccccactgtgacaagaagttcaaccaggtgggcaacctgaaggcccacctgaagatccacatcgcagatggccccctgaagtgcagagaatgtgggaagcagttcaccaccagcggcaacctgaagaggcacctgcgcatccacagcggggagaagccctacgtgtgcatccactgccagaggcagtttgctgaccccggggccctgcagagacatgtgcgcatccacactggagagaagccctgccagtgtgtgatgtgtgggaaggccttcacccaggccagcagcctgattgcccacgtgcggcagcacactggagagaagccctacgtgtgtgagcgctgtgggaagagatttgtgcagagcagccagctggccaaccacatccgccaccacgacaacatccggccccacaagtgcagcgtgtgcagcaaggcctttgtgaatgtgggggacctgagcaagcacatcatcatccacactggagagaagccctacctgtgtgacaagtgtggccggggcttcaacagagtggacaacctgcggagccacgtgaagacagtgcaccagggcaaggccggcatcaagatcctggagcctgaggagggcagcgaggtgtctgtggtgacagtggatgacatggtgaccctggccacagaggccctggccgccacagctgtgacccagctgactgtggtgcctgtgggcgctgctgtgacagcagatgaaacagaggtgctgaaggccgagatcagcaaggctgtgaagcaggtgcaggaggaggaccccaacacccacatcctgtatgcctgtgacagctgtggggacaagttcctggatgccaacagcctggcccagcacgtgcgcatccacacagcccaggccctggtgatgttccagacagatgctgacttctaccagcagtatggccctgggggcacctggccagctggccaggtgctgcaggccggggagctggtgttccggcccagagatggagctgagggccagcctgccctggccgagaccagccccacagcccctgagtgccccccacctgctgagtag

SEQ ID NO: 176338 - DNA, 1530 bp, Artificial Sequence
  Description of Artificial Sequence: Synthetic coding sequence
atggacttcccccagcacagccagcacgtgctggagcagctgaaccagcagaggcagctgggcctgctgtgtgactgcacctttgtggtggatggagtgcacttcaaggcccacaaggctgtgctggccgcctgcagcgagtacttcaagatgctgtttgtggaccagaaggatgtggtgcacctggacatcagcaatgctgctggaggagacaagagggccaaggaggagaaggtggccaccagcaccctgagccggctggagcaggccggccgcagcacccccatcggccccagccgggacctgaaggaggagcggggcggccaggcccagagcgctgccagcggggctgagcagacagagaaggcagatgccccccgggagcccccacctgtggagctgaagccagaccccaccagcggcatggctgctgctgaggccgaggccgccctgtctgagagcagcgagcaggagatggaggtggagcccgccaggaagggggaggaggagcagaaggagcaggaggagcaggaggaggagggcgccggccctgctgaggtgaaggaggagggcagccagctggagaatggagaggcccctgaggagaatgaaaatgaggagagcgctggaacagattctggccaggagctgggcagcgaggcccggggcctgcggagcggcacctatggagacagaacagagagcaaggcctacggcagcgtcatccacaagtgtgaggactgtgggaaggagttcacccacactggaaacttcaagaggcacatccgcatccacactggagagaagcccttcagctgcagagaatgttccaaggccttcagtgaccctgctgcctgcaaggcccacgagaagacccacagccccctgaagccctacggctgtgaagaatgtgggaagagctaccgcctcatcagcctgctgaacctgcacaagaagaggcacagcggggaggcccgctaccgctgtgaggactgtgggaagctgttcaccaccagcggcaacctgaagaggcaccagctggtgcacagcggggagaagccctaccagtgtgactactgcggccgctccttcagtgaccccaccagcaagatgaggcacctggagacccatgacacagacaaggagcacaagtgcccccactgtgacaagaagttcaaccaggtgtgtggccccctgcctgagcccgcccctggcagccgccgctggccccagccccacgcctgccacgtggtgggccgggccggcagcacagccccagccagccgcagcagcagcgcctgcagccccaggaagcaggcccagcgggagcccctgccccggggcagcagccggctgctgtgtggcggccaggccgacagcggccggggcctggtgctgaagaagtggggcggggccgcctacctgagccccctgggccctggcaccagcccagaccccggggagattgagcccttcacagatcctgggaagccagagagccagctgttcctgtgtggccggggccgctag

SEQ ID NO: 176339 - DNA, 2166 bp, Artificial Sequence
  Description of Artificial Sequence: Synthetic coding sequence
atgatgtgctggccctggcccctgagcagcaaatgtaggaccagcagcaggcctgccatgcccagcagccacctgctgagccggctgcctgccctgggggagatgaggcggccctggccccagaaggtgtgccctgtgcccagccctggaggagacaagagggccaaggaggagaaggtggccaccagcaccctgagccggctggagcaggccggccgcagcacccccatcggccccagccgggacctgaaggaggagcggggcggccaggcccagagcgctgccagcggggctgagcagacagagaaggcagatgccccccgggagcccccacctgtggagctgaagccagaccccaccagcggcatggctgctgctgaggccgaggccgccctgtctgagagcagcgagcaggagatggaggtggagcccgccaggaaaggagaggaggagcagaaggagcaggaggagcaggaggaggagggcgccggccctgctgaggtgaaggaggagggcagccagctggagaatggagaggccccagaagaaaatgaaaatgaggagagcgctggaacagacagcggccaggagctgggcagcgaggcccggggcctgcggagcggcacctacggggacagaacagagagcaaggcctacggcagcgtcatccacaagtgtgaggactgtgggaaggagttcacccacacaggcaacttcaagaggcacatccgcatccacactggagagaagcccttcagctgccgggagtgcagcaaggccttcagtgaccctgctgcctgcaaggcccacgagaagacccacagccccctgaagccctacggctgtgaggagtgtgggaagagctaccgcctcatcagcctgctgaacctgcacaagaagaggcacagcggggaggcccgctaccgctgtgaggactgtgggaagctgttcaccaccagcggcaacctgaagaggcaccagctggtgcacagcggggagaagccctaccagtgtgactactgcggccgctccttcagtgaccccaccagcaagatgaggcacctggagacccatgacacagacaaggagcacaagtgcccccactgtgacaagaagttcaaccaggtgggcaacctgaaggcccacctgaagatccacatcgcagatggccccctgaagtgccgggagtgtgggaagcagttcaccaccagcggcaacctgaagaggcacctgcgcatccacagcggggagaagccctacgtgtgcatccactgccagaggcagtttgctgaccccggggccctgcagagacatgtgcgcatccacactggagagaagccctgccagtgtgtgatgtgtgggaaggccttcacccaggccagcagcctcatcgcccacgtgcggcagcacactggagagaagccctacgtgtgtgagcgctgtgggaagagatttgtgcagagcagccagctggccaaccacatccgccaccacgacaacatccggccccacaagtgcagcgtgtgcagcaaggcctttgtgaatgtgggggacctgagcaagcacatcatcatccacactggagagaagccctacctgtgtgacaagtgtggccggggcttcaacagagtggacaacctgcggagccacgtgaagacagtgcaccagggcaaggccggcatcaagatcctggagcctgaggagggcagcgaggtgtctgtggtgacagtggatgacatggtgaccctggccacagaggccctggccgccacagctgtgacccagctgactgtggtgcctgtgggcgctgctgtgacagcagatgaaacagaggtgctgaaggccgagatcagcaaggctgtgaagcaggtgcaggaggaggaccccaacacccacatcctgtatgcctgtgacagctgtggggacaagttcctggatgccaacagcctggcccagcacgtgcgcatccacacagcccaggccctggtgatgttccagacagatgctgacttctaccagcagtatggccctgggggcacctggccagctggccaggtgctgcaggccggggagctggtgttccggcccagagatggagctgagggccagcctgccctggccgagaccagccccacagccccagaatgtcctcctcctgctgagtag

SEQ ID NO: 176340 - DNA, 2007 bp, Artificial Sequence
  Description of Artificial Sequence: Synthetic coding sequence
atgacagagcgcatccacagcatcaacctgcacaacttcagcaacagcgtgctggagaccctgaatgagcagaggaacagaggccacttctgtgatgtgacagtgcgcatccacggctccatgctgcgggcccaccgctgtgtgctggccgccggcagccccttcttccaggacaagctgctgctgggctacagcgacatcgagatccccagcgtggtgtctgtgcagagcgtgcagaagctgattgacttcatgtacagcggcgtgctgcgggtgtcccagagcgaggccctgcagatcctgacagctgccagcatcctgcagatcaagacagtgattgatgaatgtaccagaattgtgtcccagaatgtgggagatgtgtttcctggcatccaggacagcggccaggacaccccccggggcaccccagagagcggcaccagcggccagagcagtgacacagagagcggctacctgcagagccacccccagcacagcgtggaccgcatctacagcgccctgtatgcctgcagcatgcagaatggaagtggagagaggagcttctacagcggggctgtggtgagccaccatgaaacagccctgggcctgccccgggaccaccacatggaggaccccagctggatcacccgcatccacgagaggagccagcagatggagcgctacctgagcaccaccccagagaccacccactgcaggaagcagcccaggcctgtgcgcatccagaccctggtgggcaacatccacatcaagcaggagatggaggatgattatgactactacggccagcagagggtgcagatcctggagagaaatgaaagtgaggagtgcacagaggacacagaccaggccgagggcacagaaagtgagcccaagggggagagctttgacagcggcgtgagcagcagcatcggcacagagccagacagcgtggagcagcagtttggacctggagctgcccgggacagccaggccgagcccacccagcctgagcaggccgctgaggccccagctgagggcggcccccagaccaaccagctggagactggagccagcagccctgagaggagcaatgaggtggagatggacagcaccgtcatcaccgtgagcaacagcagtgacaagtctgtgctgcagcagcccagcgtgaacaccagcatcggccagcccctgcccagcacccagctgtacctgcggcagacagagaccctgaccagcaacctgaggatgcccctgaccctgaccagcaacacccaggtgattggaacagctggcaacacctacctgcctgccctcttcaccacccagcctgctggcagcggccccaagcccttcctgttcagcctgccccagcccctggccggccagcagacccagtttgtgacagtgtcccagcccggcctgagcaccttcaccgcccagctgcctgccccccagcccctggccagcagcgctggccacagcacagccagcggccagggcgagaagaagccctatgagtgcaccctgtgcaacaagaccttcaccgccaagcagaactacgtgaagcacatgtttgtgcacactggagagaagccccaccagtgcagcatctgctggaggagcttcagcctgaaggactacctgatcaagcacatggtgacccacactggagtgcgggcctaccagtgcagcatctgcaacaagcgcttcacccagaagagcagcctgaatgtgcacatgaggctgcacagaggagagaagagctatgagtgctacatctgcaagaagaagttcagccacaagaccctgctggagagacatgtggccctgcacagcgccagcaatggcaccccacctgctggcaccccacctggggcccgggccggccccccaggagtggtggcctgcacagagggcaccacctacgtgtgcagcgtgtgcccagccaagtttgaccagatcgagcagttcaatgaccacatgaggatgcacgtgtctgatggatag

SEQ ID NO: 176341 - DNA, 2007 bp, Artificial Sequence; identical to SEQ ID NO: 176340
  Description of Artificial Sequence: Synthetic coding sequence

SEQ ID NO: 176342 - DNA, 2007 bp, Artificial Sequence; identical to SEQ ID NO: 176340
  Description of Artificial Sequence: Synthetic coding sequence

SEQ ID NO: 176343 - DNA, 2007 bp, Artificial Sequence; identical to SEQ ID NO: 176340
  Description of Artificial Sequence: Synthetic coding sequence

SEQ ID NO: 176344 - DNA, 174 bp, Artificial Sequence
  Description of Artificial Sequence: Synthetic coding sequence
atgacagagcgcatccacagcatcaacctgcacaacttcagcaacagcgtgctggagaccctgaatgagcagaggaacagaggccacttctgtgatgtgacagtgcgcatccacggctccatgctgcgggcccaccgctgtgtgctggccgccggcagccccttcttccagtag

SEQ ID NO: 176345 - DNA, 2007 bp, Artificial Sequence; identical to SEQ ID NO: 176340
  Description of Artificial Sequence: Synthetic coding sequence

SEQ ID NO: 176346 - DNA, 2226 bp, Artificial Sequence
  Description of Artificial Sequence: Synthetic coding sequence
atgctggagaggaagaagcccaagacagctgagaaccagaaggccagcgaggagaatgagatcacccagcccggcggcagcagcgccaagccaggcctgccctgcctgaactttgaggccgtgctgagcccagaccctgccctgatccacagcacccacagcctgaccaacagccacgcccacacaggcagcagtgactgtgacatcagctgcaagggcatgacagagcgcatccacagcatcaacctgcacaacttcagcaacagcgtgctggagaccctgaatgagcagaggaacagaggccacttctgtgatgtgacagtgcgcatccacggctccatgctgcgggcccaccgctgtgtgctggccgccggcagccccttcttccaggacaagctgctgctgggctacagcgacatcgagatccccagcgtggtgtctgtgcagagcgtgcagaagctgattgacttcatgtacagcggcgtgctgcgggtgtcccagagcgaggccctgcagatcctgacagctgccagcatcctgcagatcaagacagtgattgatgagtgcacccgcatcgtgtcccagaatgtgggagatgtgtttcctggcatccaggacagcggccaggacaccccccggggcaccccagagagcggcaccagcggccagagcagtgacacagaaagtggctacctgcagagccacccccagcacagcgtggaccgcatctacagcgccctgtatgcctgcagcatgcagaatggcagcggggagaggagcttctacagcggggctgtggtgagccaccacgagacagccctgggcctgccccgggaccaccacatggaggaccccagctggatcacccgcatccacgagaggagccagcagatggagcgctacctgagcaccaccccagagaccacccactgcaggaagcagcccaggcctgtgcgcatccagaccctggtgggcaacatccacatcaagcaggagatggaggatgattatgactactacggccagcagagggtgcagatcctggagagaaatgaaagtgaagaatgtacagaggacacagaccaggccgagggcacagagagcgagcccaagggggagagctttgattctggagtgagcagcagcattggaacagagccagattctgtggagcagcagtttggacctggggccgcccgggacagccaggccgagcccacccagcctgagcaggccgctgaggccccagctgagggcggcccccagaccaaccagctggagaccggggccagcagccctgagaggagcaatgaggtggagatggacagcaccgtcatcaccgtgagcaacagcagtgacaagtctgtgctgcagcagcccagcgtgaacaccagcatcggccagcccctgcccagcacccagctgtacctgcggcagacagagaccctgaccagcaacctgaggatgcccctgaccctgaccagcaacacccaggtgattggaacagctggcaacacctacctgcctgccctcttcaccacccagcctgctggcagcggccccaagcccttcctgttcagcctgccccagcccctggccggccagcagacccagtttgtgacagtgtcccagcccggcctgagcaccttcaccgcccagctgcctgccccccagcccctggccagcagcgctggccacagcacagccagcggccagggcgagaagaagccctatgaatgtaccctgtgcaacaagaccttcaccgccaagcagaactacgtgaagcacatgtttgtgcacactggagagaagccccaccagtgcagcatctgctggaggagcttcagcctgaaggactacctgatcaagcacatggtgacccacactggagtgcgggcctaccagtgcagcatctgcaacaagcgcttcacccagaagagcagcctgaatgtgcacatgaggctgcacagaggagagaagagctatgagtgctacatctgcaagaagaagttcagccacaagaccctgctggagcggcacgtggccctgcacagcgccagcaatggcaccccacctgctggcaccccacctggggcccgggccggccccccaggagtggtggcctgcacagagggcaccacctacgtgtgcagcgtgtgcccagccaagtttgaccagatcgagcagttcaatgaccacatgaggatgcacgtgtctgatggatag

SEQ ID NO: 176347 - DNA, 2007 bp, Artificial Sequence; identical to SEQ ID NO: 176340
  Description of Artificial Sequence: Synthetic coding sequence

SEQ ID NO: 176348 - DNA, 60 bp, Artificial Sequence
  Description of Artificial Sequence: Synthetic coding sequence
atgctggagaggaagaagcccaagacagctgagaaccagaaggccagcgaggagaactag

SEQ ID NO: 176349 - DNA, 489 bp, Artificial Sequence
  Description of Artificial Sequence: Synthetic coding sequence
atggccgagaccgtggccgacaccaggaggctcatcaccaagccccagaacctgaatgatgcctacggcccccccagcaacttcctggagattgatgtgagcaacccccagacagtgggcgtgggccggggccgcttcaccacctatgagatccgggtgaagaccaacctgcccatcttcaagctgaaggagagcacagtgagaagacgctacagcgactttgagtggctgcggtctgagctggagcgggagagcaaggtggtggtgccccccctgcccgggaaggccttcctgcggcagctgcccttcagaggagatgatggcatctttgatgacaacttcatcgaggagaggaagcagggcctggagcagttcatcaacaaggtggccggccaccccctggcccagaatgaacgctgcctgcacatgttcctgcaggatgagatcatcgacaagagctacacccccagcaagatcagacatgcctag

SEQ ID NO: 176350 - DNA, 1308 bp, Artificial Sequence
  Description of Artificial Sequence: Synthetic coding sequence
atggacacagccagccacagcctggtgctgctgcagcagctgaacatgcagcgggagtttggcttcctgtgtgactgcaccgtggccatcggagatgtgtacttcaaggcccacagagctgtgctggccgccttcagcaactacttcaagatgatcttcatccaccagaccagcgagtgcatcaagatccagcccacagacatccagcctgacatcttctcctacctgctgcacatcatgtacaccgggaagggccccaagcagatcgtggaccacagccggctggaggagggcatccgcttcctgcacgccgactacctgagccacatcgccacagagatgaaccaggtgttcagccctgagaccgtgcagagcagcaacctgtatggcatccagatcagcaccacccagaagacagtggtgaagcagggcctggaggtgaaggaggcccccagcagcaacagcggcaacagagctgctgtgcagggcgaccacccccagctgcagctgagcctggccatcggcctggatgatggaacagctgaccagcagagggcctgcccagccacccaggccctggaggagcaccagaagccccctgtgtccatcaagcaggagcgctgtgaccctgagagcgtcatcagccagagccaccccagccccagcagcgaggtgacaggccccaccttcacagagaacagcgtgaagatccacctgtgccactactgtggggagagatttgacagccgcagcaacctgcggcagcacctgcacacccacgtgtctggcagcctgccctttggagtgcctgccagcatcctggagagcaatgacctgggggaggtgcaccccctgaatgaaaattctgaggccctggagtgccggcggctgagcagcttcatcgtgaaggaaaatgagcagcagcctgaccacaccaacagaggcaccacagagcccctgcagatcagccaggtgtccctcatcagcaaggacacagagcctgtggagctgaactgcaacttctccttcagcaggaagaggaagatgagctgcaccatctgtggccacaagttccccaggaagagccagctgctggagcacatgtacacccacaagggcaagagctaccgctacaaccgctgccagagatttggaaatgccctggcccagcgcttccagccctactgtgacagctggagcgatgtgtccctgaagagcagccggctgagccaggagcacctggacctgccctgtgccctggagagcgagctgacccaggagaatgtggacaccatcctggtggagtag

SEQ ID NO: 176351 - DNA, 1308 bp, Artificial Sequence; identical to SEQ ID NO: 176350
  Description of Artificial Sequence: Synthetic coding sequence

SEQ ID NO: 176352 - DNA, 1464 bp, Artificial Sequence
  Description of Artificial Sequence: Synthetic coding sequence
atgagcctgccccccatccggctgcccagcccctacggcagtgaccggctggtgcagctggccgcccggctgcggcctgccctgtgtgacaccctcatcaccgtgggcagccaggagttccctgcccacagcctggtgctggccggcgtgtcccagcagctgggccggcggggccagtgggccctgggggagggcatcagccccagcacctttgcccagctgctgaactttgtgtatggagagagcgtggagctgcagcctggagagctgcggcccctgcaggaggccgcccgggccctgggcgtgcagagcctggaggaggcctgctggagggcccggggggaccgggccaagaagccagaccccggcctgaagaagcaccaggaggagcctgagaagcccagcaggaaccctgagcgggagctgggggaccctggagagaagcagaagccagagcaggtgtccaggactggaggccgggagcaggagatgctgcacaagcacagccccccccggggccggcctgagatggccggggccacccaggaggcccagcaggagcagaccaggagcaaggagaagaggctgcaggcccctgtgggccagagaggagcagatggcaagcatggagtgctgacctggctgagagaaaatcctgggggcagcgaggagagcctgaggaagctgcccggccccctgcccccagctggcagcctgcagacctctgtgaccccccggcccagctgggccgaggccccctggctggtgggcggccagcctgccctgtggagcatcctgctgatgccacccaggtatggcatccccttctaccacagcacccccaccactggagcctggcaggaggtgtggagggagcagaggatccccctgagcctgaatgcccccaagggcctgtggagccagaaccagctggccagcagcagccccaccccaggcagcctgccccagggccctgcccagctgagccctggagagatggaggagagtgaccagggccacactggagccctggccacctgtgccggccacgaggacaaggccggctgccccccccggccccaccccccaccagcccccccagcccggagccggccctatgcctgcagcgtgtgtgggaagcgcttcagcctgaagcaccagatggagacccactacagagtgcacactggagagaagcccttcagctgcagcctgtgcccccagaggagccgggacttcagcgccatgaccaagcacctgcggacccatggagctgccccctaccgctgcagcctgtgtggggccggctgccccagcctggcctccatgcaggcccacatgaggggccacagccccagccagctgcccccaggctggaccatccgcagcaccttcctgtacagcagcagccggcccagccggcccagcaccagcccctgctgccccagcagcagcaccacctag

SEQ ID NO: 176353 - DNA, 1464 bp, Artificial Sequence; identical to SEQ ID NO: 176352
  Description of Artificial Sequence: Synthetic coding sequence

SEQ ID NO: 176354 - DNA, 2019 bp, Artificial Sequence
  Description of Artificial Sequence: Synthetic coding sequence
atggagagcaggaagctgatcagcgccacagacatccagtacagcggcagcctgctgaacagcctgaatgagcagaggggccacggcctcttctgtgatgtgacagtgattgtggaggacaggaagttccgggcccacaagaacatcctgagcgccagcagcacctacttccaccagctgttctctgtggccggccaggtggtggagctgtccttcatccgggcagagatctttgctgagatcctgaactacatctacagcagcaagatcgtgcgggtgcggagtgacctgctggatgagctgatcaagagcggccagctgctgggcgtgaagttcatcgccgagctgggcgtgcccctgagccaggtgaagagcatctctggaacagcccaggacggcaacacagagcccctgcccccagacagcggggacaagaacctggtgatccagaagagcaaggatgaggcccaggacaatggagccaccatcatgcccatcatcacagagagcttcagcctgtctgctgaggactatgagatgaagaagatcatcgtgacagacagtgatgatgatgatgatgatgtgatcttctgcagcgagatcctgcccaccaaggagaccctgcccagcaacaacacagtggcccaggtgcagagcaaccctggccctgtggccatcagtgatgtggcccccagcgccagcaacaacagcccccccctgaccaacatcacccccacccagaagctgcccacccctgtgaaccaggccaccctgagccagacccagggcagcgagaagctgctggtgtcctctgcccccacccacctgacccccaacatcatcctgctgaaccagacccccctgagcaccccaccaaatgtgagcagcagcctgcccaaccacatgcccagcagcatcaacctgctggtgcagaaccagcagacccccaacagcgccatcctgaccggcaacaaggccaatgaggaggaggaggaggagatcattgatgatgatgatgacaccatcagcagcagcccagacagcgctgtgagcaacaccagcctggtgccccaggccgacaccagccagaacaccagctttgatggcagcctcatccagaagatgcagatccccaccctgctgcaggagcccctgagcaacagcctgaagatcagtgacatcatcaccaggaacaccaatgaccccggggtgggcagcaagcacctgatggagggccagaagatcatcaccctggacacagccacagaaattgagggcctgagcacaggctgcaaggtgtatgccaacattggagaggacacctatgacatcgtcatccctgtgaaggatgatcctgatgaaggagaggcccggctggagaatgagatccccaagaccagcggcagcgagatggccaacaagaggatgaaggtgaagcatgatgaccactatgagctgattgtggatggccgggtgtactacatctgcatcgtgtgcaagaggagctatgtgtgcctgaccagcctgcggcggcacttcaacatccacagctgggagaagaagtacccctgccgctactgtgagaaggtgttccccctggccgagtaccgcaccaagcatgagatccaccacactggagagcggcgctaccagtgcctggcctgtgggaagagcttcatcaactaccagttcatgagcagccacatcaagtctgtgcacagccaggaccccagcggggacagcaagctgtaccgcctgcacccctgccgcagcctgcagatccggcagtatgcctacctgagtgacaggagcagcaccatcccagccatgaaggatgatggcatcggctacaaggtggacaccgggaaggagccccctgtgggcaccaccaccagcacccagaacaagcccatgacctgggaggacatcttcatccagcaggagaatgacagcatcttcaagcagaatgtgacagatggcagcacagaatttgagttcatcatccctgagagctactag

SEQ ID NO: 176355 - DNA, 2019 bp, Artificial Sequence; identical to SEQ ID NO: 176354
  Description of Artificial Sequence: Synthetic coding sequence

SEQ ID NO: 176356 - DNA, 2019 bp, Artificial Sequence; identical to SEQ ID NO: 176354
  Description of Artificial Sequence: Synthetic coding sequence

SEQ ID NO: 176357 - DNA, 1515 bp, Artificial Sequence
  Description of Artificial Sequence: Synthetic coding sequence
atgtctgtggagatggacagcagcagcttcatccagtttgatgtgcctgagtacagcagcacagtgctgagccagctgaatgagctgcggctgcagggcaagctgtgtgacatcatcgtgcacatccagggccagcccttccgggcccacaaggctgtgctggccgccagcagcccctacttccgggaccacagcgccctgagcaccatgagcggcctgagcatcagcgtcatcaagaaccccaacgtgtttgagcagctgctgtccttctgctacacaggccgcatgagcctgcagctgaaggatgtggtgtccttcctgacagctgccagcttcctgcagatgcagtgtgtgattgacaagtgcacccagatcctggagagcatccacagcaagatctctgtgggagatgtggacagcgtgacagtgggcgcagaagaaaatcctgagagcagaaatggagtgaaggacagcagcttctttgccaaccctgtggagatcagccccccctactgcagccagggccggcagcccacagccagcagtgacctgaggatggagaccacccccagcaaggccctgcggagccggctgcaggaggagggccacagcgaccggggcagcagcggctctgtgtctgaatatgagatccagattgaaggagaccacgagcagggcgacctgctggtgcgggagagccagatcacagaggtgaaggtgaagatggagaagagtgaccggcccagctgcagcgacagcagcagcctgggagatgatggctaccacacagagatggtggatggagagcaggtggtggccgtgaatgtgggcagctatggctctgtgctgcagcacgcctacagctacagccaggccgccagccagcccaccaacgtgtctgaggccttcggcagcctgagcaacagcagccccagccgctccatgctgagctgcttccggggcggccgggcccggcagaagagggccctgtctgtgcacctgcacagcgacctgcagggcctggtgcagggcagtgacagcgaggccatgatgaacaaccctggctatgagagcagcccccgggagaggtctgcccggggccactggtacccctacaatgaaagactcatctgcatctactgcggcaagagcttcaaccagaagggcagcctggacagacacatgaggctgcacatgggcatcaccccatttgtgtgcaagttctgtgggaagaagtacaccaggaaggaccagctggagtaccacatccggggccacacagatgacaagcccttccgctgtgagatctgtgggaagtgcttccccttccagggcaccctgaaccagcacctgaggaagaaccaccctggggtggccgaggtgcgcagcagaattgagagccctgagaggacagatgtgtatgtggagcagaagctggagaatgatgccagcgccagcgagatgggcctggacagcaggatggagatccacacagtgtctgatgccccagactag

SEQ ID NO: 176358 - DNA, 1503 bp, Artificial Sequence
  Description of Artificial Sequence: Synthetic coding sequence
atggacagcagcagcttcatccagtttgatgtgcctgagtacagcagcacagtgctgagccagctgaatgagctgcggctgcagggcaagctgtgtgacatcatcgtgcacatccagggccagcccttccgggcccacaaggctgtgctggccgccagcagcccctacttccgggaccacagcgccctgagcaccatgagcggcctgagcatcagcgtcatcaagaaccccaacgtgtttgagcagctgctgtccttctgctacacaggccgcatgagcctgcagctgaaggatgtggtgtccttcctgacagctgccagcttcctgcagatgcagtgtgtgattgacaagtgcacccagatcctggagagcatccacagcaagatctctgtgggagatgtggacagcgtgacagtgggcgcagaagaaaatcctgagagcagaaatggagtgaaggacagcagcttctttgccaaccctgtggagatcagccccccctactgcagccagggccggcagcccacagccagcagtgacctgaggatggagaccacccccagcaaggccctgcggagccggctgcaggaggagggccacagcgaccggggcagcagcggctctgtgtctgaatatgagatccagattgaaggagaccacgagcagggcgacctgctggtgcgggagagccagatcacagaggtgaaggtgaagatggagaagagtgaccggcccagctgcagcgacagcagcagcctgggagatgatggctaccacacagagatggtggatggagagcaggtggtggccgtgaatgtgggcagctatggctctgtgctgcagcacgcctacagctacagccaggccgccagccagcccaccaacgtgtctgaggccttcggcagcctgagcaacagcagccccagccgctccatgctgagctgcttccggggcggccgggcccggcagaagagggccctgtctgtgcacctgcacagcgacctgcagggcctggtgcagggcagtgacagcgaggccatgatgaacaaccctggctatgagagcagcccccgggagaggtctgcccggggccactggtacccctacaatgaaagactcatctgcatctactgcggcaagagcttcaaccagaagggcagcctggacagacacatgaggctgcacatgggcatcaccccatttgtgtgcaagttctgtgggaagaagtacaccaggaaggaccagctggagtaccacatccggggccacacagatgacaagcccttccgctgtgagatctgtgggaagtgcttccccttccagggcaccctgaaccagcacctgaggaagaaccaccctggggtggccgaggtgcgcagcagaattgagagccctgagaggacagatgtgtatgtggagcagaagctggagaatgatgccagcgccagcgagatgggcctggacagcaggatggagatccacacagtgtctgatgccccagactag

SEQ ID NO: 176359 - DNA, 3591 bp, Artificial Sequence
  Description of Artificial Sequence: Synthetic coding sequence
atgatgacagtgatgagcctgagccgggacctgaaggatgacttccacagcgacacagtgctgagcatcctgaatgagcagaggatccggggcatcctgtgtgatgtgaccatcatcgtggaggacaccaagttcaaggcccacagcaatgtgctggccgccagcagcctgtacttcaagaacatcttctggagccacaccatctgcatcagcagccacgtgctggagctggatgacctgaaggccgaggtgttcacagagatcctgaactacatctacagcagcacagtggtggtgaagaggcaggagaccgtgacagacctggccgctgctgggaagaagctgggcatctccttcctggaggacctgacagacaggaacttcagcaacagccctggcccctacgtgttctgcatcacagagaagggcgtggtgaaggaggagaagaatgagaagagacatgaggagcccgccatcaccaacggcccccgcatcaccaatgccttcagcatcatcgagacagagaacagcaacaacatgttcagccccctggacctgcgggccagcttcaagaaggtgtctgacagcatgaggacagccagcctgtgcctggagaggacagatgtgtgccatgaagctgagcctgtgaggaccctggccgagcacagctatgctgtgtcctctgtggccgaggcctaccgcagccagcctgtgcgggagcatgatggcagcagccctggcaacacaggcaaggagaactgtgaggccctggccgccaagcccaagacctgcaggaagcccaagaccttcagcatcccccaggacagcgacagcgccacagagaacatccccccacctcctgtgagcaacctggaggtgaaccaggagaggagcccccagcctgctgctgtgctgaccaggagcaagagccccaacaatgaaggagatgtgcacttcagccgggaggatgagaaccagagcagtgatgtgcccggccccccagctgctgaggtgccccccctggtgtacaactgcagctgctgcagcaaggcctttgacagcagcaccctgctgagcgcccacatgcagctgcacaagcccacccaggagcccctggtgtgcaagtactgcaacaagcagttcaccaccctgaaccggctggacagacatgagcagatctgcatgaggagcagccacatgcccatccctgggggcaaccagcgcttcctggagaactaccccaccatcggccagaatggaggcagcttcaccggccctgagcccctgctgtctgagaacagaattggagagttcagcagcacaggcagcaccctgcctgacacagaccacatggtgaagtttgtgaatggccagatgctgtacagctgtgtggtgtgcaagaggagctatgtgaccctgagcagcctgcggagacatgccaacgtgcacagctggaggaggacctacccctgccactactgcaacaaggtgtttgccctggccgagtaccgcaccaggcatgagatctggcacactggagagcggcgctaccagtgcatcttctgcctggagaccttcatgacctactacatcctgaagaaccaccagaagagcttccacgccatcgaccaccggctgagcatcagcaagaagacagccaacggcggcctgaagcccagcgtgtacccctacaagctgtaccgcctgctgcccatgaagtgcaagagggccccctacaagagctacagaaacagcagctatgaaaatgcccgggagaacagccagatgaatgaaagtgcccctggcacctacgtggtgcagaacccccacagcagcgagctgcccaccctgaacttccaggacacagtgaacaccctgaccaacagccctgccatccccctggagaccagcgcctgccaggacatccccaccagcgccaacgtgcagaatgctgagggcaccaagtggggcgaggaggccctgaagatggacctggacaacaacttctacagcacagaggtgtctgtgagcagcacagaaaatgctgtgtccagtgacctgcgggctggagatgtgcctgtgctgagcctgagcaacagcagtgaaaatgctgccagcgtcatctcctacagcggcagcgcccccagcgtcatcgtgcacagcagccagttcagcagcgtcatcatgcacagcaatgccatcgccgccatgaccagcagcaaccaccgggccttcagtgaccctgctgtgtcccagagcctgaaggatgacagcaagccagagccagacaaggtgggccgctttgccagccggcccaagagcatcaaggagaagaagaagaccaccagccacaccagaggagagatccctgaggagagcaactacgtggccgaccccggcggcagcctgagcaagaccaccaacattgctgaggagaccagcaagattgagacctacatcgccaagccagccctgcccggcaccagcaccaacagcaatgtggcccccctgtgccagatcaccgtgaagattggaaatgaggccatcgtgaagaggcacatcctgggcagcaagctgttctacaagagaggaagaagacccaagtaccagatgcaggaggagcccctgccccagggcaatgaccctgagcccagcggggacagccccctgggcctgtgccagagcgagtgcatggagatgtctgaggtgtttgatgatgccagtgaccaggacagcacagacaagccctggaggccctactacaactacaagcccaagaagaagagccggcagctgaagaagatgaggaaggtgaactggaggaaggagcacggcaacagaagccccagccacaagtgcaagtacccagctgagctggactgtgctgtgggcaaggccccccaggacaagccctttgaggaggaggagaccaaggagatgcccaagctgcagtgtgagctgtgtgatggagacaaggctgtgggcgccggcaaccagggccggccccaccgccacctgaccagccggccctatgcctgtgagctgtgtgccaagcagttccagagccccagcaccctgaagatgcacatgcgctgccacactggagagaagccctaccagtgcaagacctgtggccgctgcttctctgtgcagggcaacctgcagaagcatgagcgcatccacctgggcctgaaggagtttgtgtgccagtactgcaacaaggccttcaccctgaatgagaccctgaagatccacgagcgcatccacactggagagaagcgctaccactgccagttctgcttccagcgcttcctgtacctgagcaccaagagaaatcatgagcagaggcacatccgggagcacaacgggaagggctacgcctgcttccagtgccccaagatctgcaagacagctgctgccctgggcatgcaccagaagaagcacctgttcaagagccccagccagcaggagaagattggagatgtgtgccacgagaacagcaaccccctggagaaccagcacttcatcggctctgaagataatgaccagaaggacaacatccagacaggagtggagaatgtggtgctgtag

SEQ ID NO: 176360 - DNA, 3588 bp, Artificial Sequence
  Description of Artificial Sequence: Synthetic coding sequence
atgacagtgatgagcctgagccgggacctgaaggatgacttccacagcgacacagtgctgagcatcctgaatgagcagaggatccggggcatcctgtgtgatgtgaccatcatcgtggaggacaccaagttcaaggcccacagcaatgtgctggccgccagcagcctgtacttcaagaacatcttctggagccacaccatctgcatcagcagccacgtgctggagctggatgacctgaaggccgaggtgttcacagagatcctgaactacatctacagcagcacagtggtggtgaagaggcaggagaccgtgacagacctggccgccgccggcaagaagctgggcatctccttcctggaggacctgacagacaggaacttcagcaacagccctggcccctacgtgttctgcatcacagagaagggcgtggtgaaggaggagaagaatgagaagagacatgaggagcccgccatcaccaacggcccccgcatcaccaatgccttcagcatcattgaaacagagaacagcaacaacatgttcagccccctggacctgcgggccagcttcaagaaggtgtctgacagcatgaggacagccagcctgtgcctggagaggacagatgtgtgccacgaggccgagcctgtgaggaccctggccgagcacagctatgctgtgtcctctgtggccgaggcctaccgcagccagcctgtgcgggagcatgatggcagcagccctggcaacacaggcaaggagaactgtgaggccctggccgccaagcccaagacctgcaggaagcccaagaccttcagcatcccccaggacagcgacagcgccacagagaacatccccccacctcctgtgagcaacctggaggtgaaccaggagaggagcccccagcctgctgctgtgctgaccaggagcaagagccccaacaatgaaggagatgtgcacttcagcagagaagatgagaaccagagcagtgatgtgcccggccccccagctgctgaggtgccccccctggtgtacaactgcagctgctgcagcaaggcctttgacagcagcaccctgctgagcgcccacatgcagctgcacaagcccacccaggagcccctggtgtgcaagtactgcaacaagcagttcaccaccctgaaccggctggacagacatgagcagatctgcatgaggagcagccacatgcccatccctgggggcaaccagcgcttcctggagaactaccccaccatcggccagaatggaggcagcttcaccggccctgagcccctgctgtctgaaaatcgcatcggggagttcagcagcacaggcagcaccctgcctgacacagaccacatggtgaagtttgtgaatggccagatgctgtacagctgtgtggtgtgcaagaggagctatgtgaccctgagcagcctgcggagacatgccaacgtgcacagctggaggaggacctacccctgccactactgcaacaaggtgtttgccctggccgagtaccgcaccaggcatgagatctggcacactggagagcggcgctaccagtgcatcttctgcctggagaccttcatgacctactacatcctgaagaaccaccagaagagcttccacgccatcgaccaccggctgagcatcagcaagaagacagccaatggaggcctgaagcccagcgtgtacccctacaagctgtaccgcctgctgcccatgaagtgcaagagggccccctacaagagctacagaaacagcagctatgaaaatgcccgggagaacagccagatgaatgaaagtgcccctggcacctacgtggtgcagaacccccacagcagcgagctgcccaccctgaacttccaggacacagtgaacaccctgaccaacagccctgccatccccctggagaccagcgcctgccaggacatccccaccagcgccaacgtgcagaatgctgagggcaccaagtggggcgaggaggccctgaagatggacctggacaacaacttctacagcacagaggtgtctgtgagcagcacagaaaatgctgtgtccagtgacctgcgggctggagatgtgcctgtgctgagcctgagcaacagcagtgaaaatgctgccagcgtcatctcctacagcggcagcgcccccagcgtgattgtgcacagcagccagttcagcagcgtcatcatgcacagcaatgccatcgccgccatgaccagcagcaaccaccgggccttcagtgaccctgctgtgtcccagagcctgaaggatgacagcaagccagagccagacaaggtgggccgctttgccagccggcccaagagcatcaaggagaagaagaagaccaccagccacaccagaggagagatccctgaggagagcaactacgtggccgaccccggcggcagcctgagcaagaccaccaacattgctgaggagaccagcaagattgagacctacatcgccaagccagccctgcccggcaccagcaccaacagcaatgtggcccccctgtgccagatcaccgtgaagattggaaatgaggccatcgtgaagaggcacatcctgggcagcaagctgttctacaagaggggccggcggcccaagtaccagatgcaggaggagcccctgccccagggcaatgaccctgagcccagcggggacagccccctgggcctgtgccagagcgagtgcatggagatgtctgaggtgtttgatgatgccagtgaccaggacagcacagacaagccctggaggccctactacaactacaagcccaagaagaagagccggcagctgaagaagatgaggaaggtgaactggaggaaggagcacggcaacagaagccccagccacaagtgcaagtacccagctgagctggactgtgctgtgggcaaggccccccaggacaagccctttgaggaggaggagaccaaggagatgcccaagctgcagtgtgagctgtgtgatggagacaaggctgtgggcgccggcaaccagggccggccccaccgccacctgaccagccggccctatgcctgtgagctgtgtgccaagcagttccagagccccagcaccctgaagatgcacatgcgctgccacactggagagaagccctaccagtgcaagacctgtggccgctgcttctctgtgcagggcaacctgcagaagcatgagcgcatccacctgggcctgaaggagtttgtgtgccagtactgcaacaaggccttcaccctgaatgagaccctgaagatccacgagcgcatccacactggagagaagcgctaccactgccagttctgcttccagcgcttcctgtacctgagcaccaagaggaaccacgagcagaggcacatccgggagcacaacgggaagggctacgcctgcttccagtgccccaagatctgcaagacagctgctgccctgggcatgcaccagaagaagcacctgttcaagagccccagccagcaggagaagattggagatgtgtgccacgagaacagcaaccccctggagaaccagcacttcatcggcagcgaggacaatgaccagaaggacaacatccagacaggagtggagaatgtggtgctgtag

SEQ ID NO: 176361 - DNA, 105 bp, Artificial Sequence
  Description of Artificial Sequence: Synthetic coding sequence
atgacagtgatgagcctgagccgggacctgaaggatgacttccacagcgacacagtgctgagcatcctgaatgagcagaggatccggggcatcctgtgtgactag

SEQ ID NO: 176362 - DNA, 285 bp, Artificial Sequence
  Description of Artificial Sequence: Synthetic coding sequence
atgacagtgatgagcctgagccgggacctgaaggatgacttccacagcgacacagtgctgagcatcctgaatgagcagaggatccggggcatcctgtgtgatgtgaccatcatcgtggaggacaccaagttcaaggcccacagcaatgtgctggccgccagcagcctgtacttcaagaacatcttctggagccacaccatctgcatcagcagccacgtgctggagctggatgacctgaaggccgaggtgttcacagagatcctgaactacatctacagcagctag

SEQ ID NO: 176363 - DNA, 357 bp, Artificial Sequence
  Description of Artificial Sequence: Synthetic coding sequence
atgacagtgatgagcctgagccgggacctgaaggatgacttccacagcgacacagtgctgagcatcctgaatgagcagaggatccggggcatcctgtgtgatgtgaccatcatcgtggaggacaccaagttcaaggcccacagcaatgtgctggccgccagcagcctgtacttcaagaacatcttctggagccacaccatctgcatcagcagccacgtgctggagctggatgacctgaaggccgaggtgttcacagagatcctgaactacatctacagcagcacagtggtggtgaagaggcaggagaccgtgacagacctggccgccgccggcaagaagctgggcatctccttctag

SEQ ID NO: 176364 - DNA, 336 bp, Artificial Sequence
  Description of Artificial Sequence: Synthetic coding sequence
atgacagtgatgagcctgagccgggacctgaaggatgacttccacagcgacacagtgctgagcatcctgaatgagcagaggatccggggcatcctgtgtgatgtgaccatcatcgtggaggacaccaagttcaaggcccacagcaatgtgctggccgccagcagcctgtacttcaagaacatcttctggagccacaccatctgcatcagcagccacgtgctggagctggatgacctgaaggccgaggtgttcacagagatcctgaactacatctacagcagcacagtggtggtgaagaggcaggagaccgtgacagacctggccgccgccggctag

SEQ ID NO: 176365 - DNA, 453 bp, Artificial Sequence
  Description of Artificial Sequence: Synthetic coding sequence
atgacagtgatgagcctgagccgggacctgaaggatgacttccacagcgacacagtgctgagcatcctgaatgagcagaggatccggggcatcctgtgtgatgtgaccatcatcgtggaggacaccaagttcaaggcccacagcaatgtgctggccgccagcagcctgtacttcaagaacatcttctggagccacaccatctgcatcagcagccacgtgctggagctggatgacctgaaggccgaggtgttcacagagatcctgaactacatctacagcagcacagtggtggtgaagaggcaggagaccgtgacagacctggccgccgccggcaagaagctgggcatctccttcctggaggacctgacagacaggaacttcagcaacagccctggcccctacgtgttctgcatcacagagaagggcgtggtgaaggaggagaagaatgaatag

SEQ ID NO: 176366 - DNA, 2316 bp, Artificial Sequence
  Description of Artificial Sequence: Synthetic coding sequence
atgacagtgatgagcctgagccgggacctgaaggatgacttccacagcgacacagtgctgagcatcctgaatgagcagaggatccggggcatcctgtgtgatgtgaccatcatcgtggaggacaccaagttcaaggcccacagcaatgtgctggccgccagcagcctgtacttcaagaacatcttctggagccacaccatctgcatcagcagccacgtgctggagctggatgacctgaaggccgaggtgttcacagagatcctgaactacatctacagcagcacagtggtggtgaagaggcaggagaccgtgacagacctggccgccgccggcaagaagctgggcatctccttcctggaggacctgacagacaggaacttcagcaacagccctggcccctacgtgttctgcatcacagagaagggcgtggtgaaggaggagaagaatgagaagagacatgaggagcccgccatcaccaacggcccccgcatcaccaatgccttcagcatcattgaaacagagaacagcaacaacatgttcagccccctggacctgcgggccagcttcaagaaggtgtctgacagcatgaggacagccagcctgtgcctggagaggacagatgtgtgccacgaggccgagcctgtgaggaccctggccgagcacagctatgctgtgtcctctgtggccgaggcctaccgcagccagcctgtgcgggagcatgatggcagcagccctggcaacacaggcaaggagaactgtgaggccctggccgccaagcccaagacctgcaggaagcccaagaccttcagcatcccccaggacagcgacagcgccacagagaacatccccccacctcctgtgagcaacctggaggtgaaccaggagaggagcccccagcctgctgctgtgctgaccaggagcaagagccccaacaatgaaggagatgtgcacttcagcagagaagatgagaaccagagcagtgatgtgcccggccccccagctgctgaggtgccccccctggtgtacaactgcagctgctgcagcaaggcctttgacagcagcaccctgctgagcgcccacatgcagctgcacaagcccacccaggagcccctggtgtgcaagtactgcaacaagcagttcaccaccctgaaccggctggacagacatgagcagatctgcatgaggagcagccacatgcccatccctgggggcaaccagcgcttcctggagaactaccccaccatcggccagaatggaggcagcttcaccggccctgagcccctgctgtctgaaaatcgcatcggggagttcagcagcacaggcagcaccctgcctgacacagaccacatggtgaagtttgtgaatggccagatgctgtacagctgtgtggtgtgcaagaggagctatgtgaccctgagcagcctgcggagacatgccaacgtgcacagctggaggaggacctacccctgccactactgcaacaaggtgtttgccctggccgagtaccgcaccaggcatgagatctggcacactggagagcggcgctaccagtgcatcttctgcctggagaccttcatgacctactacatcctgaagaaccaccagaagagcttccacgccatcgaccaccggctgagcatcagcaagaagacagccaatggaggcctgaagcccagcgtgtacccctacaagctgtaccgcctgctgcccatgaagtgcaagagggccccctacaagagctacagaaacagcagctatgaaaatgcccgggagaacagccagatgaatgaaagtgcccctggcacctacgtggtgcagaacccccacagcagcgagctgcccaccctgaacttccaggacacagtgaacaccctgaccaacagccctgccatccccctggagaccagcgcctgccaggacatccccaccagcgccaacgtgcagaatgctgagggcaccaagtggggcgaggaggccctgaagatggacctggacaacaacttctacagcacagaggtgtctgtgagcagcacagaaaatgctgtgtccagtgacctgcgggctggagatgtgcctgtgctgagcctgagcaacagcagtgaaaatgctgccagcgtcatctcctacagcggcagcgcccccagcgtgattgtgcacagcagccagttcagcagcgtcatcatgcacagcaatgccatcgccgccatgaccagcagcaaccaccgggccttcagtgaccctgctgtgtcccagagcctgaaggatgacagcaagccagagccagacaaggtgggccgctttgccagccggccctag

SEQ ID NO: 176367 - DNA, 441 bp, Artificial Sequence
  Description of Artificial Sequence: Synthetic coding sequence
atgacagtgatgagcctgagccgggacctgaaggatgacttccacagcgacacagtgctgagcatcctgaatgagcagaggatccggggcatcctgtgtgatgtgaccatcatcgtggaggacaccaagttcaaggcccacagcaatgtgctggccgccagcagcctgtacttcaagaacatcttctggagccacaccatctgcatcagcagccacgtgctggagctggatgacctgaaggccgaggtgttcacagagatcctgaactacatctacagcagcacagtggtggtgaagaggcaggagaccgtgacagacctggccgccgccggcaagaagctgggcatctccttcctggaggacctgacagacaggaacttcagcaacagccctggcccctacgtgttctgcatcacagagaagggcgtggtgaaggagtag

SEQ ID NO: 176368 - DNA, 633 bp, Artificial Sequence
  Description of Artificial Sequence: Synthetic coding sequence
atgacagtgatgagcctgagccgggacctgaaggatgacttccacagcgacacagtgctgagcatcctgaatgagcagaggatccggggcatcctgtgtgatgtgaccatcatcgtggaggacaccaagttcaaggcccacagcaatgtgctggccgccagcagcctgtacttcaagaacatcttctggagccacaccatctgcatcagcagccacgtgctggagctggatgacctgaaggccgaggtgttcacagagatcctgaactacatctacagcagcacagtggtggtgaagaggcaggagaccgtgacagacctggccgccgccggcaagaagctgggcatctccttcctggaggacctgacagacaggaacttcagcaacagccctggcccctacgtgttctgcatcacagagaagggcgtggtgaaggaggagaagaatgagaagagacatgaggagcccgccatcaccaacggcccccgcatcaccaatgccttcagcatcattgaaacagagaacagcaacaacatgttcagccccctggacctgcgggccagcttcaagaaggtgtctgacagcatgaggacagccagcctgtgcctggagaggacagatgtgtgccactag

SEQ ID NO: 176369 - DNA, 327 bp, Artificial Sequence
  Description of Artificial Sequence: Synthetic coding sequence
atgacagtgatgagcctgagccgggacctgaaggatgacttccacagcgacacagtgctgagcatcctgaatgagcagaggatccggggcatcctgtgtgatgtgaccatcatcgtggaggacaccaagttcaaggcccacagcaatgtgctggccgccagcagcctgtacttcaagaacatcttctggagccacaccatctgcatcagcagccacgtgctggagctggatgacctgaaggccgaggtgttcacagagatcctgaactacatctacagcagcacagtggtggtgaagaggcaggagaccgtgacagacctggcctag

SEQ ID NO: 176370 - DNA, 213 bp, Artificial Sequence
  Description of Artificial Sequence: Synthetic coding sequence
atgacagtgatgagcctgagccgggacctgaaggatgacttccacagcgacacagtgctgagcatcctgaatgagcagaggatccggggcatcctgtgtgatgtgaccatcatcgtggaggacaccaagttcaaggcccacagcaatgtgctggccgccagcagcctgtacttcaagaacatcttctggagccacaccatctgcatctcctag

SEQ ID NO: 176371 - DNA, 3588 bp, Artificial Sequence; identical to SEQ ID NO: 176360
  Description of Artificial Sequence: Synthetic coding sequence

SEQ ID NO: 176372 - DNA, 3042 bp, Artificial Sequence
  Description of Artificial Sequence: Synthetic coding sequence
atgcctcctcctgctgaggtgacagaccccagccacgccccagctgtgctgcggcagctgaatgagcagaggctgcggggcctcttctgtgatgtgaccctgattgctggggacaccaagtttcctgcccacaggtctgtgctggccgccagcagccccttcttccgggaggccctgctgaccagcgcccccctgcccctgcccccagccactggaggagctgcccccaacccagccaccaccacagctgccagcagcagcagcagcagcagcagcagcagcagcagcagcagcagcagcgccagcagcagcagcagcagcagcagcagcagccccccaccagccagccccccagccagcagccccccccgggtgctggagctgcccggggtgcctgctgctgccttcagtgatgtgctgaacttcatctacagcgcccggctggccctgcccggcggcggcggagatggagctgctgtggccgagattggagccctgggccggcggctgggcatcagccggctgcagggcctgggggagggcggagatgcctgggtgccccccaccccagcccccatggccaccagccagcctgaggaggacagctttggacctggccccaggcctgctggggagtgggagggggacagagctgaggcccaggccccagacctgcagtgcagcctgccccggcggcccctgccctgcccccagtgtgggaagagcttcatccaccccaagaggctgcagacccatgaggcccagtgcagaagaggagccagcacccggggcagcacaggcctgggcgctgggggcgccggccctgggggccctgctggggtggatgccagcgccctgcccccacctgtgggcttccggggcggccctgagcacgtggtgaaggtggtgggcggccacgtgctgtatgtgtgtgccgcctgtgagaggagctatgtgaccctgagcagcctgaagaggcacagcaatgtgcacagctggaggaggaagtacccctgccgctactgtgagaaggtgtttgccctggccgagtaccgcaccaagcatgaggtgtggcacactggagagcggcgctaccagtgcatcttctgctgggagacctttgtgacctactacaacctgaagacccaccagagggccttccacggcatcagccctggcctgctggccagcgagaagacccccaacggcggctacaagcccaagctgaacaccctgaagctgtaccgcctgctgcccatgagagctgccaagaggccctacaagacctacagccagggcgcccctgaggcccccctgagccccaccctgaacaccccagcccctgtggccatgcctgccagccccccacctggccccccaccagcccctgagcccggccccccacccagcgtcatcacctttgcccacccagcccccagcgtcatcgtgcacggcggcagcagcagcggcggcggcggcagcggcacagccagcactggaggcagccaggccgccagcgtcatcacctacacagccccaccccggccccccaagaagcgggagtacccacctcctcctcctgagcctgctgccacccccaccagccctgccacagctgtgtccccagccacagctgctggccctgccatggccaccaccacagaggaggccaagggcaggaacccccgggccggccgcaccctgacctacacagccaagcctgtgggcggcatcggcggcggcggcggcccccccaccggggccggccggggccccagccagctgcaggcccccccacccctgtgccagatcaccgtgcgcatcggggaggaggccatcgtgaagaggcgcatcagcgagacagacctgcggcctggagagctgtctggagaggagatggaggagagcgaggaggatgaggaggaggaggatgaggaggaggaggaggaggatgaggaggagagcaaggccggcggggaggaccagctgtggaggccctactacagctacaagcccaagaggaaggccggggctgctggaggagcctctgtgggcggcagcggcctgccccggggcagaagaccaccccgctggaggcagaagctggagcggcgctcctgggaggagaccccagctgctgagagccctgctggccgggccaggacagagcggcggcaccgctgtggggactgtgcccagaccttcaccaccctgaggaagctgaggaagcaccaggaggcccacggcggcggcagccacagcagcagagctggaagaagacccagcacccgcttcacctgcccccactgtgccaaggtgtgcaagacagctgctgccctgagcagacatggccagagacatgctgctgagaggcctgggggcacccccacccctgtgattgcctacagcaagggcagcgctggcaccaggcctggagatgtgaaggaggaggccccccaggagatgcaggtgagcagcagcagcggggaggccggcggcggcagcacagctgctgaggaggccagcgagacagccagcctgcaggaccccatcatctctggaggagaggagccccctgtggtggccagcggcggcagctatgtgtacccacctgtgcaggagttccccctggccctgattggaggcggccgggagcccggcggcggccggggcaagagcggcagcgagggccctgtgggcgctggggagggggacaggatggagggcatcggggccgccaaggtgaccttctacccagagccctaccccctggtgtatggcccccagctgctggccgcctacccctacaacttcagcaacctggccgccctgcctgtggccctgaacatggtgctgcctgatgagaagggggccggggccctgcccttcctgcccggggtgtttggctatgctgtgaacccccaggccgcccccccagccccacccaccccacctccacccaccctgcccccacccatcccccccaagggggagggggagcgggccggcgtggagaggacccagaagggagatgtgggctag

SEQ ID NO: 176373 - DNA, 3042 bp, Artificial Sequence; identical to SEQ ID NO: 176372
  Description of Artificial Sequence: Synthetic coding sequence

SEQ ID NO: 176374 - DNA, 708 bp, Artificial Sequence
  Description of Artificial Sequence: Synthetic coding sequence
atggagctgcccaactacagccggcagctgctgcagcagctgtacaccctgtgcaaggagcagcagttctgtgactgcaccatcagcatcggcaccatctacttccgggcccacaagctggtgctggccgccgccagcctgctcttcaagaccctgctggacaacacagacaccatcagcattgatgcctctgtggtgtccccagaggagtttgccctgctgctggagatgatgtacaccgggaagctgcctgtgggcaagcacaacttcagcaagatcatcagcctggccgacagcctgcagatgtttgatgtggccgtgtcctgcaagaacctgctgaccagcctgctggccgccaccccaggcggccctgtgaaggccgagacagaggaggccgcccacagcgtgtcccaggagatgtctgtgaacagccccacagcccaggagagccagagaaatgctgagaccccagctgagacccccaccacagctgaggcctgcagccccagccctgctgtgcagaccttcagcgaggccaagaagaccagcacagagcccggctgtgagaggaagcactaccagctgaacttcctgctggagaatgaaggagtcttcagtgatgccctgatggtgacccaggatgtgctgaagaagctggagatgtgcagcaactgctgcgtgcctgtggaggccgtgcccatcttctag

SEQ ID NO: 176375 - DNA, 3384 bp, Artificial Sequence
  Description of Artificial Sequence: Synthetic coding sequence
atggagctgcccaactacagccggcagctgctgcagcagctgtacaccctgtgcaaggagcagcagttctgtgactgcaccatcagcatcggcaccatctacttccgggcccacaagctggtgctggccgccgccagcctgctcttcaagaccctgctggacaacacagacaccatcagcattgatgcctctgtggtgtccccagaggagtttgccctgctgctggagatgatgtacaccgggaagctgcctgtgggcaagcacaacttcagcaagatcatcagcctggccgacagcctgcagatgtttgatgtggccgtgtcctgcaagaacctgctgaccagcctggtgaactgcagcgtgcagggccaggtggtgagagatgtgtctgcccccagcagcgagaccttcaggaaggagcctgagaagccccaggtggagatcctgagcagcgagggcgctggggagccccacagcagccctgagctggccgccaccccaggcggccctgtgaaggccgagacagaggaggccgcccacagcgtgtcccaggagatgtctgtgaacagccccacagcccaggagagccagagaaatgctgagaccccagctgagacccccaccacagctgaggcctgcagccccagccctgctgtgcagaccttcagcgaggccaagaagaccagcacagagcccggctgtgagaggaagcactaccagctgaacttcctgctggagaatgaaggagtcttcagtgatgccctgatggtgacccaggatgtgctgaagaagctggagatgtgcagcgagatcaagggcccccagaaggaggtgatcctgaactgctgtgagggccgcacccccaaggagaccatcgagaacctgctgcacaggatgacagaggagaagaccctgacagctgagggcctggtgaagctgctgcaggccgtgaagaccaccttccccaacctgggcctgctgctggagaagctgcagaagagcgccaccctgcccagcaccaccgtgcagcccagcccagatgattatggaacagagctgctgcggcgctaccacgagaacctgtctgagatcttcacagacaaccagatcctgctgaagatgatcagccacatgaccagcctggcccctggagagcgggaggtgatggagaagctggtgaagagggacagcggcagcggcggcttcaacagcctcatctctgctgtgctggagaagcagaccctgagcgccacagccatctggcagctgctgctggtggtgcaggagaccaagacctgccccctggacctgctgatggaggagatcagaagagagcccggggctgatgccttcttccgggctgtgaccaccccagagcacgccaccctggagaccatcctgcggcacaaccagctgatcctggaggccatccagcagaagattgagtacaagctgttcaccagcgaggaggagcacctggccgagaccgtgaaggagatcctgagcatccccagcgagacagccagccctgaggccagcctgcgggctgtgctgagccgggccatggagaagtctgtgcctgccatcgagatctgccacctgctgtgcagcgtgcacaagagcttccctggcctgcagcctgtgatgcaggagctggcctacatcggcgtgctgaccaaggaggatggagagaaggagacctggaaggtgagcaacaagttccacctggaggccaacaacaaggaggatgagaaggccgccaaggaggacagccagcctggagagcagaatgaccagggcgagaccggcagcctgcccggccagcaggagaaggaggccagcgccagcccagaccctgccaagaagagcttcatctgcaaggcctgtgacaagagcttccacttctactgccgcctgaaggtgcacatgaagcgctgccgggtggccaagagcaagcaggtgcagtgcaaggagtgcagcgagaccaaggacagcaagaaggagctggacaagcaccagctggaggcccatggagctggaggagagccagatgcccccaagaagaagaagaagaggctgcctgtgacctgtgacctgtgtggccgggagtttgcccacgccagcggcatgcagtaccacaagctgacagagcactttgatgagaagcccttcagctgtgaggagtgtggggccaagtttgctgccaacagcaccctgaagaaccacctgcggctgcacactggagaccggcccttcatgtgcaagcactgcctgatgaccttcacccaggccagcgccctggcctaccacaccaagaagaagcacagcgagggcaagatgtatgcctgccagtactgtgatgctgtgtttgcccagagcattgagctgagcagacatgtgaggacccacactggagacaagccctacgtgtgccgggactgtgggaagggcttccggcaggccaacggcctgagcatccacctgcacaccttccacaacatcgaggacccctatgactgcaagaagtgcaggatgtccttccccaccctgcaggaccacaggaagcacatccacgaggtgcacagcaaggagtaccacccctgccccacctgtgggaagatcttcagcgcccccagcatgctggagcggcacgtggtgacccacgtgggcggcaagcccttcagctgtggcatctgcaacaaggcctaccagcagctgagcggcctgtggtaccacaacagaacccaccacccagatgtgtttgctgcccagaaccacaggagcagcaagttcagcagcctgcagtgcagcagctgtgacaagaccttccccaacaccatcgagcacaagaagcacatcaaggccgagcacgccgacatgaagttccatgaatgtgaccagtgcaaggagctgttccccaccccagccctgctgcaggtgcacgtgaagtgccagcacagcggcagccagcccttccgctgcctgtactgtgccgccaccttccgcttccctggggccctgcagcaccacgtgaccacagagcacttcaagcagagcgagaccaccttcccctgtgagctgtgtggggagctgttcaccagccaggcccagctggacagccacctggagagcgagcaccccaaggtgatgagcacagagacccaggccgccgccagccagatggcccaggtgatccagaccccagagcctgtggcccccacagagcaggtgatcaccctggaggagacccagctggccggcagccaggtgtttgtgaccctgcctgacagccaggccagccaggccagcagcgagctggtggccgtgacagtggaggacctgctggatggcaccgtgaccctcatctgtggggaggccaagtag

SEQ ID NO: 176376 - DNA, 3720 bp, Artificial Sequence
  Description of Artificial Sequence: Synthetic coding sequence
atggagctgcccaactacagccggcagctgctgcagcagctgtacaccctgtgcaaggagcagcagttctgtgactgcaccatcagcatcggcaccatctacttccgggcccacaagctggtgctggccgccgccagcctgctcttcaagaccctgctggacaacacagacaccatcagcattgatgcctctgtggtgtccccagaggagtttgccctgctgctggagatgatgtacaccgggaagctgcctgtgggcaagcacaacttcagcaagatcatcagcctggccgacagcctgcagatgtttgatgtggccgtgtcctgcaagaacctgctgaccagcctggtgaactgcagcgtgcagggccaggtggtgagagatgtgtctgcccccagcagcgagaccttcaggaaggagcctgagaagccccaggtggagatcctgagcagcgagggcgctggggagccccacagcagccctgagctggccgccaccccaggcggccctgtgaaggccgagacagaggaggccgcccacagcgtgtcccaggagatgtctgtgaacagccccacagcccaggagagccagagaaatgctgagaccccagctgagacccccaccacagctgaggcctgcagccccagccctgctgtgcagaccttcagcgaggccaagaagaccagcacagagcccggctgtgagaggaagcactaccagctgaacttcctgctggagaatgaaggagtcttcagtgatgccctgatggtgacccaggatgtgctgaagaagctggagatgtgcagcgagatcaagggcccccagaaggagatgattgtgaagtgctttgaaggagagggcggccacagcgccttccagaggatcctgggcaaggtgcgggaggagagcctggatgtgcagacagtggtgtccctgctgcggctgtaccagtacagcaacccagctgtgaagacagccctgctggacaggaagccagaagatgtggacacagtgcagcccaagggcagcacagaggagggcaagaccctgtctgtgctgctgctggagcacaaggaggacctgatccagtgtgtgacccagctgcggcccatcatggagagcctggagacagccaaggaggagttcctgaccggcacagagaagagggtcatcctgaactgctgtgagggccgcacccccaaggagaccatcgagaacctgctgcacaggatgacagaggagaagaccctgacagctgagggcctggtgaagctgctgcaggccgtgaagaccaccttccccaacctgggcctgctgctggagaagctgcagaagagcgccaccctgcccagcaccaccgtgcagcccagcccagatgattatggaacagagctgctgcggcgctaccacgagaacctgtctgagatcttcacagacaaccagatcctgctgaagatgatcagccacatgaccagcctggcccctggagagcgggaggtgatggagaagctggtgaagagggacagcggcagcggcggcttcaacagcctcatctctgctgtgctggagaagcagaccctgagcgccacagccatctggcagctgctgctggtggtgcaggagaccaagacctgccccctggacctgctgatggaggagatcagaagagagcccggggctgatgccttcttccgggctgtgaccaccccagagcacgccaccctggagaccatcctgcggcacaaccagctgatcctggaggccatccagcagaagattgagtacaagctgttcaccagcgaggaggagcacctggccgagaccgtgaaggagatcctgagcatccccagcgagacagccagccctgaggccagcctgcgggctgtgctgagccgggccatggagaagtctgtgcctgccatcgagatctgccacctgctgtgcagcgtgcacaagagcttccctggcctgcagcctgtgatgcaggagctggcctacatcggcgtgctgaccaaggaggatggagagaaggagacctggaaggtgagcaacaagttccacctggaggccaacaacaaggaggatgagaaggccgccaaggaggacagccagcctggagagcagaatgaccagggcgagaccggcagcctgcccggccagcaggagaaggaggccagcgccagcccagaccctgccaagaagagcttcatctgcaaggcctgtgacaagagcttccacttctactgccgcctgaaggtgcacatgaagcgctgccgggtggccaagagcaagcaggtgcagtgcaaggagtgcagcgagaccaaggacagcaagaaggagctggacaagcaccagctggaggcccatggagctggaggagagccagatgcccccaagaagaagaagaagaggctgcctgtgacctgtgacctgtgtggccgggagtttgcccacgccagcggcatgcagtaccacaagctgacagagcactttgatgagaagcccttcagctgtgaggagtgtggggccaagtttgctgccaacagcaccctgaagaaccacctgcggctgcacactggagaccggcccttcatgtgcaagcactgcctgatgaccttcacccaggccagcgccctggcctaccacaccaagaagaagcacagcgagggcaagatgtatgcctgccagtactgtgatgctgtgtttgcccagagcattgagctgagcagacatgtgaggacccacactggagacaagccctacgtgtgccgggactgtgggaagggcttccggcaggccaacggcctgagcatccacctgcacaccttccacaacatcgaggacccctatgactgcaagaagtgcaggatgtccttccccaccctgcaggaccacaggaagcacatccacgaggtgcacagcaaggagtaccacccctgccccacctgtgggaagatcttcagcgcccccagcatgctggagcggcacgtggtgacccacgtgggcggcaagcccttcagctgtggcatctgcaacaaggcctaccagcagctgagcggcctgtggtaccacaacagaacccaccacccagatgtgtttgctgcccagaaccacaggagcagcaagttcagcagcctgcagtgcagcagctgtgacaagaccttccccaacaccatcgagcacaagaagcacatcaaggccgagcacgccgacatgaagttccatgaatgtgaccagtgcaaggagctgttccccaccccagccctgctgcaggtgcacgtgaagtgccagcacagcggcagccagcccttccgctgcctgtactgtgccgccaccttccgcttccctggggccctgcagcaccacgtgaccacagagcacttcaagcagagcgagaccaccttcccctgtgagctgtgtggggagctgttcaccagccaggcccagctggacagccacctggagagcgagcaccccaaggtgatgagcacagagacccaggccgccgccagccagatggcccaggtgatccagaccccagagcctgtggcccccacagagcaggtgatcaccctggaggagacccagctggccggcagccaggtgtttgtgaccctgcctgacagccaggccagccaggccagcagcgagctggtggccgtgacagtggaggacctgctggatggcaccgtgaccctcatctgtggggaggccaagtag

SEQ ID NO: 176377 - DNA, 1362 bp, Artificial Sequence
  Description of Artificial Sequence: Synthetic coding sequence
atggagctgcccaactacagccggcagctgctgcagcagctgtacaccctgtgcaaggagcagcagttctgtgactgcaccatcagcatcggcaccatctacttccgggcccacaagctggtgctggccgccgccagcctgctcttcaagaccctgctggacaacacagacaccatcagcattgatgcctctgtggtgtccccagaggagtttgccctgctgctggagatgatgtacaccgggaagctgcctgtgggcaagcacaacttcagcaagatcatcagcctggccgacagcctgcagatgtttgatgtggccgtgtcctgcaagaacctgctgaccagcctggtgaactgcagcgtgcagggccaggtggtgagagatgtgtctgcccccagcagcgagaccttcaggaaggagcctgagaagccccaggtggagatcctgagcagcgagggcgctggggagccccacagcagccctgagctggccgccaccccaggcggccctgtgaaggccgagacagaggaggccgcccacagcgtgtcccaggagatgtctgtgaacagccccacagcccaggagagccagagaaatgctgagaccccagctgagacccccaccacagctgaggcctgcagccccagccctgctgtgcagaccttcagcgaggccaagaagaccagcacagagcccggctgtgagaggaagcactaccagctgaacttcctgctggagaatgaaggagtcttcagtgatgccctgatggtgacccaggatgtgctgaagaagctggagatgtgcagcgagatcaagggcccccagaaggagatgattgtgaagtgctttgaaggagagggcggccacagcgccttccagaggatcctgggcaaggtgcgggaggagagcctggatgtgcagacagtggtgtccctgctgcggctgtaccagtacagcaacccagctgtgaagacagccctgctggacaggaagccagaagatgtggacacagtgcagcccaagggcagcacagaggagggcaagaccctgtctgtgctgctgctggagcacaaggaggacctgatccagtgtgtgacccagctgcggcccatcatggagagcctggagacagccaaggaggagttcctgaccggcacagagaagagggtcatcctgaactgctgtgagggccgcacccccaaggagaccatcgagaacctgctgcacaggatgacagaggagaagaccctgacagctgagggcctggtgaagctgctgcaggccgtgaagaccaccttccccaacctgggcctgctgctggagaagctgcagaagagcgccaccctgcccagcaccacctag

SEQ ID NO: 176378 - DNA, 3720 bp, Artificial Sequence; identical to SEQ ID NO: 176376
  Description of Artificial Sequence: Synthetic coding sequence

SEQ ID NO: 176379 - DNA, 1269 bp, Artificial Sequence
  Description of Artificial Sequence: Synthetic coding sequence
atggagttccctgagcacggcggccgcctgctgggccgcctgcggcagcagcgggagctgggcttcctgtgtgactgcaccgtgctggtgggagatgcccgcttccctgcccacagagctgtgctggccgcctgcagcgtgtacttccacctgttctacagagacaggcctgctggcagccgggacacagtgcggctgaatggagacatcgtgacagccccagccttcggccgcctgctggacttcatgtatgagggccgcctggacctgcggagcctgcctgtggaggatgtgctggccgccgccagctacctgcacatgtatgacatcgtgaaggtgtgcaagggccgcctgcaggagaaggacaggagcctggaccccggcaacccagcccctggagctgagcccgcccagcccccctgcccctggcctgtgtggacagctgacctgtgcccagctgccaggaaggccaagctgccccccttcggcgtgaaggccgccctgcccccccgggccagcggccccccaccctgccaggtgcctgaggagagtgaccaggccctggacctgagcctgaagagcggcccccggcaggagcgggtgcaccccccctgtgtgctgcagacccccctgtgcagccagaggcagcccggggcccagcccctggtgaaggatgagcgggacagcctgtctgagcaggaggagagcagcagcagccgcagcccccacagcccccccaagcccccacctgtgcctgctgccaagggcctggtggtgggcctgcagcccctgcccctgtctggagagggcagccgggagctggagctgggcgccggccgcctggcctctgaagatgagctgggccctgggggccccctgtgcatctgccccctgtgcagcaagctgttccccagcagccacgtgctgcagctgcacctgagcgcccacttccgggagcgggacagcacccgggcccggctgagcccagatggagtggcccccacctgccccctgtgtgggaagaccttcagctgcacctacaccctgaagagacatgagaggacccacagcggggagaagccctacacctgtgtgcagtgtgggaagagcttccagtacagccacaacctgagccgccacacagtggtgcacacccgggagaagccccacgcctgccgctggtgtgaaagacgcttcacccagagcggggacctgtaccgccacgtgaggaagttccactgcggcctggtgaagagcctgctggtgtag

SEQ ID NO: 176380 - DNA, 1269 bp, Artificial Sequence; identical to SEQ ID NO: 176379
  Description of Artificial Sequence: Synthetic coding sequence

SEQ ID NO: 176381 - DNA, 1815 bp, Artificial Sequence
  Description of Artificial Sequence: Synthetic coding sequence
atggccagcacctgggccatccaggcccacatggaccaggatgagcccctggaggtgaagattgaggaggagaagtacaccacccggcaggactgggacctgaggaagaacaacacccacagccgggaggtgttccggcagtacttccggcagttctgctaccaggagaccagcggcccccgggaggccctgagccggctgcgggagctgtgccaccagtggctgcggcctgagacccacaccaaggagcagatcctggagctgctggtgctggagcagttcctgaccatcctgcctgaggagctgcaggcctgggtgcaggagcagcaccctgagagcggggaggaggtggtgacagtgctggaggacctggagcgggagctggatgagcctggagagcaggtgtctgtgcacactggagagcaggagatgttcctgcaggagaccgtgcggctgaggaaggagggggagcccagcatgagcctgcagagcatgaaggcccagcccaagtatgagagccctgagctggagagccagcaggagcaggtgctggatgtggagactggaaatgaatatggcaacctgaagcaggaggtgtctgaggagatggagccccacggcaagaccagcagcaagtttgaaaatgacatgagcaagagcgcccgctgtggggagacccgggagcctgaggagatcacagaggagcccagcgcctgcagccgggaggacaagcagcccacctgtgatgaaaatggagtgtccctgacagaaaattctgaccacacagagcaccagaggatctgccctggagaggagagctatggctgtgatgactgtgggaaggccttcagccagcacagccacctgattgagcaccagaggatccacactggagaccggccctacaagtgtgaggagtgtgggaaggccttccggggccgcacagtgctgatccgccacaagatcatccacactggagagaagccctacaagtgcaatgaatgtgggaaggccttcggccgctggagcgccctgaaccagcaccagaggctgcacactggagagaagcactaccactgcaatgactgtgggaaggccttcagccagaaggccggcctcttccaccacatcaagatccacacccgggacaagccctaccagtgcacccagtgcaacaagagcttcagcagaagaagcatcctgacccagcaccagggcgtgcacactggagccaagccctatgaatgtaatgaatgtgggaaggcctttgtgtacaacagcagcctggtgagccaccaggagatccaccacaaggagaagtgctaccagtgcaaggaatgtgggaagagcttcagccagagcggcctcatccagcaccagaggatccacactggagagaagccctacaagtgtgatgtgtgtgagaaggccttcatccagaggaccagcctgacagagcaccagaggatccacactggagagcggccctacaagtgtgacaagtgtgggaaggccttcacccagaggtctgtgctgacagagcaccagaggatccacactggagagcggccctacaagtgtgatgaatgtggaaatgccttccggggcatcaccagcctcatccagcaccagaggatccacactggagagaagccctaccagtgtgatgaatgtgggaaggccttccggcagaggaagaagaccagctacaaggagatcctgctgaagaaccacagcgagccccaggccggcgtgaacctgctgctgagcagcctcatccctgagtggcagagctgcttcagaagagacctgtag

SEQ ID NO: 176382 - DNA, 1815 bp, Artificial Sequence; identical to SEQ ID NO: 176381
  Description of Artificial Sequence: Synthetic coding sequence

SEQ ID NO: 176383 - DNA, 1476 bp, Artificial Sequence
  Description of Artificial Sequence: Synthetic coding sequence
atggccatccccaagcacagcctgagccctgtgccctgggaggaggacagcttcctgcaggtgaaggtggaggaggaggaggaggccagcctgagccagggcggggagagcagccatgaccacatcgcccacagcgaggccgcccggctgcgcttccgccacttccgctatgaggaggccagcggcccccatgaggccctggcccacctgcgggccctgtgctgccagtggctgcagcctgaggcccacagcaaggagcagatcctggagctgctggtgctggagcagttcctgggcgccctgcccccagagatccaggcctgggtgggcgcccagagccccaagagcggggaggaggccgctgtgctggtggaggacctgacccaggtgctggacaagaggggctgggaccccggggctgagcccacagaggccagctgcaagcagagcgacctgggggagagcgagcccagcaatgtgacagagaccctgatgggcggcgtgtccctgggccctgcctttgtgaaggcctgtgagcctgagggcagcagcgagaggagcggcctgagcggggagatctggaccaagtctgtgacccagcagatccacttcaagaagaccagcggcccctacaaggatgtgcccacagaccagaggggccgggagagcggggccagcaggaacagcagcagcgcctggcccaacctgaccagccaggagaagccacccagcgaggacaagtttgacctggtggatgcctacggcacagagcccccctacacctacagcggcaagaggagcagcaaatgtcgggagtgcaggaagatgttccagagcgccagcgccctggaggcccaccagaagacccacagcaggaagaccccctatgcctgcagtgaatgtgggaaggccttcagccgcagcacccacctggcccagcaccaggtggtgcacactggagccaagccccatgagtgcaaggaatgtgggaaggccttcagccgggtgacccacctgacccagcaccagaggatccacactggagagaagccctacaagtgtggggagtgtgggaagaccttcagccgcagcacccacctgacccagcaccagagggtgcacactggagagcggccctatgaatgtgatgcctgtgggaaggccttcagccagagcacccacctgacccagcaccagaggatccacactggagagaagccctacaagtgtgatgcctgtggccgggccttcagtgactgcagcgccctgatccgccacctgcgcatccacagcggggagaagccctaccagtgcaaggtgtgccccaaggcctttgcccagagcagcagcctcatcgagcaccagaggatccacactggagagaagccctacaagtgcagcgactgtgggaaggccttcagccgcagcagcgccctgatggtgcacctgcgcatccacatcaccgtgctgcagtag

SEQ ID NO: 176384 - DNA, 1302 bp, Artificial Sequence
  Description of Artificial Sequence: Synthetic coding sequence
atggccctggacctgcggaccatcttccagtgtgagcccagcgagaacaacctgggctctgaaaattctgccttccagcagagccagggccctgctgtgcagcgggaggagggcatcagcgagttcagcaggatggtgctgaacagcttccaggacagcaacaacagctatgcccggcaggagctgcagaggctgtaccgcatcttccacagctggctgcagcctgagaagcacagcaaggatgagatcatcagcctgctggtgctggagcagttcatgattggaggccactgcaatgacaaggcctctgtgaaggagaagtggaagagcagcggcaagaacctggagcgcttcatcgaggacctgacagatgacagcatcaaccccccagccctggtgcacgtgcacatgcagggccaggaggccctcttcagcgaggacatgcccctgagagatgtgattgtgcacctgaccaagcaggtgaatgcccagaccacccgggaggccaacatgggcacccccagccagaccagccaggacaccagcctggagaccggccagggctatgaagatgagcaggacggctggaacagcagcagcaagaccaccagggtgaatgaaaacatcaccaaccagggcaaccagatcgtgtccctcatcatcatccaggaggagaatggccccaggcctgaggagggcggcgtgtccagtgacaacccctacaacagcaagagagctgagctggtgacagcccggagccaggagggcagcatcaatggcatcaccttccagggcgtgcccatggtgatgggcgccggctgcatcagccagcctgagcagagcagccctgagagcgccctgacccaccagagcaatgaaggcaacagcacctgtgaggtgcaccagaagggcagccacggcgtgcagaagagctacaagtgtgaggagtgccccaaggtgttcaagtacctgtgccacctgctggcccaccagaggaggcacagaaatgaaagaccatttgtgtgcccagagtgccagaagggcttcttccagatcagtgacctgcgggtgcaccagatcatccacacaggcaagaagcccttcacctgcagcatgtgcaagaagagcttcagccacaagaccaacctgcggagccatgagcgcatccacactggagagaagccctacacctgccccttctgcaagaccagctaccggcagagcagcacctaccaccgccacatgaggacccatgagaagatcaccctgcccagcgtgcccagcaccccagaggccagctag

SEQ ID NO: 176385 - DNA, 2433 bp, Artificial Sequence
  Description of Artificial Sequence: Synthetic coding sequence
atgcccaaccagggcgaggactgctacttcttcttctacagcacctgcaccaagggggacagctgccccttccgccactgtgaggccgccatcggaaatgaaacagtgtgcaccctgtggcaggagggccgctgcttccggcaggtgtgccgcttccgccacatggagattgacaagaagaggtctgagatcccctgctactgggagaaccagcccaccggctgccagaagctgaactgtgccttccaccacaacagaggccgctacgtggatggcctcttcctgccccccagcaagacagtgctgcccaccgtgcctgagagccctgaggaggaggtgaaggccagccagctgtctgtgcagcagaacaagctgtctgtgcagagcaaccccagcccccagctgcggtctgtgatgaaggtggagagcagtgaaaatgtgcccagccccacccacccccctgtggtgatcaatgctgctgatgatgatgaagatgatgatgaccagttcagcgaggagggagatgagaccaagacccccaccctgcagcccaccccagaggtgcacaacggcctgcgggtgacctctgtgaggaagccagctgtgaacatcaagcagggcgagtgcctgaactttggcatcaagaccctggaggagatcaagagcaagaagatgaaggagaagagcaagaagcagggcgagggcagcagtggagtgagcagcctgctgctgcaccctgagcctgtgcccggccctgagaaggaaaatgtgaggacagtggtgaggacagtgaccctgagcaccaagcagggcgaggagcccctggtgcggctgagcctgacagagcggctgggcaagaggaagttctctgctggaggagacagcgacccccccctgaagaggagcctggcccagaggctgggcaagaaggtggaggcccctgagaccaacatcgacaagacccccaagaaggcccaggtgtccaagagcctgaaggagcggctgggcatgtctgctgaccctgacaatgaagatgccacagacaaggtgaacaaggtgggggagatccacgtgaagaccctggaggagatcctgctggagcgggccagccagaagagaggagagctgcagaccaagctgaagacagagggccccagcaagacagatgacagcaccagcggggcccggagcagcagcaccatccgcatcaagaccttcagcgaggtgctggccgagaagaagcaccggcagcaggaggccgagcggcagaagagcaagaaggacaccacctgcatcaagctgaagattgacagcgagatcaagaagacagtggtgctgccccccatcgtggccagccggggccagagcgaggagcctgctgggaagaccaagtccatgcaggaggtgcacatcaagaccctggaggagatcaagctggagaaggccctgcgggtgcagcagagcagcgagagcagcaccagcagccccagccagcacgaggccacccctggggcccggcggctgctgcgcatcaccaagaggacaggcatgaaggaggagaagaacctgcaggagggcaatgaggtggacagccagagcagcatcagaacagaggccaaggaggccagcggggagaccactggagtggacatcaccaagatccaggtgaagagatgtgagaccatgagggagaagcacatgcagaagcagcaggagcgggagaagtctgtgctgacccccctgcggggagatgtggccagctgcaacacccaggtggccgagaagcctgtgctgacagctgtgcccggcatcaccaggcacctgaccaagaggctgcccaccaagagcagccagaaggtggaggtggagaccagcggcattggagacagcctgctgaatgtgaagtgtgccgcccagaccctggagaagaggggcaaggccaagcccaaggtgaatgtgaagcccagcgtggtgaaggtggtgagcagccccaagctggcccccaagaggaaggctgtggagatgcatgctgctgtgattgctgctgtgaagcccctgagcagcagctctgtgctgcaggagcccccagccaagaaggctgctgtggccgtggtgcccctggtgtctgaggacaagtctgtgacagtgcctgaggccgagaacccccgggacagcctggtgctgccccccacccagagcagcagtgacagcagccccccagaggtgtctggccccagcagcagccagatgtccatgaagacccggcggctgagcagcgccagcacaggcaagccacccctgtctgtggaggatgactttgagaagctgatctgggagatcagcggcggcaagctggaggccgagattgacctggaccccgggaaggatgaagatgacctgctgctggagctgtctgagatgattgacagctag

SEQ ID NO: 176386 - DNA, 2433 bp, Artificial Sequence; identical to SEQ ID NO: 176385
  Description of Artificial Sequence: Synthetic coding sequence

SEQ ID NO: 176387 - DNA, 2433 bp, Artificial Sequence; identical to SEQ ID NO: 176385
  Description of Artificial Sequence: Synthetic coding sequence

SEQ ID NO: 176388 - DNA, 2433 bp, Artificial Sequence; identical to SEQ ID NO: 176385
  Description of Artificial Sequence: Synthetic coding sequence

SEQ ID NO: 176389 - DNA, 153 bp, Artificial Sequence
  Description of Artificial Sequence: Synthetic coding sequence
atgcccaaccagggcgaggactgctacttcttcttctacagcacctgcaccaagggggacagctgccccttccgccactgtgaggccgccatcggaaatgaaacagtgtgcaccctgtggcaggagggccgctgcttccggcaggtgtgctag

SEQ ID NO: 176390 - DNA, 1548 bp, Artificial Sequence
  Description of Artificial Sequence: Synthetic coding sequence
atgcccaaccagggcgaggactgctacttcttcttctacagcacctgcaccaagggggacagctgccccttccgccactgtgaggccgccatcggaaatgaaacagtgtgcaccctgtggcaggagggccgctgcttccggcaggtgtgccgcttccgccacatggagattgacaagaagaggtctgagatcccctgctactgggagaaccagcccaccggctgccagaagctgaactgtgccttccaccacaacagaggccgctacgtggatggcctcttcctgccccccagcaagacagtgctgcccaccgtgcctgagagccctgaggaggaggtgaaggccagccagctgtctgtgcagcagaacaagctgtctgtgcagagcaaccccagcccccagctgcggtctgtgatgaaggtggagagcagtgaaaatgtgcccagccccacccacccccctgtggtgatcaatgctgctgatgatgatgaagatgatgatgaccagttcagcgaggagggagatgagaccaagacccccaccctgcagcccaccccagaggtgcacaacggcctgcgggtgacctctgtgaggaagccagctgtgaacatcaagcagggcgagtgcctgaactttggcatcaagaccctggaggagatcaagagcaagaagatgaaggagaagagcaagaagcagggcgagggcagcagtggagtgagcagcctgctgctgcaccctgagcctgtgcccggccctgagaaggaaaatgtgaggacagtggtgaggacagtgaccctgagcaccaagcagggcgaggagcccctggtgcggctgagcctgacagagcggctgggcaagaggaagttctctgctggaggagacagcgacccccccctgaagaggagcctggcccagaggctgggcaagaaggtggaggcccctgagaccaacatcgacaagacccccaagaaggcccaggtgtccaagagcctgaaggagcggctgggcatgtctgctgaccctgacaatgaagatgccacagacaaggtgaacaaggtgggggagatccacgtgaagaccctggaggagatcctgctggagcgggccagccagaagagaggagagctgcagaccaagctgaagacagagggccccagcaagacagatgacagcaccagcggggcccggagcagcagcaccatccgcatcaagaccttcagcgaggtgctggccgagaagaagcaccggcagcaggaggccgagcggcagaagagcaagaaggacaccacctgcatcaagctgaagattgacagcgagatcaagaagacagtggtgctgccccccatcgtggccagccggggccagagcgaggagcctgctgggaagaccaagtccatgcaggaggtgcacatcaagaccctggaggagatcaagctggagaaggccctgcgggtgcagcagagcagcgagagcagcaccagcagccccagccagcacgaggccacccctggggcccggcggctgctgcgcatcaccaagaggacatag

SEQ ID NO: 176391 - DNA, 2271 bp, Artificial Sequence
  Description of Artificial Sequence: Synthetic coding sequence
atggagattgacaagaagaggtctgagatcccctgctactgggagaaccagcccaccggctgccagaagctgaactgtgccttccaccacaacagaggccgctacgtggatggcctcttcctgccccccagcaagacagtgctgcccaccgtgcctgagagccctgaggaggaggtgaaggccagccagctgtctgtgcagcagaacaagctgtctgtgcagagcaaccccagcccccagctgcggtctgtgatgaaggtggagagcagtgaaaatgtgcccagccccacccacccccctgtggtgatcaatgctgctgatgatgatgaagatgatgatgaccagttcagcgaggagggagatgagaccaagacccccaccctgcagcccaccccagaggtgcacaacggcctgcgggtgacctctgtgaggaagccagctgtgaacatcaagcagggcgagtgcctgaactttggcatcaagaccctggaggagatcaagagcaagaagatgaaggagaagagcaagaagcagggcgagggcagcagtggagtgagcagcctgctgctgcaccctgagcctgtgcccggccctgagaaggaaaatgtgaggacagtggtgaggacagtgaccctgagcaccaagcagggcgaggagcccctggtgcggctgagcctgacagagcggctgggcaagaggaagttctctgctggaggagacagcgacccccccctgaagaggagcctggcccagaggctgggcaagaaggtggaggcccctgagaccaacatcgacaagacccccaagaaggcccaggtgtccaagagcctgaaggagcggctgggcatgtctgctgaccctgacaatgaagatgccacagacaaggtgaacaaggtgggggagatccacgtgaagaccctggaggagatcctgctggagcgggccagccagaagagaggagagctgcagaccaagctgaagacagagggccccagcaagacagatgacagcaccagcggggcccggagcagcagcaccatccgcatcaagaccttcagcgaggtgctggccgagaagaagcaccggcagcaggaggccgagcggcagaagagcaagaaggacaccacctgcatcaagctgaagattgacagcgagatcaagaagacagtggtgctgccccccatcgtggccagccggggccagagcgaggagcctgctgggaagaccaagtccatgcaggaggtgcacatcaagaccctggaggagatcaagctggagaaggccctgcgggtgcagcagagcagcgagagcagcaccagcagccccagccagcacgaggccacccctggggcccggcggctgctgcgcatcaccaagaggacaggcatgaaggaggagaagaacctgcaggagggcaatgaggtggacagccagagcagcatcagaacagaggccaaggaggccagcggggagaccactggagtggacatcaccaagatccaggtgaagagatgtgagaccatgagggagaagcacatgcagaagcagcaggagcgggagaagtctgtgctgacccccctgcggggagatgtggccagctgcaacacccaggtggccgagaagcctgtgctgacagctgtgcccggcatcaccaggcacctgaccaagaggctgcccaccaagagcagccagaaggtggaggtggagaccagcggcattggagacagcctgctgaatgtgaagtgtgccgcccagaccctggagaagaggggcaaggccaagcccaaggtgaatgtgaagcccagcgtggtgaaggtggtgagcagccccaagctggcccccaagaggaaggctgtggagatgcatgctgctgtgattgctgctgtgaagcccctgagcagcagctctgtgctgcaggagcccccagccaagaaggctgctgtggccgtggtgcccctggtgtctgaggacaagtctgtgacagtgcctgaggccgagaacccccgggacagcctggtgctgccccccacccagagcagcagtgacagcagccccccagaggtgtctggccccagcagcagccagatgtccatgaagacccggcggctgagcagcgccagcacaggcaagccacccctgtctgtggaggatgactttgagaagctgatctgggagatcagcggcggcaagctggaggccgagattgacctggaccccgggaaggatgaagatgacctgctgctggagctgtctgagatgattgacagctag

SEQ ID NO: 176392 - DNA, 2433 bp, Artificial Sequence; identical to SEQ ID NO: 176385
  Description of Artificial Sequence: Synthetic coding sequence

SEQ ID NO: 176393 - DNA, 1584 bp, Artificial Sequence
  Description of Artificial Sequence: Synthetic coding sequence
atggagcaccccagcaagatggagttcttccagaagctgggctatgaccgggaggatgtgctgcgggtgctgggcaagctgggggagggcgccctggtgaatgatgtgctgcaggagctgatcagaacaggcagcaggcctggggccctggagcaccctgctgccccccggctggtgccccggggcagctgtggggtgcctgattctgcccagaggggccctggaacagccctggaggaggacttccgcaccctggccagcagcctgcggcccatcgtgattgatggcagcaatgtggccatgagccacggcaacaaggagaccttcagctgccggggcatcaagctggccgtggactggttccgggaccggggccacacctacatcaaggtgtttgtgcccagctggaggaaggacccccccagggctgacacccccatccgggagcagcacgtgctggccgagctggagcggcaggccgtgctggtgtacacccccagcaggaaggtgcacggcaagaggctggtgtgctatgatgaccgctacatcgtgaaggtggcctatgagcaggatggagtcatcgtgtccaatgacaactacagagacctgcagagcgagaaccctgagtggaagtggttcatcgagcagaggctgctgatgttctcctttgtgaatgaccgcttcatgcccccagatgaccccctgggccgccacggccccagcctgagcaacttcctgagcaggaagcccaagcccccagagcccagctggcagcactgcccctacggcaagaagtgcacctacggcatcaagtgcaagttctaccaccctgagcggccccaccacgcccagctggccgtggctgatgagctgcgggccaagacaggagcccggcctggagctggagctgaggagcagaggcctccccgggcccctgggggcagcgctggggcccgggccgccccccgggagccctttgcccacagcctgcccccagcccggggcagcccagacctggccgccctgcggggcagcttcagccggctggccttcagtgatgacctgggccccctgggcccccccctgcctgtgcctgcctgcagcctgaccccccggctgggcggccctgactgggtgtctgctgggggccgggtgcccggccccctgagcctgcccagccctgagagccagttcagccctggggacctgcccccacctcctggcctgcagctgcagcccagaggagagcaccggccccgggacctgcatggagacctgctgagcccccggcggcccccagatgacccctgggcccggccccccaggagtgaccgcttccctggccgctctgtgtgggccgagcccgcctggggagatggagccaccggcggcctgtctgtgtatgccacagaagatgatgaaggagatgcccgggcccgggccagaattgccctgtacagcgtcttcccccgggaccaggtggacagagtgatggccgccttccctgagctgagtgacctggcccggctcatcctgctggtgcagcgctgccagagcgctggggcccccctgggcaagccctag

SEQ ID NO: 176394 - DNA, 1584 bp, Artificial Sequence; identical to SEQ ID NO: 176393
  Description of Artificial Sequence: Synthetic coding sequence

SEQ ID NO: 176395 - DNA, 966 bp, Artificial Sequence
  Description of Artificial Sequence: Synthetic coding sequence
atggagcaccccagcaagatggagttcttccagaagctgggctatgaccgggaggatgtgctgcgggtgctgggcaagctgggggagggcgccctggtgaatgatgtgctgcaggagctgatcagaacaggcagcaggcctggggccctggagcaccctgctgccccccggctggtgccccggggcagctgtggggtgcctgattctgcccagaggggccctggaacagccctggaggaggacttccgcaccctggccagcagcctgcggcccatcgtgattgatggcagcaatgtggccatgagccacggcaacaaggagaccttcagctgccggggcatcaagctggccgtggactggttccgggaccggggccacacctacatcaaggtgtttgtgcccagctggaggaaggacccccccagggctgacacccccatccgggagcagcacgtgctggccgagctggagcggcaggccgtgctggtgtacacccccagcaggaaggtgcacggcaagaggctggtgtgctatgatgaccgctacatcgtgaaggtggcctatgagcaggatggagtcatcgtgtccaatgacaactacagagacctgcagagcgagaaccctgagtggaagtggttcatcgagcagaggctgctgatgttctcctttgtgaatgaccgcttcatgcccccagatgaccccctgggccgccacggccccagcctgagcaacttcctgagcaggaagcccaagcccccagagcccagctggcagcactgcccctacggcaagaagtgcacctacggcatcaagtgcaagttctaccaccctgagcggccccaccacgcccagctggccgtggctgatgagctgcgggccaagacaggagcccggctgggcgtgcggggccggcccccagccagcgcccggcctgctgccccagctgctggccgcaccccaccctag

SEQ ID NO: 176396 - DNA, 966 bp, Artificial Sequence
  Description of Artificial Sequence: Synthetic coding sequence
atggagcaccccagcaagatggagttcttccagaagctgggctatgaccgggaggatgtgctgcgggtgctgggcaagctgggggagggcgccctggtgaatgatgtgctgcaggagctgatcagaacaggcagcaggcctggggccctggagcaccctgctgccccccggctggtgccccggggcagctgtggggtgcctgattctgcccagaggggccctggaacagccctggaggaggacttccgcaccctggccagcagcctgcggcccatcgtgattgatggcagcaatgtggccatgagccacggcaacaaggagaccttcagctgccggggcatcaagctggccgtggactggttccgggaccggggccacacctacatcaaggtgtttgtgcccagctggaggaaggacccccccagggctgacacccccatccgggagcagcacgtgctggccgagctggagcggcaggccgtgctggtgtacacccccagcaggaaggtgcacggcaagaggctggtgtgctatgatgaccgctacatcgtgaaggtggcctatgagcaggatggagtcatcgtgtccaatgacaactacagagacctgcagagcgagaaccctgagtggaagtggttcatcgagcagaggctgctgatgttctcctttgtgaatgaccgcttcatgcccccagatgaccccctgggccgccacggccccagcctgagcaacttcctgagcaggaagcccaagcccccagagcccagctggcagcactgcccctacggcaagaagtgcacctacggcatcaagtgcaagttctaccaccctgagcggccccaccacgcccagctggccgtggctgatgagctgcgggccaagacaggagcccggcctgtgctgcccggccggcccccagccagcgcccggcctgctgccccagctgctggccgcaccccaccctag

SEQ ID NO: 176397 - DNA, 2211 bp, Artificial Sequence
  Description of Artificial Sequence: Synthetic coding sequence
atggagattggaacagagatcagcaggaagatccgcagcgccatcaagggcaagctgcaggagctgggcgcctacgtggatgaggagctgcctgactacatcatggtgatggtggccaacaagaagagccaggaccagatgacagaggacctgagcctcttcctgggcaacaacaccatccgcttcaccgtgtggctgcatggagtgctggacaagctgcggtctgtgaccacagagcccagcagcctgaagagcagtgacaccaacatctttgacagcaatgtgcccagcaacaagagcaacttcagcagaggagatgagaggagacatgaggccgctgtgccccccctggccatccccagcgcccggcctgagaagagggacagccgggtgtccaccagcagccaggagagcaagaccaccaacgtgcggcagacctatgatgatggagctgccacccggctgatgagcacagtgaagcccctgcgggagcccgcccccagtgaagatgtgattgacatcaagccagagccagatgacctgattgatgaggacctgaactttgtgcaggagaaccccctgagccagaagaagcccaccgtgaccctgacctacggcagcagccggcccagcattgagatctacagacctccagccagcagaaatgctgacagcggcgtgcacctgaaccggctgcagttccagcagcagcagaacagcatccatgctgccaagcagctggacatgcagagctcctgggtgtatgaaacaggccgcctgtgtgagcctgaggtgctgaacagcctggaggagacctacagccccttcttcaggaacaacagcgagaagatgtccatggaggatgagaacttcaggaagaggaagctgcctgtggtgtcctctgtggtgaaggtgaagaagttcaaccatgatggagaggaggaggaggaggatgatgattatggcagcaggacaggcagcatcagcagctctgtgtctgtgcctgccaagccagagcggcggcccagcctgccccccagcaagcaggccaacaagaacctgatcctgaaggccatcagcgaggcccaggagagcgtgaccaagaccaccaactacagcacagtgccccagaagcagaccctgcctgtggcccccaggaccaggaccagccaggaggagctgctggccgaggtggtgcagggccagagcaggaccccccgcatcagcccccccatcaaggaggaggagaccaagggggacagcgtggagaagaaccagggcacccagcagaggcagctgctgagccggctgcagattgatcctgtgatggccgagaccctgcagatgagccaggactactatgacatggagagcatggtgcacgccgacaccaggagcttcatcctgaagaagcccaagctgtctgaggaggtggtggtggcccccaaccaggagagcggcatgaagacagctgacagcctgcgggtgctgagcggccacctgatgcagacccgggacctggtgcagcctgacaagccagccagccccaagttcatcgtgaccctggatggagtgcccagccccccaggctacatgtctgaccaggaggaggacatgtgctttgagggcatgaagcctgtgaaccagacagctgccagcaacaagggcctgcggggcctgctgcacccccagcagctgcacctgctgagccggcagctggaggaccccaacggcagcttcagcaatgctgagatgtctgagctgtctgtggcccagaagccagagaagctgctggagcgctgcaagtactggccagcctgcaagaatggagatgaatgtgcctaccaccaccccatcagcccctgcaaggccttccccaactgcaagtttgctgagaagtgcctgtttgtgcaccccaactgcaagtatgatgccaagtgcaccaagccagactgccccttcacccacgtgtcccggcgcatccctgtgctgagccccaagccagctgtggcccccccagccccacccagcagcagccagctgtgccgctacttccctgcctgcaagaagatggagtgccccttctaccaccccaagcactgccgcttcaacacccagtgcaccaggccagactgcaccttctaccaccccaccatcaacgtgccccccaggcatgccctgaagtggatccggccccagaccagcgagtag

SEQ ID NO: 176398 - DNA, 1740 bp, Artificial Sequence
  Description of Artificial Sequence: Synthetic coding sequence
atggagattggaacagagatcagcaggaagatccgcagcgccatcaagggcaagctgcaggagctgggcgcctacgtggatgaggagctgcctgactacatcatggtgatggtggccaacaagaagagccaggaccagatgacagaggacctgagcctcttcctgggcaacaacaccatccgcttcaccgtgtggctgcatggagtgctggacaagctgcggtctgtgaccacagagcccagcagcctgaagagcagtgacaccaacatctttgacagcaatgtgcccagcaacaagagcaacttcagcagaggagatgagaggagacatgaggccgctgtgccccccctggccatccccagcgcccggcctgagaagagggacagccgggtgtccaccagcagccaggagagcaagaccaccaacgtgcggcagacctatgatgatggagctgccacccggctgatgagcacagtgaagcccctgcgggagcccgcccccagtgaagatgtgattgacatcaagccagagccagatgacctgattgatgaggacctgaactttgtgcaggagaaccccctgagccagaagaagcccaccgtgaccctgacctacggcagcagccggcccagcattgagatctacagacctccagccagcagaaatgctgacagcggcgtgcacctgaaccggctgcagttccagcagcagcagaacagcatccatgctgccaagcagctggacatgcagagctcctgggtgtatgaaacaggccgcctgtgtgagcctgaggtgctgaacagcctggaggagacctacagccccttcttcaggaacaacagcgagaagatgtccatggaggatgagaacttcaggaagaggaagctgcctgtggtgtcctctgtggtgaaggtgaagaagttcaaccatgatggagaggaggaggaggaggatgatgattatggcagcaggacaggcagcatcagcagctctgtgtctgtgcctgccaagccagagcggcggcccagcctgccccccagcaagcaggccaacaagaacctgatcctgaaggccatcagcgaggcccaggagagcgtgaccaagaccaccaactacagcacagtgccccagaagcagaccctgcctgtggcccccaggaccaggaccagccaggaggagctgctggccgaggtggtgcagggccagagcaggaccccccgcatcagcccccccatcaaggaggaggagaccaagggggacagcgtggagaagaaccaggccgagatgtctgagctgtctgtggcccagaagccagagaagctgctggagcgctgcaagtactggccagcctgcaagaatggagatgaatgtgcctaccaccaccccatcagcccctgcaaggccttccccaactgcaagtttgctgagaagtgcctgtttgtgcaccccaactgcaagtatgatgccaagtgcaccaagccagactgccccttcacccacgtgtcccggcgcatccctgtgctgagccccaagcctgtggcccccccagccccacccagcagcagccagctgtgccgctacttccctgcctgcaagaagatggagtgccccttctaccaccccaagcactgccgcttcaacacccagtgcaccaggccagactgcaccttctaccaccccaccatcaacgtgcccccaagacatgccctgaagtggatccggccccagaccagcgagtag

SEQ ID NO: 176399 - DNA, 921 bp, Artificial Sequence
  Description of Artificial Sequence: Synthetic coding sequence
atgaggatgagcagcaagttccccagcccccccctgcccatcttcctgcccccagagcctgtggacctgggcagcatcaccagcagcagctgcagcctgaatgagctggacaacatcagccacctgctgaggaagatctctgctgacatcaatgagatcaagggcatgaaggccgccatcctgactgtggaggccaacctgtttgacctgaatgtgcgggtgtccaagaatgaggccaagatcagcagcctggaggtgaagatgaatgagtacagcaccacctatgagtgcaaccggcagtttgaggaccaggaggaggacacagagagccagagcaggaccacagatgtgaagatcatcggcttcctgagaaatgtggagaagggcacccagcagaggcagctgctgagccggctgcagattgatcctgtgatggccgagaccctgcagatgagccaggccgagatgtctgagctgtctgtggcccagaagccagagaagctgctggagcgctgcaagtactggccagcctgcaagaatggagatgaatgtgcctaccaccaccccatcagcccctgcaaggccttccccaactgcaagtttgctgagaagtgcctgtttgtgcaccccaactgcaagtatgatgccaagtgcaccaagccagactgccccttcacccacgtgagccgccgcatccctgtgctgagccccaagcctgtggcccccccagccccacccagcagcagccagctgtgccgctacttccctgcctgcaagaagatggagtgccccttctaccaccccaagcactgccgcttcaacacccagtgcaccaggccagactgcaccttctaccaccccaccatcaacgtgccccccaggcatgccctgaagtggatccggccccagaccagcgagtag

SEQ ID NO: 176400 - DNA, 1716 bp, Artificial Sequence
  Description of Artificial Sequence: Synthetic coding sequence
atggtgatggtggccaacaagaagagccaggaccagatgacagaggacctgagcctcttcctgggcaacaacaccatccgcttcaccgtgtggctgcatggagtgctggacaagctgcggtctgtgaccacagagcccagcagcctgaagagcagtgacaccaacatctttgacagcaatgtgcccagcaacaagagcaacttcagcagaggagatgagaggagacatgaggccgctgtgccccccctggccatccccagcgcccggcctgagaagagggacagccgggtgtccaccagcagccaggagagcaagaccaccaacgtgcggcagacctatgatgatggagctgccacccggctgatgagcacagtgaagcccctgcgggagcccgcccccagtgaagatgtgattgacatcaagccagagccagatgacctgattgatgaggacctgaactttgtgcaggagaaccccctgagccagaagaagcccaccgtgaccctgacctacggcagcagccggcccagcattgagatctacagacctccagccagcagaaatgctgacagcggcgtgcacctgaaccggctgcagttccagcagcagcagaacagcatccatgctgccaagcagctggacatgcagagctcctgggtgtatgaaacaggccgcctgtgtgagcctgaggtgctgaacagcctggaggagacctacagccccttcttcaggaacaacagcgagaagatgtccatggaggatgagaacttcaggaagaggaagctgcctgtggtgtcctctgtggtgaaggtgaagaagttcaaccatgatggagaggaggaggaggaggatgatgattatggcagcaggacaggcagcatcagcagctctgtgtctgtgcctgccaagccagagcggcggcccagcctgccccccagcaagcaggccaacaagaacctgatcctgaaggccatcagcgaggcccaggagagcgtgaccaagaccaccaactacagcacagtgccccagaagcagaccctgcctgtggcccccaggaccaggaccagccaggaggagctgctggccgaggtggtgcagggccagagcaggaccccccgcatcagcccccccatcaaggaggaggagaccaagggggacagcgtggagaagaaccagggcacccagcagaggcagctgctgagccggctgcagattgatcctgtgatggccgagaccctgcagatgagccaggccgagatgtctgagctgtctgtggcccagaagccagagaagctgctggagcgctgcaagtactggccagcctgcaagaatggagatgaatgtgcctaccaccaccccatcagcccctgcaaggccttccccaactgcaagtttgctgagaagtgcctgtttgtgcaccccaactgcaagtatgatgccaagtgcaccaagccagactgccccttcacccacgtgagccgccgcatccctgtgctgagccccaagccagctgtggcccccccagccccacccagcagcagccagctgtgccgctacttccctgcctgcaagaagatggagtgccccttctaccaccccaagcactgccgcttcaacacccagtgcaccaggccagactgcaccttctaccaccccaccatcaacgtgcccccaagacatgccctgaagtggatccggccccagaccagcgagtag

SEQ ID NO: 176401 - DNA, 2022 bp, Artificial Sequence
  Description of Artificial Sequence: Synthetic coding sequence
atggagattggaacagagatcagcaggaagatccgcagcgccatcaagggcaagctgcaggagctgggcgcctacattgatgaggagctgcctgactacatcatggtgatggtggccaacaagaagagccaggaccagatgacagaggacctgagcctcttcctgggcaacaacaccatccgcttcaccgtgtggctgcatggagtgctggacaagctgcggtctgtgaccacagagcccagcagcctgaagagcagtgacaccaacatctttgacagcaatgtgcccagcaacaagagcaacttcagcagaggagatgagaggagacatgaggccgctgtgccccccctggccatccccagcgcccggcctgagaagagggacagccgggtgtccaccagcagccaggagagcaagaccaccaacgtgcggcagacctatgatgatggagctgccacccggctgatgagcacagtgaagcccctgcgggagcccgcccccagtgaagatgtgattgacatcaagccagagccagatgacctgattgatgaggacctgaactttgtgcaggagaaccccctgagccagaagaagcccaccgtgaccctgacctacggcagcagccggcccagcattgagatctacagacctccagccagcagaaatgctgacagcggcgtgcacctgaaccggctgcagttccagcagcagcagaacagcatccatgctgccaagcagctggacatgcagagctcctgggtgtatgaaacaggccgcctgtgtgagcctgaggtgctgaacagcctggaggagacctacagccccttcttcaggaacaacagcgagaagatgtccatggaggatgagaacttcaggaagaggaagctgcctgtggtgtcctctgtggtgaaggtgaagaagttcaaccatgatggagaggaggaggaggaggatgatgattatggcagcaggacaggcagcatcagcagctctgtgtctgtgcctgccaagccagagcggcggcccagcctgccccccagcaagcaggccaacaagaacctgatcctgaaggccatcagcgaggcccaggagagcgtgaccaagaccaccaactacagcacagtgccccagaagcagaccctgcctgtggcccccaggaccaggaccagccaggaggagctgctggccgaggtggtgcagggccagagcaggaccccccgcatcagcccccccatcaaggaggaggagaccaagggggacagcgtggagaagaaccagggcacccagcagaggcagctgctgagccggctgcagattgatcctgtgatggccgagaccctgcagatgagccaggactactatgacatggagagcatggtgcacgccgacaccaggagcttcatcctgaagaagcccaagctgtctgaggaggtggtggtggcccccaaccaggagagcggcatgaagacagctgacagcctgcgggtgctgagcggccacctgatgcagacccgggacctggtgcagcctgacaagccagccagccccaagttcatcgtgaccctggatggagtgcccagccccccaggctacatgtctgaccaggaggaggacatgtgctttgagggcatgaagcctgtgaaccagacagctgccagcaacaagggcctgcggggcctgctgcacccccagcagctgcacctgctgagccggcagctggaggaccccaactgcaagtatgatgccaagtgcaccaagccagactgccccttcacccacgtgagccgccgcatccctgtgctgagccccaagccagctgtggcccccccagccccacccagcagcagccagctgtgccgctacttccctgcctgcaagaagatggagtgccccttctaccaccccaagcactgccgcttcaacacccagtgcaccaggccagactgcaccttctaccaccccaccatcaacgtgcccccaagacatgccctgaagtggatccggccccagaccagcgagtag

SEQ ID NO: 176402 - DNA, 1716 bp, Artificial Sequence; identical to SEQ ID NO: 176400
  Description of Artificial Sequence: Synthetic coding sequence

SEQ ID NO: 176403 - DNA, 1758 bp, Artificial Sequence
  Description of Artificial Sequence: Synthetic coding sequence
atggagattggaacagagatcagcaggaagatccgcagcgccatcaagggcaagctgcaggagctgggcgcctacgtggatgaggagctgcctgactacatcatggtgatggtggccaacaagaagagccaggaccagatgacagaggacctgagcctcttcctgggcaacaacaccatccgcttcaccgtgtggctgcatggagtgctggacaagctgcggtctgtgaccacagagcccagcagcctgaagagcagtgacaccaacatctttgacagcaatgtgccccccctggccatccccagcgcccggcctgagaagagggacagccgggtgtccaccagcagccaggagagcaagaccaccaacgtgcggcagacctatgatgatggagctgccacccggctgatgagcacagtgaagcccctgcgggagcccgcccccagtgaagatgtgattgacatcaagccagagccagatgacctgattgatgaggacctgaactttgtgcaggagaaccccctgagccagaagaagcccaccgtgaccctgacctacggcagcagccggcccagcattgagatctaccggcccccagccagcagaaatgctgacagcggcgtgcacctgaaccggctgcagttccagcagcagcagaacagcatccacgccgccaagcagctggacatgcagagctcctgggtgtatgagaccggccgcctgtgtgagcctgaggtgctgaacagcctggaggagacctacagccccttcttcaggaacaacagcgagaagatgtccatggaggatgagaacttcaggaagaggaagctgcctgtggtgtcctctgtggtgaaggtgaagaagttcaaccatgatggagaggaggaggaggaggatgatgattatggcagcaggacaggcagcatcagcagctctgtgtctgtgcctgccaagccagagcggcggcccagcctgccccccagcaagcaggccaacaagaacctgatcctgaaggccatcagcgaggcccaggagagcgtgaccaagaccaccaactacagcacagtgccccagaagcagaccctgcctgtggcccccaggaccaggaccagccaggaggagctgctggccgaggtggtgcagggccagagcaggaccccccgcatcagcccccccatcaaggaggaggagaccaagggggacagcgtggagaagaaccagggcacccagcagaggcagctgctgagccggctgcagattgatcctgtgatggccgagaccctgcagatgagccaggccgagatgtctgagctgtctgtggcccagaagccagagaagctgctggagcgctgcaagtactggccagcctgcaagaatggagatgaatgtgcctaccaccaccccatcagcccctgcaaggccttccccaactgcaagtttgctgagaagtgcctgtttgtgcaccccaactgcaagtatgatgccaagtgcaccaagccagactgccccttcacccacgtgtcccggcgcatccctgtgctgagccccaagcctgtggcccccccagccccacccagcagcagccagctgtgccgctacttccctgcctgcaagaagatggagtgccccttctaccaccccaagcactgccgcttcaacacccagtgcaccaggccagactgcaccttctaccaccccaccatcaacgtgcccccaagacatgccctgaagtggatccggccccagaccagcgagtag

SEQ ID NO: 176404 - DNA, 2136 bp, Artificial Sequence
  Description of Artificial Sequence: Synthetic coding sequence
atggagattggaacagagatcagcaggaagatccgcagcgccatcaagggcaagctgcaggagctgggcgcctacgtggatgaggagctgcctgactacatcatggtgatggtggccaacaagaagagccaggaccagatgacagaggacctgagcctcttcctgggcaacaacaccatccgcttcaccgtgtggctgcatggagtgctggacaagctgcggtctgtgaccacagagcccagcagcctgaagagcagtgacaccaacatctttgacagcaatgtgcccagcaacaagagcaacttcagcagaggagatgagaggagacatgaggccgctgtgccccccctggccatccccagcgcccggcctgagaagagggacagccgggtgtccaccagcagccaggagagcaagaccaccaacgtgcggcagacctatgatgatggagctgccacccggctgatgagcacagtgaagcccctgcgggagcccgcccccagtgaagatgtgattgacatcaagccagagccagatgacctgattgatgaggacctgaactttgtgcaggagaaccccctgagccagaagaagcccaccgtgaccctgacctacggcagcagccggcccagcattgagatctacagacctccagccagcagaaatgctgacagcggcgtgcacctgaaccggctgcagttccagcagcagcagaacagcatccatgctgccaagcagctggacatgcagagctcctgggtgtatgaaacaggccgcctgtgtgagcctgaggtgctgaacagcctggaggagacctacagccccttcttcaggaacaacagcgagaagatgtccatggaggatgagaacttcaggaagaggaagctgcctgtggtgtcctctgtggtgaaggtgaagaagttcaaccatgatggagaggaggaggaggaggatgatgattatggcagcaggacaggcagcatcagcagctctgtgtctgtgcctgccaagccagagcggcggcccagcctgccccccagcaagcaggccaacaagaacctgatcctgaaggccatcagcgaggcccaggagagcgtgaccaagaccaccaactacagcacagtgccccagaagcagaccctgcctgtggcccccaggaccaggaccagccaggaggagctgctggccgaggtggtgcagggccagagcaggaccccccgcatcagcccccccatcaaggaggaggagaccaagggggacagcgtggagaagaaccaggactactatgacatggagagcatggtgcatgctgacaccaggagcttcatcctgaagaagcccaagctgtctgaggaggtggtggtggcccccaaccaggagagcggcatgaagacagctgacagcctgcgggtgctgagcggccacctgatgcagacccgggacctggtgcagcctgacaagccagccagccccaagttcatcgtgaccctggatggagtgcccagccccccaggctacatgtctgaccaggaggaggacatgtgctttgagggcatgaagcctgtgaaccagacagctgccagcaacaagggcctgcggggcctgctgcacccccagcagctgcacctgctgagccggcagctggaggaccccaacggcagcttcagcaatgctgagatgtctgagctgtctgtggcccagaagccagagaagctgctggagcgctgcaagtactggccagcctgcaagaatggagatgaatgtgcctaccaccaccccatcagcccctgcaaggccttccccaactgcaagtttgctgagaagtgcctgtttgtgcaccccaactgcaagtatgatgccaagtgcaccaagccagactgccccttcacccacgtgagccgccgcatccctgtgctgagccccaagccagctgtggcccccccagccccacccagcagcagccagctgtgccgctacttccctgcctgcaagaagatggagtgccccttctaccaccccaagcactgccgcttcaacacccagtgcaccaggccagactgcaccttctaccaccccaccatcaacgtgcccccaagacatgccctgaagtggatccggccccagaccagcgagtag

SEQ ID NO: 176405 - DNA, 2136 bp, Artificial Sequence
  Description of Artificial Sequence: Synthetic coding sequence
atggagattggaacagagatcagcaggaagatccgcagcgccatcaagggcaagctgcaggagctgggcgcctacattgatgaggagctgcctgactacatcatggtgatggtggccaacaagaagagccaggaccagatgacagaggacctgagcctcttcctgggcaacaacaccatccgcttcaccgtgtggctgcatggagtgctggacaagctgcggtctgtgaccacagagcccagcagcctgaagagcagtgacaccaacatctttgacagcaatgtgcccagcaacaagagcaacttcagcagaggagatgagaggagacatgaggccgctgtgccccccctggccatccccagcgcccggcctgagaagagggacagccgggtgtccaccagcagccaggagagcaagaccaccaacgtgcggcagacctatgatgatggagctgccacccggctgatgagcacagtgaagcccctgcgggagcccgcccccagtgaagatgtgattgacatcaagccagagccagatgacctgattgatgaggacctgaactttgtgcaggagaaccccctgagccagaagaagcccaccgtgaccctgacctacggcagcagccggcccagcattgagatctacagacctccagccagcagaaatgctgacagcggcgtgcacctgaaccggctgcagttccagcagcagcagaacagcatccatgctgccaagcagctggacatgcagagctcctgggtgtatgaaacaggccgcctgtgtgagcctgaggtgctgaacagcctggaggagacctacagccccttcttcaggaacaacagcgagaagatgtccatggaggatgagaacttcaggaagaggaagctgcctgtggtgtcctctgtggtgaaggtgaagaagttcaaccatgatggagaggaggaggaggaggatgatgattatggcagcaggacaggcagcatcagcagctctgtgtctgtgcctgccaagccagagcggcggcccagcctgccccccagcaagcaggccaacaagaacctgatcctgaaggccatcagcgaggcccaggagagcgtgaccaagaccaccaactacagcacagtgccccagaagcagaccctgcctgtggcccccaggaccaggaccagccaggaggagctgctggccgaggtggtgcagggccagagcaggaccccccgcatcagcccccccatcaaggaggaggagaccaagggggacagcgtggagaagaaccaggactactatgacatggagagcatggtgcatgctgacaccaggagcttcatcctgaagaagcccaagctgtctgaggaggtggtggtggcccccaaccaggagagcggcatgaagacagctgacagcctgcgggtgctgagcggccacctgatgcagacccgggacctggtgcagcctgacaagccagccagccccaagttcatcgtgaccctggatggagtgcccagccccccaggctacatgtctgaccaggaggaggacatgtgctttgagggcatgaagcctgtgaaccagacagctgccagcaacaagggcctgcggggcctgctgcacccccagcagctgcacctgctgagccggcagctggaggaccccaacggcagcttcagcaatgctgagatgtctgagctgtctgtggcccagaagccagagaagctgctggagcgctgcaagtactggccagcctgcaagaatggagatgaatgtgcctaccaccaccccatcagcccctgcaaggccttccccaactgcaagtttgctgagaagtgcctgtttgtgcaccccaactgcaagtatgatgccaagtgcaccaagccagactgccccttcacccacgtgagccgccgcatccctgtgctgagccccaagccagctgtggcccccccagccccacccagcagcagccagctgtgccgctacttccctgcctgcaagaagatggagtgccccttctaccaccccaagcactgccgcttcaacacccagtgcaccaggccagactgcaccttctaccaccccaccatcaacgtgcccccaagacatgccctgaagtggatccggccccagaccagcgagtag

SEQ ID NO: 176406 - DNA, 849 bp, Artificial Sequence
  Description of Artificial Sequence: Synthetic coding sequence
atgaggatgagcagcaagttccccagcccccccctgcccatcttcctgcccccagagcctgtggacctgggcagcatcaccagcagcagctgcagcctgaatgagctggacaacatcagccacctgctgaggaagatctctgctgacatcaatgagatcaagggcatgaaggccgccatcctgactgtggaggccaacctgtttgacctgaatgtgcgggtgtccaagaatgaggccaagatcagcagcctggaggtgaagatgaatgagtacagcaccacctatgagtgcaaccggcagtttgaggaccaggaggaggacacagagagccagagcaggaccacagatgtgaagatcatcggcttcctgagaaatgtggagaaggccgagatgtctgagctgtctgtggcccagaagccagagaagctgctggagcgctgcaagtactggccagcctgcaagaatggagatgaatgtgcctaccaccaccccatcagcccctgcaaggccttccccaactgcaagtttgctgagaagtgcctgtttgtgcaccccaactgcaagtatgatgccaagtgcaccaagccagactgccccttcacccacgtgtcccggcgcatccctgtgctgagccccaagccagctgtggcccccccagccccacccagcagcagccagctgtgccgctacttccctgcctgcaagaagatggagtgccccttctaccaccccaagcactgccgcttcaacacccagtgcaccaggccagactgcaccttctaccaccccaccatcaacgtgccccccaggcatgccctgaagtggatccggccccagaccagcgagtag

SEQ ID NO: 176407 - DNA, 219 bp, Artificial Sequence
  Description of Artificial Sequence: Synthetic coding sequence
atggtgatggtggccaacaagaagagccaggaccagatgacagaggacctgagcctcttcctgggcaacaacaccatccgcttcaccgtgtggctgcatggagtgctggacaagctgcggtctgtgaccacagagcccagcagcctgaagagcagtgacaccaacatctttgacagcaatgtgcccagcaacaagagcaacttcagcagaggagactag

SEQ ID NO: 176408 - DNA, 285 bp, Artificial Sequence
  Description of Artificial Sequence: Synthetic coding sequence
atggtgatggtggccaacaagaagagccaggaccagatgacagaggacctgagcctcttcctgggcaacaacaccatccgcttcaccgtgtggctgcatggagtgctggacaagctgcggtctgtgaccacagagcccagcagcctgaagagcagtgacaccaacatctttgacagcaatgtgcccagcaacaagagcaacttcagcagaggagatgagaggagacatgaggccgctgtgccccccctggccatccccagcgcccggcctgagaagagggactag

SEQ ID NO: 176409 - DNA, 648 bp, Artificial Sequence
  Description of Artificial Sequence: Synthetic coding sequence
atggtgatggtggccaacaagaagagccaggaccagatgacagaggacctgagcctcttcctgggcaacaacaccatccgcttcaccgtgtggctgcatggagtgctggacaagctgcggtctgtgaccacagagcccagcagcctgaagagcagtgacaccaacatctttgacagcaatgtgcccagcaacaagagcaacttcagcagaggagatgagaggagacatgaggccgctgtgccccccctggccatccccagcgcccggcctgagaagagggacagccgggtgtccaccagcagccaggagagcaagaccaccaacgtgcggcagacctatgatgatggagctgccacccggctgatgagcacagtgaagcccctgcgggagcccgcccccagtgaagatgtgattgacatcaagccagagccagatgacctgattgatgaggacctgaactttgtgcaggagaaccccctgagccagaagaagcccaccgtgaccctgacctacggcagcagccggcccagcattgagatctacagacctccagccagcagaaatgctgacagcggcgtgcacctgaaccggctgcagttccagcagcagcagaacagcatccatgctgccaagcagctggacatgtag

SEQ ID NO: 176410 - DNA, 1956 bp, Artificial Sequence
  Description of Artificial Sequence: Synthetic coding sequence
tgaagtgacaccaacatctttgacagcaatgtgcccagcaacaagagcaacttcagcagaggagatgagaggagacatgaggccgctgtgccccccctggccatccccagcgcccggcctgagaagagggacagccgggtgtccaccagcagccaggagagcaagaccaccaacgtgcggcagacctatgatgatggagctgccacccggctgatgagcacagtgaagcccctgcgggagcccgcccccagtgaagatgtgattgacatcaagccagagccagatgacctgattgatgaggacctgaactttgtgcaggagaaccccctgagccagaagaagcccaccgtgaccctgacctacggcagcagccggcccagcattgagatctacagacctccagccagcagaaatgctgacagcggcgtgcacctgaaccggctgcagttccagcagcagcagaacagcatccatgctgccaagcagctggacatgcagagctcctgggtgtatgaaacaggccgcctgtgtgagcctgaggtgctgaacagcctggaggagacctacagccccttcttcaggaacaacagcgagaagatgtccatggaggatgagaacttcaggaagaggaagctgcctgtggtgtcctctgtggtgaaggtgaagaagttcaaccatgatggagaggaggaggaggaggatgatgattatggcagcaggacaggcagcatcagcagctctgtgtctgtgcctgccaagccagagcggcggcccagcctgccccccagcaagcaggccaacaagaacctgatcctgaaggccatcagcgaggcccaggagagcgtgaccaagaccaccaactacagcacagtgccccagaagcagaccctgcctgtggcccccaggaccaggaccagccaggaggagctgctggccgaggtggtgcagggccagagcaggaccccccgcatcagcccccccatcaaggaggaggagaccaagggggacagcgtggagaagaaccagggcacccagcagaggcagctgctgagccggctgcagattgatcctgtgatggccgagaccctgcagatgagccaggactactatgacatggagagcatggtgcacgccgacaccaggagcttcatcctgaagaagcccaagctgtctgaggaggtggtggtggcccccaaccaggagagcggcatgaagacagctgacagcctgcgggtgctgagcggccacctgatgcagacccgggacctggtgcagcctgacaagccagccagccccaagttcatcgtgaccctggatggagtgcccagccccccaggctacatgtctgaccaggaggaggacatgtgctttgagggcatgaagcctgtgaaccagacagctgccagcaacaagggcctgcggggcctgctgcacccccagcagctgcacctgctgagccggcagctggaggaccccaacggcagcttcagcaatgctgagatgtctgagctgtctgtggcccagaagccagagaagctgctggagcgctgcaagtactggccagcctgcaagaatggagatgaatgtgcctaccaccaccccatcagcccctgcaaggccttccccaactgcaagtttgctgagaagtgcctgtttgtgcaccccaactgcaagtatgatgccaagtgcaccaagccagactgccccttcacccacgtgtcccggcgcatccctgtgctgagccccaagcctgtggcccccccagccccacccagcagcagccagctgtgccgctacttccctgcctgcaagaagatggagtgccccttctaccaccccaagcactgccgcttcaacacccagtgcaccaggccagactgcaccttctaccaccccaccatcaacgtgcccccaagacatgccctgaagtggatccggccccagaccagcgagtag

SEQ ID NO: 176411 - DNA, 402 bp, Artificial Sequence
  Description of Artificial Sequence: Synthetic coding sequence
atggtgatggtggccaacaagaagagccaggaccagatgacagaggacctgagcctcttcctgggcaacaacaccatccgcttcaccgtgtggctgcatggagtgctggacaagctgcggtctgtgaccacagagcccagcagcctgaagagcagtgacaccaacatctttgacagcaatgtgcccagcaacaagagcaacttcagcagaggagatgagaggagacatgaggccgctgtgccccccctggccatccccagcgcccggcctgagaagagggacagccgggtgtccaccagcagccaggagagcaagaccaccaacgtgcggcagacctatgatgatggagctgccacccggctgatgagcacagtgaagcccctgcgggagcccgccccctag

SEQ ID NO: 176412 - DNA, 2193 bp, Artificial Sequence
  Description of Artificial Sequence: Synthetic coding sequence
atggagattggaacagagatcagcaggaagatccgcagcgccatcaagggcaagctgcaggagctgggcgcctacgtggatgaggagctgcctgactacatcatggtgatggtggccaacaagaagagccaggaccagatgacagaggacctgagcctcttcctgggcaacaacaccatccgcttcaccgtgtggctgcatggagtgctggacaagctgcggtctgtgaccacagagcccagcagcctgaagagcagtgacaccaacatctttgacagcaatgtgcccagcaacaagagcaacttcagcagaggagatgagaggagacatgaggccgctgtgccccccctggccatccccagcgcccggcctgagaagagggacagccgggtgtccaccagcagccaggagagcaagaccaccaacgtgcggcagacctatgatgatggagctgccacccggctgatgagcacagtgaagcccctgcgggagcccgcccccagtgaagatgtgattgacatcaagccagagccagatgacctgattgatgaggacctgaactttgtgcaggagaaccccctgagccagaagaagcccaccgtgaccctgacctacggcagcagccggcccagcattgagatctacagacctccagccagcagaaatgctgacagcggcgtgcacctgaaccggctgcagttccagcagcagcagaacagcatccatgctgccaagcagctggacatgcagagctcctgggtgtatgaaacaggccgcctgtgtgagcctgaggtgctgaacagcctggaggagacctacagccccttcttcaggaacaacagcgagaagatgtccatggaggatgagaacttcaggaagaggaagctgcctgtggtgtcctctgtggtgaaggtgaagaagttcaaccatgatggagaggaggaggaggaggatgatgattatggcagcaggacaggcagcatcagcagctctgtgtctgtgcctgccaagccagagcggcggcccagcctgccccccagcaagcaggccaacaagaacctgatcctgaaggccatcagcgaggcccaggagagcgtgaccaagaccaccaactacagcacagtgccccagaagcagaccctgcctgtggcccccaggaccaggaccagccaggaggagctgctggccgaggtggtgcagggccagagcaggaccccccgcatcagcccccccatcaaggaggaggagaccaagggggacagcgtggagaagaaccagggcacccagcagaggcagctgctgagccggctgcagattgatcctgtgatggccgagaccctgcagatgagccaggactactatgacatggagagcatggtgcacgccgacaccaggagcttcatcctgaagaagcccaagctgtctgaggaggtggtggtggcccccaaccaggagagcggcatgaagacagctgacagcctgcgggtgctgagcggccacctgatgcagacccgggacctggtgcagcctgacaagccagccagccccaagttcatcgtgaccctggatggagtgcccagccccccaggctacatgtctgaccaggaggaggacatgtgctttgagggcatgaagcctgtgaaccagacagctgccagcaacaagggcctgcggggcctgctgcacccccagcagctgcacctgctgagccggcagctggaggaccccaatgctgagatgtctgagctgtctgtggcccagaagccagagaagctgctggagcgctgcaagtactggccagcctgcaagaatggagatgaatgtgcctaccaccaccccatcagcccctgcaaggccttccccaactgcaagtttgctgagaagtgcctgtttgtgcaccccaactgcaagtatgatgccaagtgcaccaagccagactgccccttcacccacgtgagccgccgcatccctgtgctgagccccaagcctgtggcccccccagccccacccagcagcagccagctgtgccgctacttccctgcctgcaagaagatggagtgccccttctaccaccccaagcactgccgcttcaacacccagtgcaccaggccagactgcaccttctaccaccccaccatcaacgtgccccccaggcatgccctgaagtggatccggccccagaccagcgagtag

SEQ ID NO: 176413 - DNA, 2709 bp, Artificial Sequence
  Description of Artificial Sequence: Synthetic coding sequence
atggctgaccctgaggtgtgctgcttcatcaccaagatcctgtgtgcccatggaggccgcatggccctggatgccctgctgcaggagatcgccctgtctgagccccagctgtgtgaggtgctgcaggtggccggccctgacagatttgtggtgctggagaccggcggggaggccggcatcaccaggtctgtggtggccaccacccgggcccgggtgtgcaggaggaagtactgccagaggccctgtgacaacctgcacctgtgcaagctgaacctgctgggccgctgcaactacagccagagcgagaggaacctgtgcaagtacagccatgaggtgctgtctgaggagaacttcaaggtgctgaagaaccacgagctgagcggcctgaacaaggaggagctggccgtgctgctgctgcagagcgaccccttcttcatgcctgagatctgcaagagctacaagggggagggccggcagcagatctgcaaccagcagcccccctgcagccggctgcacatctgtgaccacttcacccggggcaactgccgcttccccaactgcctgcggagccacaacctgatggacaggaaggtgctggccatcatgagggagcacggcctgaacccagatgtggtgcagaacatccaggacatctgcaacagcaagcacatgcagaagaaccccccaggcccccgggcccccagcagccacagaagaaacatggcctaccgggcccggagcaagagccgggaccgcttcttccagggcagccaggagttcctggccagcgccagcgccagcgctgagaggagctgcacccccagcccagaccagatcagccaccgggccagcctggaggatgcccctgtggatgacctgaccaggaagttcacctacctgggcagccaggaccgggcccggccccccagcggcagcagcaaggccacagacctgggcggcaccagccaggccggcaccagccagcgcttcctggagaatggcagccaggaggacctgctgcacggcaaccctggcagcacctacctggccagcaacagcaccagcgcccccaactggaagagcctgacctcctggaccaatgaccagggcgcccggaggaagacagtgttcagccccaccctgcctgctgcccggagcagcctgggcagcctgcagaccccagaggccgtgaccaccaggaaaggaacaggcctgctgagcagtgactaccgcatcatcaacgggaagagcggcacccaggacatccagcccggccccctcttcaacaacaatgctgatggagtggccacagacatcaccagcaccaggagcctgaactacaagagcaccagcagcggccaccgggagatcagcagcccccgcatccaggatgctggccctgccagcagagatgtgcaggccaccggcagaattgctgatgatgctgacccccgggtggccctggtgaatgacagcctgagtgatgtgaccagcaccaccagcagccgggtggatgaccatgattctgaggagatctgcctggaccacctgtgcaagggctgccccctgaatggcagctgcagcaaggtgcacttccacctgccctaccgctggcagatgctgattggcaagacctggacagactttgagcacatggagaccatcgagaagggctactgcaaccctggcatccacctgtgcagcgtgggcagctacaccatcaacttccgggtgatgagctgtgacagcttccccatccggcggctgagcacccccagctctgtgaccaagccagccaacagcgtcttcaccaccaagtggatctggtactggaagaatgaaagtggcacctggatccagtatggagaggagaaggacaagaggaagaacagcaatgtggacagcagctacctggagagcctgtaccagagctgcccccggggcgtggtgcccttccaggccggcagcagaaattatgagctgtccttccagggcatgatccagaccaacatcgccagcaagacccagaaggatgtgatcagaagacccacctttgtgccccagtggtacgtgcagcagatgaagaggggccctgaccaccagcctgccaagaccagctctgtgtccctgacagccaccttccggccccaggaggacttctgcttcctgagcagcaagaagtacaagctgtctgagatccaccacctgcacccagaatatgtgcgggtgtctgagcacttcaaggcctccatgaagaacttcaagattgagaagatcaagaagattgaaaattctgagctgctggacaagttcacctggaagaagagccagatgaaggaggagggcaagctgctcttctacgccaccagccgggcctacgtggagagcatctgcagcaacaactttgacagcttcctgcacgagacccatgagaacaagtatggcaagggcatctactttgccaaggatgccatctacagccacaagaactgcccctatgatgccaagaatgtggtgatgtttgtggcccaggtgctggtgggcaagttcacagagggcaacatcacctacaccagccccccaccccagtttgacagctgtgtggacaccaggagcaaccccagcgtgtttgtgatcttccagaaggaccaggtgtacccccagtatgtgattgagtacacagaggacaaggcctgtgtgatctcctag

SEQ ID NO: 176414 - DNA, 2100 bp, Artificial Sequence
  Description of Artificial Sequence: Synthetic coding sequence
atggctgaccctgaggtgtgctgcttcatcaccaagatcctgtgtgcccatggaggccgcatggccctggatgccctgctgcaggagatcgccctgtctgagccccagctgtgtgaggtgctgcaggtggccggccctgacagatttgtggtgctggagaccggcggggaggccggcatcaccaggtctgtggtggccaccacccgggcccgggtgtgcaggaggaagtactgccagaggccctgtgacaacctgcacctgtgcaagctgaacctgctgggccgctgcaactacagccagagcgagaggaacctgtgcaagtacagccatgaggtgctgtctgaggagaacttcaaggtgctgaagaaccacgagctgagcggcctgaacaaggaggagctggccgtgctgctgctgcagagcgaccccttcttcatgcctgagatctgcaagagctacaagggggagggccggcagcagatctgcaaccagcagcccccctgcagccggctgcacatctgtgaccacttcacccggggcaactgccgcttccccaactgcctgcggagccacaacctgatggacaggaaggtgctggccatcatgagggagcacggcctgaacccagatgtggtgcagaacatccaggacatctgcaacagcaagcacatgcagaagaaccccccaggcccccgggcccccagcagccacagaagaaacatggcctaccgggcccggagcaagagccgggaccgcttcttccagggcagccaggagttcctggccagcgccagcgccagcgctgagaggagctgcacccccagcccagaccagatcagccaccgggccagcctggaggatgcccctgtggatgacctgaccaggaagttcacctacctgggcagccaggaccgggcccggccccccagcggcagcagcaaggccacagacctgggcggcaccagccaggccggcaccagccagcgcttcctggagaatggcagccaggaggacctgctgcacggcaaccctggcagcacctacctggccagcaacagcaccagcgcccccaactggaagagcctgacctcctggaccaatgaccagggcgcccggaggaagacagtgttcagccccaccctgcctgctgcccggagcagcctgggcagcctgcagaccccagaggccgtgaccaccaggaaaggaacaggcctgctgagcagtgactaccgcatcatcaacgggaagagcggcacccaggacatccagcccggccccctcttcaacaacaatgctgatggagtggccacagacatcaccagcaccaggagcctgaactacaagagcaccagcagcggccaccgggagatcagcagcccccgcatccaggatgctggccctgccagcagagatgtgcaggccaccggcagaattgctgatgatgctgacccccgggtggccctggtgaatgacagcctgagtgatgtgaccagcaccaccagcagccgggtggatgaccatgattctgaggagatctgcctggaccacctgtgcaagggctgccccctgaatggcagctgcagcaaggtgcacttccacctgccctaccgctggcagatgctgattggcaagacctggacagactttgagcacatggagaccatcgagaagggctactgcaaccctggcatccacctgtgcagcgtgggcagctacaccatcaacttccgggtgatgagctgtgacagcttccccatccggcggctgagcacccccagctctgtgaccaagccagccaacagcgtcttcaccaccaagtggatctggtactggaagaatgaaagtggcacctggatccagtatggagaggagaaggacaagaggaagaacagcaatgtggacagcagctacctggagagcctgtaccagagctgcccccggggcgtggtgcccttccaggccggcagcagaaattatgagctgtccttccagggcatgatccagaccaacatcgccagcaagacccagaaggatgtgatcagaagacccacctttgtgccccagtggtacgtgcagcagatgaagaggggccctgagtag

SEQ ID NO: 176415 - DNA, 1521 bp, Artificial Sequence
  Description of Artificial Sequence: Synthetic coding sequence
atggcctaccgggcccggagcaagagccgggaccgcttcttccagggcagccaggagttcctggccagcgccagcgccagcgctgagaggagctgcacccccagcccagaccagatcagccaccgggccagcctggaggatgcccctgtggatgacctgaccaggaagttcacctacctgggcagccaggaccgggcccggccccccagcggcagcagcaaggccacagacctgggcggcaccagccaggccggcaccagccagcgcttcctggagaatggcagccaggaggacctgctgcacggcaaccctggcagcacctacctggccagcaacagcaccagcgcccccaactggaagagcctgacctcctggaccaatgaccagggcgcccggaggaagacagtgttcagccccaccctgcctgctgcccggagcagcctgggcagcctgcagaccccagaggccgtgaccaccaggaaaggaacaggcctgctgagcagtgactaccgcatcatcaacgggaagagcggcacccaggacatccagcccggccccctcttcaacaacaatgctgatggagtggccacagacatcaccagcaccaggagcctgaactacaagagcaccagcagcggccaccgggagatcagcagcccccgcatccaggatgctggccctgccagcagagatgtgcaggccaccggcagaattgctgatgatgctgacccccgggtggccctggtgaatgacagcctgagtgatgtgaccagcaccaccagcagccgggtggatgaccatgattctgaggagatctgcctggaccacctgtgcaagggctgccccctgaatggcagctgcagcaaggtgcacttccacctgccctaccgctggcagatgctgattggcaagacctggacagactttgagcacatggagaccatcgagaagggctactgcaaccctggcatccacctgtgcagcgtgggcagctacaccatcaacttccgggtgatgagctgtgacagcttccccatccggcggctgagcacccccagctctgtgaccaagccagccaacagcgtcttcaccaccaagtggatctggtactggaagaatgaaagtggcacctggatccagtatggagaggagaaggacaagaggaagaacagcaatgtggacagcagctacctggagagcctgtaccagagctgcccccggggcgtggtgcccttccaggccggcagcagaaattatgagctgtccttccagggcatgatccagaccaacatcgccagcaagacccagaaggatgtgatcagaagacccacctttgtgccccagtggtacgtgcaggaggagcgggcccgggtgtctgtgctgaagcagctgtttgctgaccgctgcctgcgctgcagctgccccggcctcatcaagagcctggtgaacctggagcccgtcttcctgaagagcagctgcctgcactacagcgctgtgtccatctgcatcattgatgaatag

SEQ ID NO: 176416 - DNA, 654 bp, Artificial Sequence
  Description of Artificial Sequence: Synthetic coding sequence
atgtctgggggcctggcccccagcaagagcacagtgtatgtgagcaacctgcccttcagcctgaccaacaatgacctgtaccgcatcttcagcaaatatggcaaggtggtgaaggtgaccatcatgaaggacaaggacaccaggaagagcaaaggagtggccttcatcctcttcctggacaaggacagcgcccagaactgcacccgggccatcaacaacaagcagctgtttggccgggtcatcaaggccagcatcgccatcgacaatggccgggctgctgagttcatcagaagaagaaactactttgacaagagcaagtgctatgaatgtggggagagcggccacctgtcctatgcctgccccaagaacatgctgggggagcgggagccccccaagaagaaggagaagaagaagaagaagaaggcccctgagcctgaggaggagattgaggaggtggaggagagtgaagatgaaggagaggaccctgccctggacagcctgagccaggccatcgccttccagcaggccaagattgaggaggagcagaagaagtggaagcccagcagtggagtgcccagcaccagtgatgacagcagaagaccccgcatcaagaagagcacctacttcagtgatgaggaggagctgagtgactag

SEQ ID NO: 176417 - DNA, 501 bp, Artificial Sequence
  Description of Artificial Sequence: Synthetic coding sequence
atggccatgagccaggagagcctgaccttcaaggatgtgtttgtggacttcaccctggaggagtggcagcagctggacagcgcccagaagaacctgtacagagatgtgatgctggagaactacagccacctggtgtctgtgggctacctggtggccaagccagatgtgatcttccggctgggccctggagaggagagctggatggctgatggcggcacccctgtgaggacctgtgccgaggtgtggcaggtggatgagcagattgaccactacaaggagagccaggacaagctgccctggcaggccgccttcatcggcaaggagaccctgaaggatgagagcggccaggagagcaggacctgcaggaagagcatctacctgagcacagaatttgattctgtgcggcagaggctgcccaagtactacagctgggagaaggccttcaagaccagcttcaagctgtcctggagcaagtggaagctgtgcaagaaggagaggtag

SEQ ID NO: 176418 - DNA, 516 bp, Artificial Sequence
  Description of Artificial Sequence: Synthetic coding sequence
atggccatgagccaggagagcctgaccttcaaggatgtgtttgtggacttcaccctggaggagtggcagcagctggacagcgcccagaagaacctgtacagagatgtgatgctggagaactacagccacctggtgtctgtgggctacctggtggccaagccagatgtgatcttccggctgggccctggagaggagagctggatggctgatggcggcacccctgtgaggacctgtgctggagaagatagacctgaggtgtggcaggtggatgagcagattgaccactacaaggagagccaggacaagctgccctggcaggccgccttcatcggcaaggagaccctgaaggatgaaagtggccaggagagcaggacctgcaggaagagcatctacctgagcacagaatttgacagcgtgcggcagaggctgcccaagtactacagctgggagaaggccttcaagaccagcttcaagctgtcctggagcaagtggaagctgtgcaagaaggagaggtag

SEQ ID NO: 176419 - DNA, 297 bp, Artificial Sequence
  Description of Artificial Sequence: Synthetic coding sequence
atggccatgagccaggagagcctgaccttcaaggatgtgtttgtggacttcaccctggaggagtggcagcagctggacagcgcccagaagaacctgtacagagatgtgatgctggagaactacagccacctggtgtctgtgggctacctggtggccaagccagatgtgatcttccggctgggccctggagaggagagctggatggctgatggcggcacccctgtgaggacctgtgctggagaagatagaccagatgtgtccatctttgccagctgcatcctgaagtgctgctactag

SEQ ID NO: 176420 - DNA, 297 bp, Artificial Sequence; identical to SEQ ID NO: 176419
  Description of Artificial Sequence: Synthetic coding sequence

SEQ ID NO: 176421 - DNA, 516 bp, Artificial Sequence
  Description of Artificial Sequence: Synthetic coding sequence
gtggccatgagccaggagagcctgaccttcaaggatgtgtttgtggacttcaccctggaggagtggcagcagctggacagcgcccagaagaacctgtacagagatgtgatgctggagaactacagccacctggtgtctgtgggctacctggtggccaagccagatgtgatcttccggctgggccctggagaggagagctggatggctgatggcggcacccctgtgaggacctgtgctggagaagatagacctgaggtgtggcaggtggatgagcagattgaccactacaaggagagccaggacaagctgccctggcaggccgccttcatcggcaaggagaccctgaaggatgaaagtggccaggagagcaggacctgcaggaagagcatctacctgagcacagaatttgacagcgtgcggcagaggctgcccaagtactacagctgggagaaggccttcaagaccagcttcaagctgtcctggagcaagtggaagctgtgcaagaaggagaggtag

SEQ ID NO: 176422 - DNA, 297 bp, Artificial Sequence; identical to SEQ ID NO: 176419
  Description of Artificial Sequence: Synthetic coding sequence

SEQ ID NO: 176423 - DNA, 864 bp, Artificial Sequence
  Description of Artificial Sequence: Synthetic coding sequence
atgatgaaccgcttcaggaagtggctgtacaagcccaagagaagtgacccccagctgctggcccgcttctactatgcagatgaggagctgaaccaggtggccgctgagctggacagcctggatggcaggaaggacccccagcgctgcaccctgctggtgtcccagttccgcagctgccaggacaacgtgctgaacatcatcaaccagatcatggatgagtgcatcccccaggaccgggccccccgggacttctgtgtgaagtttcctgaggagatcagacatgacaacctggccggccagctgtggtttggagctgagtgcctggccgccggcagcatcatcatgaaccgggagctggagagcatggccatgaggcccctggccaaggagctgaccaggagcctggaggatgtgcggggggccctgcgggaccaggccctgcgggacctgaacacctacacagagaagatgagggaggccctgcggcactttgatgtgctgtttgctgagtttgagctgtcctatgtgtctgccatggtgcctgtgaagagcccccgggagtactacgtgcagcaggaggtgattgtgctcttctgtgaaacagtggagcgggccctggactttggctacctgacccaggacatgattgatgattatgagcccgccctgatgttcagcatcccccggctggccatcgtgtgccccctgctgcctgcccaccccaggaccagggctggggccacagcccacgtggcctgcaggatggtggccggcagcagcagcggggccctgacccacccccctgtgtccaagcagggcgtcatcagcgccctgctgcggcccctgcctgagctgcccccatag

SEQ ID NO: 176424 - DNA, 519 bp, Artificial Sequence
  Description of Artificial Sequence: Synthetic coding sequence
atgatgaaccgcttcaggaagtggctgtacaagcccaaggacaacgtgctgaacatcatcaaccagatcatggatgagtgcatcccccaggaccgggccccccgggacttctgtgtgaagtttcctgaggagatcagacatgacaacctggccggccagctgtggtttggagcagaatgtctggccgccggcagcatcatcatgaaccgggagctggagagcatggccatgaggcccctggccaaggagctgaccaggagcctggaggatgtgcggggggccctgcgggaccaggccctgcgggacctgaacacctacacagagaagatgagggaggccctgcggcactttgatgtgctgtttgctgagtttgagctgtcctatgtgtctgccatggtgcctgtgaagagcccccgggagtactacgtgcagcaggaggtgattgtgctcttctgtgagaccgtggagagaaatggcaagggcgtgctgaagttcatgtggaactgcaatggcccctag

SEQ ID NO: 176425 - DNA, 492 bp, Artificial Sequence
  Description of Artificial Sequence: Synthetic coding sequence
atggatgagtgcatcccccaggaccgggccccccgggacttctgtgtgaagtttcctgaggagatcagacatgacaacctggccggccagctgtggtttggagctgagtgcctggccgccggcagcatcatcatgaaccgggagctggagagcatggccatgaggcccctggccaaggagctgaccaggagcctggaggatgtgcggggggccctgcgggaccaggccctgcgggacctgaacacctacacagagaagatgagggaggccctgcggcactttgatgtgctgtttgctgagtttgagctgtcctatgtgtctgccatggtgcctgtgaagagcccccgggagtactacgtgcagcaggaggtgattgtgctcttctgtgaaacagtggagcgggccctggactttggctacctgacccaggacatgattgatgattatgagcccgccctgatgttcagcatcccccggctggccatcgtgtag

SEQ ID NO: 176426 - DNA, 11112 bp, Artificial Sequence
  Description of Artificial Sequence: Synthetic coding sequence
atggagggctgtgacagccctgtggtgtctgggaaggacaatggctgcggcatcccccagcaccagcagtggacagagctgaacagcacccacctgcctgacaagcccagctccatggagcagagcactggagagagccacggccccctggacagcctgcgggcccccttcaatgaaaggctggccgagagcacagccagcgctggcccccccagcgagcccgccagcaaggaggtgacctgcaatgaatgttctgccagctttgccagcctgcagacctacatggagcaccactgccccagcgcccggcccccaccacccctgcgggaggagagcgccagtgacaccggggaggagggagatgaggagagtgatgtggagaacctggccggggagatcgtgtaccagccagatggcagcgcctacatcgtggagagcctgagccagctgacccagggcggcggggcctgtggcagcggcagcggcagcggccccctgcccagcctcttcctgaacagcctgcctggagctgggggcaagcagggcgaccccagctgtgccgcccctgtgtacccccagatcatcaacaccttccacatcgccagcagctttgggaagtggtttgagggccctgaccaggccttccccaacaccagcgccctggccggcctgagccctgtgctgcacagcttccgggtgtttgatgtgcgccacaagagcaacaaggactacctgaacagtgatggcagcgccaagagcagctgtgtgtccaaggatgtgcccaacaacgtggacctgagcaagtttgatggctttgtgctgtatggcaagaggaagcccatcctgatgtgcttcctgtgcaagctgagctttggctacgtgcgcagctttgtgacccatgctgtgcatgaccacaggatgaccctgtctgaagatgagaggaagatcctgagcaacaagaacatcagcgccatcatccagggcatcggcaaggacaaggagcccctggtgtccttcctggagcccaagaacaagaacttccagcaccccctggtgtccacagccaacctgattggccctggccacagcttctacggcaagttcagcggcatccgcatggagggggaggaggccctgcctgctggcagcgctgctggccctgagcagccccaggccggcctgctgacccccagcaccctgctgaacctgggcggcctgaccagctctgtgctgaagacccccatcacctctgtgcccctgggccccctggccagcagccccaccaagagcagcgagggcaaggacagcggggctgctgagggggagaagcaggaggtgggagatggagactgcttcagcgagaaggtggagcctgctgaggaggaggccgaggaggaggaggaggaggaggaggccgaggaggaggaggaggaggaggaggaggaggaggaggaggaggaggatgagggctgcaagggcctcttccccagcgagctggatgaggagctggaggaccggccccatgaggagcctggagctgctgctggcagcagcagcaagaaggacctggccctgagcaaccagagcatcagcaacagccccctgatgcccaacgtgctgcagaccctgagccggggcacagccagcaccagcagcaacagcgccagcagctttgtggtgtttgatggagccaacagaagaaaccggctgtccttcaacagcgagggcgtgcgggccaacgtggccgagggcggccggcggctggactttgctgatgagagcgccaacaaggacaatgccacagcccctgagcccaatgaaagcacagaaggagatgatggcggctttgtgccccaccaccagcacgccggcagcctgtgtgagctgggcgtgggagaatgtcccagcggcagcggcgtggagtgccccaagtgtgacacagtgctgggcagcagccgcagcctgggcggccacatgaccatgatgcacagcaggaacagctgcaagaccctgaagtgccccaagtgcaactggcactacaagtaccagcagaccctggaggcccacatgaaggagaagcaccctgagcccggcggcagctgtgtgtactgcaagagcggccagccccacccccggctggcccggggggagagctacacctgtggctacaagcccttccgctgtgaggtgtgcaactacagcaccaccaccaagggcaacctgagcatccacatgcagagcgacaagcacctgaacaacatgcagaacctgcagaatggaggaggagagcaggtgttcagccacacagctggagctgctgctgctgctgtggccgctgctgctgctgctgccaacatcagcagcagctgtggggcccccagccccaccaagcccaagaccaagcccacctggaggtgtgaggtgtgtgactatgagaccaacgtggccaggaacctgcgcatccacatgaccagcgagaagcacatgcacaacatgatgctgctgcagcagaacatgacccagatccagcacaacagacacctgggcctgggcagcctgcccagccctgctgaggccgagctgtaccagtactacctggcccagaacatgaacctgcccaacctgaagatggattctgctgccagtgatgcccagttcatgatgagcggcttccagctggaccctgctggccccatggccgccatgaccccagccctggtgggcggggagatccccctggacatgaggctgggcggcggccagctggtgtctgaggagctgatgaacctgggggagagcttcatccagaccaatgaccccagcctgaagctgttccagtgtgctgtgtgcaacaagttcaccacagacaacctggacatgctgggcctgcacatgaatgtggagaggagcctgtctgaagatgagtggaaggctgtgatgggagacagctaccagtgcaagctgtgccgctacaacacccagctgaaggccaacttccagctgcactgcaagacagacaagcacgtgcagaagtaccagctggtggcccacatcaaggagggcggcaaggccaatgagtggaggctgaagtgtgtggccatcggcaaccctgtgcacctgaagtgcaatgcctgtgactactacaccaacagcctggagaagctgcggctgcacacagtgaacagcagacatgaggccagcctgaagctgtacaagcacctgcagcagcatgaaagtggagtggagggggagagctgctactaccactgtgtgctgtgcaactacagcaccaaggccaagctgaacctgatccagcacgtgcgctccatgaagcaccagaggtctgagagcctgaggaagctgcagaggctgcagaagggcctgcctgaagaagatgaggacctgggccagatcttcaccatccgccgctgccccagcacagatcctgaggaggccattgaagatgtggagggccccagcgagacagctgctgaccctgaggagctggccaaggaccaggagggcggggccagcagcagccaggccgagaaggagctgacagacagccctgccaccagcaagaggatctccttccctggcagcagcgagagccccctgagcagcaagaggcccaagacagctgaggagatcaagccagagcagatgtaccagtgcccctactgcaagtacagcaatgctgatgtgaaccggctgcgggtgcacgccatgacccagcacagcgtgcagcccatgctgcgctgccccctgtgccaggacatgctgaacaacaagatccacctgcagctgcacctgacccacctgcacagcgtggccccagactgtgtggagaagctgatcatgacagtgaccaccccagagatggtgatgcccagctccatgttcctgcctgctgctgtgcctgacagagatggcaacagcaacctggaggaggccggcaagcagcctgagaccagcgaggacctgggcaagaacatcctgcccagcgccagcacagagcagagcggggacctgaagcccagccctgctgaccccggctctgtgcgggaggacagcggcttcatctgctggaagaagggctgcaaccaggtgttcaagaccagcgctgccctgcagacccacttcaatgaggtgcacgccaagaggccccagctgcctgtgtctgacagacatgtgtacaagtaccgctgcaaccagtgcagcctggccttcaagaccatcgagaagctgcagctgcacagccagtaccacgtgatccgggccgccaccatgtgctgcctgtgccagaggagcttccgcaccttccaggccctgaagaagcacctggagaccagccacctggagctgtctgaggccgacatccagcagctgtatggaggcctgctggccaacggggacctgctggccatgggagaccccaccctggccgaggaccacaccatcatcgtggaggaggacaaggaggaggagagtgacctggaggacaagcagagccccaccggcagtgacagcggctctgtgcaggaggacagcggcagcgagcccaagagggccctgcccttcaggaagggccccaacttcaccatggagaagttcctggaccccagccggccctacaagtgcaccgtgtgcaaggagagcttcacccagaagaacatcctgctggtgcactacaacagcgtgagccacctgcacaagctgaagagggccctgcaggagagcgccaccggccagcctgagcccaccagcagcccagacaacaagcccttcaagtgcaacacctgcaatgtggcctacagccagagcagcaccctggagatccacatgaggtctgtgctgcaccagaccaaggcccgggccgccaagctggaggccgccagcggcagcagcaatggaactggaaacagcagcagcatcagcctgagcagcagcacccccagccctgtgtccaccagcggcagcaacaccttcaccaccagcaaccccagcagcgctggcatcgcccccagcagcaacctgctgagccaggtgcccacagaatctgtgggcatgccacccctgggcaaccccatcggggccaacatcgccagccccagcgagcccaaggaggccaacaggaagaagctggccgacatgattgccagccggcagcagcagcagcagcagcagcagcagcagcagcagcagcagcagcagcagcagcaggcccagaccctggcccaggcccaggcccaggtgcaggcccacctgcagcaggagctgcagcagcaggccgccctgatccagagccagctgttcaaccccaccctgctgccccacttccccatgaccacagagaccctgctgcagctgcagcagcagcagcacctgctcttccccttctacatccccagcgctgagttccagctgaaccctgaggtgtccctgcctgtgaccagcggggccctgaccctgactggaactggacctggcctgctggaggacctgaaggcccaggtgcaggtgccccagcagagccaccagcagatcctgccccagcagcagcagaaccagctgagcatcgcccagagccacagcgccctgctgcagcccagccagcaccctgagaagaagaacaagctggtgatcaaggagaaggagaaggagagccagcgggagcgggacagcgctgagggcggggagggcaacacaggccccaaggagaccctgcctgatgccctgaaggccaaggagaagaaggagctggcccctgggggcggcagcgagcccagcatgctgcccccacgcatcgccagtgatgcccggggaaatgccaccaaggccctgctggagaactttggatttgagctggtgatccagtacaatgaaaacaagcagaaggtgcagaagaagaatggcaagacagaccagggcgagaacctggagaagctggagtgtgacagctgtgggaagctgttcagcaacatcctgatcctgaagagccaccaggagcacgtgcaccagaactacttccccttcaagcagctggagagatttgccaagcagtacagagaccactatgacaagctgtaccccctgcggccccagaccccagagcccccacctcctcctcctcctcctcctcctccacccctgcctgctgccccaccccagcctgccagcaccccagccatcccagccagcgccccacccatcaccagccccaccatcgccccagcccagcccagcgtgcccctgacccagctgtccatgcccatggagctgcccatcttcagccccctgatgatgcagaccatgcccctgcagaccctgcctgcccagctgcccccccagctgggccctgtggagcccctgcctgctgacctggcccagctgtaccagcaccagctgaaccccaccctgctgcagcagcagaacaagaggcccaggacccgcatcacagatgaccagctgcgggtgctgcggcagtactttgacatcaacaacagccccagcgaggagcagatcaaggagatggctgacaagagcggcctgccccagaaggtgatcaagcactggttcaggaacaccctcttcaaggagcggcagaggaacaaggacagcccctacaacttcagcaacccccccatcaccagcctggaggagctgaagattgacagccggccccccagccctgagccccccaagcaggagtactggggcagcaagaggagcagcaggacccgcttcacagactaccagctgcgggtgctgcaggacttctttgatgccaatgcctaccccaaggatgatgaatttgagcagctgagcaacctgctgaacctgcccaccagggtcatcgtggtgtggttccagaatgcccggcagaaggccaggaagaactatgagaaccagggcgagggcaaggatggagagcggcgggagctgaccaatgaccgctacatccgcaccagcaacctgaactaccagtgcaagaagtgcagcctggtgttccagaggatctttgacctgatcaagcaccagaagaagctgtgctacaaggatgaagatgaggagggccaggatgacagccagaatgaagacagcatggatgccatggagatcctgacccccaccagcagcagctgcagcacccccatgcccagccaggcctacagcgccccagcccccagcgccaacaacacagccagcagcgccttcctgcagctgacagctgaggccgaggagctggccaccttcaacagcaagacagaagctggagatgagaagcccaagctggccgaggcccccagcgcccagcccaaccagacccaggagaagcagggccagcccaagccagagctgcagcagcaggagcagcctgagcagaagaccaacaccccccagcagaagctgccccagctggtgtccctgcccagcctgccccagcccccaccccaggcccccccaccccagtgccccctgccccagagcagccccagccccagccagctgagccacctgcccctgaagcccctgcacaccagcaccccccagcagctggccaacctgcccccccagctgatcccctaccagtgtgaccagtgcaagctggccttccccagctttgagcactggcaggagcaccagcagctgcacttcctgagcgcccagaaccagttcatccacccccagttcctggacaggagcctggacatgcccttcatgctgtttgaccccagcaaccccctgctggccagccagctgctgagcggggccatcccccagatcccagccagcagcgccaccagccccagcacccccaccagcaccatgaacaccctgaagaggaagctggaggagaaggccagcgccagccctggagaaaatgattctggaactggaggagaggagccccagagggacaagaggctgcggaccaccatcaccccagagcagctggagatcctgtaccagaagtacctgctggacagcaaccccaccaggaagatgctggaccacatcgcccacgaggtgggcctgaagaagagggtggtgcaggtgtggttccagaacacccgggcccgggagaggaagggccagttccgggctgtgggccctgcccaggcccaccggcgctgccccttctgccgggccctcttcaaggccaagacagccctggaggcccacatccgcagccgccactggcatgaggccaagagagctggctacaacctgaccctgagcgccatgctgctggactgtgatggcggcctgcagatgaagggggacatctttgatggcaccagcttcagccacctgccccccagcagcagtgatggccagggcgtgcccctgagccctgtgtccaagaccatggagctgagccccaggaccctgctgagccccagcagcatcaaggtggagggcattgaagattttgagagccccagcatgagctctgtgaacctgaactttgaccagaccaagctggacaatgatgactgcagctctgtgaacacagccatcacagacaccaccactggagatgagggcaatgctgacaatgattctgccactggaattgccacagagaccaagagcagcagcgccccaaatgaaggcctgaccaaggccgccatgatggccatgtctgaatatgaagatcggctgagcagcggcctggtgtccccagcccccagcttctacagcaaggagtatgacaatgaaggaacagtggactacagcgagaccagcagcctggccgacccctgcagccccagccctggggccagcggcagcgctgggaagagcggggacagcggggaccggcccggccagaagcgcttccgcacccagatgaccaacctgcagctgaaggtgctgaagagctgcttcaatgactaccgcacccccaccatgctggagtgtgaggtgctgggcaatgacatcggcctgcccaagagggtggtgcaggtgtggttccagaatgcccgggccaaggagaagaagagcaagctgtccatggccaagcacttcggcatcaaccagaccagctatgagggccccaagacagaatgtaccctgtgtggcatcaagtacagcgcccggctgtctgtgcgggaccacatcttcagccagcagcacatcagcaaggtgaaggacaccatcggcagccagctggacaaggagaaggagtactttgatcctgccaccgtgcggcagctgatggcccagcaggagctggaccgcatcaagaaggccaatgaggtgctgggcctggccgcccagcagcagggcatgtttgacaacacccccctgcaggccctgaacctgcccacagcctacccagccctgcagggcatcccccctgtgctgctgcccggcctgaacagccccagcctgcccggcttcacccccagcaacacagccctgaccagccccaagcccaacctgatgggcctgcccagcaccaccgtgcccagccctggcctgcccaccagcggcctgcccaacaagcccagcagcgccagcctgagcagccccaccccagcccaggccaccatggccatgggcccccagcagcccccccagcagcagcagcagcagcagcagccccaggtgcagcagcccccacctcctcctgctgcccagcccccacccaccccccagctgcccctgcagcagcagcagcagaggaaggacaaggacagcgagaaggtgaaggagaaggagaaggcccacaagggcaagggggagcccctgcctgtgcccaagaaggagaagggggaggcccccacagccacagctgccaccatcagcgcccccctgcccaccatggagtatgctgtggaccctgcccagctgcaggccctgcaggccgccctgaccagtgaccccacagccctgctgaccagccagttcctgccctactttgtgcccggcttcagcccctactatgccccccagatccctggggccctgcagagcggctacctgcagcccatgtatggcatggagggcctcttcccctacagccctgccctgagccaggccctgatgggcctgagccctggcagcctgctgcagcagtaccagcagtaccagcagagcctgcaggaggccatccagcagcagcagcagaggcagctgcagcagcagcagcagcagaaggtgcagcagcagcagcccaaggccagccagacccctgtgcccccaggggcccccagcccagacaaggaccctgccaaggagagccccaagccagaggagcagaagaacaccccccgggaggtgagccccctgctgcccaagctgcctgaggagcctgaggccgagagcaagtctgctgacagcctgtatgaccccttcatcgtgcccaaggtgcagtacaagctggtgtgcaggaagtgccaggccggcttcagtgatgaggaggccgcccggagccacctgaagagcctgtgcttcttcggccagagcgtggtgaacctgcaggagatggtgctgcacgtgcccaccggcggcggcggcggcggcagcggcggcggcggcggcggcggcggcggcggcggcggcggcggcagctaccactgcctggcctgtgagagcgccctgtgtggggaggaggccctgagccagcacctggagagcgccctgcacaagcacaggaccatcaccagggctgccagaaatgccaaggagcaccccagcctgctgccccacagcgcctgcttcccagaccccagcacagccagcaccagccagagcgctgcccacagcaatgacagccccccacctccttctgctgctgcccccagcagcgccagcccccacgccagcaggaagtcctggccccaggtggtgtcccgggccagcgctgccaagcccccatccttcccccccctgagcagcagcagcacagtgaccagcagcagctgcagcaccagcggcgtgcagcccagcatgcccacagatgactacagcgaggagagtgacacagacctgagccagaagagtgatggccctgccagccctgtggagggccccaaggaccccagctgccccaaggacagcggcctgacctctgtgggcacagacaccttccggctgtag

SEQ ID NO: 176427 - DNA, 8370 bp, Artificial Sequence
  Description of Artificial Sequence: Synthetic coding sequence
atgaggctgggcggcggccagctggtgtctgaggagctgatgaacctgggggagagcttcatccagaccaatgaccccagcctgaagctgttccagtgtgctgtgtgcaacaagttcaccacagacaacctggacatgctgggcctgcacatgaatgtggagaggagcctgtctgaagatgagtggaaggctgtgatgggagacagctaccagtgcaagctgtgccgctacaacacccagctgaaggccaacttccagctgcactgcaagacagacaagcacgtgcagaagtaccagctggtggcccacatcaaggagggcggcaaggccaatgagtggaggctgaagtgtgtggccatcggcaaccctgtgcacctgaagtgcaatgcctgtgactactacaccaacagcctggagaagctgcggctgcacacagtgaacagcagacatgaggccagcctgaagctgtacaagcacctgcagcagcatgaaagtggagtggagggggagagctgctactaccactgtgtgctgtgcaactacagcaccaaggccaagctgaacctgatccagcacgtgcgctccatgaagcaccagaggtctgagagcctgaggaagctgcagaggctgcagaagggcctgcctgaagaagatgaggacctgggccagatcttcaccatccgccgctgccccagcacagatcctgaggaggccattgaagatgtggagggccccagcgagacagctgctgaccctgaggagctggccaaggaccaggagggcggggccagcagcagccaggccgagaaggagctgacagacagccctgccaccagcaagaggatctccttccctggcagcagcgagagccccctgagcagcaagaggcccaagacagctgaggagatcaagccagagcagatgtaccagtgcccctactgcaagtacagcaatgctgatgtgaaccggctgcgggtgcacgccatgacccagcacagcgtgcagcccatgctgcgctgccccctgtgccaggacatgctgaacaacaagatccacctgcagctgcacctgacccacctgcacagcgtggccccagactgtgtggagaagctgatcatgacagtgaccaccccagagatggtgatgcccagctccatgttcctgcctgctgctgtgcctgacagagatggcaacagcaacctggaggaggccggcaagcagcctgagaccagcgaggacctgggcaagaacatcctgcccagcgccagcacagagcagagcggggacctgaagcccagccctgctgaccccggctctgtgcgggaggacagcggcttcatctgctggaagaagggctgcaaccaggtgttcaagaccagcgctgccctgcagacccacttcaatgaggtgcacgccaagaggccccagctgcctgtgtctgacagacatgtgtacaagtaccgctgcaaccagtgcagcctggccttcaagaccatcgagaagctgcagctgcacagccagtaccacgtgatccgggccgccaccatgtgctgcctgtgccagaggagcttccgcaccttccaggccctgaagaagcacctggagaccagccacctggagctgtctgaggccgacatccagcagctgtatggaggcctgctggccaacggggacctgctggccatgggagaccccaccctggccgaggaccacaccatcatcgtggaggaggacaaggaggaggagagtgacctggaggacaagcagagccccaccggcagtgacagcggctctgtgcaggaggacagcggcagcgagcccaagagggccctgcccttcaggaagggccccaacttcaccatggagaagttcctggaccccagccggccctacaagtgcaccgtgtgcaaggagagcttcacccagaagaacatcctgctggtgcactacaacagcgtgagccacctgcacaagctgaagagggccctgcaggagagcgccaccggccagcctgagcccaccagcagcccagacaacaagcccttcaagtgcaacacctgcaatgtggcctacagccagagcagcaccctggagatccacatgaggtctgtgctgcaccagaccaaggcccgggccgccaagctggaggccgccagcggcagcagcaatggaactggaaacagcagcagcatcagcctgagcagcagcacccccagccctgtgtccaccagcggcagcaacaccttcaccaccagcaaccccagcagcgctggcatcgcccccagcagcaacctgctgagccaggtgcccacagaatctgtgggcatgccacccctgggcaaccccatcggggccaacatcgccagccccagcgagcccaaggaggccaacaggaagaagctggccgacatgattgccagccggcagcagcagcagcagcagcagcagcagcagcagcagcagcagcagcagcagcagcaggcccagaccctggcccaggcccaggcccaggtgcaggcccacctgcagcaggagctgcagcagcaggccgccctgatccagagccagctgttcaaccccaccctgctgccccacttccccatgaccacagagaccctgctgcagctgcagcagcagcagcacctgctcttccccttctacatccccagcgctgagttccagctgaaccctgaggtgtccctgcctgtgaccagcggggccctgaccctgactggaactggacctggcctgctggaggacctgaaggcccaggtgcaggtgccccagcagagccaccagcagatcctgccccagcagcagcagaaccagctgagcatcgcccagagccacagcgccctgctgcagcccagccagcaccctgagaagaagaacaagctggtgatcaaggagaaggagaaggagagccagcgggagcgggacagcgctgagggcggggagggcaacacaggccccaaggagaccctgcctgatgccctgaaggccaaggagaagaaggagctggcccctgggggcggcagcgagcccagcatgctgcccccacgcatcgccagtgatgcccggggaaatgccaccaaggccctgctggagaactttggatttgagctggtgatccagtacaatgaaaacaagcagaaggtgcagaagaagaatggcaagacagaccagggcgagaacctggagaagctggagtgtgacagctgtgggaagctgttcagcaacatcctgatcctgaagagccaccaggagcacgtgcaccagaactacttccccttcaagcagctggagagatttgccaagcagtacagagaccactatgacaagctgtaccccctgcggccccagaccccagagcccccacctcctcctcctcctcctcctcctccacccctgcctgctgccccaccccagcctgccagcaccccagccatcccagccagcgccccacccatcaccagccccaccatcgccccagcccagcccagcgtgcccctgacccagctgtccatgcccatggagctgcccatcttcagccccctgatgatgcagaccatgcccctgcagaccctgcctgcccagctgcccccccagctgggccctgtggagcccctgcctgctgacctggcccagctgtaccagcaccagctgaaccccaccctgctgcagcagcagaacaagaggcccaggacccgcatcacagatgaccagctgcgggtgctgcggcagtactttgacatcaacaacagccccagcgaggagcagatcaaggagatggctgacaagagcggcctgccccagaaggtgatcaagcactggttcaggaacaccctcttcaaggagcggcagaggaacaaggacagcccctacaacttcagcaacccccccatcaccagcctggaggagctgaagattgacagccggccccccagccctgagccccccaagcaggagtactggggcagcaagaggagcagcaggacccgcttcacagactaccagctgcgggtgctgcaggacttctttgatgccaatgcctaccccaaggatgatgaatttgagcagctgagcaacctgctgaacctgcccaccagggtcatcgtggtgtggttccagaatgcccggcagaaggccaggaagaactatgagaaccagggcgagggcaaggatggagagcggcgggagctgaccaatgaccgctacatccgcaccagcaacctgaactaccagtgcaagaagtgcagcctggtgttccagaggatctttgacctgatcaagcaccagaagaagctgtgctacaaggatgaagatgaggagggccaggatgacagccagaatgaagacagcatggatgccatggagatcctgacccccaccagcagcagctgcagcacccccatgcccagccaggcctacagcgccccagcccccagcgccaacaacacagccagcagcgccttcctgcagctgacagctgaggccgaggagctggccaccttcaacagcaagacagaagctggagatgagaagcccaagctggccgaggcccccagcgcccagcccaaccagacccaggagaagcagggccagcccaagccagagctgcagcagcaggagcagcctgagcagaagaccaacaccccccagcagaagctgccccagctggtgtccctgcccagcctgccccagcccccaccccaggcccccccaccccagtgccccctgccccagagcagccccagccccagccagctgagccacctgcccctgaagcccctgcacaccagcaccccccagcagctggccaacctgcccccccagctgatcccctaccagtgtgaccagtgcaagctggccttccccagctttgagcactggcaggagcaccagcagctgcacttcctgagcgcccagaaccagttcatccacccccagttcctggacaggagcctggacatgcccttcatgctgtttgaccccagcaaccccctgctggccagccagctgctgagcggggccatcccccagatcccagccagcagcgccaccagccccagcacccccaccagcaccatgaacaccctgaagaggaagctggaggagaaggccagcgccagccctggagaaaatgattctggaactggaggagaggagccccagagggacaagaggctgcggaccaccatcaccccagagcagctggagatcctgtaccagaagtacctgctggacagcaaccccaccaggaagatgctggaccacatcgcccacgaggtgggcctgaagaagagggtggtgcaggtgtggttccagaacacccgggcccgggagaggaagggccagttccgggctgtgggccctgcccaggcccaccggcgctgccccttctgccgggccctcttcaaggccaagacagccctggaggcccacatccgcagccgccactggcatgaggccaagagagctggctacaacctgaccctgagcgccatgctgctggactgtgatggcggcctgcagatgaagggggacatctttgatggcaccagcttcagccacctgccccccagcagcagtgatggccagggcgtgcccctgagccctgtgtccaagaccatggagctgagccccaggaccctgctgagccccagcagcatcaaggtggagggcattgaagattttgagagccccagcatgagctctgtgaacctgaactttgaccagaccaagctggacaatgatgactgcagctctgtgaacacagccatcacagacaccaccactggagatgagggcaatgctgacaatgattctgccactggaattgccacagagaccaagagcagcagcgccccaaatgaaggcctgaccaaggccgccatgatggccatgtctgaatatgaagatcggctgagcagcggcctggtgtccccagcccccagcttctacagcaaggagtatgacaatgaaggaacagtggactacagcgagaccagcagcctggccgacccctgcagccccagccctggggccagcggcagcgctgggaagagcggggacagcggggaccggcccggccagaagcgcttccgcacccagatgaccaacctgcagctgaaggtgctgaagagctgcttcaatgactaccgcacccccaccatgctggagtgtgaggtgctgggcaatgacatcggcctgcccaagagggtggtgcaggtgtggttccagaatgcccgggccaaggagaagaagagcaagctgtccatggccaagcacttcggcatcaaccagaccagctatgagggccccaagacagaatgtaccctgtgtggcatcaagtacagcgcccggctgtctgtgcgggaccacatcttcagccagcagcacatcagcaaggtgaaggacaccatcggcagccagctggacaaggagaaggagtactttgatcctgccaccgtgcggcagctgatggcccagcaggagctggaccgcatcaagaaggccaatgaggtgctgggcctggccgcccagcagcagggcatgtttgacaacacccccctgcaggccctgaacctgcccacagcctacccagccctgcagggcatcccccctgtgctgctgcccggcctgaacagccccagcctgcccggcttcacccccagcaacacagccctgaccagccccaagcccaacctgatgggcctgcccagcaccaccgtgcccagccctggcctgcccaccagcggcctgcccaacaagcccagcagcgccagcctgagcagccccaccccagcccaggccaccatggccatgggcccccagcagcccccccagcagcagcagcagcagcagcagccccaggtgcagcagcccccacctcctcctgctgcccagcccccacccaccccccagctgcccctgcagcagcagcagcagaggaaggacaaggacagcgagaaggtgaaggagaaggagaaggcccacaagggcaagggggagcccctgcctgtgcccaagaaggagaagggggaggcccccacagccacagctgccaccatcagcgcccccctgcccaccatggagtatgctgtggaccctgcccagctgcaggccctgcaggccgccctgaccagtgaccccacagccctgctgaccagccagttcctgccctactttgtgcccggcttcagcccctactatgccccccagatccctggggccctgcagagcggctacctgcagcccatgtatggcatggagggcctcttcccctacagccctgccctgagccaggccctgatgggcctgagccctggcagcctgctgcagcagtaccagcagtaccagcagagcctgcaggaggccatccagcagcagcagcagaggcagctgcagcagcagcagcagcagaaggtgcagcagcagcagcccaaggccagccagacccctgtgcccccaggggcccccagcccagacaaggaccctgccaaggagagccccaagccagaggagcagaagaacaccccccgggaggtgagccccctgctgcccaagctgcctgaggagcctgaggccgagagcaagtctgctgacagcctgtatgaccccttcatcgtgcccaaggtgcagtacaagctggtgtgcaggaagtgccaggccggcttcagtgatgaggaggccgcccggagccacctgaagagcctgtgcttcttcggccagagcgtggtgaacctgcaggagatggtgctgcacgtgcccaccggcggcggcggcggcggcagcggcggcggcggcggcggcggcggcggcggcggcggcggcggcagctaccactgcctggcctgtgagagcgccctgtgtggggaggaggccctgagccagcacctggagagcgccctgcacaagcacaggaccatcaccagggctgccagaaatgccaaggagcaccccagcctgctgccccacagcgcctgcttcccagaccccagcacagccagcaccagccagagcgctgcccacagcaatgacagccccccacctccttctgctgctgcccccagcagcgccagcccccacgccagcaggaagtcctggccccaggtggtgtcccgggccagcgctgccaagcccccatccttcccccccctgagcagcagcagcacagtgaccagcagcagctgcagcaccagcggcgtgcagcccagcatgcccacagatgactacagcgaggagagtgacacagacctgagccagaagagtgatggccctgccagccctgtggagggccccaaggaccccagctgccccaaggacagcggcctgacctctgtgggcacagacaccttccggctgtag

SEQ ID NO: 176428 - DNA, 10704 bp, Artificial Sequence
  Description of Artificial Sequence: Synthetic coding sequence
atggagacctgtgacagcccccccatcagccggcaggagaatggccagagcaccagcaagctgtgtggcaccacccagctggacaatgaggtgcctgagaaggtggccggcatggagccagaccgggagaacagcagcacagatgacaacctgaagacagatgagaggaagtctgaggccctgctgggcttctctgtggagaatgctgctgccacccaggtgaccagcgccaaggagatcccctgcaatgaatgtgccaccagcttccccagcctgcagaagtacatggagcaccactgccccaatgcccggctgcctgtgctgaaggatgacaatgaaagtgagatcagcgagctggaggacagtgatgtggagaacctgaccggggagatcgtgtaccagccagatggcagcgcctacatcatcgaggacagcaaggagagcggccagaatgcccagacaggagccaacagcaagctgttcagcacagccatgttcctggacagcctggccagcgctggggagaagagtgaccagagcgccagcgcccccatgtccttctacccccagatcatcaacaccttccacatcgccagcagcctgggcaagcccttcaccgctgaccaggccttccccaacaccagcgccctggccggcgtgggccctgtgctgcacagcttccgggtgtatgacctgcggcacaagcgggagaaggactacctgaccagtgatggcagcgccaagaacagctgtgtgtccaaggatgtgcccaacaacgtggacctgagcaagtttgatggctgtgtgtctgatggcaagaggaagcctgtgctgatgtgcttcctgtgcaagctgagctttggctacatccgcagctttgtgacccatgctgtgcatgaccacaggatgaccctgaatgatgaggagcagaagctgctgagcaacaagtgtgtgtctgccatcatccagggcatcggcaaggacaaggagcccctcatctccttcctggagcccaagaagagcacctctgtgtacccccacttcagcaccaccaacctgattggccctgaccccaccttccggggcctgtggagcgccttccacgtggagaatggagacagcctgcctgctggctttgccttcctgaagggcagcgccagcaccagcagcagcgctgagcagcccctgggcatcacccagatgcccaaggccgaggtgaacctgggcggcctgagcagcctggtggtgaacacccccatcacctctgtgtccctgagccacagcagcagcgagagcagcaagatgtctgagagcaaggaccaggagaacaactgtgagcggcccaaggagagcaatgtgctgcaccccaatggagaatgtcctgtgaagtctgagcccacagagcctggagatgaagatgaagaagatgcctacagcaatgagctggatgatgaggaggtgctgggggagctgacagacagcatcggcaacaaggacttccccctgctgaaccagagcatcagccccctgagcagctctgtgctgaagttcatcgagaagggcaccagcagcagcagcgccaccgtgtctgatgacacagagaagaagaagcagacagctgctgtgcgggccagcggctctgtggccagcaactacggcatcagcggcaaggactttgctgatgccagcgccagcaaggacagcgccacagctgcccaccccagcgagatcgcccggggagatgaggacagcagcgccaccccccaccagcacggcttcacccccagcaccccaggcaccccaggccctggaggagatggcagccctggcagcggcatcgagtgccccaagtgtgacacagtgctgggcagcagccgcagcctgggcggccacatgaccatgatgcacagcaggaacagctgcaagaccctgaagtgccccaagtgcaactggcactacaagtaccagcagaccctggaggcccacatgaaggagaagcaccctgagcccggcggcagctgtgtgtactgcaagacaggccagccccacccccggctggcccggggggagagctacacctgtggctacaagcccttccgctgtgaggtgtgcaactacagcaccaccaccaagggcaacctgagcatccacatgcagagcgacaagcacctgaacaacgtgcagaacctgcagaatggaaatggagagcaggtgtttggccacagcgccccagcccccaacaccagcctgagcggctgcggcacccccagccccagcaagcccaagcagaagcccacctggaggtgtgaggtgtgtgactatgagaccaacgtggccaggaacctgcgcatccacatgaccagcgagaagcacatgcacaacatgatgctgctgcagcagaacatgaagcagatccagcacaacctgcacctgggcctggccccagctgaggccgagctgtaccagtactacctggcccagaacatcggcctgaccggcatgaagctggagaacccagctgacccccagctgatgatcaaccccttccagctggaccctgccacagctgctgccctggcccctggcctgggggagctgagcccctacatcagtgaccctgccctgaagctgttccagtgtgctgtgtgcaacaagttcaccagtgacagcctggaggccctgtctgtgcacgtgagcagcgagaggagcctgcctgaggaggagtggagggctgtgattggagacatctaccagtgcaagctgtgcaactacaacacccagctgaaggccaacttccagctgcactgcaagacagacaagcacatgcagaagtaccagctggtggcccacatcaaggagggcggcaagagcaatgagtggaggctgaagtgcatcgccatcggcaaccctgtgcacctgaagtgcaatgcctgtgactactacaccaacagcgtggacaagctgcggctgcacaccaccaaccacagacatgaagctgccctgaagctgtacaagcacctgcagaagcaggagggcgctgtgaaccctgagagctgctactactactgtgctgtgtgtgactacaccaccaaggtgaagctgaacctggtgcagcacgtgcgctctgtgaagcaccagcagacagagggcctgaggaagctgcagctgcaccagcagggcctggcccctgaggaggacaacctgtctgagatcttctttgtgaaggactgccccccaaatgagctggagacagccagcctgggcgcccggacctgtgatgatgacctgacagagcagcacgaggaggccgagggcgccatcaagcccacagctgtggccgaggatgatgagaaggacaccagcgagcgggacaacagcgagggcaagaacagcaacaaggacagcgtgtctgtggccggcggcacccagcccctgctgctggccaaggaggaggatgtggccaccaagaggagcaagcccacagaggacaacaagttctgccacgagcagttctaccagtgcccctactgcaactacaacagccgggaccagagccgcatccagatgcacgtgctgagccagcacagcgtgcagcctgtgatctgctgccccctgtgccaggatgtgctgagcaacaagatgcacctgcagctgcacctgacccacctgcacagcgtgtccccagactgtgtggagaagctgctgatgacagtgcctgtgcctgatgtgatgatgcccaacagcatgctgctgcctgctgctgccagcgagaagtctgagcgggacaccccagctgctgtgacagctgagggcagcggcaagtacagcggggagagccccatggatgacaagtccatggccggcctggaggacagcaaggccaacgtggaggtgaagaatgaggagcagaagcccaccaaggagcccctggaggtgtctgagtggaacaagaacagcagcaaggatgtgaagatcccagacaccctgcaggaccagctgaatgagcagcagaagaggcagcccctgtctgtgtctgacagacatgtgtacaagtaccgctgcaaccactgcagcctggccttcaagaccatgcagaagctgcagatccacagccagtaccacgccatccgggccgccaccatgtgcaacctgtgccagaggagcttccgcaccttccaggccctgaagaagcacctggaggccggccaccctgagctgtctgaggccgagctgcagcagctgtatgccagcctgcctgtgaatggagagctgtgggccgagagcgagaccatgagccaggatgaccacggcctggagcaggagatggagcgggagtatgaggtggaccacgagggcaaggccagccctgtgggcagtgacagcagcagcatcccagatgacatgggcagcgagcccaagaggaccctgcccttcaggaagggccccaacttcaccatggagaagttcctggaccccagccggccctacaagtgcaccgtgtgcaaggagagcttcacccagaagaacatcctgctggtgcactacaacagcgtgagccacctgcacaagctgaagaaggtgctgcaggaggccagcagccctgtgccccaggagaccaacagcaacacagacaacaagccctacaagtgcagcatctgcaatgtggcctacagccagagcagcaccctggagatccacatgaggtctgtgctgcaccagaccaaggcccgggccgccaagctggagcccagcggccacgtggccggcggccacagcattgctgccaacgtgaacagccctggccagggcatgctggacagcatgagcctggccgctgtgaacagcaaggacacccacctggatgccaaggagctgaacaagaagcagaccccagacctgatcagcgcccagcctgcccaccaccccccccagagccctgcccagatccagatgcagctgcagcacgagctgcagcagcaggccgccttcttccagccccagttcctgaacccagccttcctgccccacttccccatgaccccagaggccctgctgcagttccagcagccccagttcctgttccccttctacatccctggaacagagttcagcctgggccctgacctgggcctgcccggcagcgccaccttcggcatgcctggcatgacaggcatggccggcagcctgctggaggacctgaagcagcagatccagacccagcaccacgtgggccagacccagctgcagatcctgcagcagcaggcccagcagtaccaggccacccagccccagctgcagccccagaagcagcagcagcagcccccaccaccccagcagcagcagcagcagcaggccagcaagctgctgaagcaggagcagagcaacatcgtgtctgctgactgccagatcatgaaggatgtgcccagctacaaggaggccgaggacatcagcgagaagccagagaagcccaagcaggagttcatcagcgagggggagggcctgaaggagggcaaggacaccaagaagcagaagagcctggagcccagcatccccccaccaagaattgccagcggggcccggggaaatgctgccaaggccctgctggagaactttggatttgagctggtgatccagtacaatgaaaatcggcagaaggtgcagaagaagggcaagagcggggagggggagaacacagacaagctggagtgtggcacctgtgggaagctgttcagcaatgtgctgatcctgaagagccaccaggagcacgtgcacggccagttcttcccctatgctgccctggagaagtttgcccggcagtaccgggaggcctatgacaagctgtaccccatcagccccagcagccctgagaccccacctcctcctcctcctcctccacccctgcccccagccccaccccagcccagctccatgggccctgtgaagatccccaacacagtgtccacccccctgcaggcccccccacccaccccacctcctcctcctcctcctcctcctcctcctcctcctcctcctcctcctcctcctccttctgccccaccccaggtgcagctgcctgtgtccctggacctgcccctcttccccagcatcatgatgcagcctgtgcagcacccagccctgcccccccagctggccctgcagctgccccagatggatgccctgtctgctgacctgacccagctgtgccagcagcagctgggcctggaccccaacttcctgcggcacagccagttcaagaggcccaggacccgcatcacagatgaccagctgaagatcctgcgggcctactttgacatcaacaacagccccagcgaggagcagatccaggagatggccgagaagagcggcctgagccagaaggtgatcaagcactggttcaggaacaccctcttcaaggagcggcagaggaacaaggacagcccctacaacttcagcaacccccccatcaccgtgctggaggacatcagaattgacccccagcccaccagcctggagcactacaagagtgatgccagcttcagcaagaggagcagcaggacccgcttcacagactaccagctgcgggtgctgcaggacttctttgacaccaatgcctaccccaaggatgatgaaattgagcagctgagcacagtgctgaacctgcccaccagggtgattgtggtgtggttccagaatgcccggcagaaggccaggaagagctatgagaaccaggccgagaccaaggacaatgagaagcgggagctgaccaatgaaagatacatccgcaccagcaacatgcagtaccagtgcaagaagtgcaatgtggtgttcccccgcatctttgacctgatcacccaccagaagaagcagtgctacaaggatgaagatgatgatgcccaggatgagagccagacagaagattccatggatgccacagaccaggtggtgtacaagcactgcaccgtgtctggccagacagatgctgccaagaatgctgctgccccagctgccagcagcggcagcggcaccagcacccccctcatccccagccccaagccagagcctgagaagaccagccccaagccagagtacccagctgagaagcccaagcagagcgaccccagcccccccagccagggcaccaagccagccctgcccctggccagcaccagcagtgaccccccccaggccagcacagcccagccccagccccagccccagccccccaagcagccccagctgattggccggcccccatctgccagccagacccctgtgcccagcagccccctgcagatctccatgaccagcctgcagaacagcctgcccccccagctgctgcagtaccagtgtgaccagtgcaccgtggccttccccaccctggagctgtggcaggagcaccagcacatgcacttcctggccgcccagaaccagttcctgcacagccccttcctggagcggcccatggacatgccctacatgatctttgaccccaacaaccccctgatgacaggccagctgctgggcagcagcctgacccagatgccaccccaggccagcagcagccacaccacagcccccaccaccgtggccgccagcctgaagaggaagctggatgacaaggaggacaacaactgcagcgagaaggagggcggcaacagcggggaggaccagcaccgggacaagaggctgcggaccaccatcaccccagagcagctggagatcctgtatgagaagtacctgctggacagcaaccccaccaggaagatgctggaccacatcgcccgggaggtgggcctgaagaagagggtggtgcaggtgtggttccagaacacccgggcccgggagaggaagggccagttccgggctgtgggccctgcccagagccacaagcgctgccccttctgccgggccctcttcaaggccaagagcgccctggagagccacatccgcagccgccactggaatgaaggcaagcaggccggctacagcctgccccccagccccctcatcagcacagaagatggaggagagagcccccagaagtacatctactttgactaccccagcctgcccctgaccaagattgacctgagcagtgaaaatgagctggccagcacagtgtccacccctgtgtccaagacagctgagctgagccccaagaacctgctgagccccagcagcttcaaggcagaatgttctgaagatgtggagaacctgaatgcccccccagctgaggccggctatgaccagaacaagacagactttgatgagaccagcagcatcaacacagccatcagtgatgccaccactggagatgagggcaacacagagatggagagcaccaccggcagcagtggagatgtgaagccagccctgagccccaaggagcccaagaccctggacaccctgcccaagccagccaccacccccaccacagaggtgtgtgatgacaagttcctgttcagcctgaccagccccagcatccacttcaatgacaaggatggagaccatgaccagagcttctacatcacagatgatcctgatgacaatgctgacagaagtgagaccagcagcattgctgaccccagcagccccaaccccttcggcagcagcaaccccttcaagagcaagagcaatgaccggcccggccacaagcgcttccgcacccagatgagcaacctgcagctgaaggtgctgaaggcctgcttcagtgactaccgcacccccaccatgcaggagtgtgagatgctgggcaatgaaattggcctgcccaagagggtggtgcaggtgtggttccagaatgcccgggccaaggagaagaagttcaagatcaacatcggcaagcccttcatgatcaaccagggcggcacagagggcaccaagccagaatgtaccctgtgtggggtgaagtacagcgcccggctgagcatccgggaccacatcttcagcaagcagcacatcagcaaggtgcgggagaccgtgggcagccagctggaccgggagaaggactacctggcccccaccaccgtgcggcagctgatggcccagcaggagctggaccgcatcaagaaggccagtgatgtgctgggcctgactgtgcagcagcccggcatgatggacagcagcagcctgcacggcatcagcctgcccacagcctacccaggcctgcccggcctgccccctgtgctgctgcccggcatgaatggccccagcagcctgcccggcttcccccagaacagcaacatcgccagcggcatgctgggcttccccaccagcgccaccagcagccctgccctgagcctgagcagcgcccccaccaagcccctgctgcagaccccacctcctcctcctcctcctcctcctcctccacccagcagcagcctgagcggccagcagacagagcagcagaacaaggagagcgagaagaagcagaccaagcccaacaaggtgaagaagatcaaggaggaggagctggaggccaccaagccagagaagcaccccaagaaggaggagaagatcagcagcgccctgtctgtgctgggcaaggtggtgggggagacccacgtggaccccatccagctgcaggccctgcagaatgccatcgccggggaccctgccagcttcatcggcggccagttcctgccctacttcatccctggctttgccagctacttcaccccccagctgcccggcaccgtgcagggcggctacttcccccctgtgtgtggcatggagagcctcttcccctacggccccaccatgccccagaccctggccggcctgagccctggggccctgctgcagcagtaccagcagtaccagcagaacctgcaggagagcctgcagaagcagcagaagcagcagcaggagcagcagcagaagcctgtgcaggccaagaccagcaaggtggagagtgaccagccccagaacagcaatgatgccagcgagaccaaggaggacaagagcacagccacagagagcaccaaggaggagccccagctggagagcaagtctgctgacttcagtgacacctacgtggtgccctttgtgaagtatgagttcatctgcaggaagtgccagatgatgttcacagatgaagatgctgctgtgaaccaccagaagagcttctgctacttcggccagcccctgattgacccccaggagaccgtgctgcgggtgcctgtgtccaagtaccagtgcctggcctgtgatgtggccatctctggaaatgaggccctgagccagcacctgcagagcagcctgcacaaggagaagaccatcaagcaggccatgagaaatgccaaggagcacgtgcggctgctgccccacagcgtgtgcagccccaaccccaacaccaccagcaccagccagagcgctgccagcagcaacaacacctacccccacctgagctgcttctccatgaagtcctggcccaacatcctcttccaggccagcgccaggagagctgccagcccccccagcagcccccccagcctgagcctgcccagcacagtgaccagcagcctgtgcagcaccagcggcgtgcagaccagcctgcccacagagagctgcagtgatgaaagtgacagcgagctgagccagaagctggaggacctggacaacagcctggaggtgaaggccaagccagccagcggcctggatggcaacttcaacagcatccgcatggacatgttttctgtgtag

SEQ ID NO: 176429 - DNA, 10803 bp, Artificial Sequence
  Description of Artificial Sequence: Synthetic coding sequence
atggagacctgtgacagcccccccatcagccggcaggagaatggccagagcaccagcaagctgtgtggcaccacccagctggacaatgaggtgcctgagaaggtggccggcatggagccagaccgggagaacagcagcacagatgacaacctgaagacagatgagaggaagtctgaggccctgctgggcttctctgtggagaatgctgctgccacccaggtgaccagcgccaaggagatcccctgcaatgaatgtgccaccagcttccccagcctgcagaagtacatggagcaccactgccccaatgcccggctgcctgtgctgaaggatgacaatgaaagtgagatcagcgagctggaggacagtgatgtggagaacctgaccggggagatcgtgtaccagccagatggcagcgcctacatcatcgaggacagcaaggagagcggccagaatgcccagacaggagccaacagcaagctgttcagcacagccatgttcctggacagcctggccagcgctggggagaagagtgaccagagcgccagcgcccccatgtccttctacccccagatcatcaacaccttccacatcgccagcagcctgggcaagcccttcaccgctgaccaggccttccccaacaccagcgccctggccggcgtgggccctgtgctgcacagcttccgggtgtatgacctgcggcacaagcgggagaaggactacctgaccagtgatggcagcgccaagaacagctgtgtgtccaaggatgtgcccaacaacgtggacctgagcaagtttgatggctgtgtgtctgatggcaagaggaagcctgtgctgatgtgcttcctgtgcaagctgagctttggctacatccgcagctttgtgacccatgctgtgcatgaccacaggatgaccctgaatgatgaggagcagaagctgctgagcaacaagtgtgtgtctgccatcatccagggcatcggcaaggacaaggagcccctcatctccttcctggagcccaagaagagcacctctgtgtacccccacttcagcaccaccaacctgattggccctgaccccaccttccggggcctgtggagcgccttccacgtggagaatggagacagcctgcctgctggctttgccttcctgaagggcagcgccagcaccagcagcagcgctgagcagcccctgggcatcacccagatgcccaaggccgaggtgaacctgggcggcctgagcagcctggtggtgaacacccccatcacctctgtgtccctgagccacagcagcagcgagagcagcaagatgtctgagagcaaggaccaggagaacaactgtgagcggcccaaggagagcaatgtgctgcaccccaatggagaatgtcctgtgaagtctgagcccacagagcctggagatgaagatgaagaagatgcctacagcaatgagctggatgatgaggaggtgctgggggagctgacagacagcatcggcaacaaggacttccccctgctgaaccagagcatcagccccctgagcagctctgtgctgaagttcatcgagaagggcaccagcagcagcagcgccaccgtgtctgatgacacagagaagaagaagcagacagctgctgtgcgggccagcggctctgtggccagcaactacggcatcagcggcaaggactttgctgatgccagcgccagcaaggacagcgccacagctgcccaccccagcgagatcgcccggggagatgaggacagcagcgccaccccccaccagcacggcttcacccccagcaccccaggcaccccaggccctggaggagatggcagccctggcagcggcatcgagtgccccaagtgtgacacagtgctgggcagcagccgcagcctgggcggccacatgaccatgatgcacagcaggaacagctgcaagaccctgaagtgccccaagtgcaactggcactacaagtaccagcagaccctggaggcccacatgaaggagaagcaccctgagcccggcggcagctgtgtgtactgcaagacaggccagccccacccccggctggcccggggggagagctacacctgtggctacaagcccttccgctgtgaggtgtgcaactacagcaccaccaccaagggcaacctgagcatccacatgcagagcgacaagcacctgaacaacgtgcagaacctgcagaatggaaatggagagcaggtgtttggccacagcgccccagcccccaacaccagcctgagcggctgcggcacccccagccccagcaagcccaagcagaagcccacctggaggtgtgaggtgtgtgactatgagaccaacgtggccaggaacctgcgcatccacatgaccagcgagaagcacatgcacaacatgatgctgctgcagcagaacatgaagcagatccagcacaacctgcacctgggcctggccccagctgaggccgagctgtaccagtactacctggcccagaacatcggcctgaccggcatgaagctggagaacccagctgacccccagctgatgatcaaccccttccagctggaccctgccacagctgctgccctggcccctggcctggtgaacaatgagctgcccccagagatccggctggccagcggccagctgatgggagatgacctgagcctgctgacagctggggagctgagcccctacatcagtgaccctgccctgaagctgttccagtgtgctgtgtgcaacaagttcaccagtgacagcctggaggccctgtctgtgcacgtgagcagcgagaggagcctgcctgaggaggagtggagggctgtgattggagacatctaccagtgcaagctgtgcaactacaacacccagctgaaggccaacttccagctgcactgcaagacagacaagcacatgcagaagtaccagctggtggcccacatcaaggagggcggcaagagcaatgagtggaggctgaagtgcatcgccatcggcaaccctgtgcacctgaagtgcaatgcctgtgactactacaccaacagcgtggacaagctgcggctgcacaccaccaaccacagacatgaagctgccctgaagctgtacaagcacctgcagaagcaggagggcgctgtgaaccctgagagctgctactactactgtgctgtgtgtgactacaccaccaaggtgaagctgaacctggtgcagcacgtgcgctctgtgaagcaccagcagacagagggcctgaggaagctgcagctgcaccagcagggcctggcccctgaggaggacaacctgtctgagatcttctttgtgaaggactgccccccaaatgagctggagacagccagcctgggcgcccggacctgtgatgatgacctgacagagcagcagctgcggagcaccagcgaggagcagagcgaggaggccgagggcgccatcaagcccacagctgtggctgaagatgatgagaaggacaccagcgagcgggacaacagcgagggcaagaacagcaacaaggacagcggcatcatcaccccagagaaggagctgaaggtgtctgtggccggcggcacccagcccctgctgctggccaaggaggaggatgtggccaccaagaggagcaagcccacagaggacaacaagttctgccacgagcagttctaccagtgcccctactgcaactacaacagccgggaccagagccgcatccagatgcacgtgctgagccagcacagcgtgcagcccgtcatctgctgccccctgtgccaggatgtgctgagcaacaagatgcacctgcagctgcacctgacccacctgcacagcgtgtccccagactgtgtggagaagctgctgatgacagtgcctgtgcctgatgtgatgatgcccaacagcatgctgctgcctgctgctgccagcgagaagtctgagcgggacaccccagctgctgtgacagctgagggcagcggcaagtacagcggggagagccccatggatgacaagtccatggccggcctggaggacagcaaggccaacgtggaggtgaagaatgaggagcagaagcccaccaaggagcccctggaggtgtctgagtggaacaagaacagcagcaaggatgtgaagatcccagacaccctgcaggaccagctgaatgagcagcagaagaggcagcccctgtctgtgtctgacagacatgtgtacaagtaccgctgcaaccactgcagcctggccttcaagaccatgcagaagctgcagatccacagccagtaccacgccatccgggccgccaccatgtgcaacctgtgccagaggagcttccgcaccttccaggccctgaagaagcacctggaggccggccaccctgagctgtctgaggccgagctgcagcagctgtatgccagcctgcctgtgaatggagagctgtgggccgagagcgagaccatgagccaggatgaccacggcctggagcaggagatggagcgggagtatgaggtggaccacgagggcaaggccagccctgtgggcagtgacagcagcagcatcccagatgacatgggcagcgagcccaagaggaccctgcccttcaggaagggccccaacttcaccatggagaagttcctggaccccagccggccctacaagtgcaccgtgtgcaaggagagcttcacccagaagaacatcctgctggtgcactacaacagcgtgagccacctgcacaagctgaagaaggtgctgcaggaggccagcagccctgtgccccaggagaccaacagcaacacagacaacaagccctacaagtgcagcatctgcaatgtggcctacagccagagcagcaccctggagatccacatgaggtctgtgctgcaccagaccaaggcccgggccgccaagctggagcccagcggccacgtggccggcggccacagcattgctgccaacgtgaacagccctggccagggcatgctggacagcatgagcctggccgctgtgaacagcaaggacacccacctggatgccaaggagctgaacaagaagcagaccccagacctgatcagcgcccagcctgcccaccaccccccccagagccctgcccagatccagatgcagctgcagcacgagctgcagcagcaggccgccttcttccagccccagttcctgaacccagccttcctgccccacttccccatgaccccagaggccctgctgcagttccagcagccccagttcctgttccccttctacatccctggaacagagttcagcctgggccctgacctgggcctgcccggcagcgccaccttcggcatgcctggcatgacaggcatggccggcagcctgctggaggacctgaagcagcagatccagacccagcaccacgtgggccagacccagctgcagatcctgcagcagcaggcccagcagtaccaggccacccagccccagctgcagccccagaagcagcagcagcagcccccaccaccccagcagcagcagcagcagcaggccagcaagctgctgaagcaggagcagagcaacatcgtgtctgctgactgccagatcatgaaggatgtgcccagctacaaggaggccgaggacatcagcgagaagccagagaagcccaagcaggagttcatcagcgagggggagggcctgaaggagggcaaggacaccaagaagcagaagagcctggagcccagcatccccccaccccgcatcgccagcggggcccggggaaatgctgccaaggccctgctggagaactttggatttgagctggtgatccagtacaatgaaaatcggcagaaggtgcagaagaagggcaagtctggagaaggagaaaatacagacaagctggagtgtggcacctgtgggaagctgttcagcaatgtgctgatcctgaagagccaccaggagcacgtgcacggccagttcttcccctatgctgccctggagaagtttgcccggcagtaccgggaggcctatgacaagctgtaccccatcagccccagcagccctgagaccccacctcctcctcctcctcctccacccctgcccccagccccaccccagcccagctccatgggccctgtgaagatccccaacacagtgtccacccccctgcaggcccccccacccaccccacctccacccagcgccccaccccaggtgcagctgcctgtgtccctggacctgcccctcttccccagcatcatgatgcagcctgtgcagcacccagccctgcccccccagctggccctgcagctgccccagatggatgccctgtctgctgacctgacccagctgtgccagcagcagctgggcctggaccccaacttcctgcggcacagccagttcaagaggcccaggacccgcatcacagatgaccagctgaagatcctgcgggcctactttgacatcaacaacagccccagcgaggagcagatccaggagatggccgagaagagcggcctgagccagaaggtgatcaagcactggttcaggaacaccctcttcaaggagcggcagaggaacaaggacagcccctacaacttcagcaacccccccatcaccgtgctggaggacatcagaattgacccccagcccaccagcctggagcactacaagagtgatgccagcttcagcaagaggagcagcaggacccgcttcacagactaccagctgcgggtgctgcaggacttctttgacaccaatgcctaccccaaggatgatgaaattgagcagctgagcacagtgctgaacctgcccaccagggtcatcgtggtgtggttccagaatgcccggcagaaggccaggaagagctatgagaaccaggccgagaccaaggacaatgagaagcgggagctgaccaatgaaagatacatccgcaccagcaacatgcagtaccagtgcaagaagtgcaatgtggtgttcccccgcatctttgacctgatcacccaccagaagaagcagtgctacaaggatgaagatgatgatgcccaggatgagagccagacagaggacagcatggatgccacagaccaggtggtgtacaagcactgcaccgtgtctggccagacagatgctgccaagaatgctgctgccccagctgccagcagcggcagcggcaccagcacccccctcatccccagccccaagccagagcctgagaagaccagccccaagccagagtacccagctgagaagcccaagcagagcgaccccagcccccccagccagggcaccaagccagccctgcccctggccagcaccagcagtgaccccccccaggccagcacagcccagccccagccccagccccagccccccaagcagccccagctgattggccggccccccagcgccagccagacccctgtgcccagcagccccctgcagatctccatgaccagcctgcagaacagcctgcccccccagctgctgcagtaccagtgtgaccagtgcaccgtggccttccccaccctggagctgtggcaggagcaccagcacatgcacttcctggccgcccagaaccagttcctgcacagccccttcctggagcggcccatggacatgccctacatgatctttgaccccaacaaccccctgatgacaggccagctgctgggcagcagcctgacccagatgccaccccaggccagcagcagccacaccacagcccccaccaccgtggccgccagcctgaagaggaagctggatgacaaggaggacaacaactgcagcgagaaggagggcggcaacagcggggaggaccagcaccgggacaagaggctgcggaccaccatcaccccagagcagctggagatcctgtatgagaagtacctgctggacagcaaccccaccaggaagatgctggaccacatcgcccgggaggtgggcctgaagaagagggtggtgcaggtgtggttccagaacacccgggcccgggagaggaagggccagttccgggctgtgggccctgcccagagccacaagcgctgccccttctgccgggccctcttcaaggccaagagcgccctggagagccacatccgcagccgccactggaatgaaggcaagcaggccggctacagcctgccccccagccccctcatcagcacagaagatggaggagagagcccccagaagtacatctactttgactaccccagcctgcccctgaccaagattgacctgagcagtgaaaatgagctggccagcacagtgtccacccctgtgtccaagacagctgagctgagccccaagaacctgctgagccccagcagcttcaaggccgagtgcagtgaagatgtggagaacctgaatgcccctcctgctgaggccggctatgaccagaacaagacagactttgatgagaccagcagcatcaacacagccatcagtgatgccaccactggagatgagggcaacacagagatggagagcaccaccggcagcagtggagatgtgaagccagccctgagccccaaggagcccaagaccctggacaccctgcccaagccagccaccacccccaccacagaggtgtgtgatgacaagttcctgttcagcctgaccagccccagcatccacttcaatgacaaggatggagaccatgaccagagcttctacatcacagatgatcctgatgacaatgctgacagaagtgagaccagcagcattgctgaccccagcagccccaaccccttcggcagcagcaaccccttcaagagcaagagcaatgacaggcctggccacaagcgcttccgcacccagatgagcaacctgcagctgaaggtgctgaaggcctgcttcagtgactaccgcacccccaccatgcaggagtgtgagatgctgggcaatgagatcggcctgcccaagagggtggtgcaggtgtggttccagaatgcccgggccaaggagaagaagttcaagatcaacatcggcaagcccttcatgatcaaccagggcggcacagagggcaccaagccagagtgcaccctgtgtggggtgaagtacagcgcccggctgagcatccgggaccacatcttcagcaagcagcacatcagcaaggtgcgggagaccgtgggcagccagctggaccgggagaaggactacctggcccccaccaccgtgcggcagctgatggcccagcaggagctggaccgcatcaagaaggccagtgatgtgctgggcctgactgtgcagcagcccggcatgatggacagcagcagcctgcacggcatcagcctgcccacagcctacccaggcctgcccggcctgccccctgtgctgctgcccggcatgaatggccccagcagcctgcccggcttcccccagaacagcaacaccctgaccccacctggagctggcatgctgggcttccccaccagcgccaccagcagccctgccctgagcctgagcagcgcccccaccaagcccctgctgcagaccccacctcctcctcctcctcctcctcctcctccacccagcagcagcctgagcggccagcagacagagcagcagaacaaggagagcgagaagaagcagaccaagcccaacaaggtgaagaagatcaaggaggaggagctggaggccaccaagccagagaagcaccccaagaaggaggagaagatcagcagcgccctgtctgtgctgggcaaggtggtgggggagacccacgtggaccccatccagctgcaggccctgcagaatgccatcgccggggaccctgccagcttcatcggcggccagttcctgccctacttcatccctggctttgccagctacttcaccccccagctgcccggcaccgtgcagggcggctacttcccccctgtgtgtggcatggagagcctcttcccctacggccccaccatgccccagaccctggccggcctgagccctggggccctgctgcagcagtaccagcagtaccagcagaacctgcaggagagcctgcagaagcagcagaagcagcagcaggagcagcagcagaagcctgtgcaggccaagaccagcaaggtggagagtgaccagccccagaacagcaatgatgccagcgagaccaaggaggacaagagcacagccacagagagcaccaaggaggagccccagctggagagcaagtctgctgacttcagtgacacctacgtggtgccctttgtgaagtatgagttcatctgcaggaagtgccagatgatgttcacagatgaagatgctgctgtgaaccaccagaagagcttctgctacttcggccagcccctgattgacccccaggagaccgtgctgcgggtgcctgtgtccaagtaccagtgcctggcctgtgatgtggccatctctggaaatgaggccctgagccagcacctgcagagcagcctgcacaaggagaagaccatcaagcaggccatgagaaatgccaaggagcacgtgcggctgctgccccacagcgtgtgcagccccaaccccaacaccaccagcaccagccagagcgctgccagcagcaacaacacctacccccacctgagctgcttctccatgaagtcctggcccaacatcctcttccaggccagcgcccggcgggccgccagcccccccagcagcccccccagcctgagcctgcccagcacagtgaccagcagcctgtgcagcaccagcggcgtgcagaccagcctgcccacagagagctgcagtgatgaaagtgacagcgagctgagccagaagctggaggacctggacaacagcctggaggtgaaggccaagccagccagcggcctggatggcaacttcaacagcatccgcatggacatgttttctgtgtag

SEQ ID NO: 176430 - DNA, 10716 bp, Artificial Sequence
  Description of Artificial Sequence: Synthetic coding sequence
atggagacctgtgacagcccccccatcagccggcaggagaatggccagagcaccagcaagctgtgtggcaccacccagctggacaatgaggtgcctgagaaggtggccggcatggagccagaccgggagaacagcagcacagatgacaacctgaagacagatgagaggaagtctgaggccctgctgggcttctctgtggagaatgctgctgccacccaggtgaccagcgccaaggagatcccctgcaatgaatgtgccaccagcttccccagcctgcagaagtacatggagcaccactgccccaatgcccggctgcctgtgctgaaggatgacaatgaaagtgagatcagcgagctggaggacagtgatgtggagaacctgaccggggagatcgtgtaccagccagatggcagcgcctacatcatcgaggacagcaaggagagcggccagaatgcccagacaggagccaacagcaagctgttcagcacagccatgttcctggacagcctggccagcgctggggagaagagtgaccagagcgccagcgcccccatgtccttctacccccagatcatcaacaccttccacatcgccagcagcctgggcaagcccttcaccgctgaccaggccttccccaacaccagcgccctggccggcgtgggccctgtgctgcacagcttccgggtgtatgacctgcggcacaagcgggagaaggactacctgaccagtgatggcagcgccaagaacagctgtgtgtccaaggatgtgcccaacaacgtggacctgagcaagtttgatggctgtgtgtctgatggcaagaggaagcctgtgctgatgtgcttcctgtgcaagctgagctttggctacatccgcagctttgtgacccatgctgtgcatgaccacaggatgaccctgaatgatgaggagcagaagctgctgagcaacaagtgtgtgtctgccatcatccagggcatcggcaaggacaaggagcccctcatctccttcctggagcccaagaagagcacctctgtgtacccccacttcagcaccaccaacctgattggccctgaccccaccttccggggcctgtggagcgccttccacgtggagaatggagacagcctgcctgctggctttgccttcctgaagggcagcgccagcaccagcagcagcgctgagcagcccctgggcatcacccagatgcccaaggccgaggtgaacctgggcggcctgagcagcctggtggtgaacacccccatcacctctgtgtccctgagccacagcagcagcgagagcagcaagatgtctgagagcaaggaccaggagaacaactgtgagcggcccaaggagagcaatgtgctgcaccccaatggagaatgtcctgtgaagtctgagcccacagagcctggagatgaagatgaagaagatgcctacagcaatgagctggatgatgaggaggtgctgggggagctgacagacagcatcggcaacaaggacttccccctgctgaaccagagcatcagccccctgagcagctctgtgctgaagttcatcgagaagggcaccagcagcagcagcgccaccgtgtctgatgacacagagaagaagaagcagacagctgctgtgcgggccagcggctctgtggccagcaactacggcatcagcggcaaggactttgctgatgccagcgccagcaaggacagcgccacagctgcccaccccagcgagatcgcccggggagatgaggacagcagcgccaccccccaccagcacggcttcacccccagcaccccaggcaccccaggccctggaggagatggcagccctggcagcggcatcgagtgccccaagtgtgacacagtgctgggcagcagccgcagcctgggcggccacatgaccatgatgcacagcaggaacagctgcaagaccctgaagtgccccaagtgcaactggcactacaagtaccagcagaccctggaggcccacatgaaggagaagcaccctgagcccggcggcagctgtgtgtactgcaagacaggccagccccacccccggctggcccggggggagagctacacctgtggctacaagcccttccgctgtgaggtgtgcaactacagcaccaccaccaagggcaacctgagcatccacatgcagagcgacaagcacctgaacaacgtgcagaacctgcagaatggaaatggagagcaggtgtttggccacagcgccccagcccccaacaccagcctgagcggctgcggcacccccagccccagcaagcccaagcagaagcccacctggaggtgtgaggtgtgtgactatgagaccaacgtggccaggaacctgcgcatccacatgaccagcgagaagcacatgcacaacatgatgctgctgcagcagaacatgaagcagatccagcacaacctgcacctgggcctggccccagctgaggccgagctgtaccagtactacctggcccagaacatcggcctgaccggcatgaagctggagaacccagctgacccccagctgatgatcaaccccttccagctggaccctgccacagctgctgccctggcccctggcctgggggagctgagcccctacatcagtgaccctgccctgaagctgttccagtgtgctgtgtgcaacaagttcaccagtgacagcctggaggccctgtctgtgcacgtgagcagcgagaggagcctgcctgaggaggagtggagggctgtgattggagacatctaccagtgcaagctgtgcaactacaacacccagctgaaggccaacttccagctgcactgcaagacagacaagcacatgcagaagtaccagctggtggcccacatcaaggagggcggcaagagcaatgagtggaggctgaagtgcatcgccatcggcaaccctgtgcacctgaagtgcaatgcctgtgactactacaccaacagcgtggacaagctgcggctgcacaccaccaaccacagacatgaagctgccctgaagctgtacaagcacctgcagaagcaggagggcgctgtgaaccctgagagctgctactactactgtgctgtgtgtgactacaccaccaaggtgaagctgaacctggtgcagcacgtgcgctctgtgaagcaccagcagacagagggcctgaggaagctgcagctgcaccagcagggcctggcccctgaggaggacaacctgtctgagatcttctttgtgaaggactgccccccaaatgagctggagacagccagcctgggcgcccggacctgtgatgatgacctgacagagcagcacgaggaggccgagggcgccatcaagcccacagctgtggccgaggatgatgagaaggacaccagcgagcgggacaacagcgagggcaagaacagcaacaaggacagcgtgtctgtggccggcggcacccagcccctgctgctggccaaggaggaggatgtggccaccaagaggagcaagcccacagaggacaacaagttctgccacgagcagttctaccagtgcccctactgcaactacaacagccgggaccagagccgcatccagatgcacgtgctgagccagcacagcgtgcagcctgtgatctgctgccccctgtgccaggatgtgctgagcaacaagatgcacctgcagctgcacctgacccacctgcacagcgtgtccccagactgtgtggagaagctgctgatgacagtgcctgtgcctgatgtgatgatgcccaacagcatgctgctgcctgctgctgccagcgagaagtctgagcgggacaccccagctgctgtgacagctgagggcagcggcaagtacagcggggagagccccatggatgacaagtccatggccggcctggaggacagcaaggccaacgtggaggtgaagaatgaggagcagaagcccaccaaggagcccctggaggtgtctgagtggaacaagaacagcagcaaggatgtgaagatcccagacaccctgcaggaccagctgaatgagcagcagaagaggcagcccctgtctgtgtctgacagacatgtgtacaagtaccgctgcaaccactgcagcctggccttcaagaccatgcagaagctgcagatccacagccagtaccacgccatccgggccgccaccatgtgcaacctgtgccagaggagcttccgcaccttccaggccctgaagaagcacctggaggccggccaccctgagctgtctgaggccgagctgcagcagctgtatgccagcctgcctgtgaatggagagctgtgggccgagagcgagaccatgagccaggatgaccacggcctggagcaggagatggagcgggagtatgaggtggaccacgagggcaaggccagccctgtgggcagtgacagcagcagcatcccagatgacatgggcagcgagcccaagaggaccctgcccttcaggaagggccccaacttcaccatggagaagttcctggaccccagccggccctacaagtgcaccgtgtgcaaggagagcttcacccagaagaacatcctgctggtgcactacaacagcgtgagccacctgcacaagctgaagaaggtgctgcaggaggccagcagccctgtgccccaggagaccaacagcaacacagacaacaagccctacaagtgcagcatctgcaatgtggcctacagccagagcagcaccctggagatccacatgaggtctgtgctgcaccagaccaaggcccgggccgccaagctggagcccagcggccacgtggccggcggccacagcattgctgccaacgtgaacagccctggccagggcatgctggacagcatgagcctggccgctgtgaacagcaaggacacccacctggatgccaaggagctgaacaagaagcagaccccagacctgatcagcgcccagcctgcccaccaccccccccagagccctgcccagatccagatgcagctgcagcacgagctgcagcagcaggccgccttcttccagccccagttcctgaacccagccttcctgccccacttccccatgaccccagaggccctgctgcagttccagcagccccagttcctgttccccttctacatccctggaacagagttcagcctgggccctgacctgggcctgcccggcagcgccaccttcggcatgcctggcatgacaggcatggccggcagcctgctggaggacctgaagcagcagatccagacccagcaccacgtgggccagacccagctgcagatcctgcagcagcaggcccagcagtaccaggccacccagccccagctgcagccccagaagcagcagcagcagcccccaccaccccagcagcagcagcagcagcaggccagcaagctgctgaagcaggagcagagcaacatcgtgtctgctgactgccagatcatgaaggatgtgcccagctacaaggaggccgaggacatcagcgagaagccagagaagcccaagcaggagttcatcagcgagggggagggcctgaaggagggcaaggacaccaagaagcagaagagcctggagcccagcatccccccaccaagaattgccagcggggcccggggaaatgctgccaaggccctgctggagaactttggatttgagctggtgatccagtacaatgaaaatcggcagaaggtgcagaagaagggcaagagcggggagggggagaacacagacaagctggagtgtggcacctgtgggaagctgttcagcaatgtgctgatcctgaagagccaccaggagcacgtgcacggccagttcttcccctatgctgccctggagaagtttgcccggcagtaccgggaggcctatgacaagctgtaccccatcagccccagcagccctgagaccccacctcctcctcctcctcctccacccctgcccccagccccaccccagcccagctccatgggccctgtgaagatccccaacacagtgtccacccccctgcaggcccccccacccaccccacctcctcctcctcctcctcctcctcctcctcctcctcctcctcctcctcctcctccttctgccccaccccaggtgcagctgcctgtgtccctggacctgcccctcttccccagcatcatgatgcagcctgtgcagcacccagccctgcccccccagctggccctgcagctgccccagatggatgccctgtctgctgacctgacccagctgtgccagcagcagctgggcctggaccccaacttcctgcggcacagccagttcaagaggcccaggacccgcatcacagatgaccagctgaagatcctgcgggcctactttgacatcaacaacagccccagcgaggagcagatccaggagatggccgagaagagcggcctgagccagaaggtgatcaagcactggttcaggaacaccctcttcaaggagcggcagaggaacaaggacagcccctacaacttcagcaacccccccatcaccgtgctggaggacatcagaattgacccccagcccaccagcctggagcactacaagagtgatgccagcttcagcaagaggagcagcaggacccgcttcacagactaccagctgcgggtgctgcaggacttctttgacaccaatgcctaccccaaggatgatgaaattgagcagctgagcacagtgctgaacctgcccaccagggtgattgtggtgtggttccagaatgcccggcagaaggccaggaagagctatgagaaccaggccgagaccaaggacaatgagaagcgggagctgaccaatgaaagatacatccgcaccagcaacatgcagtaccagtgcaagaagtgcaatgtggtgttcccccgcatctttgacctgatcacccaccagaagaagcagtgctacaaggatgaagatgatgatgcccaggatgagagccagacagaagattccatggatgccacagaccaggtggtgtacaagcactgcaccgtgtctggccagacagatgctgccaagaatgctgctgccccagctgccagcagcggcagcggcaccagcacccccctcatccccagccccaagccagagcctgagaagaccagccccaagccagagtacccagctgagaagcccaagcagagcgaccccagcccccccagccagggcaccaagccagccctgcccctggccagcaccagcagtgaccccccccaggccagcacagcccagccccagccccagccccagccccccaagcagccccagctgattggccggcccccatctgccagccagacccctgtgcccagcagccccctgcagatctccatgaccagcctgcagaacagcctgcccccccagctgctgcagtaccagtgtgaccagtgcaccgtggccttccccaccctggagctgtggcaggagcaccagcacatgcacttcctggccgcccagaaccagttcctgcacagccccttcctggagcggcccatggacatgccctacatgatctttgaccccaacaaccccctgatgacaggccagctgctgggcagcagcctgacccagatgccaccccaggccagcagcagccacaccacagcccccaccaccgtggccgccagcctgaagaggaagctggatgacaaggaggacaacaactgcagcgagaaggagggcggcaacagcggggaggaccagcaccgggacaagaggctgcggaccaccatcaccccagagcagctggagatcctgtatgagaagtacctgctggacagcaaccccaccaggaagatgctggaccacatcgcccgggaggtgggcctgaagaagagggtggtgcaggtgtggttccagaacacccgggcccgggagaggaagggccagttccgggctgtgggccctgcccagagccacaagcgctgccccttctgccgggccctcttcaaggccaagagcgccctggagagccacatccgcagccgccactggaatgaaggcaagcaggccggctacagcctgccccccagccccctcatcagcacagaagatggaggagagagcccccagaagtacatctactttgactaccccagcctgcccctgaccaagattgacctgagcagtgaaaatgagctggccagcacagtgtccacccctgtgtccaagacagctgagctgagccccaagaacctgctgagccccagcagcttcaaggcagaatgttctgaagatgtggagaacctgaatgcccccccagctgaggccggctatgaccagaacaagacagactttgatgagaccagcagcatcaacacagccatcagtgatgccaccactggagatgagggcaacacagagatggagagcaccaccggcagcagtggagatgtgaagccagccctgagccccaaggagcccaagaccctggacaccctgcccaagccagccaccacccccaccacagaggtgtgtgatgacaagttcctgttcagcctgaccagccccagcatccacttcaatgacaaggatggagaccatgaccagagcttctacatcacagatgatcctgatgacaatgctgacagaagtgagaccagcagcattgctgaccccagcagccccaaccccttcggcagcagcaaccccttcaagagcaagagcaatgaccggcccggccacaagcgcttccgcacccagatgagcaacctgcagctgaaggtgctgaaggcctgcttcagtgactaccgcacccccaccatgcaggagtgtgagatgctgggcaatgaaattggcctgcccaagagggtggtgcaggtgtggttccagaatgcccgggccaaggagaagaagttcaagatcaacatcggcaagcccttcatgatcaaccagggcggcacagagggcaccaagccagaatgtaccctgtgtggggtgaagtacagcgcccggctgagcatccgggaccacatcttcagcaagcagcacatcagcaaggtgcgggagaccgtgggcagccagctggaccgggagaaggactacctggcccccaccaccgtgcggcagctgatggcccagcaggagctggaccgcatcaagaaggccagtgatgtgctgggcctgactgtgcagcagcccggcatgatggacagcagcagcctgcacggcatcagcctgcccacagcctacccaggcctgcccggcctgccccctgtgctgctgcccggcatgaatggccccagcagcctgcccggcttcccccagaacagcaacaccctgaccccacctggggccggcatgctgggcttccccaccagcgccaccagcagccctgccctgagcctgagcagcgcccccaccaagcccctgctgcagaccccacctcctcctcctcctcctcctcctcctccacccagcagcagcctgagcggccagcagacagagcagcagaacaaggagagcgagaagaagcagaccaagcccaacaaggtgaagaagatcaaggaggaggagctggaggccaccaagccagagaagcaccccaagaaggaggagaagatcagcagcgccctgtctgtgctgggcaaggtggtgggggagacccacgtggaccccatccagctgcaggccctgcagaatgccatcgccggggaccctgccagcttcatcggcggccagttcctgccctacttcatccctggctttgccagctacttcaccccccagctgcccggcaccgtgcagggcggctacttcccccctgtgtgtggcatggagagcctcttcccctacggccccaccatgccccagaccctggccggcctgagccctggggccctgctgcagcagtaccagcagtaccagcagaacctgcaggagagcctgcagaagcagcagaagcagcagcaggagcagcagcagaagcctgtgcaggccaagaccagcaaggtggagagtgaccagccccagaacagcaatgatgccagcgagaccaaggaggacaagagcacagccacagagagcaccaaggaggagccccagctggagagcaagtctgctgacttcagtgacacctacgtggtgccctttgtgaagtatgagttcatctgcaggaagtgccagatgatgttcacagatgaagatgctgctgtgaaccaccagaagagcttctgctacttcggccagcccctgattgacccccaggagaccgtgctgcgggtgcctgtgtccaagtaccagtgcctggcctgtgatgtggccatctctggaaatgaggccctgagccagcacctgcagagcagcctgcacaaggagaagaccatcaagcaggccatgagaaatgccaaggagcacgtgcggctgctgccccacagcgtgtgcagccccaaccccaacaccaccagcaccagccagagcgctgccagcagcaacaacacctacccccacctgagctgcttctccatgaagtcctggcccaacatcctcttccaggccagcgccaggagagctgccagcccccccagcagcccccccagcctgagcctgcccagcacagtgaccagcagcctgtgcagcaccagcggcgtgcagaccagcctgcccacagagagctgcagtgatgaaagtgacagcgagctgagccagaagctggaggacctggacaacagcctggaggtgaaggccaagccagccagcggcctggatggcaacttcaacagcatccgcatggacatgttttctgtgtag

SEQ ID NO: 176431 - DNA, 468 bp, Artificial Sequence
  Description of Artificial Sequence: Synthetic coding sequence
atggagacctgtgacagcccccccatcagccggcaggagaatggccagagcaccagcaagctgtgtggcaccacccagctggacaatgaggtgcctgagaaggtggccggcatggagccagaccgggagaacagcagcacagatgacaacctgaagacagatgagaggaagtctgaggccctgctgggcttctctgtggagaatgctgctgccacccaggtgaccagcgccaaggagatcccctgcaatgaatgtgccaccagcttccccagcctgcagaagtacatggagcaccactgccccaatgcccggctgcctgtgctgaaggatgacaatgaaagtgagatcagcgagctggaggacagtgatgtggagaacctgaccggggagatcgtgtaccagccagatggcagcgcctacatcatcgaggacagcaaggagagcggccagaatgcccagacaggatag

SEQ ID NO: 176432 - DNA, 10773 bp, Artificial Sequence
  Description of Artificial Sequence: Synthetic coding sequence
atggagacctgtgacagcccccccatcagccggcaggagaatggccagagcaccagcaagctgtgtggcaccacccagctggacaatgaggtgcctgagaaggtggccggcatggagccagaccgggagaacagcagcacagatgacaacctgaagacagatgagaggaagtctgaggccctgctgggcttctctgtggagaatgctgctgccacccaggtgaccagcgccaaggagatcccctgcaatgaatgtgccaccagcttccccagcctgcagaagtacatggagcaccactgccccaatgcccggctgcctgtgctgaaggatgacaatgaaagtgagatcagcgagctggaggacagtgatgtggagaacctgaccggggagatcgtgtaccagccagatggcagcgcctacatcatcgaggacagcaaggagagcggccagaatgcccagacaggagccaacagcaagctgttcagcacagccatgttcctggacagcctggccagcgctggggagaagagtgaccagagcgccagcgcccccatgtccttctacccccagatcatcaacaccttccacatcgccagcagcctgggcaagcccttcaccgctgaccaggccttccccaacaccagcgccctggccggcgtgggccctgtgctgcacagcttccgggtgtatgacctgcggcacaagcgggagaaggactacctgaccagtgatggcagcgccaagaacagctgtgtgtccaaggatgtgcccaacaacgtggacctgagcaagtttgatggctgtgtgtctgatggcaagaggaagcctgtgctgatgtgcttcctgtgcaagctgagctttggctacatccgcagctttgtgacccatgctgtgcatgaccacaggatgaccctgaatgatgaggagcagaagctgctgagcaacaagtgtgtgtctgccatcatccagggcatcggcaaggacaaggagcccctcatctccttcctggagcccaagaagagcacctctgtgtacccccacttcagcaccaccaacctgattggccctgaccccaccttccggggcctgtggagcgccttccacgtggagaatggagacagcctgcctgctggctttgccttcctgaagggcagcgccagcaccagcagcagcgctgagcagcccctgggcatcacccagatgcccaaggccgaggtgaacctgggcggcctgagcagcctggtggtgaacacccccatcacctctgtgtccctgagccacagcagcagcgagagcagcaagatgtctgagagcaaggaccaggagaacaactgtgagcggcccaaggagagcaatgtgctgcaccccaatggagaatgtcctgtgaagtctgagcccacagagcctggagatgaagatgaagaagatgcctacagcaatgagctggatgatgaggaggtgctgggggagctgacagacagcatcggcaacaaggacttccccctgctgaaccagagcatcagccccctgagcagctctgtgctgaagttcatcgagaagggcaccagcagcagcagcgccaccgtgtctgatgacacagagaagaagaagcagacagctgctgtgcgggccagcggctctgtggccagcaactacggcatcagcggcaaggactttgctgatgccagcgccagcaaggacagcgccacagctgcccaccccagcgagatcgcccggggagatgaggacagcagcgccaccccccaccagcacggcttcacccccagcaccccaggcaccccaggccctggaggagatggcagccctggcagcggcatcgagtgccccaagtgtgacacagtgctgggcagcagccgcagcctgggcggccacatgaccatgatgcacagcaggaacagctgcaagaccctgaagtgccccaagtgcaactggcactacaagtaccagcagaccctggaggcccacatgaaggagaagcaccctgagcccggcggcagctgtgtgtactgcaagacaggccagccccacccccggctggcccggggggagagctacacctgtggctacaagcccttccgctgtgaggtgtgcaactacagcaccaccaccaagggcaacctgagcatccacatgcagagcgacaagcacctgaacaacgtgcagaacctgcagaatggaaatggagagcaggtgtttggccacagcgccccagcccccaacaccagcctgagcggctgcggcacccccagccccagcaagcccaagcagaagcccacctggaggtgtgaggtgtgtgactatgagaccaacgtggccaggaacctgcgcatccacatgaccagcgagaagcacatgcacaacatgatgctgctgcagcagaacatgaagcagatccagcacaacctgcacctgggcctggccccagctgaggccgagctgtaccagtactacctggcccagaacatcggcctgaccggcatgaagctggagaacccagctgacccccagctgatgatcaaccccttccagctggaccctgccacagctgctgccctggcccctggcctgggggagctgagcccctacatcagtgaccctgccctgaagctgttccagtgtgctgtgtgcaacaagttcaccagtgacagcctggaggccctgtctgtgcacgtgagcagcgagaggagcctgcctgaggaggagtggagggctgtgattggagacatctaccagtgcaagctgtgcaactacaacacccagctgaaggccaacttccagctgcactgcaagacagacaagcacatgcagaagtaccagctggtggcccacatcaaggagggcggcaagagcaatgagtggaggctgaagtgcatcgccatcggcaaccctgtgcacctgaagtgcaatgcctgtgactactacaccaacagcgtggacaagctgcggctgcacaccaccaaccacagacatgaagctgccctgaagctgtacaagcacctgcagaagcaggagggcgctgtgaaccctgagagctgctactactactgtgctgtgtgtgactacaccaccaaggtgaagctgaacctggtgcagcacgtgcgctctgtgaagcaccagcagacagagggcctgaggaagctgcagctgcaccagcagggcctggcccctgaggaggacaacctgtctgagatcttctttgtgaaggactgccccccaaatgagctggagacagccagcctgggcgcccggacctgtgatgatgacctgacagagcagcagctgcggagcaccagcgaggagcagagcgaggaggccgagggcgccatcaagcccacagctgtggctgaagatgatgagaaggacaccagcgagcgggacaacagcgagggcaagaacagcaacaaggacagcggcatcatcaccccagagaaggagctgaaggtgtctgtggccggcggcacccagcccctgctgctggccaaggaggaggatgtggccaccaagaggagcaagcccacagaggacaacaagttctgccacgagcagttctaccagtgcccctactgcaactacaacagccgggaccagagccgcatccagatgcacgtgctgagccagcacagcgtgcagcccgtcatctgctgccccctgtgccaggatgtgctgagcaacaagatgcacctgcagctgcacctgacccacctgcacagcgtgtccccagactgtgtggagaagctgctgatgacagtgcctgtgcctgatgtgatgatgcccaacagcatgctgctgcctgctgctgccagcgagaagtctgagcgggacaccccagctgctgtgacagctgagggcagcggcaagtacagcggggagagccccatggatgacaagtccatggccggcctggaggacagcaaggccaacgtggaggtgaagaatgaggagcagaagcccaccaaggagcccctggaggtgtctgagtggaacaagaacagcagcaaggatgtgaagatcccagacaccctgcaggaccagctgaatgagcagcagaagaggcagcccctgtctgtgtctgacagacatgtgtacaagtaccgctgcaaccactgcagcctggccttcaagaccatgcagaagctgcagatccacagccagtaccacgccatccgggccgccaccatgtgcaacctgtgccagaggagcttccgcaccttccaggccctgaagaagcacctggaggccggccaccctgagctgtctgaggccgagctgcagcagctgtatgccagcctgcctgtgaatggagagctgtgggccgagagcgagaccatgagccaggatgaccacggcctggagcaggagatggagcgggagtatgaggtggaccacgagggcaaggccagccctgtgggcagtgacagcagcagcatcccagatgacatgggcagcgagcccaagaggaccctgcccttcaggaagggccccaacttcaccatggagaagttcctggaccccagccggccctacaagtgcaccgtgtgcaaggagagcttcacccagaagaacatcctgctggtgcactacaacagcgtgagccacctgcacaagctgaagaaggtgctgcaggaggccagcagccctgtgccccaggagaccaacagcaacacagacaacaagccctacaagtgcagcatctgcaatgtggcctacagccagagcagcaccctggagatccacatgaggtctgtgctgcaccagaccaaggcccgggccgccaagctggagcccagcggccacgtggccggcggccacagcattgctgccaacgtgaacagccctggccagggcatgctggacagcatgagcctggccgctgtgaacagcaaggacacccacctggatgccaaggagctgaacaagaagcagaccccagacctgatcagcgcccagcctgcccaccaccccccccagagccctgcccagatccagatgcagctgcagcacgagctgcagcagcaggccgccttcttccagccccagttcctgaacccagccttcctgccccacttccccatgaccccagaggccctgctgcagttccagcagccccagttcctgttccccttctacatccctggaacagagttcagcctgggccctgacctgggcctgcccggcagcgccaccttcggcatgcctggcatgacaggcatggccggcagcctgctggaggacctgaagcagcagatccagacccagcaccacgtgggccagacccagctgcagatcctgcagcagcaggcccagcagtaccaggccacccagccccagctgcagccccagaagcagcagcagcagcccccaccaccccagcagcagcagcagcagcaggccagcaagctgctgaagcaggagcagagcaacatcgtgtctgctgactgccagatcatgaaggatgtgcccagctacaaggaggccgaggacatcagcgagaagccagagaagcccaagcaggagttcatcagcgagggggagggcctgaaggagggcaaggacaccaagaagcagaagagcctggagcccagcatccccccaccccgcatcgccagcggggcccggggaaatgctgccaaggccctgctggagaactttggatttgagctggtgatccagtacaatgaaaatcggcagaaggtgcagaagaagggcaagtctggagaaggagaaaatacagacaagctggagtgtggcacctgtgggaagctgttcagcaatgtgctgatcctgaagagccaccaggagcacgtgcacggccagttcttcccctatgctgccctggagaagtttgcccggcagtaccgggaggcctatgacaagctgtaccccatcagccccagcagccctgagaccccacctcctcctcctcctcctccacccctgcccccagccccaccccagcccagctccatgggccctgtgaagatccccaacacagtgtccacccccctgcaggcccccccacccaccccacctcctcctcctcctcctcctcctcctcctcctcctcctcctcctcctcctccacccagcgccccaccccaggtgcagctgcctgtgtccctggacctgcccctcttccccagcatcatgatgcagcctgtgcagcacccagccctgcccccccagctggccctgcagctgccccagatggatgccctgtctgctgacctgacccagctgtgccagcagcagctgggcctggaccccaacttcctgcggcacagccagttcaagaggcccaggacccgcatcacagatgaccagctgaagatcctgcgggcctactttgacatcaacaacagccccagcgaggagcagatccaggagatggccgagaagagcggcctgagccagaaggtgatcaagcactggttcaggaacaccctcttcaaggagcggcagaggaacaaggacagcccctacaacttcagcaacccccccatcaccgtgctggaggacatcagaattgacccccagcccaccagcctggagcactacaagagtgatgccagcttcagcaagaggagcagcaggacccgcttcacagactaccagctgcgggtgctgcaggacttctttgacaccaatgcctaccccaaggatgatgaaattgagcagctgagcacagtgctgaacctgcccaccagggtcatcgtggtgtggttccagaatgcccggcagaaggccaggaagagctatgagaaccaggccgagaccaaggacaatgagaagcgggagctgaccaatgaaagatacatccgcaccagcaacatgcagtaccagtgcaagaagtgcaatgtggtgttcccccgcatctttgacctgatcacccaccagaagaagcagtgctacaaggatgaagatgatgatgcccaggatgagagccagacagaggacagcatggatgccacagaccaggtggtgtacaagcactgcaccgtgtctggccagacagatgctgccaagaatgctgctgccccagctgccagcagcggcagcggcaccagcacccccctcatccccagccccaagccagagcctgagaagaccagccccaagccagagtacccagctgagaagcccaagcagagcgaccccagcccccccagccagggcaccaagccagccctgcccctggccagcaccagcagtgaccccccccaggccagcacagcccagccccagccccagccccagccccccaagcagccccagctgattggccggccccccagcgccagccagacccctgtgcccagcagccccctgcagatctccatgaccagcctgcagaacagcctgcccccccagctgctgcagtaccagtgtgaccagtgcaccgtggccttccccaccctggagctgtggcaggagcaccagcacatgcacttcctggccgcccagaaccagttcctgcacagccccttcctggagcggcccatggacatgccctacatgatctttgaccccaacaaccccctgatgacaggccagctgctgggcagcagcctgacccagatgccaccccaggccagcagcagccacaccacagcccccaccaccgtggccgccagcctgaagaggaagctggatgacaaggaggacaacaactgcagcgagaaggagggcggcaacagcggggaggaccagcaccgggacaagaggctgcggaccaccatcaccccagagcagctggagatcctgtatgagaagtacctgctggacagcaaccccaccaggaagatgctggaccacatcgcccgggaggtgggcctgaagaagagggtggtgcaggtgtggttccagaacacccgggcccgggagaggaagggccagttccgggctgtgggccctgcccagagccacaagcgctgccccttctgccgggccctcttcaaggccaagagcgccctggagagccacatccgcagccgccactggaatgaaggcaagcaggccggctacagcctgccccccagccccctcatcagcacagaagatggaggagagagcccccagaagtacatctactttgactaccccagcctgcccctgaccaagattgacctgagcagtgaaaatgagctggccagcacagtgtccacccctgtgtccaagacagctgagctgagccccaagaacctgctgagccccagcagcttcaaggccgagtgcagtgaagatgtggagaacctgaatgcccctcctgctgaggccggctatgaccagaacaagacagactttgatgagaccagcagcatcaacacagccatcagtgatgccaccactggagatgagggcaacacagagatggagagcaccaccggcagcagtggagatgtgaagccagccctgagccccaaggagcccaagaccctggacaccctgcccaagccagccaccacccccaccacagaggtgtgtgatgacaagttcctgttcagcctgaccagccccagcatccacttcaatgacaaggatggagaccatgaccagagcttctacatcacagatgatcctgatgacaatgctgacagaagtgagaccagcagcattgctgaccccagcagccccaaccccttcggcagcagcaaccccttcaagagcaagagcaatgacaggcctggccacaagcgcttccgcacccagatgagcaacctgcagctgaaggtgctgaaggcctgcttcagtgactaccgcacccccaccatgcaggagtgtgagatgctgggcaatgagatcggcctgcccaagagggtggtgcaggtgtggttccagaatgcccgggccaaggagaagaagttcaagatcaacatcggcaagcccttcatgatcaaccagggcggcacagagggcaccaagccagagtgcaccctgtgtggggtgaagtacagcgcccggctgagcatccgggaccacatcttcagcaagcagcacatcagcaaggtgcgggagaccgtgggcagccagctggaccgggagaaggactacctggcccccaccaccgtgcggcagctgatggcccagcaggagctggaccgcatcaagaaggccagtgatgtgctgggcctgactgtgcagcagcccggcatgatggacagcagcagcctgcacggcatcagcctgcccacagcctacccaggcctgcccggcctgccccctgtgctgctgcccggcatgaatggccccagcagcctgcccggcttcccccagaacagcaacaccctgaccccacctggagctggcatgctgggcttccccaccagcgccaccagcagccctgccctgagcctgagcagcgcccccaccaagcccctgctgcagaccccacctcctcctcctcctcctcctcctcctccacccagcagcagcctgagcggccagcagacagagcagcagaacaaggagagcgagaagaagcagaccaagcccaacaaggtgaagaagatcaaggaggaggagctggaggccaccaagccagagaagcaccccaagaaggaggagaagatcagcagcgccctgtctgtgctgggcaaggtggtgggggagacccacgtggaccccatccagctgcaggccctgcagaatgccatcgccggggaccctgccagcttcatcggcggccagttcctgccctacttcatccctggctttgccagctacttcaccccccagctgcccggcaccgtgcagggcggctacttcccccctgtgtgtggcatggagagcctcttcccctacggccccaccatgccccagaccctggccggcctgagccctggggccctgctgcagcagtaccagcagtaccagcagaacctgcaggagagcctgcagaagcagcagaagcagcagcaggagcagcagcagaagcctgtgcaggccaagaccagcaaggtggagagtgaccagccccagaacagcaatgatgccagcgagaccaaggaggacaagagcacagccacagagagcaccaaggaggagccccagctggagagcaagtctgctgacttcagtgacacctacgtggtgccctttgtgaagtatgagttcatctgcaggaagtgccagatgatgttcacagatgaagatgctgctgtgaaccaccagaagagcttctgctacttcggccagcccctgattgacccccaggagaccgtgctgcgggtgcctgtgtccaagtaccagtgcctggcctgtgatgtggccatctctggaaatgaggccctgagccagcacctgcagagcagcctgcacaaggagaagaccatcaagcaggccatgagaaatgccaaggagcacgtgcggctgctgccccacagcgtgtgcagccccaaccccaacaccaccagcaccagccagagcgctgccagcagcaacaacacctacccccacctgagctgcttctccatgaagtcctggcccaacatcctcttccaggccagcgcccggcgggccgccagcccccccagcagcccccccagcctgagcctgcccagcacagtgaccagcagcctgtgcagcaccagcggcgtgcagaccagcctgcccacagagagctgcagtgatgaaagtgacagcgagctgagccagaagctggaggacctggacaacagcctggaggtgaaggccaagccagccagcggcctggatggcaacttcaacagcatccgcatggacatgttttctgtgtag

SEQ ID NO: 176433 - DNA, 468 bp, Artificial Sequence; identical to SEQ ID NO: 176431
  Description of Artificial Sequence: Synthetic coding sequence

SEQ ID NO: 176434 - DNA, 10851 bp, Artificial Sequence
  Description of Artificial Sequence: Synthetic coding sequence
atggagacctgtgacagcccccccatcagccggcaggagaatggccagagcaccagcaagctgtgtggcaccacccagctggacaatgaggtgcctgagaaggtggccggcatggagccagaccgggagaacagcagcacagatgacaacctgaagacagatgagaggaagtctgaggccctgctgggcttctctgtggagaatgctgctgccacccaggtgaccagcgccaaggagatcccctgcaatgaatgtgccaccagcttccccagcctgcagaagtacatggagcaccactgccccaatgcccggctgcctgtgctgaaggatgacaatgaaagtgagatcagcgagctggaggacagtgatgtggagaacctgaccggggagatcgtgtaccagccagatggcagcgcctacatcatcgaggacagcaaggagagcggccagaatgcccagacaggagccaacagcaagctgttcagcacagccatgttcctggacagcctggccagcgctggggagaagagtgaccagagcgccagcgcccccatgtccttctacccccagatcatcaacaccttccacatcgccagcagcctgggcaagcccttcaccgctgaccaggccttccccaacaccagcgccctggccggcgtgggccctgtgctgcacagcttccgggtgtatgacctgcggcacaagcgggagaaggactacctgaccagtgatggcagcgccaagaacagctgtgtgtccaaggatgtgcccaacaacgtggacctgagcaagtttgatggctgtgtgtctgatggcaagaggaagcctgtgctgatgtgcttcctgtgcaagctgagctttggctacatccgcagctttgtgacccatgctgtgcatgaccacaggatgaccctgaatgatgaggagcagaagctgctgagcaacaagtgtgtgtctgccatcatccagggcatcggcaaggacaaggagcccctcatctccttcctggagcccaagaagagcacctctgtgtacccccacttcagcaccaccaacctgattggccctgaccccaccttccggggcctgtggagcgccttccacgtggagaatggagacagcctgcctgctggctttgccttcctgaagggcagcgccagcaccagcagcagcgctgagcagcccctgggcatcacccagatgcccaaggccgaggtgaacctgggcggcctgagcagcctggtggtgaacacccccatcacctctgtgtccctgagccacagcagcagcgagagcagcaagatgtctgagagcaaggaccaggagaacaactgtgagcggcccaaggagagcaatgtgctgcaccccaatggagaatgtcctgtgaagtctgagcccacagagcctggagatgaagatgaagaagatgcctacagcaatgagctggatgatgaggaggtgctgggggagctgacagacagcatcggcaacaaggacttccccctgctgaaccagagcatcagccccctgagcagctctgtgctgaagttcatcgagaagggcaccagcagcagcagcgccaccgtgtctgatgacacagagaagaagaagcagacagctgctgtgcgggccagcggctctgtggccagcaactacggcatcagcggcaaggactttgctgatgccagcgccagcaaggacagcgccacagctgcccaccccagcgagatcgcccggggagatgaggacagcagcgccaccccccaccagcacggcttcacccccagcaccccaggcaccccaggccctggaggagatggcagccctggcagcggcatcgagtgccccaagtgtgacacagtgctgggcagcagccgcagcctgggcggccacatgaccatgatgcacagcaggaacagctgcaagaccctgaagtgccccaagtgcaactggcactacaagtaccagcagaccctggaggcccacatgaaggagaagcaccctgagcccggcggcagctgtgtgtactgcaagacaggccagccccacccccggctggcccggggggagagctacacctgtggctacaagcccttccgctgtgaggtgtgcaactacagcaccaccaccaagggcaacctgagcatccacatgcagagcgacaagcacctgaacaacgtgcagaacctgcagaatggaaatggagagcaggtgtttggccacagcgccccagcccccaacaccagcctgagcggctgcggcacccccagccccagcaagcccaagcagaagcccacctggaggtgtgaggtgtgtgactatgagaccaacgtggccaggaacctgcgcatccacatgaccagcgagaagcacatgcacaacatgatgctgctgcagcagaacatgaagcagatccagcacaacctgcacctgggcctggccccagctgaggccgagctgtaccagtactacctggcccagaacatcggcctgaccggcatgaagctggagaacccagctgacccccagctgatgatcaaccccttccagctggaccctgccacagctgctgccctggcccctggcctggtgaacaatgagctgcccccagagatccggctggccagcggccagctgatgggagatgacctgagcctgctgacagctggggagctgagcccctacatcagtgaccctgccctgaagctgttccagtgtgctgtgtgcaacaagttcaccagtgacagcctggaggccctgtctgtgcacgtgagcagcgagaggagcctgcctgaggaggagtggagggctgtgattggagacatctaccagtgcaagctgtgcaactacaacacccagctgaaggccaacttccagctgcactgcaagacagacaagcacatgcagaagtaccagctggtggcccacatcaaggagggcggcaagagcaatgagtggaggctgaagtgcatcgccatcggcaaccctgtgcacctgaagtgcaatgcctgtgactactacaccaacagcgtggacaagctgcggctgcacaccaccaaccacagacatgaagctgccctgaagctgtacaagcacctgcagaagcaggagggcgctgtgaaccctgagagctgctactactactgtgctgtgtgtgactacaccaccaaggtgaagctgaacctggtgcagcacgtgcgctctgtgaagcaccagcagacagagggcctgaggaagctgcagctgcaccagcagggcctggcccctgaggaggacaacctgtctgagatcttctttgtgaaggactgccccccaaatgagctggagacagccagcctgggcgcccggacctgtgatgatgacctgacagagcagcagctgcggagcaccagcgaggagcagagcgaggaggccgagggcgccatcaagcccacagctgtggctgaagatgatgagaaggacaccagcgagcgggacaacagcgagggcaagaacagcaacaaggacagcggcatcatcaccccagagaaggagctgaaggtgtctgtggccggcggcacccagcccctgctgctggccaaggaggaggatgtggccaccaagaggagcaagcccacagaggacaacaagttctgccacgagcagttctaccagtgcccctactgcaactacaacagccgggaccagagccgcatccagatgcacgtgctgagccagcacagcgtgcagcccgtcatctgctgccccctgtgccaggatgtgctgagcaacaagatgcacctgcagctgcacctgacccacctgcacagcgtgtccccagactgtgtggagaagctgctgatgacagtgcctgtgcctgatgtgatgatgcccaacagcatgctgctgcctgctgctgccagcgagaagtctgagcgggacaccccagctgctgtgacagctgagggcagcggcaagtacagcggggagagccccatggatgacaagtccatggccggcctggaggacagcaaggccaacgtggaggtgaagaatgaggagcagaagcccaccaaggagcccctggaggtgtctgagtggaacaagaacagcagcaaggatgtgaagatcccagacaccctgcaggaccagctgaatgagcagcagaagaggcagcccctgtctgtgtctgacagacatgtgtacaagtaccgctgcaaccactgcagcctggccttcaagaccatgcagaagctgcagatccacagccagtaccacgccatccgggccgccaccatgtgcaacctgtgccagaggagcttccgcaccttccaggccctgaagaagcacctggaggccggccaccctgagctgtctgaggccgagctgcagcagctgtatgccagcctgcctgtgaatggagagctgtgggccgagagcgagaccatgagccaggatgaccacggcctggagcaggagatggagcgggagtatgaggtggaccacgagggcaaggccagccctgtgggcagtgacagcagcagcatcccagatgacatgggcagcgagcccaagaggaccctgcccttcaggaagggccccaacttcaccatggagaagttcctggaccccagccggccctacaagtgcaccgtgtgcaaggagagcttcacccagaagaacatcctgctggtgcactacaacagcgtgagccacctgcacaagctgaagaaggtgctgcaggaggccagcagccctgtgccccaggagaccaacagcaacacagacaacaagccctacaagtgcagcatctgcaatgtggcctacagccagagcagcaccctggagatccacatgaggtctgtgctgcaccagaccaaggcccgggccgccaagctggagcccagcggccacgtggccggcggccacagcattgctgccaacgtgaacagccctggccagggcatgctggacagcatgagcctggccgctgtgaacagcaaggacacccacctggatgccaaggagctgaacaagaagcagaccccagacctgatcagcgcccagcctgcccaccaccccccccagagccctgcccagatccagatgcagctgcagcacgagctgcagcagcaggccgccttcttccagccccagttcctgaacccagccttcctgccccacttccccatgaccccagaggccctgctgcagttccagcagccccagttcctgttccccttctacatccctggaacagagttcagcctgggccctgacctgggcctgcccggcagcgccaccttcggcatgcctggcatgacaggcatggccggcagcctgctggaggacctgaagcagcagatccagacccagcaccacgtgggccagacccagctgcagatcctgcagcagcaggcccagcagtaccaggccacccagccccagctgcagccccagaagcagcagcagcagcccccaccaccccagcagcagcagcagcagcaggccagcaagctgctgaagcaggagcagagcaacatcgtgtctgctgactgccagatcatgaaggatgtgcccagctacaaggaggccgaggacatcagcgagaagccagagaagcccaagcaggagttcatcagcgagggggagggcctgaaggagggcaaggacaccaagaagcagaagagcctggagcccagcatccccccaccccgcatcgccagcggggcccggggaaatgctgccaaggccctgctggagaactttggatttgagctggtgatccagtacaatgaaaatcggcagaaggtgcagaagaagggcaagtctggagaaggagaaaatacagacaagctggagtgtggcacctgtgggaagctgttcagcaatgtgctgatcctgaagagccaccaggagcacgtgcacggccagttcttcccctatgctgccctggagaagtttgcccggcagtaccgggaggcctatgacaagctgtaccccatcagccccagcagccctgagaccccacctcctcctcctcctcctccacccctgcccccagccccaccccagcccagctccatgggccctgtgaagatccccaacacagtgtccacccccctgcaggcccccccacccaccccacctcctcctcctcctcctcctcctcctcctcctcctcctcctcctcctcctccacccagcgccccaccccaggtgcagctgcctgtgtccctggacctgcccctcttccccagcatcatgatgcagcctgtgcagcacccagccctgcccccccagctggccctgcagctgccccagatggatgccctgtctgctgacctgacccagctgtgccagcagcagctgggcctggaccccaacttcctgcggcacagccagttcaagaggcccaggacccgcatcacagatgaccagctgaagatcctgcgggcctactttgacatcaacaacagccccagcgaggagcagatccaggagatggccgagaagagcggcctgagccagaaggtgatcaagcactggttcaggaacaccctcttcaaggagcggcagaggaacaaggacagcccctacaacttcagcaacccccccatcaccgtgctggaggacatcagaattgacccccagcccaccagcctggagcactacaagagtgatgccagcttcagcaagaggagcagcaggacccgcttcacagactaccagctgcgggtgctgcaggacttctttgacaccaatgcctaccccaaggatgatgaaattgagcagctgagcacagtgctgaacctgcccaccagggtcatcgtggtgtggttccagaatgcccggcagaaggccaggaagagctatgagaaccaggccgagaccaaggacaatgagaagcgggagctgaccaatgaaagatacatccgcaccagcaacatgcagtaccagtgcaagaagtgcaatgtggtgttcccccgcatctttgacctgatcacccaccagaagaagcagtgctacaaggatgaagatgatgatgcccaggatgagagccagacagaggacagcatggatgccacagaccaggtggtgtacaagcactgcaccgtgtctggccagacagatgctgccaagaatgctgctgccccagctgccagcagcggcagcggcaccagcacccccctcatccccagccccaagccagagcctgagaagaccagccccaagccagagtacccagctgagaagcccaagcagagcgaccccagcccccccagccagggcaccaagccagccctgcccctggccagcaccagcagtgaccccccccaggccagcacagcccagccccagccccagccccagccccccaagcagccccagctgattggccggccccccagcgccagccagacccctgtgcccagcagccccctgcagatctccatgaccagcctgcagaacagcctgcccccccagctgctgcagtaccagtgtgaccagtgcaccgtggccttccccaccctggagctgtggcaggagcaccagcacatgcacttcctggccgcccagaaccagttcctgcacagccccttcctggagcggcccatggacatgccctacatgatctttgaccccaacaaccccctgatgacaggccagctgctgggcagcagcctgacccagatgccaccccaggccagcagcagccacaccacagcccccaccaccgtggccgccagcctgaagaggaagctggatgacaaggaggacaacaactgcagcgagaaggagggcggcaacagcggggaggaccagcaccgggacaagaggctgcggaccaccatcaccccagagcagctggagatcctgtatgagaagtacctgctggacagcaaccccaccaggaagatgctggaccacatcgcccgggaggtgggcctgaagaagagggtggtgcaggtgtggttccagaacacccgggcccgggagaggaagggccagttccgggctgtgggccctgcccagagccacaagcgctgccccttctgccgggccctcttcaaggccaagagcgccctggagagccacatccgcagccgccactggaatgaaggcaagcaggccggctacagcctgccccccagccccctcatcagcacagaagatggaggagagagcccccagaagtacatctactttgactaccccagcctgcccctgaccaagattgacctgagcagtgaaaatgagctggccagcacagtgtccacccctgtgtccaagacagctgagctgagccccaagaacctgctgagccccagcagcttcaaggccgagtgcagtgaagatgtggagaacctgaatgcccctcctgctgaggccggctatgaccagaacaagacagactttgatgagaccagcagcatcaacacagccatcagtgatgccaccactggagatgagggcaacacagagatggagagcaccaccggcagcagtggagatgtgaagccagccctgagccccaaggagcccaagaccctggacaccctgcccaagccagccaccacccccaccacagaggtgtgtgatgacaagttcctgttcagcctgaccagccccagcatccacttcaatgacaaggatggagaccatgaccagagcttctacatcacagatgatcctgatgacaatgctgacagaagtgagaccagcagcattgctgaccccagcagccccaaccccttcggcagcagcaaccccttcaagagcaagagcaatgacaggcctggccacaagcgcttccgcacccagatgagcaacctgcagctgaaggtgctgaaggcctgcttcagtgactaccgcacccccaccatgcaggagtgtgagatgctgggcaatgagatcggcctgcccaagagggtggtgcaggtgtggttccagaatgcccgggccaaggagaagaagttcaagatcaacatcggcaagcccttcatgatcaaccagggcggcacagagggcaccaagccagagtgcaccctgtgtggggtgaagtacagcgcccggctgagcatccgggaccacatcttcagcaagcagcacatcagcaaggtgcgggagaccgtgggcagccagctggaccgggagaaggactacctggcccccaccaccgtgcggcagctgatggcccagcaggagctggaccgcatcaagaaggccagtgatgtgctgggcctgactgtgcagcagcccggcatgatggacagcagcagcctgcacggcatcagcctgcccacagcctacccaggcctgcccggcctgccccctgtgctgctgcccggcatgaatggccccagcagcctgcccggcttcccccagaacagcaacaccctgaccccacctggagctggcatgctgggcttccccaccagcgccaccagcagccctgccctgagcctgagcagcgcccccaccaagcccctgctgcagaccccacctcctcctcctcctcctcctcctcctccacccagcagcagcctgagcggccagcagacagagcagcagaacaaggagagcgagaagaagcagaccaagcccaacaaggtgaagaagatcaaggaggaggagctggaggccaccaagccagagaagcaccccaagaaggaggagaagatcagcagcgccctgtctgtgctgggcaaggtggtgggggagacccacgtggaccccatccagctgcaggccctgcagaatgccatcgccggggaccctgccagcttcatcggcggccagttcctgccctacttcatccctggctttgccagctacttcaccccccagctgcccggcaccgtgcagggcggctacttcccccctgtgtgtggcatggagagcctcttcccctacggccccaccatgccccagaccctggccggcctgagccctggggccctgctgcagcagtaccagcagtaccagcagaacctgcaggagagcctgcagaagcagcagaagcagcagcaggagcagcagcagaagcctgtgcaggccaagaccagcaaggtggagagtgaccagccccagaacagcaatgatgccagcgagaccaaggaggacaagagcacagccacagagagcaccaaggaggagccccagctggagagcaagtctgctgacttcagtgacacctacgtggtgccctttgtgaagtatgagttcatctgcaggaagtgccagatgatgttcacagatgaagatgctgctgtgaaccaccagaagagcttctgctacttcggccagcccctgattgacccccaggagaccgtgctgcgggtgcctgtgtccaagtaccagtgcctggcctgtgatgtggccatctctggaaatgaggccctgagccagcacctgcagagcagcctgcacaaggagaagaccatcaagcaggccatgagaaatgccaaggagcacgtgcggctgctgccccacagcgtgtgcagccccaaccccaacaccaccagcaccagccagagcgctgccagcagcaacaacacctacccccacctgagctgcttctccatgaagtcctggcccaacatcctcttccaggccagcgcccggcgggccgccagcccccccagcagcccccccagcctgagcctgcccagcacagtgaccagcagcctgtgcagcaccagcggcgtgcagaccagcctgcccacagagagctgcagtgatgaaagtgacagcgagctgagccagaagctggaggacctggacaacagcctggaggtgaaggccaagccagccagcggcctggatggcaacttcaacagcatccgcatggacatgttttctgtgtag

SEQ ID NO: 176435 - DNA, 423 bp, Artificial Sequence
  Description of Artificial Sequence: Synthetic coding sequence
atggagacctgtgacagcccccccatcagccggcaggagaatggccagagcaccagcaagctgtgtggcaccacccagctggacaatgaggtgcctgagaaggtggccggcatggagccagaccgggagaacagcagcacagatgacaacctgaagacagatgagaggaagtctgaggccctgctgggcttctctgtggagaatgctgctgccacccaggtgaccagcgccaaggagatcccctgcaatgaatgtgccaccagcttccccagcctgcagaagtacatggagcaccactgccccaatgcccggctgcctgtgctgaaggatgacaatgaaagtgagatcagcgagctggaggacagtgatgtggagaacctgaccggggagatcgtgtaccagccagatggcagcgcctactag

SEQ ID NO: 176436 - DNA, 306 bp, Artificial Sequence
  Description of Artificial Sequence: Synthetic coding sequence
atggagacctgtgacagcccccccatcagccggcaggagaatggccagagcaccagcaagctgtgtggcaccacccagctggacaatgaggtgcctgagaaggtggccggcatggagccagaccgggagaacagcagcacagatgacaacctgaagacagatgagaggaagtctgaggccctgctgggcttctctgtggagaatgctgctgccacccaggtgaccagcgccaaggagatcccctgcaatgaatgtgccaccagcttccccagcctgcagaagtacatggagcaccactgcccctag

SEQ ID NO: 176437 - DNA, 2253 bp, Artificial Sequence
  Description of Artificial Sequence: Synthetic coding sequence
atggagtttgtgtctggctacagagatgagttcctggacttcaccgccctgctgtttggctggttcaggaagtttgtggccgagagaggagctgtgggcaccagcctggagggccgctgccggcagctggaggcccagatccggcggctgccccaggaccctgccctgtgggtgctgcacgtgctgcccaaccacagcgtgggcatcagcctgggccagggcgctgagcccggccctggccctggcctgggcacagcctggctgctgggggacaacccccccctgcacctgcgggacctgagcccctacatcagctttgtgtccctggaggatggagaggagggggaggaggaggaggaggaggatgaggaggaggagaagagagaagatggaggagctggcagcacagagaaggtggagccagaagaagatcgggagctggcccccaccagccgggagagcccccaggagaccaaccccccaggagagagcgaggaggccgcccgggaggccggcggcggcaaggatggctgccgggaggacagagtggagaatgagacccggccccagaagaggaagggccagaggtctgaggccgcccccctgcacgtgtcctgcctgctgctggtgacagatgagcacggcaccatcctgggcatcgacctgctggtggatggagcccagggcacagcctcctggggcagcggcaccaaggacctggccccctgggcctatgccctgctgtgccacagcatggcctgccccatgggcagcggggaccccaggaagccccggcagctgactgtgggagatgcccggctgcaccgggagctggagagcctggtgccccggctgggcgtgaagctggccaagacccccatgaggacctggggccccaggcctggcttcacctttgccagcctgcgggcccggacctgccacgtgtgccaccgccacagctttgaggccaagctgaccccctgcccccagtgcagcgctgtgctgtactgtggggaggcctgcctgcgggctgactggcagcgctgcccagatgatgtgagccaccgcttctggtgcccccggctggccgccttcatggagagagctggggagctggccaccctgcccttcacctacacagctgaggtgaccagcgagaccttcaacaaggaggccttcctggccagccggggcctgacccggggctactggacccagctgtccatgctgatccctggccctggcttcagccgccacccccggggcaacacccccagcctgagcctgctgcggggcggggacccctaccagctgctgcagggagatggaacagccctgatgcctcctgtgcccccccaccccccccggggcgtgtttggctcctggcaggactactacacctggaggggcctgagcctggacagccccatcgctgtgctgctgacctaccccctgactgtgtactacgtgatcacccacctggtgccccagagcttccctgagctgaacatccagaacaagcagagcctgaagatccacgtggtggaggccggcaaggagtttgacctggtgatggtgttctgggagctgctggtgctgctgccccacgtggccctggagctgcagtttgtgggagatggcctgcccccagagagtgatgagcagcacttcaccctgcagagggacagcctggaggtgtctgtgcggcccggcagcggcatcagcgcccggcccagcagcggcaccaaggagaagggcggccggcgggacctgcagatcaaggtgtctgcccggccctaccacctgttccagggccccaagccagacctggtgattgccagccccagcagcctgtctgctggcttcaacagcggctttgccctgaaggacacctggctgcggagcctgccccggctgcagagcctgcgggtgcctgccttcttcacagagagcagcgagtacagctgtgtgatggatggccagaccatggctgtggccactggaggcggcaccagccccccccagcccaaccccttccgcagccccttccggctgcgggctgctgacaactgcatgtcctggtactgcaatgccttcatcttccacctggtgtacaagccagcccagggcagcggggcccggcctgcccctggccccccaccacccagccccaccccatctgcccccccagcccccaccaggagaagaagaggagagaagaagccaggccgcggggcccggcggaggaagtag

SEQ ID NO: 176438 - DNA, 2112 bp, Artificial Sequence
  Description of Artificial Sequence: Synthetic coding sequence
atggagtttgtgtctggctacagagatgagttcctggacttcaccgccctgctgtttggctggttcaggaagtttgtggccgagagaggagctgtgggcaccagcctggagggccgctgccggcagctggaggcccagatccggcggctgccccaggaccctgccctgtgggtgctgcacgtgctgcccaaccacagcgtgggcatcagcctgggccagggcgctgagcccggccctggccctggcctgggcacagcctggctgctgggggacaacccccccctgcacctgcgggacctgagcccctacatcagctttgtgtccctggaggatggagaggagggggaggaggaggaggaggaggatgaggaggaggagaagagagaagatggaggagctggcagcacagagaaggtggagccagaagaagatcgggagctggcccccaccagccgggagagcccccaggagaccaaccccccaggagagagcgaggaggccgcccgggaggccggcggcggcaaggatggctgccgggaggacagagtggagaatgagacccggccccagaagaggaagggccagaggtctgaggccgcccccctgcacgtgtcctgcctgctgctggtgacagatgagcacggcaccatcctgggcatcgacctgctggtggatggagcccagggcacagcctcctggggcagcggcaccaaggacctggccccctgggcctatgccctgctgtgccacagcatggcctgccccatgggcagcggggaccccaggaagccccggcagctgactgtgggagatgcccggctgcaccgggagctggagagcctggtgccccggctgggcgtgaagctggccaagacccccatgaggacctggggccccaggcctggcttcacctttgccagcctgcgggcccggacctgccacgtgtgccaccgccacagctttgaggccaagctgaccccctgcccccagtgcagcgctgtgctgtactgtggggaggcctgcctgcgggctgactggcagcgctgcccagatgatgtgagccaccgcttctggtgcccccggctggccgccttcatggagagagctggggagctggccaccctgcccttcacctacacagctgaggtgaccagcgagaccttcaacaaggaggccttcctggccagccggggcctgacccggggctactggacccagctgtccatgctgatccctggccctggcttcagccgccacccccggggcaacacccccagcctgagcctgctgcggggcggggacccctaccagctgctgcagggagatggaacagccctgatgcctcctgtgcccccccaccccccccggggcgtgtttgtgcctgagctgaacatccagaacaagcagagcctgaagatccacgtggtggaggccggcaaggagtttgacctggtgatggtgttctgggagctgctggtgctgctgccccacgtggccctggagctgcagtttgtgggagatggcctgcccccagagagtgatgagcagcacttcaccctgcagagggacagcctggaggtgtctgtgcggcccggcagcggcatcagcgcccggcccagcagcggcaccaaggagaagggcggcagaagagacctgcagatcaaggtgtctgcccggccctaccacctgttccagggccccaagccagacctggtgattggcttcaacagcggctttgccctgaaggacacctggctgcggagcctgccccggctgcagagcctgcgggtgcctgccttcttcacagagagcagcgagtacagctgtgtgatggatggccagaccatggctgtggccaccggcggcggcaccagccccccccagcccaaccccttccgcagccccttccggctgcgggctgctgacaactgcatgtcctggtactgcaatgccttcatcttccacctggtgtacaagccagcccagggcagcggggcccggcctgcccctggccccccaccacccagccccacccccagcgcccccccagcccccaccaggagaagaagaggagagaagaagccaggccgcggggcccggcggaggaagtag

SEQ ID NO: 176439 - DNA, 1722 bp, Artificial Sequence
  Description of Artificial Sequence: Synthetic coding sequence
atggatgccaagagcctgacagcctggagcaggaccctggtgaccttcaaggatgtgtttgtggacttcacccgggaggagtggaagctgctggacacagcccagcagatcgtgtacagaaatgtgatgctggagaactacaagaacctggtgtccctgggctaccagctgaccaagccagatgtgatcctgcggctggagaagggggaggagccctggctggtggagcgggagatccaccaggagacccacccagattctgaaacagcctttgagatcaagagctctgtgagcagccgcagcatcttcaaggacaagcagagctgtgacatcaagatggagggcatggccagaaatgacctgtggtacctgagcctggaggaggtgtggaagtgccgggaccagctggacaagtaccaggagaaccctgagcggcacctgcggcaggtggccttcacccagaagaaggtgctgacccaggagcgggtgtctgagagcggcaagtatggaggcaactgcctgctgcctgcccagctggtgctgcgggagtacttccacaagagggacagccacaccaagagcctgaagcatgacctggtgctgaatggccaccaggacagctgtgccagcaacagcaatgaatgtggccagaccttctgccagaacatccacctgatccagtttgcccggacccacactggagacaagagctacaagtgcccagacaatgacaacagcctgacccacggcagcagcctgggcatcagcaagggcatccaccgggagaagccctatgagtgcaaggaatgtgggaagttcttctcctggaggagcaacctgaccaggcaccagctgatccacactggagagaagccctatgagtgcaaggaatgtgggaagagcttcagccgcagcagccacctgattggccaccagaagacccacactggagaggagccctatgagtgcaaggaatgtgggaagagcttctcctggttcagccacctggtgacccaccagaggacccacactggagacaagctgtacacctgcaaccagtgtgggaagagctttgtgcacagcagccgcctcatccgccaccagaggacccacactggagagaagccctatgagtgcccagaatgtgggaagagcttccggcagagcacccacctgatcctgcaccagaggacccacgtgcgggtgcggccctatgagtgcaatgaatgtgggaagagctacagccagaggagccacctggtggtgcaccaccgcatccacacaggcctgaagccctttgagtgcaaggactgtgggaagtgcttcagccgcagcagccacctgtacagccaccagaggacccacactggagagaagccctatgagtgccacgactgtgggaagagcttcagccagagcagcgccctgattgtgcaccagaggatccacactggagagaagccctatgagtgctgccagtgtgggaaggccttcatcaggaagaatgacctgatcaagcaccagagaattcatgtgggggaggagacctacaagtgcaaccagtgtggcatcatcttcagccagaacagccccttcatcgtgcaccagatcgcccacactggagagcagttcctgacctgcaaccagtgtggcacagccctggtgaacaccagcaacctgattggctaccagaccaaccacatccgggagaatgcctactag

SEQ ID NO: 176440 - DNA, 1722 bp, Artificial Sequence; identical to SEQ ID NO: 176439
  Description of Artificial Sequence: Synthetic coding sequence

SEQ ID NO: 176441 - DNA, 219 bp, Artificial Sequence
  Description of Artificial Sequence: Synthetic coding sequence
atggatgccaagagcctgacagcctggagcaggaccctggtgaccttcaaggatgtgtttgtggacttcacccgggaggagtggaagctgctggacacagcccagcagatcgtgtacagaaatgtgatgctggagaactacaagaacctggtgtccctgggctaccagctgaccaagccagatgtgatcctgcggctggagaagggggaggagccctag

SEQ ID NO: 176442 - DNA, 132 bp, Artificial Sequence
  Description of Artificial Sequence: Synthetic coding sequence
atggatgccaagagcctgacagcctggagcaggaccctggtgaccttcaaggatgtgtttgtggacttcacccgggaggagtggaagctgctggacacagcccagcagatcgtgtacagaaatgtgatgtag

SEQ ID NO: 176443 - DNA, 144 bp, Artificial Sequence
  Description of Artificial Sequence: Synthetic coding sequence
atggatgccaagagcctgacagcctggagcaggaccctggtgaccttcaaggatgtgtttgtggacttcacccgggaggagtggaagctgctggacacagcccagcagatcgtgtacagaaatgtgatgctggagaactactag

SEQ ID NO: 176444 - DNA, 1629 bp, Artificial Sequence
  Description of Artificial Sequence: Synthetic coding sequence
atggatgaccccaggtatggcatgtgccccctgaagggggccagcggctgccctggagctgagaggagcctgctggtgcagagctactttgagaagggccccctgaccttcagagatgtggccatcgagttcagcctggaggagtggcagtgcctggacagcgcccagcagggcctgtacaggaaggtgatgctggagaactacagaaacctggtgttcctggccggcatcgccctgaccaagccagacctgatcacctgcctggagcagggcaaggagccctggaacatcaagagacatgagatggtggccaagccccctgtgatctgcagccacttcccccaggacctgtgggccgagcaggacatcaaggacagcttccaggaggccatcctgaagaagtatggcaagtatggccatgacaacctgcagctgcagaagggctgcaagtctgtggatgagtgcaaggtgcacaaggagcatgacaacaagctgaaccagtgcctgatcaccacccagagcaacatcttccagtgtgaccccagcgccaaggtgttccacaccttcagcaacagcaacagacacaagatccgccacaccaggaagaagcccttcaagtgcaagaagtgtgagaagagcttctgcatgctgctgcacctgacccagcacaagcgcttccacatcacagagaacagctaccagtgcaaggactgtgggaaggccttcaactggttcagcaccctgaccacccaccggcgcatccacactggagagaagccctacaagtgtgaagaatgtgggaaggccttcaacagaagcagccacctgaccacccacaagatcatccacactggagagaagccctaccgctgtgaagaatgtgggaaggccttcaacagaagcagccacctgaccacccacaagaggatccacactggagtgaagccctacaagtgcacagaatgtgggaaggccttcaacagaagcagccacctgaccacccaccgcatcatccacactggagagaagccctacaagtgtgaagaatgtgggaaggccttcaaccagagcagcaccctgaccacccacaagatcacccacgccggggagaagccctacaagtgtgaagaatgtgggaaggccttctaccgcttctcctacctgaccaagcacaagaccagccacactggagagaagttctacaagtgtgaagaatgtgggaagggcttcaactggagcagcgccctgaccaagcacaagaggatccacactggagagaagccctacaagtgtgaagaatgtgggaaggccttcaatgaaagcagcaacctgaccacccacaagatgatccacactggagagaagccctacaagtgtgatgaatgtgggaaggccttcaacagaagcagccagctgacagcccacaagatgatccacactggagagaagccctacaagtgtgaagaatgtgggaaggccttcaacagaagcagcaccctgaccaagcacaagatcacccacactggagagaagagctacaagtgggaggagtgtgggaaggacttcaaccagagcctgagcctcatcaagcagaacaacagctactggagggagaccctgcagatgtag

SEQ ID NO: 176445 - DNA, 1311 bp, Artificial Sequence
  Description of Artificial Sequence: Synthetic coding sequence
atggattctgtggcctttgaagatgtggccgtgaacttcacccaggaggagtgggccctgctgagccccagccagaagaacctgtacagagatgtgaccctggagaccttcaggaacctggcctctgtgggcatccagtggaaggaccaggacattgaaaatctctaccagaacctgggcatcaagctgcggagcctggtggagcggctgtgtggcaggaaggagggcaatgagcaccgggagaccttcagccagatcccagactgccacctgaacaagaagagccagacaggagtgaagccctgcaagtgcagcgtgtgtgggaaggtgttcctgcggcacagcttcctggacagacacatgagggcccatgctggccacaagagaagtgaatgtggcggggagtggagggagacccccaggaagcagaagcagcacggcaaggccagcatcagccccagcagcggggcccggaggacagtgacccccaccaggaagaggccctatgagtgcaaggtgtgtgggaaggccttcaacagccccaacctcttccagatccaccagaggacccacacaggcaagaggagctacaagtgccgggagatcgtgcgggccttcaccgtgagcagcttcttcaggaagcacggcaagatgcacactggagagaagagatatgagtgcaagtactgtgggaagcccatcgactaccccagcctcttccagatccacgtgaggacccacactggagagaagccctacaagtgcaagcagtgtgggaaggccttcatctctgctggctacctgcggacccatgagatccgcagccacgccctggagaagagccaccagtgccaggagtgtgggaagaagctgagctgcagcagcagcctgcacagacatgagaggacccacagcggcggcaagctgtatgagtgccagaagtgtgccaaggtgttccgctgccccaccagcctgcaggcccacgagcgggcccacactggagagcggccctatgagtgcaacaagtgtgggaagaccttcaactaccccagctgcttccgccgccacaagaagacccacagcggggagaagccctatgaatgtacccgctgtgggaaggccttcggctggtgcagcagcctgcggagacatgagatgacccacactggagagaagccctttgactgcaagcagtgtgggaaggtgttcaccttcagcaactacctgcggctgcacgagaggacccacctggccggccgcagccagtgcttcggccggcggcagggcgaccacctgagccctggggtgtag

SEQ ID NO: 176446 - DNA, 1311 bp, Artificial Sequence; identical to SEQ ID NO: 176445
  Description of Artificial Sequence: Synthetic coding sequence

SEQ ID NO: 176447 - DNA, 951 bp, Artificial Sequence
  Description of Artificial Sequence: Synthetic coding sequence
atgagggcccatgctggccacaagagaagtgaatgtggcggggagtggagggagacccccaggaagcagaagcagcacggcaaggccagcatcagccccagcagcggggcccggaggacagtgacccccaccaggaagaggccctatgagtgcaaggtgtgtgggaaggccttcaacagccccaacctcttccagatccaccagaggacccacacaggcaagaggagctacaagtgccgggagatcgtgcgggccttcaccgtgagcagcttcttcaggaagcacggcaagatgcacactggagagaagagatatgagtgcaagtactgtgggaagcccatcgactaccccagcctcttccagatccacgtgaggacccacactggagagaagccctacaagtgcaagcagtgtgggaaggccttcatctctgctggctacctgcggacccatgagatccgcagccacgccctggagaagagccaccagtgccaggagtgtgggaagaagctgagctgcagcagcagcctgcacagacatgagaggacccacagcggcggcaagctgtatgagtgccagaagtgtgccaaggtgttccgctgccccaccagcctgcaggcccacgagcgggcccacactggagagcggccctatgagtgcaacaagtgtgggaagaccttcaactaccccagctgcttccgccgccacaagaagacccacagcggggagaagccctatgaatgtacccgctgtgggaaggccttcggctggtgcagcagcctgcggagacatgagatgacccacactggagagaagccctttgactgcaagcagtgtgggaaggtgttcaccttcagcaactacctgcggctgcacgagaggacccacctggccggccgcagccagtgcttcggccggcggcagggcgaccacctgagccctggggtgtag

SEQ ID NO: 176448 - DNA, 1311 bp, Artificial Sequence; identical to SEQ ID NO: 176445
  Description of Artificial Sequence: Synthetic coding sequence

SEQ ID NO: 176449 - DNA, 2352 bp, Artificial Sequence
  Description of Artificial Sequence: Synthetic coding sequence
atggtggccaagccccctgtgatgtccttccactttgcccaggacctgtggccagagcagaacatcaaggacagcttccagaaggtgaccctgcggcgctatggaaaatgtgaatatgagaacctgcagctgaggaagggctgcaagcacgtggatgaatgtacaggccacaagggcggccacaacacagtgaaccagtgcctgacagccacccccagcaagatcttccagtgcaacaagtatgtgaaggtgtttgacaagttcagcaacagcaaccgctacaagaggaggcacactggaaacaagcacttcaagtgcaaggagtgcagcaagagcttctgtgtgctgagccagctgacccagcaccggcgcatccacaccagggtgaacagctacaagtgtgaggagtgtgggaaggccttcaactggttcagcaccctgaccaagcacaagaggatccacactggagagaagccctacaagtgtgaggagtgtgggaaggccttcaaccagagcagccagctgaccaggcacaagatcatccacacagaggagaagcccaacaagtgtgaggagtgtgggaaggccttcaagcaggccagccacctgaccatccacaagatcatccacactggagagaagccctacaagtatgaggagtgtgggaaggtgttcagccagagcagccacctgaccacccagaagatcctgcacactggagaaaatctctacaagtgcaaggaatgtgggaaggccttcaacctcttcagcaacctgaccaaccacaagagaattcatgctggggagaagccctacaagtgcaaggaatgtggccgggccttcaacatcagcagcaacctgaacaagcaggagaagatccacactggaggcaagctgaacaagtgtgaggagtgtgacaaggccttcaacagaagcctgaagctgacagcccacaagaagatcctgatggaggagaagccctacaagtgtgaggagtgtgggaaggtgttcaaccagttcagcaccctgaccaggcacaagatcatccacactggagagaagccctacaagtgcaaggaatgtgggaaggccttcaaccagagcagcaacctgacagagcacaagaagatccacacagctgagaagagctacaagtgtgaggagtgtgggaaggccttcaaccagcacagcaacctgatcaaccacaggaagatctacagcggggagaagccctacaagtgtgaggagtgtgggaaggccttcaacagaagcagcaccctgaccaggcacaagaagatccacactggagagaagccctacaagtgtgaggagtgtgaccgggccttcagccagagcagcaacctgacagagcacaagaagatccacactggagagaagccctacaagtgtgaggagtgtgggaaggccttcaaccgcttcagcaccctgaccaagcacaagaggatccacactggagagaagccctacaagtgtgaggagtgtgggaaggccttcaaccagagctaccagctgaccaggcacaagatcgtgcacaccaaggagaagctgaacaagtgtgaggagtttgggaaggccttcaagcagagcagccacaggaccatccacaagatcatccacactggagagaagccctacaagtgtgaggagcacggcaaggtgttcaaccagagcagcaacctgaccacccagaagatcatccacactggagaaaatctctacaagtttgaggagcacggcaaggccttcaacctcttcagcaacatcaccaaccacaagatcatctacacaggagagaagccccacaagtgtgaggagtgtgggaaggcctacaaccgcttcagcaacctgaccatccacaagaggatccacactggagagaagccctaccagtgtgccgagtgtgggaaggccttcaactgcagcagcaccctgaacagacacaagatcatccacactggagagaagccctacaagtgcaaggaatgtgggaaggccttcaacctgagcagcaccctgacagcccacaagaagatccacactggagagaagccctacaagtgtgaggagtgtgggaaggccttcaaccagagcagcaacctgaccacccacaagaagatccacaccagcgagaagccctacaagtgtgaggagtgtgggaagagcttcaaccagttcagcagcctgaacatccacaagatcatccacactggagagaagccctacaagtgtggggactatggccgggccttcaacctgagcagcaacctgaccacccacaagaagatccacactggagagaagccctacaagtgtgaatatggcaagacctag

SEQ ID NO: 176450 - DNA, 276 bp, Artificial Sequence
  Description of Artificial Sequence: Synthetic coding sequence
atggtggccaagccccctgtgatgtccttccactttgcccaggacctgtggccagagcagaacatcaaggacagcttccagaaggtgaccctgcggcgctatggaaaatgtgaatatgagaacctgcagctgaggaagggctgcaagcacgtggatgaatgtacaggccacaagggcggccacaacacagtgaaccagtgcctgacagccacccccagcaagatcttccagtgcaacaagtatgtgaaggtgtttgacaagttcagcaacagctag

SEQ ID NO: 176451 - DNA, 2352 bp, Artificial Sequence; identical to SEQ ID NO: 176449
  Description of Artificial Sequence: Synthetic coding sequence

SEQ ID NO: 176452 - DNA, 2352 bp, Artificial Sequence; identical to SEQ ID NO: 176449
  Description of Artificial Sequence: Synthetic coding sequence

SEQ ID NO: 176453 - DNA, 453 bp, Artificial Sequence
  Description of Artificial Sequence: Synthetic coding sequence
atggtggccaagccccctgtgatgtccttccactttgcccaggacctgtggccagagcagaacatcaaggacagcttccagaaggtgaccctgcggcgctatggaaaatgtgaatatgagaacctgcagctgaggaagggctgcaagcacgtggatgaatgtacaggccacaagggcggccacaacacagtgaaccagtgcctgacagccacccccagcaagatcttccagtgcaacaagtatgtgaaggtgtttgacaagttcagcaacagcaaccgctacaagaggaggcacactggaaacaagcacttcaagtgcaaggagtgcagcaagagcttctgtgtgctgagccagctgacccagcaccggcgcatccacaccagggtgaacagctacaagtgtgaggagtgtgggaaggccatcatcatctgcagcgacttcacccagcactag

SEQ ID NO: 176454 - DNA, 1254 bp, Artificial Sequence
  Description of Artificial Sequence: Synthetic coding sequence
atgagccaggacagcgtgacctttgctgatgtggccgtgaacttcaccaaggaggagtggaccctgctggaccctgcccagaggaacctgtacagagatgtgatgctggagaacagcaggaacctggccttcatcgactgggccaccccctgcaagaccaaggatgccaccccccagcctgacatcctgcccaagaggaccttccctgaggccaacagagtgtgcctgaccagcatcagcagccagcacagcaccctgcgggaggactggcgctgccccaagacagaggagccccaccggcagggcgtgaacaacgtgaagcccccagctgtggcccctgagaaggatgagagccctgtgtccatctgtgaggaccacgagatgaggaaccacagcaagcccacctgccgcctggtgcccagccagggcgacagcatccggcagtgcatcctgacccgggacagcagcatcttcaagtacaaccctgtgctgaatgacagccagaagacccatgagaacaatgaagatgatggagtgctgggctggaacatccagtgggtgccctgtggcaggaagacagagctgaagagcagcacctggacaggcagccagaacacagtgcaccacatcagagatgaaattgacaccggggccaacagacaccagaggaacccctttgggaaggccttccgggaggatggcagcctgcgggcccacaacacccacggccgggagaagatgtatgacttcacccagtgtgagaacaccagcaggaacaacagcatccacgccatgcagatgcagctgtacacagctgagaccaacaagaaggactgccagacaggagccaccagcgccaatgcccccaacagcggcagccacaagagccactgcacaggagagaagacccacaagtgcccagaatgtggccgggccttcttctaccagagcttcctgatgaggcacatgaagatccacactggagagaagccctatgaatgtgggaaatgtgggaaggccttccgctacagcctgcacctgaacaagcacctgaggaagcacgtggtgcagaagaagccctatgaatgtgaagaatgtgggaaggtgatccgggagagcagcaagtacacccacatccgcagccacactggagagaagccctacaagtgcaagacctgtgggaaggactttgccaagagcagcggcctgaagaagcacctgaagacccacaaggatgagaagccctgtgagtag

SEQ ID NO: 176455 - DNA, 1254 bp, Artificial Sequence; identical to SEQ ID NO: 176454
  Description of Artificial Sequence: Synthetic coding sequence

SEQ ID NO: 176456 - DNA, 1452 bp, Artificial Sequence
  Description of Artificial Sequence: Synthetic coding sequence
atgaagagacatgagatggtggccaagcacctggtgatgttctactactttgcccagcacctgtggccagagcagaacatccgggacagcttccagaaggtgaccctgcggcgctacagaaaatgtggctatgagaacctgcagctgaggaagggctgcaagtctgtggtggagtgcaagcagcacaagggggactacagcggcctgaaccagtgcctgaagaccaccctgagcaagatcttccagtgcaacaagtatgtggaggtgttccacaagatcagcaacagcaacagacacaagatgaggcacacagagaacaagcacttcaagtgcaaggaatgtaggaagaccttctgcatgctgagccacctgacccagcacaagaggatccagaccagggtgaacttctacaagtgtgaggcctacggccgggccttcaactggagcagcaccctgaacaagcacaagaggatccacactggagagaagccctacaagtgcaaggaatgtgggaaggccttcaaccagaccagccacctgatccgccacaagaggatccacacagaggagaagccctacaagtgtgaagaatgtgggaaggccttcaaccagagcagcaccctgaccacccacaacatcatccacactggagagatcccctacaagtgtgagaagtgtgtgcgggccttcaaccaggccagcaagctgacagagcacaagctgatccacactggagagaagagatatgaatgtgaagaatgtgggaaggccttcaacagaagcagcaagctgacagagcacaagtacatccacactggagagaagctgtacaagtgtgaagaatgtgggaaggccttcaaccagagcagcaccctgaccacccacaagaggatccacagcggggagaagccctacaagtgtgaagaatgtgggaaggccttcaagcagttcagcaacctgacagaccacaagaagatccacactggagagaagccctacaagtgtgaagaatgtgggaaggccttcaaccagctgagcaacctgaccaggcacaaggtgatccacactggagagaagccctacaagtgtggagaatgtgggaaggccttcaaccagagcagcgccctgaacacccacaagatcatccacactggagagaacccccacaagtgccgggagagcggcaaggtgttccacctgagcagcaagctgagcacctgcaagaagatccacactggagagaagctgtacaagtgtgaagaatgtgggaaggccttcaacagaagcagcaccctgattggccacaagaggatccacactggagagaagccctacaagtgtgaagaatgtgggaaggccttcaaccagagcagcaccctgaccacccacaagatcatccacacagaggagaagcagtacaagtgtgatgaatgtgggaaggccagcacctag

SEQ ID NO: 176457 - DNA, 1152 bp, Artificial Sequence
  Description of Artificial Sequence: Synthetic coding sequence
atgaagagacatgagatggtggccaagcacctggtgatgttctactactttgcccagcacctgtggccagagcagaacatccgggacagcttccagaaggtgaccctgcggcgctacagaaaatgtggctatgagaacctgcagctgaggaagggctgcaagtctgtggtggagtgcaagcagcacaagggggactacagcggcctgaaccagtgcctgaagaccaccctgagcaagatcttccagtgcaacaagtatgtggaggtgttccacaagatcagcaacagcaacagacacaagatgaggcacacagagaacaagcacttcaagtgcaaggaatgtaggaagaccttctgcatgctgagccacctgacccagcacaagaggatccagaccagggtgaacttctacaagtgtgaggcctacggccgggccttcaactggagcagcaccctgaacaagcacaagaggatccacactggagagaagccctacaagtgcaaggaatgtgggaaggccttcaaccagaccagccacctgatccgccacaagaggatccacacagaggagaagccctacaagtgtgaagaatgtgggaaggccttcaaccagagcagcaccctgaccacccacaacatcatccacactggagagatcccctacaagtgtgagaagtgtgtgcgggccttcaaccaggccagcaagctgacagagcacaagctgatccacactggagagaagagatatgaatgtgaagaatgtgggaaggccttcaacagaagcagcaagctgacagagcacaagtacatccacactggagagaagctgtacaagtgtgaagaatgtgggaaggccttcaaccagagcagcaccctgaccacccacaagaggatccacagcggggagaagccctacaagtgtgaagaatgtgggaaggccttcaagcagttcagcaacctgacagaccacaagaagatccacactggagagaagccctacaagtgtgaagaatgtgggaaggccttcaaccagctgagcaacctgaccaggcacaaggtgatccacactggagagaagccctacaagtgtggagaatgtgggaaggccaacctgagcagcaccctgaccccccacaagaccatccacatctag

SEQ ID NO: 176458 - DNA, 1368 bp, Artificial Sequence
  Description of Artificial Sequence: Synthetic coding sequence
atgctggagaactacagcaacctggtgtctgtgggctaccacatcatcaagccagatgtgatcagcaagctggagcagggcgaggagccctggatcgtggagggggagttcctgctgcagagctacccagatgaggtgtggcagacagatgacctgattgagcgcatccaggaggaggagaacaagcccagccggcagacagtgttcatcgagaccctcatcgaggagagaggaaatgtgcctgggaagacctttgatgtggagaccaaccctgtgcccagcaggaagatcgcctacaagaacagcctgtgtgacagctgtgagaagtgcctgacctctgtgtctgagtacatcagcagtgatggcagctatgccaggatgaaggcagatgaatgttctggctgcggcaagagcctgctgcacatcaagctggagaagacccaccctggggaccaggcctatgagttcaaccagaatggagagccctacaccctgaatgaggagagcctgtaccagaagatccgcatcctggagaagccctttgagtacatcgagtgccagaaggccttccagaaggacacagtgtttgtgaaccacatggaggagaagccctacaagtggaatggcagcgagatcgccttcctgcagatgtctgacctgactgtgcaccagaccagccacatggagatgaagccctatgagtgcagtgaatgtgggaagagcttctgcaagaagagcaagttcatcatccaccagaggacccacactggagagaagccctatgagtgcaaccagtgtgggaagagcttctgccagaagggcaccctgactgtgcaccagaggacccacactggagagaagccctatgagtgcaatgaatgtgggaagaacttctaccagaagctgcacctgatccagcaccagaggacccacagcggggagaagccctatgagtgcagctactgtgggaagagcttctgccagaagacccacctgacccagcaccagaggacccacagcggggagcggccctacgtgtgccacgactgtggccccagccgccgcagccagcacctgatgcaccagaagatccacactggagtgaagctgtacaagtgcagtgaatgtgggaagtgcttctgcaggaagagcaccctgaccacccacctgcggacccacactggagagaagccctatgagtgcaatgaatgtgggaagttcttcagccggctgagctacctgactgtgcactaccgcacccacagcggggagaagccctatgagtgcaatgaatgtgggaagaccttctacctgaacagcgccctgatgaggcaccagagggtgcacactggagagaagccctactag

SEQ ID NO: 176459 - DNA, 1980 bp, Artificial Sequence
  Description of Artificial Sequence: Synthetic coding sequence
atgaacaagagcctgggccctgtgtccttcaaggatgtggccgtggacttcacccaggaggagtggcagcagctggaccctgagcagaagatcacctacagagatgtgatgctggagaactacagcaacctggtgtctgtgggctaccacatcatcaagccagatgtgatcagcaagctggagcagggcgaggagccctggatcgtggagggggagttcctgctgcagagctacccagatgaggtgtggcagacagatgacctgattgagcgcatccaggaggaggagaacaagcccagccggcagacagtgttcatcgagaccctcatcgaggagcgggagtacatcagcagtgatggcagctatgccaggatgaaggcagatgaatgttctggctgcggcaagagcctgctgcacatcaagctggagaagacccaccctggggaccaggcctatgagttcaaccagaatggagagccctacaccctgaatgaggagagcctgtaccagaagatccgcatcctggagaagccctttgagtacatcgagtgccagaaggccttccagaaggacacagtgtttgtgaaccacatggaggagaagccctacaagtggaatggcagcgagatcgccttcctgcagatgtctgacctgactgtgcaccagaccagccacatggagatgaagccctatgagtgcagtgaatgtgggaagagcttctgcaagaagagcaagttcatcatccaccagaggacccacactggagagaagccctatgagtgcaaccagtgtgggaagagcttctgccagaagggcaccctgactgtgcaccagaggacccacactggagagaagccctatgagtgcaatgaatgtgggaagaacttctaccagaagctgcacctgatccagcaccagaggacccacagcggggagaagccctatgagtgcagctactgtgggaagagcttctgccagaagacccacctgacccagcaccagaggacccacagcggggagcggccctacgtgtgccacgactgtgggaagaccttcagccagaagagcgccctgaatgaccaccagaagatccacactggagtgaagctgtacaagtgcagtgaatgtgggaagtgcttctgcaggaagagcaccctgaccacccacctgcggacccacactggagagaagccctatgagtgcaatgaatgtgggaagttcttcagccggctgagctacctgactgtgcactaccgcacccacagcggggagaagccctatgagtgcaatgaatgtgggaagaccttctacctgaacagcgccctgatgaggcaccagagggtgcacactggagagaagccctatgagtgcaatgaatgtgggaagctgttcagccagctgagctacctgaccatccaccacaggacccacagcggcgtgaagccctatgagtgcagtgaatgtgggaagaccttctaccagaacagcgccctgtgccgccaccggcgcatccacaagggggagaagccctatgagtgctacatctgtgggaagttcttcagccagatgagctacctgaccatccaccaccgcatccacagcggggagaagccctatgagtgcagtgaatgtgggaagaccttctgccagaacagcgccctgaacagacaccagaggacccacactggagagaaggcctatgagtgctatgaatgtgggaagtgcttcagccagatgagctacctgaccatccaccaccgcatccacagcggggagaagccctttgagtgcaatgaatgtgggaaggccttcagcaggatgagctacctgactgtgcactaccgcacccacagcggggagaagccctatgagtgcacagaatgtgggaagaagttctaccacaagagcgccttcaacagccaccagaggatccaccggcggggcaacatgaatgtgattgatgtgggccgcctgctgtag

SEQ ID NO: 176460 - DNA, 2268 bp, Artificial Sequence
  Description of Artificial Sequence: Synthetic coding sequence
atgagggccacagccctggtgcgctggacaggccgggacctggccagcagaagagccccagccacagccatcccccccaggcctgtgggcagcggcggcgctgaggccgctgagccccaggaggacctgccccccctgagccagagcagccgcttcttccaggagcagcagaagatgaacaagagcctgggccctgtgtccttcaaggatgtggccgtggacttcacccaggaggagtggcagcagctggaccctgagcagaagatcacctacagagatgtgatgctggagaactacagcaacctggtgtctgtgggctaccacatcatcaagccagatgtgatcagcaagctggagcagggcgaggagccctggatcgtggagggggagttcctgctgcagagctacccagatgaggtgtggcagacagatgacctgattgagcgcatccaggaggaggagaacaagcccagccggcagacagtgttcatcgagaccctcatcgaggagagaggaaatgtgcctgggaagacctttgatgtggagaccaaccctgtgcccagcaggaagatcgcctacaagaacagcctgtgtgacagctgtgagaagtgcctgacctctgtgtctgagtacatcagcagtgatggcagctatgccaggatgaaggcagatgaatgttctggctgcggcaagagcctgctgcacatcaagctggagaagacccaccctggggaccaggcctatgagttcaaccagaatggagagccctacaccctgaatgaggagagcctgtaccagaagatccgcatcctggagaagccctttgagtacatcgagtgccagaaggccttccagaaggacacagtgtttgtgaaccacatggaggagaagccctacaagtggaatggcagcgagatcgccttcctgcagatgtctgacctgactgtgcaccagaccagccacatggagatgaagccctatgagtgcagtgaatgtgggaagagcttctgcaagaagagcaagttcatcatccaccagaggacccacactggagagaagccctatgagtgcaaccagtgtgggaagagcttctgccagaagggcaccctgactgtgcaccagaggacccacactggagagaagccctatgagtgcaatgaatgtgggaagaacttctaccagaagctgcacctgatccagcaccagaggacccacagcggggagaagccctatgagtgcagctactgtgggaagagcttctgccagaagacccacctgacccagcaccagaggacccacagcggggagcggccctacgtgtgccacgactgtgggaagaccttcagccagaagagcgccctgaatgaccaccagaagatccacactggagtgaagctgtacaagtgcagtgaatgtgggaagtgcttctgcaggaagagcaccctgaccacccacctgcggacccacactggagagaagccctatgagtgcaatgaatgtgggaagttcttcagccggctgagctacctgactgtgcactaccgcacccacagcggggagaagccctatgagtgcaatgaatgtgggaagaccttctacctgaacagcgccctgatgaggcaccagagggtgcacactggagagaagccctatgagtgcaatgaatgtgggaagctgttcagccagctgagctacctgaccatccaccacaggacccacagcggcgtgaagccctatgagtgcagtgaatgtgggaagaccttctaccagaacagcgccctgtgccgccaccggcgcatccacaagggggagaagccctatgagtgctacatctgtgggaagttcttcagccagatgagctacctgaccatccaccaccgcatccacagcggggagaagccctatgagtgcagtgaatgtgggaagaccttctgccagaacagcgccctgaacagacaccagaggacccacactggagagaaggcctatgagtgctatgaatgtgggaagtgcttcagccagatgagctacctgaccatccaccaccgcatccacagcggggagaagccctttgagtgcaatgaatgtgggaaggccttcagcaggatgagctacctgactgtgcactaccgcacccacagcggggagaagccctatgagtgcacagaatgtgggaagaagttctaccacaagagcgccttcaacagccaccagaggatccaccggcggggcaacatgaatgtgattgatgtgggccgcctgctgtag

SEQ ID NO: 176461 - DNA, 2094 bp, Artificial Sequence
  Description of Artificial Sequence: Synthetic coding sequence
atgaacaagagcctgggccctgtgtccttcaaggatgtggccgtggacttcacccaggaggagtggcagcagctggaccctgagcagaagatcacctacagagatgtgatgctggagaactacagcaacctggtgtctgtgggctaccacatcatcaagccagatgtgatcagcaagctggagcagggcgaggagccctggatcgtggagggggagttcctgctgcagagctacccagatgaggtgtggcagacagatgacctgattgagcgcatccaggaggaggagaacaagcccagccggcagacagtgttcatcgagaccctcatcgaggagagaggaaatgtgcctgggaagacctttgatgtggagaccaaccctgtgcccagcaggaagatcgcctacaagaacagcctgtgtgacagctgtgagaagtgcctgacctctgtgtctgagtacatcagcagtgatggcagctatgccaggatgaaggcagatgaatgttctggctgcggcaagagcctgctgcacatcaagctggagaagacccaccctggggaccaggcctatgagttcaaccagaatggagagccctacaccctgaatgaggagagcctgtaccagaagatccgcatcctggagaagccctttgagtacatcgagtgccagaaggccttccagaaggacacagtgtttgtgaaccacatggaggagaagccctacaagtggaatggcagcgagatcgccttcctgcagatgtctgacctgactgtgcaccagaccagccacatggagatgaagccctatgagtgcagtgaatgtgggaagagcttctgcaagaagagcaagttcatcatccaccagaggacccacactggagagaagccctatgagtgcaaccagtgtgggaagagcttctgccagaagggcaccctgactgtgcaccagaggacccacactggagagaagccctatgagtgcaatgaatgtgggaagaacttctaccagaagctgcacctgatccagcaccagaggacccacagcggggagaagccctatgagtgcagctactgtgggaagagcttctgccagaagacccacctgacccagcaccagaggacccacagcggggagcggccctacgtgtgccacgactgtgggaagaccttcagccagaagagcgccctgaatgaccaccagaagatccacactggagtgaagctgtacaagtgcagtgaatgtgggaagtgcttctgcaggaagagcaccctgaccacccacctgcggacccacactggagagaagccctatgagtgcaatgaatgtgggaagttcttcagccggctgagctacctgactgtgcactaccgcacccacagcggggagaagccctatgagtgcaatgaatgtgggaagaccttctacctgaacagcgccctgatgaggcaccagagggtgcacactggagagaagccctatgagtgcaatgaatgtgggaagctgttcagccagctgagctacctgaccatccaccacaggacccacagcggcgtgaagccctatgagtgcagtgaatgtgggaagaccttctaccagaacagcgccctgtgccgccaccggcgcatccacaagggggagaagccctatgagtgctacatctgtgggaagttcttcagccagatgagctacctgaccatccaccaccgcatccacagcggggagaagccctatgagtgcagtgaatgtgggaagaccttctgccagaacagcgccctgaacagacaccagaggacccacactggagagaaggcctatgagtgctatgaatgtgggaagtgcttcagccagatgagctacctgaccatccaccaccgcatccacagcggggagaagccctttgagtgcaatgaatgtgggaaggccttcagcaggatgagctacctgactgtgcactaccgcacccacagcggggagaagccctatgagtgcacagaatgtgggaagaagttctaccacaagagcgccttcaacagccaccagaggatccaccggcggggcaacatgaatgtgattgatgtgggccgcctgctgtag

SEQ ID NO: 176462 - DNA, 1173 bp, Artificial Sequence
  Description of Artificial Sequence: Synthetic coding sequence
atggccgagatccacaacggcggggagctgtgtgacttcatggagaatggagagatcttcagcgagcacagctgcctgaatgcccacatgggcacagaaaatactggagacacctatgactgtgatgaatatggagagaacttccccatgctgcacaacagcgccccagctggggagaccctgtctgtgctgaaccagtgcaggaaggccttcagcctgccccccaacgtgcaccagaggacctggattggagacaagagctttgagtacagcgactgtgaggaggcctttgtggaccagagccacctgcaggccaaccgcatcacccacaatggagagaccctgtatgagcagaagcagtgtggccgggccttcacctacagcaccagccatgctgtgtctgtgaagatgcacacagtggagaagccctatgagtgcaaggaatgtgggaagttcttccgctacagcagctacctgaacagccacatgaggacccacactggagagaagccctatgagtgcaaggaatgtgggaagtgcttcaccgtgagcagccacctggtggagcacgtgcgcatccacactggagagaagccctaccagtgcaaggaatgtggccgggcctttgctggccgcagcggcctgaccaagcacgtgcgcatccacactggagagaagccctatgaatgtaatgaatgtgggaaggcctacaaccgcttctacctgctgacagagcacttcaagacccacacagaggagaagccctttgagtgcaaggtgtgtgggaagagcttccgcagcagcagctgcctgaagaaccacttccgcatccacacaggcatcaagccctacaagtgcaaggaatgtgggaaggccttcaccgtgagcagcagcctgcacaaccacgtgaagatccacactggagagaagccctatgagtgcaaggactgtgggaaggcctttgccaccagcagccagctgattgagcacatccgcacccacactggagagaagccctacatctgcaaggaatgtgggaagaccttccgggccagcagccacctgcagaagcacgtgcgcatccacactggagagaagccctacatctgcaatgaatgtgggaaggcctacaaccgcttctacctgctgaccaagcacctgaagacccactag

SEQ ID NO: 176463 - DNA, 1032 bp, Artificial Sequence
  Description of Artificial Sequence: Synthetic coding sequence
atggccgagatccacaacggcggggagctgtgtgacttcatggagaatggagagatcttcagcgagcacagctgcctgaatgcccacatgggcacagaaaatactggagacacctatgactgtgatgaatatggagagaacttccccatgctgcacaacagcgccccagctggggagaccctgtctgtgctgaaccagtgcaggaaggccttcagcctgccccccaacgtgcaccagaggacctggattggagacaagagctttgagtacagcgactgtgaggaggcctttgtggaccagagccacctgcaggccaaccgcatcacccacaatggagagaccctgtatgagcagaagcagtgtggccgggccttcacctacagcaccagccatgctgtgtctgtgaagatgcacacagtggagaagccctatgagtgcaaggaatgtgggaagttcttccgctacagcagctacctgaacagccacatgaggacccacactggagagaagccctatgagtgcaaggaatgtgggaagtgcttcaccgtgagcagccacctggtggagcacgtgcgcatccacactggagagaagccctaccagtgcaaggaatgtggccgggcctttgctggccgcagcggcctgaccaagcacgtgcgcatccacactggagagaagccctatgaatgtaatgaatgtgggaaggcctacaaccgcttctacctgctgacagagcacttcaagacccacacagaggagaagccctttgagtgcaaggtgtgtgggaagagcttccgcagcagcagctgcctgaagaaccacttccgcatccacacaggcatcaagccctacaagtgcaaggaatgtgggaaggccttcaccgtgagcagcagcctgcacaaccacgtgaagatccacactggagagaagccctatgagtgcaaggactgtgggaaggcctttgccaccagcagccagctgattgagcacatccgcacccacacctgcaaccccagcaccctgcggggctag

SEQ ID NO: 176464 - DNA, 870 bp, Artificial Sequence
  Description of Artificial Sequence: Synthetic coding sequence
atgagcggccaccctggctcctgggagatgaacagcgtggcctttgaagatgtggccgtgaacttcacccaggaggagtgggccctgctggaccccagccagaagaacctgtacagagatgtgatgcaggagaccttcaggaacctggccagcatcggcaacaagggggaggaccagagcattgaggaccagtacaagaacagcagcaggaacctgagcagcttccagatccaccagaggaaccacactggagagaagccctatgagtgcatggagtgtgggaaggccctgggcttcagccgcagcctgaacagacacaagaggatccacactggagagaagagatatgagtgcaagcagtgtgggaaggccttcagccgcagcagccacctgcgggaccacgagaggacccacactggagagaagccctatgagtgcaagcactgcggcaaggccttccgctacagcaactgcctgcactaccacgagaggacccacactggagagaagccctacgtgtgcatggagtgtgggaaggccttcagctgcctgagcagcctgcagggccacatcaaggcccatgctggggaggagccctacccctgcaagcagtgtgggaaggccttccgctatgccagcagcctgcagaagcatgagaagacccacatcgcccagaagccctacgtgtgcaacaactgtgggaagggcttccgctgcagcagcagcctgcgggaccacgagaggacccacactggagagaagccctatgagtgccagaagtgtgggaaggccttcagccgggccagcaccctgtggaagcacaagaagacccacactggagagaagccctacaagtgcaagaagatgtag

SEQ ID NO: 176465 - DNA, 939 bp, Artificial Sequence
  Description of Artificial Sequence: Synthetic coding sequence
atgcccaacttcaacctgaacaagaagatcccagcccgggtgaagccccatgagtgcatcgtgtgtgagaagttcttcatccgccacagcagcctgcaccgccacatcatcagccacagcggcaacaacccctacggctgtgaagaatgtgggaagaagccctgcacctgcaagcagtgccagaagaccagcctgtctgtgaccagggtgcaccgggacacagtgatgcacactggaaatggccactacggctgcaccatctgtgagaaggtgttcaacatccccagcagcttccagatccaccagaggaaccacactggagagaagccctatgagtgcatggagtgtgggaaggccctgggcttcagccgcagcctgaacagacacaagaggatccacactggagagaagagatatgagtgcaagcagtgtgggaaggccttcagccgcagcagccacctgcgggaccacgagaggacccacactggagagaagccctatgagtgcaagcactgtgggaaggccttccgctacagcaactgcctgcactaccacgagaggacccacactggagagaagccctacgtgtgcatggagtgtgggaaggccttcagctgcctgagcagcctgcagggccacatcaaggcccacgccggggaggagccctacccctgcaagcagtgtgggaaggccttccgctatgccagcagcctgcagaagcatgagaagacccacatcgcccagaagccctacgtgtgcaacaactgtgggaagggcttccgctgcagcagcagcctgcgggaccacgagaggacccacactggagagaagccctatgagtgccagaagtgtgggaaggccttcagccgggccagcaccctgtggaagcacaagaagacccacactggagagaagccctacaagtgcaagaagatgtag

SEQ ID NO: 176466 - DNA, 468 bp, Artificial Sequence
  Description of Artificial Sequence: Synthetic coding sequence
atgaatgccctgtgtgtgaagaacagcagctaccacagcagcctgcaccgccacatcatcagccacagcggcaacaacccctacggctgtgaggagtgtgggaagaagccctgcacctgcaagcagtgccagaagaccagcctgtctgtgaccagggtgcaccgggacacagtgatgcacactggaaatggccactacggctgcaccatctgtgagaaggtgttcaacatccccagcagcttccagatccaccagaggaaccacactggagagaagccctatgagtgcatggagtgtgggaaggccctgggcttcagccgcagcctgaacagacacaagaggatccacactggagagaagagatatgagtgcaagaagtgtgggaaggccttcagccgggccagcaccctgtggaagcacaagaagacccacactggagagaagccctacaagtgcaagaagatgtag

SEQ ID NO: 176467 - DNA, 888 bp, Artificial Sequence
  Description of Artificial Sequence: Synthetic coding sequence
atgaatgccctgtgtgtgaagaacagcagctaccacagcagcctgcaccgccacatcatcagccacagcggcaacaacccctacggctgtgaggagtgtgggaagaagccctgcacctgcaagcagtgccagaagaccagcctgtctgtgaccagggtgcaccgggacacagtgatgcacactggaaatggccactacggctgcaccatctgtgagaaggtgttcaacatccccagcagcttccagatccaccagaggaaccacactggagagaagccctatgagtgcatggagtgtgggaaggccctgggcttcagccgcagcctgaacagacacaagaggatccacactggagagaagagatatgagtgcaagcagtgtgggaaggccttcagccgcagcagccacctgcgggaccacgagaggacccacactggagagaagccctatgagtgcaagcactgcggcaaggccttccgctacagcaactgcctgcactaccacgagaggacccacactggagagaagccctacgtgtgcatggagtgtgggaaggccttcagctgcctgagcagcctgcagggccacatcaaggcccatgctggggaggagccctacccctgcaagcagtgtgggaaggccttccgctatgccagcagcctgcagaagcatgagaagacccacatcgcccagaagccctacgtgtgcaacaactgtgggaagggcttccgctgcagcagcagcctgcgggaccacgagaggacccacactggagagaagccctatgagtgccagaagtgtgggaaggccttcagccgggccagcaccctgtggaagcacaagaagacccacactggagagaagccctacaagtgcaagaagatgtag

SEQ ID NO: 176468 - DNA, 222 bp, Artificial Sequence
  Description of Artificial Sequence: Synthetic coding sequence
atgagcggccaccctggctcctgggagatgaacagcgtggcctttgaagatgtggccgtgaacttcacccaggaggagtgggccctgctggaccccagccagaagaacctgtacagagatgtgatgcaggagaccttcaggaacctggccagcatcggcaacaagggggaggaccagagcattgaggaccagtacaagaacagcagcaggaacctgaggtag

SEQ ID NO: 176469 - DNA, 1770 bp, Artificial Sequence
  Description of Artificial Sequence: Synthetic coding sequence
atggaggccgaggagaccatggagtgcctgcaggagttccctgagcaccacaagatgatcctggaccggctgaatgagcagcgggagcaggaccgcttcacagacatcaccctgattgtggatggccaccacttcaaggcccacaaggctgtgctggccgcctgcagcaagttcttctacaagttcttccaggagttcacccaggagcccctggtggagattgagggcgtgtccaagatggccttccgccacctgattgagttcacctacacagccaagctgatgatccagggcgaggaggaggccaatgatgtgtggaaggctgctgagttcctgcagatgctggaggccatcaaggccctggaggtgaggaacaaggaaaattctgcccccctggaggagaacaccaccgggaagaatgaggccaagaagaggaagattgctgagaccagcaatgtcatcacagagagcctgcccagcgctgagagcgagcctgtggagattgaggtggagattgctgagggcaccatcgaggtggaggatgagggcatcgagaccctggaggaggtggccagcgccaagcagagcgtgaagtacatccagagcacaggcagcagtgatgattctgccctggccctgctggccgacatcaccagcaagtaccggcagggcgacaggaagggccagatcaaggaggatggctgccccagcgaccccaccagcaagcaggagcacatgaagagccacagcacagagagcttcaagtgtgagatctgcaacaagcgctacctgcgggagagcgcctggaagcagcacctgaactgctaccacctggaggagggcggcgtgtccaagaagcagaggacaggcaagaagatccacgtgtgccagtactgtgagaagcagtttgaccacttcggccacttcaaggagcacctgaggaagcacactggagagaagccctttgaatgtcccaactgccacgagagatttgccaggaacagcaccctgaagtgccacctgacagcctgccagacaggagtgggcgccaagaagggcaggaagaagctgtatgagtgccaggtgtgcaacagcgtcttcaacagctgggaccagttcaaggaccacctggtgatccacactggagacaagcccaaccactgcaccctgtgtgacctgtggttcatgcagggcaatgagctgcggcggcacctgagtgatgcccacaacatcagcgagcggctggtgacagaggaggtgctgtctgtggagaccagggtgcagacagagcctgtgacctccatgaccatcatcgagcaggtgggcaaggtgcacgtgctgcccctgctgcaggtgcaggtggacagcgcccaggtgacagtggagcaggtgcacccagacctgctgcaggacagccaggtgcatgacagccacatgtctgagctgcctgagcaggtgcaggtgtcctacctggaggtgggccgcatccagacagaggagggcacagaggtgcacgtggaggagctgcacgtggagcgggtgaaccagatgcctgtggaggtgcagacagagctgctggaggccgacctggaccacgtgaccccagagatcatgaaccaggaggagcgggagagcagccaggctgatgctgctgaggccgcccgggaggaccatgaagatgctgaggacctggagaccaagcccaccgtggacagcgaggccgagaaggccgagaatgaagatagaacagccctgcctgtgctggagtag

SEQ ID NO: 176470 - DNA, 1872 bp, Artificial Sequence
  Description of Artificial Sequence: Synthetic coding sequence
atggaggccgaggagaccatggagtgcctgcaggagttccctgagcaccacaagatgatcctggaccggctgaatgagcagcgggagcaggaccgcttcacagacatcaccctgattgtggatggccaccacttcaaggcccacaaggctgtgctggccgcctgcagcaagttcttctacaagttcttccaggagttcacccaggagcccctggtggagattgagggcgtgtccaagatggccttccgccacctgattgagttcacctacacagccaagctgatgatccagggcgaggaggaggccaatgatgtgtggaaggctgctgagttcctgcagatgctggaggccatcaaggccctggaggtgaggaacaaggaaaattctgcccccctggaggagaacaccaccgggaagaatgaggccaagaagaggaagattgctgagaccagcaatgtcatcacagagagcctgcccagcgctgagagcgagcctgtggagattgaggtggagattgctgagggcaccatcgaggtggaggatgagggcatcgagaccctggaggaggtggccagcgccaagcagagcgtgaagtacatccagagcacaggcagcagtgatgattctgccctggccctgctggccgacatcaccagcaagtaccggcagggcgacaggaagggccagatcaaggaggatggctgccccagcgaccccaccagcaagcaggtggagggcattgaaattgtggagctgcagctgagccacgtgaaggacctcttccactgtgagaagtgcaacagaagcttcaagctgttctaccacttcaaggagcacatgaagagccacagcacagagagcttcaagtgtgagatctgcaacaagcgctacctgcgggagagcgcctggaagcagcacctgaactgctaccacctggaggagggcggcgtgtccaagaagcagaggacaggcaagaagatccacgtgtgccagtactgtgagaagcagtttgaccacttcggccacttcaaggagcacctgaggaagcacactggagagaagccctttgaatgtcccaactgccacgagagatttgccaggaacagcaccctgaagtgccacctgacagcctgccagacaggagtgggcgccaagaagggcaggaagaagctgtatgagtgccaggtgtgcaacagcgtcttcaacagctgggaccagttcaaggaccacctggtgatccacactggagacaagcccaaccactgcaccctgtgtgacctgtggttcatgcagggcaatgagctgcggcggcacctgagtgatgcccacaacatcagcgagcggctggtgacagaggaggtgctgtctgtggagaccagggtgcagacagagcctgtgacctccatgaccatcatcgagcaggtgggcaaggtgcacgtgctgcccctgctgcaggtgcaggtggacagcgcccaggtgacagtggagcaggtgcacccagacctgctgcaggacagccaggtgcatgacagccacatgtctgagctgcctgagcaggtgcaggtgtcctacctggaggtgggccgcatccagacagaggagggcacagaggtgcacgtggaggagctgcacgtggagcgggtgaaccagatgcctgtggaggtgcagacagagctgctggaggccgacctggaccacgtgaccccagagatcatgaaccaggaggagcgggagagcagccaggctgatgctgctgaggccgcccgggaggaccatgaagatgctgaggacctggagaccaagcccaccgtggacagcgaggccgagaaggccgagaatgaagatagaacagccctgcctgtgctggagtag

SEQ ID NO: 176471 - DNA, 1770 bp, Artificial Sequence; identical to SEQ ID NO: 176469
  Description of Artificial Sequence: Synthetic coding sequence

SEQ ID NO: 176472 - DNA, 456 bp, Artificial Sequence
  Description of Artificial Sequence: Synthetic coding sequence
atggaggccgaggagaccatggagtgcctgcaggagttccctgagcaccacaagatgatcctggaccggctgaatgagcagcgggagcaggaccgcttcacagacatcaccctgattgtggatggccaccacttcaaggcccacaaggctgtgctggccgcctgcagcaagttcttctacaagttcttccaggagttcacccaggagcccctggtggagattgagggcgtgtccaagatggccttccgccacctgattgagttcacctacacagccaagctgatgatccagggcgaggaggaggccaatgatgtgtggaaggctgctgagttcctgcagatgctggaggccatcaaggccctggaggtgaggaacaaggaaaattctgcccccctggaggagaacaccaccgggaagaatgaggccaagaagaggaagattgctgagaccagctag

SEQ ID NO: 176473 - DNA, 1872 bp, Artificial Sequence; identical to SEQ ID NO: 176470
  Description of Artificial Sequence: Synthetic coding sequence

SEQ ID NO: 176474 - DNA, 420 bp, Artificial Sequence
  Description of Artificial Sequence: Synthetic coding sequence
atggaggccgaggagaccatggagtgcctgcaggagttccctgagcaccacaagatgatcctggaccggctgaatgagcagcgggagcaggaccgcttcacagacatcaccctgattgtggatggccaccacttcaaggcccacaaggctgtgctggccgcctgcagcaagttcttctacaagttcttccaggagttcacccaggagcccctggtggagattgagggcgtgtccaagatggccttccgccacctgattgagttcacctacacagccaagctgatgatccagggcgaggaggaggccaatgatgtgtggaaggctgctgagttcctgcagatgctggaggccatcaaggccctggaggtgaggaacaaggaaaattctgcccccctggaggagaacaccaccgggaagtag

SEQ ID NO: 176475 - DNA, 1770 bp, Artificial Sequence; identical to SEQ ID NO: 176469
  Description of Artificial Sequence: Synthetic coding sequence

SEQ ID NO: 176476 - DNA, 798 bp, Artificial Sequence
  Description of Artificial Sequence: Synthetic coding sequence
atggaggccgaggagaccatggagtgcctgcaggagttccctgagcaccacaagatgatcctggaccggctgaatgagcagcgggagcaggaccgcttcacagacatcaccctgattgtggatggccaccacttcaaggcccacaaggctgtgctggccgcctgcagcaagttcttctacaagttcttccaggagttcacccaggagcccctggtggagattgagggcgtgtccaagatggccttccgccacctgattgagttcacctacacagccaagctgatgatccagggcgaggaggaggccaatgatgtgtggaaggctgctgagttcctgcagatgctggaggccatcaaggccctggaggtgaggaacaaggaaaattctgcccccctggaggagaacaccaccgggaagaatgaggccaagaagaggaagattgctgagaccagcaatgtcatcacagagagcctgcccagcgctgagagcgagcctgtggagattgaggtggagattgctgagggcaccatcgaggtggaggatgagggcatcgagaccctggaggaggtggccagcgccaagcagagcgtgaagtacatccagagcacaggcagcagtgatgattctgccctggccctgctggccgacatcaccagcaagtaccggcagggcgacaggaagggccagatcaaggaggatggctgccccagcgaccccaccagcaagcaggagcacatgaagagccacagcacagagagcttcaagtgtgagatctgcaacaagcgctacctgaggtag

SEQ ID NO: 176477 - DNA, 2121 bp, Artificial Sequence
  Description of Artificial Sequence: Synthetic coding sequence
atggccctgcccagcccccaggtgctgatgggcctgcctgccctgctgatgggccctgcccagcacacctcctggccctgtggcagcgctgtgcccaccctgaagtccatggtgacctttgaagatgtggccgtgtacttcagccaggaggagtgggagctgctggatgctgcccagaggcacctgtaccacagcgtgatgctggagaacctggagctggtgaccagcctgggctcctggcatggagtggagggggagggcgcccaccccaagcagaatgtgtctgtggaggtgctgcaggtgcgcatccccaatgctgaccccagcaccaagaaggccaacagctgtgacatgtgtggccccttcctgaaggacatcctgcacctggccgagcaccagggcacccagagcgaggagaagccctacacctgtggggcctgtggccgggacttctggctgaatgccaacctgcaccagcaccagaaggagcacagcggcggcaagcccttccgctggtacaaggacagagatgccctgatgaagagcagcaaggtgcacctgtctgagaaccccttcacctgccgggagggcggcaaggtgatcctgggcagctgtgacctgctgcagctgcaggccgtggacagcggccagaagccctacagcaacctgggccagctgcctgaggtgtgcaccacccagaagctgtttgaatgtagcaactgtgggaaggccttcctgaagagcagcaccctgcccaaccacctgcggacccacagcgaggagatccccttcacctgccccaccggcggcaacttcctggaggagaagagcatcctgggcaacaagaagttccacactggagagatcccccacgtgtgcaaggaatgtgggaaggccttcagccacagcagcaagctgaggaagcaccagaagttccacacagaggtgaagtactatgagtgcatcgcctgtgggaagaccttcaaccacaagctgacctttgtgcaccaccagaggatccacagcggggagcggccctatgaatgtgatgaatgtgggaaggccttcagcaacagaagccacctgatcagacatgagaaggtgcacactggagagcggccctttgagtgcctgaagtgtggccgggccttcagccagagcagcaacttcctgcggcaccagaaggtgcacacccaggtgcggccctatgagtgcagccagtgtgggaagagcttcagccgcagcagcgccctgatccagcactggagggtgcacactggagagcggccctatgagtgcagtgaatgtggccgggccttcaacaacaacagcaacctggcccagcaccagaaggtgcacactggagagcggccctttgagtgcagtgaatgtggccgggacttcagccagagcagccacctgctgcggcaccagaaggtgcacactggagagcggccctttgagtgctgtgactgtgggaaggccttcagcaacagcagcaccctcatccagcaccagaaggtgcacacaggccagaggccctatgagtgcagtgaatgtaggaagagcttcagccgcagcagcagcctcatccagcactggaggatccacactggagagaagccctatgagtgcagtgaatgtgggaaggcctttgcccacagcagcaccctgattgagcactggagggtgcacaccaaggagcggccctatgagtgcaatgaatgtgggaagttcttcagccagaacagcatcctgatcaagcaccagaaggtgcacactggagagaagccctacaagtgcagtgaatgtgggaagttcttcagcaggaagagcagcctcatctgccactggagggtgcacactggagagcggccctatgagtgcagtgaatgtggccgggccttcagcagcaacagccacctggtgcgccaccagagggtgcacacccaggagcggccctatgagtgcatccagtgtgggaaggccttcagcgagaggagcaccctggtgcgccaccagaaggtgcacacccgggagaggacctatgagtgcagccagtgtgggaagctgttcagccacctgtgcaacctggcccagcacaagaagatccacacctag

SEQ ID NO: 176478 - DNA, 1191 bp, Artificial Sequence
  Description of Artificial Sequence: Synthetic coding sequence
cccaccctgaagtccatggtgacctttgaagatgtggccgtgtacttcagccaggaggagtgggagctgctggatgctgcccagaggcacctgtaccacagcgtgatgctggagaacctggagctggtgaccagcctgggcaatgccctgagccagcacgtgtgcctcttccccatcgagagctctgtgcaccccaaggcccgctcctgggtgctgctgcccagccgggtgtcctgctgccgctgctggggcgctgaggtgctgctgggcgtggagggggagggcgcccaccccaagcagaatgtgtctgtggaggtgctgcagcaccagaaggagcacagcggcggcaagcccttccgctggtacaaggacagcagcggccagaagccctacagcaacctgggccagctgcctgaggtgtgcaccacccagaagctgtttgagtgcagcaactgtgggaaggccttcctgaagagcagcaccctgcccaaccacctgcggacccacagcgaggagatccccttcacctgccccactggaggcaacttcctggaggagaagagcatcctgggcaacaagaagttccacactggagagatcccccacgtgtgcaaggaatgtgggaaggccttcagccacagcagcaagctgaggaagcaccagaagttccacacagaggtgcggccctatgaatgttcccagtgtgggaagagcttcagccgcagcagcgccctgatccagcactggaggatccacactggagagaagccctatgaatgttctgaatgtgggaaggcctttgcccacagcagcaccctcatcgagcactggagggtgcacaccaaggagcggccctatgaatgtaatgaatgtgggaagttcttcagccagaacagcatcctgatcaagcaccagaaggtgcacactggagagaagccctacaagtgcagtgaatgtgggaagttcttcagcaggaagagcagcctcatctgccactggagggtgcacactggagagcggccctatgaatgttctgaatgtggccgggccttcagcagcaacagccacctggtgcgccaccagagggtgcacacccaggagcggccctatgagtgcatccagtgtgggaaggccttcagcgagaggagcaccctggtgcgccaccagaaggtgcacacccgggagaggtag

SEQ ID NO: 176479 - DNA, 1965 bp, Artificial Sequence
  Description of Artificial Sequence: Synthetic coding sequence
atggccttcagagatgtggccgtggacttcacccaggatgagtggaggctgctgagccctgcccagaggaccctgtaccgggaggtgatgctggagaactacagcaacctggtgtccctgggcatctccttcagcaagccagagctgatcacccagctggagcagggcaaggagacctggagggaggagaagaagtgcagccctgccacctgcccagctgaccctgagcctgagctgtacctggaccccttctgccccccaggcttcagcagccagaagttccccatgcagcacgtgctgtgcaaccaccccccctggatcttcacctgcctgtgtgccgagggcaacatccagcccggggaccccggccctggggaccaggagaagcagcagcaggccagcgagggccggccctggagcgaccaggccgagggccctgagggggagggcgccatgcccctgtttggaagaaccaagaagaggaccctgggcgccttcagcaggcctccccagaggcagcctgtgagcagcagaaatggcctgcggggcgtggagctggaggccagccctgcccagagcggcaaccctgaggagacagacaagctgctgaagagaattgaggtgctgggctttggaacagtgaactgtggggagtgtggcctgtccttcagcaagatgaccaacctgctgagccaccagaggatccacagcggggagaagccctacgtgtgtggggtgtgtgagaagggcttcagcctgaagaagagcctggcccggcaccagaaggcccacagcggggagaagcccatcgtgtgccgggagtgtggccggggcttcaacaggaagagcaccctcatcatccacgagaggacccacagcggggagaagccctacatgtgcagtgaatgtggccggggcttcagccagaagagcaacctgatcatccaccagaggacccacagcggggagaagccctacgtgtgccgggagtgtgggaagggcttcagccagaagtctgctgtggtgcgccaccagaggacccacctggaggagaagaccatcgtgtgcagcgactgtggcctgggcttcagtgacaggagcaacctgatcagccaccagaggacccacagcggggagaagccctatgcctgcaaggaatgtggccgctgcttccggcagaggaccaccctggtgaaccaccagaggacccacagcaaggagaagccctacgtgtgtggggtgtgtggccacagcttcagccagaacagcaccctcatcagccacaggaggacccacactggagagaagccctacgtgtgtggggtgtgtggccggggcttcagcctgaagagccacctgaacagacaccagaacatccacagcggggagaagcccatcgtgtgcaaggactgtggccggggcttcagccagcagagcaacctgatccgccaccagaggacccacagcggggagaagcccatggtgtgtggggagtgtggccggggcttcagccagaagagcaacctggtggcccaccagaggacccacagcggggagcggccctacgtgtgccgggagtgtggccggggcttcagccaccaggccggcctcatccgccacaagaggaagcacagccgggagaagccctacatgtgccggcagtgtggcctgggctttggaaacaagagcgccctgatcacccacaagagggcccacagcgaggagaagccctgtgtgtgccgggagtgtggccagggcttcctgcagaagagccacctgaccctgcaccagatgacccacactggagagaagccctacgtgtgcaagacctgtggccggggcttcagcctgaagagccacctgagccgccacaggaagaccacctctgtgcaccaccggctgcctgtgcagcctgaccctgagccctgtgccggccagcccagcgacagcctgtacagcctgtag

SEQ ID NO: 176480 - DNA, 300 bp, Artificial Sequence
  Description of Artificial Sequence: Synthetic coding sequence
atggccttcagagatgtggccgtggacttcacccaggatgagtggaggctgctgagccctgcccagaggaccctgtaccgggaggtgatgctggagaactacagcaacctggtgtccctgggcatctccttcagcaagccagagctgatcacccagctggagcagggcaaggagacctggagggaggagaagaagtgcagccctgccacctgcccagaccaccaggagtatggcaacaactgtgacctgcagaaggaggccgaccctgagcctgagctgtacctggaccccttctgctag

SEQ ID NO: 176481 - DNA, 1962 bp, Artificial Sequence
  Description of Artificial Sequence: Synthetic coding sequence
atggccttcagagatgtggccgtggacttcacccaggatgagtggaggctgctgagccctgcccagaggaccctgtaccgggaggtgatgctggagaactacagcaacctggtgtccctgggcatctccttcagcaagccagagctgatcacccagctggagcagggcaaggagacctggagggaggagaagaagtgcagccctgccacctgcccagaccctgagcctgagctgtacctggaccccttctgccccccaggcttcagcagccagaagttccccatgcagcacgtgctgtgcaaccaccccccctggatcttcacctgcctgtgtgccgagggcaacatccagcccggggaccccggccctggggaccaggagaagcagcagcaggccagcgagggccggccctggagcgaccaggccgagggccctgagggggagggcgccatgcccctgtttggccgcaccaagaagaggaccctgggcgccttcagccggcccccccagaggcagcctgtgagcagcagaaatggcctgcggggcgtggagctggaggccagccctgcccagagcggcaaccctgaggagacagacaagctgctgaagagaattgaggtgctgggcttcggcaccgtgaactgtggagaatgtggcctgtccttcagcaagatgaccaacctgctgagccaccagaggatccacagcggggagaagccctacgtgtgtggggtgtgtgagaagggcttcagcctgaagaagagcctggcccggcaccagaaggcccacagcggggagaagcccatcgtgtgcagagaatgtggccggggcttcaacaggaagagcaccctcatcatccacgagaggacccacagcggggagaagccctacatgtgcagtgaatgtggccggggcttcagccagaagagcaacctgatcatccaccagaggacccacagcggggagaagccctacgtgtgcagagaatgtgggaagggcttcagccagaagtctgctgtggtgcgccaccagaggacccacctggaggagaagaccatcgtgtgcagcgactgtggcctgggcttcagtgacaggagcaacctgatcagccaccagaggacccacagcggggagaagccctatgcctgcaaggaatgtggccgctgcttccggcagaggaccaccctggtgaaccaccagaggacccacagcaaggagaagccctacgtgtgtggggtgtgtggccacagcttcagccagaacagcaccctcatcagccacaggaggacccacactggagagaagccctacgtgtgtggggtgtgtggccggggcttcagcctgaagagccacctgaacagacaccagaacatccacagcggggagaagcccatcgtgtgcaaggactgtggccggggcttcagccagcagagcaacctgatccgccaccagaggacccacagcggggagaagcccatggtgtgtggagaatgtggccggggcttcagccagaagagcaacctggtggcccaccagaggacccacagcggggagcggccctacgtgtgcagagaatgtggccggggcttcagccaccaggccggcctcatccgccacaagaggaagcacagccgggagaagccctacatgtgccggcagtgtggcctgggcttcggcaacaagagcgccctgatcacccacaagagggcccacagcgaggagaagccctgtgtgtgcagagaatgtggccagggcttcctgcagaagagccacctgaccctgcaccagatgacccacactggagagaagccctacgtgtgcaagacctgtggccggggcttcagcctgaagagccacctgagccgccacaggaagaccacctctgtgcaccaccggctgcctgtgcagcctgaccctgagccctgtgccggccagcccagcgacagcctgtacagcctgtag

SEQ ID NO: 176482 - DNA, 1974 bp, Artificial Sequence
  Description of Artificial Sequence: Synthetic coding sequence
atggcccacatggccttcagagatgtggccgtggacttcacccaggatgagtggaggctgctgagccctgcccagaggaccctgtaccgggaggtgatgctggagaactacagcaacctggtgtccctgggcatctccttcagcaagccagagctgatcacccagctggagcagggcaaggagacctggagggaggagaagaagtgcagccctgccacctgcccagctgaccctgagcctgagctgtacctggaccccttctgccccccaggcttcagcagccagaagttccccatgcagcacgtgctgtgcaaccaccccccctggatcttcacctgcctgtgtgccgagggcaacatccagcccggggaccccggccctggggaccaggagaagcagcagcaggccagcgagggccggccctggagcgaccaggccgagggccctgagggggagggcgccatgcccctgtttggccgcaccaagaagaggaccctgggcgccttcagccggcccccccagaggcagcctgtgagcagcagaaatggcctgcggggcgtggagctggaggccagccctgcccagagcggcaaccctgaggagacagacaagctgctgaagagaattgaggtgctgggcttcggcaccgtgaactgtggagaatgtggcctgtccttcagcaagatgaccaacctgctgagccaccagaggatccacagcggggagaagccctacgtgtgtggggtgtgtgagaagggcttcagcctgaagaagagcctggcccggcaccagaaggcccacagcggggagaagcccatcgtgtgcagagaatgtggccggggcttcaacaggaagagcaccctcatcatccacgagaggacccacagcggggagaagccctacatgtgcagtgaatgtggccggggcttcagccagaagagcaacctgatcatccaccagaggacccacagcggggagaagccctacgtgtgcagagaatgtgggaagggcttcagccagaagtctgctgtggtgcgccaccagaggacccacctggaggagaagaccatcgtgtgcagcgactgtggcctgggcttcagtgacaggagcaacctgatcagccaccagaggacccacagcggggagaagccctatgcctgcaaggaatgtggccgctgcttccggcagaggaccaccctggtgaaccaccagaggacccacagcaaggagaagccctacgtgtgtggggtgtgtggccacagcttcagccagaacagcaccctcatcagccacaggaggacccacactggagagaagccctacgtgtgtggggtgtgtggccggggcttcagcctgaagagccacctgaacagacaccagaacatccacagcggggagaagcccatcgtgtgcaaggactgtggccggggcttcagccagcagagcaacctgatccgccaccagaggacccacagcggggagaagcccatggtgtgtggagaatgtggccggggcttcagccagaagagcaacctggtggcccaccagaggacccacagcggggagcggccctacgtgtgcagagaatgtggccggggcttcagccaccaggccggcctcatccgccacaagaggaagcacagccgggagaagccctacatgtgccggcagtgtggcctgggcttcggcaacaagagcgccctgatcacccacaagagggcccacagcgaggagaagccctgtgtgtgcagagaatgtggccagggcttcctgcagaagagccacctgaccctgcaccagatgacccacactggagagaagccctacgtgtgcaagacctgtggccggggcttcagcctgaagagccacctgagccgccacaggaagaccacctctgtgcaccaccggctgcctgtgcagcctgaccctgagccctgtgccggccagcccagcgacagcctgtacagcctgtag

SEQ ID NO: 176483 - DNA, 1965 bp, Artificial Sequence; identical to SEQ ID NO: 176479
  Description of Artificial Sequence: Synthetic coding sequence

SEQ ID NO: 176484 - DNA, 1776 bp, Artificial Sequence
  Description of Artificial Sequence: Synthetic coding sequence
atgtgcaatggaaggaagacagtgctggccgaccctgagcctgagctgtacctggaccccttctgccccccaggcttcagcagccagaagttccccatgcagcacgtgctgtgcaaccaccccccctggatcttcacctgcctgtgtgccgagggcaacatccagcccggggaccccggccctggggaccaggagaagcagcagcaggccagcgagggccggccctggagcgaccaggccgagggccctgagggggagggcgccatgcccctgtttggccgcaccaagaagaggaccctgggcgccttcagccggcccccccagaggcagcctgtgagcagcagaaatggcctgcggggcgtggagctggaggccagccctgcccagagcggcaaccctgaggagacagacaagctgctgaagagaattgaggtgctgggcttcggcaccgtgaactgtggagaatgtggcctgtccttcagcaagatgaccaacctgctgagccaccagaggatccacagcggggagaagccctacgtgtgtggggtgtgtgagaagggcttcagcctgaagaagagcctggcccggcaccagaaggcccacagcggggagaagcccatcgtgtgcagagaatgtggccggggcttcaacaggaagagcaccctcatcatccacgagaggacccacagcggggagaagccctacatgtgcagtgaatgtggccggggcttcagccagaagagcaacctgatcatccaccagaggacccacagcggggagaagccctacgtgtgcagagaatgtgggaagggcttcagccagaagtctgctgtggtgcgccaccagaggacccacctggaggagaagaccatcgtgtgcagcgactgtggcctgggcttcagtgacaggagcaacctgatcagccaccagaggacccacagcggggagaagccctatgcctgcaaggaatgtggccgctgcttccggcagaggaccaccctggtgaaccaccagaggacccacagcaaggagaagccctacgtgtgtggggtgtgtggccacagcttcagccagaacagcaccctcatcagccacaggaggacccacactggagagaagccctacgtgtgtggggtgtgtggccggggcttcagcctgaagagccacctgaacagacaccagaacatccacagcggggagaagcccatcgtgtgcaaggactgtggccggggcttcagccagcagagcaacctgatccgccaccagaggacccacagcggggagaagcccatggtgtgtggagaatgtggccggggcttcagccagaagagcaacctggtggcccaccagaggacccacagcggggagcggccctacgtgtgcagagaatgtggccggggcttcagccaccaggccggcctcatccgccacaagaggaagcacagccgggagaagccctacatgtgccggcagtgtggcctgggcttcggcaacaagagcgccctgatcacccacaagagggcccacagcgaggagaagccctgtgtgtgcagagaatgtggccagggcttcctgcagaagagccacctgaccctgcaccagatgacccacactggagagaagccctacgtgtgcaagacctgtggccggggcttcagcctgaagagccacctgagccgccacaggaagaccacctctgtgcaccaccggctgcctgtgcagcctgaccctgagccctgtgccggccagcccagcgacagcctgtacagcctgtag

SEQ ID NO: 176485 - DNA, 540 bp, Artificial Sequence
  Description of Artificial Sequence: Synthetic coding sequence
atggccttcagagatgtggccgtggacttcacccaggatgagtggaggctgctgagccctgcccagaggaccctgtaccgggaggtgatgctggagaactacagcaacctggtgtccctgggcatctccttcagcaagccagagctgatcacccagctggagcagggcaaggagacctggagggaggagaagaagtgcagccctgccacctgcccagctgaccctgagcctgagctgtacctggaccccttctgccccccaggcttcagcagccagaagttccccatgcagcacgtgctgtgcaaccaccccccctggatcttcacctgcctgtgtgccgagggcaacatccagcccggggaccccggccctggggaccaggagaagcagcagcaggccagcgagggccggccctggagcgaccaggccgagggccctgagggggagggcgccatgcccctgtttggaagaaccaagaagaggaccctgggcgccttcagcaggcctccccagaggcagcctgtgagcagcaggaactag

SEQ ID NO: 176486 - DNA, 432 bp, Artificial Sequence
  Description of Artificial Sequence: Synthetic coding sequence
atggccttcagagatgtggccgtggacttcacccaggatgagtggaggctgctgagccctgcccagaggaccctgtaccgggaggtgatgctggagaactacagcaacctggtgtccctgggcatctccttcagcaagccagagctgatcacccagctggagcagggcaaggagacctggagggaggagaagaagtgcagccctgccacctgcccagctgaccctgagcctgagctgtacctggaccccttctgccccccaggcttcagcagccagaagttccccatgcagcacgtgctgtgcaaccaccccccctggatcttcacctgcctgtgtgccgagggcaacatccagcccggggaccccggccctggggaccaggagaagcagcagcaggccagcgagggccggccctggagcgaccaggcctag

SEQ ID NO: 176487 - DNA, 1680 bp, Artificial Sequence
  Description of Artificial Sequence: Synthetic coding sequence
atgcagcacgtgctgtgcaaccaccccccctggatcttcacctgcctgtgtgccgagggcaacatccagcccggggaccccggccctggggaccaggagaagcagcagcaggccagcgagggccggccctggagcgaccaggccgagggccctgagggggagggcgccatgcccctgtttggccgcaccaagaagaggaccctgggcgccttcagccggcccccccagaggcagcctgtgagcagcagaaatggcctgcggggcgtggagctggaggccagccctgcccagagcggcaaccctgaggagacagacaagctgctgaagagaattgaggtgctgggcttcggcaccgtgaactgtggagaatgtggcctgtccttcagcaagatgaccaacctgctgagccaccagaggatccacagcggggagaagccctacgtgtgtggggtgtgtgagaagggcttcagcctgaagaagagcctggcccggcaccagaaggcccacagcggggagaagcccatcgtgtgcagagaatgtggccggggcttcaacaggaagagcaccctcatcatccacgagaggacccacagcggggagaagccctacatgtgcagtgaatgtggccggggcttcagccagaagagcaacctgatcatccaccagaggacccacagcggggagaagccctacgtgtgcagagaatgtgggaagggcttcagccagaagtctgctgtggtgcgccaccagaggacccacctggaggagaagaccatcgtgtgcagcgactgtggcctgggcttcagtgacaggagcaacctgatcagccaccagaggacccacagcggggagaagccctatgcctgcaaggaatgtggccgctgcttccggcagaggaccaccctggtgaaccaccagaggacccacagcaaggagaagccctacgtgtgtggggtgtgtggccacagcttcagccagaacagcaccctcatcagccacaggaggacccacactggagagaagccctacgtgtgtggggtgtgtggccggggcttcagcctgaagagccacctgaacagacaccagaacatccacagcggggagaagcccatcgtgtgcaaggactgtggccggggcttcagccagcagagcaacctgatccgccaccagaggacccacagcggggagaagcccatggtgtgtggagaatgtggccggggcttcagccagaagagcaacctggtggcccaccagaggacccacagcggggagcggccctacgtgtgcagagaatgtggccggggcttcagccaccaggccggcctcatccgccacaagaggaagcacagccgggagaagccctacatgtgccggcagtgtggcctgggcttcggcaacaagagcgccctgatcacccacaagagggcccacagcgaggagaagccctgtgtgtgcagagaatgtggccagggcttcctgcagaagagccacctgaccctgcaccagatgacccacactggagagaagccctacgtgtgcaagacctgtggccggggcttcagcctgaagagccacctgagccgccacaggaagaccacctctgtgcaccaccggctgcctgtgcagcctgaccctgagccctgtgccggccagcccagcgacagcctgtacagcctgtag

SEQ ID NO: 176488 - DNA, 1680 bp, Artificial Sequence; identical to SEQ ID NO: 176487
  Description of Artificial Sequence: Synthetic coding sequence

SEQ ID NO: 176489 - DNA, 1284 bp, Artificial Sequence
  Description of Artificial Sequence: Synthetic coding sequence
atgaccctggtgacagctgggggcgcctggacaggccctggctgctggcatgaggtgaaggatgaggagagcagcagcgagcagagcatcagcattgctgtgagccacgtgaacaccagcaaggccggcctgcctgcccagacagccctgccctgtgacatctgtggccccatcctgaaggacatcctgcacctggatgagcaccagggcacccaccacggcctgaagctgcacacctgtggggcctgtggccggcagttctggttcagcgccaacctgcaccagtaccagaagtgctacagcattgagcagcccctgcggcgggacaagtctgaggccagcatcgtgaagaactgcaccgtgtccaaggagccccaccccagcgagaagcccttcacctgcaaggaggagcagaagaacttccaggccaccctgggcggctgccagcagaaggccatccacagcaagaggaagacccacaggagcacagaaagtggagatgccttccacggggagcagatgcactacaagtgcagtgaatgtgggaaggccttcagcaggaaggacaccctggtgcagcaccagaggatccacagcggggagaagccctatgaatgttctgaatgtgggaaggccttcagcaggaaggccaccctggtgcagcaccagaggatccacactggagagcggccctatgaatgttctgaatgtgggaagaccttcagcaggaaggacaacctgacccagcacaagaggatccacactggagagatgccctacaagtgcaatgaatgtgggaagtacttcagccaccacagcaacctgattgtgcaccagagggtgcacaatggagcccggccctacaagtgcagcgactgtgggaaggtgttccgccacaagagcaccctggtgcagcacgagagcatccacactggagagaacccctatgactgcagcgactgtgggaagagctttggccacaagtacaccctcatcaagcaccagaggatccacacagagagcaagccctttgaatgtattgaatgtgggaagttcttcagccgcagcagtgactacatcgcccaccagagggtgcacactggagagcggccctttgtgtgcagcaaatgtgggaaggacttcatccgcaccagccacctggtgcgccaccagagggtgcacactggagagcggccctatgaatgttctgaatgtgggaaggcctacagcctgagcagccacctgaacagacaccagaaggtgcacacagctggccgcctgtag

SEQ ID NO: 176490 - DNA, 1485 bp, Artificial Sequence
  Description of Artificial Sequence: Synthetic coding sequence
ctgcgctggaaccacaggagccgcagcagcggcctgctgggcggcagcgaggtgacagaagctgggggctgcggccgcagccgctgcagcctgtgtggggtggcccggcagaggcggccccggctgcggccccggggccgcaccacagctgtgcccggcagccgggacctgggccccccccggggcagcggctggagcaccaactgtgatggcggcggcagaggagatggccctggggccggctgctggcatgaggtgaaggatgaggagagcagcagcgagcagagcatcagcattgctgtgagccacgtgaacaccagcaaggccggcctgcctgcccagacagccctgccctgtgacatctgtggccccatcctgaaggacatcctgcacctggatgagcaccagggcacccaccacggcctgaagctgcacacctgtggggcctgtggccggcagttctggttcagcgccaacctgcaccagtaccagaagtgctacagcattgagcagcccctgcggcgggacaagtctgaggccagcatcgtgaagaactgcaccgtgtccaaggagccccaccccagcgagaagcccttcacctgcaaggaggagcagaagaacttccaggccaccctgggcggctgccagcagaaggccatccacagcaagaggaagacccacaggagcacagagagcggagatgccttccatggagagcagatgcactacaagtgcagtgaatgtgggaaggccttcagcaggaaggacaccctggtgcagcaccagaggatccacagcggggagaagccctatgagtgcagtgaatgtgggaaggccttcagcaggaaggccaccctggtgcagcaccagaggatccacactggagagcggccctatgagtgcagtgaatgtgggaagaccttcagcaggaaggacaacctgacccagcacaagaggatccacactggagagatgccctacaagtgcaatgaatgtgggaagtacttcagccaccacagcaacctgattgtgcaccagagggtgcacaacggggcccggccctacaagtgcagcgactgtgggaaggtgttccgccacaagagcaccctggtgcagcacgagagcatccacactggagagaacccctatgactgcagcgactgtgggaagagctttggccacaagtacaccctcatcaagcaccagaggatccacacagagagcaagccctttgagtgcattgaatgtgggaagttcttcagccgcagcagtgactacatcgcccaccagagggtgcacactggagagcggccctttgtgtgcagcaaatgtgggaaggacttcatccgcaccagccacctggtgcgccaccagagggtgcacactggagagcggccctatgagtgcagtgaatgtgggaaggcctacagcctgagcagccacctgaacagacaccagaaggtgcacacagctggccgcctgtag

SEQ ID NO: 176491 - DNA, 1044 bp, Artificial Sequence
  Description of Artificial Sequence: Synthetic coding sequence
atgtggggcatgtgggagaccatcctggtgcagtgcctgcaccagtaccagaagtgctacagcattgagcagcccctgcggcgggacaagtctgaggccagcatcgtgaagaactgcaccgtgtccaaggagccccaccccagcgagaagcccttcacctgcaaggaggagcagaagaacttccaggccaccctgggcggctgccagcagaaggccatccacagcaagaggaagacccacaggagcacagaaagtggagatgccttccacggggagcagatgcactacaagtgcagtgaatgtgggaaggccttcagcaggaaggacaccctggtgcagcaccagaggatccacagcggggagaagccctatgaatgttctgaatgtgggaaggccttcagcaggaaggccaccctggtgcagcaccagaggatccacactggagagcggccctatgaatgttctgaatgtgggaagaccttcagcaggaaggacaacctgacccagcacaagaggatccacactggagagatgccctacaagtgcaatgaatgtgggaagtacttcagccaccacagcaacctgattgtgcaccagagggtgcacaatggagcccggccctacaagtgcagcgactgtgggaaggtgttccgccacaagagcaccctggtgcagcacgagagcatccacactggagagaacccctatgactgcagcgactgtgggaagagctttggccacaagtacaccctcatcaagcaccagaggatccacacagagagcaagccctttgaatgtattgaatgtgggaagttcttcagccgcagcagtgactacatcgcccaccagagggtgcacactggagagcggccctttgtgtgcagcaaatgtgggaaggacttcatccgcaccagccacctggtgcgccaccagagggtgcacactggagagcggccctatgaatgttctgaatgtgggaaggcctacagcctgagcagccacctgaacagacaccagaaggtgcacacagctggccgcctgtag

SEQ ID NO: 176492 - DNA, 1977 bp, Artificial Sequence
  Description of Artificial Sequence: Synthetic coding sequence
atgaccccaggagtgcgggtgtccacagatcctgagcaggtgacctttgaagatgtggtggtgggcttcagccaggaggagtggggccagctgaagccagcccagaggaccctgtacagagatgtgatgctggacaccttccggctgctggtgtctgtgggccactggctgcccaagcccaacgtcatcagcctgctggagcaggaggccgagctgtgggccgtggagagccggctgccccagggcgtgtacccagacctggagacccggcccaaggtgaagctgtctgtgctgaagcagggcatcagcgaggagatcagcaacagcgtcatcctggtggagcgcttcctgtgggatggcctgtggtactgcagaggagaggacacagagggccactgggagtggagctgtgagagcctggagagcctggccgtgcctgtggccttcacccctgtgaagacccctgtgctggagcagtggcagagaaatggatttggagagaacatcagcctgaacccagacctgccccaccagcccatgaccccagagcggcagagcccccacacctggggcacccggggcaagcgggagaagccagacctgaatgtgctgcagaagacctgtgtgaaggagaagccctacaagtgccaggagtgtgggaaggccttcagccacagcagcgccctgattgagcaccacaggacccacactggagagcggccctatgaatgtcatgagtgcctgaagggcttcaggaacagcagcgccctgaccaagcaccagaggatccacactggagagaagccctacaagtgcacccagtgtggccgcaccttcaaccagatcgcccccctcatccagcaccagaggacccacactggagagaagccctatgaatgttctgaatgtgggaagagcttctccttccgcagcagcttcagccagcacgagaggacccacactggagagaagccctatgaatgttctgaatgtgggaaggccttccggcagagcatccacctgacccagcacctgcgcatccacactggagagaagccctaccagtgtggggagtgtgggaaggccttcagccacagcagcagcctgaccaagcaccagaggatccacactggagagaagccctatgaatgtcatgaatgtgggaaggccttcacccagatcacccccctcatccagcaccagaggacccacactggagagaagccctatgaatgtggggagtgtgggaaggccttcagccagagcaccctgctgacagagcaccggcgcatccacactggagagaagccctacggctgcaatgaatgtgggaagaccttcagccacagcagcagcctgagccagcacgagaggacccacactggagagaagccctatgaatgttcccagtgtgggaaggccttccggcagagcacccacctgacccagcaccagaggatccacactggagagaagccctatgaatgtaatgactgtgggaaggccttcagccacagcagcagcctgaccaagcaccagaggatccacactggagagaagccctatgagtgcaaccagtgtggccgggccttcagccagctggcccccctcatccagcaccagaggatccacactggagagaagccctatgagtgcaaccagtgtggccgggccttcagccagagcagcctgctgattgagcaccagaggatccacaccaaggagaagccctacggctgcaatgaatgtgggaagagcttcagccacagcagcagcctgagccagcacgagaggacccacactggagagaagccctatgaatgtcatgactgtgggaagagcttccggcagagcacccacctgacccagcaccggcgcatccacactggagagaagccctatgcctgccgggactgtgggaaggccttcacccacagcagcagcctgaccaagcaccagaggacccacactggatag

SEQ ID NO: 176493 - DNA, 1173 bp, Artificial Sequence
  Description of Artificial Sequence: Synthetic coding sequence
atggagctgggcagcagaagaagatctgtgggctgccgctgccggggcctgtgcctggccgtgcggcgggagcaggtgacctttgaagatgtggtggtgggcttcagccaggaggagtggggccagctgaagccagcccagaggaccctgtacagagatgtgatgctggacaccttccggctgctggtgtctgtgggccactggctgcccaagcccaacgtcatcagcctgctggagcaggaggccgagctgtgggccgtggagagccggctgccccagggcgtgtacccagacctggagacccggcccaaggtgaagctgtctgtgctgaagcagggcatcagcgaggagatcagcaacagcgtcatcctggtggagcgcttcctgtgggatggcctgtggtactgcagaggagaggacacagagggccactgggagtggagctgtgagagcctggagagcctggccgtgcctgtggccttcacccctgtgaagacccctgtgctggagcagtggcagagaaatggatttggagagaacatcagcctgaacccagacctgccccaccagcccatgaccccagagcggcagagcccccacacctggggcacccggggcaagcgggagaagccagacctgaatgtgctgcagaagacctgtgtgaaggagaagccctacaagtgccaggagtgtgggaaggccttcagccacagcagcgccctgattgagcaccacaggacccacactggagagcggccctatgaatgtcatgagtgcctgaagggcttcaggaacagcagcgccctgaccaagcaccagaggatccacactggagagaagccctacaagtgcacccagtgtggccgcaccttcaaccagatcgcccccctcatccagcaccagaggacccacactggagagaagccctatgaatgttctgaatgtgggaagagcttctccttccgcagcagcttcagccagcacgagaggacccacactggagagaagccctatgaatgttctgaatgtgggaaggccttccggcagagcatccacctgacccagcacctgcgcatccacactggagagaagccctaccagtgtggggagtgtgggaaggccttcacccacagcagcagcctgaccaagcaccagaggacccacactggatag

SEQ ID NO: 176494 - DNA, 2049 bp, Artificial Sequence
  Description of Artificial Sequence: Synthetic coding sequence
atggagctgggcagcagaagaagatctgtgggctgccgctgccggggcctgtgcctggccgtgcggcgggagcaggtgacctttgaagatgtggtggtgggcttcagccaggaggagtggggccagctgaagccagcccagaggaccctgtacagagatgtgatgctggacaccttccggctgctggtgtctgtgggccactggctgcccaagcccaacgtcatcagcctgctggagcaggaggccgagctgtgggccgtggagagccggctgccccagggcgtgtacccagagatcaagggccacttccagttcctgctgctgagtgacctggagacccggcccaaggtgaagctgtctgtgctgaagcagggcatcagcgaggagatcagcaacagcgtcatcctggtggagcgcttcctgtgggatggcctgtggtactgcagaggagaggacacagagggccactgggagtggagctgtgagagcctggagagcctggccgtgcctgtggccttcacccctgtgaagacccctgtgctggagcagtggcagagaaatggatttggagagaacatcagcctgaacccagacctgccccaccagcccatgaccccagagcggcagagcccccacacctggggcacccggggcaagcgggagaagccagacctgaatgtgctgcagaagacctgtgtgaaggagaagccctacaagtgccaggagtgtgggaaggccttcagccacagcagcgccctgattgagcaccacaggacccacactggagagcggccctatgaatgtcatgagtgcctgaagggcttcaggaacagcagcgccctgaccaagcaccagaggatccacactggagagaagccctacaagtgcacccagtgtggccgcaccttcaaccagatcgcccccctcatccagcaccagaggacccacactggagagaagccctatgaatgttctgaatgtgggaagagcttctccttccgcagcagcttcagccagcacgagaggacccacactggagagaagccctatgaatgttctgaatgtgggaaggccttccggcagagcatccacctgacccagcacctgcgcatccacactggagagaagccctaccagtgtggggagtgtgggaaggccttcagccacagcagcagcctgaccaagcaccagaggatccacactggagagaagccctatgaatgtcatgaatgtgggaaggccttcacccagatcacccccctcatccagcaccagaggacccacactggagagaagccctatgaatgtggggagtgtgggaaggccttcagccagagcaccctgctgacagagcaccggcgcatccacactggagagaagccctacggctgcaatgaatgtgggaagaccttcagccacagcagcagcctgagccagcacgagaggacccacactggagagaagccctatgaatgttcccagtgtgggaaggccttccggcagagcacccacctgacccagcaccagaggatccacactggagagaagccctatgaatgtaatgactgtgggaaggccttcagccacagcagcagcctgaccaagcaccagaggatccacactggagagaagccctatgagtgcaaccagtgtggccgggccttcagccagctggcccccctcatccagcaccagaggatccacactggagagaagccctatgagtgcaaccagtgtggccgggccttcagccagagcagcctgctgattgagcaccagaggatccacaccaaggagaagccctacggctgcaatgaatgtgggaagagcttcagccacagcagcagcctgagccagcacgagaggacccacactggagagaagccctatgaatgtcatgactgtgggaagagcttccggcagagcacccacctgacccagcaccggcgcatccacactggagagaagccctatgcctgccgggactgtgggaaggccttcacccacagcagcagcctgaccaagcaccagaggacccacactggatag

SEQ ID NO: 176495 - DNA, 1977 bp, Artificial Sequence; identical to SEQ ID NO: 176492
  Description of Artificial Sequence: Synthetic coding sequence

SEQ ID NO: 176496 - DNA, 1851 bp, Artificial Sequence
  Description of Artificial Sequence: Synthetic coding sequence
atgctggacaccttccggctgctggtgtctgtgggccactggctgcccaagcccaacgtcatcagcctgctggagcaggaggccgagctgtgggccgtggagagccggctgccccagggcgtgtacccagacctggagacccggcccaaggtgaagctgtctgtgctgaagcagggcatcagcgaggagatcagcaacagcgtcatcctggtggagcgcttcctgtgggatggcctgtggtactgcagaggagaggacacagagggccactgggagtggagctgtgagagcctggagagcctggccgtgcctgtggccttcacccctgtgaagacccctgtgctggagcagtggcagagaaatggatttggagagaacatcagcctgaacccagacctgccccaccagcccatgaccccagagcggcagagcccccacacctggggcacccggggcaagcgggagaagccagacctgaatgtgctgcagaagacctgtgtgaaggagaagccctacaagtgccaggagtgtgggaaggccttcagccacagcagcgccctgattgagcaccacaggacccacactggagagcggccctatgaatgtcatgagtgcctgaagggcttcaggaacagcagcgccctgaccaagcaccagaggatccacactggagagaagccctacaagtgcacccagtgtggccgcaccttcaaccagatcgcccccctcatccagcaccagaggacccacactggagagaagccctatgaatgttctgaatgtgggaagagcttctccttccgcagcagcttcagccagcacgagaggacccacactggagagaagccctatgaatgttctgaatgtgggaaggccttccggcagagcatccacctgacccagcacctgcgcatccacactggagagaagccctaccagtgtggggagtgtgggaaggccttcagccacagcagcagcctgaccaagcaccagaggatccacactggagagaagccctatgaatgtcatgaatgtgggaaggccttcacccagatcacccccctcatccagcaccagaggacccacactggagagaagccctatgaatgtggggagtgtgggaaggccttcagccagagcaccctgctgacagagcaccggcgcatccacactggagagaagccctacggctgcaatgaatgtgggaagaccttcagccacagcagcagcctgagccagcacgagaggacccacactggagagaagccctatgaatgttcccagtgtgggaaggccttccggcagagcacccacctgacccagcaccagaggatccacactggagagaagccctatgaatgtaatgactgtgggaaggccttcagccacagcagcagcctgaccaagcaccagaggatccacactggagagaagccctatgagtgcaaccagtgtggccgggccttcagccagctggcccccctcatccagcaccagaggatccacactggagagaagccctatgagtgcaaccagtgtggccgggccttcagccagagcagcctgctgattgagcaccagaggatccacaccaaggagaagccctacggctgcaatgaatgtgggaagagcttcagccacagcagcagcctgagccagcacgagaggacccacactggagagaagccctatgaatgtcatgactgtgggaagagcttccggcagagcacccacctgacccagcaccggcgcatccacactggagagaagccctatgcctgccgggactgtgggaaggccttcacccacagcagcagcctgaccaagcaccagaggacccacactggatag

SEQ ID NO: 176497 - DNA, 2013 bp, Artificial Sequence
  Description of Artificial Sequence: Synthetic coding sequence
atgaccccaggagtgcgggtgtccacagatcctgagcaggtgacctttgaagatgtggtggtgggcttcagccaggaggagtggggccagctgaagccagcccagaggaccctgtacagagatgtgatgctggacaccttccggctgctggtgtctgtgggccactggctgcccaagcccaacgtcatcagcctgctggagcaggaggccgagctgtgggccgtggagagccggctgccccagggcgtgtacccagagatcaagggccacttccagttcctgctgctgagtgacctggagacccggcccaaggtgaagctgtctgtgctgaagcagggcatcagcgaggagatcagcaacagcgtcatcctggtggagcgcttcctgtgggatggcctgtggtactgcagaggagaggacacagagggccactgggagtggagctgtgagagcctggagagcctggccgtgcctgtggccttcacccctgtgaagacccctgtgctggagcagtggcagagaaatggatttggagagaacatcagcctgaacccagacctgccccaccagcccatgaccccagagcggcagagcccccacacctggggcacccggggcaagcgggagaagccagacctgaatgtgctgcagaagacctgtgtgaaggagaagccctacaagtgccaggagtgtgggaaggccttcagccacagcagcgccctgattgagcaccacaggacccacactggagagcggccctatgaatgtcatgagtgcctgaagggcttcaggaacagcagcgccctgaccaagcaccagaggatccacactggagagaagccctacaagtgcacccagtgtggccgcaccttcaaccagatcgcccccctcatccagcaccagaggacccacactggagagaagccctatgaatgttctgaatgtgggaagagcttctccttccgcagcagcttcagccagcacgagaggacccacactggagagaagccctatgaatgttctgaatgtgggaaggccttccggcagagcatccacctgacccagcacctgcgcatccacactggagagaagccctaccagtgtggggagtgtgggaaggccttcagccacagcagcagcctgaccaagcaccagaggatccacactggagagaagccctatgaatgtcatgaatgtgggaaggccttcacccagatcacccccctcatccagcaccagaggacccacactggagagaagccctatgaatgtggggagtgtgggaaggccttcagccagagcaccctgctgacagagcaccggcgcatccacactggagagaagccctacggctgcaatgaatgtgggaagaccttcagccacagcagcagcctgagccagcacgagaggacccacactggagagaagccctatgaatgttcccagtgtgggaaggccttccggcagagcacccacctgacccagcaccagaggatccacactggagagaagccctatgaatgtaatgactgtgggaaggccttcagccacagcagcagcctgaccaagcaccagaggatccacactggagagaagccctatgagtgcaaccagtgtggccgggccttcagccagctggcccccctcatccagcaccagaggatccacactggagagaagccctatgagtgcaaccagtgtggccgggccttcagccagagcagcctgctgattgagcaccagaggatccacaccaaggagaagccctacggctgcaatgaatgtgggaagagcttcagccacagcagcagcctgagccagcacgagaggacccacactggagagaagccctatgaatgtcatgactgtgggaagagcttccggcagagcacccacctgacccagcaccggcgcatccacactggagagaagccctatgcctgccgggactgtgggaaggccttcacccacagcagcagcctgaccaagcaccagaggacccacactggatag

SEQ ID NO: 176498 - DNA, 2031 bp, Artificial Sequence
  Description of Artificial Sequence: Synthetic coding sequence
tgaagatctgtgggctgccgctgccggggcctgtgcctggccgtgcggcgggagcaggtgacctttgaagatgtggtggtgggcttcagccaggaggagtggggccagctgaagccagcccagaggaccctgtacagagatgtgatgctggacaccttccggctgctggtgtctgtgggccactggctgcccaagcccaacgtcatcagcctgctggagcaggaggccgagctgtgggccgtggagagccggctgccccagggcgtgtacccagagatcaagggccacttccagttcctgctgctgagtgacctggagacccggcccaaggtgaagctgtctgtgctgaagcagggcatcagcgaggagatcagcaacagcgtcatcctggtggagcgcttcctgtgggatggcctgtggtactgcagaggagaggacacagagggccactgggagtggagctgtgagagcctggagagcctggccgtgcctgtggccttcacccctgtgaagacccctgtgctggagcagtggcagagaaatggatttggagagaacatcagcctgaacccagacctgccccaccagcccatgaccccagagcggcagagcccccacacctggggcacccggggcaagcgggagaagccagacctgaatgtgctgcagaagacctgtgtgaaggagaagccctacaagtgccaggagtgtgggaaggccttcagccacagcagcgccctgattgagcaccacaggacccacactggagagcggccctatgaatgtcatgagtgcctgaagggcttcaggaacagcagcgccctgaccaagcaccagaggatccacactggagagaagccctacaagtgcacccagtgtggccgcaccttcaaccagatcgcccccctcatccagcaccagaggacccacactggagagaagccctatgaatgttctgaatgtgggaagagcttctccttccgcagcagcttcagccagcacgagaggacccacactggagagaagccctatgaatgttctgaatgtgggaaggccttccggcagagcatccacctgacccagcacctgcgcatccacactggagagaagccctaccagtgtggggagtgtgggaaggccttcagccacagcagcagcctgaccaagcaccagaggatccacactggagagaagccctatgaatgtcatgaatgtgggaaggccttcacccagatcacccccctcatccagcaccagaggacccacactggagagaagccctatgaatgtggggagtgtgggaaggccttcagccagagcaccctgctgacagagcaccggcgcatccacactggagagaagccctacggctgcaatgaatgtgggaagaccttcagccacagcagcagcctgagccagcacgagaggacccacactggagagaagccctatgaatgttcccagtgtgggaaggccttccggcagagcacccacctgacccagcaccagaggatccacactggagagaagccctatgaatgtaatgactgtgggaaggccttcagccacagcagcagcctgaccaagcaccagaggatccacactggagagaagccctatgagtgcaaccagtgtggccgggccttcagccagctggcccccctcatccagcaccagaggatccacactggagagaagccctatgagtgcaaccagtgtggccgggccttcagccagagcagcctgctgattgagcaccagaggatccacaccaaggagaagccctacggctgcaatgaatgtgggaagagcttcagccacagcagcagcctgagccagcacgagaggacccacactggagagaagccctatgaatgtcatgactgtgggaagagcttccggcagagcacccacctgacccagcaccggcgcatccacactggagagaagccctatgcctgccgggactgtgggaaggccttcacccacagcagcagcctgaccaagcaccagaggacccacactggatag

SEQ ID NO: 176499 - DNA, 1623 bp, Artificial Sequence
  Description of Artificial Sequence: Synthetic coding sequence
atggattctgtggcctttgaagatgtggatgtgaacttcacccaggaggagtgggccctgctggaccccagccagaagaacctgtacagagatgtgatgtgggagaccatgaggaacctggccagcatcggcaagaagtggaaggaccagaacatcaaggaccactacaagcaccggggcaggaacctgcggagccacatgctggagcggctgtaccagaccaaggatggcagccagagaggaggcatcttcagccagtttgccaaccagaacctgagcaagaagatccctggggtgaagctgtgtgagagcatcgtgtatggagaggtgtccatgggccagagcagcctgaacagacacatcaaggaccacagcggccacgagcccaaggagtaccaggagtatggagagaagccagacaccaggaaccagtgctggaagcccttcagcagccaccacagcttccgcacccatgagatcatccacactggagagaagctgtatgactgcaaggaatgtgggaagaccttcttcagcctgaagaggatccgccgccacatcatcacccacagcggctacaccccctacaagtgcaaggtgtgtgggaaggcctttgactaccccagccgcttccgcacccatgagaggagccacactggagagaagccctatgagtgccaggagtgtgggaaggccttcacctgcatcacctctgtgcggcggcacatgatcaagcacactggagatggcccctacaagtgcaaggtgtgtgggaagcccttccacagcctgagcagcttccaggtgcatgagcgcatccacactggagagaagcccttcaagtgcaagcagtgtgggaaggccttcagctgcagccccaccctgcgcatccacgagaggacccacactggagagaagccctatgagtgcaagcagtgtgggaaggccttctcctacctgcccagcctgcggctgcacgagcgcatccacactggagagaagccctttgtgtgcaagcagtgtgggaaggccttccgcagcgccagcaccttccagatccacgagaggacccacactggagagaagccctatgagtgcaaggaatgtggggaggccttcagctgcatccccagcatgaggaggcacatgatcaagcacactggagagggcccctacaagtgcaaggtgtgtgggaagcccttccacagcctgagccccttccgcatccacgagaggacccacactggagagaagccctacgtgtgcaagcactgcggcaaggcctttgtgagcagcaccagcatccgcatccacgagaggacccacactggagagaagccctatgagtgcaagcagtgtgggaaggccttctcctacctgaacagcttccgcacccatgagatgatccacactggagagaagccctttgagtgcaagagatgtgggaaggccttccgcagcagcagcagcttccggctgcacgagaggacccacacaggccagaagccctaccactgcaaggaatgtgggaaggcctacagctgccgggccagcttccagaggcacatgctgacccatgctgaagatggccccccctacaagtgcatgtgggagagcctgtag

SEQ ID NO: 176500 - DNA, 1425 bp, Artificial Sequence
  Description of Artificial Sequence: Synthetic coding sequence
atgctggagcggctgtaccagaccaaggatggcagccagagaggaggcatcttcagccagtttgccaaccagaacctgagcaagaagatccctggggtgaagctgtgtgagagcatcgtgtatggagaggtgtccatgggccagagcagcctgaacagacacatcaaggaccacagcggccacgagcccaaggagtaccaggagtatggagagaagccagacaccaggaaccagtgctggaagcccttcagcagccaccacagcttccgcacccatgagatcatccacactggagagaagctgtatgactgcaaggaatgtgggaagaccttcttcagcctgaagaggatccgccgccacatcatcacccacagcggctacaccccctacaagtgcaaggtgtgtgggaaggcctttgactaccccagccgcttccgcacccatgagaggagccacactggagagaagccctatgagtgccaggagtgtgggaaggccttcacctgcatcacctctgtgcggcggcacatgatcaagcacactggagatggcccctacaagtgcaaggtgtgtgggaagcccttccacagcctgagcagcttccaggtgcatgagcgcatccacactggagagaagcccttcaagtgcaagcagtgtgggaaggccttcagctgcagccccaccctgcgcatccacgagaggacccacactggagagaagccctatgagtgcaagcagtgtgggaaggccttctcctacctgcccagcctgcggctgcacgagcgcatccacactggagagaagccctttgtgtgcaagcagtgtgggaaggccttccgcagcgccagcaccttccagatccacgagaggacccacactggagagaagccctatgagtgcaaggaatgtggggaggccttcagctgcatccccagcatgaggaggcacatgatcaagcacactggagagggcccctacaagtgcaaggtgtgtgggaagcccttccacagcctgagccccttccgcatccacgagaggacccacactggagagaagccctacgtgtgcaagcactgcggcaaggcctttgtgagcagcaccagcatccgcatccacgagaggacccacactggagagaagccctatgagtgcaagcagtgtgggaaggccttctcctacctgaacagcttccgcacccatgagatgatccacactggagagaagccctttgagtgcaagagatgtgggaaggccttccgcagcagcagcagcttccggctgcacgagaggacccacacaggccagaagccctaccactgcaaggaatgtgggaaggcctacagctgccgggccagcttccagaggcacatgctgacccatgctgaagatggccccccctacaagtgcatgtgggagagcctgtag

SEQ ID NO: 176501 - DNA, 960 bp, Artificial Sequence
  Description of Artificial Sequence: Synthetic coding sequence
atgggccccctgaccttcatggatgtggccatcgagttcagcctggaggagtggcagtgcctggacacagcccagagaaatgtgtacagacatgtgatgctggagaactacagaaacctggtgttcctggacctgatcacctgcctggagcagggcaaggagccctggaacatgaagagacatgagatggtggtggccaagcacagcgccctgtgcagcagatttgcccaggacctgtggctggagcagaacatcaaggacagcttccagaaggtgaccctgagccgctatggcaagtatggccacaagaacctgcagctgaggaagggctgcaagtctgtggatgagtgcaagggccaccagggcggcttcaacggcctgaaccagtgcctgaagatcaccaccagcaagatcttccagtgcaacaagtatgtgaaggtgatgcacaagttcagcaacagcaacagacacaagatccgccacacagagaacaagcacttccgctgcaaggaatgtgacaagagcctgtgcatgctgagccggctgacccagcacaagaagatccacacccgggagaacttctacaagtgtgaagaatgtgggaagaccttcaactggagcaccaacctgagcaagcccaagaagatccacactggagagaagccctacaagtgtgaggtgtgtgggaaggccttccaccagagcagcatcctgaccaagcacaagatcatcagaactggagagaagccctacaagtgtgcccactgtgggaaggccttcaagcagagcagccacctgaccaggcacaagatcatccacacagaggagaagccctacaagtgtgagcagtgtgggaaggtgttcaagcagagccccaccctgaccaagcaccagatcatctacaccggggaggagccctacaagtgtgaagaatgtgggaaggccttcaacctgtcctag

SEQ ID NO: 176502 - DNA, 789 bp, Artificial Sequence
  Description of Artificial Sequence: Synthetic coding sequence
atgaagagacatgagatggtggtggccaagcacagcgccctgtgcagcagatttgcccaggacctgtggctggagcagaacatcaaggacagcttccagaaggtgaccctgagccgctatggcaagtatggccacaagaacctgcagctgaggaagggctgcaagtctgtggatgaatgtaaaggccaccagggcggcttcaacggcctgaaccagtgcctgaagatcaccaccagcaagatcttccagtgcaacaagtatgtgaaggtgatgcacaagttcagcaacagcaacagacacaagatccgccacacagagaacaagcacttccgctgcaaggaatgtgacaagagcctgtgcatgctgagccggctgacccagcacaagaagatccacacccgggagaacttctacaagtgtgaggagtgtgggaagaccttcaactggagcaccaacctgagcaagcccaagaagatccacactggagagaagccctacaagtgtgaggtgtgtgggaaggccttccaccagagcagcatcctgaccaagcacaagatcatcagaactggagagaagccctacaagtgtgcccactgcggcaaggccttcaagcagagcagccacctgaccaggcacaagatcatccacacagaggagaagccctacaagtgtgagcagtgtgggaaggtgttcaagcagagccccaccctgaccaagcaccagatcatctacacaggagaggagccctacaagtgtgaggagtgtgggaaggccttcaacctgtcctag

SEQ ID NO: 176503 - DNA, 789 bp, Artificial Sequence; identical to SEQ ID NO: 176502
  Description of Artificial Sequence: Synthetic coding sequence

SEQ ID NO: 176504 - DNA, 864 bp, Artificial Sequence
  Description of Artificial Sequence: Synthetic coding sequence
atggatgtggccatcgagttcagcctggaggagtggcagtgcctggacacagcccagagaaatgtgtacagacatgtgatgctggagaactacagaaacctggtgttcctggccctgtgcagcagatttgcccaggacctgtggctggagcagaacatcaaggacagcttccagaaggtgaccctgagccgctatggcaagtatggccacaagaacctgcagctgaggaagggctgcaagtctgtggatgagtgcaagggccaccagggcggcttcaacggcctgaaccagtgcctgaagatcaccaccagcaagatcttccagtgcaacaagtatgtgaaggtgatgcacaagttcagcaacagcaacagacacaagatccgccacacagagaacaagcacttccgctgcaaggaatgtgacaagagcctgtgcatgctgagccggctgacccagcacaagaagatccacacccgggagaacttctacaagtgtgaagaatgtgggaagaccttcaactggagcaccaacctgagcaagcccaagaagatccacactggagagaagccctacaagtgtgaggtgtgtgggaaggccttccaccagagcagcatcctgaccaagcacaagatcatcagaactggagagaagccctacaagtgtgcccactgtgggaaggccttcaagcagagcagccacctgaccaggcacaagatcatccacacagaggagaagccctacaagtgtgagcagtgtgggaaggtgttcaagcagagccccaccctgaccaagcaccagatcatctacaccggggaggagccctacaagtgtgaagaatgtgggaaggccttcaacctgtcctag

SEQ ID NO: 176505 - DNA, 882 bp, Artificial Sequence
  Description of Artificial Sequence: Synthetic coding sequence
atgggccccctgaccttcatggatgtggccatcgagttcagcctggaggagtggcagtgcctggacacagcccagagaaatgtgtacagacatgtgatgctggagaactacagaaacctggtgttcctggccctgtgcagcagatttgcccaggacctgtggctggagcagaacatcaaggacagcttccagaaggtgaccctgagccgctatggcaagtatggccacaagaacctgcagctgaggaagggctgcaagtctgtggatgagtgcaagggccaccagggcggcttcaacggcctgaaccagtgcctgaagatcaccaccagcaagatcttccagtgcaacaagtatgtgaaggtgatgcacaagttcagcaacagcaacagacacaagatccgccacacagagaacaagcacttccgctgcaaggaatgtgacaagagcctgtgcatgctgagccggctgacccagcacaagaagatccacacccgggagaacttctacaagtgtgaagaatgtgggaagaccttcaactggagcaccaacctgagcaagcccaagaagatccacactggagagaagccctacaagtgtgaggtgtgtgggaaggccttccaccagagcagcatcctgaccaagcacaagatcatcagaactggagagaagccctacaagtgtgcccactgtgggaaggccttcaagcagagcagccacctgaccaggcacaagatcatccacacagaggagaagccctacaagtgtgagcagtgtgggaaggtgttcaagcagagccccaccctgaccaagcaccagatcatctacaccggggaggagccctacaagtgtgaagaatgtgggaaggccttcaacctgtcctag

SEQ ID NO: 176506 - DNA, 381 bp, Artificial Sequence
  Description of Artificial Sequence: Synthetic coding sequence
atgggccccctgaccttcatggatgtggccatcgagttcagcctggaggagtggcagtgcctggacacagcccagagaaatgtgtacagacatgtgatgctggagaactacagaaacctggtgttcctggacctgatcacctgcctggagcagggcaaggagccctggaacatgaagagacatgagatggtggtggccaagcacagcgctgtggccttcacctttgacctgagcggcctgaacatcctgtccttccagagcatcctgccctttgtgtctgccctgtatgtgatgggcaacagaaaccagtgcctgcagaagcacctggaggccaggaacaaggacctgtgtgtgctggtgctgcccaagacctttggatag

SEQ ID NO: 176507 - DNA, 1929 bp, Artificial Sequence
  Description of Artificial Sequence: Synthetic coding sequence
atggattctgtgtcctttgaagatgtggccgtgaacttcaccctggaggagtgggccctgctggacagcagccagaagaagctgtatgaagatgtgatgcaggagaccttcaagaacctggtgtgcctgggcaagaagtgggaggaccaggacattgaagatgaccacaggaaccagggcaagaacagacgctgccacatggtggagcggctgtgtgagagcagaagaggcagcaaatgtggggagaccaccagccagatgcccaacgtgaacatcaacaaggagaccttcaccggggccaagccccatgagtgcagcttctgtggccgggacttcatccaccacagcagcctgaacagacacatgaggagccacacaggccagaagcccaatgagtaccaggagtatgagaagcagccctgcaagtgcaaggctgtgggcaagaccttctcctaccaccactgcttcaggaagcatgagaggacccacactggagtgaagccctatgagtgcaagcagtgtgggaaggccttcatctactaccagcccttccagagacatgagaggacccacgccggccagaagccctatgagtgcaagcagtgtgggaagaccttcatctactaccagagcttccagaagcacgcccacacaggcaagaagccctatgagtgcaagcagtgtgggaaggccttcatctgctaccagagcttccagaggcacaagaggacccacactggagagaagccctatgagtgcaagcagtgtgggaaggccttcagctgccccacctacttccgcacccatgagaggacccacactggagagaagccctacaagtgcaaggaatgtgggaaggccttctccttcctgagcagcttcagaagacacaagaggacccacagcggggagaagccctatgagtgcaaggaatgtgggaaggccttcttctacagcgccagcttccgggcccacgtgatcatccacactggagcccggccctacaagtgcaaggaatgtgggaaggccttcaacagcagcaacagctgccgggtgcatgagaggacccacatcggggagaagccctatgagtgcaagagatgtgggaagagcttctcctggagcatcagcctgcggctgcacgagaggacccacactggagagaagccctatgagtgcaagcagtgccacaagaccttctccttcagcagcagcctgcgggagcacgagaccacccacactggagagaagccctatgagtgcaagcagtgtgggaagaccttctccttcagcagcagcctgcagagacatgagaggacccacaatgctgagaagccctatgagtgcaagcagtgtgggaaggccttccgctgcagcagctacttccgcatccacgagaggagccacactggagagaagccctatgagtgcaagcagtgtgggaaggtgttcatccgcagcagcagcttccggctgcacgagaggacccacactggagagaagccctatgagtgcaagctgtgtgggaagaccttctccttcagcagcagcctgcgggagcacgagaagatccacacaggcaacaagccctttgagtgcaagcagtgtgggaaggccttcctgcggagcagccagatccggctgcacgagaggacccacactggagagaagccctaccagtgcaagcagtgtgggaaggccttcatcagcagcagcaagttcaggatgcatgagaggacccacactggagagaagccctaccgctgcaagcagtgtgggaaggccttccgcttcagcagctctgtgcgcatccacgagaggagccacactggagagaagccctatgagtgcaagcagtgtgggaaggccttcatcagcagcagccacttccggctgcacgagaggacccacatgggagagaaggtgtag

SEQ ID NO: 176508 - DNA, 1374 bp, Artificial Sequence
  Description of Artificial Sequence: Synthetic coding sequence
atgagccagggctctgtgaccttcagagatgtggccatcgacttcagccaggaggagtggaagtggctgcagcctgcccagagggacctgtaccgctgtgtgatgctggagaactacggccacctggtgtccctgggcctgagcatcagcaagccagatgtggtgtccctgctggagcagggcaaggagccctggctgggcaagcgggaggtgaagagggacctcttctctgtgtctgagagcagcggggagatcaaggacttcagccccaagaatgtcatctatgatgacagcagccagtacctgatcatggagcgcatcctgagccagggccctgtgtacagcagcttcaagggcggctggaagtgcaaggaccacacagagatgctgcaggagaaccagggctgcatcaggaaggtgacagtgagccaccaggaggccctggcccagcacatgaacatcagcacagtggagcggccctacggctgccatgaatgtgggaagaccttcggccgccgcttcagcctggtgctgcaccagaggacccacactggagagaagccctatgcctgcaaggaatgtgggaagaccttcagccagatcagcaacctggtgaagcaccagatgatccacacaggcaagaagccccatgagtgcaaggactgcaacaagaccttctcctacctgtccttcctgattgagcaccagaggacccacactggagagaagccctatgagtgcacagaatgtgggaaggccttcagccgggccagcaacctgaccaggcaccagaggatccacatcggcaagaagcagtacatctgcaggaaatgtgggaaggccttcagcagcggcagcgagctgatccgccaccagatcacccacactggagagaagccctatgagtgcattgaatgtgggaaggccttccgccgcttcagccacctgaccaggcaccagagcatccacaccaccaagaccccctatgagtgcaatgaatgtaggaaggccttccgctgccacagcttcctgatcaagcaccagagaattcatgctggggagaagctgtatgaatgtgatgaatgtgggaaggtgttcacctggcacgccagcctcatccagcacaccaagagccacactggagagaagccctatgcctgtgctgaatgtgacaaggccttcagccgctccttcagcctcatcctgcaccagaggacccacactggagagaagccctacgtgtgcaaggtgtgcaacaagagcttctcctggagcagcaacctggccaagcaccagaggacccacaccctggacaacccctatgaatatgagaacagcttcaactaccacagcttcctgacagagcaccagtag

SEQ ID NO: 176509 - DNA, 351 bp, Artificial Sequence
  Description of Artificial Sequence: Synthetic coding sequence
atgagccagggctctgtgaccttcagagatgtggccatcgacttcagccaggaggagtggaagtggctgcagcctgcccagagggacctgtaccgctgtgtgatgctggagaactacggccacctggtgtccctgggcctgagcatcagcaagccagatgtggtgtccctgctggagcagggcaaggagccctggctgggcaagcgggaggtgaagagggacctcttctctgtgtctgagagcagcggggagatcaaggacttcagccccaagaatgtcatctatgatgacagcagccagtacctgatcatggagcgcatcctgagccagggccctgtgtacagcagctag

SEQ ID NO: 176510 - DNA, 684 bp, Artificial Sequence
  Description of Artificial Sequence: Synthetic coding sequence
acccacactggagagaagccctatgcctgcaaggaatgtgggaagaccttcagccagatcagcaacctggtgaagcaccagatgatccacacaggcaagaagccccatgagtgcaaggactgcaacaagaccttctcctacctgtccttcctgattgagcaccagaggacccacactggagagaagccctatgaatgtacagaatgtgggaaggccttcagccgggccagcaacctgaccaggcaccagaggatccacatcggcaagaagcagtacatctgcaggaaatgtgggaaggccttcagcagcggcagcgagctgatccgccaccagatcacccacactggagagaagccctatgaatgtattgaatgtgggaaggccttccgccgcttcagccacctgaccaggcaccagagaattcatgctggggagaagctgtatgaatgtgatgaatgtgggaaggtgttcacctggcacgccagcctcatccagcacaccaagagccacactggagagaagccctatgcctgtgccgagtgtgacaaggccttcagccgctccttcagcctcatcctgcaccagaggacccacactggagagaagccctacgtgtgcaaggtgtgcaacaagagcttctcctggagcagcaacctggccaagcaccagaggacccacacctag

SEQ ID NO: 176511 - DNA, 1065 bp, Artificial Sequence
  Description of Artificial Sequence: Synthetic coding sequence
atggagcgcatcctgagccagggccctgtgtacagcagcttcaagggcggctggaagtgcaaggaccacacagagatgctgcaggagaaccagggctgcatcaggaaggtgacagtgagccaccaggaggccctggcccagcacatgaacatcagcacagtggagcggccctacggctgccatgaatgtgggaagacctttggaagacgcttcagcctggtgctgcaccagaggacccacactggagagaagccctatgcctgcaaggaatgtgggaagaccttcagccagatcagcaacctggtgaagcaccagatgatccacacaggcaagaagccccatgagtgcaaggactgcaacaagaccttctcctacctgtccttcctgattgagcaccagaggacccacactggagagaagccctatgaatgtacagaatgtgggaaggccttcagccgggccagcaacctgaccaggcaccagaggatccacatcggcaagaagcagtacatctgcaggaaatgtgggaaggccttcagcagcggcagcgagctgatccgccaccagatcacccacactggagagaagccctatgaatgtattgaatgtgggaaggccttccgccgcttcagccacctgaccaggcaccagagcatccacaccaccaagaccccctatgaatgtaatgaatgtaggaaggccttccgctgccacagcttcctgatcaagcaccagagaattcatgctggggagaagctgtatgaatgtgatgaatgtgggaaggtgttcacctggcacgccagcctcatccagcacaccaagagccacactggagagaagccctatgcctgtgccgagtgtgacaaggccttcagccgctccttcagcctcatcctgcaccagaggacccacactggagagaagccctacgtgtgcaaggtgtgcaacaagagcttctcctggagcagcaacctggccaagcaccagaggacccacaccctggacaacccctatgaatatgaaaattccttcaactaccacagcttcctgacagagcaccagtag

SEQ ID NO: 176512 - DNA, 1425 bp, Artificial Sequence
  Description of Artificial Sequence: Synthetic coding sequence
atggagctgctgaccttcagagatgtggccatcgagttcagccctgaggagtggaagtgcctggaccctgaccagcagaacctgtacagagatgtgatgctggagaactacagaaacctggtgtccctgggcgtggccatcagcaacccagacctggtgacctgcctggagcagaggaaggagccctacaacgtgaagatccacaagatcgtggcccggcccccagccatgtgcagccacttcacccaggaccactggcctgtgcagggcatcgaggacagcttccacaagctgatcctgcggcgctatgaaaaatgtggccatgacaacctgcagctgaggaagggctgcaagagcctgaatgaatgcaagctgcagaagggcggctacaatgagttcaatgaatgtctgagcaccacccagagcaagatcctgcagtgcaaggcctctgtgaaggtggtgtccaagttcagcaacagcaacaagaggaagaccaggcacactggagagaagcacttcaaggaatgtgggaagagcttccagaagttcagccacctgacccagcacaaggtgattcatgctggggagaagccctacacctgtgaagaatgtgggaaggccttcaagtggagcctcatcttcaatgagcacaagaggatccacactggagagaagcccttcacctgtgaagaatgtggcagcatcttcaccaccagcagccactttgccaagcacaagatcatccacactggagagaagccctacaagtgtgaagaatgtgggaaggccttcaaccgcttcaccaccctgaccaagcacaagagaattcatgctggggagaagcccatcacctgtgaagaatgtaggaagatcttcaccagcagcagcaactttgccaagcacaagaggatccacactggagagaagccctacaagtgtgaagaatgtgggaaggccttcaacagaagcaccaccctgaccaagcacaagaggatccacactggagagaagccctacacctgtgaagaatgtgggaaggccttccggcagagcagcaagctgaatgagcacaagaaggtgcacactggagagcggccctacaagtgtgatgaatgtgggaaggccttcggccgcagccgggtgctgaatgagcacaagaagatccacactggagagaagccctacaagtgtgaagaatgtgggaaggccttcagaagaagcacagacaggagccagcacaagaagatccacagcgctgacaagccctacaagtgcaaggaatgtgacaaggccttcaagcagttcagcctgctgagccagcacaagaagatccacacagtggacaagccctacaagtgcaaggactgtgacaaggccttcaagcgcttcagccacctgaacaagcacaagaagatccacacctag

SEQ ID NO: 176513 - DNA, 606 bp, Artificial Sequence
  Description of Artificial Sequence: Synthetic coding sequence
atggagctgctgaccttcagagatgtggccatcgagttcagccctgaggagtggaagtgcctggaccctgaccagcagaacctgtacagagatgtgatgctggagaactacagaaacctggtgtccctgggcgtggccatcagcaacccagacctggtgacctgcctggagcagaggaaggagccctacaacgtgaagatccacaagatcgtggcccggcccccagccatgtgcagccacttcacccaggaccactggcctgtgcagggcatcgaggacagcttccacaagctgatcctgcggcgctatgaaaaatgtggccatgacaacctgcagctgaggaagggctgcaagagcctgaatgaatgcaagctgcagaagggcggctacaatgagttcaatgaatgtctgagcaccacccagagcaagatcctgcagtgcaaggcctctgtgaaggtggtgtccaagttcagcaacagcaacaagaggaagaccaggcacactggagagaagcacttcaaggaatgtgggaagagcttccagaagttcagccacctgacccagcacaagaacagcagcatctccatgaccaccagccccttctag

SEQ ID NO: 176514 - DNA, 5064 bp, Artificial Sequence
  Description of Artificial Sequence: Synthetic coding sequence
atgacagaccccctgctggacagccagcctgccagcagcactggagagatggatggcctgtgcccagagctgctgctgatccccccacccctgagcaacagaggcatcctgggccctgtgcagagcccctgccccagccgggaccctgcccccatccccacagagcccggctgcctgctggtggaggccacagccacagaggagggccctggcaacatggagatcatcgtggagaccgtggccggcaccctgacccctggggcccctggagagaccccagcccccaagctgcccccaggagagcgggagcccagccaggaggccggcacccccctgcccggccaggagacagctgaggaggagaatgtggagaaggaggagaagagtgacacccagaaggacagccagaaggctgtggacaagggccagggcgcccagaggctggagggagatgtggtgtctggaacagagagcctcttcaagacccacatgtgcccagagtgcaagcgctgcttcaagaagaggacccacctggtggagcacctgcacctgcacttcccagaccccagcctgcagtgccccaactgccagaagttcttcaccagcaagagcaagctgaagacccacctgctgcgggagctgggggagaaggcccaccactgccccctgtgccactacagcgctgtggagagaaatgccctgaacagacacatggcctccatgcatgaggacatcagcaacttctacagcgacacctacgcctgccctgtgtgccgggaggagttccggctgagccaggccctgaaggagcacctgaagagccacacagctgctgctgctgctgagcccctgcccctgcgctgcttccaggagggctgcagctatgctgccccagacaggaaggccttcatcaagcacctgaaggagacccatggagtgcgggctgtggagtgccgccaccacagctgccccatgctgtttgccacagctgaggccatggaggcccaccacaagagccactacgccttccactgcccccactgtgactttgcctgcagcaacaagcacctgttcaggaagcacaagaagcagggccaccctggcagcgaggagctgcgctgcaccttctgcccctttgccaccttcaaccctgtggcctaccaggaccacgtgggcaagatgcacgcccacgagaagatccaccagtgcccagagtgcaactttgccacagcccacaagagggtgctgatccgccacatgctgctgcacactggagagaagccccacaagtgtgagctgtgtgacttcacctgcagagatgtgtcctacctgagcaagcacatgctgacccacagcaacaccaaggactacatgtgcacagaatgtggctacgtgaccaagtggaagcactacctgcgggtgcacatgaggaagcacgccggggacctgcgctaccagtgcaaccagtgcagctaccgctgccacagagctgaccagctgagcagccacaagctgcggcaccagggcaagagcctgatgtgtgaggtgtgtgcctttgcctgcaagaggaaatatgagctgcagaagcacatggccagccagcaccaccctggcaccccagcccccctgtacccctgccactactgcagctaccagagccgccacaagcaggccgtgctgagccatgagaactgcaagcacacccggctgcgggagttccactgtgccctgtgtgactaccgcaccttcagcaacaccaccctgctcttccacaagaggaaggcccacggctacgtgcctggggaccaggcctggcagctgcgctatgccagccaggagcctgagggcgccatgcagggccccaccccacctccagattctgagcccagcaaccagctgagcgcccggcctgagggccctggccacgagcccggcaccgtggtggaccccagcctggaccaggccctgcctgagatgtctgaggaggtgaacacaggccggcaggagggcagcgaggcccctcatggaggagacctgggcggcagccccagccctgctgaggtggaggagggcagctgcaccctgcacctggaggccctgggcgtggagctggagagcgtgacagagccccccctggaggaggtgacagaaacagcccccatggagttccggcccctgggcctggagggcccagatggcctggagggccctgagctgagcagctttgagggcatcggcaccagtgacctgtctgctgaggagaaccccctgctggagaagcctgtgtctgagcccagcaccaacccccccagcctggaggaggcccccaacaactgggtgggcaccttcaagaccaccccacctgctgagacagcccccctgccccccctgcctgagagcgagagcctgctgaaggccctgcggcggcaggacaaggagcaggccgaggccctggtgctggagggccgggtgcagatggtggtgatccagggcgagggccgggccttccgctgcccccactgccccttcatcacccggcgggagaaggccctgaacctgcacagcaggacaggctgccagggccggcgggagcccctgctgtgcccagaatgtggggccagcttcaagcagcagaggggcctgagcacccacctgctgaagaagtgccctgtgctgctgaggaagaacaagggcctgcccaggccagacagccccatccccctgcagcctgtgctgcccggcacccaggccagcgaggacacagaaagtggcaagcccccaccagccagccaggaggccgagctgctgctgcccaaggatgcccccctggagctgccccgggagcctgaggagacagaggagcccctggccaccgtgtctggcagccctgtgcccccagctggcaacagcctgcccacagaggcccccaagaagcactgctttgatcctgtgcccccagctggcaacagcagccccacagaggcccccaagaagcaccacctggaccctgtgcccccagctggcaacagcagccccacagaggccctgaagaagcacagatttgagcagggcaagttccactgcaacagctgccccttcctgtgcagccggctgagcagcatcaccagccacgtggccgagggctgccggggcggccggggcggcggcggcaagaggggcaccccccagacccagccagatgtgagccccctgagcaatggagacagcgccccacccaagaatggcagcacagagagcagcagtggagatggagacacagtgctggtgcagaagcagaagggggcccgcttcagctgccccacctgccccttcagctgccagcaggagcgggccctgcggacccaccagatccggggctgccccctggaggagagcggggagctgcactgcagcctgtgccccttcaccgccccagctgccacagccctgcggctgcaccagaagaggaggcaccccacagctgccccagcccggggcccccggccccacctgcagtgtggggactgtggcttcacctgcaagcagagccgctgcatgcagcagcaccggcggctgaagcatgagggcgtgaagccccaccagtgccccttctgtgacttcagcaccacccggcgctaccgcctggaggcccaccagagccgccacactggaattggccgcatcccctgcagcagctgcccccagaccttcggcaccaacagcaagctgcggctgcaccggctgcgggtgcatgacaagacccccacccacttctgccccctgtgtgactacagcggctacctgcggcatgacatcaccaggcatgtgaacagctgccaccagggcaccccagcctttgcctgcagccagtgtgaggcccagttcagcagcgagacagccctgaagcagcacgccctgcggcggcaccctgagcccgcccagcctgcccctggcagccctgctgagaccacagagggccccctgcactgcagccgctgtggcctgctgtgccccagccctgccagcctgcggggccacaccaggaagcagcacccccggctggagtgtggggcctgccaggaggccttccccagccggctggccctggatgagcaccggcggcagcagcacttcagccaccgctgccagctgtgtgactttgctgcccgggagcgggtgggcctggtgaagcactacctggagcagcacgaggagaccagcgctgctgtggccgccagtgatggagatggagatgctggccagccccccctgcactgccccttctgtgacttcacctgccgccaccagctggtgctggaccaccacgtgaagggccacggcggcacccggctgtacaagtgcacagactgtgcctacagcaccaagaaccggcagaagatcacctggcacagccgcatccacactggagagaagccctaccactgccacctgtgcccctatgcctgtgccgaccccagccggctgaagtaccacatgaggatccacaaggaggagaggaagtacctgtgcccagaatgtggctacaagtgcaagtgggtgaaccagctgaagtaccacatgaccaagcacacaggcctgaagccctaccagtgcccagaatgtgagtactgcaccaacagagcagatgccctgcgggtgcaccaggagaccaggcaccgggaggcccgggccttcatgtgtgagcagtgtgggaaggccttcaagacccgcttcctgctgcggacccacctgaggaagcacagcgaggccaagccctacgtgtgcaatgtgtgccaccgggccttccgctgggccgccggcctgcggcaccacgccctgacccacacagacagacaccccttcttctgccgcctgtgcaactacaaggccaagcagaagttccaggtggtgaagcacgtgagaagacaccacccagaccaggccgaccccaaccagggcgtgggcaaggaccccaccacccccaccgtgcacctgcatgatgtgcagctggaggaccccagccccccagccccagctgccccccacactggacctgagggctag

SEQ ID NO: 176515 - DNA, 45 bp, Artificial Sequence
  Description of Artificial Sequence: Synthetic coding sequence
atgacagaccccctgctggacagccagcctgccagcagcacctag

SEQ ID NO: 176516 - DNA, 5064 bp, Artificial Sequence; identical to SEQ ID NO: 176514
  Description of Artificial Sequence: Synthetic coding sequence

SEQ ID NO: 176517 - DNA, 81 bp, Artificial Sequence
  Description of Artificial Sequence: Synthetic coding sequence
atgacagaccccctgctggacagccagcctgccagcagcactggagagatggatggcctgtgcccagagctgctgctgtag

SEQ ID NO: 176518 - DNA, 1824 bp, Artificial Sequence
  Description of Artificial Sequence: Synthetic coding sequence
atgctgctggcccagatcaacagagacagccagggcatgacagagttccctgggggcggcatggaggcccagcacgtgaccctgtgcctgacagaagctgtgacagtggctgatgccaagctgattgatggccaggtgatccagctggaggatggcagcgctgcctacgtgcagcacgtgcccatccccaagagcactggagacagcctgcggctggaggatggccaggccgtgcagctggaggatggcaccacagccttcatccaccacaccagcaaggacagctatgaccagagcgccctgcaggccgtgcagctggaggatggcaccacagcctacatccaccacgctgtgcaggtgccccagagcgacaccatcctggccatccaggctgatggcaccgtggccggcctgcacactggagatgccaccattgatcctgacaccatcagcgccctggagcagtatgctgccaaggtgtccattgatggcagcgagagcgtggccggcaccggcatgattggagaaaatgagcaggagaagaagatgcagatcgtgctgcagggccacgccaccagggtgacagccaagagccagcagagcggggagaaggccttccgctgtgaatatgatggctgcggcaagctgtacaccacagcccaccacctgaaggtgcatgagaggagccacactggagaccggccctaccagtgtgagcacgccggctgcggcaaggcctttgccaccggctacggcctgaagagccacgtgaggacccacactggagagaagccctaccgctgcagcgaggacaactgcaccaagagcttcaagaccagcggggacctgcagaagcacatccgcacccacactggagagcggcccttcaagtgcccctttgagggctgcggccgctccttcaccaccagcaacatcaggaaggtgcacgtgaggacccacactggagagcggccctactactgcacagagcccggctgcggccgggcctttgccagcgccaccaactacaagaaccacgtgcgcatccacactggagagaagccctacgtgtgcaccgtgcccggctgtgacaagcgcttcacagagtacagcagcctgtacaagcaccacgtggtgcacacccacagcaagccctacaactgcaaccactgcggcaagacctacaagcagatcagcaccctggccatgcacaagaggacagcccacaatgacacagagcccatcgaggaggagcaggaggccttctttgagcccccacctggccagggagaagatgtgctgaagggcagccagatcacctacgtgactggagtggagggagatgatgtggtgtccacccaggtggccaccgtgacccagagcggcctgagccagcaggtgaccctcatcagccaggacggcacccagcacgtgaacatcagccaggccgacatgcaggccatcggcaacaccatcaccatggtgacccaggacggcacccccatcaccgtgcctgcccatgatgctgtgatcagcagcgctggcacccacagcgtggccatggtgacagctgagggcacagaaggagagcaggtggccatcgtggcccaggacctggccgccttccacacagccagcagcgagatgggccaccagcagcacagccaccacctggtgaccacagagacccggcccctgaccctggtggccaccagcaatggcacccagattgctgtgcagctgggggagcagcccagcctggaggaggccatcagaattgccagccgcatccagcagggcgagaccccaggcctggatgactag

SEQ ID NO: 176519 - DNA, 1917 bp, Artificial Sequence
  Description of Artificial Sequence: Synthetic coding sequence
atgctgctggcccagatcaacagagacagccagggcatgacagagttccctgggggcggcatggaggcccagcacgtgaccctgtgcctgacagaagctgtgacagtggctgatggagacaacctggagaacatggagggcgtgtccctgcaggccgtgaccctggctgatggcagcacagcctacatccagcacaacagcaaggatgccaagctgattgatggccaggtgatccagctggaggatggcagcgctgcctacgtgcagcacgtgcccatccccaagagcactggagacagcctgcggctggaggatggccaggccgtgcagctggaggatggcaccacagccttcatccaccacaccagcaaggacagctatgaccagagcgccctgcaggccgtgcagctggaggatggcaccacagcctacatccaccacgctgtgcaggtgccccagagcgacaccatcctggccatccaggctgatggcaccgtggccggcctgcacactggagatgccaccatcgaccctgacaccatcagcgccctggagcagtatgctgccaaggtgtccattgatggcagcgagagcgtggccggcaccggcatgattggagaaaatgagcaggagaagaagatgcagatcgtgctgcagggccacgccaccagggtgacagccaagagccagcagagcggggagaaggccttccgctgtgaatatgatggctgtgggaagctgtacaccacagcccaccacctgaaggtgcatgagaggagccacactggagaccggccctaccagtgtgaacatgctggctgtgggaaggcctttgccaccggctacggcctgaagagccacgtgaggacccacactggagagaagccctaccgctgcagcgaggacaactgcaccaagagcttcaagaccagcggggacctgcagaagcacatccgcacccacactggagagcggcccttcaagtgcccctttgagggctgcggccgctccttcaccaccagcaacatcaggaaggtgcacgtgaggacccacactggagagcggccctactactgcacagagcccggctgcggccgggcctttgccagcgccaccaactacaagaaccacgtgcgcatccacactggagagaagccctacgtgtgcaccgtgcccggctgtgacaagcgcttcacagagtacagcagcctgtacaagcaccacgtggtgcacacccacagcaagccctacaactgcaaccactgtgggaagacctacaagcagatcagcaccctggccatgcacaagaggacagcccacaatgacacagagcccatcgaggaggagcaggaggccttctttgagcccccacctggccagggagaagatgtgctgaagggcagccagatcacctacgtgactggagtggagggagatgatgtggtgtccacccaggtggccaccgtgacccagagcggcctgagccagcaggtgaccctcatcagccaggacggcacccagcacgtgaacatcagccaggccgacatgcaggccatcggcaacaccatcaccatggtgacccaggacggcacccccatcaccgtgcctgcccatgatgctgtgatcagcagcgctggcacccacagcgtggccatggtgacagctgagggcacagaaggagagcaggtggccatcgtggcccaggacctggccgccttccacacagccagcagcgagatgggccaccagcagcacagccaccacctggtgaccacagagacccggcccctgaccctggtggccaccagcaatggcacccagattgctgtgcagctgggggagcagcccagcctggaggaggccatccgcatcgccagccgcatccagcagggcgagaccccaggcctggatgactag

SEQ ID NO: 176520 - DNA, 429 bp, Artificial Sequence
  Description of Artificial Sequence: Synthetic coding sequence
atgctgctggcccagatcaacagagacagccagggcatgacagagttccctgggggcggcatggaggcccagcacgtgaccctgtgcctgacagaagctgtgacagtggctgatggagacaacctggagaacatggagggcgtgtccctgcaggccgtgaccctggctgatggcagcacagcctacatccagcacaacagcaaggatgccaagctgattgatggccaggtgatccagctggaggatggcagcgctgcctacgtgcagcacgtgcccatccccaagagccgggacagcctgcggctggaggatggccaggccgtgcagctggaggatggcaccacagccttcatccaccacaccagcaaggacagctatgaccagagcgccctgcaggccgtgcagctggaggatggcaccacagcctag

SEQ ID NO: 176521 - DNA, 255 bp, Artificial Sequence
  Description of Artificial Sequence: Synthetic coding sequence
atgctgctggcccagatcaacagagacagccagggcatgacagagttccctgggggcggcatggaggcccagcacgtgaccctgtgcctgacagaagctgtgacagtggctgatggagacaacctggagaacatggagggcgtgtccctgcaggccgtgaccctggctgatggcagcacagcctacatccagcacaacagcaaggatgccaagctgattgatggccaggtgatccagctggaggatggcagctag

SEQ ID NO: 176522 - DNA, 222 bp, Artificial Sequence
  Description of Artificial Sequence: Synthetic coding sequence
atgctgctggcccagatcaacagagacagccagggcatgacagagttccctgggggcggcatggaggcccagcacgtgaccctgtgcctgacagaagctgtgacagtggctgatggagacaacctggagaacatggagggcgtgtccctgcaggccgtgaccctggctgatggcagcacagcctacatccagcacaacagcaaggatgccaagctgatctag

SEQ ID NO: 176523 - DNA, 573 bp, Artificial Sequence
  Description of Artificial Sequence: Synthetic coding sequence
atgctgctggcccagatcaacagagacagccagggcatgacagagttccctgggggcggcatggaggcccagcacgtgaccctgtgcctgacagaagctgtgacagtggctgatggagacaacctggagaacatggagggcgtgtccctgcaggccgtgaccctggctgatggcagcacagcctacatccagcacaacagcaaggatgccaagctgattgatggccaggtgatccagctggaggatggcagcgctgcctacgtgcagcacgtgcccatccccaagagcactggagacagcctgcggctggaggatggccaggccgtgcagctggaggatggcaccacagccttcatccaccacaccagcaaggacagctatgaccagagcgccctgcaggccgtgcagctggaggatggcaccacagcctacatccaccacgctgtgcaggtgccccagagcgacaccatcctggccatccaggctgatggcaccgtggccggcctgcacactggagatgccaccatcgaccctgacaccatcagcgccctggagcagtatgctgccaagtag

SEQ ID NO: 176524 - DNA, 411 bp, Artificial Sequence
  Description of Artificial Sequence: Synthetic coding sequence
atgctgctggcccagatcaacagagacagccagggcatgacagagttccctgggggcggcatggaggcccagcacgtgaccctgtgcctgacagaagctgtgacagtggctgatggagacaacctggagaacatggagggcgtgtccctgcaggccgtgaccctggctgatggcagcacagcctacatccagcacaacagcaaggatgccaagctgattgatggccaggtgatccagctggaggatggcagcgctgcctacgtgcagcacgtgcccatccccaagagcactggagacagcctgcggctggaggatggccaggccgtgcagctggaggatggcaccacagccttcatccaccacaccagcaaggacagctatgaccagagcgccctgcaggccgtgcagtag

SEQ ID NO: 176525 - DNA, 528 bp, Artificial Sequence
  Description of Artificial Sequence: Synthetic coding sequence
atgctgctggcccagatcaacagagacagccagggcatgacagagttccctgggggcggcatggaggcccagcacgtgaccctgtgcctgacagaagctgtgacagtggctgatggagacaacctggagaacatggagggcgtgtccctgcaggccgtgaccctggctgatggcagcacagcctacatccagcacaacagcaaggatgccaagctgattgatggccaggtgatccagctggaggatggcagcgctgcctacgtgcagcacgtgcccatccccaagagcactggagacagcctgcggctggaggatggccaggccgtgcagctggaggatggcaccacagccttcatccaccacaccagcaaggacagctatgaccagagcgccctgcaggccgtgcagctggaggatggcaccacagcctacatccaccacgctgtgcaggtgccccagagcgacaccatcctggccatccaggctgatggcaccgtggccggcctgcacactggagatgccacctag

SEQ ID NO: 176526 - DNA, 879 bp, Artificial Sequence
  Description of Artificial Sequence: Synthetic coding sequence
atgagccacctgagccagcagaggatctacagcggggagaacccctttgcctgcaaggtgtgtgggaaggtgttcagccacaagagcaacctgacagagcacgagcacttccacacccgggagaagccctttgaatgtaatgaatgtgggaaggccttcagccagaagcagtatgtgatcaagcaccagaacacccacactggagagaagctgtttgaatgtaatgaatgtgggaagagcttcagccagaaggagaacctgctgacccaccagaagatccacactggagagaagccctttgagtgcaaggactgtgggaaggccttcatccagaagagcaacctgatccgccaccagaggacccacactggagagaagccctttgtgtgcaaggaatgtgggaagaccttcagcggcaagagcaacctgacagagcacgagaagatccacatcggggagaagcccttcaagtgcagtgaatgtggcacagccttcggccagaagaagtacctgatcaagcaccagaacatccacactggagagaagccctatgaatgtaatgaatgtgggaaggccttcagccagaggaccagcctcatcgtgcacgtgcgcatccacagcggggacaagccctatgaatgtaatgtgtgtgggaaggccttcagccagagcagcagcctgactgtgcacgtgcgcagccacactggagagaagccctacggctgcaatgaatgtgggaaggccttcagccagttcagcaccctggccctgcacctgcgcatccacacaggcaagaagccctaccagtgcagtgaatgtgggaaggccttcagccagaagagccaccacatccgccaccagaagatccacacccactag

SEQ ID NO: 176527 - DNA, 879 bp, Artificial Sequence; identical to SEQ ID NO: 176526
  Description of Artificial Sequence: Synthetic coding sequence

SEQ ID NO: 176528 - DNA, 2385 bp, Artificial Sequence
  Description of Artificial Sequence: Synthetic coding sequence
atgaacattgatgacaagctggagggcctcttcctgaagtgtggcggcattgatgagatgcagagcagcaggaccatggtggtgatgggcggcgtgtctggccagagcacagtgtctggagagctgcaggacagcgtgctgcaggaccgctccatgccccaccaggagatcctggccgcagatgaggtgctgcaggagagcgagatgaggcagcaggacatgatcagccatgatgagctgatggtgcatgaggagaccgtgaagaatgatgaggagcagatggagacccatgagcggctgccccagggcctgcagtatgccctgaatgtgcccatctctgtgaagcaggagatcaccttcacagatgtgtctgagcagctgatgagggacaagaagcagatccgggagcctgtggacctgcagaagaagaagaagaggaagcagaggagccctgccaagatcctgaccatcaatgaagatggcagcctgggcctgaagacccccaagagccacgtgtgtgagcactgcaatgctgccttccgcaccaactaccacctgcagagacatgtgttcatccacactggagagaagcccttccagtgcagccagtgtgacatgaggttcatccagaagtacctgctgcagagacatgagaagatccacactggagagaagcccttccgctgtgatgaatgtggcatgaggttcatccagaagtaccacatggagcggcacaagaggacccacagcggggagaagccctaccagtgtgagtactgcctgcagtacttcagcaggacagacagagtgctgaagcacaagaggatgtgccatgaaaatcatgacaagaagctgaacagatgtgccatcaagggcggcctgctgaccagtgaagaagattctggcttcagcaccagccccaaggacaacagcctgcccaagaagaagaggcagaagacagagaagaagagcagcggcatggacaaggagagcgccctggacaagagtgacctgaagaaggacaagaatgactacctgcccctgtacagcagcagcaccaaggtgaaggatgagtacatggtggccgagtatgctgtggagatgccccacagctctgtgggcggcagccacctggaggatgccagcggggagatccacccccccaagctggtgctgaagaagatcaacagcaagaggagcctgaagcagcccctggagcagaaccagaccatcagccccctgagcacctatgaggagagcaaggtgtccaaatatgcctttgagctggtggacaagcaggccctgctggacagcgagggcaatgctgacatcgaccaggtggacaacctgcaggagggccccagcaagcctgtgcacagcagcaccaactatgatgatgccatgcagttcctgaagaagaagcgctacctgcaggccgccagcaacaacagccgggagtatgccctgaatgtgggcaccatcgccagccagcccagcgtgacccaggccgctgtggcctctgtgattgatgagagcaccacagccagcatcctggagagccaggccctgaatgtggagatcaagagcaaccacgacaagaatgtcatcccagatgaggtgctgcagaccctgctggaccactacagccacaaggccaacggccagcacgagatctccttctctgtggccgacacagaggtgaccagcagcatcagcatcaacagcagcgaggtgcctgaggtgacccccagtgaaaatgtgggcagcagcagccaggccagcagcagtgacaaggccaacatgctgcaggagtacagcaagttcctgcagcaggccctggacaggaccagccagaatgatgcctacctgaacagccccagcctgaactttgtgacagacaaccagaccctgcccaaccagcctgccttcagcagcattgacaagcaggtgtatgccaccatgcccatcaacagcttccgcagcggcatgaacagccccctgcggaccaccccagacaagagccacttcggcctgattgtgggggacagccagcacagcttccccttctctggagatgagaccaaccacgccagcgccaccagcacccaggacttcctggaccaggtgaccagccagaagaaggccgaggcccagcctgtgcaccaggcctaccagatgagcagctttgagcagcccttccgggccccctaccacggcagccgggccggcatcgccacccagttcagcacagccaacggccaggtgaacctgcggggccctggcaccagcgctgagttcagcgagttccccctggtgaatgtgaatgacaacagagctggcatgaccagcagcccagatgccaccaccggccagacctttggatag

SEQ ID NO: 176529 - DNA, 252 bp, Artificial Sequence
  Description of Artificial Sequence: Synthetic coding sequence
atgaacattgatgacaagctggagggcctcttcctgaagtgtggcggcattgatgagatgcagagcagcaggaccatggtggtgatgggcggcgtgtctggccagagcacagtgtctggagagctgcaggacagcgtgctgcaggaccgctccatgccccaccaggagatcctggccgcagatgaggtgctgcaggagagcgagatgaggcagcaggacatgatcagccatgatgagctgatggtgcactag

SEQ ID NO: 176530 - DNA, 435 bp, Artificial Sequence
  Description of Artificial Sequence: Synthetic coding sequence
atgaagggggagaagcccttccagtgcagccagtgtgacatgaggttcatccagaagtacctgctgcagagacatgagaagatccacactggagagaagcccttccgctgtgatgaatgtggagatgagaccaaccacgccagcgccaccagcacccaggacttcctggaccaggtgaccagccagaagaaggccgaggcccagcctgtgcaccaggcctaccagatgagcagctttgagcagcccttccgggccccctaccacggcagccgggccggcatcgccacccagttcagcacagccaacggccaggtgaacctgcggggccctggcaccagcgctgagttcagcgagttccccctggtgaatgtgaatgacaacagagctggcatgaccagcagcccagatgccaccaccggccagacctttggatag

SEQ ID NO: 176531 - DNA, 78 bp, Artificial Sequence
  Description of Artificial Sequence: Synthetic coding sequence
atgaacattgatgacaagctggagggcctcttcctgaagtgtggcggcattgatgagatgcagagcagcaggacatag

SEQ ID NO: 176532 - DNA, 2385 bp, Artificial Sequence; identical to SEQ ID NO: 176528
  Description of Artificial Sequence: Synthetic coding sequence

SEQ ID NO: 176533 - DNA, 2385 bp, Artificial Sequence; identical to SEQ ID NO: 176528
  Description of Artificial Sequence: Synthetic coding sequence

SEQ ID NO: 176534 - DNA, 2385 bp, Artificial Sequence; identical to SEQ ID NO: 176528
  Description of Artificial Sequence: Synthetic coding sequence

SEQ ID NO: 176535 - DNA, 228 bp, Artificial Sequence
  Description of Artificial Sequence: Synthetic coding sequence
atgaacattgatgacaagctggagggcctcttcctgaagtgtggcggcattgatgagatgcagagcagcaggaccatggtggtgatgggcggcgtgtctggccagagcacagtgtctggagagctgcaggacagcgtgctgcaggaccgctccatgccccaccaggagatcctggccgcagatgaggtgctgcaggagagcgagatgaggcagcaggacatgatctag

SEQ ID NO: 176536 - DNA, 1365 bp, Artificial Sequence
  Description of Artificial Sequence: Synthetic coding sequence
atgaacattgatgacaagctggagggcctcttcctgaagtgtggcggcattgatgagatgcagagcagcaggaccatggtggtgatgggcggcgtgtctggccagagcacagtgtctggagagctgcaggacagcgtgctgcaggaccgctccatgccccaccaggagatcctggccgcagatgaggtgctgcaggagagcgagatgaggcagcaggacatgatcagccatgatgagctgatggtgcatgaggagaccgtgaagaatgatgaggagcagatggagacccatgagcggctgccccagggcctgcagtatgccctgaatgtgcccatctctgtgaagcaggagatcaccttcacagatgtgtctgagcagctgatgagggacaagaagcagatccgggagcctgtggacctgcagaagaagaagaagaggaagcagaggagccctgccaagatcctgaccatcaatgaagatggcagcctgggcctgaagacccccaagagccacgtgtgtgagcactgcaatgctgccttccgcaccaactaccacctgcagagacatgtgttcatccacactggagagaagcccttccagtgcagccagtgtgacatgaggttcatccagaagtacctgctgcagagacatgagaagatccacactggagagaagcccttccgctgtgatgaatgtggcatgaggttcatccagaagtaccacatggagcggcacaagaggacccacagcggggagaagccctaccagtgtgagtactgcctgcagtacttcagcaggacagacagagtgctgaagcacaagaggatgtgccatgaaaatcatgacaagaagctgaacagatgtgccatcaagggcggcctgctgaccagtgaagaagattctggcttcagcaccagccccaaggacaacagcctgcccaagaagaagaggcagaagacagagaagaagagcagcggcatggacaaggagagcgccctggacaagagtgacctgaagaaggacaagaatgactacctgcccctgtacagcagcagcaccaaggtgaaggatgagtacatggtggccgagtatgctgtggagatgccccacagctctgtgggcggcagccacctggaggatgccagcggggagatccacccccccaagctggtgctgaagaagatcaacagcaagaggagcctgaagcagcccctggagcagaaccagaccatcagccccctgagcacctatgaggagagcaagttccagagcatgctgctgaacctgtggatcaaccggctgtactggacccagaaggccatgctgaccctcatccgcctcatcatctgcagaagagcccagtag

SEQ ID NO: 176537 - DNA, 396 bp, Artificial Sequence
  Description of Artificial Sequence: Synthetic coding sequence
atgaggttcatccagaagtacctgctgcagagacatgagaagatccacactggagagaagcccttccgctgtgatgaatgtggagatgagaccaaccacgccagcgccaccagcacccaggacttcctggaccaggtgaccagccagaagaaggccgaggcccagcctgtgcaccaggcctaccagatgagcagctttgagcagcccttccgggccccctaccacggcagcagagctggcatcgccacccagttcagcacagccaacggccaggtgaacctgcggggccctggcaccagcgctgagttcagcgagttccccctggtgaatgtgaatgacaacagagctggcatgaccagcagcccagatgccaccaccggccagaccttcggctag

SEQ ID NO: 176538 - DNA, 432 bp, Artificial Sequence
  Description of Artificial Sequence: Synthetic coding sequence
aagacccactacaactgtggggagcacaccaaggccttcagcggcaagcacaccctggtgcagcagcagaggaccctgaccacagagcgctgctacatctgcagtgaatgtgggaagagcttcagcaacaagagcaacctgatcaagcacagaagagtgcacactggagagcggccctatgaatgttctgaatgtgggaagagcttcagccagaggtctgccctgctgcagcaccggggcgtgcacactggagagcggccctatgaatgttctgaatgtgggaagttcttcacctaccacagcagcctcatcaagcaccagaaggtgcacagcggcagccggccctatgaatgttctgaatgtgggaagagcttcagccagaacagcagcctcatcgagcaccaccgggtgcacactggagagcggccctag

SEQ ID NO: 176539 - DNA, 1314 bp, Artificial Sequence
  Description of Artificial Sequence: Synthetic coding sequence
atggctgctgccaccctgcggacccccacccagggcaccgtgacctttgaagatgtggccgtgcacttctcctgggaggagtggggcctgctggatgaggcccagcgctgcctgtacagagatgtgatgctggagaacctggccctgctgaccagcctggatgtgcaccaccagaagcagcacctgggggagaagcacttccgcagcaatgtgggccgggccctgtttgtgaagacctgcaccttccacgtgtctggagagcccagcacctgccgggaggtgggcaaggacttcctggccaagctgggcttcctgcaccagcaggccgcccacactggagagcagagcaacagcaagagtgatggaggagccatcagccaccggggcaagacccactacaactgtggggagcacaccaaggccttcagcggcaagcacaccctggtgcagcagcagaggaccctgaccacagagcgctgctacatctgcagtgaatgtgggaagagcttcagcaagagctacagcctgaatgaccactggaggctgcacactggagagaagccctatgagtgcagagaatgtgggaagagcttccggcagagcagcagcctcatccagcaccggcgggtgcacacagctgtgcggccccatgaatgtgatgaatgtgggaagctgttcagcaacaagagcaacctgatcaagcaccggcgggtgcacactggagagcggccctatgagtgcagtgaatgtgggaagagcttcagccagaggtctgccctgctgcagcacagaggagtgcacactggagagcggccctatgagtgcagtgaatgtgggaagttcttcacctaccacagcagcctcatcaagcaccagaaggtgcacagcggcagccggccctatgagtgcagtgaatgtgggaagagcttcagccagaacagcagcctgattgagcaccaccgggtgcacactggagagcggccctacaagtgcagtgaatgtgggaagagcttcagccagaggtctgccctgctgcagcacagaggagtgcacactggagagcggccctatgagtgcagtgaatgtgggaagttcttcccctacagcagcagcctgaggaagcaccagagggtgcacacaggcagccggccctatgagtgcagtgaatgtgggaagagcttcacccagaacagcggcctcatcaagcaccggcgggtgcacactggagagaagccctatgagtgcacagaatgtgggaagagcttcagccacaacagcagcctcatcaagcaccagaggatccacagcaggtag

SEQ ID NO: 176540 - DNA, 1314 bp, Artificial Sequence; identical to SEQ ID NO: 176539
  Description of Artificial Sequence: Synthetic coding sequence

SEQ ID NO: 176541 - DNA, 1617 bp, Artificial Sequence
  Description of Artificial Sequence: Synthetic coding sequence
atgaccaccttcaaggaggccgtgaccttcaaggatgtggccgtggtgttcacagaggaggagctgggcctgctggaccctgcccagaggaagctgtacagagatgtgatgctggagaacttcaggaacctgctgtctgtgggccaccagcccttccaccaggacacctgccacttcctgcgggaggagaagttctggatgatgggcacagccacccagcgggagggcaacagcggcggcaagatccagacagagctggagagcgtgcctgaggccggggcccacgaggagtggagctgccagcagatctgggagcagatcgccaaggacctgaccaggagccaggacagcatcatcaacaacagccagttctttgaaaatggagatgtgcccagccaggtggaggccggcctgcccaccatccacacaggccagaagcccagccagggcggcaagtgcaagcagagcatcagtgatgtgcccatctttgacctgccccagcagctgtacagcgaggagaagagctacacctgtgatgaatgtgggaagagcatctgctacatcagcgccctgcacgtgcaccagagggtgcacgtgggggagaagctgttcatgtgtgatgtgtgtgggaaggagttcagccagagcagccacctgcagacccaccagagggtgcacactggagagaagcccttcaagtgtgagcagtgtgggaagggcttcagcagaagaagtgccctgaatgtgcacaggaagctgcacactggagagaagccctacatctgtgaggcctgtgggaaggccttcatccatgacagccagctgaaggagcacaagaggatccacactggagagaagcccttcaagtgtgacatctgtgggaagaccttctacttccgcagccggctgaagagccacagcatggtgcacactggagagaagcccttccgctgtgacacctgtgacaagagcttccaccagaggtctgccctgaacagacactgcatggtgcacactggagagaagccctaccgctgtgagcagtgtgggaagggcttcatcggccgcctggacttctacaagcaccaggtggtgcacactggagagaagccctacaactgcaaggaatgtgggaagagcttccgctggagcagctgcctgctgaaccaccagagggtgcacagcggggagaagagcttcaagtgtgaggagtgtgggaagggcttctacaccaacagccagctgagcagccaccagaggagccacagcggggagaagccctacaagtgtgaggagtgtgggaagggctacgtgaccaagttcaacctggacctgcaccagagggtgcacactggagagcggccctacaactgcaaggaatgtgggaagaacttcagccgggccagcagcatcctgaaccacaagaggctgcactgccagaagaagcccttcaagtgtgaggactgtgggaagaggctggtgcacaggacctacaggaaggaccagccccgggactacagcggggagaaccccagcaaatgtgaggactgtggccgccgctacaagaggcggctgaacctggacatcctgctgagcctcttcctgaatgacacctag

SEQ ID NO: 176542 - DNA, 1650 bp, Artificial Sequence
  Description of Artificial Sequence: Synthetic coding sequence
atgatcaagaggagcaaggtgctggtgttctgcagcaagatcatggaggaggccgtgaccttcaaggatgtggccgtggtgttcacagaggaggagctgggcctgctggaccctgcccagaggaagctgtacagagatgtgatgctggagaacttcaggaacctgctgtctgtgggccaccagcccttccaccaggacacctgccacttcctgcgggaggagaagttctggatgatgggcacagccacccagcgggagggcaacagcggcggcaagatccagacagagctggagagcgtgcctgaggccggggcccacgaggagtggagctgccagcagatctgggagcagatcgccaaggacctgaccaggagccaggacagcatcatcaacaacagccagttctttgaaaatggagatgtgcccagccaggtggaggccggcctgcccaccatccacacaggccagaagcccagccagggcggcaagtgcaagcagagcatcagtgatgtgcccatctttgacctgccccagcagctgtacagcgaggagaagagctacacctgtgatgaatgtgggaagagcatctgctacatcagcgccctgcacgtgcaccagagggtgcacgtgggggagaagctgttcatgtgtgatgtgtgtgggaaggagttcagccagagcagccacctgcagacccaccagagggtgcacactggagagaagcccttcaagtgtgagcagtgtgggaagggcttcagccgccgcagcgccctgaatgtgcacaggaagctgcacactggagagaagccctacatctgtgaggcctgtgggaaggccttcatccatgacagccagctgaaggagcacaagaggatccacactggagagaagcccttcaagtgtgacatctgtgggaagaccttctacttccgcagccggctgaagagccacagcatggtgcacactggagagaagcccttccgctgtgacacctgtgacaagagcttccaccagaggtctgccctgaacagacactgcatggtgcacactggagagaagccctaccgctgtgagcagtgtgggaagggcttcatcggccgcctggacttctacaagcaccaggtggtgcacactggagagaagccctacaactgcaaggaatgtgggaagagcttccgctggagcagctgcctgctgaaccaccagagggtgcacagcggggagaagagcttcaagtgtgaagaatgtgggaagggcttctacaccaacagccagctgagcagccaccagaggagccacagcggggagaagccctacaagtgtgaagaatgtgggaagggctacgtgaccaagttcaacctggacctgcaccagagggtgcacactggagagcggccctacaactgcaaggaatgtgggaagaacttcagccgggccagcagcatcctgaaccacaagaggctgcactgccagaagaagcccttcaagtgtgaggactgtgggaagaggctggtgcacaggacctacaggaaggaccagccccgggactacagcggggagaaccccagcaaatgtgaggactgtggccgccgctacaagaggcggctgaacctggacatcctgctgagcctcttcctgaatgacacctag

SEQ ID NO: 176543 - DNA, 693 bp, Artificial Sequence
  Description of Artificial Sequence: Synthetic coding sequence
atggtgatgagccccccccggctgaagcaggactacccccagttcatccaggacaggaacctgccccgggtgggctctgtgaacagccccagcgtgatgttccccagcctcatcttcctgagcagctacacccagaagaggagcctcatccacgtgatgtctgtggagaaggcctctgtgaccagccagctgttcatgttcatccgggagagcacctgggagaggaacagcctgtgtgtgatgtgtgtggccaggaacctggtgaaggcccacatctgcaagctgatccgggagagcaccctggagaggaaccacagcaatgtgtccaatgtgggcaaggtgtctgtggtggaccagcacctgatgttcatcgtgaactacacccaggagaggaacctgacctttgtgcgccacgtgggccggcccagcttcatgatccccagcctgaggaacatccgggagagcatcctgggcaggaaccacagcaatgtcatctacgtggtgcggcccagcatcctgggccaggacctgcgggccatcccctggttcacccaggagaagaaccacctgggcgtcatccacgtgatccgggccttcatccgggaccagcacctgattggcatcgcctggagcacccaggagaggaacagaacagatgtgtcctctgtggagaaggccctgctggtgggctag

SEQ ID NO: 176544 - DNA, 1521 bp, Artificial Sequence
  Description of Artificial Sequence: Synthetic coding sequence
atgcctgccaacggcaccagcccccagcgcttccctgccctgatccctggagagcccggccgcagctttgagggctctgtgtcctttgaagatgtggccgtggacttcacccggcaggagtggcaccggctggaccctgcccagaggaccatgcacaaggatgtgatgctggagacctacagcaacctggcctctgtgggcctgtgtgtggccaagccagagatgatcttcaagctggagcggggggaggagctgtggatcctggaggaggagagcagcggccacggctacagcggcagcctgagcctgctgtgtggaaatggatctgtgggggacaatgccctgcggcatgacaatgacctgctgcaccaccagaagatccagaccctggaccagaatgtggagtacaacggctgcaggaaggccttccacgagaagacaggctttgtgcggaggaagaggacccccaggggggacaagaactttgaatgtcatgaatgtgggaaggcctactgcaggaagagcaacctggtggagcacctgcgcatccacactggagagcggccctatgaatgtggggagtgtgccaagaccttcagcgcccggagctacctgattgcccaccagaagacccacactggagagcggccctttgaatgtaatgaatgtgggaagagctttggaaggaagagccagctgatcctgcacaccaggacccacactggagagcggccctatgaatgtacagaatgtgggaagaccttcagcgagaaggccaccctgaccatccaccagaggacccacactggagagaagccctatgaatgttctgaatgtgggaagaccttccgggtgaagatcagcctgacccagcaccacaggacccacactggagagaagccctatgaatgtggggagtgtgggaagaacttccgggccaagaagagcctgaaccagcaccagaggatccacactggagagaagccctatgaatgtggggagtgtgggaagttcttcaggatgaagatgaccctgaacaaccaccagaggacccacactggagagaagccctaccagtgcaatgaatgtgggaagagcttccgggtgcacagcagcctgggcatccaccagaggatccacactggagagaagccctatgaatgtaatgaatgtggaaatgccttctacgtgaaggcccggctcatcgagcaccagaggatgcacagcggggagaagccctatgaatgttctgaatgtgggaagatcttctccatgaagaagagcctgtgccagcacaggaggacccacactggagagaagccctatgaatgttctgaatgtggaaatgccttctacgtgaaggtgcggctcatcgagcaccagaggatccacactggagagcggccctttgagtgccaggagtgtgggaaggccttctgcaggaaggcccacctgacagagcaccagaggacccacatcggctggagctggcgctgcaccatgaagaaggccagccactag

SEQ ID NO: 176545 - DNA, 2049 bp, Artificial Sequence
  Description of Artificial Sequence: Synthetic coding sequence
atgcccagcctgcggacccggcgggaggaggccgagatggagctgtctgtgcccggccccagcccctggaccccagctgcccaggcccgggtgagagatgccccagctgtgacccaccctggcagcgctgcctgtggcaccccctgctgcagcgacacagagctggaggccatctgcccccactaccagcagcctgactgtgacaccaggacagaggacaaggagttcctgcacaaggaggacatccacgaggacctggagagccaggccgagatcagcgagaactatgctggagatgtgtcccaggtgcctgagctgggggacctgtgtgatgatgtgtctgagcgggactggggcgtgcctgagggccggcggctgccccagagcctgagccaggagggggacttcaccccagctgccatgggcctgctgcggggccccctgggggagaaggacctggactgcaatggatttgacagccgcttcagcctgagccccaacctgatggcctgccaggagatccccacagaggagcggccccacccctatgacatgggcggccagagcttccagcacagcgtggacctgactggacatgaaggagtgcccacagctgagagccccctcatctgcaatgaatgtgggaagaccttccagggcaacccagacctgatccagaggcagatcgtgcacactggagaggccagcttcatgtgtgatgactgtgggaagaccttcagccagaacagcgtgctgaagaacagacacaggagccacatgtctgagaaggcctaccagtgcagtgaatgtgggaaggccttccggggccacagcgacttcagccgccaccagagccaccacagcagcgagcggccctacatgtgcaatgaatgtgggaaggccttcagccagaacagcagcctgaagaagcaccagaagagccacatgtctgagaagccctatgagtgcaatgaatgtgggaaggccttcagaagaagcagcaacctgatccagcaccagaggatccacagcggggagaagccctacgtgtgcagtgaatgtgggaaggccttcagaagaagcagcaacctgatcaagcaccacaggacccacactggagagaagccctttgaatgtggagaatgtgggaaggccttcagccagagcgcccacctgaggaagcaccagagggtgcacactggagagaagccctatgagtgcaatgactgtgggaagcccttcagccgggtgagcaacctgatcaagcaccaccgggtgcacactggagagaagccctacaagtgcagcgactgtgggaaggccttcagccagagcagcagcctcatccagcaccggcgcatccacactggagagaagccccacgtgtgcaatgtgtgtgggaaggccttctcctacagctctgtgctgaggaagcaccagatcatccacactggagagaagccctaccgctgcagcgtgtgtgggaaggccttcagccacagcagcgccctgatccagcaccagggcgtgcacactggagacaagccctatgcctgccatgaatgtgggaagaccttcggccgcagcagcaacctgatcctgcaccagagggtgcacactggagagaagccctatgagtgcacagaatgtgggaagaccttcagccagagcagcaccctcatccagcaccagaggatccacaacggcctgaagccccatgagtgcaaccagtgtgggaaggccttcaacagaagcagcaacctgatccaccaccagaaggtgcacactggagagaagccctacacctgtgtggagtgtgggaagggcttcagccagagcagccacctgatccagcaccagatcatccacactggagagcggccctacaagtgcagtgaatgtgggaaggccttcagccagaggtctgtgctgatccagcaccagaggatccacactggagtgaagccctatgactgtgccgcctgtgggaaggccttcagccagaggagcaagctgatcaagcaccagctgatccacacccgggagtag

SEQ ID NO: 176546 - DNA, 2049 bp, Artificial Sequence; identical to SEQ ID NO: 176545
  Description of Artificial Sequence: Synthetic coding sequence

SEQ ID NO: 176547 - DNA, 444 bp, Artificial Sequence
  Description of Artificial Sequence: Synthetic coding sequence
atggccctgacccaggtgcggctgaccttcagagatgtggccatcgagttcagccaggaggagtggaagtgcctggaccctgcccagaggatcctgtacagagatgtgatgctggagaactactggaacctggtgtccctgggcctgtgccactttgacatgaacatcatctccatgctggaggagggcaaggagccctggacagtgaagagctgtgtgaagatcgccaggaagcccaggaccccagaatgtgtgaagggcgtggtgacagacctgctgcggcgctggaagcactggctgctgctgctgggcatctgctgccccaagccccacggccgggtgagcagccggctgcggctgagccgcagcctgggccacttcttccacagcgcctttgccaccttcatgggcgtgtgtgacaagagggtgggcagcatcttctag

SEQ ID NO: 176548 - DNA, 2457 bp, Artificial Sequence
  Description of Artificial Sequence: Synthetic coding sequence
atggccctgacccaggtgcggctgaccttcagagatgtggccatcgagttcagccaggaggagtggaagtgcctggaccctgcccagaggatcctgtacagagatgtgatgctggagaactactggaacctggtgtccctgggcctgtgccactttgacatgaacatcatctccatgctggaggagggcaaggagccctggacagtgaagagctgtgtgaagatcgccaggaagcccaggaccccagaatgtgtgaagggcgtggtgacagacatcccccccaagtgcaccatcaaggacctgctgcccaaggagaagagcagcacagaagctgtgttccacacagtggtgctggagagacatgagagcccagacatcgaggacttctccttcaaggagccccagaagaatgtgcatgactttgagtgccagtggagagatgacaccggcaactacaagggcgtgctgatggcccagaaggagggcaagagggaccagagggacagaagagacatcgagaacaagctgatgaacaaccagctgggcgtgtccttccacagccacctgcctgagctgcagctgttccagggcgagggcaagatgtatgagtgcaaccaggtggagaagagcaccaacaacggcagctctgtgagccccctgcagcagatccccagctctgtgcagacccacaggagcaagaagtaccacgagctgaaccacttcagcctgctgacccagaggaggaaggccaacagctgtgggaagccctacaagtgcaatgaatgtgggaaggccttcacccagaacagcaacctgaccagccaccggcgcatccacagcggggagaagccctacaagtgcagtgaatgtgggaagaccttcaccgtgcgcagcaacctgaccatccaccaggtgatccacactggagagaagccctacaagtgccatgaatgtgggaaggtgttccgccacaacagctacctggccacccaccggcgcatccacactggagagaagccctacaagtgcaatgaatgtgggaaggccttccggggccacagcaacctgaccacccaccagctgatccacactggagagaagcccttcaagtgcaatgaatgtgggaagctgttcacccagaacagccacctgatcagccactggaggatccacactggagagaagccctacaagtgcaatgaatgtgggaaggccttctctgtgcgcagcagcctggccatccaccagaccatccacactggagagaagccctacaagtgcaatgaatgtgggaaggtgttccgctacaacagctacctgggccgccaccggcgggtgcacactggagagaagccctacaagtgcaatgaatgtgggaaggccttctccatgcacagcaacctggccacccaccaggtgatccacacaggcaccaagcccttcaagtgcaatgaatgttccaaggtgttcacccagaacagccagctggccaaccaccggcgcatccacactggagagaagccctacaagtgcaatgaatgtgggaaggccttctctgtgcgcagcagcctgaccacccaccaggccatccacagcggggagaagccctacaagtgcattgaatgtgggaagagcttcacccagaagagccacctgcggagccaccggggcatccacagcggggagaagccctacaagtgcaatgaatgtgggaaggtgtttgcccagaccagccagctggcccggcactggagggtgcacactggagagaagccctacaagtgcaatgactgtggccgggccttcagtgacaggagcagcctgaccttccaccaggccatccacactggagagaagccctacaagtgccatgaatgtgggaaggtgttccgccacaacagctacctggccacccaccggcgcatccacactggagagaagccctacaagtgcaatgaatgtgggaaggccttctccatgcacagcaacctgaccacccacaaggtgatccacactggagagaagccctacaagtgcaaccagtgtgggaaggtgttcacccagaacagccacctggccaaccaccagaggacccacactggagagaagccctaccgctgcaatgaatgtgggaaggccttctctgtgcgcagcagcctgaccacccaccaggccatccacacaggcaagaagccctacaagtgcaatgaatgtgggaaggtgttcacccagaatgcccacctggccaaccaccggcgcatccacactggagagaagccctaccgctgcacagaatgtgggaaggccttccgggtgcgcagcagcctgaccacccacatggccatccacactggagagaagcgctacaagtgcaatgaatgtgggaaggtgttccggcagagcagcaacctggccagccaccacaggatgcacactggagagaagccctacaagtag

SEQ ID NO: 176549 - DNA, 2457 bp, Artificial Sequence; identical to SEQ ID NO: 176548
  Description of Artificial Sequence: Synthetic coding sequence

SEQ ID NO: 176550 - DNA, 2457 bp, Artificial Sequence; identical to SEQ ID NO: 176548
  Description of Artificial Sequence: Synthetic coding sequence

SEQ ID NO: 176551 - DNA, 1350 bp, Artificial Sequence
  Description of Artificial Sequence: Synthetic coding sequence
atggagttcttcatctccatgtctgagaccatcaagtacaatgatgatgaccacaagaccctcttcctgaagaccctgaatgagcagaggctggagggggagttctgtgacatcgccatcgtggtggaggatgtgaagttccgggcccaccgctgtgtgctggccgcctgcagcacctacttcaagaagctgttcaagaagctggaggtggacagcagcagcgtcatcgagattgacttcctgcggagtgacatctttgaggaggtgctgaactacatgtacacagccaagatctctgtgaagaaggaggatgtgaacctgatgatgagcagcggccagatcctgggcatccgcttcctggacaagctgtgcagccagaagagagatgtgagcagcccagatgaaaataatggccagagcaagagcaagtactgcctgaagatcaaccggcccatcggagatgctgctgacacccaggatgatgatgtggaggagatcggggaccaggatgacagccccagtgatgacacagtggagggcaccccacccagccaggaggatggcaagagccccaccaccaccctgcgggtgcaggaggccatcctgaaggagctgggcagcgaggaggtgaggaaggtgaactgctacggccaggaggtggagagcatggagaccccagagagcaaggacctgggcagccagaccccccaggccctgaccttcaatgatggcatgtctgaggtgaaggatgagcagaccccaggctggaccacagctgccagtgacatgaagtttgagtacctgctgtatggccaccaccgggagcagatcgcctgccaggcctgtgggaagaccttcagtgatgagggccgcctgaggaagcatgagaagctgcacacagctgaccggccctttgtgtgtgagatgtgcaccaagggcttcaccacccaggcccacctgaaggagcacctgaagatccacacaggctacaagccctacagctgtgaggtgtgtgggaagagcttcatccgggccccagacctgaagaagcatgagcgggtgcacagcaatgaaagaccatttgcctgccacatgtgtgacaaggccttcaagcacaagagccacctgaaggaccatgaaagaagacacagaggagagaagccctttgtgtgtggcagctgcaccaaggcctttgccaaggccagtgacctgaagagacatgagaacaacatgcacagcgagaggaagcaggtgaccccatctgccatccagagcgagacagagcagctgcaggccgccgccatggctgctgaggccgagcagcagctggagaccatcgcctgcagctag

SEQ ID NO: 176552 - DNA, 1350 bp, Artificial Sequence; identical to SEQ ID NO: 176551
  Description of Artificial Sequence: Synthetic coding sequence

SEQ ID NO: 176553 - DNA, 1458 bp, Artificial Sequence
  Description of Artificial Sequence: Synthetic coding sequence
atggccacagagcccaagaaggctgctgcccagaacagcccagaagatgagggcctgctgattgtgaagattgaggaggaggagttcatccacggccaggacacctgcctgcagaggtctgagctgctgaagcaggagctgtgccggcagctgttccggcagttctgctaccaggacagccctggcccccgggaggccctgagccggctgcgggagctgtgctgccagtggctgaagccagagatccacaccaaggagcagatcctggagctgctggtgctggagcagttcctgaccatcctgcccggggacctgcaggcctgggtgcatgagcactacccagagagcggggaggaggccgtgaccatcctggaggacctggagcggggcacagatgaggccgtgctgcaggtgcaggcccatgaacatggccaggagatcttccagaagaaggtgagccccccaggccctgccctgaatgtgaagctgcagcctgtggagaccaaggcccactttgacagcagcgagccccagctgctgtgggactgtgacaatgaaagtgagaacagccgctccatgcccaagctggagatctttgagaagattgagagccagaggatcatcagcggccgcatcagcggctacatcagcgaggccagcggggagagccaggacatctgcaagtctgctggccgggtgaagaggcagtgggagaaggagagcggggagagccagaggctgagcagcgcccaggatgagggctttgggaagatcctgacccacaagaacacagtgcggggggagatcatcagccatgatggctgtgaaagaaggctgaacctgaacagcaatgagttcacccaccagaagagctgcaagcacggcacctgtgaccagagcttcaagtggaacagcgacttcatcaaccaccagatcatctatgctggggagaagaaccaccagtatggcaagagcttcaagagccccaagctggccaagcatgctgctgtgttttctggggacaagacccaccagtgcaatgaatgtgggaaggccttccgccacagcagcaagctggcccggcaccagaggatccacactggagagcgctgctatgaatgtaatgaatgtgggaagagctttgctgagagcagtgacctgaccaggcaccggcgcatccacactggagagcggcccttcggctgcaaggaatgtggccgggccttcaacctgaacagccacctgatccgccaccagaggatccacacccgggagaagccctatgaatgttctgaatgtgggaagaccttccgggtgagcagccacctgatccgccacttccgcatccacactggagagaagccctatgaatgttctgaatgtggccgggccttcagccagagcagcaacctgagccagcaccagaggatccacatgagggagaacctgctgatgtag

SEQ ID NO: 176554 - DNA, 1239 bp, Artificial Sequence
  Description of Artificial Sequence: Synthetic coding sequence
atgagcctgggcggcagtgacaccatgctgaagggagctgacaccagcgagagcggggccgtcatccggggcaactaccgcctgggcctgagcaagaagagcagcctcttcagccaccagaagcaccacgtgtgcccagaatgtggccggggcttctgccagaggagtgacctgatcaagcaccagaggacccacactggagagaagccctacctgtgcccagaatgtggccgccgcttcagccagaaggccagcctgagcatccaccagaggaagcacagcggggagaagccctacgtgtgcagagaatgtggccgccacttccgctacaccagcagcctgaccaaccacaagaggatccacagcggggagcggccctttgtgtgccaggagtgtggccggggcttccggcagaagatcgccctgctgctgcaccagaggacccacctggaggagaagccctttgtgtgcccagaatgtggccggggcttctgccagaaggccagcctgctgcagcaccagagcagccacactggagagcggcccttcctgtgcctggagtgtggccgctccttccggcagcagagcctgctgctgagccaccaggtgacccacagcggggagaagccctacgtgtgtgctgaatgtggccacagcttccggcagaaggtgaccctcatccgccaccagaggacccacactggagagaagccctacctgtgcccccagtgtggccggggcttcagccagaaggtgaccctgattggccaccagaggacccacactggagagaagccctacctgtgcccagactgtggccggggcttcggccagaaggtgaccctcatccgccaccagaggacccacactggagagaagccctacctgtgccccaagtgtggccgggccttcggcttcaagagcctgctgaccaggcaccagaggacccacagcgaggaggagctgtatgtggacagagtgtgtggccagggcctgggccagaagagccacctgatcagtgaccagaggacccacagcggggagaagccctgcatctgtgatgaatgtggccggggcttcggcttcaagagcgccctgatccgccaccagaggacccacagcggggagaagccctacgtgtgcagagaatgtggccggggcttcagccagaagagccacctgcaccgccacaggaggaccaagagcggccaccagctgctgccccaggaggtgttctag

SEQ ID NO: 176555 - DNA, 291 bp, Artificial Sequence
  Description of Artificial Sequence: Synthetic coding sequence
atgagccctggcctgctgaccaccaggaaggaggccctgatggccttcagagatgtggccgtggccttcacccagaaggagtggaagctgctgagcagcgcccagaggaccctgtaccgggaggtgatgctggagaactacagccacctggtgtccctgggcatcgccttcagcaagcccaagctgattgagcagctggagcagggagatgagccctggagggaggagaatgagcacctgctggacctgtgccctggaagacgcatcaccaggtctggagtgcgggactag

SEQ ID NO: 176556 - DNA, 1812 bp, Artificial Sequence
  Description of Artificial Sequence: Synthetic coding sequence
atgagccctggcctgctgaccaccaggaaggaggccctgatggccttcagagatgtggccgtggccttcacccagaaggagtggaagctgctgagcagcgcccagaggaccctgtaccgggaggtgatgctggagaactacagccacctggtgtccctgggcatcgccttcagcaagcccaagctgattgagcagctggagcagggagatgagccctggagggaggagaatgagcacctgctggacctgtgcccagagcccaggacagagttccagcccagcttcccccacctggtggccttcagcagcagccagctgctgcggcagtatgccctgagcggccaccccacccagatcttccccagcagcagcgctggaggagacttccagctggaggccccccgctgcagcagcgagaagggggagagcggggagacagagggccctgacagcagcctgaggaagaggcccagccgcatcagcaggaccttcttcagcccccaccagggcgaccctgtggagtgggtggagggcaaccgggagggcggcacagacctgcggctggcccagaggatgagcctgggcggcagtgacaccatgctgaagggagctgacaccagcgagagcggggctgtgatccggggcaactaccgcctgggcctgagcaagaagagcagcctcttcagccaccagaagcaccacgtgtgcccagaatgtggccggggcttctgccagaggagtgacctgatcaagcaccagaggacccacactggagagaagccctacctgtgcccagaatgtggccgccgcttcagccagaaggccagcctgagcatccaccagaggaagcacagcggggagaagccctacgtgtgccgggagtgtggccgccacttccgctacaccagcagcctgaccaaccacaagaggatccacagcggggagcggccctttgtgtgccaggagtgtggccggggcttccggcagaagatcgccctgctgctgcaccagaggacccacctggaggagaagccctttgtgtgcccagaatgtggccggggcttctgccagaaggccagcctgctgcagcaccagagcagccacactggagagcggcccttcctgtgcctggagtgtggccgctccttccggcagcagagcctgctgctgagccaccaggtgacccacagcggggagaagccctacgtgtgtgccgagtgtggccacagcttccggcagaaggtgaccctcatccgccaccagaggacccacactggagagaagccctacctgtgcccccagtgtggccggggcttcagccagaaggtgaccctcatcggccaccagaggacccacactggagagaagccctacctgtgcccagactgtggccggggcttcggccagaaggtgaccctcatccgccaccagaggacccacactggagagaagccctacctgtgccccaagtgtggccgggccttcggcttcaagagcctgctgaccaggcaccagaggacccacagcgaggaggagctgtatgtggacagagtgtgtggccagggcctgggccagaagagccacctgatcagtgaccagaggacccacagcggggagaagccctgcatctgtgatgaatgtggccggggcttcggcttcaagagcgccctgatccgccaccagaggacccacagcggggagaagccctacgtgtgccgggagtgtggccggggcttcagccagaagagccacctgcaccgccacaggaggaccaagagcggccaccagctgctgccccaggaggtgttctag

SEQ ID NO: 176557 - DNA, 1224 bp, Artificial Sequence
  Description of Artificial Sequence: Synthetic coding sequence
atggccgccaagatggagatcaccctgagcagcaacacagaggccagcagcaagcaggagcggcacatcatcgccaagctggaggagaagaggggcccccccctgcagaagaactgcccagaccctgagctgtgccggcagagcttccgccgcttctgctaccaggaggtgtctggcccccaggaggccctgagccagctgcggcagctgtgccggcagtggctgcagcctgagctgcacaccaaggagcagatcctggagctgctggtgatggagcagttcctgaccatcctgcccccagagatccaggcccgggtgcgccaccgctgccccatgagcagcaaggagatcgtgaccctggtggaggacttccaccgggccagcaagaagcccaagcagtgggtggccgtgtgcatgcagggccagaaggtgctgctggagaagacaggcagccagctgggggagcaggagctgcctgacttccagccccagaccccaagaagagacctgcgggagagcagccctgctgagcccagccaggccggggcctatgaccggctgagcccccaccactgggagaagagccccctgctgcaggagcccacccccaagctggccggcacagaggcccccaggatgagaagtgacaacaaggagaacccccagcaggagggcgccaagggggccaagccctgtgctgtgtctgctggccgcagcaaaggaaatggcctgcagaaccctgagcccaggggggccaacatgtctgagccccggctgagccggcggcaggtgagcagccccaatgcccagaagccctttgcccactaccagaggcactgccgggtggagtacatcagcagccccctgaagagccaccccctgcgggagctgaagaagagcaaaggaggcaagaggagcctgagcaaccggctgcagcacctgggccaccagcccaccaggtctgccaagaagccctacaagtgtgatgactgtgggaagagcttcacctggaacagcgagctgaagaggcacaagagggtgcacactggagagcggccctacacctgtggggagtgtggcaactgcttcggccggcagagcaccctgaagctgcaccagaggatccacactggagagaagccctaccagtgtggccagtgtgggaagagcttccggcagagcagcaacctgcaccagcaccaccggctgcaccacggggactag

SEQ ID NO: 176558 - DNA, 705 bp, Artificial Sequence
  Description of Artificial Sequence: Synthetic coding sequence
atggccgccaagatggagatcaccctgagcagcaacacagaggccagcagcaagcaggagcggcacatcatcgccaagctggaggagaagaggggcccccccctgcagaagaactgcccagaccctgagctgtgccggcagagcttccgccgcttctgctaccaggaggtgtctggcccccaggaggccctgagccagctgcggcagctgtgccggcagtggctgcagcctgagctgcacaccaaggagcagatcctggagctgctggtgatggagcagttcctgaccatcctgcccccagagatccaggcccgggtgcgccaccgctgccccatgagcagcaaggagatcgtgaccctggtggaggacttccaccgggccagcaagaagcccaagcagtgggtggccgtgtgcatgcagggccagaaggtgctgctggagaagacaggcagccagctgggggagcaggagctgcctgacttccagccccagaccccaagaagagacctgcgggagagcagccctgctgagcccagccaggccggggcctatgaccggctgagcccccaccactgggagaagagccccctgctgcaggagcccacccccaagctggccggcacagagctgctgattgagaagacagaccccaacatggccacagatgagctgccctgcaagctgtggctgtccttcatcgcctag

SEQ ID NO: 176559 - DNA, 2136 bp, Artificial Sequence
  Description of Artificial Sequence: Synthetic coding sequence
atgccagcagatgtgaacctgagccagaagccccaggtgctgggccctgagaagcaggacggcagctgtgaggcctctgtgtcctttgaagatgtgacagtggacttcagccgggaggagtggcagcagctggaccctgcccagcgctgcctgtacagagatgtgatgctggagctgtacagccacctgtttgctgtgggctaccacatccccaaccctgaggtgatcttcaggatgctgaaggagaaggagccccgggtggaggaggccgaggtgagccaccagcgctgccaggagcgggagtttggcctggagatcccccagaaggagatcagcaagaaggccagcttccagaaggacatggtgggggagttcaccagagatggctcctggtgcagcatcctggaggagctgcggctggatgctgacaggaccaagaaggatgagcagaaccagatccagcccatgagccacagcgccttcttcaacaagaagaccctgaacacagagagcaactgtgagtacaaggaccccgggaagatgatccgcacccggccccacctggccagcagccagaagcagccccagaagtgctgcctcttcacagagagcctgaagctgaacctggaggtgaatggccagaatgaaagcaatgacacagagcagctggatgatgtggtgggcagcggccagctgttcagccacagcagcagtgatgcctgcagcaagaacatccacactggagagaccttctgcaagggcaaccagtgcaggaaggtgtgtggccacaagcagagcctgaagcagcaccagatccacacccagaagaagccagatggctgcagtgaatgtggcggcagcttcacccagaagagccacctgtttgcccagcagaggatccacagcgtgggcaacctgcatgaatgtgggaaatgtgggaaggccttcatgccccagctgaagctgtctgtgtacctgacagaccacactggagacatcccctgcatctgcaaggaatgtgggaaggtgttcatccagaggtctgagctgctgacccaccagaagacccacaccaggaagaagccctacaagtgccacgactgtgggaaggccttcttccagatgctgagcctcttccgccaccagaggacccacagccgggagaagctgtatgagtgcagtgaatgtgggaagggcttcagccagaacagcaccctcatcatccaccagaagatccacactggagagcggcagtatgcctgcagtgaatgtgggaaggccttcacccagaagagcaccctgagcctgcaccagaggatccacagcggccagaagagctatgtgtgcattgaatgtggccaggccttcatccagaaggcccacctgattgtgcaccagaggagccacactggagagaagccctaccagtgccacaactgtgggaagagcttcatcagcaagagccagctggacatccaccaccgcatccacactggagagaagccctatgagtgcagcgactgtgggaagaccttcacccagaagagccacctgaacatccaccagaagatccacactggagagcggcaccacgtgtgcagtgaatgtgggaaggccttcaaccagaagagcatcctgtccatgcaccagaggatccacactggagagaagccctacaagtgcagtgaatgtgggaaggccttcaccagcaagagccagttcaaggagcaccagaggatccacactggagagaagccctacgtgtgcacagaatgtgggaaggccttcaacggccgcagcaacttccacaagcaccagatcacccacacccgggagcggccctttgtgtgctacaagtgtgggaaggcctttgtgcagaagtctgagctgatcacccaccagaggacccacatgggagagaagccctatgagtgcctggactgtgggaagagcttcagcaagaagccccagctgaaggtgcaccagaggatccacactggagagcggccctacgtgtgcagtgaatgtgggaaggccttcaacaacagaagcaacttcaacaagcaccagaccacccacacccgggacaagagctacaagtgcagctacagcgtgaagggcttcaccaagcagtag

SEQ ID NO: 176560 - DNA, 966 bp, Artificial Sequence
  Description of Artificial Sequence: Synthetic coding sequence
atggctgctggctggctgaccacctggagccagaacagcgtgaccttccaggaggtggccgtggacttcagccaggaggagtgggccctgctggaccctgcccagaagaacctgtacaaggatgtgatgctggagaacttcaggaacctggcctctgtgggctaccagctgtgccgccacagcctcatcagcaaggtggaccaggagcagctgaagacagatgagcggggcatcctgcagggcgactgtgccgactgggagacccagctgaagcccaaggacaccatcgccatgcagaacatccctgggggcaagaccagcaatggcatcaacaccaactgtgtgaggacccacagcggggagatgccctatgaatgtagtgactgtgggaaggccttcatcttccagagcagcctgaagaagcacatgaggagccacactggagagaagccctatgaatgtgaccactgcggcaagagcttcagccagagcagccacctgaatgtgcacaagaggacccacactggagagaagccctatgactgcaaggaatgtgggaaggccttcaccgtgcccagcagcctgcagaagcacgtgaggacccacactggagagaagccctatgaatgtagtgactgtgggaaggccttcatcgaccagagcagcctgaagaagcacaccaggagccacactggagagaagccctatgagtgcaaccagtgtgggaagagcttcagcacaggcagctacctgattgtgcacaagaggacccacactggagagaagacctatgagtgcaaggaatgtgggaaggccttcaggaacagcagctgcctgcgggtgcacgtgaggacccacactggagagaagccctacaagtgcatccagtgtgagaaggccttcagcaccagcaccaacctgatcatgcacaagaggatccacaacggccagaagctgcacgagtag

SEQ ID NO: 176561 - DNA, 1446 bp, Artificial Sequence
  Description of Artificial Sequence: Synthetic coding sequence
atggctgctggctggctgaccacctggagccagaacagcgtgaccttccaggaggtggccgtggacttcagccaggaggagtgggccctgctggaccctgcccagaagaacctgtacaaggatgtgatgctggagaacttcaggaacctggcctctgtgggctaccagctgtgccgccacagcctcatcagcaaggtggaccaggagcagctgaagacagatgagcggggcatcctgcagggcgactgtgccgactgggagacccagctgaagcccaaggacaccatcgccatgcagaacatccctgggggcaagaccagcaatggcatcaacacagctgagaaccagcctggagagcacagcctggagtgcaaccactgcggcaagttcaggaagaacacccgcttcatctgcacccgctactgcaagggggagaagtgctacaagtacatcaagtacagcaaggtgttcaaccaccccagcaccctgcggagccacgtgtccatccacatcggggagaagaccctggagttcacagactgcaggaaggccttcaaccaggagagcagcctgaggaagcacctgcggacccccaccggccagaagttccaggagtatgagcagtgtgacatgtccttcagcctgcacagcagctgcagcgtgcgggagcagatccccactggagagaagggagatgaatgtagtgactatggcaagatcagccccctgtctgtgcacaccaagacaggctctgtggaggagggcctggagtgcaatgaacatgagaagaccttcacagaccccctgagcctgcagaactgtgtgaggacccacagcggggagatgccctatgaatgtagtgactgtgggaaggccttcatcttccagagcagcctgaagaagcacatgaggagccacactggagagaagccctatgaatgtgaccactgcggcaagagcttcagccagagcagccacctgaatgtgcacaagaggacccacactggagagaagccctatgactgcaaggaatgtgggaaggccttcaccgtgcccagcagcctgcagaagcacgtgaggacccacactggagagaagccctatgaatgtagtgactgtgggaaggccttcatcgaccagagcagcctgaagaagcacaccaggagccacactggagagaagccctatgagtgcaaccagtgtgggaagagcttcagcacaggcagctacctgattgtgcacaagaggacccacactggagagaagacctatgagtgcaaggaatgtgggaaggccttcaggaacagcagctgcctgcgggtgcacgtgaggacccacactggagagaagccctacaagtgcatccagtgtgagaaggccttcagcaccagcaccaacctgatcatgcacaagaggatccacaacggccagaagctgcacgagtag

SEQ ID NO: 176562 - DNA, 363 bp, Artificial Sequence
  Description of Artificial Sequence: Synthetic coding sequence
atggctgctggctggctgaccacctggagccagaacagcgtgaccttccaggaggtggccgtggacttcagccaggaggagtgggccctgctggaccctgcccagaagaacctgtacaaggatgtgatgctggagaacttcaggaacctggcctctgtgggctaccagctgtgccgccacagcctcatcagcaaggtggaccaggagcagctgaagacagatgagcggggcatcctgcagggcgactgtgccgactgggagacccagctgaagcccaaggacaccatcgccatgcagaacatccctgggggcaagaccagcaatggcatcaacaccaacccccacggccgggagttcctgtag

SEQ ID NO: 176563 - DNA, 966 bp, Artificial Sequence; identical to SEQ ID NO: 176560
  Description of Artificial Sequence: Synthetic coding sequence

SEQ ID NO: 176564 - DNA, 1650 bp, Artificial Sequence
  Description of Artificial Sequence: Synthetic coding sequence
atgcctgtggacctgggccaggccctgggcctgctgcccagcctggccaaggccgaggacagccagttcagcgagagtgatgctgccctgcaggaggagctgagcagccctgagacagcccggcagctgttccggcagttccgctaccaggtgatgagcggcccccatgagaccctgaagcagctgaggaagctgtgcttccagtggctgcagcctgaggtgcacaccaaggagcagatcctggagatcctgatgctggagcagttcctgaccatcctgcccggggagatccagatgtgggtgaggaagcagtgccccggcagcggggaggaggccgtgaccctggtggagagcctgaagggggacccccagaggctgtggcagtggatcagcatccaggtgctgggccaggacatcctgtctgagaagatggagagccccagctgccaggtgggggaggtggagccccacctggaggtggtgccccaggagctgggcctggagaacagcagcagcggccctggagagctgctgagccacatcgtgaaggaggagagtgacacagaggccgagctggccctggccgccagccagcctgcccggctggaggagcggctcatccgggaccaggacctgggcgccagcctgctgcctgctgccccccaggagcagtggaggcagctggacagcacccagaaggagcagtactgggacctgatgctggagacctacggcaagatggtgtctggagctggcatcagccaccccaagagtgacctgaccaacagcattgaatttggagaggagctggccggcatctacctgcacgtgaatgagaagatcccccggcccacctgcattggagaccggcaggagaatgacaaggagaacctgaacctggagaaccaccgggaccaggagctgctgcacgccagctgccaggccagcggggaggtgcccagccaggccagcctgcggggcttcttcacagaagatgagcccggctgctttggagaaggagagaacctgcctgaggccctgcagaacatccaggatgagggcactggagagcagctgagcccccaggagcgcatcagcgagaagcagctgggccagcacctgcccaacccccacagcggggagatgagcaccatgtggctggaggagaagcgggagaccagccagaagggccagccccgggcccccatggcccagaagctgcccacctgccgggagtgtgggaagaccttctacagaaacagccagctgatcttccaccagaggacccacactggagagacctacttccagtgcaccatctgcaagaaggccttcctgcggagcagtgactttgtgaagcaccagaggacccacactggagagaagccctgcaagtgtgactactgtgggaagggcttcagtgacttcagcggcctgcggcaccacgagaagatccacactggagagaagccctacaagtgccccatctgtgagaagagcttcatccagaggagcaacttcaacagacaccagagggtgcacactggagagaagccctacaagtgcagccactgcggcaagagcttctcctggagcagcagcctggacaagcaccagaggagccacctgggcaagaagcccttccagtag

SEQ ID NO: 176565 - DNA, 1650 bp, Artificial Sequence; identical to SEQ ID NO: 176564
  Description of Artificial Sequence: Synthetic coding sequence

SEQ ID NO: 176566 - DNA, 1959 bp, Artificial Sequence
  Description of Artificial Sequence: Synthetic coding sequence
atgatcaatgcccaggagctgctgaccctggaggatgtgacagtggagttcacctgggaggagtggcagctgctgggccccttccagaaggacctgtacagagatgtgatgctggagatctacagcaacctgctgtccatgggctaccaggtgtccaagccagatgccctgagcaagctggagcggggggaggagccctggaccatggaggatgagcggcacagccgcatctgcccagagaacaatgaggtggatgaccacctgcaggaccacctggagaaccagaggatgctgaagtctgtggagcagtaccacgagcacaatgccttcggcaacacagccagccagaccaagagcctgtgcctcttcagagaaaatcatgacacctttgagctgtacatcaagaccctgaagagcaacctgagcctggtgaaccagaacaagagctgtgagatcaacaacagcaccaagttctctggagatggcaagagcttcctgcacggcaactatgaggagctgtacagcgctgccaagttctctgtgtccaccaaggccaacagcaccaagagccaggtgtccaagcaccagaggacccatgaaattgagaagaaccacgtgtgcagtgaatgtgggaaggcctttgtgaagaagagccagctgacagaccacgagcgggtgcacactggagagaagccctacggctgcaccctgtgtgccaaggtgttcagcaggaagagccggctgaatgagcaccagaggatccacaagcgggagaagagcttcatctgcagtgaatgtgggaaggtgttcaccatgaagagccggctgattgagcaccagaggacccacactggagagaagccctacatctgcaatgaatgtgggaagggcttccctgggaagaggaacctgattgtgcaccagaggaaccacactggagagaagagctacatctgcagtgaatgtgggaagggcttcaccgggaagtccatgctgatcatccaccagaggacccacactggagagaagccctacatctgcagtgaatgtgggaagggcttcaccaccaagcactacgtgatcatccaccagaggaaccacactggagagaagccctacatctgcaatgaatgtgggaagggcttcaccatgaagagcaggatgattgagcaccagaggacccacactggagagaagccctacatctgcagtgaatgtgggaagggcttccccaggaagagcaacctgattgtgcaccagaggaaccacacagtggagaagagctacctgtgcagtgaatgtgggaagggcttcaccgtgaagtccatgctgatcatccaccagaggacccacactggagagaagccctacacctgcagtgaatgtgggaagggcttccccctgaagagccggctgattgtgcaccagaggacccacactggagagaagccctaccgctgcagtgaatgtgggaagggcttcatcgtgaacagcggcctgatgctgcaccagaggacccacactggagagaagccctacatctgcaatgaatgtgggaagggctttgccttcaagagcaacctggtggtgcaccagaggacccacactggagagaagcccttcatgtgcagtgaatgtgggaagggcttcaccatgaagcgctacctgattgtgcaccagcagatccacacagaggagaagagctgcatctgcagtgaatgtggccggggctttgccaaggagacagagctggccctgcacaagcaggtgcacactggagagaagccctacggctgcaatgaatgtgggaagggcttcaccatgaagagccggctgattgtgcaccagaggacccacactggagagaagccctttgtgtgcagtgaatgtaggaaggccttcagcagcaagaggaacctgattgtgcaccagaggacccacaacggcaacaagccctag

SEQ ID NO: 176567 - DNA, 2004 bp, Artificial Sequence
  Description of Artificial Sequence: Synthetic coding sequence
atgagggcctgtgccggcagcacccgggaggccggcagcggggcccaggacctgagcaccctgctgtgcctggaggagagcatggaggagcaggatgagaagcccccagagccccccaaggcctgtgcccaggagggcgtgaacttcaagatcgtgacagtggacttcacccgggaggagcagggcacctggaacccagcccagaggaccctggacagagatgtgatcctggagaaccaccgggacctggtgtcctgggacctggccacagctgtgggcaagaaggacagcaccagcaagcagaggatctttgatgaggagcccgccaacggggtgaagattgagcgcttcaccagagatgacccctggctgagcagctgtgaggaggtggatgactgcaaggaccagctggagaagcagcaggagaagcaggagatcctgctgcaggaggtggccttcacccagaggaaggccgtcatccacgagcgggtgtgcaagagtgatgagaccggggagaagagcggcctgaacagcagcctcttcagcagccctgtgatccccatccggaaccacttccacaagcacgtgagccacgccaagaagtggcacctgaatgctgctgtgaacagccaccagaagatcaatgaaaatgagaccctgtatgagaacaatgaatgtgggaagccaccccagagcatccacctgatccagttcaccaggacccagaccaaggacaagtgctacggcttcagtgaccgcatccagagcttctgccacggcacccccctgcacatccacgagaagatccacggcggcggcaagacctttgacttcaaggaatgtggccaggtgctgaaccccaagatcagccacaatgagcagcagaggatcccctttgaggagagccagtacaagtgcagcgagaccagccacagcagcagcctgacccagaacatgaggaacaacagcgaggagaagccctttgagtgcaaccagtgtgggaagagcttctcctggagcagccacctggtggcccaccagaggacccacactggagagaagccctatgaatgttctgaatgtgggaagagcttcagccgcagcagccacctggtgagccaccagaggacccacactggagagaagccctaccgctgcaaccagtgtgggaagagcttcagccagagctatgtgctggtggtgcaccagaggacccacactggagagaagccctatgagtgcaaccagtgtgggaagagcttccggcagagctacaagctgattgcccaccagaggacccacactggagagaagccctatgagtgcaaccagtgtgggaagagcttcatccagagctacaagctgattgcccaccagaggatccacactggagagaagccctatgagtgcaaccagtgtgggaagagcttcagccagagctacaagctggtggcccaccagaggacccacactggagagaagccctttgagtgcaaccagtgtgggaagagcttctcctggagcagccagctggtggcccaccagaggacccacactggagagaagccctatgaatgttctgaatgtgggaagagcttcaacagaagcagccacctggtgatgcaccagaggatccacactggagagaagccctatgagtgcaaccagtgtgggaagagcttcagccagagctatgtgctggtggtgcaccagaggacccacactggagagaagccctatgaatgttcccagtgtgggaagagcttccggcagagcagctgcctgacccagcaccagaggacccacactggagagaagccctttgagtgcaaccagtgtgggaagaccttcagcctgagcgcccggctcatcgtgcaccagaggacccacactggagagaagcccttcacctgcatccagtgtgggaaggccttcatcaacagctacaagctgatccgccaccaggccacccacacagaggagaagctgtatgagtgcaactag

SEQ ID NO: 176568 - DNA, 1848 bp, Artificial Sequence
  Description of Artificial Sequence: Synthetic coding sequence
atgccccagctgcagtacccagagggctacctggcccccaaccgctgcctggtgagcaactgtggggtgaacaagatgagcaatgatgagctggtgggccagaaccacggcatggagggggaggcctgcattggaggagatgtgaccttcaatgatgtggccatcgacttcacccatgaggagtggggctggctgagcagcgcccagagggacctgtacaaggatgtgatggtgcagaactatgagaacctggtgtctgtggccggcctgtctgtgaccaagccctacgtgatcaccctgctggaggatggcaaggagccctggatgatggagaagaagctgagcaagggcatgatcccagactgggagagccgctgggagaacaaggagctgagcaccaagaaggacaactatgatgaggacagcccccagaccgtcatcatcgagaaggtggtgaagcagagctatgagttcagcaacagcaagaagaacctggagtacatcgagaagctggagggcaagcacggcagccaggtggaccacttccggcctgccatcctgaccagccgggagagccccacagctgacagcgtgtacaagtacaacatcttccgcagcaccttccacagcaagagcaccctgtctgagccccagaagatctctgctgagggcaacagccacaagtatgacatcctgaagaagaacctgcccaagaagagcgtcatcaagaatgagaaggtgaatggaggcaagaagctgctgaacagcaacaagtctggagctgccttcagccagggcaagagcctgaccctgccccagacctgcaaccgggagaagatctacacctgcagtgaatgtgggaaggccttcggcaagcagagcatcctgaacagacactggaggatccacactggagagaagccctatgagtgcagagaatgtgggaagaccttcagccacggcagcagcctgaccaggcacctgatcagccacagcggggagaagccctacaagtgcattgaatgtgggaaggccttcagccacgtgagcagcctgaccaaccaccagagcacccacactggagagaagccctatgagtgcatgaactgtgggaagagcttcagccgggtgagccacctgattgagcacctgcgcatccacacccaggagaagctgtatgagtgccgcatctgtgggaaggccttcatccacaggagcagcctcatccaccaccagaagatccacactggagagaagccctatgagtgcagagaatgtgggaaggccttctgctgcagcagccacctgaccaggcaccagaggatccacaccatggagaagcagtatgagtgcaacaagtgcctgaaggtgttcagcagcctgtccttcctggtgcagcaccagagcatccacacagaggagaagccctttgagtgccagaagtgcaggaagagcttcaaccagctggagagcctgaacatgcacctgaggaaccacatccggctgaagccctatgagtgcagcatctgtgggaaggccttcagccacaggagcagcctgctgcagcaccaccgcatccacactggagagaagccctatgagtgcatcaagtgtgggaagaccttcagctgcagcagcaacctgactgtgcaccagaggatccacactggagagaagccctacaagtgcaatgaatgtgggaaggccttcagcaagggcagcaacctgacagcccaccagagggtgcacaacggggagaagcccaacagcgtggtgtctgtggagaagcccctggactacatgaaccactacacctgtgagaagagctacagaagagagaccgtgtag

SEQ ID NO: 176569 - DNA, 1404 bp, Artificial Sequence
  Description of Artificial Sequence: Synthetic coding sequence
atgccccaggtgaccttcaatgatgtggccatcgacttcacccatgaggagtggggctggctgagcagcgcccagagggacctgtacaaggatgtgatggtgcagaactatgagaacctggtgtctgtgggcctgtctgtgaccaagccctacgtgatcaccctgctggaggatggcaaggagccctggatgatggagaagaagctgagcaagggcatgatcccagactgggagagccgctgggagaacaaggagctgagcaccaagaaggacaactatgatgaggacagcccccagaccgtcatcatcgagaaggtggtgaagcagagctatgagttcagcaacagcaagaagaacctggagtacatcgagaagctggagggcaagcacggcagccaggtggaccacttccggcctgccatcctgaccagccgggagagccccacagctgacagcgtgtacaagtacaacatcttccgcagcaccttccacagcaagagcaccctgtctgagccccagaagatctctgctgagggcaacagccacaagtatgacatcctgaagaagaacctgcccaagaagagcgtcatcaagaatgagaaggtgaatggaggcaagaagctgctgaacagcaacaagagcggggccgccttcagccagggcaagagcctgaccctgccccagacctgcaaccgggagaagatctacacctgcagtgaatgtgggaaggccttcggcaagcagagcatcctgaacagacactggaggatccacactggagagaagccctatgaatgtcgggagtgtgggaagaccttcagccacggcagcagcctgaccaggcacctgatcagccacagcggggagaagccctacaagtgcattgaatgtgggaaggccttcagccacgtgagcagcctgaccaaccaccagagcacccacactggagagaagccctatgagtgcatgaactgtgggaagagcttcagccgggtgagccacctgattgagcacctgcgcatccacacccaggagaagctgtatgaatgtcgcatctgtgggaaggccttcatccacaggagcagcctcatccaccaccagaagatccacactggagagaagccctatgaatgtcgggagtgtgggaaggccttctgctgcagcagccacctgaccaggcaccagaggatccacaccatggagaagcagtatgagtgcaacaagtgcctgaaggtgttcagcagcctgtccttcctggtgcagcaccagagcatccacacagaggagaagccctttgagtgccagaagtgcaggaagagcttcaaccagctggagagcctgaacatgcacctgaggaaccacatcgagaccctgaggatgcagtacatgtgggagagcctgtag

SEQ ID NO: 176570 - DNA, 1713 bp, Artificial Sequence
  Description of Artificial Sequence: Synthetic coding sequence
atgccccaggtgaccttcaatgatgtggccatcgacttcacccatgaggagtggggctggctgagcagcgcccagagggacctgtacaaggatgtgatggtgcagaactatgagaacctggtgtctgtgggcctgtctgtgaccaagccctacgtgatcaccctgctggaggatggcaaggagccctggatgatggagaagaagctgagcaagggcatgatcccagactgggagagccgctgggagaacaaggagctgagcaccaagaaggacaactatgatgaggacagcccccagaccgtcatcatcgagaaggtggtgaagcagagctatgagttcagcaacagcaagaagaacctggagtacatcgagaagctggagggcaagcacggcagccaggtggaccacttccggcctgccatcctgaccagccgggagagccccacagctgacagcgtgtacaagtacaacatcttccgcagcaccttccacagcaagagcaccctgtctgagccccagaagatctctgctgagggcaacagccacaagtatgacatcctgaagaagaacctgcccaagaagagcgtcatcaagaatgagaaggtgaatggaggcaagaagctgctgaacagcaacaagagcggggccgccttcagccagggcaagagcctgaccctgccccagacctgcaaccgggagaagatctacacctgcagtgaatgtgggaaggccttcggcaagcagagcatcctgaacagacactggaggatccacactggagagaagccctatgaatgtcgggagtgtgggaagaccttcagccacggcagcagcctgaccaggcacctgatcagccacagcggggagaagccctacaagtgcattgaatgtgggaaggccttcagccacgtgagcagcctgaccaaccaccagagcacccacactggagagaagccctatgagtgcatgaactgtgggaagagcttcagccgggtgagccacctgattgagcacctgcgcatccacacccaggagaagctgtatgaatgtcgcatctgtgggaaggccttcatccacaggagcagcctcatccaccaccagaagatccacactggagagaagccctatgaatgtcgggagtgtgggaaggccttctgctgcagcagccacctgaccaggcaccagaggatccacaccatggagaagcagtatgagtgcaacaagtgcctgaaggtgttcagcagcctgtccttcctggtgcagcaccagagcatccacacagaggagaagccctttgagtgccagaagtgcaggaagagcttcaaccagctggagagcctgaacatgcacctgaggaaccacatccggctgaagccctatgaatgttccatctgtgggaaggccttcagccacaggagcagcctgctgcagcaccaccgcatccacactggagagaagccctatgagtgcatcaagtgtgggaagaccttcagctgcagcagcaacctgactgtgcaccagaggatccacactggagagaagccctacaagtgcaatgaatgtgggaaggccttcagcaagggcagcaacctgacagcccaccagagggtgcacaatggagagaagcccaacagcgtggtgtctgtggagaagcccctggactacatgaaccactacacctgtgagaagagctaccgccgggagaccgtgtag

SEQ ID NO: 176571 - DNA, 1716 bp, Artificial Sequence
  Description of Artificial Sequence: Synthetic coding sequence
atgccccaggtgaccttcaatgatgtggccatcgacttcacccatgaggagtggggctggctgagcagcgcccagagggacctgtacaaggatgtgatggtgcagaactatgagaacctggtgtctgtggccggcctgtctgtgaccaagccctacgtgatcaccctgctggaggatggcaaggagccctggatgatggagaagaagctgagcaagggcatgatcccagactgggagagccgctgggagaacaaggagctgagcaccaagaaggacaactatgatgaggacagcccccagaccgtcatcatcgagaaggtggtgaagcagagctatgagttcagcaacagcaagaagaacctggagtacatcgagaagctggagggcaagcacggcagccaggtggaccacttccggcctgccatcctgaccagccgggagagccccacagctgacagcgtgtacaagtacaacatcttccgcagcaccttccacagcaagagcaccctgtctgagccccagaagatctctgctgagggcaacagccacaagtatgacatcctgaagaagaacctgcccaagaagagcgtcatcaagaatgagaaggtgaatggaggcaagaagctgctgaacagcaacaagtctggagctgccttcagccagggcaagagcctgaccctgccccagacctgcaaccgggagaagatctacacctgcagtgaatgtgggaaggccttcggcaagcagagcatcctgaacagacactggaggatccacactggagagaagccctatgagtgcagagaatgtgggaagaccttcagccacggcagcagcctgaccaggcacctgatcagccacagcggggagaagccctacaagtgcattgaatgtgggaaggccttcagccacgtgagcagcctgaccaaccaccagagcacccacactggagagaagccctatgagtgcatgaactgtgggaagagcttcagccgggtgagccacctgattgagcacctgcgcatccacacccaggagaagctgtatgagtgccgcatctgtgggaaggccttcatccacaggagcagcctcatccaccaccagaagatccacactggagagaagccctatgagtgcagagaatgtgggaaggccttctgctgcagcagccacctgaccaggcaccagaggatccacaccatggagaagcagtatgagtgcaacaagtgcctgaaggtgttcagcagcctgtccttcctggtgcagcaccagagcatccacacagaggagaagccctttgagtgccagaagtgcaggaagagcttcaaccagctggagagcctgaacatgcacctgaggaaccacatccggctgaagccctatgagtgcagcatctgtgggaaggccttcagccacaggagcagcctgctgcagcaccaccgcatccacactggagagaagccctatgagtgcatcaagtgtgggaagaccttcagctgcagcagcaacctgactgtgcaccagaggatccacactggagagaagccctacaagtgcaatgaatgtgggaaggccttcagcaagggcagcaacctgacagcccaccagagggtgcacaacggggagaagcccaacagcgtggtgtctgtggagaagcccctggactacatgaaccactacacctgtgagaagagctacagaagagagaccgtgtag

SEQ ID NO: 176572 - DNA, 1920 bp, Artificial Sequence
  Description of Artificial Sequence: Synthetic coding sequence
atgaccccagccagcgccagcggagaagattctggcagcttctacagctggcagaaggccaagcgggagcagggcctggtgacctttgaagatgtggccgtggacttcacccaggaggagtggcagtacctgaaccccccccagaggaccctgtacagagatgtgatgctggagacctacagcaacctggtgtttgtgggccagcaggtgaccaagcccaacctgatcctgaagctggaggtggaggagtgcccagctgagggcaagatccccttctggaacttccctgaggtgtgccaggtggatgagcagatcgagcggcagcaccaggatgaccaggacaagtgcctgctgatgcaggtgggcttcagtgacaagaagaccatcatcaccaagagcgcccgggactgccacgagtttggaaacatcctgcacctgagcaccaacctggtggccagcatccagaggccagacaagcatgagagctttggaaacaacatggtggacaacctggacctcttcagccgcagcagcgctgagaacaagtatgacaatggctgtgccaagctgttcttccacacagaatatgagaagaccaaccctggcatgaagccctacggctacaaggaatgtgggaagggcctgcggaggaagaagggcctgagcctgcaccagaggatcaagaatggagagaagccctttgaatgtacagcctgcaggaagaccttcagcaagaagagccacctgattgtgcactggaggacccacactggagagaagcccttcggctgcacagaatgtgggaaggccttcagccagaagagccagctgatcatccacctgcggacccacactggagagcggccctttgaatgtccagaatgtgggaaggccttccgggagaagagcaccgtcatcatccactaccgcacccacactggagagaagccctatgaatgtaatgaatgtgggaaggccttcacccagaagagcaacctgattgtgcaccagaagacccacactggagagaagacctatgaatgtaccaagtgtggggagagcttcatccagaagctggacctgatcatccaccacagcacccacacaggcaagaagccccatgaatgtaatgaatgcaagaagaccttcagtgacaagagcaccctcatcatccaccagaggacccacactggagagaagccccacaagtgcacagaatgtgggaagagcttcaatgagaagagcaccctcatcgtgcaccagaggacccacactggagagaagccctatgaatgtgatgtgtgtgggaagaccttcacccagaagagcaacctgggcgtgcaccagaggacccacagcggggagaagccctttgaatgtaatgaatgtgagaaggccttcagccagaagagctacctgatgctgcaccagaggggccacactggagagaagccctatgaatgtaatgaatgtgagaaggccttcagccagaagagctacctgatcatccaccagaggacccacacagaggagaagccctacaagtgcaatgaatgtgggaaggccttccgggagaagagcaagctgatcatccaccagaggatccacactggagagaagccctatgaatgtcctgtgtgctggaaggccttcagccagaagagccagctgatcatccaccagaggacccacactggagagaagccctatgcctgcacagaatgtgggaaggccttccgggagaagagcaccttcaccgtgcaccagaggacccacactggagagaagccctacaagtgcacagaatgtgggaaggccttcacccagaagagcaacctgattgtgcaccagaggacccatgctgggaagaaggcccacggccggggccacaccaggaagagcaagttcatggcccactag

SEQ ID NO: 176573 - DNA, 1863 bp, Artificial Sequence
  Description of Artificial Sequence: Synthetic coding sequence
atggccaagccccagggcctggtgacctttgaagatgtggccgtggacttcacccaggaggagtggcagtacctgaaccccccccagaggaccctgtacagagatgtgatgctggagacctacagcaacctggtgtttgtgggccagcaggtgaccaagcccaacctgatcctgaagctggaggtggaggagtgcccagctgagggcaagatccccttctggaacttccctgaggtgtgccaggtggatgagcagatcgagcggcagcaccaggatgaccaggacaagtgcctgctgatgcaggtgggcttcagtgacaagaagaccatcatcaccaagagcgcccgggactgccatgaatttggaaacatcctgcacctgagcaccaacctggtggccagcatccagaggccagacaagcatgagagctttggaaacaacatggtggacaacctggacctcttcagccgcagcagcgctgagaacaagtatgacaatggctgtgccaagctgttcttccacacagaatatgagaagaccaaccctggcatgaagccctacggctacaaggaatgtgggaagggcctgcggaggaagaagggcctgagcctgcaccagaggatcaagaatggagagaagccctttgagtgcacagcctgcaggaagaccttcagcaagaagagccacctgattgtgcactggaggacccacactggagagaagcccttcggctgcacagaatgtgggaaggccttcagccagaagagccagctgatcatccacctgcggacccacactggagagcggccctttgagtgcccagaatgtgggaaggccttccgggagaagagcaccgtcatcatccactaccgcacccacactggagagaagccctatgagtgcaatgaatgtgggaaggccttcacccagaagagcaacctgattgtgcaccagaagacccacactggagagaagacctatgagtgcaccaagtgtggggagagcttcatccagaagctggacctgatcatccaccacagcacccacacaggcaagaagccccatgagtgcaatgaatgcaagaagaccttcagtgacaagagcaccctcatcatccaccagaggacccacactggagagaagccccacaagtgcacagaatgtgggaagagcttcaatgagaagagcaccctgattgtgcaccagaggacccacactggagagaagccctatgaatgtgatgtgtgtgggaagaccttcacccagaagagcaacctgggcgtgcaccagaggacccacagcggggagaagccctttgagtgcaatgaatgtgagaaggccttcagccagaagagctacctgatgctgcaccagaggggccacactggagagaagccctatgagtgcaatgaatgtgagaaggccttcagccagaagagctacctgatcatccaccagaggacccacacagaggagaagccctacaagtgcaatgaatgtgggaaggccttccgggagaagagcaagctgatcatccaccagaggatccacactggagagaagccctatgagtgccctgtgtgctggaaggccttcagccagaagagccagctgatcatccaccagaggacccacactggagagaagccctatgcctgcacagaatgtgggaaggccttccgggagaagagcaccttcaccgtgcaccagaggacccacactggagagaagccctacaagtgcacagaatgtgggaaggccttcacccagaagagcaacctgattgtgcaccagaggacccacgccggcaagaaggcccacggccggggccacaccaggaagagcaagttcatggcccactag

SEQ ID NO: 176574 - DNA, 1920 bp, Artificial Sequence; identical to SEQ ID NO: 176572
  Description of Artificial Sequence: Synthetic coding sequence

SEQ ID NO: 176575 - DNA, 921 bp, Artificial Sequence
  Description of Artificial Sequence: Synthetic coding sequence
atgagcagcgagaagagcggcctgcctgattctgtgccccacaccagccccccaccctacaatgccccccagcccccagctgagcccccagcccccccaccccaggccgcccccagcagccaccaccaccaccaccaccactaccaccagagcggcacagccaccctgccccggctgggcgccggcggcctggccagcagcgctgccacagcccagaggggccccagcagcagcgccaccctgccccggcccccccaccacgcccctcctggccctgctgctggggcccctcctcctggctgtgccaccctgcccaggatgcccccagacccctacctgcaggagaccaggtttgagggccccctgcccccacctcctcctgctgctgctgcccctcctcctccagccccagcccagacagcccaggcccctggctttgtggtgcccacccacgccggcaccgtgggcaccctgcccctgggcggctacgtggcccctggctaccccctgcagctgcagccctgcacagcctacgtgcctgtgtaccctgtgggcaccccctatgccggcggcaccccaggcggcaccggggtgaccagcaccctgcccccaccaccccagggccctggcctggccctgctggagcccaggaggcctcctcatgactacatgcccatcgctgtgctgaccaccatctgctgcttctggcccaccggcatcatcgccatcttcaaggctgtgcaggtgaggacagccctggcccggggggacatggtgtctgctgagatcgccagccgggaggccaggaacttctccttcatcagcctggccgtgggcattgctgccatggtgctgtgcaccatcctgactgtggtgatcatcatcgccgcccagcaccacgagaactactgggacccctag

SEQ ID NO: 176576 - DNA, 2004 bp, Artificial Sequence
  Description of Artificial Sequence: Synthetic coding sequence
atggaggacctgagcagcccagacagcaccctgctgcagggcggccacaacctgctgagcagcgccagcttccaggaggccgtgaccttcaaggatgtgattgtggacttcacccaggaggagtggaagcagctggaccccggccagagggacctcttcagagatgtgaccctggagaactacacccacctggtgtccatcggcctgcaggtgtccaagccagatgtgatcagccagctggagcagggcacagagccctggatcatggagcccagcatccctgtgggcacctgtgccgactgggagacccggctggagaacagcgtgtctgcccctgagccagacatcagcgaggaggagctgagccctgaggtgattgtggagaagcacaagagagatgacagctggagcagcaacctgctggagagctgggagtatgagggcagcctggagcggcagcaggccaaccagcagaccctgcccaaggagatcaaggtgacagagaagaccatccccagctgggagaagggccctgtgaacaatgaatttgggaagtctgtgaatgtgagcagcaacctggtgacccaggagcccagccctgaggagaccagcaccaagaggagcatcaagcagaacagcaaccctgtgaagaaggagaagagctgcaagtgcaatgaatgtgggaaggccttctcctactgcagcgccctgatccgccaccagaggacccacactggagagaagccctacaagtgcaatgaatgtgagaaggccttcagccgctcagaaaatctcatcaaccaccagaggatccacactggagacaagccctacaagtgtgaccagtgtgggaagggcttcatcgagggccccagcctgacccagcaccagaggatccacactggagagaagccctacaagtgtgatgaatgtgggaaggccttcagccagaggacccacctggtgcagcaccagaggatccacactggagagaagccctacacctgcaatgaatgtgggaaggccttcagccagaggggccacttcatggagcaccagaagatccacactggagagaagcccttcaagtgtgatgaatgtgacaagaccttcaccaggagcacccacctgacccagcaccagaagatccacactggagagaagacctacaagtgcaatgaatgtgggaaggccttcaacggccccagcaccttcatccgccaccacatgatccacactggagagaagccctatgaatgtaatgaatgtgggaaggccttcagccagcacagcaacctgacccagcaccagaagacccacacccaggagaaggcctatgagtgcaaggaatgtgggaaggccttcatccgcagcagcagcctggccaagcatgagcgcatccacactggagagaagccctaccagtgccatgaatgtgggaagaccttctcctatggcagcagcctcatccagcacaggaagatccacactggagagcggccctacaagtgcaatgaatgtggccgggccttcaaccagaacatccacctgacccagcacaagaggatccacactggagccaagccctatgaatgtgccgagtgtgggaaggccttccgccactgcagcagcctggcccagcaccagaagacccacacagaggagaagccctaccagtgcaacaagtgtgagaagaccttcagccagagcagccacctgacccagcaccagaggatccacactggagagaagccctacaagtgcaatgaatgtgacaaggccttcagccgcagcacccacctgacagagcaccagaacacccacactggagagaagccctacaactgcaatgaatgtaggaagaccttcagccagagcacctacctgatccagcaccagaggatccacagcggggagaagcccttcggctgcaatgactgtgggaagagcttccgctacagaagtgccctgaacaagcaccagaggctgcaccctggcatctag

SEQ ID NO: 176577 - DNA, 2256 bp, Artificial Sequence
  Description of Artificial Sequence: Synthetic coding sequence
atggaggacctgagcagcccagacagcaccctgctgcagggcggccacaacctgctgagcagcgccagcttccaggaggccgtgaccttcaaggatgtgattgtggacttcacccaggaggagtggaagcagctggaccccggccagagggacctcttcagagatgtgaccctggagaactacacccacctggtgtccatcggcctgcaggtgtccaagccagatgtgatcagccagctggagcagggcacagagccctggatcatggagcccagcatccctgtgggcacctgtgccgactgggagacccggctggagaacagcgtgtctgcccctgagccagacatcagcgaggaggagctgagccctgaggtgattgtggagaagcacaagagagatgacagctggagcagcaacctgctggagagctgggagtatgagggcagcctggagcggcagcaggccaaccagcagaccctgcccaaggagatcaaggtgacagagaagaccatccccagctgggagaagggccctgtgaacaatgaatttgggaagtctgtgaatgtgagcagcaacctggtgacccaggagcccagccctgaggagaccagcaccaagaggagcatcaagcagaacagcaaccctgtgaagaaggagaagagctgcaagtgcaatgaatgtgggaaggccttctcctactgcagcgccctgatccgccaccagaggacccacactggagagaagccctacaagtgcaatgaatgtgagaaggccttcagccgctcagaaaatctcatcaaccaccagaggatccacactggagacaagccctacaagtgtgaccagtgtgggaagggcttcatcgagggccccagcctgacccagcaccagaggatccacactggagagaagccctacaagtgtgatgaatgtgggaaggccttcagccagaggacccacctggtgcagcaccagaggatccacactggagagaagccctacacctgcaatgaatgtgggaaggccttcagccagaggggccacttcatggagcaccagaagatccacactggagagaagcccttcaagtgtgatgaatgtgacaagaccttcaccaggagcacccacctgacccagcaccagaagatccacactggagagaagacctacaagtgcaatgaatgtgggaaggccttcaacggccccagcaccttcatccgccaccacatgatccacactggagagaagccctatgaatgtaatgaatgtgggaaggccttcagccagcacagcaacctgacccagcaccagaagacccacactggagagaagccctatgactgtgccgagtgtgggaagagcttctcctactggagcagcctggcccagcacctgaagatccacactggagagaagccctacaagtgcaatgaatgtgggaaggccttctcctactgcagcagcctgacccagcaccggcgcatccacacccgggagaagccctttgaatgttctgaatgtgggaaggccttctcctacctgagcaacctgaaccagcaccagaagacccacacccaggagaaggcctatgagtgcaaggaatgtgggaaggccttcatccgcagcagcagcctggccaagcatgagcgcatccacactggagagaagccctaccagtgccatgaatgtgggaagaccttctcctatggcagcagcctcatccagcacaggaagatccacactggagagcggccctacaagtgcaatgaatgtggccgggccttcaaccagaacatccacctgacccagcacaagaggatccacactggagccaagccctatgaatgtgccgagtgtgggaaggccttccgccactgcagcagcctggcccagcaccagaagacccacacagaggagaagccctaccagtgcaacaagtgtgagaagaccttcagccagagcagccacctgacccagcaccagaggatccacactggagagaagccctacaagtgcaatgaatgtgacaaggccttcagccgcagcacccacctgacagagcaccagaacacccacactggagagaagccctacaactgcaatgaatgtaggaagaccttcagccagagcacctacctgatccagcaccagaggatccacagcggggagaagcccttcggctgcaatgactgtgggaagagcttccgctacagaagtgccctgaacaagcaccagaggctgcaccctggcatctag

SEQ ID NO: 176578 - DNA, 234 bp, Artificial Sequence
  Description of Artificial Sequence: Synthetic coding sequence
aaggccttcagccagaggacccacctggtgcagcaccagaggatccacactggagagaagccctacacctgcaatgaatgtgggaaggccttcagccagaggggccacttcatggagcaccagaagatccacactggagagaagcccttcaagtgtgatgaatgtgacaagaccttcaccaggagcacccacctgaccaccagcaagaacagctactggaggaagaacctgtag

SEQ ID NO: 176579 - DNA, 1755 bp, Artificial Sequence
  Description of Artificial Sequence: Synthetic coding sequence
atgatggagaactacggcaacctggtgtccctggatgtgctgaacagagacaaggatgaggagcccaccgtgaagcaggagattgaggagattgaggaggaggtggagccccagggcgtgattgtgacccgcatcaagtcagaaattgaccaggaccccatgggccgggagacctttgagctggtgggccgcctggacaagcagaggggcatcttcctgtgggagatcccccgggagagcctgacccaggagcagaggatgttccgggagaacaccaacatcatcaggaagaggcccaacagcgaggagaagtgccacaagtgtgaggagtgtgggaaaggatttgtgaggaaggcccacttcatccagcaccagagggtgcacactggagagaagcccttccagtgcaatgaatgtgggaagagcttcagccgcagcagctttgtgattgagcaccagaggatccacactggagagcggccctatgagtgcaactactgcggcaagaccttctctgtgagcagcaccctcatccgccaccagaggatccacactggagagcggccctaccagtgcaaccagtgcaagcagagcttcagccagaggaggagcctggtgaagcaccagaggatccacactggagagaagccccacaagtgcagcgactgtgggaaggccttctcctggaagagccacctgattgagcaccagaggacccacactggagagaagccctaccactgcaccaagtgcaagaagagcttcagcaggaacagcctgctggtggagcaccagaggatccacactggagagcggccccacaagtgtggggagtgtgggaaggccttccggctgagcacctacctgatccagcaccagaagatccacactggagagaagcccttcctgtgcattgaatgtgggaagagcttcagccgcagcagcttcctgattgagcaccagaggatccacactggagagcggccctaccagtgcaaggaatgtgggaagagcttcagccagctgtgcaacctgaccaggcaccagaggatccacactggagacaagccccacaagtgtgaggagtgtgggaaggccttcagccgcagcagcggcctcatccagcaccagaggatccacacccgggagaagacctacccctacaatgagaccaaggagagctttgaccccaactgcagcctggtgatccagcaggaggtgtaccccaaggagaagagctacaagtgtgatgaatgtgggaagaccttctctgtgtctgcccacctggtgcagcaccagaggatccacactggagagaagccctacctgtgcaccgtgtgtgggaagagcttcagccgcagcagcttcctgattgagcaccagaggatccacactggagagcggccctacctgtgccggcagtgtgggaagagcttcagccagctgtgcaacctgatccgccaccagggcgtgcacactggaaacaagccccacaagtgtgatgaatgtgggaaggccttcagcagaaattctggcctcatccagcaccagaggatccacactggagagaagccctacaagtgtgagaagtgtgacaagagcttcagccagcagaggagcctggtgaaccaccagaagatccatgctgaggtgaagacccaggagacccatgaatgtgatgcctgtggggaggccttcaactgccgcatcagcctcatccagcaccagaagctgcacacagcctggatgcagtag

SEQ ID NO: 176580 - DNA, 1881 bp, Artificial Sequence
  Description of Artificial Sequence: Synthetic coding sequence
atggccagccccagccccccacctgagagcaagggcctgctgacctttgaagatgtggccgtgttcttcacccaggaggagtgggactacctggaccctgcccagaggagcctgtacaaggatgtgatgatggagaactacggcaacctggtgtccctggatgtgctgaacagagacaaggatgaggagcccaccgtgaagcaggagattgaggagattgaggaggaggtggagccccagggcgtgattgtgacccgcatcaagtcagaaattgaccaggaccccatgggccgggagacctttgagctggtgggccgcctggacaagcagaggggcatcttcctgtgggagatcccccgggagagcctgacccaggagcagaggatgttccgggagaacaccaacatcatcaggaagaggcccaacagcgaggagaagtgccacaagtgtgaggagtgtgggaaaggatttgtgaggaaggcccacttcatccagcaccagagggtgcacactggagagaagcccttccagtgcaatgaatgtgggaagagcttcagccgcagcagctttgtgattgagcaccagaggatccacactggagagcggccctatgagtgcaactactgcggcaagaccttctctgtgagcagcaccctcatccgccaccagaggatccacactggagagcggccctaccagtgcaaccagtgcaagcagagcttcagccagaggaggagcctggtgaagcaccagaggatccacactggagagaagccccacaagtgcagcgactgtgggaaggccttctcctggaagagccacctgattgagcaccagaggacccacactggagagaagccctaccactgcaccaagtgcaagaagagcttcagcaggaacagcctgctggtggagcaccagaggatccacactggagagcggccccacaagtgtggggagtgtgggaaggccttccggctgagcacctacctgatccagcaccagaagatccacactggagagaagcccttcctgtgcattgaatgtgggaagagcttcagccgcagcagcttcctgattgagcaccagaggatccacactggagagcggccctaccagtgcaaggaatgtgggaagagcttcagccagctgtgcaacctgaccaggcaccagaggatccacactggagacaagccccacaagtgtgaggagtgtgggaaggccttcagccgcagcagcggcctcatccagcaccagaggatccacacccgggagaagacctacccctacaatgagaccaaggagagctttgaccccaactgcagcctggtgatccagcaggaggtgtaccccaaggagaagagctacaagtgtgatgaatgtgggaagaccttctctgtgtctgcccacctggtgcagcaccagaggatccacactggagagaagccctacctgtgcaccgtgtgtgggaagagcttcagccgcagcagcttcctgattgagcaccagaggatccacactggagagcggccctacctgtgccggcagtgtgggaagagcttcagccagctgtgcaacctgatccgccaccagggcgtgcacactggaaacaagccccacaagtgtgatgaatgtgggaaggccttcagcagaaattctggcctcatccagcaccagaggatccacactggagagaagccctacaagtgtgagaagtgtgacaagagcttcagccagcagaggagcctggtgaaccaccagaagatccatgctgaggtgaagacccaggagacccatgaatgtgatgcctgtggggaggccttcaactgccgcatcagcctcatccagcaccagaagctgcacacagcctggatgcagtag

SEQ ID NO: 176581 - DNA, 1839 bp, Artificial Sequence
  Description of Artificial Sequence: Synthetic coding sequence
atggccagccccagccccccacctgagagcaaggaggagtgggactacctggaccctgcccagaggagcctgtacaaggatgtgatgatggagaactacggcaacctggtgtccctggatgtgctgaacagagacaaggatgaggagcccaccgtgaagcaggagattgaggagattgaggaggaggtggagccccagggcgtgattgtgacccgcatcaagtcagaaattgaccaggaccccatgggccgggagacctttgagctggtgggccgcctggacaagcagaggggcatcttcctgtgggagatcccccgggagagcctgacccaggagcagaggatgttccgggagaacaccaacatcatcaggaagaggcccaacagcgaggagaagtgccacaagtgtgaggagtgtgggaaaggatttgtgaggaaggcccacttcatccagcaccagagggtgcacactggagagaagcccttccagtgcaatgaatgtgggaagagcttcagccgcagcagctttgtgattgagcaccagaggatccacactggagagcggccctatgagtgcaactactgcggcaagaccttctctgtgagcagcaccctcatccgccaccagaggatccacactggagagcggccctaccagtgcaaccagtgcaagcagagcttcagccagaggaggagcctggtgaagcaccagaggatccacactggagagaagccccacaagtgcagcgactgtgggaaggccttctcctggaagagccacctgattgagcaccagaggacccacactggagagaagccctaccactgcaccaagtgcaagaagagcttcagcaggaacagcctgctggtggagcaccagaggatccacactggagagcggccccacaagtgtggggagtgtgggaaggccttccggctgagcacctacctgatccagcaccagaagatccacactggagagaagcccttcctgtgcattgaatgtgggaagagcttcagccgcagcagcttcctgattgagcaccagaggatccacactggagagcggccctaccagtgcaaggaatgtgggaagagcttcagccagctgtgcaacctgaccaggcaccagaggatccacactggagacaagccccacaagtgtgaggagtgtgggaaggccttcagccgcagcagcggcctcatccagcaccagaggatccacacccgggagaagacctacccctacaatgagaccaaggagagctttgaccccaactgcagcctggtgatccagcaggaggtgtaccccaaggagaagagctacaagtgtgatgaatgtgggaagaccttctctgtgtctgcccacctggtgcagcaccagaggatccacactggagagaagccctacctgtgcaccgtgtgtgggaagagcttcagccgcagcagcttcctgattgagcaccagaggatccacactggagagcggccctacctgtgccggcagtgtgggaagagcttcagccagctgtgcaacctgatccgccaccagggcgtgcacactggaaacaagccccacaagtgtgatgaatgtgggaaggccttcagcagaaattctggcctcatccagcaccagaggatccacactggagagaagccctacaagtgtgagaagtgtgacaagagcttcagccagcagaggagcctggtgaaccaccagaagatccatgctgaggtgaagacccaggagacccatgaatgtgatgcctgtggggaggccttcaactgccgcatcagcctcatccagcaccagaagctgcacacagcctggatgcagtag

SEQ ID NO: 176582 - DNA, 1377 bp, Artificial Sequence
  Description of Artificial Sequence: Synthetic coding sequence
atggccgccatgcccctgaaggcccagtaccaggagatggtgacctttgaagatgtggccgtgcacttcaccaagacagagtggacaggcctgagccctgcccagagggccctgtacagatctgtgatgctggagaactttggaaacctgacagccctgggctaccctgtgcccaagccagccctgatcagcctgctggagcggggggacatggcctggggcctggaggcccaggatgatcctcctgctgagaggaccaagaatgtgtgcaaggatgtggagaccaacattgattctgagagcaccctcatccagggcatcagcgaggagagagatggcatgatgagccacggccagctgaagtctgtgccccagaggacagacttccctgagaccagaaatgtggagaagcaccaggacatccccaccgtgaagaacatccagggcaaggtgccccgcatcccctgtgccaggaagcccttcatctgtgaagaatgtgggaagagcttctcctacttctcctactatgcccggcaccagaggatccacactggagagaagccctttgagtgcagtgaatgtgggaaggccttcaatggaaacagcagcctcatccgccaccagaggatccacactggagagcggccctaccagtgtgaagaatgtggccgggccttcaatgacaatgccaacctgatccgccaccagaggatccacagcggggaccggccctactactgcacagaatgtggcaacagcttcaccagcagcagcgagtttgtgatccaccagaggatccacactggagagaagccctatgagtgcaatgaatgtgggaaggcctttgtgggcaacagccccctgctgcggcaccagaagatccacactggagagaagccctatgagtgcaatgaatgtgggaagagctttggccgcaccagccacctgagccagcaccagaggatccacactggagagaagccctacagctgcaaggtgtgtggccaggccttcaacttccacaccaagctgaccaggcaccagaggatccacagcgaggagaagccctttgactgtgtggactgtgggaaggccttcagcgcccaggagcagctgaagaggcacctgcgcatccacacccaggagagcagctatgtgtgtgatgaatgtgggaaggccctgaccagcaagaggaacctgcaccagcaccagaggatccacactggagagaagccctatgagtgcagcaaatatgagaaggccttcggcaccagcagccagctgggccacctggagcacgtgtacagcggggagaagcctgtgctggacatctgccgcttcggcctgcctgagttcttcacccccttctactggtag

SEQ ID NO: 176583 - DNA, 1737 bp, Artificial Sequence
  Description of Artificial Sequence: Synthetic coding sequence
atggccgaggagagcaggaagcccagcgcccccagccccccagaccagaccccagaggaggacctggtgattgtgaaggtggaggaggaccacggctgggaccaggagagcagcctgcacgagagcaaccccctgggccaggaggtgttccggctgcgcttccggcagctgcgctaccaggagaccctgggcccccgggaggccctgatccagctgcgggccctgtgccaccagtggctgcggccagacctgaacaccaaggagcagatcctggagctgctggtgctggagcagttcctgaccatcctgcctgaggagctgcagaccctggtgaaggagcaccagctggagaatggagaggaggtggtgaccctgctggaggacctggagcggcagattgacatcctgggccggcctgtgtctgcccgggtgcacggccaccgggtgctgtgggaggaggtggtgcacagcgccagcgcccctgagccccccaacacccagctgcagagcgaggccacccagcacaagagccctgtgccccaggagagccaggagcgggccatgagcaccagccagagccccaccaggagccagaagggcagcagcggggaccaggagatgacagccaccctgctgacagctggcttccagaccctggagaagattgaggacatggctgtgtccctcatccgggaggagtggctgctggaccccagccagaaggacctgtgccgggacaacagacctgagaacttcaggaacatgttcagcctgggcggggagaccaggagtgaaaatcgggagctggccagcaagcaggtgatcagcacaggcatccagccccacggggagacagctgccaagtgcaatggagatgtgatccggggcctggagcacgaggaggcccgggacctgctgggccgcctggagcggcagaggggcaaccccacccaggagcggcggcacaagtgtgatgaatgtgggaagagctttgcccagagcagcggcctggtgcgccactggaggatccacactggagagaagccctaccagtgcaatgtgtgtgggaaggccttctcctacagaagtgccctgctgagccaccaggacatccacaacaaggtgaagcgctaccactgcaaggaatgtgggaaggccttcagccagaacacaggcctcatcctgcaccagaggatccacactggagagaagccctaccagtgcaaccagtgtgggaaggccttcagccagagcgctggcctcatcctgcaccagaggatccacagcggggagcggccctatgaatgtaatgaatgtgggaaggccttcagccacagcagccacctgattggccaccagaggatccacactggagagaagccctatgaatgtgatgaatgtgggaagaccttccgccgcagcagccacctgattggccaccagaggagccacactggagagaagccctacaagtgcaatgaatgtggccgggccttcagccagaagagcggcctcatcgagcaccagaggatccacactggagagcggccctacaagtgcaaggaatgtgggaaggccttcaacggcaacacaggcctcatccagcacctgcgcatccacactggagagaagccctaccagtgcaatgaatgtgggaaggccttcatccagaggagcagcctcatccgccaccagaggatccacagcggggagaagtctgagagcatctctgtgtag

SEQ ID NO: 176584 - DNA, 1737 bp, Artificial Sequence; identical to SEQ ID NO: 176583
  Description of Artificial Sequence: Synthetic coding sequence

SEQ ID NO: 176585 - DNA, 477 bp, Artificial Sequence
  Description of Artificial Sequence: Synthetic coding sequence
atggccgaggagagcaggaagcccagcgcccccagccccccagaccagaccccagaggaggacctggtgattgtgaaggtggaggaggaccacggctgggaccaggagagcagcctgcacgagagcaaccccctgggccaggaggtgttccggctgcgcttccggcagctgcgctaccaggagaccctgggcccccgggaggccctgatccagctgcgggccctgtgccaccagtggctgcggccagacctgaacaccaaggagcagatcctggagctgctggtgctggagcagttcctgaccatcctgcctgaggagctgcagaccctggtgaaggagcaccagctggagaatggagaggaggtggtgaccctgctggaggacctggagcggcagattgacatcctgggccggcctgtgtccagaagaagaagccagctggcctacatggacatcggctacagcggcagaagatag

SEQ ID NO: 176586 - DNA, 1185 bp, Artificial Sequence
  Description of Artificial Sequence: Synthetic coding sequence
atgaacaccaacagcaaggaggtgctgagcctgggcgtgcaggtgcctgaggcctgggaggagctgctgaccatgaaggtggaggccaagagccacctgcagtggcaggagagccggctgaagaggagcaaccccctggcccgggagatcttccgccgccacttccggcagctgtgctaccaggagaccccaggcccccgggaggccctgacccggctgcaggagctgtgctaccagtggctgcggccccacgtgtccaccaaggagcagatcctggacctgctggtgctggagcagttcctgagcatcctgcccaaggagctgcagggctgggtgcgggagcactgcccagagagcggggaggaggccgtcatcctgctggaggacctggagcgggagctggatgagccccagcacgagatggtggcccaccgccaccggcaggaggtgctgtgcaaggagatggtgcccctggccgagcagacccccctgaccctgcagagccagcccaaggagccccagctgacctgtgacagcgcccagaagtgccacagcatcggggagacagatgaggtgaccaagacagaggaccgggagctggtgctgaggaaggactgccccaagatcgtggagccccacggcaagatgtttaatgagcagacctgggaggtgtcccagcaggaccccagccatggagaggtgggggagcacaaggacagaattgagcggcagtggggcaacctgctgggggagggccagcacaagtgtgatgaatgtgggaagagcttcacccagagcagcggcctcatccgccaccagaggatccacactggagagcggccctatgaatgtaatgaatgtgggaaggccttcagccgcagcagcggcctcttcaaccaccggggcatccacaacatccagaagcgctaccactgcaaggaatgtgggaaggtgttcagccagagcgctggcctcatccagcaccagaggatccacaagggggagaagccctaccagtgcagccagtgcagcaagagctacagcagaagaagcttcctgattgagcaccagaggagccacactggagagcggccccaccagtgcattgaatgtgggaagagcttcaacagacactgcaacctgatccgccaccagaagatccacacagtggccgagctggtgtag

SEQ ID NO: 176587 - DNA, 126 bp, Artificial Sequence
  Description of Artificial Sequence: Synthetic coding sequence
atgaacaccaacagcaaggaggtgctgagcctgggcgtgcaggtgcctgaggcctgggaggagctgctgaccatgaaggtggaggccaagagccacctgcagtggcaggagagccggctgaagtag

SEQ ID NO: 176588 - DNA, 1185 bp, Artificial Sequence; identical to SEQ ID NO: 176586
  Description of Artificial Sequence: Synthetic coding sequence

SEQ ID NO: 176589 - DNA, 1338 bp, Artificial Sequence
  Description of Artificial Sequence: Synthetic coding sequence
atgaacaccaacagcaaggaggtgctgagcctgggcgtgcaggtgcctgaggcctgggaggagctgctgaccatgaaggtggaggccaagagccacctgcagtggcaggagagccggctgaagaggagcaaccccctggcccgggagatcttccgccgccacttccggcagctgtgctaccaggagaccccaggcccccgggaggccctgacccggctgcaggagctgtgctaccagtggctgcggccccacgtgtccaccaaggagcagatcctggacctgctggtgctggagcagttcctgagcatcctgcccaaggagctgcagggctgggtgcgggagcactgcccagagagcggggaggaggccgtcatcctgctggaggacctggagcgggagctggatgagccccagcacgagatggtggcccaccgccaccggcaggaggtgctgtgcaaggagatggtgcccctggccgagcagacccccctgaccctgcagagccagcccaaggagccccagctgacctgtgacagcgcccagaagtgccacagcatcggggagacagacctgatccgcagcctgcggaggagagctgtgctgatccccctgggcgcccacctgttcagcacagacaccttcctgttcagcaagcctgtggtgatcccccagctgaagggcggcggggagacctggcccaacaacagaggagtgctgagagatgaggtgaccaagacagaagatcgggagctggtgctgaggaaggactgccccaagatcgtggagccccacggcaagatgtttaatgagcagacctgggaggtgtcccagcaggaccccagccacggggaggtgggggagcacaaggaccgcatcgagcggcagtggggcaacctgctgggggagggccagcacaagtgtgatgaatgtgggaagagcttcacccagagcagcggcctcatccgccaccagaggatccacactggagagcggccctatgagtgcaatgaatgtgggaaggccttcagccgcagcagcggcctcttcaaccaccggggcatccacaacatccagaagcgctaccactgcaaggaatgtgggaaggtgttcagccagagcgctggcctcatccagcaccagaggatccacaagggggagaagccctaccagtgcagccagtgcagcaagagctacagccgccgctccttcctgattgagcaccagaggagccacactggagagcggccccaccagtgcattgaatgtgggaagagcttcaacagacactgcaacctgatccgccaccagaagatccacacagtggccgagctggtgtag

SEQ ID NO: 176590 - DNA, 1821 bp, Artificial Sequence
  Description of Artificial Sequence: Synthetic coding sequence
atgaccctgctgaccttcagagatgtggccatcgagttcagcctggaggagtggaagtgcctggacctggcccagcagaacctgtacagagatgtgatgctggagaactacagaaacctcttctctgtgggcctgactgtgtgcaagccaggcctcatcacctgcctggagcagaggaaggagccctggaatgtgaagaggcaggaggccgcagatggccaccctgagatgggcttccaccacgccacccaggcctgcctggagctgctgggcagcagtgacctgcctgccagcgccagccagagcgctggcatcaccggggtgaaccaccgggcccagcccggcctgaatgtgtctgtggacaagttcaccgccatgagcagccacttcacccaggacctgctgcctgagcagggcatccaggatgccttccccaagaggatcctgcggggctacggcaactgtggcctggacaacctgtacctgaggaaggactgggagagcctggatgagtgcaagctgcagaaggactacaacggcctgaaccagtgcagcagcaccacccacagcaagatcttccagtacaacaagtatgtgaagatctttgacaacttcagcaacctgcacagaagaaacatcagcaacacaggagagaagcccttcaagtgccaggagtgtgggaagagcttccagatgctgtccttcctgacagagcaccagaagatccacacaggcaagaagttccagaagtgtggagaatgtgggaagaccttcatccagtgcagccacttcacagagcctgagaacatcgacaccggggagaagccctacaagtgccaggagtgcaacaacgtcatcaagacctgcagcgtgctgaccaagaaccgcatctatgccggcggggagcactaccgctgtgaggagtttgggaaggtgttcaaccagtgcagccacctgacagagcacgagcacggcacagaggagaagccctgcaagtatgaagaatgtagcagcgtcttcatcagctgcagcagcctgagcaaccagcagatgatcctggccggggagaagctgagcaaatgtgagacctggtacaagggcttcaaccacagccccaaccccagcaagcaccagagaaatgagatcggcggcaagcccttcaagtgtgaagaatgtgacagcatcttcaagtggttcagtgacctgaccaagcacaagaggatccacactggagagaagccctacaagtgtgatgaatgtgggaaggcctacacccagagcagccacctgtctgagcaccggcgcatccacactggagagaagccctaccagtgtgaagaatgtgggaaggtgttccgcacctgcagcagcctgagcaaccacaagaggacccacagcgaggagaagccctacacctgtgaagaatgtggcaacatcttcaagcagctgagtgacctgaccaagcacaagaagacccacactggagagaagccctacaagtgtgatgaatgtgggaagaacttcacccagagcagcaacctgattgtgcacaagaggatccacactggagagaagccctacaagtgtgaagaatgtggccgggtcttcatgtggttcagtgacatcaccaagcacaagaagacccacactggagagaagccctacaagtgtgatgaatgtgggaagaacttcacccagagcagcaacctgattgtgcacaagaggatccacactggagagaagccctacaagtgtgagaagtgtgggaaggccttcacccagttcagccacctgactgtgcatgagagcatccacacctag

SEQ ID NO: 176591 - DNA, 1686 bp, Artificial Sequence
  Description of Artificial Sequence: Synthetic coding sequence
atggccggggcccagaccctgctgaccttcagagatgtggccatcgagttcagcctggaggagtggaagtgcctggacctggcccagcagaacctgtacagagatgtgatgctggagaactacagaaacctcttctctgtgggcctgactgtgtgcaagccaggcctcatcacctgcctggagcagaggaaggagccctggaatgtgaagaggcaggaggccgcagatggccacccagccatgagcagccacttcacccaggacctgctgcctgagcagggcatccaggatgccttccccaagaggatcctgcggggctacggcaactgtggcctggacaacctgtacctgaggaaggactgggagagcctggatgagtgcaagctgcagaaggactacaacggcctgaaccagtgcagcagcaccacccacagcaagatcttccagtacaacaagtatgtgaagatctttgacaacttcagcaacctgcacagaagaaacatcagcaacacaggagagaagcccttcaagtgccaggagtgtgggaagagcttccagatgctgtccttcctgacagagcaccagaagatccacacaggcaagaagttccagaagtgtggggagtgtgggaagaccttcatccagtgcagccacttcacagagccagaaaatattgacacaggagagaagccctacaagtgccaggagtgcaacaacgtcatcaagacctgcagcgtgctgaccaagaaccgcatctatgctggaggagagcactaccgctgtgaggagtttgggaaggtgttcaaccagtgcagccacctgacagaacatgaacatggaacagaggagaagccctgcaagtatgaggagtgcagctctgtgttcatcagctgcagcagcctgagcaaccagcagatgatcctggccggggagaagctgagcaaatgtgagacctggtacaagggcttcaaccacagccccaaccccagcaagcaccagagaaatgaaattggaggcaagcccttcaagtgtgaggagtgtgacagcatcttcaagtggttcagtgacctgaccaagcacaagaggatccacactggagagaagccctacaagtgtgatgaatgtgggaaggcctacacccagagcagccacctgtctgagcaccggcgcatccacactggagagaagccctaccagtgtgaggagtgtgggaaggtgttccgcacctgcagcagcctgagcaaccacaagaggacccacagcgaggagaagccctacacctgtgaggagtgtggcaacatcttcaagcagctgagtgacctgaccaagcacaagaagacccacactggagagaagccctacaagtgtgatgaatgtgggaagaacttcacccagagcagcaacctgattgtgcacaagaggatccacactggagagaagccctacaagtgtgaggagtgtggccgggtcttcatgtggttcagtgacatcaccaagcacaagaagacccacactggagagaagccctacaagtgtgatgaatgtgggaagaacttcacccagagcagcaacctgattgtgcacaagaggatccacactggagagaagccctacaagtgtgagaagtgtgggaaggccttcacccagttcagccacctgactgtgcatgagagcatccacacctag

SEQ ID NO: 176592 - DNA, 1674 bp, Artificial Sequence
  Description of Artificial Sequence: Synthetic coding sequence
atgaccctgctgaccttcagagatgtggccatcgagttcagcctggaggagtggaagtgcctggacctggcccagcagaacctgtacagagatgtgatgctggagaactacagaaacctcttctctgtgggcctgactgtgtgcaagccaggcctcatcacctgcctggagcagaggaaggagccctggaatgtgaagaggcaggaggccgcagatggccacccagccatgagcagccacttcacccaggacctgctgcctgagcagggcatccaggatgccttccccaagaggatcctgcggggctacggcaactgtggcctggacaacctgtacctgaggaaggactgggagagcctggatgagtgcaagctgcagaaggactacaacggcctgaaccagtgcagcagcaccacccacagcaagatcttccagtacaacaagtatgtgaagatctttgacaacttcagcaacctgcacagaagaaacatcagcaacacaggagagaagcccttcaagtgccaggagtgtgggaagagcttccagatgctgtccttcctgacagagcaccagaagatccacacaggcaagaagttccagaagtgtggggagtgtgggaagaccttcatccagtgcagccacttcacagagccagaaaatattgacacaggagagaagccctacaagtgccaggagtgcaacaacgtcatcaagacctgcagcgtgctgaccaagaaccgcatctatgctggaggagagcactaccgctgtgaggagtttgggaaggtgttcaaccagtgcagccacctgacagaacatgaacatggaacagaggagaagccctgcaagtatgaggagtgcagctctgtgttcatcagctgcagcagcctgagcaaccagcagatgatcctggccggggagaagctgagcaaatgtgagacctggtacaagggcttcaaccacagccccaaccccagcaagcaccagagaaatgaaattggaggcaagcccttcaagtgtgaggagtgtgacagcatcttcaagtggttcagtgacctgaccaagcacaagaggatccacactggagagaagccctacaagtgtgatgaatgtgggaaggcctacacccagagcagccacctgtctgagcaccggcgcatccacactggagagaagccctaccagtgtgaggagtgtgggaaggtgttccgcacctgcagcagcctgagcaaccacaagaggacccacagcgaggagaagccctacacctgtgaggagtgtggcaacatcttcaagcagctgagtgacctgaccaagcacaagaagacccacactggagagaagccctacaagtgtgatgaatgtgggaagaacttcacccagagcagcaacctgattgtgcacaagaggatccacactggagagaagccctacaagtgtgaggagtgtggccgggtcttcatgtggttcagtgacatcaccaagcacaagaagacccacactggagagaagccctacaagtgtgatgaatgtgggaagaacttcacccagagcagcaacctgattgtgcacaagaggatccacactggagagaagccctacaagtgtgagaagtgtgggaaggccttcacccagttcagccacctgactgtgcatgagagcatccacacctag

SEQ ID NO: 176593 - DNA, 1890 bp, Artificial Sequence
  Description of Artificial Sequence: Synthetic coding sequence
atgaccctgctgaccttcagagatgtggccatcgagttcagcctggaggagtggaagtgcctggacctggcccagcagaacctgtacagagatgtgatgctggagaactacagaaacctcttctctgtgggcctgactgtgtgcaagccaggcctcatcacctgcctggagcagaggaaggagccctggaatgtgaagaggcaggaggccgcagatggccaccctgagatgggcttccaccacgccacccaggcctgcctggagctgctgggcagcagtgacctgcctgccagcgccagccagagcgctggcatcaccggggtgaaccaccgggcccagcccggcctgaatgtgtctgtggacaagttcaccgccctgtgcagccctggggtgctgcagacagtgaagtggttcctggagttccgctgcatcttcagcctggccatgagcagccacttcacccaggacctgctgcctgagcagggcatccaggatgccttccccaagaggatcctgcggggctacggcaactgtggcctggacaacctgtacctgaggaaggactgggagagcctggatgagtgcaagctgcagaaggactacaacggcctgaaccagtgcagcagcaccacccacagcaagatcttccagtacaacaagtatgtgaagatctttgacaacttcagcaacctgcacagaagaaacatcagcaacacaggagagaagcccttcaagtgccaggagtgtgggaagagcttccagatgctgtccttcctgacagagcaccagaagatccacacaggcaagaagttccagaagtgtggggagtgtgggaagaccttcatccagtgcagccacttcacagagccagaaaatattgacacaggagagaagccctacaagtgccaggagtgcaacaacgtcatcaagacctgcagcgtgctgaccaagaaccgcatctatgctggaggagagcactaccgctgtgaggagtttgggaaggtgttcaaccagtgcagccacctgacagaacatgaacatggaacagaggagaagccctgcaagtatgaggagtgcagctctgtgttcatcagctgcagcagcctgagcaaccagcagatgatcctggccggggagaagctgagcaaatgtgagacctggtacaagggcttcaaccacagccccaaccccagcaagcaccagagaaatgaaattggaggcaagcccttcaagtgtgaggagtgtgacagcatcttcaagtggttcagtgacctgaccaagcacaagaggatccacactggagagaagccctacaagtgtgatgaatgtgggaaggcctacacccagagcagccacctgtctgagcaccggcgcatccacactggagagaagccctaccagtgtgaggagtgtgggaaggtgttccgcacctgcagcagcctgagcaaccacaagaggacccacagcgaggagaagccctacacctgtgaggagtgtggcaacatcttcaagcagctgagtgacctgaccaagcacaagaagacccacactggagagaagccctacaagtgtgatgaatgtgggaagaacttcacccagagcagcaacctgattgtgcacaagaggatccacactggagagaagccctacaagtgtgaggagtgtggccgggtcttcatgtggttcagtgacatcaccaagcacaagaagacccacactggagagaagccctacaagtgtgatgaatgtgggaagaacttcacccagagcagcaacctgattgtgcacaagaggatccacactggagagaagccctacaagtgtgagaagtgtgggaaggccttcacccagttcagccacctgactgtgcatgagagcatccacacctag

SEQ ID NO: 176594 - DNA, 1686 bp, Artificial Sequence; identical to SEQ ID NO: 176591
  Description of Artificial Sequence: Synthetic coding sequence

SEQ ID NO: 176595 - DNA, 1833 bp, Artificial Sequence
  Description of Artificial Sequence: Synthetic coding sequence
atggccggggcccagaccctgctgaccttcagagatgtggccatcgagttcagcctggaggagtggaagtgcctggacctggcccagcagaacctgtacagagatgtgatgctggagaactacagaaacctcttctctgtgggcctgactgtgtgcaagccaggcctcatcacctgcctggagcagaggaaggagccctggaatgtgaagaggcaggaggccgcagatggccaccctgagatgggcttccaccacgccacccaggcctgcctggagctgctgggcagcagtgacctgcctgccagcgccagccagagcgctggcatcaccggggtgaaccaccgggcccagcccggcctgaatgtgtctgtggacaagttcaccgccatgagcagccacttcacccaggacctgctgcctgagcagggcatccaggatgccttccccaagaggatcctgcggggctacggcaactgtggcctggacaacctgtacctgaggaaggactgggagagcctggatgagtgcaagctgcagaaggactacaacggcctgaaccagtgcagcagcaccacccacagcaagatcttccagtacaacaagtatgtgaagatctttgacaacttcagcaacctgcacagaagaaacatcagcaacacaggagagaagcccttcaagtgccaggagtgtgggaagagcttccagatgctgtccttcctgacagagcaccagaagatccacacaggcaagaagttccagaagtgtggagaatgtgggaagaccttcatccagtgcagccacttcacagagcctgagaacatcgacaccggggagaagccctacaagtgccaggagtgcaacaacgtcatcaagacctgcagcgtgctgaccaagaaccgcatctatgccggcggggagcactaccgctgtgaggagtttgggaaggtgttcaaccagtgcagccacctgacagagcacgagcacggcacagaggagaagccctgcaagtatgaagaatgtagcagcgtcttcatcagctgcagcagcctgagcaaccagcagatgatcctggccggggagaagctgagcaaatgtgagacctggtacaagggcttcaaccacagccccaaccccagcaagcaccagagaaatgagatcggcggcaagcccttcaagtgtgaagaatgtgacagcatcttcaagtggttcagtgacctgaccaagcacaagaggatccacactggagagaagccctacaagtgtgatgaatgtgggaaggcctacacccagagcagccacctgtctgagcaccggcgcatccacactggagagaagccctaccagtgtgaagaatgtgggaaggtgttccgcacctgcagcagcctgagcaaccacaagaggacccacagcgaggagaagccctacacctgtgaagaatgtggcaacatcttcaagcagctgagtgacctgaccaagcacaagaagacccacactggagagaagccctacaagtgtgatgaatgtgggaagaacttcacccagagcagcaacctgattgtgcacaagaggatccacactggagagaagccctacaagtgtgaagaatgtggccgggtcttcatgtggttcagtgacatcaccaagcacaagaagacccacactggagagaagccctacaagtgtgatgaatgtgggaagaacttcacccagagcagcaacctgattgtgcacaagaggatccacactggagagaagccctacaagtgtgagaagtgtgggaaggccttcacccagttcagccacctgactgtgcatgagagcatccacacctag

SEQ ID NO: 176596 - DNA, 396 bp, Artificial Sequence
  Description of Artificial Sequence: Synthetic coding sequence
atggccggggcccagaccctgctgaccttcagagatgtggccatcgagttcagcctggaggagtggaagtgcctggacctggcccagcagaacctgtacagagatgtgatgctggagaactacagaaacctcttctctgtgggcctgactgtgtgcaagccaggcctcatcacctgcctggagcagaggaaggagccctggaatgtgaagaggcaggaggccgcagatggccacccagccatgagcagccacttcacccaggacctgctgcctgagcagggcatccaggatgccttccccaagaggatcctgcggggctacggcaactgtggcctggacaacctgtacctgaggaaggactgggagagcctggatgagtgcaagctgcagaagtag

SEQ ID NO: 176597 - DNA, 348 bp, Artificial Sequence
  Description of Artificial Sequence: Synthetic coding sequence
atggccggggcccagaccctgctgaccttcagagatgtggccatcgagttcagcctggaggagtggaagtgcctggacctggcccagcagaacctgtacagagatgtgatgctggagaactacagaaacctcttctctgtgggcctgactgtgtgcaagccaggcctcatcacctgcctggagcagaggaaggagccctggaatgtgaagaggcaggaggccgcagatggccaccctgagatgggcttccaccacgccacccaggcctgcctggagctgctgggcagcagtgacctgcctgccagcgccagccagagcgctggcatcaccggggtgaaccacaggtag

SEQ ID NO: 176598 - DNA, 1281 bp, Artificial Sequence
  Description of Artificial Sequence: Synthetic coding sequence
atggctgctgtgagccccaccacccgctgccaggagagcgtgacctttgaagatgtggccgtggtgttcacagatgaggagtggagccggctggtgcccatccagagggacctgtacaaggaggtgatgctggagaactacaacagcatcgtgtccctgggcctgcctgtgccccagccagatgtgatcttccagctgaagagaggagacaagccctggatggtggacctgcacggcagcgaggagcgggagtggccagagagcgtgtccctggactgggagaccaagccagagatccatgatgccagtgacaagaagtctgagggcagcctgagagaatgtctgggccggcagagccccctgtgccccaagtttgaggtgcacaccccaaatggaaggatgggcacagagaagcagagccccagcggggagaccaggaagaagagcctgagccgggacaagggcctgcggaggagaagaagtgccctgagccgggagatcctgaccaaggagcggcaccaggagtgcagcgactgtgggaagaccttctttgaccacagcagcctgaccaggcaccagaggacccacactggagagaagccctatgactgccgggagtgtgggaaggccttcagccacaggagcagcctgagccgccacctgatgagccacactggagagagcccctatgaatgttctgtgtgcagcaaggccttctttgacaggagcagcctgactgtgcaccagaggatccacactggagagaagcccttccagtgcaatgaatgtgggaaggccttctttgacaggagcagcctgaccaggcaccagaggatccacactggagagagcccctatgagtgccaccagtgtgggaaggccttcagccagaagagcatcctgaccaggcaccagctgatccacactggaaggaagccctatgaatgtaatgaatgtgggaaggccttctacggcgtgagcagcctgaacagacaccagaaggcccatgctggggacccccgctaccagtgcaatgaatgtgggaaggccttctttgacaggagcagcctgacccagcaccagaagatccacactggagacaagccctatgaatgttctgaatgtgggaaggccttcagccagcgctgccgcctgaccaggcaccagagggtgcacactggagagaagccctttgaatgtactgtgtgtgggaaggtgttcagcagcaagagcagcgtcatccagcaccagaggagatatgccaagcagggcattgattag

SEQ ID NO: 176599 - DNA, 1155 bp, Artificial Sequence
  Description of Artificial Sequence: Synthetic coding sequence
atgctggagaactacaacagcatcgtgtccctgggcctgcctgtgccccagccagatgtgatcttccagctgaagagaggagacaagccctggatggtggacctgcacggcagcgaggagcgggagtggccagagagcgtgtccctggactgggagaccaagccagagatccatgatgccagtgacaagaagtctgagggcagcctgagagaatgtctgggccggcagagccccctgtgccccaagtttgaggtgcacaccccaaatggaaggatgggcacagagaagcagagccccagcggggagaccaggaagaagagcctgagccgggacaagggcctgcggaggagaagaagtgccctgagccgggagatcctgaccaaggagcggcaccaggagtgcagcgactgtgggaagaccttctttgaccacagcagcctgaccaggcaccagaggacccacactggagagaagccctatgactgccgggagtgtgggaaggccttcagccacaggagcagcctgagccgccacctgatgagccacactggagagagcccctatgaatgttctgtgtgcagcaaggccttctttgacaggagcagcctgactgtgcaccagaggatccacactggagagaagcccttccagtgcaatgaatgtgggaaggccttctttgacaggagcagcctgaccaggcaccagaggatccacactggagagagcccctatgagtgccaccagtgtgggaaggccttcagccagaagagcatcctgaccaggcaccagctgatccacactggaaggaagccctatgaatgtaatgaatgtgggaaggccttctacggcgtgagcagcctgaacagacaccagaaggcccatgctggggacccccgctaccagtgcaatgaatgtgggaaggccttctttgacaggagcagcctgacccagcaccagaagatccacactggagacaagccctatgaatgttctgaatgtgggaaggccttcagccagcgctgccgcctgaccaggcaccagagggtgcacactggagagaagccctttgaatgtactgtgtgtgggaaggtgttcagcagcaagagcagcgtcatccagcaccagaggagatatgccaagcagggcattgattag

SEQ ID NO: 176600 - DNA, 1041 bp, Artificial Sequence
  Description of Artificial Sequence: Synthetic coding sequence
atgctggagaactacaacagcatcgtgtccctggactgggagaccaagccagagatccatgatgccagtgacaagaagtctgagggcagcctgagagaatgtctgggccggcagagccccctgtgccccaagtttgaggtgcacaccccaaatggaaggatgggcacagagaagcagagccccagcggggagaccaggaagaagagcctgagccgggacaagggcctgcggaggagaagaagtgccctgagccgggagatcctgaccaaggagcggcaccaggagtgcagcgactgtgggaagaccttctttgaccacagcagcctgaccaggcaccagaggacccacactggagagaagccctatgactgccgggagtgtgggaaggccttcagccacaggagcagcctgagccgccacctgatgagccacactggagagagcccctatgaatgttctgtgtgcagcaaggccttctttgacaggagcagcctgactgtgcaccagaggatccacactggagagaagcccttccagtgcaatgaatgtgggaaggccttctttgacaggagcagcctgaccaggcaccagaggatccacactggagagagcccctatgagtgccaccagtgtgggaaggccttcagccagaagagcatcctgaccaggcaccagctgatccacactggaaggaagccctatgaatgtaatgaatgtgggaaggccttctacggcgtgagcagcctgaacagacaccagaaggcccatgctggggacccccgctaccagtgcaatgaatgtgggaaggccttctttgacaggagcagcctgacccagcaccagaagatccacactggagacaagccctatgaatgttctgaatgtgggaaggccttcagccagcgctgccgcctgaccaggcaccagagggtgcacactggagagaagccctttgaatgtactgtgtgtgggaaggtgttcagcagcaagagcagcgtcatccagcaccagaggagatatgccaagcagggcattgattag

SEQ ID NO: 176601 - DNA, 1320 bp, Artificial Sequence
  Description of Artificial Sequence: Synthetic coding sequence
atggctgctgtgagccccaccacccgctgccaggagagcgtgacctttgaagatgtggccgtggtgttcacagatgaggagtggagccggctggtgcccatccagagggacctgtacaaggaggtgatgctggagaactacaacagcatcgtgtccctgggcctgcctgtgccccagccagatgtgatcttccagctgaagagaggagacaagccctggatggtggacctgcacggcagcgaggagcgggagtggccagagagcgtgtccctggcccaggagaagaactgcatctgcttcctgtttgtgcctgactgggagaccaagccagagatccatgatgccagtgacaagaagtctgagggcagcctgcgggagtgcctgggccggcagagccccctgtgccccaagtttgaggtgcacacccccaacggccgcatgggcacagagaagcagagccccagcggggagaccaggaagaagagcctgagccgggacaagggcctgcggcggcggcgcagcgccctgagccgggagatcctgaccaaggagcggcaccaggagtgcagcgactgtgggaagaccttctttgaccacagcagcctgaccaggcaccagaggacccacactggagagaagccctatgactgcagagaatgtgggaaggccttcagccacaggagcagcctgagccgccacctgatgagccacactggagagagcccctatgagtgcagcgtgtgcagcaaggccttctttgacaggagcagcctgactgtgcaccagaggatccacactggagagaagcccttccagtgcaatgaatgtgggaaggccttctttgacaggagcagcctgaccaggcaccagaggatccacactggagagagcccctatgagtgccaccagtgtgggaaggccttcagccagaagagcatcctgaccaggcaccagctgatccacacaggcaggaagccctatgagtgcaatgaatgtgggaaggccttctatggagtgagcagcctgaacagacaccagaaggcccacgccggggacccccgctaccagtgcaatgaatgtgggaaggccttctttgacaggagcagcctgacccagcaccagaagatccacactggagacaagccctatgagtgcagtgaatgtgggaaggccttcagccagcgctgccgcctgaccaggcaccagagggtgcacactggagagaagccctttgagtgcaccgtgtgtgggaaggtgttcagcagcaagagcagcgtcatccagcaccagaggagatatgccaagcagggcatcgactag

SEQ ID NO: 176602 - DNA, 1611 bp, Artificial Sequence
  Description of Artificial Sequence: Synthetic coding sequence
atgatgttccaggacagcgtggcctttgaagatgtggccgtgtccttcacccaggaggagtgggccctgctggaccccagccagaagaacctgtacagagatgtgatgcaggagaccttcaagaacctgacctctgtgggcaagacctggaaggtgcagaacattgaagatgagtacaagaaccccaggaggaacctgagcctgatgagggagaagctgtgtgagagcaaggagagccaccactgtggggagagcttcaaccagattgctgatgacatgctgaacaggaagaccctgcccggcatcaccccctgtgagagctctgtgtgtggggaggtgggcaccggccacagcagcctgaacacccacatccgggctgacaccggccacaagagcagcgagtaccaggagtatggagagaacccctacagaaacaaggagtgcaagaaggccttctcctacctggacagcttccagagccatgacaaggcctgcaccaaggagaagccctatgatggcaaggaatgtacagagaccttcatcagccacagctgcatccagaggcaccgggtgatgcacagcggagatggcccctacaagtgcaagttctgtgggaaggccttctacttcctgaacctgtgcctgattcatgagcgcatccacactggagtgaagccctacaagtgcaagcagtgtgggaaggccttcaccaggagcaccaccctgcctgtgcatgagaggacccacactggagtgaatgctgatgagtgcaaggaatgtggaaatgccttctccttccccagcgagatcagaagacacaagaggagccacactggagagaagccctatgagtgcaagcagtgtgggaaggtgttcatctccttcagcagcatccagtaccacaagatgacccacactggagagaagccctatgagtgcaagcagtgtgggaaggccttccgctgtggcagccacctgcagaagcacggccgcacccacactggagagaagccctatgagtgccggcagtgtgggaaggccttccgctgcaccagtgacctgcagagacatgagaagacccacacagaggacaagccctacggctgcaagcagtgtgggaagggcttccgctgtgccagccagctgcagatccacgagaggacccacagcggggagaagccccatgagtgcaaggaatgtgggaaggtgttcaagtacttcagcagcctgcgcatccacgagaggacccacactggagagaagccccatgagtgcaagcagtgtgggaaggccttccgctacttcagcagcctgcacatccacgagaggacccacactggagacaagccctatgagtgcaaggtgtgtgggaaggccttcacctgcagcagcagcatccgctaccacgagaggacccacactggagagaagccctatgagtgcaagcactgtgggaaggccttcatcagcaactacatccgctaccacgagaggacccacactggagagaagccctaccagtgcaagcagtgtgggaaggccttcatcgtgcctgtgcacgtggagaacatgaaggagctgatccccctgattgatgagaagagcttctag

SEQ ID NO: 176603 - DNA, 1599 bp, Artificial Sequence
  Description of Artificial Sequence: Synthetic coding sequence
atgatgttccaggacagcgtggcctttgaagatgtggccgtgtccttcacccaggaggagtgggccctgctggaccccagccagaagaacctgtacagagatgtgatgcaggagaccttcaagaacctgacctctgtgggcaagacctggaaggtgcagaacattgaagatgagtacaagaaccccaggaggaacctgagcctgatgagggagaagctgtgtgagagcaaggagagccaccactgtggggagagcttcaaccagattgctgatgacatgctgaacaggaagaccctgcccggcatcaccccctgtgagagctctgtgtgtggggaggtgggcaccggccacagcagcctgaacacccacatccgggctgacaccggccacaagagcagcgagtaccaggagtatggagagaacccctacagaaacaaggagtgcaagaaggccttctcctacctggacagcttccagagccatgacaaggcctgcaccaaggagaagccctatgatggcaaggaatgtacagagaccttcatcagccacagctgcatccagaggcaccgggtgatgcacagcggagatggcccctacaagtgcaagttctgtgggaaggccttctacttcctgaacctgtgcctgattcatgagcgcatccacactggagtgaagccctacaagtgcaagcagtgtgggaaggccttcaccaggagcaccaccctgcctgtgcatgagaggacccacactggagtgaatgctgatgagtgcaaggaatgtggaaatgccttctccttccccagcgagatcagaagacacaagaggagccacactggagagaagccctatgagtgcaagcagtgtgggaaggtgttcatctccttcagcagcatccagtaccacaagatgacccacactggagagaagccctatgagtgcaagcagtgtgggaaggccttccgctgtggcagccacctgcagaagcacggccgcacccacactggagagaagccctatgagtgccggcagtgtgggaaggccttccgctgcaccagtgacctgcagagacatgagaagacccacacagaggacaagccctacggctgcaagcagtgtgggaagggcttccgctgtgccagccagctgcagatccacgagaggacccacagcggggagaagccccatgagtgcaaggaatgtgggaaggtgttcaagtacttcagcagcctgcgcatccacgagaggacccacactggagagaagccccatgagtgcaagcagtgtgggaaggccttccgctacttcagcagcctgcacatccacgagaggacccacactggagacaagccctatgagtgcaaggtgtgtgggaaggccttcacctgcagcagcagcatccgctaccacgagaggacccacactggagagaagccctatgagtgcaagcactgtgggaaggccttcatcagcaactacatccgctaccacgagaggacccacactggagagaagccctaccagtgcaagcagtgtgggaaggccttcatccgggccagcagctgccgggagcacgagaggacccacaccatcaacagatag

SEQ ID NO: 176604 - DNA, 1185 bp, Artificial Sequence
  Description of Artificial Sequence: Synthetic coding sequence
atgatggccgccaaggtggtgcccatgccacccaagcccaagcagagcttcatcctgcgggtgcccccagacagcaagctgggccaggacctgctgagagatgccaccaacggccccaagaccatccaccagctggtgctggagcacttcctgaccttcctgcccaagcccagcctggtgcagcccagccagaaggtgaaggagaccctggtgatcatgaaggatgtgagcagcagcctgcagaacagagtgcacccccggcccctggtgaagctgctgcccaagggcgtgcagaaggagcaggagaccgtgtccctgtacctgaaggccaaccctgagctggtggtgtttgaggacctgaatgtgttccactgccaggaggagtgtgtgtccctggaccccacccagcagctgaccagcgagaaggaggatgacagctctgtgggggagatgatgctgctggccgtgaatggcagcaaccctgagggggaggaccctgagcgggagcctgtggagaatgaagactaccgggagaagagcagtgatgatgatgagatggacagcagcctggtgtcccagcagcccccagacaaccaggagaaggagcggctgaacaccagcatcccccagaagaggaagatgaggaacctgctggtgaccattgaaaatgacacccccctggaggagctgagcaaatatgtggacatcagcatcatcgccctgaccaggaacagaaggacccggcgctggtacacctgccccctgtgtgggaagcagttcaatgaaagcagctacctgatcagccaccagaggacccacactggagagaagccctatgactgcaaccactgtgggaagagcttcaaccacaagaccaacctgaacaagcatgagcgcatccacactggagagaagccctacagctgcagccagtgtgggaagaacttccggcagaacagccacaggagcagacatgagggcatccacatccgggagaagatcttcaagtgcccagaatgtgggaagaccttccccaagaatgaggagtttgtgctgcacctgcagagccatgaagctgagcggccctacggctgcaagaagtgtggccgccgcttcggccgcctgagcaactgcaccaggcatgagaagacccacagcgcctgcaagaccaggaagcagaagtag

SEQ ID NO: 176605 - DNA, 1188 bp, Artificial Sequence
  Description of Artificial Sequence: Synthetic coding sequence
atgatggccgccaaggtggtgcccatgccacccaagcccaagcagagcttcatcctgcgggtgcccccagacagcaagctgggccaggacctgctgagagatgccaccaacggccccaagaccatccaccagctggtgctggagcacttcctgaccttcctgcccaagcccagcctggtgcagcccagccagaaggtgaaggagaccctggtgatcatgaaggatgtgagcagcagcctgcagaacagagtgcacccccggcccctggtgaagctgctgcccaagggcgtgcagaaggagcaggagaccgtgtccctgtacctgaaggccaaccctgaggagctggtggtgtttgaggacctgaatgtgttccactgccaggaggagtgtgtgtccctggaccccacccagcagctgaccagcgagaaggaggatgacagctctgtgggggagatgatgctgctggccgtgaatggcagcaacccagaaggagaagatcctgagcgggagcctgtggagaatgaagactaccgggagaagagcagtgatgatgatgagatggacagcagcctggtgtcccagcagcccccagacaaccaggagaaggagcggctgaacaccagcatcccccagaagaggaagatgaggaacctgctggtgaccattgaaaatgacacccccctggaggagctgagcaaatatgtggacatcagcatcatcgccctgaccaggaacagaaggacccggcgctggtacacctgccccctgtgtgggaagcagttcaatgaaagcagctacctgatcagccaccagaggacccacactggagagaagccctatgactgcaaccactgcggcaagagcttcaaccacaagaccaacctgaacaagcatgagcgcatccacactggagagaagccctacagctgcagccagtgtgggaagaacttccggcagaacagccacaggagcagacatgagggcatccacatccgggagaagatcttcaagtgcccagaatgtgggaagaccttccccaagaatgaggagtttgtgctgcacctgcagagccatgaggccgagcggccctacggctgcaagaagtgtggcagaagatttggccgcctgagcaactgcaccaggcatgagaagacccacagcgcctgcaagaccaggaagcagaagtag

SEQ ID NO: 176606 - DNA, 1185 bp, Artificial Sequence
  Description of Artificial Sequence: Synthetic coding sequence
atgatggccgccaaggtggtgcccatgccacccaagcccaagcagagcttcatcctgcgggtgcccccagacagcaagctgggccaggacctgctgagagatgccaccaacggccccaagaccatccaccagctggtgctggagcacttcctgaccttcctgcccaagcccagcctggtgcagcccagccagaaggtgaaggagaccctggtgatcatgaaggatgtgagcagcagcctgcagaacagagtgcacccccggcccctggtgaagctgctgcccaagggcgtgcagaaggagcaggagaccgtgtccctgtacctgaaggccaaccctgaggagctggtggtgtttgaggacctgaatgtgttccactgccaggaggagtgtgtgtccctggaccccacccagcagctgaccagcgagaaggaggatgacagctctgtgggggagatgatgctgctggtgaatggcagcaaccctgagggggaggaccctgagcgggagcctgtggagaatgaagactaccgggagaagagcagtgatgatgatgagatggacagcagcctggtgtcccagcagcccccagacaaccaggagaaggagcggctgaacaccagcatcccccagaagaggaagatgaggaacctgctggtgaccattgaaaatgacacccccctggaggagctgagcaaatatgtggacatcagcatcatcgccctgaccaggaacagaaggacccggcgctggtacacctgccccctgtgtgggaagcagttcaatgaaagcagctacctgatcagccaccagaggacccacactggagagaagccctatgactgcaaccactgtgggaagagcttcaaccacaagaccaacctgaacaagcatgagcgcatccacactggagagaagccctacagctgcagccagtgtgggaagaacttccggcagaacagccacaggagcagacatgagggcatccacatccgggagaagatcttcaagtgcccagaatgtgggaagaccttccccaagaatgaggagtttgtgctgcacctgcagagccatgaagctgagcggccctacggctgcaagaagtgtggccgccgcttcggccgcctgagcaactgcaccaggcatgagaagacccacagcgcctgcaagaccaggaagcagaagtag

SEQ ID NO: 176607 - DNA, 1185 bp, Artificial Sequence; identical to SEQ ID NO: 176606
  Description of Artificial Sequence: Synthetic coding sequence

SEQ ID NO: 176608 - DNA, 1188 bp, Artificial Sequence; identical to SEQ ID NO: 176605
  Description of Artificial Sequence: Synthetic coding sequence

SEQ ID NO: 176609 - DNA, 1947 bp, Artificial Sequence
  Description of Artificial Sequence: Synthetic coding sequence
atggccacagctgtggagcctgaggaccaggacctgtgggaggaggagggcatcctgatggtgaagctggaggatgacttcacctgcaggcctgagagcgtgctgcagagagatgatcctgtgctggagaccagccaccagaacttccgccgcttccgctaccaggaggccgccagcccccgggaggccctgatccggctgcgggagctgtgccaccagtggctgcggcctgagaggaggaccaaggagcagatcctggagctgctggtgctggagcagttcctgactgtgctgcctggagagctgcagagctgggtgcggggccagaggcctgagagcggggaggaggccgtgaccctggtggagggcctgcagaagcagccccggcggccccggcgctgggtgacagtgcacgtgcacggccaggaggtgctgtctgaggagaccgtgcacctgggcgtggagcctgagagccccaatgagctgcaggaccctgtgcagagcagcaccccagagcagagccctgaggagaccacccagagcccagacctgggcgccccagctgagcagaggccccaccaggaggaggagctgcagaccctgcaggagagcgaggtgcctgtgcctgaggaccctgacctgcctgctgagaggagcagcggggacagcgagatggtggccctgctgacagccctgagccagggcctggtgaccttcaaggatgtggccgtgtgcttcagccaggaccagtggagcgacctggaccccacccagaaggagttctacggggagtatgtgctggaggaggactgtggcatcgtggtgtccctgtccttccccatccccaggccagatgagatcagccaggtgcgggaggaggagccctgggtgcctgacatccaggagccccaggagacccaggagcctgagatcctgtccttcacctacacaggagacaggagcaaggatgaggaggagtgcctggagcaggaggacctgagcctggaggacatccacaggcctgtgctgggggagcctgagatccaccagaccccagactgggagatcgtgtttgaggacaaccctggccgcctgaatgaaagacgcttcggcaccaacatcagccaggtgaacagctttgtgaacctgcgggagaccacccctgtgcaccccctgctgggccgccaccacgactgcagcgtgtgtgggaagagcttcacctgcaacagccacctggtgcgccacctgcggacccacactggagagaagccctacaagtgcatggagtgtgggaagagctacaccaggagcagccacctggcccggcaccagaaggtgcacaagatgaatgccccctacaagtaccccctgaacaggaagaacctggaggagaccagccctgtgacccaggccgagaggacccccagcgtggagaagccctaccgctgtgatgactgtgggaagcacttccgctggaccagtgacctggtgcgccaccagaggacccacactggagagaagcccttcttctgcaccatctgtgggaagagcttcagccagaagtctgtgctgaccacccaccagaggatccacctgggcggcaagccctacctgtgtggagaatgtggggaggacttcagcgagcaccggcgctacctggcccacaggaagacccacgccgctgaggagctgtacctgtgcagtgaatgtggccgctgcttcacccacagcgctgcctttgccaagcacctgcggggccacgcctctgtgcggccctgccgctgcaatgaatgtgggaagagcttcagccggcgggaccacctggtgcgccaccagaggacccacactggagagaagcccttcacctgccccacctgtgggaagagcttcagccggggctaccacctgatccgccaccagaggacccacagcgagaagaccagctag

SEQ ID NO: 176610 - DNA, 1947 bp, Artificial Sequence; identical to SEQ ID NO: 176609
  Description of Artificial Sequence: Synthetic coding sequence

SEQ ID NO: 176611 - DNA, 1947 bp, Artificial Sequence; identical to SEQ ID NO: 176609
  Description of Artificial Sequence: Synthetic coding sequence

SEQ ID NO: 176612 - DNA, 399 bp, Artificial Sequence
  Description of Artificial Sequence: Synthetic coding sequence
atgacagctgctgccagcctgctggccagcctgctgcctgccctgccccccctgaacctgcaggatgccaagtttgtggaggagaggaggaagcagctgcagaactacctgcggtctgtgatgaacaaggtgatccagatggtgcctgagtttgctgccagccccaagaaggagaccctcatccagctgatgcccttctttgtgatgggcctgcaggtgggcatgtatggcctcttccactttggagtgatgatggaccagccccagcccagcctgaccagggcagatgagagcccctgtgacagagtgctgagcccctgtgccgcccacaggaagcagagggactgctgcctgtcctggaaggccgagcctgagcgcttcctggtgaagaagaagtag

SEQ ID NO: 176613 - DNA, 1665 bp, Artificial Sequence; identical to SEQ ID NO: 162821
  Description of Artificial Sequence: Synthetic coding sequence

SEQ ID NO: 176614 - DNA, 840 bp, Artificial Sequence
  Description of Artificial Sequence: Synthetic coding sequence
atgtctgcagatggcggcggcatccaggacacccaggacaaggagaccccacctgaggtgcctgaccggggccacccccaccaggagatgcccagcaagctgggggaggccgtgcccagcggggacacccaggagagcctgcacatcaagatggagcctgaggagccccacagcgagggcgccagccaggaggatggagcccagggcgcctggggctgggcccccctgagccacggcagcaaggagaaggccctcttcctgcccggcggggccctgcccagcccccgcatccctgtgctgagccgggagggccgcacccgggaccggcagatggctgctgccctgctgacagcctggagccagatgcctgtgacctttgaagatgtggccctgtacctgagccgggaggagtggggccgcctggaccacacccagcagaacttctacagagatgtgctgcagaagaagaatggcctgagcctgggcttccccttcagccggcccttctgggccccccaggcccatggaaaaggagaggccagcggcagcagccggcaggccggagatgagaaggagtggaggggggcctgcaccggggctgtggaggtgggccagagggtgcagaccagctctgtggccgccctgggcaatgtgaagcccttccgcaccagggctggccgggtgcagtggggcgtgccccagtgtgcccaggaggccgcctgtggccgcagcagcggccctgccaaggacagcggccagcctgctgagccagacaggaccccagatgctgcccccccagaccccagccccacagagccccaggagtacagagtgccctag

SEQ ID NO: 176615 - DNA, 357 bp, Artificial Sequence
  Description of Artificial Sequence: Synthetic coding sequence
atgtctgcagatggcggcggcatccaggacacccaggacaaggagaccccacctgaggtgcctgaccggggccacccccaccaggagatgcccagcaagctgggggaggccgtgcccagcggggacacccaggagagcctgcacatcaagatggagcctgaggagccccacagcgagggcgccagccaggaggatggagcccagggcgcctggggctgggcccccctgagccacggcagcaaggagaaggccctcttcctgcccggcggggccctgcccagcccccgcatccctgtgctgagccgggagggccgcacccgggaccggcagatggctgctgccctgctgacagcctag

SEQ ID NO: 176616 - DNA, 1392 bp, Artificial Sequence
  Description of Artificial Sequence: Synthetic coding sequence
atgggcaggaagaagaagaagcagctgaagccctggtgctggtactgcaacagagactttgatgatgagaagatcctgatccagcaccagaaggccaagcacttcaagtgccacatctgccacaagaagctgtacacaggccctggcctggccatccactgcatgcaggtgcacaaggagaccattgatgctgtgcccaatgccatccctggccgcacagacatcgagctggagatctacggcatggagggcatccctgagaaggacatggatgaaagaagaaggctgctggagcagaagacccaggagagccagaagaagaagcagcaggatgacagtgatgaatatgatgatgatgattctgctgccagcaccagcttccagccccagcctgtgcagccccagcagggctacatcccccccatggcccagcccggcctgccccctgtgcctggggcccctggcatgcctcctggcatcccccccctgatgcctggggtgccccccctgatgcctggcatgcctcctgtgatgcctggcatgcctcctggcctgcaccaccagaggaagtacacccagagcttctgtggggagaacatcatgatgcccatgggcggcatgatgcctcctggccctggcatcccccccctgatgcctggcatgcctcctggcatgcctcctcctgtgccccggcccggcatcccccccatgacccaggcccaggccgtgtctgcccctggcatcctgaaccggcccccagcccccacagccaccgtgcctgccccccagccccctgtgaccaagcccctcttccccagcgctggccaggcccaggccgctgtgcagggccctgtgggcacagacttcaagcccctgaacagcaccccagccaccaccacagagccccccaagcccaccttccctgcctacacccagagcacagccagcaccaccagcaccaccaacagcacagctgccaagccagctgccagcatcaccagcaagccagccaccctgaccaccaccagcgccaccagcaagctgatccacccagatgaggacatcagcctggaggagcggcgggcccagctgcccaagtaccagaggaacctgccccggcccggccaggcccccatcggcaacccccctgtgggccccatcggcggcatgatgccaccccagcccggcatcccccagcagcagggcatgaggcctcccatgccaccccacggccagtatggaggccaccaccagggcatgcctggctacctgcccggggccatgccaccctacggccagggcccccccatggtgcccccctaccagggcggccccccccggccccccatgggcatgaggcctcctgtgatgagccagggcggccgctactag

SEQ ID NO: 176617 - DNA, 1188 bp, Artificial Sequence
  Description of Artificial Sequence: Synthetic coding sequence
atgggcaggaagaagaagaagcagctgaagccctggtgctggtactgcaacagagactttgatgatgagaagatcctgatccagcaccagaaggccaagcacttcaagtgccacatctgccacaagaagctgtacacaggcctgccccctgtgcctggggcccctggcatgcctcctggcatcccccccctgatgcctggggtgccccccctgatgcctggcatgcctcctgtgatgcctggcatgcctcctggcctgcaccaccagaggaagtacacccagagcttctgtggggagaacatcatgatgcccatgggcggcatgatgcctcctggccctggcatcccccccctgatgcctggcatgcctcctggcatgcctcctcctgtgcccaggcctggcatcccccccatgacccaggcccaggccgtgtctgcccctggcatcctgaacagacctccagcccccacagccaccgtgcctgccccccagccccctgtgaccaagcccctcttccccagcgctggccagatgggcacccctgtgaccagcagcagcacagccagcagcaacagcgagagcctgagcgccagcagcaaggccctcttccccagcacagcccaggcccaggccgctgtgcagggccctgtgggcacagacttcaagcccctgaacagcaccccagccaccaccacagagccccccaagcccaccttccctgcctacacccagagcacagccagcaccaccagcaccaccaacagcacagctgccaagccagctgccagcatcaccagcaagccagccaccctgaccaccaccagcgccaccagcaagctgatccacccagatgaggacatcagcctggaggagcggcgggcccagctgcccaagtaccagaggaacctgccccggcccggccaggcccccatcggcaacccccctgtgggccccatcggcggcatgatgccaccccagcccggcatcccccagcagcagggcatgaggcctcccatgccaccccacggccagtatggaggccaccaccagggcatgcctggctacctgcccggggccatgccaccctacggccagggcccccccatggtgcccccctaccagggcggccccccccggccccccatgggcatgaggcctcctgtgatgagccagggcggccgctactag

SEQ ID NO: 176618 - DNA, 1437 bp, Artificial Sequence
  Description of Artificial Sequence: Synthetic coding sequence
atgggcaggaagaagaagaagcagctgaagccctggtgctggtactgcaacagagactttgatgatgagaagatcctgatccagcaccagaaggccaagcacttcaagtgccacatctgccacaagaagctgtacacaggccctggcctggccatccactgcatgcaggtgcacaaggagaccattgatgctgtgcccaatgccatccctggccgcacagacatcgagctggagatctacggcatggagggcatccctgagaaggacatggatgaaagaagaaggctgctggagcagaagacccaggagagccagaagaagaagcagcaggatgacagtgatgaatatgatgatgatgattctgctgccagcaccagcttccagccccagcctgtgcagccccagcagggctacatcccccccatggcccagcccggcctgccccctgtgcctggggcccctggcatgcctcctggcatcccccccctgatgcctggggtgccccccctgatgcctggcatgcctcctgtgatgcctggcatgcctcctggcatgatgcccatgggcggcatgatgcctcctggccctggcatcccccccctgatgcctggcatgcctcctggcatgcctcctcctgtgccccggcccggcatcccccccatgacccaggcccaggccgtgtctgcccctggcatcctgaaccggcccccagcccccacagccaccgtgcctgccccccagccccctgtgaccaagcccctcttccccagcgctggccagatgggcacccctgtgaccagcagcagcacagccagcagcaacagcgagagcctgagcgccagcagcaaggccctcttccccagcacagcccaggcccaggccgctgtgcagggccctgtgggcacagacttcaagcccctgaacagcaccccagccaccaccacagagccccccaagcccaccttccctgcctacacccagagcacagccagcaccaccagcaccaccaacagcacagctgccaagccagctgccagcatcaccagcaagccagccaccctgaccaccaccagcgccaccagcaagctgatccacccagatgaggacatcagcctggaggagcggcgggcccagctgcccaagtaccagaggaacctgcccaggcctggccaggcccccatcggcaacccccctgtgggccccatcggcggcatgatgccaccccagcccggcatcccccagcagcagggcatgaggcctcccatgcctcctcatggccagtatggaggccaccaccagggcatgcctggctacctgcccggggccatgccaccctacggccagggcccccccatggtgcccccctaccagggcggcccccccaggcctcccatgggcatgaggcctcctgtgatgagccagggcggccgctactag

SEQ ID NO: 176619 - DNA, 1485 bp, Artificial Sequence
  Description of Artificial Sequence: Synthetic coding sequence
atgggcaggaagaagaagaagcagctgaagccctggtgctggtactgcaacagagactttgatgatgagaagatcctgatccagcaccagaaggccaagcacttcaagtgccacatctgccacaagaagctgtacacaggccctggcctggccatccactgcatgcaggtgcacaaggagaccattgatgctgtgcccaatgccatccctggccgcacagacatcgagctggagatctacggcatggagggcatccctgagaaggacatggatgaaagaagaaggctgctggagcagaagacccaggagagccagaagaagaagcagcaggatgacagtgatgaatatgatgatgatgattctgctgccagcaccagcttccagccccagcctgtgcagccccagcagggctacatcccccccatggcccagcccggcctgccccctgtgcctggggcccctggcatgcctcctggcatcccccccctgatgcctggggtgccccccctgatgcctggcatgcctcctgtgatgcctggcatgcctcctggcctgcaccaccagaggaagtacacccagagcttctgtggggagaacatcatgatgcccatgggcggcatgatgcctcctggccctggcatcccccccctgatgcctggcatgcctcctggcatgcctcctcctgtgccccggcccggcatcccccccatgacccaggcccaggccgtgtctgcccctggcatcctgaaccggcccccagcccccacagccaccgtgcctgccccccagccccctgtgaccaagcccctcttccccagcgctggccagatgggcacccctgtgaccagcagcagcacagccagcagcaacagcgagagcctgagcgccagcagcaaggccctcttccccagcacagcccaggcccaggccgctgtgcagggccctgtgggcacagacttcaagcccctgaacagcaccccagccaccaccacagagccccccaagcccaccttccctgcctacacccagagcacagccagcaccaccagcaccaccaacagcacagctgccaagccagctgccagcatcaccagcaagccagccaccctgaccaccaccagcgccaccagcaagctgatccacccagatgaggacatcagcctggaggagcggcgggcccagctgcccaagtaccagaggaacctgcccaggcctggccaggcccccatcggcaacccccctgtgggccccatcggcggcatgatgccaccccagcccggcatcccccagcagcagggcatgaggcctcccatgcctcctcatggccagtatggaggccaccaccagggcatgcctggctacctgcccggggccatgccaccctacggccagggcccccccatggtgcccccctaccagggcggcccccccaggcctcccatgggcatgaggcctcctgtgatgagccagggcggccgctactag

SEQ ID NO: 176620 - DNA, 1344 bp, Artificial Sequence
  Description of Artificial Sequence: Synthetic coding sequence
atgggcaggaagaagaagaagcagctgaagccctggtgctggtactgcaacagagactttgatgatgagaagatcctgatccagcaccagaaggccaagcacttcaagtgccacatctgccacaagaagctgtacacaggccctggcctggccatccactgcatgcaggtgcacaaggagaccattgatgctgtgcccaatgccatccctggccgcacagacatcgagctggagatctacggcatggagggcatccctgagaaggacatggatgaaagaagaaggctgctggagcagaagacccaggagagccagaagaagaagcagcaggatgacagtgatgaatatgatgatgatgattctgctgccagcaccagcttccagccccagcctgtgcagccccagcagggctacatcccccccatggcccagcccggcctgccccctgtgcctggggcccctggcatgcctcctggcatcccccccctgatgcctggggtgccccccctgatgcctggcatgcctcctgtgatgcctggcatgcctcctggcatgatgcccatgggcggcatgatgcctcctggccctggcatcccccccctgatgcctggcatgcctcctggcatgcctcctcctgtgccccggcccggcatcccccccatgacccaggcccaggccgtgtctgcccctggcatcctgaaccggcccccagcccccacagccaccgtgcctgccccccagccccctgtgaccaagcccctcttccccagcgctggccaggcccaggccgctgtgcagggccctgtgggcacagacttcaagcccctgaacagcaccccagccaccaccacagagccccccaagcccaccttccctgcctacacccagagcacagccagcaccaccagcaccaccaacagcacagctgccaagccagctgccagcatcaccagcaagccagccaccctgaccaccaccagcgccaccagcaagctgatccacccagatgaggacatcagcctggaggagcggcgggcccagctgcccaagtaccagaggaacctgccccggcccggccaggcccccatcggcaacccccctgtgggccccatcggcggcatgatgccaccccagcccggcatcccccagcagcagggcatgaggcctcccatgccaccccacggccagtatggaggccaccaccagggcatgcctggctacctgcccggggccatgccaccctacggccagggcccccccatggtgcccccctaccagggcggccccccccggccccccatgggcatgaggcctcctgtgatgagccagggcggccgctactag

SEQ ID NO: 176621 - DNA, 1491 bp, Artificial Sequence
  Description of Artificial Sequence: Synthetic coding sequence
aacacagtgatgggcaggaagaagaagaagcagctgaagccctggtgctggtactgcaacagagactttgatgatgagaagatcctgatccagcaccagaaggccaagcacttcaagtgccacatctgccacaagaagctgtacacaggccctggcctggccatccactgcatgcaggtgcacaaggagaccattgatgctgtgcccaatgccatccctggccgcacagacatcgagctggagatctacggcatggagggcatccctgagaaggacatggatgagcggcggcggctgctggagcagaagacccaggagagccagaagaagaagcagcaggatgacagtgatgaatatgatgatgatgacagcgctgccagcaccagcttccagccccagcctgtgcagccccagcagggctacatcccccccatggcccagcccggcctgccccctgtgcctggggcccctggcatgcctcctggcatcccccccctgatgcctggggtgccccccctgatgcctggcatgcctcctgtgatgcctggcatgcctcctggcctgcaccaccagaggaagtacacccagagcttctgtggggagaacatcatgatgcccatgggcggcatgatgcctcctggccctggcatcccccccctgatgcctggcatgcctcctggcatgcctcctcctgtgcccaggcctggcatcccccccatgacccaggcccaggccgtgtctgcccctggcatcctgaacagacctccagcccccacagccaccgtgcctgccccccagccccctgtgaccaagcccctcttccccagcgctggccagatgggcacccctgtgaccagcagcagcacagccagcagcaacagcgagagcctgagcgccagcagcaaggccctcttccccagcacagcccaggcccaggccgctgtgcagggccctgtgggcacagacttcaagcccctgaacagcaccccagccaccaccacagagccccccaagcccaccttccctgcctacacccagagcacagccagcaccaccagcaccaccaacagcacagctgccaagccagctgccagcatcaccagcaagccagccaccctgaccaccaccagcgccaccagcaagctgatccacccagatgaggacatcagcctggaggagcggcgggcccagctgcccaagtaccagaggaacctgccccggcccggccaggcccccatcggcaacccccctgtgggccccatcggcggcatgatgccaccccagcccggcatcccccagcagcagggcatgaggcctcccatgccaccccacggccagtatggaggccaccaccagggcatgcctggctacctgcccggggccatgccaccctacggccagggcccccccatggtgcccccctaccagggcggccccccccggccccccatgggcatgaggcctcctgtgatgagccagggcctgccctag

SEQ ID NO: 176622 - DNA, 3843 bp, Artificial Sequence
  Description of Artificial Sequence: Synthetic coding sequence
atgggcagcctgaccttcagagatgtggccatcgagttcagcctggaggagtggcagtgcctggacacagcccagcagaacctgtacagaaatgtgatgctggagaactacagaaacctggtgttcctgggcattgctgccttcaagccagacctgatcatcttcctggaggagggcaaggagagctggaacatgaagagacatgagatggtggaggagagccctgtgatctgcagccactttgcccaggacctgtggccagagcagggcatcgaggacagcttccagaaggtgatcctgcggcgctatgaaaaatgtggccacgagaacctgcacctgaagattggctacaccaacgtggatgagtgcaaggtgcacaaggagggctacaacaagctgaaccagagcctgaccaccacccagagcaaggtgttccagaggggcaagtatgccaacgtgttccacaagtgcagcaacagcaacagacacaagatccgccacacaggcaagaagcacctgcagtgcaaggagtatgtgcgctccttctgcatgctgagccacctgagccagcacaagaggatctacacccgggagaacagctacaagtgtgaggagggcggcaaggccttcaactggagcagcaccctgacctactacaagagcgcccacactggagagaagccctaccgctgcaaggaatgtgggaaggccttcagcaagttcagcatcctgaccaagcacaaggtgatccacactggagagaagagctacaagtgtgaagaatgtgggaaggccttcaaccagagcgccatcctgaccaagcacaagatcatccacactggagagaagcccaacaagtgtgaagaatgtgggaaggccttcagcaaggtgtccaccctgaccacccacaaggccatccacgccggggagaagccctacaagtgcaaggaatgtgggaaggccttcagcaaggtgtccaccctcatcacccacaaggccatccacgccggggagaagccctacaagtgcaaggaatgtgggaaggccttcagcaagttcagcatcctgaccaagcacaaggtgatccacactggagagaagccctacaagtgtgaagaatgtgggaaggcctacaagtggcccagcaccctgagctaccacaagaagatccacactggagagaagccctacaagtgtgaagaatgtgggaagggcttctccatgttcagcatcctgaccaagcatgaagtcatccacactggagagaagccctacaagtgtgaagaatgtgggaaggccttcaactggagcagcaacctgatggagcacaagaagatccacactggagagaccccctacaagtgtgaagaatgtgggaagggcttctccatgttcagcatcctgaccaagcacaaggtgatccacaacggggagaagccctacaagtgtgaagaatgtgacaaggccacccacgccggggagaagccctacaagtgtgaagaatgtgggaaggccttcaactggagcagcaacctgatggagcacaagaggatccacactggagagaagccctacaagtgtgaagaatgtgggaagagcttcagcaccttcagcatcctgaccaagcacaaggtgatccacactggagagaagccctacaagtgtgaagaatgtgggaaggcctacaagtggagcagcaccctgagctaccacaagaagatccacacagtggagaagccctacaagtgtgaagaatgtgggaaggccttcaaccagagcgccatcctgatcaagcacaagaggatccacactggagagaagccctacaagtgtgaagaatgtgggaagaccttcagcaaggtgtccaccctgaccacccacaaggccatccacgccggggagaagccctacaagtgcaaggaatgtgggaagaccttcatcaaggtgtccaccctgaccacccacaaggccatccacgccggggagaagccctacaagtgcaaggaatgtgggaaggccttcagcaagttcagcatcctgaccaagcacaaggtgatccacactggagagaagccctacaagtgtgaagaatgtgggaaggccttcaactggagcagcaacctgatggagcacaagaggatccacactggagagaagccctacaagtgtgaagaatgtgggaagagcttcagcaccttctctgtgctgaccaagcacaaggtgatccacactggagagaagccctacaagtgtgaagaatgtgggaaggcctacaagtggagcagcaccctgagctaccacaagaagatccacacagtggagaagccctacaagtgtgaagaatgtgggaaggccttcaacagaagtgccatcctgatcaagcacaagaggatccacacagatgagaagccctacaagtgtgaagaatgtgggaagaccttcagcaaggtgtccaccctgaccacccacaaggccatccacgccggggagaagccctacaagtgcaaggaatgtgggaaggccttcagcaagttcagcatcctgaccaagcacaaggtgatccacactggagagaagccctacaagtgtgaagaatgtgggaaggcctacaagtggcccagcaccctgagctaccacaagaagatccacactggagagaagccctacaagtgtgaagaatgtgggaagggcttctccatgttcagcatcctgaccaagcatgaagtcatccacactggagagaagccctacaagtgtgaagaatgtgggaaggccttctcctggctgagcgtcttcagcaagcacaagaagacccacgccggggagaagttctacaagtgtgaggcctgtgggaaggcctacaagagcagcagcaccctgagctaccacaagaagatccacacagaggagaagccctacaagtatgaagaatgtgggaagggcttcagcaccttcagcatcctgaccaagcacaaggtgatccacactggagagaagccctacaagtgtgaagaatgtgggaaggccttcaactggagcagcaacctgatggagcacaagaagatccacactggagagaccccctacaagtgtgaagaatgtgacaaggccttctcctggcccagcagcctgacagagcacaaggccacccacgccggggagaagccctacaagtgtgaagaatgtgggaaggccttctcctggcccagccggctgacagagcacaaggccacccacgccggggaggagccctacaagtgtgaagaatgtgggaaggccttcaactggagcagcaacctgatggagcacaagaggatccacactggagagaagccctacaagtgtgaagaatgtgggaagagcttcagcaccttcagcatcctgaccaagcacaaggtgatccacactggagagaagccctacaagtgtgaagaatgtgggaaggcctacaagtggagcagcaccctgagctaccacaagaagatccacacagtggagaagccctacaagtgtgaagaatgtgggaagggctttgtgatgttcagcatcctggccaagcacaaggtgatccacactggagagaagctgtacaagtgtgaagaatgtgggaaggcctacaagtggcccagcaccctgcgctaccacaagaagatccacactggagagaagccctacaagtgtgaagaatgtgggaaggccttcagcaccttcagcatcctgaccaagcacaaggtgatccacactggagagaagccctacaagtgtgaagaatgtgggaaggccttctcctggctgagcgtcttcagcaagcacaagaagatccacactggagagaagctgtag

SEQ ID NO: 176623 - DNA, 123 bp, Artificial Sequence
  Description of Artificial Sequence: Synthetic coding sequence
gggaagggcttctccatgttcagcatcctgaccaagcacaaggccacccacgccggggagaagccctacaagtgtgaagaatgtgggaaggccttcaactggagcagcaacctgatggagtag

SEQ ID NO: 176624 - DNA, 3504 bp, Artificial Sequence
  Description of Artificial Sequence: Synthetic coding sequence
atgggcagcctgaccttcagagatgtggccatcgagttcagcctggaggagtggcagtgcctggacacagcccagcagaacctgtacagaaatgtgatgctggagaactacagaaacctggtgttcctgggcattgctgccttcaagccagacctgatcatcttcctggaggagggcaaggagagctggaacatgaagagacatgagatggtggaggagagccctgtgatctgcagccactttgcccaggacctgtggccagagcagggcatcgaggacagcttccagaaggtgatcctgcggcgctatgaaaaatgtggccacgagaacctgcacctgaagattggctacaccaacgtggatgagtgcaaggtgcacaaggagggctacaacaagctgaaccagagcctgaccaccacccagagcaaggtgttccagaggggcaagtatgccaacgtgttccacaagtgcagcaacagcaacagacacaagatccgccacacaggcaagaagcacctgcagtgcaaggagtatgtgcgctccttctgcatgctgagccacctgagccagcacaagaggatctacacccgggagaacagctacaagtgtgaggagggcggcaaggccttcaactggagcagcaccctgacctactacaagagcgcccacactggagagaagccctaccgctgcaaggaatgtgggaaggccttcagcaagttcagcatcctgaccaagcacaaggtgatccacactggagagaagagctacaagtgtgaagaatgtgggaaggccttcaaccagagcgccatcctgaccaagcacaagatcatccacactggagagaagcccaacaagtgtgaagaatgtgggaaggccttcagcaaggtgtccaccctgaccacccacaaggccatccacgccggggagaagccctacaagtgcaaggaatgtgggaaggccttcagcaaggtgtccaccctcatcacccacaaggccatccacgccggggagaagccctacaagtgcaaggaatgtgggaaggccttcagcaagttcagcatcctgaccaagcacaaggtgatccacactggagagaagccctacaagtgtgaagaatgtgggaaggcctacaagtggcccagcaccctgagctaccacaagaagatccacactggagagaagccctacaagtgtgaagaatgtgggaagggcttctccatgttcagcatcctgaccaagcatgaagtcatccacactggagagaagccctacaagtgtgaagaatgtgggaaggccttcaactggagcagcaacctgatggagcacaagaagatccacactggagagaccccctacaagtgtgaagaatgtgggaagggcttcaagtggagcagcaccctgagctaccacaagaagatccacacagtggagaagccctacaagtgtgaagaatgtgggaaggccttcaaccagagcgccatcctgatcaagcacaagaggatccacactggagagaagccctacaagtgtgaagaatgtgggaagaccttcagcaaggtgtccaccctgaccacccacaaggccatccacgccggggagaagccctacaagtgcaaggaatgtgggaagaccttcatcaaggtgtccaccctgaccacccacaaggccatccacgccggggagaagccctacaagtgcaaggaatgtgggaaggccttcagcaagttcagcatcctgaccaagcacaaggtgatccacactggagagaagccctacaagtgtgaagaatgtgggaaggccttcaactggagcagcaacctgatggagcacaagaggatccacactggagagaagccctacaagtgtgaagaatgtgggaagagcttcagcaccttctctgtgctgaccaagcacaaggtgatccacactggagagaagccctacaagtgtgaagaatgtgggaaggcctacaagtggagcagcaccctgagctaccacaagaagatccacacagtggagaagccctacaagtgtgaagaatgtgggaaggccttcaacagaagtgccatcctgatcaagcacaagaggatccacacagatgagaagccctacaagtgtgaagaatgtgggaagaccttcagcaaggtgtccaccctgaccacccacaaggccatccacgccggggagaagccctacaagtgcaaggaatgtgggaaggccttcagcaagttcagcatcctgaccaagcacaaggtgatccacactggagagaagccctacaagtgtgaagaatgtgggaaggcctacaagtggcccagcaccctgagctaccacaagaagatccacactggagagaagccctacaagtgtgaagaatgtgggaagggcttctccatgttcagcatcctgaccaagcatgaagtcatccacactggagagaagccctacaagtgtgaagaatgtgggaaggccttctcctggctgagcgtcttcagcaagcacaagaagacccacgccggggagaagttctacaagtgtgaggcctgtgggaaggcctacaacaccttcagcatcctgaccaagcacaaggtgatccacactggagagaagccctacaagtgtgaagaatgtgggaaggccttcaactggagcagcaacctgatggagcacaagaagatccacactggagagaccccctacaagtgtgaagaatgtgacaaggccttctcctggcccagcagcctgacagagcacaaggccacccacgccggggagaagccctacaagtgtgaagaatgtgggaaggccttctcctggcccagccggctgacagagcacaaggccacccacgccggggaggagccctacaagtgtgaagaatgtgggaaggccttcaactggagcagcaacctgatggagcacaagaggatccacactggagagaagccctacaagtgtgaagaatgtgggaagagcttcagcaccttcagcatcctgaccaagcacaaggtgatccacactggagagaagccctacaagtgtgaagaatgtgggaaggcctacaagtggagcagcaccctgagctaccacaagaagatccacacagtggagaagccctacaagtgtgaagaatgtgggaagggctttgtgatgttcagcatcctggccaagcacaaggtgatccacactggagagaagctgtacaagtgtgaagaatgtgggaaggcctacaagtggcccagcaccctgcgctaccacaagaagatccacactggagagaagccctacaagtgtgaagaatgtgggaaggccttcagcaccttcagcatcctgaccaagcacaaggtgatccacactggagagaagccctacaagtgtgaagaatgtgggaaggccttctcctggctgagcgtcttcagcaagcacaagaagatccacactggagtgcccaacccccccacccacaagaagatccatgctggggagaagctgtacaagtag

SEQ ID NO: 176625 - DNA, 1488 bp, Artificial Sequence
  Description of Artificial Sequence: Synthetic coding sequence
atggccgagagcgccccagcccggcacaggaggaagagaagaagcacccccctgaccagcagcaccctgcccagccaggccacagagaagagcagctacttccagaccacagagatcagcctgtggacagtggtggccgccatccaggccgtggagaagaagatggagagccaggccgcccggctgcagagcctggagggccgcactggaacagctgagaagaagctggccgactgtgagaagatggctgtggagtttggaaaccagctggagggcaagtgggccgtgctgggcaccctgctgcaggagtatggcctgctgcagaggcggctggagaatgtggagaacctgctgaggaacagaaacttctggatcctgcggctgcccccaggcagcaaaggagaggcccccaaggtgagccgcagcctggagaatgatggagtgtgcttcacagagcaggagtgggagaacctggaggactggcagaaggagctgtacagaaatgtgatggagagcaactatgagaccctggtgtccctgaaggtgctgggccagacagaaggagaggccgagctgggcacagagatgctgggggacctggaggaggagggccctggaggagcccaccctgctggaggagtgatgatcaagcaggagctgcagtacacccaggagggccctgctgacctgcctggagagttcagctgcatcgccgaggagcaggccttcctgagccctgagcagacagagctgtggggcggccagggcagctctgtgctgctggagactggacctggggacagcaccctggaggagcctgtgggcagccgggtgcccagcagcagcaggacagtgggctgccccaagcagaagagccaccggcaggtgcagctggaccaggagtgtggccagggcctgaagctgaagaaggacaccagccggccctatgaatgttctgaatgtgagatcaccttccgctacaagcagcagctggccacccacctgcggagccacagcggctggggcagctgcaccccagaggagcctgaggagagcctgcggccccggccccggctgaagccccagaccaagaaggccaagctgcaccagtgtgatgtgtgcctgcgctccttcagctgcaaggtgtccctggtgacccaccagcgctgccacctgcaggagggccccagcgctggccagcacgtgcaggagcgcttcagccccaacagcctggtggccctgcccggccacatcccctggaggaagagccgcagcagcctcatctgtggctactgtgggaagagcttcagccaccccagcgacctggtgcgccaccagaggatccacactggagagcggccctacagctgcacagaatgtgagaagagctttgtgcagaagcagcacctgctgcagcaccagaagatccaccagcgggagcggggcggcctggccctggagcccggccggcccaacggcctgctgtag

SEQ ID NO: 176626 - DNA, 1380 bp, Artificial Sequence
  Description of Artificial Sequence: Synthetic coding sequence
atggccgcccccctggaggcccaggaccaggcccctggagagggggagggcctgctgattgtgaaggtggaggacagctcctgggagcaggagagcgcccagcatgaagatggccgggacagcgaggcctgccggcagcgcttccggcagttctgctatggagatgtgcacggcccccatgaggccttcagccagctgtgggagctgtgctgccgctggctgcggcctgagctgcggaccaaggagcagatcctggagctgctggtgctggagcagttcctgactgtgctgcccggggagatccagggctgggtgcgggagcagcaccctggcagcggggaggaggccgtggccctggtggaggacctgcagaagcagcctgtgaaggcctggaggcaggatgtgcccagcgaggaggccgagcctgaggccgccggccggggcagccaggccaccggccccccacccaccgtgggcgcccggcggcggcccagcgtgccccaggagcagcacagccacagcgcccagcccccagccctgctgaaggagggccggcctggagagaccacagacacctgctttgtgtctggagtgcacggccctgtggccctgggggacatccccttctacttcagccgggaggagtggggcaccctggaccctgcccagagggacctcttctgggacatcaagcgggagaacagcaggaacaccaccctgggcttcggcctgaagggccagagcgagaagagcctgctgcaggagatggtgcctgtggtgcccggccagacaggcagtgatgtgacagtgtcctggagccctgaggaggccgaggcctgggagagtgaaaatcggccccgggccgccctgggccctgtggtgggcgcccggcggggccggccccccacccggcggcggcagttccgggacctggccgctgagaagccccacagctgtggccagtgtgggaagcgcttccgctggggcagtgacctggcccggcaccagaggacccacactggagagaagccccacaagtgcccagaatgtgacaagagcttccgcagcagcagtgacctggtgcgccaccagggcgtgcacactggagagaagcccttcagctgcagtgaatgtgggaagagcttcagccgcagcgcctacctggccgaccaccagaggatccacactggagagaagcccttcggctgcagcgactgtgggaagagcttcagcctgcggagctacctgctggaccaccggcgggtgcacactggagagcggcccttcggctgtggagaatgtgacaagagcttcaagcagagggcccacctgattgcccaccagagcctgcacgccaagatggcccagcctgtgggctag

SEQ ID NO: 176627 - DNA, 906 bp, Artificial Sequence
  Description of Artificial Sequence: Synthetic coding sequence
atgtgccccaggagaagaagaaacccccggctgcaggccggggacccccggccccggggcctgccccggcgctggggccatggaggcggccgcctcttccccaggagcagcacagccatcgccggccctgtggccctgggggacatccccttctacttcagccgggaggagtggggcaccctggaccctgcccagagggacctcttctgggacatcaagcgggagaacagcaggaacaccaccctgggcttcggcctgaagggccagagcgagaagagcctgctgcaggagatggtgcctgtggtgcccggccagacaggcagtgatgtgacagtgtcctggagccctgaggaggccgaggcctgggagagtgaaaatcggccccgggccgccctgggccctgtggtgggcgcccggcggggccggccccccacccggcggcggcagttccgggacctggccgctgagaagccccacagctgtggccagtgtgggaagcgcttccgctggggcagtgacctggcccggcaccagaggacccacactggagagaagccccacaagtgcccagaatgtgacaagagcttccgcagcagcagtgacctggtgcgccaccagggcgtgcacactggagagaagcccttcagctgcagtgaatgtgggaagagcttcagccgcagcgcctacctggccgaccaccagaggatccacactggagagaagcccttcggctgcagcgactgtgggaagagcttcagcctgcggagctacctgctggaccaccggcgggtgcacactggagagcggcccttcggctgtggagaatgtgacaagagcttcaagcagagggcccacctgattgcccaccagagcctgcacgccaagatggcccagcctgtgggctag

SEQ ID NO: 176628 - DNA, 1821 bp, Artificial Sequence
  Description of Artificial Sequence: Synthetic coding sequence
atggctgtgacctttgaagatgtgaccatcatcttcacctgggaggagtggaagttcctggacagcagccagaagaggctgtaccgggaggtgatgtgggagaactacaccaacgtgatgtctgtggagaactggaatgaaagctacaagagccaggaggagaagttccgctacctggagtatgagaacttctcctactggcagggctggtggaatgctggggcccagatgtatgagaaccagaactatggagagaccgtgcagggcacagacagcaaggacctgacccagcaggacaggagccagtgccaggagtggctgatcctgagcacccaggtgcccggctacggcaactatgagctgacctttgagagcaagagcctgaggaacctgaagtacaagaacttcatgccctggcagagcctggagaccaagaccacccaggactatggccgggagatctacatgagcggcagccacggcttccagggcggccgctaccgcctgggcatcagcaggaagaacctgtccatggagaaggagcagaagctgattgtgcagcacagctacatccctgtggaggaggccctgccccagtatgtgggcgtcatctgccaggaggacctgctgcgggacagcatggaggagaagtactgcggctgcaacaagtgcaagggcatctactactggaacagccgctgtgtgttccacaagaggaaccagcccggggagaacctgtgccagtgcagcatctgcaaggcctgcttcagccagaggagtgacctgtaccgccaccccaggaaccacatcggcaagaagctgtatggctgtgatgaggtggatggcaacttccaccagagcagcggcgtgcacttccaccagagggtgcacatcggggaggtgccctacagctgcaatgcctgtgggaagagcttcagccagatcagcagcctgcacaaccaccagagggtgcacacagaggagaagttctacaagattgaatgtgacaaggacctgagcaggaacagcctgctgcacatccaccagaggctgcacatcggggagaagcccttcaagtgcaaccagtgtgggaagagcttcaacagaagctctgtgctgcacgtgcaccagagggtgcacactggagagaagccctacaagtgtgatgaatgtgggaagggcttcagccagagcagcaacctgcgcatccaccagctggtgcacactggagagaagagctacaagtgtgaggactgtgggaagggcttcacccagaggagcaacctgcagatccaccagagggtgcacactggagagaagccctacaagtgtgatgactgtgggaaggacttcagccacagcagtgacctgcgcatccaccagagggtgcacactggagagaagccctacacctgcccagaatgtgggaagggcttcagcaagagcagcaagctgcacacccaccagagggtgcacactggagagaagccctacaagtgtgaggagtgtgggaagggcttcagccagaggagccacctgctgatccaccagagggtgcacactggagagaagccctacaagtgccacgactgtgggaagggcttcagccacagcagcaacctgcacatccaccagagggtgcacactggagagaagccctaccagtgtgccaagtgtgggaagggcttcagccacagcagcgccctgcgcatccaccagagggtgcatgctggggagaagccctacaagtgccgggagtactacaagggctttgaccacaacagccacctgcacaacaaccaccggcggggcaacctgtag

SEQ ID NO: 176629 - DNA, 1821 bp, Artificial Sequence; identical to SEQ ID NO: 176628
  Description of Artificial Sequence: Synthetic coding sequence

SEQ ID NO: 176630 - DNA, 1554 bp, Artificial Sequence
  Description of Artificial Sequence: Synthetic coding sequence
atgcagcccctgagcaagctgatggccatcagcaagcccaggaacctgagcctgcgggagcagcgggaggtgctgcgggctgacatgtcctggcagcaggagaccaaccctgtggtggagacccatgacagcgaggccagccggcagaagttccgccacttccagtacctgaaggtgtctggcccccatgaggccctgagccagctgtgggagctgtgcctgcagtggctgcggcctgagatccacaccaagaagcagatcatcgagctgctggtgctggagcagttcctggccatcctgcctgaggaggtgaggacctgggtgaacctgcagcaccccaacaacagcaaggacatggtgaccctgattgaagatgtgattgagatgctggaggatgaggacatgccctgcaaggacagcgccctgcagatgggcagcatcaaggagaagatgaaggccggcagcaggacaggcaagccccaggagcctgtgaccttcaaggatgtggtggtggagttcagcaaggaggagtggggccagctggacagcgctgtgaagaacctgtacagaaatgtgatgctggagaacttcaggaacctgaacagcctgaggaaggcccacctgctgagcaagccctttgagagcctgaagctggagagcaagaagaagcgctggatcatggagaaggagatccccaggaagaccatctttgacatgaagagcatctctggagaggagagcagccatggagtcatcatgacccggctgacagaaagtggccaccccagcagtgatgcctggaagggggagaactggctgtacagaaaccagaagaagtgggacatcaacctgccccaggaggccttcatccctgagaccatctacacagaggaggaggactttgagtgcagcgagaacaagaagagctttgacatcaacagcgtgagcagcatctgtgccatccaggtgggcatccccagcaggaagggcagccccaagtgtgacaagttcaagacctacttcaagttcaacctggacagcgtgggcaagcagcacagtgaatatgaatatggaaatgacctgagcctgagcacagacatccgccaccagaagagccacaccaccatgaacagctatgagtgctaccagtgtgggaaggccttctgccgcagcagcagcctcatccgccaccagatcatccacactggagagaagccctacaagtgcagtgaatgtggccgcttcttcaacagaaggaccaacctgaccaagcaccagaagctgcacgccgaggccaaggcctgcaccagcaacaagtgtgggaaggccttcagcaagtctgaggacagcaacaaccccaccctgcactttggaaacaacttctaccagtgtgtgaactgtgggaagagcttcaacagaagcagcagcctcatccgccaccagatgatccacactggagagaagcccttcaagtgcaaggagtgcagcaaggccttcaacagaagcagcaacctggtgaagcaccagaagctgcacacccgggacaagagctag

SEQ ID NO: 176631 - DNA, 1554 bp, Artificial Sequence; identical to SEQ ID NO: 176630
  Description of Artificial Sequence: Synthetic coding sequence

SEQ ID NO: 176632 - DNA, 915 bp, Artificial Sequence
  Description of Artificial Sequence: Synthetic coding sequence
atgcagcccctgagcaagctgatggccatcagcaagcccaggaacctgagcctgcgggagcagcgggaggtgctgcgggctgacatgtcctggcagcaggagaccaaccctgtggtggagacccatgacagcgaggccagccggcagaagttccgccacttccagtacctgaaggtgtctggcccccatgaggccctgagccagctgtgggagctgtgcctgcagtggctgcggcctgagatccacaccaagaagcagatcatcgagctgctggtgctggagcagttcctggccatcctgcctgaggaggtgaggacctgggtgaacctgcagcaccccaacaacagcaaggacatggtgaccctgattgaagatgtgattgagatgctggaggatgaggacatgccctgcaaggacagcgccctgcagatgggcagcatcaaggagaagatgaaggccggcagcaggacaggcaagccccaggagcctgtgaccttcaaggatgtggtggtggagttcagcaaggaggagtggggccagctggacagcgctgtgaagaacctgtacagaaatgtgatgctggagaacttcaggaacctgaacagcctgaggaaggcccacctgctgagcaagccctttgagagcctgaagctggagagcaagaagaagcgctggatcatggagaaggagatccccaggaagaccatctttgacatgaagagcatctctggagaggagagcagccatggagtcatcatgacccggctgacagaaagtggccaccccagcagtgatgcctggaaggatggagtgtccctgctgctgccccggctggagtacaatgatgctgtgtctgcccactgcaacctgcacctgtgggtgcaggtgatcctgctgccccagcccccagagtag

SEQ ID NO: 176633 - DNA, 3147 bp, Artificial Sequence
  Description of Artificial Sequence: Synthetic coding sequence
atgcagagcaaggtgacaggcaacatgcccacccagagcctgctgatgtacatggatggccctgaggtgattggcagcagcctgggcagccccatggagatggaggatgccctgtccatgaagggcacagctgtggtgcccttccgggccacccaggagaagaatgtcatccagatcgagggctacatgcccctggactgcatgttctgcagccagaccttcacccacagcgaggacctgaacaagcacgtgctgatgcagcaccggcccaccctgtgtgagcctgctgtgctgcgggtggaggccgagtacctgagccccctggacaagagccaggtgaggacagagccccccaaggagaagaactgcaaggaaaatgagttcagctgtgaggtgtgtggccagaccttccgggtggcctttgatgtggagatccacatgaggacccacaaggacagcttcacctacggctgcaacatgtgtggccgccgcttcaaggagccctggttcctgaagaaccacatgaggacccacaacgggaagagcggggcccggagcaagctgcagcagggcctggagagcagccctgccaccatcaatgaggtggtgcaggtgcatgctgctgagagcatcagcagcccctacaagatctgcatggtgtgtggcttcctgttccccaacaaggagagcctcatcgagcacaggaaggtgcacaccaagaagacagccttcggcaccagcagcgcccagacagacagcccccagggcggcatgcccagcagccgggaggacttcctgcagctgttcaacctgcggcccaagagccaccctgagaccgggaagaagcctgtgcgctgcatcccccagctggaccccttcaccaccttccaggcctggcagctggccaccaagggcaaggtggccatctgccaggaggtgaaggagagcggccaggagggcagcacagacaatgatgacagcagcagcgagaaggagctgggggagaccaacaagggcagctgtgccggcctgagccaggagaaggagaagtgcaagcacagccatggagaggcccccagcgtggatgctgaccccaagctgcccagcagcaaggagaagcccacccactgcagtgaatgtgggaaggccttccgcacctaccaccagctggtgctgcacagccgggtgcacaagaaggacagaagagctggagctgagagccccaccatgtctgtggatggccggcagcccggcacctgcagcccagacctggccgcccccctggatgaaaatggagctgtggacagaggagagggcggctctgaagatggctctgaagatggcctgcctgagggcatccacctggacaagaatgatgatggcggcaagatcaagcacctgaccagcagccgggagtgcagctactgtgggaagttcttccgcagcaactactacctgaacatccacctgcggacccacactggagagaagccctacaagtgtgagttctgtgaatatgctgctgcccagaagaccagcctgcgctaccacctggagcggcaccacaaggagaagcagacagatgtggccgctgaggtgaagaatgatggcaagaaccaggacacagaagatgccctgctgacagctgacagcgcccagaccaagaacctgaagcgcttctttgatggagccaaggatgtgacaggcagccccccagccaagcagctgaaggagatgcccagcgtcttccagaatgtgctgggcagcgctgtgctgagccctgcccacaaggacacccaggacttccacaagaatgctgctgatgacagcgctgacaaggtgaacaagaaccccaccccagcctacctggacctgctgaagaagaggtctgctgtggagacccaggccaacaacctgatctgcaggaccaaggcagatgtgaccccacctccagatggcagcaccacccacaacctggaggtgagccccaaggagaagcagacagaaacagctgctgactgccgctaccggcccagcgtggactgccacgagaagcccctgaacctgtctgtgggcgccctgcacaactgcccagccatcagcctgagcaagagcctcatccccagcatcacctgccccttctgcaccttcaagaccttctacccagaggtgctgatgatgcaccagaggctggagcacaagtacaacccagatgtgcacaagaactgcaggaacaagagcctgctgcggagcagaagaacaggctgccccccagccctgctgggcaaggatgtgccccccctgagcagcttctgcaagcccaagcccaagagcgccttccctgcccagagcaagagcctgcccagcgccaagggcaagcagagccccccaggccctgggaaggcccccctgaccagcggcatcgacagcagcaccctggcccccagcaacctgaagagccaccggccccagcagaatgtgggcgtgcagggcgccgccacccggcagcagcagagcgagatgttccccaagacctctgtgtccccagccccagacaagaccaagaggcctgagaccaagctgaagcccctgcctgtggcccccagccagcccaccctgggcagcagcaacatcaatggcagcattgactacccagccaagaatgacagcccctgggcccctcctggccgggactacttctgcaacagaagtgccagcaacacagctgctgagtttggagagcccctgcccaagaggctgaagagctctgtggtggccctggatgtggaccagcccggggccaactacagaagaggctatgacctgcccaagtaccacatggtgcggggcatcaccagcctgctgccccaggactgtgtgtaccccagccaggccctgccccccaagccccgcttcctgagcagcagcgaggtggacagccccaacgtgctgactgtgcagaagccctacggcggcagcggccccctgtacacctgtgtgcctgctggcagccctgccagcagcagcaccctggagggcaagaggcctgtgtcctaccagcacctgagcaacagcatggcccagaagaggaactatgagaacttcatcggaaatgcccactaccggcccaatgacaagaagacctag

SEQ ID NO: 176634 - DNA, 3147 bp, Artificial Sequence; identical to SEQ ID NO: 176633
  Description of Artificial Sequence: Synthetic coding sequence

SEQ ID NO: 176635 - DNA, 666 bp, Artificial Sequence
  Description of Artificial Sequence: Synthetic coding sequence
atgttccccaagacctctgtgtccccagccccagacaagaccaagaggcctgagaccaagctgaagcccctgcctgtggcccccagccagcccaccctgggcagcagcaacatcaatggcagcattgactacccagccaagaatgacagcccctgggcccctcctggccgggactacttctgcaacagaagtgccagcaacacagctgctgagtttggagagcccctgcccaagaggctgaagagctctgtggtggccctggatgtggaccagcccggggccaactacagaagaggctatgacctgcccaagtaccacatggtgcggggcatcaccagcctgctgccccaggactgtgtgtaccccagccaggccctgccccccaagccccgcttcctgagcagcagcgaggtggacagccccaacgtgctgactgtgcagaagccctacggcggcagcggccccctgtacacctgtgtgcctgctggcagccctgccagcagcagcaccctggagggcctgggcggctgccagtgcctgctgcccatgaagctgaacttcaccagcagctttgagaagaggatggtgaaggccacagagatcagctgtgactgcaccgtgcacaagacctatgaggagagcgccaggaacaccaccgtggtgtag

SEQ ID NO: 176636 - DNA, 288 bp, Artificial Sequence
  Description of Artificial Sequence: Synthetic coding sequence
atgcagagcaaggtgacaggcaacatgcccacccagagcctgctgatgtacatggatggccctgaggtgattggcagcagcctgggcagccccatggagatggaggatgccctgtccatgaagggcacagctgtggtgcccttccgggccacccaggagaagaatgtcatccagatcgagggctacatgcccctggactgcatgttctgcagccagaccttcacccacagcgaggacctgaacaagcacgtgctgatgcagcaccggcccaccctgtgtgagccctag

SEQ ID NO: 176637 - DNA, 2169 bp, Artificial Sequence
  Description of Artificial Sequence: Synthetic coding sequence
atggagggcagccggccccgggcccccagcggccacctggcccccagccccccagcctttgatggagagctggacctgcagcgctacagcaatggacctgctgtgtctgctggcagcctgggcatgggcgctgtgtcctggagcgagagccgggccggggagcggcgcttcccctgccctgtgtgtgggaagcgcttccgcttcaacagcatcctggccctgcacctgcgggcccaccctggggcccaggccttccagtgcccccactgcggccaccgggccgcccagagggccctgctgcggagccacctgcggacccaccagcctgagcggcccaggagccctgctgcccggctgctgctggagctggaggagcgggccctgctgcgggaggcccggctgggccgggcccggagcagcggcggcatgcaggccaccccagccacagagggcctggcccggccccaggcccccagcagcagcgccttccgctgcccctactgcaagggcaagttccgcaccagcgctgagcgggagcggcacctgcacatcctgcaccggccctggaagtgtggcctgtgcagctttggcagcagccaggaggaggagctgctgcaccacagcctgacagcccacggggcccctgagcggcccctggccgccaccagcgctgcccccccaccccagccccagccccagcccccaccccagcctgagcccaggtctgtgccccagcctgagcctgagcctgagcctgagcgggaggccacccccaccccagccccagctgcccctgaggagcccccagcccctcctgagttccgctgccaggtgtgtggccagagcttcacccagagctggttcctgaagggccacatgaggaagcacaaggccagctttgaccacgcctgccctgtgtgtggccgctgcttcaaggagccctggttcctgaagaaccacatgaaggtgcacgccagcaagctgggccccctgcgggcccctggccctgccagcggccctgcccgggccccccagcccccagacctgggcctgctggcctatgagcccctgggccctgccctgctgctggccccagcccccaccccagctgagcggcgggagccccccagcctgctgggctacctgagcctgcgggccggggagggccggcccaacggggagggcgctgagcccggccctggccgcagctttggaggcttccggcccctgagcagcgccctgcctgcccgggcccggcggcacagagctgaggagcctgaggaggaggaggaggtggtggaggccgaggaggagacctgggcccggggccgcagcctgggcagcctggccagcctgcaccccaggcctggagagggccctggccacagcgccagcgctgctggggcccaggcccggagcacagccacccaggaggagaatggcctgctggtgggcggcaccaggcctgagggcggccgcggggccaccgggaaggactgccccttctgtgggaagagcttccgcagcgcccaccacctgaaggtgcacctgcgggtgcacactggagagcggccctacaagtgcccccactgtgactatgccggcacccagagcggcagcctgaagtaccacctgcagaggcaccaccgggagcagaggtctggggccggccctggccccccacctgagcccccaccacccagccagaggggcagcgccccccagagcggggccaagcccagcccccagcctgccacctgggtggagggcgccagcagcccccggccccccagcagtggagctggccctggcagcaggaggaagccagccagccctggccgcaccctgagaaatggccggggcggggaggccgagcccctggacctgagcctgcgggccggccctggaggagaggccggccctggaggagccctgcaccgctgcctcttctgcccctttgccactggagcccctgagctgatggccctgcacctgcaggtgcaccacagcagaagagcccggggccggcggcccccccaggctgatgccagccccccctatgcccgggtgcccagcggggagaccccacccagccccagccaggagggggaggagggcagcggcctgagcaggcctggagaggccggcctgggcggccaggagaggtag

SEQ ID NO: 176638 - DNA, 2169 bp, Artificial Sequence; identical to SEQ ID NO: 176637
  Description of Artificial Sequence: Synthetic coding sequence

SEQ ID NO: 176639 - DNA, 2169 bp, Artificial Sequence; identical to SEQ ID NO: 176637
  Description of Artificial Sequence: Synthetic coding sequence

SEQ ID NO: 176640 - DNA, 324 bp, Artificial Sequence
  Description of Artificial Sequence: Synthetic coding sequence
atggagggcagccggccccgggcccccagcggccacctggcccccagccccccagcctttgatggagagctggacctgcagcgctacagcaatggacctgctgtgtctgctggcagcctgggcatgggcgctgtgtcctggagcgagagccgggccggggagcggcgcttcccctgccctgtgtgtgggaagcgcttccgcttcaacagcatcctggccctgcacctgcgggcccaccctggggcccaggccttccagtgcccccactgcggccaccgggccgcccagagggccctgctgcggagccacctgcggacccactag

SEQ ID NO: 176641 - DNA, 636 bp, Artificial Sequence
  Description of Artificial Sequence: Synthetic coding sequence
atggagggcagccggccccgggcccccagcggccacctggcccccagccccccagcctttgatggagagctggacctgcagcgctacagcaatggacctgctgtgtctgctggcagcctgggcatgggcgctgtgtcctggagcgagagccgggccggggagcggcgcttcccctgccctgtgtgtgggaagcgcttccgcttcaacagcatcctggccctgcacctgcgggcccaccctggggcccaggccttccagtgcccccactgcggccaccgggccgcccagagggccctgctgcggagccacctgcggacccaccagcctgagcggcccaggagccctgctgcccggctgctgctggagctggaggagcgggccctgctgcgggaggcccggctgggccgggcccggagcagcggcggcatgcaggccaccccagccacagagggcctggcccggccccaggcccccagcagcagcgccttccgctgcccctactgcaagggcaagttccgcaccagcgctgagcgggagcggcacctgcacatcctgcaccggccctggaagtgtggcctgtgcagctttggcagcagccaggaggaggagctgctgcaccacagcctgacagcctag

SEQ ID NO: 176642 - DNA, 96 bp, Artificial Sequence
  Description of Artificial Sequence: Synthetic coding sequence
atggagggcagccggccccgggcccccagcggccacctggcccccagccccccagcctttgatggagagctggacctgcagcgctacagcaactag

SEQ ID NO: 176643 - DNA, 336 bp, Artificial Sequence
  Description of Artificial Sequence: Synthetic coding sequence
atggagggcagccggccccgggcccccagcggccacctggcccccagccccccagcctttgatggagagctggacctgcagcgctacagcaatggacctgctgtgtctgctggcagcctgggcatgggcgctgtgtcctggagcgagagccgggccggggagcggcgcttcccctgccctgtgtgtgggaagcgcttccgcttcaacagcatcctggccctgcacctgcgggcccaccctggggcccaggccttccagtgcccccactgcggccaccgggccgcccagagggccctgctgcggagccacctgcggacccaccagcctgagaggtag

SEQ ID NO: 176644 - DNA, 675 bp, Artificial Sequence
  Description of Artificial Sequence: Synthetic coding sequence
atgaggctggccaagcccaaggccggcatcagccgcagcagcagccagggcaaggcctatgagaacaagaggaagacaggccggcagaggcagaagtggggcatgaccatccgctttgacagcagcttcagccggctgcggcgcagcctggatgacaagccctacaagtgcacagaatgtgagaagagcttcagccagagcagcaccctcttccagcaccagaagatccacacaggcaagaagagccacaagtgtgccgactgtgggaagagcttcttccagagcagcaacctgatccagcaccggcgcatccacactggagagaagccctacaagtgtgatgaatgtggggagagcttcaagcagagcagcaacctgatccagcaccagaggatccacactggagagaagccctaccagtgtgatgaatgtggccgctgcttcagccagagcagccacctgatccagcaccagaggacccacactggagagaagccctaccagtgcagtgaatgtgggaagtgcttcagccagagcagccacctgcggcagcacatgaaggtgcacaaggaggagaagcccaggaagacccggggcaagaacatccgggtgaagacccacctgcccagctggaaggccggcactggaaggaagtctgtggccggcctgaggtag

SEQ ID NO: 176645 - DNA, 237 bp, Artificial Sequence
  Description of Artificial Sequence: Synthetic coding sequence
atgaccaccttcaaggaggccatgaccttcaaggatgtggccgtggtgttcacagaggaggagctgggcctgctggacctggcccagaggaagctgtacagagatgtgatgctggagaacttcaggaacctgctgtctgtgggccaccaggccttccaccgggacaccttccacttcctgcgggaggagaagatctggatgatgaagacagccatccagcgggagggcaacagctag

SEQ ID NO: 176646 - DNA, 2124 bp, Artificial Sequence
  Description of Artificial Sequence: Synthetic coding sequence
atgaccaccttcaaggaggccatgaccttcaaggatgtggccgtggtgttcacagaggaggagctgggcctgctggacctggcccagaggaagctgtacagagatgtgatgctggagaacttcaggaacctgctgtctgtgggccaccaggccttccaccgggacaccttccacttcctgcgggaggagaagatctggatgatgaagacagccatccagcgggagggcaacagcggggacaagatccagacagagatggagaccgtgtctgaggccggcacccaccaggagtggagcttccagcagatctgggagaagatcgccagtgacctgaccaggagccaggacctgatgatcaacagcagccagttcagcaaggagggggacttcccctgccagacagaggccggcctgagcgtcatccacacccggcagaagagcagccagggcaatggctacaagcccagcttcagtgatgtgagccactttgacttccaccagcagctgcacagcggggagaagagccacacctgtgatgaatgtgggaagaacttctgctacatcagcgccctgcgcatccaccagagggtgcacatgggagagaagtgctacaagtgtgatgtgtgtgggaaggagttcagccagagcagccacctgcagacccaccagagggtgcacactggagagaagcccttcaagtgtgtggagtgtgggaagggcttcagcagaagaagtgccctgaatgtgcaccacaagctgcacactggagagaagccctacaactgtgaggagtgtgggaaggccttcatccatgacagccagctgcaggagcaccagaggatccacactggagagaagcccttcaagtgtgacatctgtgggaagagcttctgtggccgcagccggctgaacagacacagcatggtgcacacagctgagaagcccttccgctgtgacacctgtgacaagagcttccggcagaggtctgccctgaacagccacaggatgatccacactggagagaagccctacaagtgtgaggagtgtgggaagggcttcatctgccggcgggacctgtacacccaccacatggtgcacactggagagaagccctacaactgcaaggaatgtgggaagagcttccgctgggccagctgcctgctgaagcaccagagggtgcacagcggggagaagcccttcaagtgtgaggagtgtgggaagggcttctacaccaacagccagtgctacagccaccagaggagccacagcggggagaagccctacaagtgtgtggagtgtgggaagggctacaagaggcggctggacctggacttccaccagagggtgcacactggagagaagctgtacaactgcaaggaatgtgggaagagcttcagccgggccccctgcctgctgaagcatgagcggctgcacagcggggagaagcccttccagtgtgaggagtgtgggaagcgcttcacccagaacagccacctgcacagccaccagagggtgcacactggagagaagccctacaagtgtgagaagtgtgggaagggctacaacagcaagttcaacctggacatgcaccagaaggtgcacactggagagcggccctacaactgcaaggaatgtgggaagagctttggctgggccagctgcctgctgaagcaccagaggctgcacagcggggagaagcccttcaagtgtgaggagtgtgggaagcgcttcacccagaacagccagctgcacagccaccagagggtgcacactggagagaagccctacaagtgtgatgaatgtgggaagggcttctcctggagcagcacccggctgacccaccagaggaggcacagccgggagacccccctgaagtgtgagcagcacggcaagaacatcgtgcagaacagcttcagcaaggtgcaggagaaggtgcacagcgtggagaagccctacaagtgtgaggactgtgggaagggctacaacagaaggctgaacctggacatgcaccagagggtgcacatgggagagaagacctggaagtgccgggagtgtgacatgtgcttcagccaggccagcagcctgcggctgcaccagaatgtgcacgtgggggagaagccctag

SEQ ID NO: 176647 - DNA, 1932 bp, Artificial Sequence
  Description of Artificial Sequence: Synthetic coding sequence
atgctggagaactatggaaatgtggccagcctgggcttccccctgctgaagccagctgtgatcagccagctggagggcggcagcgagctgggcggcagcagccccctggccgccggcaccggcctgcagggcctgcagacagacatccagacagacaatgacctgaccaaggagatgtatgagggcaaggaaaatgtgtcctttgagctgcagagggacttcagccaggagacagacttcagcgaggccagcctgctggagaagcagcaggaggtgcacagcgctggcaacatcaagaaggagaagagcaacaccattgatggcaccgtgaaggatgagaccagccctgtggaggagtgcttcttcagccagagcagcaacagctaccagtgccacaccatcactggagagcagcccagcggctgcaccggcctgggcaagagcatcagctttgacaccaagctggtgaagcatgagatcatcaacagcgaggagcggcccttcaagtgtgaggagctggtggagcccttccgctgtgacagccagctgatccagcaccaggagaacaacacagaggagaagccctaccagtgcagtgaatgtgggaaggccttcagcatcaatgagaagctgatctggcaccagaggctgcacagcggggagaagcccttcaagtgtgtggagtgtgggaagagcttctcctacagcagccactacatcacccaccagaccatccacagcggggagaagccctaccagtgcaagatgtgtgggaaggccttctctgtgaatggcagcctgagccgccaccagaggatccacactggagagaagccctaccagtgcaaggaatgtggaaatggcttcagctgcagcagcgcctacatcacccaccagagggtgcacactggagagaagccctatgaatgtaatgactgtgggaaggccttcaacgtgaatgccaagctgatccagcaccagaggatccacactggagagaagccctatgaatgtaatgaatgtgggaagggcttccgctgcagcagccagctgcggcagcaccagagcatccacactggagagaagccctaccagtgcaaggaatgtgggaagggcttcaacaacaacaccaagctgatccagcaccagaggatccacactggagagaagccctatgaatgtacagaatgtgggaaggccttctctgtgaagggcaagctgatccagcaccagaggatccacactggagagaagccctatgaatgtaatgaatgtgggaaggccttccgctgcaacagccagttccggcagcacctgcgcatccacactggagagaagccctatgaatgtaatgaatgtgggaaggccttctctgtgaatggcaagctgatgaggcaccagaggatccacactggagagaagccctttgaatgtaatgaatgtggccgctgcttcaccagcaagaggaacctgctggaccaccaccgcatccacactggagagaagccctaccagtgcaaggaatgtgggaaggccttcagcatcaatgccaagctgaccaggcaccagaggatccacactggagagaagcccttcaagtgcatggagtgtgagaaggccttcagctgcagcagcaactacatcgtgcaccagaggatccacactggagagaagcccttccagtgcaaggaatgtgggaaggccttccacgtgaatgcccacctgatccgccaccagaggagccacactggagagaagcccttccgctgtgtggagtgtgggaagggcttctccttcagcagtgactacatcatccaccagacagtgcacacctggaagaagccctacatgtgcagcgtgtgtgggaaggccttccgcttctccttccagctgagccagcaccagagcgtgcacagcgagggcaagagctag

SEQ ID NO: 176648 - DNA, 1248 bp, Artificial Sequence
  Description of Artificial Sequence: Synthetic coding sequence
tgtgggaaggccttcagcatcaatgagaagctgatctggcaccagaggctgcacagcggggagaagcccttcaagtgtgtggagtgtgggaagagcttctcctacagcagccactacatcacccaccagaccatccacagcggggagaagccctaccagtgcaagatgtgtgggaaggccttctctgtgaatggcagcctgagccgccaccagaggatccacactggagagaagccctaccagtgcaaggaatgtggaaatggcttcagctgcagcagcgcctacatcacccaccagagggtgcacactggagagaagccctatgaatgtaatgactgtgggaaggccttcaacgtgaatgccaagctgatccagcaccagaggatccacactggagagaagccctatgaatgtaatgaatgtgggaagggcttccgctgcagcagccagctgcggcagcaccagagcatccacactggagagaagccctaccagtgcaaggaatgtgggaagggcttcaacaacaacaccaagctgatccagcaccagaggatccacactggagagaagccctatgaatgtaatgaatgtgggaaggccttccgctgcaacagccagttccggcagcacctgcgcatccacactggagagaagccctatgaatgtaatgaatgtgggaaggccttctctgtgaatggcaagctgatgaggcaccagaggatccacactggagagaagccctttgaatgtaatgaatgtggccgctgcttcaccagcaagaggaacctgctggaccaccaccgcatccacactggagagaagccctaccagtgcaaggaatgtgggaaggccttcagcatcaatgccaagctgaccaggcaccagaggatccacactggagagaagcccttcaagtgcatggagtgtgagaaggccttcagctgcagcagcaactacatcgtgcaccagaggatccacactggagagaagcccttccagtgcaaggaatgtgggaaggccttccacgtgaatgcccacctgatccgccaccagaggagccacactggagagaagcccttccgctgtgtggagtgtgggaagggcttctccttcagcagtgactacatcatccaccagacagtgcacacctggaagaagccctacatgtgcagcgtgtgtgggaaggccttccgcttctccttccagctgagccagcaccagagcgtgcacagcgagggcaagagctag

SEQ ID NO: 176649 - DNA, 1932 bp, Artificial Sequence; identical to SEQ ID NO: 176647
  Description of Artificial Sequence: Synthetic coding sequence

SEQ ID NO: 176650 - DNA, 1932 bp, Artificial Sequence; identical to SEQ ID NO: 176647
  Description of Artificial Sequence: Synthetic coding sequence

SEQ ID NO: 176651 - DNA, 1758 bp, Artificial Sequence
  Description of Artificial Sequence: Synthetic coding sequence
atgtatgagggcaaggaaaatgtgtcctttgagctgcagagggacttcagccaggagacagacttcagcgaggccagcctgctggagaagcagcaggaggtgcacagcgctggcaacatcaagaaggagaagagcaacaccattgatggcaccgtgaaggatgagaccagccctgtggaggagtgcttcttcagccagagcagcaacagctaccagtgccacaccatcactggagagcagcccagcggctgcaccggcctgggcaagagcatcagctttgacaccaagctggtgaagcatgagatcatcaacagcgaggagcggcccttcaagtgtgaggagctggtggagcccttccgctgtgacagccagctgatccagcaccaggagaacaacacagaggagaagccctaccagtgcagtgaatgtgggaaggccttcagcatcaatgagaagctgatctggcaccagaggctgcacagcggggagaagcccttcaagtgtgtggagtgtgggaagagcttctcctacagcagccactacatcacccaccagaccatccacagcggggagaagccctaccagtgcaagatgtgtgggaaggccttctctgtgaatggcagcctgagccgccaccagaggatccacactggagagaagccctaccagtgcaaggaatgtggaaatggcttcagctgcagcagcgcctacatcacccaccagagggtgcacactggagagaagccctatgaatgtaatgactgtgggaaggccttcaacgtgaatgccaagctgatccagcaccagaggatccacactggagagaagccctatgaatgtaatgaatgtgggaagggcttccgctgcagcagccagctgcggcagcaccagagcatccacactggagagaagccctaccagtgcaaggaatgtgggaagggcttcaacaacaacaccaagctgatccagcaccagaggatccacactggagagaagccctatgaatgtacagaatgtgggaaggccttctctgtgaagggcaagctgatccagcaccagaggatccacactggagagaagccctatgaatgtaatgaatgtgggaaggccttccgctgcaacagccagttccggcagcacctgcgcatccacactggagagaagccctatgaatgtaatgaatgtgggaaggccttctctgtgaatggcaagctgatgaggcaccagaggatccacactggagagaagccctttgaatgtaatgaatgtggccgctgcttcaccagcaagaggaacctgctggaccaccaccgcatccacactggagagaagccctaccagtgcaaggaatgtgggaaggccttcagcatcaatgccaagctgaccaggcaccagaggatccacactggagagaagcccttcaagtgcatggagtgtgagaaggccttcagctgcagcagcaactacatcgtgcaccagaggatccacactggagagaagcccttccagtgcaaggaatgtgggaaggccttccacgtgaatgcccacctgatccgccaccagaggagccacactggagagaagcccttccgctgtgtggagtgtgggaagggcttctccttcagcagtgactacatcatccaccagacagtgcacacctggaagaagccctacatgtgcagcgtgtgtgggaaggccttccgcttctccttccagctgagccagcaccagagcgtgcacagcgagggcaagagctag

SEQ ID NO: 176652 - DNA, 1758 bp, Artificial Sequence; identical to SEQ ID NO: 176651
  Description of Artificial Sequence: Synthetic coding sequence

SEQ ID NO: 176653 - DNA, 5538 bp, Artificial Sequence
  Description of Artificial Sequence: Synthetic coding sequence
atgggcctgtgtggcctgctggagcgctgctggctgcaccacgaccctgatggagtgctgaccctgaatgctgagaacaccaactatgcctaccaggtgcccaacttccacaagtgtgagatctgcctgctgtccttccccaaggagagccagttccagaggcacatgagggaccatgaaagaaatgacaagccccaccgctgtgaccagtgcccccagaccttcaacgtggagttcaacctgaccctgcacaagtgcacccacagcggggaggaccccacctgccctgtgtgcaacaagaagttcagccgggtggccagcctgaaggcccacatcatgctgcacgagaaggaggagaacctgatctgcagtgaatgtggagatgagttcaccctgcagagccagctggccgtgcacatggaggagcaccggcaggagctggccggcacccggcagcacgcctgcaaggcctgcaagaaggagtttgagaccagcagcgagctgaaggagcacatgaagacccactacaagatccgggtgagcagcaccaggagctacaacagaaacatcgacagaagtggcttcacctacagctgcccccactgtgggaagaccttccagaagcccagccagctgaccaggcacatccgcatccacactggagagcggcccttcaagtgcagtgaatgtgggaaggccttcaaccagaagggggccctgcagacccacatgatcaagcacactggagagaagccccacgcctgtgccttctgcccagctgccttcagccagaagggcaacctgcagagccacgtgcagagggtgcacagcgaggtgaagaatggccccacctacaactgcacagaatgttcctgtgtgttcaagagcctgggcagcctgaacacccacatcagcaagatgcacatgggcggcccccagaacagcaccagcagcacagaaacagcccacgtgctgacagccaccctcttccagaccctgcccctgcagcagacagaggcccaggccaccagcgccagcagccagcccagcagccaggccgtgtctgatgtgatccagcagctgctggagctgtctgagcccgcccctgtggagagcggccagagcccccagcccggccagcagctgagcatcaccgtgggcatcaaccaggacatcctgcagcaggccctggagaacagcggcctgagcagcatcccagctgctgcccaccccaatgacagctgccacgccaagaccagcgcccctcatgcccagaacccagatgtgtcctctgtgtccaatgagcagacagaccccacagatgctgagcaggagaaggagcaggagagccctgagaagctggacaagaaggagaagaagatgatcaagaagaagagccccttcctgcccggcagcatccgggaggagaatggagtgcgctggcacgtgtgcccctactgtgccaaggagttcaggaagcccagcgacctggtgcgccacatccgcatccacacccatgagaagcccttcaagtgcccccagtgcttccgggcctttgctgtgaagagcaccctgacagcccacatcaagacccacacaggcatcaaggccttcaagtgccagtactgcatgaagagcttcagcaccagcggcagcctgaaggtgcacatccggctgcacactggagtgcggccctttgcctgcccccactgtgacaagaagttccgcaccagcggccacaggaagacccacatcgccagccacttcaagcacacagagctgaggaagatgaggcaccagaggaagccagccaaggtgcgggtgggcaagaccaacatccctgtgcctgacatccccctgcaggagcccatcctgatcacagacctgggcctcatccagcccatccccaagaaccagttcttccagagctacttcaacaacaactttgtgaatgaagctgaccggccctacaagtgcttctactgccaccgggcctacaagaagagctgccacctgaagcagcacatccgcagccacactggagagaagcccttcaagtgcagccagtgtggccggggctttgtgtctgctggggtgctgaaggcccacatccgcacccacacaggcctgaagagcttcaagtgcctgatctgcaatggagccttcaccaccggcggcagcctgcggcggcacatgggcatccacaatgacctgcggccctacatgtgcccctactgccagaagaccttcaagaccagcctgaactgcaagaagcacatgaagacccacagatatgagctggcccagcagctgcagcagcaccagcaggccgccagcattgatgacagcacagtggaccagcagagcatgcaggccagcacccagatgcaggtggagattgaaagtgatgagctgccccagacagctgaggtggtggccgccaaccctgaggccatgctggacctggagccccagcacgtggtgggcacagaggaggccggcctgggccagcagctggccgaccagcccctggaggctgatgaagatggctttgtggccccccaggaccccctgcggggccacgtggaccagtttgaggagcagagccctgcccagcagagctttgagcccgccggcctgccccagggcttcaccgtgacagacacctaccaccagcagccccagtttcctcctgtgcagcagctgcaggacagcagcaccctggagagccaggccctgagcaccagcttccaccagcagagcctgctgcaggcccccagcagtgatggcatgaatgtgaccaccaggctcatccaggagagcagccaggaggagctggacctgcaggcccagggcagccagttcctggaggacaatgaagaccagagccgccgcagctaccgctgtgactactgcaacaagggcttcaagaagagcagccacctgaagcagcacgtgcgcagccacactggagagaagccctacaagtgcaagctgtgtggccggggctttgtgtcctctggagtgctgaagagccatgagaagacccacactggagtgaaggccttcagctgcagcgtgtgcaatgccagcttcaccaccaacggcagcctgaccaggcacatggccacccacatgtccatgaagccctacaagtgccccttctgtgaggagggcttccgcaccaccgtgcactgcaagaagcacatgaagaggcaccagacagtgcccagcgctgtgtctgccactggagaaacagagggcggggacatctgcatggaggaggaggaggagcacagcgacagaaatgccagcaggaagagcaggcctgaggtgatcaccttcacagaggaggagacagcccagctggccaagatccggccccaggagagcgccaccgtgtctgagaaggtgctggtgcagagcgctgctgagaaggaccgcatcagcgagctgcgggacaagcaggccgagctgcaggatgagcccaagcacgccaactgctgcacctactgccccaagagcttcaagaagcccagcgacctggtgagacatgtgcgcatccacactggagagaagccctacaagtgtgatgaatgtgggaagagcttcaccgtgaagagcaccctggactgccacgtgaagacccacacaggccagaagctgttcagctgccacgtgtgcagcaatgccttcagcaccaagggcagcctgaaggtgcacatgaggctgcacactggagccaagcccttcaagtgcccccactgtgagctgcgcttccgcaccagcggccgcaggaagacccacatgcagttccactacaagccagaccccaagaaggccaggaagcccatgaccaggagcagcagcgagggcctgcagcctgtgaacctgctgaacagcagcagcacagaccccaacgtgttcatcatgaacaacagcgtgctgaccggccagtttgaccagaacctgctgcagcccggcctggtgggccaggccatcctgcctgcctctgtgtctgctggaggagacctgactgtgtccctgacagatggcagcctggccaccctggagggcatccagctgcagctggccgccaacctggtgggccccaacgtgcagatcagcggcattgatgctgccagcatcaacaacatcaccctgcagattgaccccagcatcctgcagcagaccctgcagcagggcaacctgctggcccagcagctgaccggggagcccggcctggccccccagaacagcagcctgcagaccagtgacagcacagtgcctgcctctgtggtgatccagcccatcagcggcctgagcctgcagcccaccgtgaccagcgccaacctgaccatcggccccctgtctgagcaggacagcgtgctgaccaccaacagcagcggcacccaggacctgacccaggtgatgaccagccagggcctggtgagccccagcggcggcccccatgagatcaccctgaccatcaacaacagcagcctgagccaggtgctggcccaggccgccggccccacagccaccagcagcagcggcagcccccaggagatcaccctgaccatcagcgagctgaacaccaccagcggcagcctgcccagcaccacccccatgagccccagcgccatcagcacccagaacctggtgatgagcagcagtggagtgggcggagatgcctctgtgaccctgaccctggccgacacccagggcatgctgagcggcggcctggacacagtgaccctgaacatcaccagccagggccagcagtttcctgccctgctgacagaccccagcctgagcggccagggcggggccggcagcccccaggtgatcctggtgagccacaccccccagagcgccagcgctgcctgtgaggagatcgcctaccaggtggccggcgtgtctggcaacctggcccctggcaaccagcctgagaaggagggccgggcccaccagtgcctggagtgtgaccgggccttcagcagcgctgctgtgctgatgcaccacagcaaggaggtgcacggccgggagcgcatccacggctgccctgtgtgcaggaaggccttcaagagggccacccacctgaaggagcacatgcagacccaccaggccggccccagcctgagcagccagaagcccagggtcttcaagtgtgacacctgtgagaaggcctttgccaagcccagccagctggagcggcacagccgcatccacactggagagcggcccttccactgcaccctgtgtgagaaggccttcaaccagaagagcgccctgcaggtgcacatgaagaagcacactggagagcggccctacaagtgtgcctactgtgtgatgggcttcacccagaagagcaacatgaagctgcacatgaagagggcccacagctatgctggggccctgcaggagagcgctggccaccctgagcaggatggagaggagctgagcaggaccctgcacctggaggaggtggtgcaggaggccgccggggagtggcaggccctgacccacgtgttctag

SEQ ID NO: 176654 - DNA, 4677 bp, Artificial Sequence
  Description of Artificial Sequence: Synthetic coding sequence
atgggcctgtgtggcctgctggagcgctgctggctgcaccacgaccctgatggagtgctgaccctgaatgctgagaacaccaactatgcctaccaggtgcccaacttccacaagtgtgagatctgcctgctgtccttccccaaggagagccagttccagaggcacatgagggaccatgaaagaaatgacaagccccaccgctgtgaccagtgcccccagaccttcaacgtggagttcaacctgaccctgcacaagtgcacccacagcggggaggaccccacctgccctgtgtgcaacaagaagttcagccgggtggccagcctgaaggcccacatcatgctgcacgagaaggaggagaacctgatctgcagtgaatgtggagatgagttcaccctgcagagccagctggccgtgcacatggaggagcaccggcaggagctggccggcacccggcagcacgcctgcaaggcctgcaagaaggagtttgagaccagcagcgagctgaaggagcacatgaagacccactacaagatccgggtgagcagcaccaggagctacaacagaaacatcgacagaagtggcttcacctacagctgcccccactgtgggaagaccttccagaagcccagccagctgaccaggcacatccgcatccacactggagagcggcccttcaagtgcagtgaatgtgggaaggccttcaaccagaagggggccctgcagacccacatgatcaagcacactggagagaagccccacgcctgtgccttctgcccagctgccttcagccagaagggcaacctgcagagccacgtgcagagggtgcacagcgaggtgaagaatggccccacctacaactgcacagaatgttcctgtgtgttcaagagcctgggcagcctgaacacccacatcagcaagatgcacatgggcggcccccagaacagcaccagcagcacagaaacagcccacgtgctgacagccaccctcttccagaccctgcccctgcagcagacagaggcccaggccaccagcgccagcagccagcccagcagccaggccgtgtctgatgtgatccagcagctgctggagctgtctgagcccgcccctgtggagagcggccagagcccccagcccggccagcagctgagcatcaccgtgggcatcaaccaggacatcctgcagcaggccctggagaacagcggcctgagcagcatcccagctgctgcccaccccaatgacagctgccacgccaagaccagcgcccctcatgcccagaacccagatgtgtcctctgtgtccaatgagcagacagaccccacagatgctgagcaggagaaggagcaggagagccctgagaagctggacaagaaggagaagaagatgatcaagaagaagagccccttcctgcccggcagcatccgggaggagaatggagtgcgctggcacgtgtgcccctactgtgccaaggagttcaggaagcccagcgacctggtgcgccacatccgcatccacacccatgagaagcccttcaagtgcccccagtgcttccgggcctttgctgtgaagagcaccctgacagcccacatcaagacccacacaggcatcaaggccttcaagtgccagtactgcatgaagagcttcagcaccagcggcagcctgaaggtgcacatccggctgcacactggagtgcggccctttgcctgcccccactgtgacaagaagttccgcaccagcggccacaggaagacccacatcgccagccacttcaagcacacagagctgaggaagatgaggcaccagaggaagccagccaaggtgcgggtgggcaagaccaacatccctgtgcctgacatccccctgcaggagcccatcctgatcacagacctgggcctcatccagcccatccccaagaaccagttcttccagagctacttcaacaacaactttgtgaatgaagctgaccggccctacaagtgcttctactgccaccgggcctacaagaagagctgccacctgaagcagcacatccgcagccacactggagagaagcccttcaagtgcagccagtgtggccggggctttgtgtctgctggggtgctgaaggcccacatccgcacccacacaggcctgaagagcttcaagtgcctgatctgcaatggagccttcaccaccggcggcagcctgcggcggcacatgggcatccacaatgacctgcggccctacatgtgcccctactgccagaagaccttcaagaccagcctgaactgcaagaagcacatgaagacccacagatatgagctggcccagcagctgcagcagcaccagcaggccgccagcattgatgacagcacagtggaccagcagagcatgcaggccagcacccagatgcaggtggagattgaaagtgatgagctgccccagacagctgaggtggtggccgccaaccctgaggccatgctggacctggagccccagcacgtggtgggcacagaggaggccggcctgggccagcagctggccgaccagcccctggaggctgatgaagatggctttgtggccccccaggaccccctgcggggccacgtggaccagtttgaggagcagagccctgcccagcagagctttgagcccgccggcctgccccagggcttcaccgtgacagacacctaccaccagcagccccagtttcctcctgtgcagcagctgcaggacagcagcaccctggagagccaggccctgagcaccagcttccaccagcagagcctgctgcaggcccccagcagtgatggcatgaatgtgaccaccaggctcatccaggagagcagccaggaggagctggacctgcaggcccagggcagccagttcctggaggacaatgaagaccagagccgccgcagctaccgctgtgactactgcaacaagggcttcaagaagagcagccacctgaagcagcacgtgcgcagccacactggagagaagccctacaagtgcaagctgtgtggccggggctttgtgtcctctggagtgctgaagagccatgagaagacccacactggagtgaaggccttcagctgcagcgtgtgcaatgccagcttcaccaccaacggcagcctgaccaggcacatggccacccacatgtccatgaagccctacaagtgccccttctgtgaggagggcttccgcaccaccgtgcactgcaagaagcacatgaagaggcaccagacagtgcccagcgctgtgtctgccactggagaaacagagggcggggacatctgcatggaggaggaggaggagcacagcgacagaaatgccagcaggaagagcaggcctgaggtgatcaccttcacagaggaggagacagcccagctggccaagatccggccccaggagagcgccaccgtgtctgagaaggtgctggtgcagagcgctgctgagaaggaccgcatcagcgagctgcgggacaagcaggccgagctgcaggatgagcccaagcacgccaactgctgcacctactgccccaagagcttcaagaagcccagcgacctggtgagacatgtgcgcatccacactggagagaagccctacaagtgtgatgaatgtgggaagagcttcaccgtgaagagcaccctggactgccacgtgaagacccacacaggccagaagctgttcagctgccacgtgtgcagcaatgccttcagcaccaagggcagcctgaaggtgcacatgaggctgcacactggagccaagcccttcaagtgcccccactgtgagctgcgcttccgcaccagcggccgcaggaagacccacatgcagttccactacaagccagaccccaagaaggccaggaagcccatgaccaggagcagcagcgagggcctgcagcctgtgaacctgctgaacagcagcagcacagaccccaacgtgttcatcatgaacaacagcgtgctgaccggccagtttgaccagaacctgctgcagcccggcctggtgggccaggccatcctgcctgcctctgtgtctgctggaggagacctgactgtgtccctgacagatggcagcctggccaccctggagggcatccagctgcagctggccgccaacctggtgggccccaacgtgcagatcagcggcattgatgctgccagcatcaacaacatcaccctgcagattgaccccagcatcctgcagcagaccctgcagcagggcaacctgctggcccagcagctgaccggggagcccggcctggccccccagaacagcagcctgcagaccagtgacagcacagtgcctgcctctgtggtgatccagcccatcagcggcctgagcctgcagcccaccgtgaccagcgccaacctgaccatcggccccctgtctgagcaggacagcgtgctgaccaccaacagcagcggcacccaggacctgacccaggtgatgaccagccagggcctggtgagccccagcggcggcccccatgagatcaccctgaccatcaacaacagcagcctgagccaggtgctggcccaggccgccggccccacagccaccagcagcagcggcagcccccaggagatcaccctgaccatcagcggcagccgctctgtgcagcacagcgtgggcccccaggagtgtggctctgtggaggccctgtacctggagaacagcagtgacaagacctag

SEQ ID NO: 176655 - DNA, 4677 bp, Artificial Sequence; identical to SEQ ID NO: 176654
  Description of Artificial Sequence: Synthetic coding sequence

SEQ ID NO: 176656 - DNA, 1596 bp, Artificial Sequence
  Description of Artificial Sequence: Synthetic coding sequence
atgtgccccaagggctatgaagattccatggagttcccagaccacagccgccacctgctgcagtgcctgtctgagcagaggcaccagggcttcctgtgtgactgcaccgtgctggtgggagatgcccagttccgggcccacagagctgtgctggccagctgcagcatgtacttccacctgttctacaaggaccagctggacaagagggacatcgtgcacctgaacagcgacatcgtgacagccccagcctttgccctgctgctggagttcatgtatgagggcaagctgcagttcaaggacctgcccattgaagatgtgctggccgccgccagctacctgcacatgtatgacatcgtgaaggtgtgcaagaagaagctgaaggagaaggccaccacagaggccgacagcaccaagaaggaggaggatgccagcagctgcagcgacaaggtggagagcctgagtgatggcagcagccacatcgccggggacctgcccagtgatgaagatgaaggagaagatgagaagctgaacatcctgcccagcaagagggacctggccgctgagcccggcaacatgtggatgaggctgcccagcgacagcgctggcatcccccaggccggcggggaggccgagccccacgccacagctgctgggaagacagtggccagcccctgcagcagcacagagagcctgagccagaggtctgtgacctctgtgcgggacagcgcagatgtggactgtgtgctggacctgtctgtgaagagcagcctgagcggcgtggagaacctgaacagcagctacttcagcagccaggatgtgctgcggagcaacctggtgcaggtgaaggtggagaaggaggccagctgtgatgaaagtgatgtgggcaccaatgactatgacatggagcacagcacagtgaaggagagcgtgtccaccaacaacagagtgcagtatgagcccgcccacctggcccccctgcgggaggacagcgtgctgcgggagctggaccgggaggacaaggccagtgatgatgagatgatgaccccagagagcgagcgggtgcaggtggagggcggcatggagagcagcctgctgccctacgtgagcaacatcctgagccctgctggccagatcttcatgtgccccctgtgcaacaaggtgttccccagcccccacatcctgcagatccacctgagcacccacttccgggagcaggacggcatccgcagcaagccagctgctgatgtgaatgtgcccacctgcagcctgtgtgggaagaccttcagctgcatgtacaccctgaagagacatgagaggacccacagcggggagaagccctacacctgcacccagtgtgggaagagcttccagtacagccacaacctgagcagacatgctgtggtgcacacccgggagaagccccacgcctgcaagtggtgtgagcggcgcttcacccagagcggggacctgtaccgccacatcaggaagttccactgtgagctggtgaacagcctgtctgtgaagtctgaggccctgagcctgcccaccgtgcgggactggaccctggaggacagcagccaggagctgtggaagtag

SEQ ID NO: 176657 - DNA, 1464 bp, Artificial Sequence
  Description of Artificial Sequence: Synthetic coding sequence
atgtgccccaagggctatgaagattccatggagttcccagaccacagccgccacctgctgcagtgcctgtctgagcagaggcaccagggcttcctgtgtgactgcaccgtgctggtgggagatgcccagttccgggcccacagagctgtgctggccagctgcagcatgtacttccacctgttctacaaggaccagctggacaagagggacatcgtgcacctgaacagcgacatcgtgacagccccagcctttgccctgctgctggagttcatgtatgagggcaagctgcagttcaaggacctgcccattgaagatgtgctggccgccgccagctacctgcacatgtatgacatcgtgaaggtgtgcaagaagaagctgaaggagaaggccaccacagaggccgacagcaccaagaaggaggaggatgccagcagctgcagcgacaaggtggagagcctgagtgatggcagcagccacatcgccggggacctgcccagtgatgaagatgaaggagaagatgagaagctgaacatcctgcccagcaagagggacctggccgctgagcccggcaacatgtggatgaggctgcccagcgacagcgctggcatcccccaggccggcggggaggccgagccccacgccacagctgctgggaagacagtggccagcccctgcagcagcacagagagcctgagccagaggtctgtgacctctgtgcgggacagcgcagatgtggactgtgtgctggacctgtctgtgaagagcagcctgagcggcgtggagaacctgaacagcagctacttcagcagccaggatgtgctgcggagcaacctggtgcaggtgaaggtggagaaggaggccagctgtgatgaaagtgatgtgggcaccaatgactatgacatggagcacagcacagtgaaggagagcgtgtccaccaacaacagagtgcagtatgagcccgcccacctggcccccctgcgggaggacagcgtgctgcgggagctggaccgggaggacaaggccagtgatgatgagatgatgaccccagagagcgagcgggtgcaggtggagggcggcatggagagcagcctgctgccctacgtgagcaacatcctgagccctgctggccagatcttcatgtgccccctgtgcaacaaggtgttccccagcccccacatcctgcagatccacctgagcacccacttccgggagcaggacggcatccgcagcaagccagctgctgatgtgaatgtgcccacctgcagcctgtgtgggaagaccttcagctgcatgtacaccctgaagagacatgagaggacccacagcggggagaagccctacacctgcacccagtgtgggaagagcttccagtacagccacaacctgagccggctgcaggtggtgcgggcccaggtgcatgctgtgcggggccctgtgcagacccacagccaggtgcccctgtag

SEQ ID NO: 176658 - DNA, 1377 bp, Artificial Sequence
  Description of Artificial Sequence: Synthetic coding sequence
atggccagcaccatcaccggcagccaggactgcatcgtgaaccacagaggagaggtggatggagagcctgagctggacatcagcccctgccagcagtggggcgaggccagcagccccatcagcaggaacagagacagcgtgatgaccctgcagagcggctgctttgagaacatcgagagcgagacctacctgcccctgaaggtgagcagccagattgacacccaggacagctctgtgaagttctgcaagaatgagccccaggaccaccaggagagcagaagactctttgtgatggaggagagcacagagaggaaggtgatcaagggggagagctgcagcgagaacctgcaggtgaagctggtgtctgatggccaggagctggccagccccctgctgaatggagaggccacctgccagaatggccagctgaaggagagcctggaccccatcgactgcaactgcaaggacatccacggctggaagagccaggtggtgtcctgcagccagcagagggcccacacagaggagaagccctgtgaccacaacaactgtgggaagatcctgaacaccagcccagatggccacccctatgagaagatccacacagctgagaagcagtatgagtgcagccagtgtgggaagaacttcagccagagcagcgagctgctgctgcaccagagggaccacacagaggagaagccctacaagtgtgagcagtgtgggaagggcttcaccaggagcagcagcctgctgatccaccaggccgtgcacacagatgagaagccctacaagtgtgacaagtgtgggaagggcttcaccaggagcagcagcctgctgatccaccacgctgtgcacactggagagaagccctacaagtgtgacaagtgtgggaagggcttcagccagagcagcaagctgcacatccaccagagggtgcacactggagagaagccctatgaatgtgaagaatgtggcatgtccttcagccagaggagcaacctgcacatccaccagagggtgcacactggagagcggccctacaagtgtggagaatgtgggaagggcttcagccagagcagcaacctgcacatccaccgctgcatccacactggagagaagccctaccagtgctatgaatgtgggaagggcttcagccagagcagtgacctgcgcatccacctgcgggtgcacactggagagaagccctaccactgtgggaaatgtgggaagggcttcagccagagcagcaagctgctgatccaccagagggtgcacactggagagaagccctatgagtgcagcaaatgtgggaagggcttcagccagagcagcaacctgcacatccaccagagggtgcacaagaaggaccccaggtag

SEQ ID NO: 176659 - DNA, 1377 bp, Artificial Sequence; identical to SEQ ID NO: 176658
  Description of Artificial Sequence: Synthetic coding sequence

SEQ ID NO: 176660 - DNA, 1377 bp, Artificial Sequence; identical to SEQ ID NO: 176658
  Description of Artificial Sequence: Synthetic coding sequence

SEQ ID NO: 176661 - DNA, 1377 bp, Artificial Sequence; identical to SEQ ID NO: 176658
  Description of Artificial Sequence: Synthetic coding sequence

SEQ ID NO: 176662 - DNA, 1377 bp, Artificial Sequence; identical to SEQ ID NO: 176658
  Description of Artificial Sequence: Synthetic coding sequence

SEQ ID NO: 176663 - DNA, 1107 bp, Artificial Sequence
  Description of Artificial Sequence: Synthetic coding sequence
atgtctgcccagagcgtggaggaggacagcatcctgatcatccccaccccagatgaggaggagaagatcctgcgggtgaagctggaggaggaccctgatggagaggagggcagcagcatcccctggaaccacctgcctgaccctgagatcttccggcagcgcttccggcagtttggctaccaggacagccctggcccccgggaggccgtgtcccagctgcgggagctgtgccgcctgtggctgcggcctgagacccacaccaaggagcagatcctggagctggtggtgctggagcagtttgtggccatcctgcccaaggagctgcagacctgggtgcgggaccaccacccagaaaatggagaggaggccgtgacagtgctggaggacctggagagcgagctggatgatcctggccagcctgtgtccctgcggcggaggaagcgggaggtgctggtggaggacatggtgtcccaggaggaggcccagggcctgcccagcagcgagctggatgctgtggagaaccagctgaagtgggcctcctgggagctgcacagcctgcggcactgtgatgatgatggccgcacagaaaatggagccctggcccccaagcaggagctgcccagcgccctggagagccatgaggtgcccggcaccctgaacatgggcgtgccccagatcttcaagtatggagagacctgcttccccaagggccgctttgagaggaagaggaaccccagcaggaagaagcagcacatctgtgatgaatgtgggaagcacttcagccagggcagcgccctgatcctgcaccagaggatccacagcggggagaagccctacggctgtgtggagtgtgggaaggccttcagccgcagcagcatcctggtgcagcaccagagggtgcacactggagagaagccctacaagtgcctggagtgtgggaaggccttcagccagaacagcggcctcatcaaccaccagaggatccacactggagagaagccctatgaatgtgtgcagtgtgggaagagctacagccagagcagcaacctcttccgccaccagaggaggcacaatgctgagaagctgctgaatgtggtgaaggtgtag

SEQ ID NO: 176664 - DNA, 1107 bp, Artificial Sequence; identical to SEQ ID NO: 176663
  Description of Artificial Sequence: Synthetic coding sequence
